United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 226

SEQ ID NO: 9357138 - DNA, 22 bp, Homo sapiens
tcagggctgcagaagaggcagg

SEQ ID NO: 9357139 - DNA, 22 bp, Homo sapiens
tcagggctgcagaagaggcagg

SEQ ID NO: 9357140 - DNA, 22 bp, Homo sapiens
tcagggctgcagaagaggcagg

SEQ ID NO: 9357141 - DNA, 22 bp, Homo sapiens
tcagggctcagcatctggcatt

SEQ ID NO: 9357142 - DNA, 22 bp, Homo sapiens
tcagggctcagcatctggcatt

SEQ ID NO: 9357143 - DNA, 22 bp, Homo sapiens
tcagggctccggaagtggcctc

SEQ ID NO: 9357144 - DNA, 22 bp, Homo sapiens
tcagggcatactcttcaaggtc

SEQ ID NO: 9357145 - DNA, 21 bp, Homo sapiens
tcagggcagtgggaggttcct

SEQ ID NO: 9357146 - DNA, 22 bp, Homo sapiens
tcagggcatcatcatgaatata

SEQ ID NO: 9357147 - DNA, 22 bp, Homo sapiens
tcagggcatactcttcaaggtc

SEQ ID NO: 9357148 - DNA, 22 bp, Homo sapiens
tcagggcatactcttcaaggtc

SEQ ID NO: 9357149 - DNA, 22 bp, Homo sapiens
tcagggcatctcttaagtggtg

SEQ ID NO: 9357150 - DNA, 22 bp, Homo sapiens
tcagggcatccattgcctgttg

SEQ ID NO: 9357151 - DNA, 22 bp, Homo sapiens
tcagggcatccattgcctgttg

SEQ ID NO: 9357152 - DNA, 22 bp, Homo sapiens
tcagggcatcatcatgaatata

SEQ ID NO: 9357153 - DNA, 22 bp, Homo sapiens
tcagggcatcatcatgaatata

SEQ ID NO: 9357154 - DNA, 22 bp, Homo sapiens
tcagggcatctcttaagtggtg

SEQ ID NO: 9357155 - DNA, 22 bp, Homo sapiens
tcagggccctggacaaccctcc

SEQ ID NO: 9357156 - DNA, 22 bp, Homo sapiens
tccaaagagcttaggagagaaa

SEQ ID NO: 9357157 - DNA, 22 bp, Homo sapiens
tccaaagagcttaggagagaaa

SEQ ID NO: 9357158 - DNA, 22 bp, Homo sapiens
tccaaagacttgctgtatgtaa

SEQ ID NO: 9357159 - DNA, 22 bp, Homo sapiens
tccaaagccgactgacatctga

SEQ ID NO: 9357160 - DNA, 22 bp, Homo sapiens
tccaaagcatctgagtgtgcat

SEQ ID NO: 9357161 - DNA, 22 bp, Homo sapiens
tccaaagaacctggctactgtc

SEQ ID NO: 9357162 - DNA, 22 bp, Homo sapiens
tccaaacaccctccatgctgca

SEQ ID NO: 9357163 - DNA, 22 bp, Homo sapiens
tccaaatacatttactgtattt

SEQ ID NO: 9357164 - DNA, 22 bp, Homo sapiens
tccaaaggaagaggctgtcagt

SEQ ID NO: 9357165 - DNA, 22 bp, Homo sapiens
tccaaaggacatttctgcttct

SEQ ID NO: 9357166 - DNA, 22 bp, Homo sapiens
tccaaatatacagaatctcctc

SEQ ID NO: 9357167 - DNA, 22 bp, Homo sapiens
tccaaatagttctggaagactg

SEQ ID NO: 9357168 - DNA, 22 bp, Homo sapiens
tccaaatatagatgagttgtaa

SEQ ID NO: 9357169 - DNA, 22 bp, Homo sapiens
tccaaatatagatgagttgtaa

SEQ ID NO: 9357170 - DNA, 22 bp, Homo sapiens
tccaaatataggatgtgatata

SEQ ID NO: 9357171 - DNA, 22 bp, Homo sapiens
tccaaatataggatgtgatata

SEQ ID NO: 9357172 - DNA, 23 bp, Homo sapiens
tccaaatacctgtcaccttgtct

SEQ ID NO: 9357173 - DNA, 23 bp, Homo sapiens
tccaaatacctgtcaccttgtct

SEQ ID NO: 9357174 - DNA, 22 bp, Homo sapiens
tccaaatagctggatgatggtg

SEQ ID NO: 9357175 - DNA, 22 bp, Homo sapiens
tccaaataccagatgggctaat

SEQ ID NO: 9357176 - DNA, 22 bp, Homo sapiens
tcatttttttccggtaggaata

SEQ ID NO: 9357177 - DNA, 22 bp, Homo sapiens
tcatttttctcttacacgtaga

SEQ ID NO: 9357178 - DNA, 22 bp, Homo sapiens
tcatttttgtctccggtttgtg

SEQ ID NO: 9357179 - DNA, 22 bp, Homo sapiens
tcatttttgaccatgggtagga

SEQ ID NO: 9357180 - DNA, 22 bp, Homo sapiens
tcatttgttcatctgctcttct

SEQ ID NO: 9357181 - DNA, 22 bp, Homo sapiens
tcatttttagcgcgcaaaagtt

SEQ ID NO: 9357182 - DNA, 22 bp, Homo sapiens
tcatttttagcgcgcaaaagtt

SEQ ID NO: 9357183 - DNA, 21 bp, Homo sapiens
tccaacatgcctgatggtgcc

SEQ ID NO: 9357184 - DNA, 22 bp, Homo sapiens
tccaaattgacagtagtgatta

SEQ ID NO: 9357185 - DNA, 22 bp, Homo sapiens
tccaagaagctcagcaaacatc

SEQ ID NO: 9357186 - DNA, 22 bp, Homo sapiens
tccaagaagagcctttctcctc

SEQ ID NO: 9357187 - DNA, 22 bp, Homo sapiens
tccaaatattcggtctttctga

SEQ ID NO: 9357188 - DNA, 22 bp, Homo sapiens
tccaaatattcatctacttctg

SEQ ID NO: 9357189 - DNA, 22 bp, Homo sapiens
tccaaatattatgattatagga

SEQ ID NO: 9357190 - DNA, 22 bp, Homo sapiens
tccaaatattatgattatagga

SEQ ID NO: 9357191 - DNA, 22 bp, Homo sapiens
tccaaatatcttggtggttagg

SEQ ID NO: 9357192 - DNA, 22 bp, Homo sapiens
tccaaatatattcacgtcctag

SEQ ID NO: 9357193 - DNA, 21 bp, Homo sapiens
tccaagctcaactcccttcct

SEQ ID NO: 9357194 - DNA, 22 bp, Homo sapiens
tccaagaagcttacaatctaat

SEQ ID NO: 9357195 - DNA, 22 bp, Homo sapiens
tccaaggaagtttgcactattg

SEQ ID NO: 9357196 - DNA, 22 bp, Homo sapiens
tccaagctttccatgccctcac

SEQ ID NO: 9357197 - DNA, 22 bp, Homo sapiens
tccaaggagtcttaagttacat

SEQ ID NO: 9357198 - DNA, 22 bp, Homo sapiens
tccaagggaatgtgggcaatgc

SEQ ID NO: 9357199 - DNA, 22 bp, Homo sapiens
tccaagggcagcagccatagcc

SEQ ID NO: 9357200 - DNA, 22 bp, Homo sapiens
tccaagggctttggcgtgaagt

SEQ ID NO: 9357201 - DNA, 23 bp, Homo sapiens
tccaattcaattgggtcaggaag

SEQ ID NO: 9357202 - DNA, 20 bp, Homo sapiens
tccaattaaaaattgtatgc

SEQ ID NO: 9357203 - DNA, 22 bp, Homo sapiens
tccaataaccacaatcagatag

SEQ ID NO: 9357204 - DNA, 22 bp, Homo sapiens
tccaataacatctaaaaactta

SEQ ID NO: 9357205 - DNA, 22 bp, Homo sapiens
tccaataaagagaggaatgtct

SEQ ID NO: 9357206 - DNA, 20 bp, Homo sapiens
tccaagttataaagtgccaa

SEQ ID NO: 9357207 - DNA, 22 bp, Homo sapiens
tccaataaaactcttgaattaa

SEQ ID NO: 9357208 - DNA, 23 bp, Homo sapiens
tcatttcaggttgcatggtacca

SEQ ID NO: 9357209 - DNA, 22 bp, Homo sapiens
tcatttcacttctctagggaga

SEQ ID NO: 9357210 - DNA, 22 bp, Homo sapiens
tcatttcagatgcatttagaat

SEQ ID NO: 9357211 - DNA, 22 bp, Homo sapiens
tcatttatattgtattctgtag

SEQ ID NO: 9357212 - DNA, 22 bp, Homo sapiens
tcatttatattgtattctgtag

SEQ ID NO: 9357213 - DNA, 22 bp, Homo sapiens
tcatttatattgtattctgtag

SEQ ID NO: 9357214 - DNA, 22 bp, Homo sapiens
tcatttatcatttgtgctgtag

SEQ ID NO: 9357215 - DNA, 22 bp, Homo sapiens
tcatttcacttctctagggaga

SEQ ID NO: 9357216 - DNA, 22 bp, Homo sapiens
tcatttctatctatgcagcttc

SEQ ID NO: 9357217 - DNA, 17 bp, Homo sapiens
tcatttctaggcactcc

SEQ ID NO: 9357218 - DNA, 22 bp, Homo sapiens
tcatttcctcaaattcaaggtt

SEQ ID NO: 9357219 - DNA, 22 bp, Homo sapiens
tcatttcagtcctctgtgtgag

SEQ ID NO: 9357220 - DNA, 23 bp, Homo sapiens
tcatttcatccagccttgagagt

SEQ ID NO: 9357221 - DNA, 22 bp, Homo sapiens
tcatttggagccttcctgtttt

SEQ ID NO: 9357222 - DNA, 20 bp, Homo sapiens
tcatttcttggggttccaag

SEQ ID NO: 9357223 - DNA, 22 bp, Homo sapiens
tcatttcttaactagagtgaac

SEQ ID NO: 9357224 - DNA, 22 bp, Homo sapiens
tcatttcttaactagagtgaac

SEQ ID NO: 9357225 - DNA, 22 bp, Homo sapiens
tcatttctgttgtgcatcactg

SEQ ID NO: 9357226 - DNA, 22 bp, Homo sapiens
tcatttctgagccttccatgat

SEQ ID NO: 9357227 - DNA, 22 bp, Homo sapiens
tcatttctctgagtctgataat

SEQ ID NO: 9357228 - DNA, 22 bp, Homo sapiens
tcatttctctgagtctgataat

SEQ ID NO: 9357229 - DNA, 22 bp, Homo sapiens
tcatttctctgagtctgataat

SEQ ID NO: 9357230 - DNA, 22 bp, Homo sapiens
tcatttctctgagtctgataat

SEQ ID NO: 9357231 - DNA, 22 bp, Homo sapiens
tcatttctcctaagtgaaatat

SEQ ID NO: 9357232 - DNA, 22 bp, Homo sapiens
tcatttctcctaagtgaaatat

SEQ ID NO: 9357233 - DNA, 22 bp, Homo sapiens
tcatttctcctaagtgaaatat

SEQ ID NO: 9357234 - DNA, 22 bp, Homo sapiens
tcatttctcctaagtgaaatat

SEQ ID NO: 9357235 - DNA, 21 bp, Homo sapiens
tcatttctctatgtatttcac

SEQ ID NO: 9357236 - DNA, 21 bp, Homo sapiens
tcatttctctatgtatttcac

SEQ ID NO: 9357237 - DNA, 22 bp, Homo sapiens
tcatttctcccggccaaaaact

SEQ ID NO: 9357238 - DNA, 22 bp, Homo sapiens
tcatttctcccggccaaaaact

SEQ ID NO: 9357239 - DNA, 22 bp, Homo sapiens
tcatttctattgctactgtctg

SEQ ID NO: 9357240 - DNA, 22 bp, Homo sapiens
tcatttctccgacctgctgtcc

SEQ ID NO: 9357241 - DNA, 22 bp, Homo sapiens
tcatttctcccggccaaaaact

SEQ ID NO: 9357242 - DNA, 22 bp, Homo sapiens
tcatttctccgacctgctgtcc

SEQ ID NO: 9357243 - DNA, 22 bp, Homo sapiens
tcatgcatctgggctggctggt

SEQ ID NO: 9357244 - DNA, 22 bp, Homo sapiens
tcatgcatcaatttctctttag

SEQ ID NO: 9357245 - DNA, 22 bp, Homo sapiens
tcatgcataatggtgacaacct

SEQ ID NO: 9357246 - DNA, 23 bp, Homo sapiens
tcattgtgactgtgccacataac

SEQ ID NO: 9357247 - DNA, 22 bp, Homo sapiens
tcattgttaactcccagattca

SEQ ID NO: 9357248 - DNA, 22 bp, Homo sapiens
tcattgtattcagaactgaaga

SEQ ID NO: 9357249 - DNA, 22 bp, Homo sapiens
tcattgttaattgtatgatctg

SEQ ID NO: 9357250 - DNA, 22 bp, Homo sapiens
tcattgttactgtttagttgcc

SEQ ID NO: 9357251 - DNA, 22 bp, Homo sapiens
tcattgttactgtttagttgcc

SEQ ID NO: 9357252 - DNA, 22 bp, Homo sapiens
tcattgttaattcctgccggcc

SEQ ID NO: 9357253 - DNA, 22 bp, Homo sapiens
tcattgttcctatttggcaaga

SEQ ID NO: 9357254 - DNA, 22 bp, Homo sapiens
tcattgttatgttttgctgtct

SEQ ID NO: 9357255 - DNA, 22 bp, Homo sapiens
tcattgttatgttttgctgtct

SEQ ID NO: 9357256 - DNA, 22 bp, Homo sapiens
tcattgctctaggttccttgga

SEQ ID NO: 9357257 - DNA, 22 bp, Homo sapiens
tcattggttgtcacacagggag

SEQ ID NO: 9357258 - DNA, 22 bp, Homo sapiens
tcattggtaattatttttgaca

SEQ ID NO: 9357259 - DNA, 21 bp, Homo sapiens
tcattggtaagttttgtttgc

SEQ ID NO: 9357260 - DNA, 22 bp, Homo sapiens
tcatttacaggtgaagcaacta

SEQ ID NO: 9357261 - DNA, 22 bp, Homo sapiens
tcattgtttctgcttttcatga

SEQ ID NO: 9357262 - DNA, 22 bp, Homo sapiens
tcattgttttgattccttcatg

SEQ ID NO: 9357263 - DNA, 19 bp, Homo sapiens
tcattgttggtttgtcggg

SEQ ID NO: 9357264 - DNA, 22 bp, Homo sapiens
tcattgttgcgttaatgtcttc

SEQ ID NO: 9357265 - DNA, 19 bp, Homo sapiens
tcattgttggtttgtcggg

SEQ ID NO: 9357266 - DNA, 22 bp, Homo sapiens
tcattgttgacataccaagagc

SEQ ID NO: 9357267 - DNA, 21 bp, Homo sapiens
tcattgttgcatggtaggggg

SEQ ID NO: 9357268 - DNA, 22 bp, Homo sapiens
tcatttatagctaaccttgaat

SEQ ID NO: 9357269 - DNA, 22 bp, Homo sapiens
tcatttatagctaaccttgaat

SEQ ID NO: 9357270 - DNA, 22 bp, Homo sapiens
tcatttatagctaaccttgaat

SEQ ID NO: 9357271 - DNA, 22 bp, Homo sapiens
tcatttatagctaaccttgaat

SEQ ID NO: 9357272 - DNA, 22 bp, Homo sapiens
tcatttataaggatgcaattaa

SEQ ID NO: 9357273 - DNA, 22 bp, Homo sapiens
tcatttataaggatgcaattaa

SEQ ID NO: 9357274 - DNA, 22 bp, Homo sapiens
tcatttataaggatgcaattaa

SEQ ID NO: 9357275 - DNA, 22 bp, Homo sapiens
tcatttatagaagtgggcagta

SEQ ID NO: 9357276 - DNA, 22 bp, Homo sapiens
tcatttatagaagtgggcagta

SEQ ID NO: 9357277 - DNA, 22 bp, Homo sapiens
tcatttataaggatgcaattaa

SEQ ID NO: 9357278 - DNA, 22 bp, Homo sapiens
tcatttataaggatgcaattaa

SEQ ID NO: 9357279 - DNA, 22 bp, Homo sapiens
tcatttataaggatgcaattaa

SEQ ID NO: 9357280 - DNA, 22 bp, Homo sapiens
tcatttacttggttttaatctt

SEQ ID NO: 9357281 - DNA, 22 bp, Homo sapiens
tcatttactgtaggcaaaaatt

SEQ ID NO: 9357282 - DNA, 22 bp, Homo sapiens
tcatttacttctatgacaacat

SEQ ID NO: 9357283 - DNA, 22 bp, Homo sapiens
tcatttactgtaggagtgaacc

SEQ ID NO: 9357284 - DNA, 22 bp, Homo sapiens
tcatttacgcgcctccttcctt

SEQ ID NO: 9357285 - DNA, 22 bp, Homo sapiens
tcatttacatgtctttctctga

SEQ ID NO: 9357286 - DNA, 22 bp, Homo sapiens
tccaggtctaatttgtccttga

SEQ ID NO: 9357287 - DNA, 21 bp, Homo sapiens
tccagggctttgattctctca

SEQ ID NO: 9357288 - DNA, 21 bp, Homo sapiens
tccagggctttgattctctca

SEQ ID NO: 9357289 - DNA, 19 bp, Homo sapiens
tccagggctttatggcttt

SEQ ID NO: 9357290 - DNA, 19 bp, Homo sapiens
tccagggctttatggcttt

SEQ ID NO: 9357291 - DNA, 18 bp, Homo sapiens
tccagggcttcctcctct

SEQ ID NO: 9357292 - DNA, 22 bp, Homo sapiens
tccagggcttgacagggtgcct

SEQ ID NO: 9357293 - DNA, 22 bp, Homo sapiens
tccagggcttgacagggtgcct

SEQ ID NO: 9357294 - DNA, 22 bp, Homo sapiens
tccagggcttgacagggtgcct

SEQ ID NO: 9357295 - DNA, 22 bp, Homo sapiens
tccagggcttggctgggacggt

SEQ ID NO: 9357296 - DNA, 22 bp, Homo sapiens
tccaggtcttcctattccaggt

SEQ ID NO: 9357297 - DNA, 22 bp, Homo sapiens
tccaggtgagtgcaggtgcaga

SEQ ID NO: 9357298 - DNA, 22 bp, Homo sapiens
tccaggtgagtgcaggtgcaga

SEQ ID NO: 9357299 - DNA, 22 bp, Homo sapiens
tccaggtgacagagacaggata

SEQ ID NO: 9357300 - DNA, 22 bp, Homo sapiens
tccaggtgagtgcaggtgcaga

SEQ ID NO: 9357301 - DNA, 22 bp, Homo sapiens
tccaggtgccggggactgaggc

SEQ ID NO: 9357302 - DNA, 19 bp, Homo sapiens
tccaggtggagagacaccc

SEQ ID NO: 9357303 - DNA, 22 bp, Homo sapiens
tccaggtgccggggactgaggc

SEQ ID NO: 9357304 - DNA, 22 bp, Homo sapiens
tccaggtgggctgcacccaggc

SEQ ID NO: 9357305 - DNA, 19 bp, Homo sapiens
tccaggtggagagacaccc

SEQ ID NO: 9357306 - DNA, 22 bp, Homo sapiens
tccaggtgtatttactgaagta

SEQ ID NO: 9357307 - DNA, 22 bp, Homo sapiens
tccaggttttctgaaggcagga

SEQ ID NO: 9357308 - DNA, 22 bp, Homo sapiens
tccaggtttcgctacaggagag

SEQ ID NO: 9357309 - DNA, 22 bp, Homo sapiens
tccatggagatggatgactgta

SEQ ID NO: 9357310 - DNA, 18 bp, Homo sapiens
tccagggcttcctcctct

SEQ ID NO: 9357311 - DNA, 22 bp, Homo sapiens
tccagggctgggttggctcagc

SEQ ID NO: 9357312 - DNA, 22 bp, Homo sapiens
tccagggctgggttggctcagc

SEQ ID NO: 9357313 - DNA, 22 bp, Homo sapiens
tccagggctgggttggctcagc

SEQ ID NO: 9357314 - DNA, 22 bp, Homo sapiens
tccagggctgggttggctcagc

SEQ ID NO: 9357315 - DNA, 22 bp, Homo sapiens
tccagggctgggttggctcagc

SEQ ID NO: 9357316 - DNA, 22 bp, Homo sapiens
tccagggctgggttggctcagc

SEQ ID NO: 9357317 - DNA, 22 bp, Homo sapiens
tccagggctgacttgggagagg

SEQ ID NO: 9357318 - DNA, 22 bp, Homo sapiens
tccagggctgacttgggagagg

SEQ ID NO: 9357319 - DNA, 22 bp, Homo sapiens
tccagggctgacttgggagagg

SEQ ID NO: 9357320 - DNA, 22 bp, Homo sapiens
tccagggacagcgctggagcta

SEQ ID NO: 9357321 - DNA, 22 bp, Homo sapiens
tccagggctccccaacatccag

SEQ ID NO: 9357322 - DNA, 22 bp, Homo sapiens
tccagggacacagagtccttct

SEQ ID NO: 9357323 - DNA, 22 bp, Homo sapiens
tccagggaaggtgtgaggctgg

SEQ ID NO: 9357324 - DNA, 22 bp, Homo sapiens
tccagggaaggtgtgaggctgg

SEQ ID NO: 9357325 - DNA, 22 bp, Homo sapiens
tccagggaaggtgtgaggctgg

SEQ ID NO: 9357326 - DNA, 22 bp, Homo sapiens
tccagggaagagcagaggctac

SEQ ID NO: 9357327 - DNA, 22 bp, Homo sapiens
tccagggaaggtgtgaggctgg

SEQ ID NO: 9357328 - DNA, 23 bp, Homo sapiens
tccaggctgggacttcaactggc

SEQ ID NO: 9357329 - DNA, 22 bp, Homo sapiens
tccaggctgggctgaagggtgc

SEQ ID NO: 9357330 - DNA, 21 bp, Homo sapiens
tccagggaacttctcaggaat

SEQ ID NO: 9357331 - DNA, 22 bp, Homo sapiens
tccagggaagagcagaggctac

SEQ ID NO: 9357332 - DNA, 22 bp, Homo sapiens
tccaggctagaagtcacaggcc

SEQ ID NO: 9357333 - DNA, 22 bp, Homo sapiens
tccaggctagagtgcagtggcc

SEQ ID NO: 9357334 - DNA, 22 bp, Homo sapiens
tccaggctagaagtcacaggcc

SEQ ID NO: 9357335 - DNA, 22 bp, Homo sapiens
tccaggctagaagtcacaggcc

SEQ ID NO: 9357336 - DNA, 22 bp, Homo sapiens
tccaggctagcctggtagagaa

SEQ ID NO: 9357337 - DNA, 22 bp, Homo sapiens
tccaggctggacatgaggcggg

SEQ ID NO: 9357338 - DNA, 22 bp, Homo sapiens
tccaggctggagtgcagtggca

SEQ ID NO: 9357339 - DNA, 22 bp, Homo sapiens
tccaggctggagtgcagtggcg

SEQ ID NO: 9357340 - DNA, 18 bp, Homo sapiens
tccaggctggattgatga

SEQ ID NO: 9357341 - DNA, 22 bp, Homo sapiens
tccaggctggcctcgcgtgaca

SEQ ID NO: 9357342 - DNA, 22 bp, Homo sapiens
tccaggctggcctcgcgtgaca

SEQ ID NO: 9357343 - DNA, 22 bp, Homo sapiens
tccaggctggctcttcaaaatt

SEQ ID NO: 9357344 - DNA, 22 bp, Homo sapiens
tccaggctggctcttcaaaatt

SEQ ID NO: 9357345 - DNA, 22 bp, Homo sapiens
tccaggcctgcaatgacaaagc

SEQ ID NO: 9357346 - DNA, 22 bp, Homo sapiens
tccaggcctgcctggtgtttgc

SEQ ID NO: 9357347 - DNA, 22 bp, Homo sapiens
tccaggcctgactataaatgta

SEQ ID NO: 9357348 - DNA, 22 bp, Homo sapiens
tccaggcctgactataaatgta

SEQ ID NO: 9357349 - DNA, 22 bp, Homo sapiens
tccaggcctgcaatgacaaagc

SEQ ID NO: 9357350 - DNA, 22 bp, Homo sapiens
tccaggcctgcaatgacaaagc

SEQ ID NO: 9357351 - DNA, 18 bp, Homo sapiens
tccaggcctgaagtgtcc

SEQ ID NO: 9357352 - DNA, 18 bp, Homo sapiens
tccaggcctgaagtgtcc

SEQ ID NO: 9357353 - DNA, 22 bp, Homo sapiens
tccaggcctctagccctctctt

SEQ ID NO: 9357354 - DNA, 22 bp, Homo sapiens
tccaggcctctagccctctctt

SEQ ID NO: 9357355 - DNA, 22 bp, Homo sapiens
tccaggcctctagcccctatct

SEQ ID NO: 9357356 - DNA, 22 bp, Homo sapiens
tccaggcctctagcccctatct

SEQ ID NO: 9357357 - DNA, 22 bp, Homo sapiens
tccaggccttgacaggtcagtt

SEQ ID NO: 9357358 - DNA, 22 bp, Homo sapiens
tccaggccttgacaggtcagtt

SEQ ID NO: 9357359 - DNA, 22 bp, Homo sapiens
tccaggcctggctccattcagt

SEQ ID NO: 9357360 - DNA, 22 bp, Homo sapiens
tccaggccttgacaggtcagtt

SEQ ID NO: 9357361 - DNA, 22 bp, Homo sapiens
tccaggcctggctccattcagt

SEQ ID NO: 9357362 - DNA, 22 bp, Homo sapiens
tccaggcctgcctggtgtttgc

SEQ ID NO: 9357363 - DNA, 22 bp, Homo sapiens
tccaggctaattttgcattgtt

SEQ ID NO: 9357364 - DNA, 22 bp, Homo sapiens
tccaggcctttgcacatgttgt

SEQ ID NO: 9357365 - DNA, 22 bp, Homo sapiens
tccaggcctttgcacatgttgt

SEQ ID NO: 9357366 - DNA, 22 bp, Homo sapiens
tccaggcctttgcacatgttgt

SEQ ID NO: 9357367 - DNA, 20 bp, Homo sapiens
tccaggccttgttctcagat

SEQ ID NO: 9357368 - DNA, 20 bp, Homo sapiens
tccaggccttgttctcagat

SEQ ID NO: 9357369 - DNA, 22 bp, Homo sapiens
tccaggctaattttgcattgtt

SEQ ID NO: 9357370 - DNA, 22 bp, Homo sapiens
tccaggctacttggattcctgg

SEQ ID NO: 9357371 - DNA, 22 bp, Homo sapiens
tccatgggaagattttgagtgg

SEQ ID NO: 9357372 - DNA, 22 bp, Homo sapiens
tccatggagatggatgactgta

SEQ ID NO: 9357373 - DNA, 22 bp, Homo sapiens
tccatggagatggatgactgta

SEQ ID NO: 9357374 - DNA, 22 bp, Homo sapiens
tccatggagtttttatttggta

SEQ ID NO: 9357375 - DNA, 22 bp, Homo sapiens
tccatgggtagccctggttgag

SEQ ID NO: 9357376 - DNA, 22 bp, Homo sapiens
tccatgtgacggtggcagtttt

SEQ ID NO: 9357377 - DNA, 22 bp, Homo sapiens
tccattatacttctgattcaaa

SEQ ID NO: 9357378 - DNA, 22 bp, Homo sapiens
tccatgtgttttcctgtccaca

SEQ ID NO: 9357379 - DNA, 22 bp, Homo sapiens
tccattcttttgctgtcttcct

SEQ ID NO: 9357380 - DNA, 22 bp, Homo sapiens
tccattcttttgctgtcttcct

SEQ ID NO: 9357381 - DNA, 22 bp, Homo sapiens
tccattctttttacctctcaga

SEQ ID NO: 9357382 - DNA, 22 bp, Homo sapiens
tccattctttttacctctcaga

SEQ ID NO: 9357383 - DNA, 22 bp, Homo sapiens
tccattcagaaatctggctaca

SEQ ID NO: 9357384 - DNA, 22 bp, Homo sapiens
tccattcaggccagtgcaaagt

SEQ ID NO: 9357385 - DNA, 22 bp, Homo sapiens
tccattatacttctgattcaaa

SEQ ID NO: 9357386 - DNA, 22 bp, Homo sapiens
tccattcagaaatctggctaca

SEQ ID NO: 9357387 - DNA, 22 bp, Homo sapiens
tcccaaagctactcttctgact

SEQ ID NO: 9357388 - DNA, 18 bp, Homo sapiens
tccattgttctactgtga

SEQ ID NO: 9357389 - DNA, 22 bp, Homo sapiens
tccattctttttacctctcaga

SEQ ID NO: 9357390 - DNA, 22 bp, Homo sapiens
tcccaaagtattagcatttcaa

SEQ ID NO: 9357391 - DNA, 22 bp, Homo sapiens
tcccaaagtcaagctgtgtctt

SEQ ID NO: 9357392 - DNA, 22 bp, Homo sapiens
tcccaaatataatgcaagagac

SEQ ID NO: 9357393 - DNA, 21 bp, Homo sapiens
tcccaagaatatgcataagtt

SEQ ID NO: 9357394 - DNA, 22 bp, Homo sapiens
tcccaagagctactcaatggaa

SEQ ID NO: 9357395 - DNA, 22 bp, Homo sapiens
tcccaagagacagaatggtatc

SEQ ID NO: 9357396 - DNA, 22 bp, Homo sapiens
tcccagagaagagctggatgga

SEQ ID NO: 9357397 - DNA, 22 bp, Homo sapiens
tcccagagaagagctggatgga

SEQ ID NO: 9357398 - DNA, 22 bp, Homo sapiens
tcccaagagctctgggataagg

SEQ ID NO: 9357399 - DNA, 22 bp, Homo sapiens
tcccaagaggggttattatgcc

SEQ ID NO: 9357400 - DNA, 22 bp, Homo sapiens
tcccaagatacgctgtaagaag

SEQ ID NO: 9357401 - DNA, 22 bp, Homo sapiens
tcccaagattattgagggaggg

SEQ ID NO: 9357402 - DNA, 22 bp, Homo sapiens
tcccaagattattgagggaggg

SEQ ID NO: 9357403 - DNA, 22 bp, Homo sapiens
tcccagagcagtactccaggag

SEQ ID NO: 9357404 - DNA, 22 bp, Homo sapiens
tcccagagcagtactccaggag

SEQ ID NO: 9357405 - DNA, 22 bp, Homo sapiens
tcccagagatttcctctccttc

SEQ ID NO: 9357406 - DNA, 22 bp, Homo sapiens
tcccagcattaatgcctgtcag

SEQ ID NO: 9357407 - DNA, 22 bp, Homo sapiens
tcccagcattaatgcctgtcag

SEQ ID NO: 9357408 - DNA, 22 bp, Homo sapiens
tcccagccacaggtgtagccct

SEQ ID NO: 9357409 - DNA, 22 bp, Homo sapiens
tcccagccggtgcctgggtccc

SEQ ID NO: 9357410 - DNA, 22 bp, Homo sapiens
tcccagaggtctctgctggttc

SEQ ID NO: 9357411 - DNA, 22 bp, Homo sapiens
tcccagaggttgagtcacttat

SEQ ID NO: 9357412 - DNA, 22 bp, Homo sapiens
tcccagcctgacagtgcatcaa

SEQ ID NO: 9357413 - DNA, 22 bp, Homo sapiens
tcccagccttatctcccctggc

SEQ ID NO: 9357414 - DNA, 22 bp, Homo sapiens
tcccagccttatctcccctggc

SEQ ID NO: 9357415 - DNA, 22 bp, Homo sapiens
tcccaggcgcctggtggggagc

SEQ ID NO: 9357416 - DNA, 22 bp, Homo sapiens
tcccaggcgcctggtggggagc

SEQ ID NO: 9357417 - DNA, 22 bp, Homo sapiens
tcccaggcgcctggtggggagc

SEQ ID NO: 9357418 - DNA, 22 bp, Homo sapiens
tcccaggccataaaactcagag

SEQ ID NO: 9357419 - DNA, 22 bp, Homo sapiens
tcccaggccataaaactcagag

SEQ ID NO: 9357420 - DNA, 22 bp, Homo sapiens
tcccaggccataaaactcagag

SEQ ID NO: 9357421 - DNA, 16 bp, Homo sapiens
tcccaggccaggtgga

SEQ ID NO: 9357422 - DNA, 22 bp, Homo sapiens
tcccaggccataaaactcagag

SEQ ID NO: 9357423 - DNA, 22 bp, Homo sapiens
tcccaggccataaaactcagag

SEQ ID NO: 9357424 - DNA, 16 bp, Homo sapiens
tcccaggccaggtgga

SEQ ID NO: 9357425 - DNA, 22 bp, Homo sapiens
tcccaggcaggtgacaggggga

SEQ ID NO: 9357426 - DNA, 22 bp, Homo sapiens
tcccaggccacacttggggaac

SEQ ID NO: 9357427 - DNA, 22 bp, Homo sapiens
tcccaggcaggtgacaggggga

SEQ ID NO: 9357428 - DNA, 22 bp, Homo sapiens
tcccagcctttctttctccagc

SEQ ID NO: 9357429 - DNA, 22 bp, Homo sapiens
tcctagggattcaacactgaac

SEQ ID NO: 9357430 - DNA, 22 bp, Homo sapiens
tcctagggttggagacagtgac

SEQ ID NO: 9357431 - DNA, 22 bp, Homo sapiens
tcctaggcccagcctgagctgt

SEQ ID NO: 9357432 - DNA, 22 bp, Homo sapiens
tcctaggcctggcctggtggat

SEQ ID NO: 9357433 - DNA, 22 bp, Homo sapiens
tcctaggcagttggtgctccat

SEQ ID NO: 9357434 - DNA, 19 bp, Homo sapiens
tcctagcacctggcacata

SEQ ID NO: 9357435 - DNA, 22 bp, Homo sapiens
tcctaaaggctgcttttatatt

SEQ ID NO: 9357436 - DNA, 20 bp, Homo sapiens
tcctaaagtcattgaatttc

SEQ ID NO: 9357437 - DNA, 22 bp, Homo sapiens
tccgtggggcctgtggcttccg

SEQ ID NO: 9357438 - DNA, 22 bp, Homo sapiens
tccgtggagattttgtgcaggg

SEQ ID NO: 9357439 - DNA, 18 bp, Homo sapiens
tccctgggatataattac

SEQ ID NO: 9357440 - DNA, 18 bp, Homo sapiens
tccctgggatataattac

SEQ ID NO: 9357441 - DNA, 22 bp, Homo sapiens
tccctgggaccggcagctcaca

SEQ ID NO: 9357442 - DNA, 22 bp, Homo sapiens
tccctgggacggccttttggag

SEQ ID NO: 9357443 - DNA, 22 bp, Homo sapiens
tccctgggactcagacatggaa

SEQ ID NO: 9357444 - DNA, 22 bp, Homo sapiens
tccctgggactcagacatggaa

SEQ ID NO: 9357445 - DNA, 22 bp, Homo sapiens
tccctgggagatgatgatgagg

SEQ ID NO: 9357446 - DNA, 16 bp, Homo sapiens
tccctgggagtggtgg

SEQ ID NO: 9357447 - DNA, 15 bp, Homo sapiens
tccctgggagatggt

SEQ ID NO: 9357448 - DNA, 22 bp, Homo sapiens
tccctgggaccggcagctcaca

SEQ ID NO: 9357449 - DNA, 22 bp, Homo sapiens
tccctgggaccggcagctcaca

SEQ ID NO: 9357450 - DNA, 22 bp, Homo sapiens
tccctgggaattaatatttgga

SEQ ID NO: 9357451 - DNA, 22 bp, Homo sapiens
tccctgggaacaaaggatgaga

SEQ ID NO: 9357452 - DNA, 22 bp, Homo sapiens
tccctgggaaatgtcagtttca

SEQ ID NO: 9357453 - DNA, 22 bp, Homo sapiens
tccctgggaacaaaggatgaga

SEQ ID NO: 9357454 - DNA, 22 bp, Homo sapiens
tccctgggaaatgtcagtttca

SEQ ID NO: 9357455 - DNA, 22 bp, Homo sapiens
tccctggctgtgttcaggtgcg

SEQ ID NO: 9357456 - DNA, 19 bp, Homo sapiens
tccctggcgcctctcgggc

SEQ ID NO: 9357457 - DNA, 19 bp, Homo sapiens
tccctggcgcctctcgggc

SEQ ID NO: 9357458 - DNA, 23 bp, Homo sapiens
tccctggccgcaatggccgcctt

SEQ ID NO: 9357459 - DNA, 22 bp, Homo sapiens
tccctggctgggggctgccttg

SEQ ID NO: 9357460 - DNA, 22 bp, Homo sapiens
tccctggccattcctctaggcc

SEQ ID NO: 9357461 - DNA, 22 bp, Homo sapiens
tccctggccattcctctaggcc

SEQ ID NO: 9357462 - DNA, 22 bp, Homo sapiens
tccctggccattcctctaggcc

SEQ ID NO: 9357463 - DNA, 22 bp, Homo sapiens
tccctggccattcctctaggcc

SEQ ID NO: 9357464 - DNA, 22 bp, Homo sapiens
tccctggcacaagaaggctgtc

SEQ ID NO: 9357465 - DNA, 20 bp, Homo sapiens
tccctggaggtggtggcatc

SEQ ID NO: 9357466 - DNA, 22 bp, Homo sapiens
tccctggacaacagacttcact

SEQ ID NO: 9357467 - DNA, 22 bp, Homo sapiens
tccctggaacagagagacaacg

SEQ ID NO: 9357468 - DNA, 22 bp, Homo sapiens
tcctagttctctgccagtcgct

SEQ ID NO: 9357469 - DNA, 22 bp, Homo sapiens
tcctagttctctgccagtcgct

SEQ ID NO: 9357470 - DNA, 22 bp, Homo sapiens
tcctagttctctgccagtcgct

SEQ ID NO: 9357471 - DNA, 22 bp, Homo sapiens
tcctagttctctgccagtcgct

SEQ ID NO: 9357472 - DNA, 22 bp, Homo sapiens
tcctagttctggttctgtcact

SEQ ID NO: 9357473 - DNA, 22 bp, Homo sapiens
tcctcacaagcaagcacaggta

SEQ ID NO: 9357474 - DNA, 22 bp, Homo sapiens
tcctcacacccataccactgac

SEQ ID NO: 9357475 - DNA, 22 bp, Homo sapiens
tcctcacaagcatcctgtctca

SEQ ID NO: 9357476 - DNA, 22 bp, Homo sapiens
tcctcacaagcatcctgtctca

SEQ ID NO: 9357477 - DNA, 22 bp, Homo sapiens
tcctcacactatagatgaggat

SEQ ID NO: 9357478 - DNA, 22 bp, Homo sapiens
tcctcacagatgggtgcatagc

SEQ ID NO: 9357479 - DNA, 22 bp, Homo sapiens
tcctcacagagtggcaggcaat

SEQ ID NO: 9357480 - DNA, 22 bp, Homo sapiens
tcctcacagctggttcattcag

SEQ ID NO: 9357481 - DNA, 22 bp, Homo sapiens
tcctcacagcatgaccaggcag

SEQ ID NO: 9357482 - DNA, 22 bp, Homo sapiens
tcctcagaatggatggcagggg

SEQ ID NO: 9357483 - DNA, 22 bp, Homo sapiens
tcctcagaatccaaactgcagt

SEQ ID NO: 9357484 - DNA, 22 bp, Homo sapiens
tcctcagaatcacctggcagct

SEQ ID NO: 9357485 - DNA, 22 bp, Homo sapiens
tcctcagaatcacctggcagct

SEQ ID NO: 9357486 - DNA, 22 bp, Homo sapiens
tcctcagaagaacccctagatt

SEQ ID NO: 9357487 - DNA, 22 bp, Homo sapiens
tcctcagaaacccctgtgaggt

SEQ ID NO: 9357488 - DNA, 20 bp, Homo sapiens
tcctcagaagacatttgggg

SEQ ID NO: 9357489 - DNA, 22 bp, Homo sapiens
tcctcacagggcaggaaggagg

SEQ ID NO: 9357490 - DNA, 22 bp, Homo sapiens
tcctcacagtcaacactttgag

SEQ ID NO: 9357491 - DNA, 22 bp, Homo sapiens
tcctcacatggtgagccacaca

SEQ ID NO: 9357492 - DNA, 22 bp, Homo sapiens
tcctcactgcagtgctccgagc

SEQ ID NO: 9357493 - DNA, 22 bp, Homo sapiens
tcctcactgcagtgctccgagc

SEQ ID NO: 9357494 - DNA, 22 bp, Homo sapiens
tcctcacatggtgagccacaca

SEQ ID NO: 9357495 - DNA, 22 bp, Homo sapiens
tcctcagaaacccctgtgaggt

SEQ ID NO: 9357496 - DNA, 22 bp, Homo sapiens
tcctcactttgtagccatcctt

SEQ ID NO: 9357497 - DNA, 22 bp, Homo sapiens
tcctcactttgtagccatcctt

SEQ ID NO: 9357498 - DNA, 22 bp, Homo sapiens
tcctcactttgtagccatcctt

SEQ ID NO: 9357499 - DNA, 22 bp, Homo sapiens
tcctcagatacctggcagatca

SEQ ID NO: 9357500 - DNA, 22 bp, Homo sapiens
tcctcagatataaatgagggtg

SEQ ID NO: 9357501 - DNA, 22 bp, Homo sapiens
tcctcagagcatagcgctgtct

SEQ ID NO: 9357502 - DNA, 22 bp, Homo sapiens
tcctcagagcagccctccgcat

SEQ ID NO: 9357503 - DNA, 22 bp, Homo sapiens
tcctcagagatgggcatctaag

SEQ ID NO: 9357504 - DNA, 22 bp, Homo sapiens
tcctcagacttccctttgtgta

SEQ ID NO: 9357505 - DNA, 22 bp, Homo sapiens
tcctcagacttccctttgtgta

SEQ ID NO: 9357506 - DNA, 22 bp, Homo sapiens
tcctcagacaccctgctggctt

SEQ ID NO: 9357507 - DNA, 22 bp, Homo sapiens
tcctcagacaccctgctggctt

SEQ ID NO: 9357508 - DNA, 22 bp, Homo sapiens
tcctcagcaaacacttcactct

SEQ ID NO: 9357509 - DNA, 22 bp, Homo sapiens
tcctcagatgctcttggacgcc

SEQ ID NO: 9357510 - DNA, 23 bp, Homo sapiens
tcctcagcatgttttgtcatgta

SEQ ID NO: 9357511 - DNA, 23 bp, Homo sapiens
tcctcagcatgttttgtcatgta

SEQ ID NO: 9357512 - DNA, 22 bp, Homo sapiens
tcctcagggcggcctccgtctt

SEQ ID NO: 9357513 - DNA, 19 bp, Homo sapiens
tcctcaggggctcacagac

SEQ ID NO: 9357514 - DNA, 22 bp, Homo sapiens
tccctcagcttgtctccatgca

SEQ ID NO: 9357515 - DNA, 22 bp, Homo sapiens
tccctcagcttgtctccatgca

SEQ ID NO: 9357516 - DNA, 15 bp, Homo sapiens
tccctcagctaaaga

SEQ ID NO: 9357517 - DNA, 22 bp, Homo sapiens
tccctcagctcatatttatgcc

SEQ ID NO: 9357518 - DNA, 22 bp, Homo sapiens
tccctcagcttgtctccatgca

SEQ ID NO: 9357519 - DNA, 22 bp, Homo sapiens
tccctcagcttgtctccatgca

SEQ ID NO: 9357520 - DNA, 23 bp, Homo sapiens
tccctcaggccttatctccatct

SEQ ID NO: 9357521 - DNA, 22 bp, Homo sapiens
tccctcaggacccaacttgtaa

SEQ ID NO: 9357522 - DNA, 22 bp, Homo sapiens
tccctcaggtggttcttgtttc

SEQ ID NO: 9357523 - DNA, 22 bp, Homo sapiens
tccctcagtccctggacaggca

SEQ ID NO: 9357524 - DNA, 20 bp, Homo sapiens
tccctcaggtcattgggctg

SEQ ID NO: 9357525 - DNA, 22 bp, Homo sapiens
tccctcaggtggttcttgtttc

SEQ ID NO: 9357526 - DNA, 22 bp, Homo sapiens
tccctcagggtgcagttgcttt

SEQ ID NO: 9357527 - DNA, 23 bp, Homo sapiens
tccctcaggccttatctccatct

SEQ ID NO: 9357528 - DNA, 19 bp, Homo sapiens
tccctcagtctgccaggcc

SEQ ID NO: 9357529 - DNA, 20 bp, Homo sapiens
tccctcagtcctggctttgt

SEQ ID NO: 9357530 - DNA, 22 bp, Homo sapiens
tccctccacacctgctggtacc

SEQ ID NO: 9357531 - DNA, 22 bp, Homo sapiens
tccctccagaatggtgaggaag

SEQ ID NO: 9357532 - DNA, 20 bp, Homo sapiens
tccctcagtttccagccctg

SEQ ID NO: 9357533 - DNA, 22 bp, Homo sapiens
tccctccccacttctgagcttt

SEQ ID NO: 9357534 - DNA, 20 bp, Homo sapiens
tccctccctccagctctggg

SEQ ID NO: 9357535 - DNA, 22 bp, Homo sapiens
tccctccccacttctgagcttt

SEQ ID NO: 9357536 - DNA, 22 bp, Homo sapiens
tccctccataacagaggtgagc

SEQ ID NO: 9357537 - DNA, 22 bp, Homo sapiens
tccctccaggcagctgggtact

SEQ ID NO: 9357538 - DNA, 22 bp, Homo sapiens
tccctgagagcactggggagcc

SEQ ID NO: 9357539 - DNA, 22 bp, Homo sapiens
tccctgcctcctggcagtgcca

SEQ ID NO: 9357540 - DNA, 22 bp, Homo sapiens
tccctgcctcctggcagtgcca

SEQ ID NO: 9357541 - DNA, 22 bp, Homo sapiens
tccctgccctgccttcatggtt

SEQ ID NO: 9357542 - DNA, 22 bp, Homo sapiens
tccctctgtgttgggcatgcct

SEQ ID NO: 9357543 - DNA, 22 bp, Homo sapiens
tccctctgtggttggttctgtc

SEQ ID NO: 9357544 - DNA, 22 bp, Homo sapiens
tccctctgtgttgggcatgcct

SEQ ID NO: 9357545 - DNA, 22 bp, Homo sapiens
tccctctgtgttgggcatgcct

SEQ ID NO: 9357546 - DNA, 22 bp, Homo sapiens
tccctctgttctgttccaagtg

SEQ ID NO: 9357547 - DNA, 22 bp, Homo sapiens
tccctgaaccactagtgatgag

SEQ ID NO: 9357548 - DNA, 20 bp, Homo sapiens
tccctcctgcagatagagaa

SEQ ID NO: 9357549 - DNA, 22 bp, Homo sapiens
tccctctgctagtgcttgagct

SEQ ID NO: 9357550 - DNA, 22 bp, Homo sapiens
tccctctgggctccagcacgga

SEQ ID NO: 9357551 - DNA, 22 bp, Homo sapiens
tccctctggtctggacgccata

SEQ ID NO: 9357552 - DNA, 22 bp, Homo sapiens
tccctctggtcctcggtggaga

SEQ ID NO: 9357553 - DNA, 22 bp, Homo sapiens
tccctctgggctggagcagggt

SEQ ID NO: 9357554 - DNA, 22 bp, Homo sapiens
tccctctgggctggagcagggt

SEQ ID NO: 9357555 - DNA, 20 bp, Homo sapiens
tccctccctccagctctggg

SEQ ID NO: 9357556 - DNA, 18 bp, Homo sapiens
tccctccctgctgtggcc

SEQ ID NO: 9357557 - DNA, 20 bp, Homo sapiens
tcccaggctccaccctagac

SEQ ID NO: 9357558 - DNA, 20 bp, Homo sapiens
tcccaggctccaccctagac

SEQ ID NO: 9357559 - DNA, 22 bp, Homo sapiens
tcccaggctcttcaaggaagac

SEQ ID NO: 9357560 - DNA, 22 bp, Homo sapiens
tcccaggctggcaggcagcagt

SEQ ID NO: 9357561 - DNA, 22 bp, Homo sapiens
tcccaggctcttcaaggaagac

SEQ ID NO: 9357562 - DNA, 22 bp, Homo sapiens
tcccaggctcttcaaggaagac

SEQ ID NO: 9357563 - DNA, 22 bp, Homo sapiens
tcccaggctggcaggcagcagt

SEQ ID NO: 9357564 - DNA, 22 bp, Homo sapiens
tcccaggctggcaggcagcagt

SEQ ID NO: 9357565 - DNA, 22 bp, Homo sapiens
tcccaggctggcaggcagcagt

SEQ ID NO: 9357566 - DNA, 20 bp, Homo sapiens
tcccaggctgggctccagct

SEQ ID NO: 9357567 - DNA, 20 bp, Homo sapiens
tcccaggctccaccctagac

SEQ ID NO: 9357568 - DNA, 22 bp, Homo sapiens
tcccaggctaggcctctgcgtt

SEQ ID NO: 9357569 - DNA, 22 bp, Homo sapiens
tcccaggctaggcctctgcgtt

SEQ ID NO: 9357570 - DNA, 22 bp, Homo sapiens
tcccaggctaccagtgaggtca

SEQ ID NO: 9357571 - DNA, 22 bp, Homo sapiens
tcccaggctaccagtgaggtca

SEQ ID NO: 9357572 - DNA, 22 bp, Homo sapiens
tcccaggctaccagtgaggtca

SEQ ID NO: 9357573 - DNA, 22 bp, Homo sapiens
tcccagggacaccaagctgttt

SEQ ID NO: 9357574 - DNA, 22 bp, Homo sapiens
tcccagggacaccaagctgttt

SEQ ID NO: 9357575 - DNA, 23 bp, Homo sapiens
tcccagggaaggtgagcgaggct

SEQ ID NO: 9357576 - DNA, 22 bp, Homo sapiens
tcccaggctgggggcctgaagt

SEQ ID NO: 9357577 - DNA, 22 bp, Homo sapiens
tcccaggctgggggcctgaagt

SEQ ID NO: 9357578 - DNA, 20 bp, Homo sapiens
tcccaggctgggctccagct

SEQ ID NO: 9357579 - DNA, 20 bp, Homo sapiens
tcccaggctgggctccagct

SEQ ID NO: 9357580 - DNA, 22 bp, Homo sapiens
tcccaggctggggccaggtgac

SEQ ID NO: 9357581 - DNA, 20 bp, Homo sapiens
tcccaggctgggctccagct

SEQ ID NO: 9357582 - DNA, 22 bp, Homo sapiens
tcccaggctggggccaggtgac

SEQ ID NO: 9357583 - DNA, 22 bp, Homo sapiens
tcccaggctggggccaggtgac

SEQ ID NO: 9357584 - DNA, 22 bp, Homo sapiens
tcccaggctggggccaggtgac

SEQ ID NO: 9357585 - DNA, 22 bp, Homo sapiens
tccctcagatgagctcctagca

SEQ ID NO: 9357586 - DNA, 22 bp, Homo sapiens
tccctcagatgagctcctagca

SEQ ID NO: 9357587 - DNA, 22 bp, Homo sapiens
tccctcagagggcaagcgcaga

SEQ ID NO: 9357588 - DNA, 22 bp, Homo sapiens
tccctcagagaccgtggtgcag

SEQ ID NO: 9357589 - DNA, 21 bp, Homo sapiens
tccctcagacagggtgcctat

SEQ ID NO: 9357590 - DNA, 22 bp, Homo sapiens
tccctcagacagatgtgttcct

SEQ ID NO: 9357591 - DNA, 22 bp, Homo sapiens
tccctcagcaggaatgtggcag

SEQ ID NO: 9357592 - DNA, 22 bp, Homo sapiens
tccctcagcaggaatgtggcag

SEQ ID NO: 9357593 - DNA, 22 bp, Homo sapiens
tccctcagcaggaactggcctg

SEQ ID NO: 9357594 - DNA, 22 bp, Homo sapiens
tccctcagcaggaactggcctg

SEQ ID NO: 9357595 - DNA, 20 bp, Homo sapiens
tccctcagcacttctacctc

SEQ ID NO: 9357596 - DNA, 20 bp, Homo sapiens
tccctcagcacttctacctc

SEQ ID NO: 9357597 - DNA, 22 bp, Homo sapiens
tccctcagatgagctcctagca

SEQ ID NO: 9357598 - DNA, 22 bp, Homo sapiens
tccctcagattggcaattagat

SEQ ID NO: 9357599 - DNA, 18 bp, Homo sapiens
tccccttccaggaagtca

SEQ ID NO: 9357600 - DNA, 18 bp, Homo sapiens
tccccttccaggaagtca

SEQ ID NO: 9357601 - DNA, 22 bp, Homo sapiens
tcccagggactggatgatgcag

SEQ ID NO: 9357602 - DNA, 22 bp, Homo sapiens
tcccctggcacctagtcctact

SEQ ID NO: 9357603 - DNA, 22 bp, Homo sapiens
tcccagggactggatgatgcag

SEQ ID NO: 9357604 - DNA, 22 bp, Homo sapiens
tcccagggacccagcctgatac

SEQ ID NO: 9357605 - DNA, 22 bp, Homo sapiens
tcccagggacccagcctgatac

SEQ ID NO: 9357606 - DNA, 22 bp, Homo sapiens
tcccagggacccagcctgatac

SEQ ID NO: 9357607 - DNA, 22 bp, Homo sapiens
tcccagggactctctgccttcc

SEQ ID NO: 9357608 - DNA, 22 bp, Homo sapiens
tcccagggactctctgccttcc

SEQ ID NO: 9357609 - DNA, 22 bp, Homo sapiens
tcccgcccttgtacttgccgag

SEQ ID NO: 9357610 - DNA, 22 bp, Homo sapiens
tcccgcttcttccgaatcgcga

SEQ ID NO: 9357611 - DNA, 22 bp, Homo sapiens
tcccgcatgccgccggtgaaca

SEQ ID NO: 9357612 - DNA, 22 bp, Homo sapiens
tcccctttgtcttcctgtgggt

SEQ ID NO: 9357613 - DNA, 22 bp, Homo sapiens
tcccgcatgccgccggtgaaca

SEQ ID NO: 9357614 - DNA, 21 bp, Homo sapiens
tccctcagaagctcttggtca

SEQ ID NO: 9357615 - DNA, 21 bp, Homo sapiens
tccctcagaaggtagccaagc

SEQ ID NO: 9357616 - DNA, 18 bp, Homo sapiens
tccctcagaattatagaa

SEQ ID NO: 9357617 - DNA, 22 bp, Homo sapiens
tccctcagacagatgtgttcct

SEQ ID NO: 9357618 - DNA, 22 bp, Homo sapiens
tcctgagacatctctgctggtc

SEQ ID NO: 9357619 - DNA, 20 bp, Homo sapiens
tcctgagaggctcttggaga

SEQ ID NO: 9357620 - DNA, 22 bp, Homo sapiens
tcctgagagcagctgctttgga

SEQ ID NO: 9357621 - DNA, 22 bp, Homo sapiens
tcctgagagcagctgctttgga

SEQ ID NO: 9357622 - DNA, 22 bp, Homo sapiens
tcctgagaatagagttgcatgt

SEQ ID NO: 9357623 - DNA, 22 bp, Homo sapiens
tcctgagaaggcacagcttgca

SEQ ID NO: 9357624 - DNA, 22 bp, Homo sapiens
tcctgaaggcctgagttccacc

SEQ ID NO: 9357625 - DNA, 22 bp, Homo sapiens
tcctgagaaggcacagcttgca

SEQ ID NO: 9357626 - DNA, 22 bp, Homo sapiens
tcctgaaggcctgagttccacc

SEQ ID NO: 9357627 - DNA, 22 bp, Homo sapiens
tcctgaaggcagatggggatca

SEQ ID NO: 9357628 - DNA, 22 bp, Homo sapiens
tcctgaagcctgagtgatgact

SEQ ID NO: 9357629 - DNA, 22 bp, Homo sapiens
tcctgaagcagttagcatgagc

SEQ ID NO: 9357630 - DNA, 22 bp, Homo sapiens
tcctgaagaggttgtctttata

SEQ ID NO: 9357631 - DNA, 22 bp, Homo sapiens
tcctgaacattatgcaagcttc

SEQ ID NO: 9357632 - DNA, 22 bp, Homo sapiens
tcctgaagaacgaagtcatgta

SEQ ID NO: 9357633 - DNA, 19 bp, Homo sapiens
tcctgaaaacttctggaat

SEQ ID NO: 9357634 - DNA, 22 bp, Homo sapiens
tcctgaaaaattacatgttcag

SEQ ID NO: 9357635 - DNA, 19 bp, Homo sapiens
tcctgaaaacttctggaat

SEQ ID NO: 9357636 - DNA, 19 bp, Homo sapiens
tcctgaaaacttctggaat

SEQ ID NO: 9357637 - DNA, 22 bp, Homo sapiens
tcctgaaatgtgcacatgacat

SEQ ID NO: 9357638 - DNA, 22 bp, Homo sapiens
tcctgaaaataatttcacaaga

SEQ ID NO: 9357639 - DNA, 22 bp, Homo sapiens
tcctgaaatgtgcacatgacat

SEQ ID NO: 9357640 - DNA, 22 bp, Homo sapiens
tcctgaaattctggttgtcact

SEQ ID NO: 9357641 - DNA, 22 bp, Homo sapiens
tcctctggggcgtggtcctgga

SEQ ID NO: 9357642 - DNA, 22 bp, Homo sapiens
tcctctgggctccctgcaacag

SEQ ID NO: 9357643 - DNA, 22 bp, Homo sapiens
tcctctgggctccctgcaacag

SEQ ID NO: 9357644 - DNA, 22 bp, Homo sapiens
tcctctggggcgtggtcctgga

SEQ ID NO: 9357645 - DNA, 22 bp, Homo sapiens
tcctctggtcctgcagcagatc

SEQ ID NO: 9357646 - DNA, 22 bp, Homo sapiens
tcctctggtcttcggtgtggac

SEQ ID NO: 9357647 - DNA, 22 bp, Homo sapiens
tcctctggtacttaaagtgctt

SEQ ID NO: 9357648 - DNA, 22 bp, Homo sapiens
tcctctggggcgtggtcctgga

SEQ ID NO: 9357649 - DNA, 22 bp, Homo sapiens
tcctctggggtcagggcactac

SEQ ID NO: 9357650 - DNA, 22 bp, Homo sapiens
tcctctggggtcagggcactac

SEQ ID NO: 9357651 - DNA, 19 bp, Homo sapiens
tcctctggtaccacccttg

SEQ ID NO: 9357652 - DNA, 22 bp, Homo sapiens
tcctcttctaagctcattcagg

SEQ ID NO: 9357653 - DNA, 22 bp, Homo sapiens
tcctcttctgcctatatctgcc

SEQ ID NO: 9357654 - DNA, 22 bp, Homo sapiens
tcctcttctgtggattccctga

SEQ ID NO: 9357655 - DNA, 22 bp, Homo sapiens
tcctgaaaaattacatgttcag

SEQ ID NO: 9357656 - DNA, 22 bp, Homo sapiens
tcctcttcaaaatagctctgaa

SEQ ID NO: 9357657 - DNA, 22 bp, Homo sapiens
tcctcttcaaaatagctctgaa

SEQ ID NO: 9357658 - DNA, 22 bp, Homo sapiens
tcctcttcagagggacctcggg

SEQ ID NO: 9357659 - DNA, 22 bp, Homo sapiens
tcctcttcaaaaggatttcctt

SEQ ID NO: 9357660 - DNA, 22 bp, Homo sapiens
tcctcttcaaaaggatttcctt

SEQ ID NO: 9357661 - DNA, 22 bp, Homo sapiens
tcctctggttatacttgcaccc

SEQ ID NO: 9357662 - DNA, 22 bp, Homo sapiens
tcctctggttatacttgcaccc

SEQ ID NO: 9357663 - DNA, 22 bp, Homo sapiens
tcctgagatccttttagggatc

SEQ ID NO: 9357664 - DNA, 22 bp, Homo sapiens
tcctgagatgagacagtgctgc

SEQ ID NO: 9357665 - DNA, 22 bp, Homo sapiens
tcctgagatgagacagtgctgc

SEQ ID NO: 9357666 - DNA, 23 bp, Homo sapiens
tcctgagatgagacagtgctgcc

SEQ ID NO: 9357667 - DNA, 23 bp, Homo sapiens
tcctgagatgagacagtgctgcc

SEQ ID NO: 9357668 - DNA, 23 bp, Homo sapiens
tcctgagatgagacagtgctgcc

SEQ ID NO: 9357669 - DNA, 22 bp, Homo sapiens
tcctgagatgagacagtgctgc

SEQ ID NO: 9357670 - DNA, 22 bp, Homo sapiens
tcctgagattctgcatttctaa

SEQ ID NO: 9357671 - DNA, 22 bp, Homo sapiens
tcctgagattctgcatttctaa

SEQ ID NO: 9357672 - DNA, 22 bp, Homo sapiens
tcctgagatgtggagctccatg

SEQ ID NO: 9357673 - DNA, 22 bp, Homo sapiens
tcctgagcaacacagctaagtg

SEQ ID NO: 9357674 - DNA, 20 bp, Homo sapiens
tcctgagatttaaggggttc

SEQ ID NO: 9357675 - DNA, 20 bp, Homo sapiens
tcctgagatttaaggggttc

SEQ ID NO: 9357676 - DNA, 22 bp, Homo sapiens
tcctgagccctactctagacga

SEQ ID NO: 9357677 - DNA, 22 bp, Homo sapiens
tcctgagccctggggtcagtgt

SEQ ID NO: 9357678 - DNA, 20 bp, Homo sapiens
tcctgagcctccaccatgtc

SEQ ID NO: 9357679 - DNA, 20 bp, Homo sapiens
tcctgagcctccaccatgtc

SEQ ID NO: 9357680 - DNA, 22 bp, Homo sapiens
tcctgaggcctctgtgatgtga

SEQ ID NO: 9357681 - DNA, 22 bp, Homo sapiens
tcctgagtgagagctgggaggt

SEQ ID NO: 9357682 - DNA, 20 bp, Homo sapiens
tcctgagtgcagttggcttg

SEQ ID NO: 9357683 - DNA, 22 bp, Homo sapiens
tcctgagtggttgttttcttcc

SEQ ID NO: 9357684 - DNA, 21 bp, Homo sapiens
tcctgagtgtgcccaggctct

SEQ ID NO: 9357685 - DNA, 22 bp, Homo sapiens
tcctgatggcctctggctccag

SEQ ID NO: 9357686 - DNA, 22 bp, Homo sapiens
tcctgagctcccatgaacaggc

SEQ ID NO: 9357687 - DNA, 22 bp, Homo sapiens
tcctgcagagacagaggcctca

SEQ ID NO: 9357688 - DNA, 22 bp, Homo sapiens
tcctgcagacctcagtcaggtc

SEQ ID NO: 9357689 - DNA, 22 bp, Homo sapiens
tcctgcagagacagaggcctca

SEQ ID NO: 9357690 - DNA, 22 bp, Homo sapiens
tcctgcagagacagaggcctca

SEQ ID NO: 9357691 - DNA, 22 bp, Homo sapiens
tcctgcagagacagaggcctca

SEQ ID NO: 9357692 - DNA, 22 bp, Homo sapiens
tcctgcagacctcagtcaggtc

SEQ ID NO: 9357693 - DNA, 19 bp, Homo sapiens
tcctgcagaccagacctgt

SEQ ID NO: 9357694 - DNA, 22 bp, Homo sapiens
tcctgcagacctcagtcaggtc

SEQ ID NO: 9357695 - DNA, 19 bp, Homo sapiens
tcctgcagaccagacctgt

SEQ ID NO: 9357696 - DNA, 19 bp, Homo sapiens
tcctgcagaccagacctgt

SEQ ID NO: 9357697 - DNA, 22 bp, Homo sapiens
tcctgcagacatttacaccttt

SEQ ID NO: 9357698 - DNA, 22 bp, Homo sapiens
tcctgcagacatttacaccttt

SEQ ID NO: 9357699 - DNA, 22 bp, Homo sapiens
tcctgcagacatttacaccttt

SEQ ID NO: 9357700 - DNA, 21 bp, Homo sapiens
tcctgcagaatgccttcctac

SEQ ID NO: 9357701 - DNA, 22 bp, Homo sapiens
tcctgattaggtttccatagct

SEQ ID NO: 9357702 - DNA, 22 bp, Homo sapiens
tcctgattaggtttccatagct

SEQ ID NO: 9357703 - DNA, 22 bp, Homo sapiens
tcctgcacagcctaagtagaaa

SEQ ID NO: 9357704 - DNA, 23 bp, Homo sapiens
tcctgcagataagctggttgaca

SEQ ID NO: 9357705 - DNA, 22 bp, Homo sapiens
tcctgcagagtcccactgattt

SEQ ID NO: 9357706 - DNA, 23 bp, Homo sapiens
tcctgcagataagctggttgaca

SEQ ID NO: 9357707 - DNA, 22 bp, Homo sapiens
tcctgcagagacagaggcctca

SEQ ID NO: 9357708 - DNA, 22 bp, Homo sapiens
tcctgcagagccgccctcaggt

SEQ ID NO: 9357709 - DNA, 22 bp, Homo sapiens
tcctgcagccactgcaggcaga

SEQ ID NO: 9357710 - DNA, 22 bp, Homo sapiens
tcctgcagcatccgtcgtctgt

SEQ ID NO: 9357711 - DNA, 22 bp, Homo sapiens
tcctgcagccttgggctggagc

SEQ ID NO: 9357712 - DNA, 22 bp, Homo sapiens
tcctgcagccattagaggtcaa

SEQ ID NO: 9357713 - DNA, 22 bp, Homo sapiens
tcctgcagccactgcaggcaga

SEQ ID NO: 9357714 - DNA, 22 bp, Homo sapiens
tcctgcagtctgcactctgcct

SEQ ID NO: 9357715 - DNA, 22 bp, Homo sapiens
tcctgcagtctgcactctgcct

SEQ ID NO: 9357716 - DNA, 20 bp, Homo sapiens
tcctgcagtcgctagcgccc

SEQ ID NO: 9357717 - DNA, 20 bp, Homo sapiens
tcctgcagtcgctagcgccc

SEQ ID NO: 9357718 - DNA, 22 bp, Homo sapiens
tcctgcagtctgcactctgcct

SEQ ID NO: 9357719 - DNA, 22 bp, Homo sapiens
tcctgccgtcctccggggcctc

SEQ ID NO: 9357720 - DNA, 22 bp, Homo sapiens
tcctgcccagagctctccactc

SEQ ID NO: 9357721 - DNA, 22 bp, Homo sapiens
tcctgccctcgggggtgttcca

SEQ ID NO: 9357722 - DNA, 21 bp, Homo sapiens
tcctgcagggcagcagagtgg

SEQ ID NO: 9357723 - DNA, 22 bp, Homo sapiens
tcctgcaggcttgagtcctcag

SEQ ID NO: 9357724 - DNA, 20 bp, Homo sapiens
tcctgcagtcgctagcgccc

SEQ ID NO: 9357725 - DNA, 19 bp, Homo sapiens
tcctgcaggtggcttgcag

SEQ ID NO: 9357726 - DNA, 19 bp, Homo sapiens
tcctgcaggtggcttgcag

SEQ ID NO: 9357727 - DNA, 22 bp, Homo sapiens
tcctgcaggggctgaggaacca

SEQ ID NO: 9357728 - DNA, 22 bp, Homo sapiens
tcctgcaggggctgaggaacca

SEQ ID NO: 9357729 - DNA, 19 bp, Homo sapiens
tcctgcaggtggcttgcag

SEQ ID NO: 9357730 - DNA, 21 bp, Homo sapiens
tcctgcaggaggcctgagagg

SEQ ID NO: 9357731 - DNA, 22 bp, Homo sapiens
tcctgcaggccagaggggtgag

SEQ ID NO: 9357732 - DNA, 21 bp, Homo sapiens
tcctgcaggaggcctgagagg

SEQ ID NO: 9357733 - DNA, 22 bp, Homo sapiens
tcctgcagctgcagacctgggg

SEQ ID NO: 9357734 - DNA, 22 bp, Homo sapiens
tcctgcagctgaagctcatgtg

SEQ ID NO: 9357735 - DNA, 22 bp, Homo sapiens
tcctgcagctgcagacctgggg

SEQ ID NO: 9357736 - DNA, 22 bp, Homo sapiens
tcctgcagctgcagacctgggg

SEQ ID NO: 9357737 - DNA, 22 bp, Homo sapiens
tcctgcagctgaagctcatgtg

SEQ ID NO: 9357738 - DNA, 22 bp, Homo sapiens
tcctgcagccttgggctggagc

SEQ ID NO: 9357739 - DNA, 22 bp, Homo sapiens
tcctgcagccttgggctggagc

SEQ ID NO: 9357740 - DNA, 22 bp, Homo sapiens
tcctgcagctctgagaagcatc

SEQ ID NO: 9357741 - DNA, 22 bp, Homo sapiens
tcctgcagctctgagaagcatc

SEQ ID NO: 9357742 - DNA, 22 bp, Homo sapiens
tcctgcctcaggctctggagta

SEQ ID NO: 9357743 - DNA, 22 bp, Homo sapiens
tcctgcctcaggctctggagta

SEQ ID NO: 9357744 - DNA, 22 bp, Homo sapiens
tcctgcctcacagttgaagttt

SEQ ID NO: 9357745 - DNA, 22 bp, Homo sapiens
tcctgcctaccttgcggaggtg

SEQ ID NO: 9357746 - DNA, 22 bp, Homo sapiens
tcctgcctagcaggtgacctat

SEQ ID NO: 9357747 - DNA, 22 bp, Homo sapiens
tcctgcctaccttgcggaggtg

SEQ ID NO: 9357748 - DNA, 22 bp, Homo sapiens
tcctgcctcacagttgaagttt

SEQ ID NO: 9357749 - DNA, 22 bp, Homo sapiens
tcctgcctagcaggtgacctat

SEQ ID NO: 9357750 - DNA, 22 bp, Homo sapiens
tcctgcctcttttcttattcca

SEQ ID NO: 9357751 - DNA, 22 bp, Homo sapiens
tcctgcctgcaatcccagcact

SEQ ID NO: 9357752 - DNA, 22 bp, Homo sapiens
tcctgcctgagcgtggaggagg

SEQ ID NO: 9357753 - DNA, 22 bp, Homo sapiens
tcctgcctgcaatcccagcact

SEQ ID NO: 9357754 - DNA, 22 bp, Homo sapiens
tcctgcctcttttcttattcca

SEQ ID NO: 9357755 - DNA, 22 bp, Homo sapiens
tcctgcctcttttcttattcca

SEQ ID NO: 9357756 - DNA, 22 bp, Homo sapiens
tcctgcctcttgccttcttcac

SEQ ID NO: 9357757 - DNA, 22 bp, Homo sapiens
tcctgcctcttgccttcttcac

SEQ ID NO: 9357758 - DNA, 22 bp, Homo sapiens
tcctgcctcttgccttcttcac

SEQ ID NO: 9357759 - DNA, 22 bp, Homo sapiens
tcctgcctctccatgctaacta

SEQ ID NO: 9357760 - DNA, 22 bp, Homo sapiens
ctgtgtttgatgagaagccacc

SEQ ID NO: 9357761 - DNA, 22 bp, Homo sapiens
ctgtgtttttggtctgatctat

SEQ ID NO: 9357762 - DNA, 22 bp, Homo sapiens
ctgtgttttgagatattattaa

SEQ ID NO: 9357763 - DNA, 22 bp, Homo sapiens
ctgtgttggcttttctcttgta

SEQ ID NO: 9357764 - DNA, 22 bp, Homo sapiens
ctgtgttcccctgctgctgagg

SEQ ID NO: 9357765 - DNA, 22 bp, Homo sapiens
ctgtgtgtttatatcatttcct

SEQ ID NO: 9357766 - DNA, 23 bp, Homo sapiens
ctgtgtgtgccgagggtggccac

SEQ ID NO: 9357767 - DNA, 22 bp, Homo sapiens
ctgtgtgtgagaagcaggttga

SEQ ID NO: 9357768 - DNA, 22 bp, Homo sapiens
ctgtgtgtgagaagcaggttga

SEQ ID NO: 9357769 - DNA, 22 bp, Homo sapiens
ctgtgtgtgaacacagcccagc

SEQ ID NO: 9357770 - DNA, 22 bp, Homo sapiens
ctgtgtgtgtctgcagcatact

SEQ ID NO: 9357771 - DNA, 22 bp, Homo sapiens
ctgtgtgtgtctgcagcatact

SEQ ID NO: 9357772 - DNA, 22 bp, Homo sapiens
ctgtgtgtgctacaggcttcca

SEQ ID NO: 9357773 - DNA, 22 bp, Homo sapiens
ctgtgtgtgctacaggcttcca

SEQ ID NO: 9357774 - DNA, 22 bp, Homo sapiens
ctgtggggaaagggtcctgctc

SEQ ID NO: 9357775 - DNA, 18 bp, Homo sapiens
ctgtgggctggtgcatga

SEQ ID NO: 9357776 - DNA, 19 bp, Homo sapiens
ctgtgggtgtgcaagggtg

SEQ ID NO: 9357777 - DNA, 22 bp, Homo sapiens
ctgtggtcaccaggctggggcc

SEQ ID NO: 9357778 - DNA, 22 bp, Homo sapiens
ctgtggggccaaattctcctct

SEQ ID NO: 9357779 - DNA, 22 bp, Homo sapiens
ctgtggggagctgatcagatca

SEQ ID NO: 9357780 - DNA, 22 bp, Homo sapiens
ctgtggggaagatagaaccgac

SEQ ID NO: 9357781 - DNA, 21 bp, Homo sapiens
ctgtggtacagctgggacgga

SEQ ID NO: 9357782 - DNA, 21 bp, Homo sapiens
ctgtggtacagctgggacgga

SEQ ID NO: 9357783 - DNA, 22 bp, Homo sapiens
ctgtgtgtgaacacagcccagc

SEQ ID NO: 9357784 - DNA, 22 bp, Homo sapiens
ctgtgtgagcatcacttcagat

SEQ ID NO: 9357785 - DNA, 22 bp, Homo sapiens
ctgtgtgaatagtgaggtctat

SEQ ID NO: 9357786 - DNA, 22 bp, Homo sapiens
ctgtgtctttcctactttgtgg

SEQ ID NO: 9357787 - DNA, 22 bp, Homo sapiens
ctgtgtcttctgttttgaagtt

SEQ ID NO: 9357788 - DNA, 22 bp, Homo sapiens
ctgtggagtttgtggcgctgac

SEQ ID NO: 9357789 - DNA, 23 bp, Homo sapiens
ctgtggcaagtcctgcacctgcc

SEQ ID NO: 9357790 - DNA, 22 bp, Homo sapiens
ctgtggcaagtctgcctgtcac

SEQ ID NO: 9357791 - DNA, 22 bp, Homo sapiens
ctgtggcaaatgatacctccca

SEQ ID NO: 9357792 - DNA, 22 bp, Homo sapiens
ctgtggcaaatgatacctccca

SEQ ID NO: 9357793 - DNA, 22 bp, Homo sapiens
ctgtggcagaggtgacacctct

SEQ ID NO: 9357794 - DNA, 22 bp, Homo sapiens
ctgtggcactcaagaagcctcc

SEQ ID NO: 9357795 - DNA, 22 bp, Homo sapiens
ctgtggcactcaagaagcctcc

SEQ ID NO: 9357796 - DNA, 22 bp, Homo sapiens
ctgtggcaggaagggactagca

SEQ ID NO: 9357797 - DNA, 22 bp, Homo sapiens
ctgtggcaggaagggactagca

SEQ ID NO: 9357798 - DNA, 22 bp, Homo sapiens
ctgtggcaccaatacatttttc

SEQ ID NO: 9357799 - DNA, 22 bp, Homo sapiens
ctgtggcacatgtggcaaggcc

SEQ ID NO: 9357800 - DNA, 22 bp, Homo sapiens
ctgtggcattgccgaggctggc

SEQ ID NO: 9357801 - DNA, 22 bp, Homo sapiens
ctgtggcattgccgaggctggc

SEQ ID NO: 9357802 - DNA, 22 bp, Homo sapiens
ctgtggcattaataaaagtgca

SEQ ID NO: 9357803 - DNA, 22 bp, Homo sapiens
ctgtggcattgccgaggctggc

SEQ ID NO: 9357804 - DNA, 20 bp, Homo sapiens
ctgtggcatcttgaaggagg

SEQ ID NO: 9357805 - DNA, 22 bp, Homo sapiens
ctgtggcattgtgaggactgca

SEQ ID NO: 9357806 - DNA, 22 bp, Homo sapiens
ctgtggcattgtgaggactgca

SEQ ID NO: 9357807 - DNA, 22 bp, Homo sapiens
ctgtggcattgccgaggctggc

SEQ ID NO: 9357808 - DNA, 20 bp, Homo sapiens
ctgtggcatctgtcatggtg

SEQ ID NO: 9357809 - DNA, 20 bp, Homo sapiens
ctgtggcatctgtcatggtg

SEQ ID NO: 9357810 - DNA, 20 bp, Homo sapiens
ctgtggcatctgtcatggtg

SEQ ID NO: 9357811 - DNA, 22 bp, Homo sapiens
ctgtggcagggaagaggccatg

SEQ ID NO: 9357812 - DNA, 22 bp, Homo sapiens
ctgtggcagggaagaggccatg

SEQ ID NO: 9357813 - DNA, 22 bp, Homo sapiens
ctgtggcaggtgtctggggcag

SEQ ID NO: 9357814 - DNA, 22 bp, Homo sapiens
ctgtgggctcccagcttctctc

SEQ ID NO: 9357815 - DNA, 22 bp, Homo sapiens
ctgtgggcagctcctcctgtca

SEQ ID NO: 9357816 - DNA, 22 bp, Homo sapiens
ctgtgggcagctcctcctgtca

SEQ ID NO: 9357817 - DNA, 22 bp, Homo sapiens
ctgtgggcctagtctggcctag

SEQ ID NO: 9357818 - DNA, 23 bp, Homo sapiens
ctgtggccacccctagctggagg

SEQ ID NO: 9357819 - DNA, 23 bp, Homo sapiens
ctgtggccacccctagctggagg

SEQ ID NO: 9357820 - DNA, 22 bp, Homo sapiens
ctgtggcatttagaggttgcgt

SEQ ID NO: 9357821 - DNA, 22 bp, Homo sapiens
ctgtggctttctctgcctcctt

SEQ ID NO: 9357822 - DNA, 22 bp, Homo sapiens
ctgtgggagcactggggaccga

SEQ ID NO: 9357823 - DNA, 22 bp, Homo sapiens
ctgtgggagcactggggaccga

SEQ ID NO: 9357824 - DNA, 22 bp, Homo sapiens
ctgtgggatgggacctcagctg

SEQ ID NO: 9357825 - DNA, 22 bp, Homo sapiens
ctgtgggagggaaggcgcggcc

SEQ ID NO: 9357826 - DNA, 19 bp, Homo sapiens
ctgtcccagactctgctct

SEQ ID NO: 9357827 - DNA, 22 bp, Homo sapiens
ctgtcccagatgttctcagcac

SEQ ID NO: 9357828 - DNA, 22 bp, Homo sapiens
ctgtcccagccccgtactctaa

SEQ ID NO: 9357829 - DNA, 22 bp, Homo sapiens
ctgtcccagccccgtactctaa

SEQ ID NO: 9357830 - DNA, 22 bp, Homo sapiens
ctgtcccaggagctgtaagaca

SEQ ID NO: 9357831 - DNA, 22 bp, Homo sapiens
ctgtcccacaagcagtgtgcac

SEQ ID NO: 9357832 - DNA, 22 bp, Homo sapiens
ctgtcccacaagcagtgtgcac

SEQ ID NO: 9357833 - DNA, 22 bp, Homo sapiens
ctgtccatattcaaggggtagg

SEQ ID NO: 9357834 - DNA, 22 bp, Homo sapiens
ctgtccagtgcagagaacagag

SEQ ID NO: 9357835 - DNA, 22 bp, Homo sapiens
ctgtccatattcaaggggtagg

SEQ ID NO: 9357836 - DNA, 22 bp, Homo sapiens
ctgtccatggcaatgatgcaga

SEQ ID NO: 9357837 - DNA, 22 bp, Homo sapiens
ctgtccatgcatgttgtctgct

SEQ ID NO: 9357838 - DNA, 21 bp, Homo sapiens
ctgtccccagtgagcaccccc

SEQ ID NO: 9357839 - DNA, 21 bp, Homo sapiens
ctgtccccagtgagcaccccc

SEQ ID NO: 9357840 - DNA, 22 bp, Homo sapiens
ctgtcccagtgatcctgagtgc

SEQ ID NO: 9357841 - DNA, 22 bp, Homo sapiens
ctgtcccagtgatcctgagtgc

SEQ ID NO: 9357842 - DNA, 18 bp, Homo sapiens
ctgtcccatcctcaggtt

SEQ ID NO: 9357843 - DNA, 18 bp, Homo sapiens
ctgtcccatcctcaggtt

SEQ ID NO: 9357844 - DNA, 22 bp, Homo sapiens
ctgtcccatccttactctaccc

SEQ ID NO: 9357845 - DNA, 20 bp, Homo sapiens
ctgtccccgaggtcaccagg

SEQ ID NO: 9357846 - DNA, 22 bp, Homo sapiens
ctggttcatccccttccaggaa

SEQ ID NO: 9357847 - DNA, 22 bp, Homo sapiens
ctggttggaagtgcagactctc

SEQ ID NO: 9357848 - DNA, 22 bp, Homo sapiens
ctggttctgattttgctgcatt

SEQ ID NO: 9357849 - DNA, 22 bp, Homo sapiens
ctggttggaggagaagtttgga

SEQ ID NO: 9357850 - DNA, 22 bp, Homo sapiens
ctggttgggaggttggctttca

SEQ ID NO: 9357851 - DNA, 22 bp, Homo sapiens
ctggttggtgccacatggtggc

SEQ ID NO: 9357852 - DNA, 22 bp, Homo sapiens
ctggtttaagcttatatagttg

SEQ ID NO: 9357853 - DNA, 22 bp, Homo sapiens
ctggtttaagcttatatagttg

SEQ ID NO: 9357854 - DNA, 19 bp, Homo sapiens
ctggtttaggtagtgagtc

SEQ ID NO: 9357855 - DNA, 22 bp, Homo sapiens
ctgtcagttctatctttgtgct

SEQ ID NO: 9357856 - DNA, 22 bp, Homo sapiens
ctgtcattgagcctgtcagggc

SEQ ID NO: 9357857 - DNA, 22 bp, Homo sapiens
ctggttttccaatgttttgact

SEQ ID NO: 9357858 - DNA, 22 bp, Homo sapiens
ctggttttctagtccactggct

SEQ ID NO: 9357859 - DNA, 22 bp, Homo sapiens
ctggttttgaatatgtctgctt

SEQ ID NO: 9357860 - DNA, 22 bp, Homo sapiens
ctggttttggctggcaaggttg

SEQ ID NO: 9357861 - DNA, 22 bp, Homo sapiens
ctggttttggctggcaaggttg

SEQ ID NO: 9357862 - DNA, 22 bp, Homo sapiens
ctggttttaagctgtcagagag

SEQ ID NO: 9357863 - DNA, 22 bp, Homo sapiens
ctggttttaatgttatgtttat

SEQ ID NO: 9357864 - DNA, 22 bp, Homo sapiens
ctggttttaatgttatgtttat

SEQ ID NO: 9357865 - DNA, 22 bp, Homo sapiens
ctgtccctcatcacctctgggt

SEQ ID NO: 9357866 - DNA, 21 bp, Homo sapiens
ctgtccctctttgcttccctc

SEQ ID NO: 9357867 - DNA, 21 bp, Homo sapiens
ctgtccctctttgcttccctc

SEQ ID NO: 9357868 - DNA, 22 bp, Homo sapiens
ctgtccctctcacacctcacca

SEQ ID NO: 9357869 - DNA, 19 bp, Homo sapiens
ctgtccctcccaggtatga

SEQ ID NO: 9357870 - DNA, 22 bp, Homo sapiens
ctgtctgttatctcaccagtcc

SEQ ID NO: 9357871 - DNA, 22 bp, Homo sapiens
ctgtgaaactggacagcacttg

SEQ ID NO: 9357872 - DNA, 22 bp, Homo sapiens
ctgtgaaatcaaccttgagccc

SEQ ID NO: 9357873 - DNA, 22 bp, Homo sapiens
ctgtgacagtttctcagaattt

SEQ ID NO: 9357874 - DNA, 22 bp, Homo sapiens
ctgtgacagtttctcagacttt

SEQ ID NO: 9357875 - DNA, 22 bp, Homo sapiens
ctgtgacctccaggaaggggtg

SEQ ID NO: 9357876 - DNA, 22 bp, Homo sapiens
ctgtgacagagcttgagtgaga

SEQ ID NO: 9357877 - DNA, 22 bp, Homo sapiens
ctgtgaagtgaatgctcctagt

SEQ ID NO: 9357878 - DNA, 22 bp, Homo sapiens
ctgtgaagtgaatgctcctagt

SEQ ID NO: 9357879 - DNA, 22 bp, Homo sapiens
ctgtgactttgaataagaggga

SEQ ID NO: 9357880 - DNA, 22 bp, Homo sapiens
ctgtgacttccggatgacatga

SEQ ID NO: 9357881 - DNA, 22 bp, Homo sapiens
ctgtgacttccactactgatca

SEQ ID NO: 9357882 - DNA, 22 bp, Homo sapiens
ctgtggaatcatcaggtcttac

SEQ ID NO: 9357883 - DNA, 20 bp, Homo sapiens
ctgtggaattttaccatgcg

SEQ ID NO: 9357884 - DNA, 20 bp, Homo sapiens
ctgtggaattttaccatgcg

SEQ ID NO: 9357885 - DNA, 22 bp, Homo sapiens
ctgtgagctgggtggccaggac

SEQ ID NO: 9357886 - DNA, 22 bp, Homo sapiens
ctgtgaggcgggtggagtggag

SEQ ID NO: 9357887 - DNA, 22 bp, Homo sapiens
ctggttaaatgaaaaagtatta

SEQ ID NO: 9357888 - DNA, 22 bp, Homo sapiens
ctggttaaatgaaaaagtatta

SEQ ID NO: 9357889 - DNA, 22 bp, Homo sapiens
ctggtgtttatctgactgccta

SEQ ID NO: 9357890 - DNA, 22 bp, Homo sapiens
ctggtgtggcggcgccctgtag

SEQ ID NO: 9357891 - DNA, 22 bp, Homo sapiens
ctggtgtggcggcgccctgtag

SEQ ID NO: 9357892 - DNA, 22 bp, Homo sapiens
ctggtgtggcggcgccctgtag

SEQ ID NO: 9357893 - DNA, 22 bp, Homo sapiens
ctggtgtgattgagcccaggtg

SEQ ID NO: 9357894 - DNA, 22 bp, Homo sapiens
ctggtggttcaggagaatggct

SEQ ID NO: 9357895 - DNA, 22 bp, Homo sapiens
ctggtgtccgcaacgggcagcg

SEQ ID NO: 9357896 - DNA, 22 bp, Homo sapiens
ctggtaggggtgactgttatcg

SEQ ID NO: 9357897 - DNA, 22 bp, Homo sapiens
ctggtagtttgcaaaatggtgt

SEQ ID NO: 9357898 - DNA, 22 bp, Homo sapiens
ctggtagtgtctgccgaggtcc

SEQ ID NO: 9357899 - DNA, 22 bp, Homo sapiens
ctggtgcctcctccctgtgctt

SEQ ID NO: 9357900 - DNA, 22 bp, Homo sapiens
ctggtgccctgtgtggcaggag

SEQ ID NO: 9357901 - DNA, 22 bp, Homo sapiens
ctggtgcctcctccctgtgctt

SEQ ID NO: 9357902 - DNA, 22 bp, Homo sapiens
ctggtgggtagagggcatcagg

SEQ ID NO: 9357903 - DNA, 22 bp, Homo sapiens
ctggtgcctcctctcccaggtc

SEQ ID NO: 9357904 - DNA, 22 bp, Homo sapiens
ctgggtggttttgatgtgaatt

SEQ ID NO: 9357905 - DNA, 22 bp, Homo sapiens
ctgggtgtcaggagacatgatg

SEQ ID NO: 9357906 - DNA, 22 bp, Homo sapiens
ctgggtgtgggtcaagcaacca

SEQ ID NO: 9357907 - DNA, 22 bp, Homo sapiens
ctgggtgttcacccgaggcgct

SEQ ID NO: 9357908 - DNA, 22 bp, Homo sapiens
ctgggtgtagcccagtatgagg

SEQ ID NO: 9357909 - DNA, 22 bp, Homo sapiens
ctgggtgtagatggaagtttgg

SEQ ID NO: 9357910 - DNA, 22 bp, Homo sapiens
ctgggtgttcaggagctgggct

SEQ ID NO: 9357911 - DNA, 22 bp, Homo sapiens
ctgggtgttgggtactgaccgt

SEQ ID NO: 9357912 - DNA, 22 bp, Homo sapiens
ctgggttacaagaagcaaaaac

SEQ ID NO: 9357913 - DNA, 22 bp, Homo sapiens
ctgggttgcaaagcgctggctg

SEQ ID NO: 9357914 - DNA, 22 bp, Homo sapiens
ctgggttgatctcagccctaag

SEQ ID NO: 9357915 - DNA, 22 bp, Homo sapiens
ctgggttggggttacatgactg

SEQ ID NO: 9357916 - DNA, 22 bp, Homo sapiens
ctgggtttagggtctccccttg

SEQ ID NO: 9357917 - DNA, 22 bp, Homo sapiens
ctgggtttagggtctccccttg

SEQ ID NO: 9357918 - DNA, 22 bp, Homo sapiens
ctgggttggggttacatgactg

SEQ ID NO: 9357919 - DNA, 22 bp, Homo sapiens
ctgggttgccctgggcctgtga

SEQ ID NO: 9357920 - DNA, 22 bp, Homo sapiens
ctgggttgccctgggcctgtga

SEQ ID NO: 9357921 - DNA, 22 bp, Homo sapiens
ctgggttgcaaagcgctggctg

SEQ ID NO: 9357922 - DNA, 22 bp, Homo sapiens
ctgggttttattacagtgagct

SEQ ID NO: 9357923 - DNA, 22 bp, Homo sapiens
ctggtaacaatatccacaaaga

SEQ ID NO: 9357924 - DNA, 22 bp, Homo sapiens
ctggtacagtgttacaaaatgg

SEQ ID NO: 9357925 - DNA, 22 bp, Homo sapiens
ctgggctccctcatgtgtctgc

SEQ ID NO: 9357926 - DNA, 22 bp, Homo sapiens
ctgggctcctaaccatccaggt

SEQ ID NO: 9357927 - DNA, 22 bp, Homo sapiens
ctgggctcctaaccatccaggt

SEQ ID NO: 9357928 - DNA, 18 bp, Homo sapiens
ctgggctcgagagatcct

SEQ ID NO: 9357929 - DNA, 22 bp, Homo sapiens
ctgggctcctaaccatccaggt

SEQ ID NO: 9357930 - DNA, 22 bp, Homo sapiens
ctgggctctaagggagcaccgt

SEQ ID NO: 9357931 - DNA, 20 bp, Homo sapiens
ctgggctcggtggccctggc

SEQ ID NO: 9357932 - DNA, 20 bp, Homo sapiens
ctgggctcggtggccctggc

SEQ ID NO: 9357933 - DNA, 18 bp, Homo sapiens
ctgggctcgagagatcct

SEQ ID NO: 9357934 - DNA, 22 bp, Homo sapiens
ctgggggcaatggtcagagtgt

SEQ ID NO: 9357935 - DNA, 22 bp, Homo sapiens
ctggggctggtgaggcaggctc

SEQ ID NO: 9357936 - DNA, 22 bp, Homo sapiens
ctggggctggtgaggcaggctc

SEQ ID NO: 9357937 - DNA, 22 bp, Homo sapiens
ctggggctggtgaggcaggctc

SEQ ID NO: 9357938 - DNA, 22 bp, Homo sapiens
ctgggctctaagggagcaccgt

SEQ ID NO: 9357939 - DNA, 22 bp, Homo sapiens
ctgggctctagaaaggaaagaa

SEQ ID NO: 9357940 - DNA, 22 bp, Homo sapiens
ctggggctggtgaggcaggctc

SEQ ID NO: 9357941 - DNA, 22 bp, Homo sapiens
ctggggctggtgaggcaggctc

SEQ ID NO: 9357942 - DNA, 22 bp, Homo sapiens
ctggggtgagcagaaacagggg

SEQ ID NO: 9357943 - DNA, 22 bp, Homo sapiens
ctggggtctcaattctagcggg

SEQ ID NO: 9357944 - DNA, 22 bp, Homo sapiens
ctggggtatctgccacaactct

SEQ ID NO: 9357945 - DNA, 22 bp, Homo sapiens
ctgggggtgagcagcagcgacg

SEQ ID NO: 9357946 - DNA, 22 bp, Homo sapiens
ctgggggtcgcgcctctgggca

SEQ ID NO: 9357947 - DNA, 22 bp, Homo sapiens
ctgggggtgagcagcagcgacg

SEQ ID NO: 9357948 - DNA, 22 bp, Homo sapiens
ctgggggtcgcgcctctgggca

SEQ ID NO: 9357949 - DNA, 22 bp, Homo sapiens
ctggggggctactgacagagga

SEQ ID NO: 9357950 - DNA, 22 bp, Homo sapiens
ctgggtgcttactttgtgctag

SEQ ID NO: 9357951 - DNA, 22 bp, Homo sapiens
ctgggtggaaagtgctgagaat

SEQ ID NO: 9357952 - DNA, 22 bp, Homo sapiens
ctgggtggaaagtgctgagaat

SEQ ID NO: 9357953 - DNA, 22 bp, Homo sapiens
ctgggtggaaagtgctgagaat

SEQ ID NO: 9357954 - DNA, 22 bp, Homo sapiens
ctggggtgtctcgtctgccatt

SEQ ID NO: 9357955 - DNA, 22 bp, Homo sapiens
ctggggtggtgcaggcctcatg

SEQ ID NO: 9357956 - DNA, 22 bp, Homo sapiens
ctggggtggatgggtccaagtt

SEQ ID NO: 9357957 - DNA, 22 bp, Homo sapiens
ctggggtgagcagaaacagggg

SEQ ID NO: 9357958 - DNA, 22 bp, Homo sapiens
ctggggtggagattggcaatct

SEQ ID NO: 9357959 - DNA, 22 bp, Homo sapiens
ctggggtggagattggcaatct

SEQ ID NO: 9357960 - DNA, 22 bp, Homo sapiens
ctggggtggaggagctcccctg

SEQ ID NO: 9357961 - DNA, 21 bp, Homo sapiens
ctgggctcatggtgttacaga

SEQ ID NO: 9357962 - DNA, 22 bp, Homo sapiens
ctgggctccactacttgctaac

SEQ ID NO: 9357963 - DNA, 22 bp, Homo sapiens
ctgggctccactacttgctaac

SEQ ID NO: 9357964 - DNA, 22 bp, Homo sapiens
ctgggctccactcccacagtgt

SEQ ID NO: 9357965 - DNA, 22 bp, Homo sapiens
ctgggctccctcatgtgtctgc

SEQ ID NO: 9357966 - DNA, 22 bp, Homo sapiens
ctgggctcagtggctcatggct

SEQ ID NO: 9357967 - DNA, 22 bp, Homo sapiens
ctgggctcagtggctcatggct

SEQ ID NO: 9357968 - DNA, 22 bp, Homo sapiens
ctgggctcagtggctcatggct

SEQ ID NO: 9357969 - DNA, 22 bp, Homo sapiens
ctgggctcagtggctcatggct

SEQ ID NO: 9357970 - DNA, 22 bp, Homo sapiens
ctgggcctccacgggccatcac

SEQ ID NO: 9357971 - DNA, 22 bp, Homo sapiens
ctgggcctccagctctgccagc

SEQ ID NO: 9357972 - DNA, 22 bp, Homo sapiens
ctgggcctccagctctgccagc

SEQ ID NO: 9357973 - DNA, 22 bp, Homo sapiens
ctgggcctccacgggccatcac

SEQ ID NO: 9357974 - DNA, 22 bp, Homo sapiens
ctgggcctccacgggccatcac

SEQ ID NO: 9357975 - DNA, 22 bp, Homo sapiens
ctgggctcagcccatgctgtcc

SEQ ID NO: 9357976 - DNA, 22 bp, Homo sapiens
ctgggctcaaatcctggccctg

SEQ ID NO: 9357977 - DNA, 22 bp, Homo sapiens
ctgggctcaagaagtcttccct

SEQ ID NO: 9357978 - DNA, 22 bp, Homo sapiens
ctgggcctcacacccaccaaat

SEQ ID NO: 9357979 - DNA, 22 bp, Homo sapiens
ctgggcctcaagctcagatttc

SEQ ID NO: 9357980 - DNA, 22 bp, Homo sapiens
ctgggcctcatccccagagttt

SEQ ID NO: 9357981 - DNA, 22 bp, Homo sapiens
ctgggcctcatccccagagttt

SEQ ID NO: 9357982 - DNA, 22 bp, Homo sapiens
ctgggcctagcaacagaggagt

SEQ ID NO: 9357983 - DNA, 22 bp, Homo sapiens
ctgggcctagaggaagctgaca

SEQ ID NO: 9357984 - DNA, 22 bp, Homo sapiens
ctgggcctaacccacagcgttt

SEQ ID NO: 9357985 - DNA, 22 bp, Homo sapiens
ctgggcctaacccacagcgttt

SEQ ID NO: 9357986 - DNA, 22 bp, Homo sapiens
ctggagctcagcccaggttcca

SEQ ID NO: 9357987 - DNA, 22 bp, Homo sapiens
ctggagccttcaccaggggaaa

SEQ ID NO: 9357988 - DNA, 22 bp, Homo sapiens
ctggagccttcaccaggggaaa

SEQ ID NO: 9357989 - DNA, 22 bp, Homo sapiens
ctggagctaataatccatctga

SEQ ID NO: 9357990 - DNA, 22 bp, Homo sapiens
ctgggaggcggaggttgcagtg

SEQ ID NO: 9357991 - DNA, 22 bp, Homo sapiens
ctggagctctccagagccccgt

SEQ ID NO: 9357992 - DNA, 22 bp, Homo sapiens
ctggagctccagggtctcctct

SEQ ID NO: 9357993 - DNA, 22 bp, Homo sapiens
ctgggaggcggaggttgcagtg

SEQ ID NO: 9357994 - DNA, 22 bp, Homo sapiens
ctggagctcagcccaggttcca

SEQ ID NO: 9357995 - DNA, 22 bp, Homo sapiens
ctggagctccagggtctcctct

SEQ ID NO: 9357996 - DNA, 22 bp, Homo sapiens
ctgggagtgaaaggagggctgc

SEQ ID NO: 9357997 - DNA, 22 bp, Homo sapiens
ctgggagtgaaaggagggctgc

SEQ ID NO: 9357998 - DNA, 22 bp, Homo sapiens
ctgggagtgaaaggagggctgc

SEQ ID NO: 9357999 - DNA, 22 bp, Homo sapiens
ctgggagtctggcctctggtcc

SEQ ID NO: 9358000 - DNA, 22 bp, Homo sapiens
ctgggagtgaaaggagggctgc

SEQ ID NO: 9358001 - DNA, 22 bp, Homo sapiens
ctgggagtggtgacagctctcg

SEQ ID NO: 9358002 - DNA, 22 bp, Homo sapiens
ctgggagtggtgacagctctcg

SEQ ID NO: 9358003 - DNA, 22 bp, Homo sapiens
ctgggagtccctggaatagctc

SEQ ID NO: 9358004 - DNA, 22 bp, Homo sapiens
ctgggagtccctggaatagctc

SEQ ID NO: 9358005 - DNA, 22 bp, Homo sapiens
ctgggagtctaagctagcaccg

SEQ ID NO: 9358006 - DNA, 22 bp, Homo sapiens
ctgggagtctaagctagcaccg

SEQ ID NO: 9358007 - DNA, 22 bp, Homo sapiens
ctgggagtctggaattttggta

SEQ ID NO: 9358008 - DNA, 22 bp, Homo sapiens
ctgggagtctggaattttggta

SEQ ID NO: 9358009 - DNA, 22 bp, Homo sapiens
ctgggagtctggcctctggtcc

SEQ ID NO: 9358010 - DNA, 22 bp, Homo sapiens
ctgggagtctggcctctggtcc

SEQ ID NO: 9358011 - DNA, 22 bp, Homo sapiens
ctgggagtcaccaggagcaagg

SEQ ID NO: 9358012 - DNA, 22 bp, Homo sapiens
ctgggagtactgggggatgtca

SEQ ID NO: 9358013 - DNA, 22 bp, Homo sapiens
ctgggagtactgggggatgtca

SEQ ID NO: 9358014 - DNA, 22 bp, Homo sapiens
ctgggagtactgggggatgtca

SEQ ID NO: 9358015 - DNA, 22 bp, Homo sapiens
ctgggagtactgggggatgtca

SEQ ID NO: 9358016 - DNA, 22 bp, Homo sapiens
ctgggagtcaccaggagcaagg

SEQ ID NO: 9358017 - DNA, 22 bp, Homo sapiens
ctgggagtcaccaggagcaagg

SEQ ID NO: 9358018 - DNA, 22 bp, Homo sapiens
ctgggagtccaggatacagatg

SEQ ID NO: 9358019 - DNA, 22 bp, Homo sapiens
ctgggagtccaggatacagatg

SEQ ID NO: 9358020 - DNA, 22 bp, Homo sapiens
ctgggagtccctggaatagctc

SEQ ID NO: 9358021 - DNA, 22 bp, Homo sapiens
ctgggagtcagtataagaagca

SEQ ID NO: 9358022 - DNA, 22 bp, Homo sapiens
ctgggagtcagtataagaagca

SEQ ID NO: 9358023 - DNA, 22 bp, Homo sapiens
ctgggagtttctagagaaagac

SEQ ID NO: 9358024 - DNA, 22 bp, Homo sapiens
ctgggagtttctagagaaagac

SEQ ID NO: 9358025 - DNA, 22 bp, Homo sapiens
ctgggagtttgttagtaatgca

SEQ ID NO: 9358026 - DNA, 22 bp, Homo sapiens
ctgggagtttgttagtaatgca

SEQ ID NO: 9358027 - DNA, 22 bp, Homo sapiens
ctgggatccacgggctcccaag

SEQ ID NO: 9358028 - DNA, 22 bp, Homo sapiens
ctgggatgatagtgctagtatt

SEQ ID NO: 9358029 - DNA, 22 bp, Homo sapiens
ctgggatgcggaggttgcggtg

SEQ ID NO: 9358030 - DNA, 22 bp, Homo sapiens
ctgggatgctccggcctggatg

SEQ ID NO: 9358031 - DNA, 22 bp, Homo sapiens
ctgggatggctccgctgctgct

SEQ ID NO: 9358032 - DNA, 22 bp, Homo sapiens
ctgggatgctccggcctggatg

SEQ ID NO: 9358033 - DNA, 22 bp, Homo sapiens
ctgggagtgttctaggtcacat

SEQ ID NO: 9358034 - DNA, 22 bp, Homo sapiens
ctgggagtgttctaggtcacat

SEQ ID NO: 9358035 - DNA, 22 bp, Homo sapiens
ctgggagtgtccctctggtaat

SEQ ID NO: 9358036 - DNA, 22 bp, Homo sapiens
ctgggagtgtccctctggtaat

SEQ ID NO: 9358037 - DNA, 22 bp, Homo sapiens
ctgggagtgttctaggtcacat

SEQ ID NO: 9358038 - DNA, 22 bp, Homo sapiens
ctgggagtgttctaggtcacat

SEQ ID NO: 9358039 - DNA, 19 bp, Homo sapiens
ctgggagttcactgctgcc

SEQ ID NO: 9358040 - DNA, 19 bp, Homo sapiens
ctgggagttcactgctgcc

SEQ ID NO: 9358041 - DNA, 22 bp, Homo sapiens
ctgggagttgacgaggcttgta

SEQ ID NO: 9358042 - DNA, 22 bp, Homo sapiens
ctgggagttgacgaggcttgta

SEQ ID NO: 9358043 - DNA, 22 bp, Homo sapiens
ctgggagttgacgaggcttgta

SEQ ID NO: 9358044 - DNA, 22 bp, Homo sapiens
ctgggagttgacgaggcttgta

SEQ ID NO: 9358045 - DNA, 22 bp, Homo sapiens
ctgggcccacgagggctctggg

SEQ ID NO: 9358046 - DNA, 22 bp, Homo sapiens
ctgggatggctttcctgcatta

SEQ ID NO: 9358047 - DNA, 22 bp, Homo sapiens
ctgggatggctccgctgctgct

SEQ ID NO: 9358048 - DNA, 22 bp, Homo sapiens
ctgggatgtctatagaacactt

SEQ ID NO: 9358049 - DNA, 22 bp, Homo sapiens
ctgggatgtgaggagcgcctct

SEQ ID NO: 9358050 - DNA, 22 bp, Homo sapiens
ctgggatgtctatagaacactt

SEQ ID NO: 9358051 - DNA, 22 bp, Homo sapiens
cttgctgtgtggtgttctcaga

SEQ ID NO: 9358052 - DNA, 22 bp, Homo sapiens
cttgctgtcttgcatttagagc

SEQ ID NO: 9358053 - DNA, 22 bp, Homo sapiens
cttggagacaggacaggcagaa

SEQ ID NO: 9358054 - DNA, 22 bp, Homo sapiens
cttggagaatgacagtggatta

SEQ ID NO: 9358055 - DNA, 22 bp, Homo sapiens
cttggacaacttttctctggtt

SEQ ID NO: 9358056 - DNA, 22 bp, Homo sapiens
cttcttcctgaaagctggctct

SEQ ID NO: 9358057 - DNA, 22 bp, Homo sapiens
cttcttcctgctgcagcctcca

SEQ ID NO: 9358058 - DNA, 22 bp, Homo sapiens
cttcttcctgctgcagcctcca

SEQ ID NO: 9358059 - DNA, 22 bp, Homo sapiens
cttcttcctgctgcagcctcca

SEQ ID NO: 9358060 - DNA, 22 bp, Homo sapiens
cttcttcctgctgcagcctcca

SEQ ID NO: 9358061 - DNA, 22 bp, Homo sapiens
cttcttcctgaaagctggctct

SEQ ID NO: 9358062 - DNA, 22 bp, Homo sapiens
cttcttcccagcttccctcacc

SEQ ID NO: 9358063 - DNA, 22 bp, Homo sapiens
cttcttcccagcttccctcacc

SEQ ID NO: 9358064 - DNA, 22 bp, Homo sapiens
cttcttcccagcttccctcacc

SEQ ID NO: 9358065 - DNA, 22 bp, Homo sapiens
cttcttccaagcttatgctcaa

SEQ ID NO: 9358066 - DNA, 22 bp, Homo sapiens
cttcttccaagcttatgctcaa

SEQ ID NO: 9358067 - DNA, 22 bp, Homo sapiens
cttgctggggtaagtctgtgct

SEQ ID NO: 9358068 - DNA, 22 bp, Homo sapiens
cttgctgtcttgcatttagagc

SEQ ID NO: 9358069 - DNA, 22 bp, Homo sapiens
cttgctgtcccttggtatgaac

SEQ ID NO: 9358070 - DNA, 22 bp, Homo sapiens
cttgctggtggtgttttctatg

SEQ ID NO: 9358071 - DNA, 19 bp, Homo sapiens
cttgctgggtggtttctgc

SEQ ID NO: 9358072 - DNA, 22 bp, Homo sapiens
cttgcctaggtgtatattaaat

SEQ ID NO: 9358073 - DNA, 22 bp, Homo sapiens
cttcttcttcccccttcagggg

SEQ ID NO: 9358074 - DNA, 22 bp, Homo sapiens
cttcttctggacaggcagctcc

SEQ ID NO: 9358075 - DNA, 19 bp, Homo sapiens
cttcttcttggcagccaag

SEQ ID NO: 9358076 - DNA, 22 bp, Homo sapiens
ctttcctctggcactgtctggt

SEQ ID NO: 9358077 - DNA, 22 bp, Homo sapiens
ctttcctgagaaaggagaagga

SEQ ID NO: 9358078 - DNA, 22 bp, Homo sapiens
ctttcctggctggcagttgtgg

SEQ ID NO: 9358079 - DNA, 23 bp, Homo sapiens
ctttcctttctttgacacccagc

SEQ ID NO: 9358080 - DNA, 22 bp, Homo sapiens
ctttccagacctccttgtagct

SEQ ID NO: 9358081 - DNA, 22 bp, Homo sapiens
ctttccagacctccttgtagct

SEQ ID NO: 9358082 - DNA, 22 bp, Homo sapiens
ctttccagatttgtccagttat

SEQ ID NO: 9358083 - DNA, 22 bp, Homo sapiens
ctttccaccaactcacttccct

SEQ ID NO: 9358084 - DNA, 22 bp, Homo sapiens
ctttccagacctccttgtagct

SEQ ID NO: 9358085 - DNA, 22 bp, Homo sapiens
ctttccagatttgtccagttat

SEQ ID NO: 9358086 - DNA, 22 bp, Homo sapiens
ctttcctagttggtcccagcac

SEQ ID NO: 9358087 - DNA, 22 bp, Homo sapiens
ctttccaagaatgcagatacct

SEQ ID NO: 9358088 - DNA, 22 bp, Homo sapiens
ctttccaatgtcactatgaatc

SEQ ID NO: 9358089 - DNA, 22 bp, Homo sapiens
ctttccaatgcatttccaatgt

SEQ ID NO: 9358090 - DNA, 22 bp, Homo sapiens
cttggaggaaaggcagggagac

SEQ ID NO: 9358091 - DNA, 22 bp, Homo sapiens
cttggagcccagcaggcctgga

SEQ ID NO: 9358092 - DNA, 22 bp, Homo sapiens
cttggaggaaaggcagggagac

SEQ ID NO: 9358093 - DNA, 22 bp, Homo sapiens
cttggagctcccgcactgatta

SEQ ID NO: 9358094 - DNA, 22 bp, Homo sapiens
cttggagcccagcaggcctgga

SEQ ID NO: 9358095 - DNA, 22 bp, Homo sapiens
cttggaggatgtgcggctgccc

SEQ ID NO: 9358096 - DNA, 22 bp, Homo sapiens
cttggaggtggaagttgcagtg

SEQ ID NO: 9358097 - DNA, 22 bp, Homo sapiens
cttggaggaaggggctcttctg

SEQ ID NO: 9358098 - DNA, 22 bp, Homo sapiens
cttggaggaggtggtgcttgat

SEQ ID NO: 9358099 - DNA, 22 bp, Homo sapiens
ctttctctgtgtttcacatgct

SEQ ID NO: 9358100 - DNA, 22 bp, Homo sapiens
ctttctcttacccaaggatctg

SEQ ID NO: 9358101 - DNA, 22 bp, Homo sapiens
ctttctctgtgtttcacatgct

SEQ ID NO: 9358102 - DNA, 22 bp, Homo sapiens
ctttctcttcactgtcatgatc

SEQ ID NO: 9358103 - DNA, 22 bp, Homo sapiens
ctttctcttacccaaggatctg

SEQ ID NO: 9358104 - DNA, 22 bp, Homo sapiens
ctttctcttcactgtcatgatc

SEQ ID NO: 9358105 - DNA, 22 bp, Homo sapiens
ctttctcagtgttaattacttt

SEQ ID NO: 9358106 - DNA, 22 bp, Homo sapiens
ctttctcctactgggcgcggga

SEQ ID NO: 9358107 - DNA, 22 bp, Homo sapiens
ctttctccctgtcccaaactgg

SEQ ID NO: 9358108 - DNA, 22 bp, Homo sapiens
ctttctccagagctgcttattt

SEQ ID NO: 9358109 - DNA, 22 bp, Homo sapiens
ctttctctgtgtttcacatgct

SEQ ID NO: 9358110 - DNA, 22 bp, Homo sapiens
ctttctctgtgtggtaaagggc

SEQ ID NO: 9358111 - DNA, 22 bp, Homo sapiens
ctttctctggaggggagtggtt

SEQ ID NO: 9358112 - DNA, 20 bp, Homo sapiens
ctttctctaatttataagta

SEQ ID NO: 9358113 - DNA, 20 bp, Homo sapiens
ctttctctaatttataagta

SEQ ID NO: 9358114 - DNA, 22 bp, Homo sapiens
cttcactggaatctgtaatagt

SEQ ID NO: 9358115 - DNA, 22 bp, Homo sapiens
cttcacctgtacgctggagcta

SEQ ID NO: 9358116 - DNA, 22 bp, Homo sapiens
cttcactgagtagtctagactc

SEQ ID NO: 9358117 - DNA, 22 bp, Homo sapiens
cttcactgagtagtctagactc

SEQ ID NO: 9358118 - DNA, 22 bp, Homo sapiens
cttcagaaccagccagaagagg

SEQ ID NO: 9358119 - DNA, 22 bp, Homo sapiens
cttccaggtaggcctaaggcag

SEQ ID NO: 9358120 - DNA, 22 bp, Homo sapiens
cttccagggtccaggaagagcc

SEQ ID NO: 9358121 - DNA, 22 bp, Homo sapiens
cttcagaaactagtaacagcta

SEQ ID NO: 9358122 - DNA, 22 bp, Homo sapiens
cttcactgtttggttcacagca

SEQ ID NO: 9358123 - DNA, 22 bp, Homo sapiens
cttcactgtgcttcaagcagct

SEQ ID NO: 9358124 - DNA, 22 bp, Homo sapiens
cttcactgggctcctgagaggg

SEQ ID NO: 9358125 - DNA, 23 bp, Homo sapiens
cttcacaggttcaggggattaag

SEQ ID NO: 9358126 - DNA, 22 bp, Homo sapiens
cttcacagtaaatccagaagaa

SEQ ID NO: 9358127 - DNA, 22 bp, Homo sapiens
cttcacagtaaatccagaagaa

SEQ ID NO: 9358128 - DNA, 22 bp, Homo sapiens
cttcacagtcaccctgctgtgt

SEQ ID NO: 9358129 - DNA, 16 bp, Homo sapiens
cttcacagaggagagt

SEQ ID NO: 9358130 - DNA, 22 bp, Homo sapiens
ctgttaaatgagaaagcagact

SEQ ID NO: 9358131 - DNA, 20 bp, Homo sapiens
ctgttaaaaggtatgaattc

SEQ ID NO: 9358132 - DNA, 20 bp, Homo sapiens
ctgttaaaaggtatgaattc

SEQ ID NO: 9358133 - DNA, 22 bp, Homo sapiens
ctgttaaaatgtggtcttaaaa

SEQ ID NO: 9358134 - DNA, 22 bp, Homo sapiens
ctgttaaagatagttaagcttc

SEQ ID NO: 9358135 - DNA, 22 bp, Homo sapiens
cttcccagaccttagagtgcag

SEQ ID NO: 9358136 - DNA, 22 bp, Homo sapiens
cttcccagcacctcagtctggc

SEQ ID NO: 9358137 - DNA, 22 bp, Homo sapiens
cttcccagcacctcagtctggc

SEQ ID NO: 9358138 - DNA, 22 bp, Homo sapiens
cttcccagacggggtggcagcc

SEQ ID NO: 9358139 - DNA, 22 bp, Homo sapiens
cttcccagttctgcttgagggg

SEQ ID NO: 9358140 - DNA, 22 bp, Homo sapiens
cttcccagttctgcttgagggg

SEQ ID NO: 9358141 - DNA, 22 bp, Homo sapiens
cttccccaggacctctgctaaa

SEQ ID NO: 9358142 - DNA, 21 bp, Homo sapiens
cttccccaggctggtctgtat

SEQ ID NO: 9358143 - DNA, 22 bp, Homo sapiens
cttccccaagtagagaggggag

SEQ ID NO: 9358144 - DNA, 22 bp, Homo sapiens
cttccccaaccccgactgtgtg

SEQ ID NO: 9358145 - DNA, 22 bp, Homo sapiens
cttccctgagctttctcaggct

SEQ ID NO: 9358146 - DNA, 22 bp, Homo sapiens
cttccctgagctttctcaggct

SEQ ID NO: 9358147 - DNA, 22 bp, Homo sapiens
cttccctgataagagcctcaga

SEQ ID NO: 9358148 - DNA, 22 bp, Homo sapiens
cttccctgataagagcctcaga

SEQ ID NO: 9358149 - DNA, 22 bp, Homo sapiens
cttccctgataagagcctcaga

SEQ ID NO: 9358150 - DNA, 22 bp, Homo sapiens
cttcccttcctggggcaattta

SEQ ID NO: 9358151 - DNA, 22 bp, Homo sapiens
cttcccttcccctcacggagac

SEQ ID NO: 9358152 - DNA, 22 bp, Homo sapiens
cttcccttcccctcacggagac

SEQ ID NO: 9358153 - DNA, 22 bp, Homo sapiens
cttcttcaatagcaagcgcata

SEQ ID NO: 9358154 - DNA, 22 bp, Homo sapiens
cttcttcatctgtaaaacttgg

SEQ ID NO: 9358155 - DNA, 20 bp, Homo sapiens
cttcttcagcctatgcttca

SEQ ID NO: 9358156 - DNA, 22 bp, Homo sapiens
cttctgtgacgtatgtgaggac

SEQ ID NO: 9358157 - DNA, 22 bp, Homo sapiens
cttctgtgaccaccagcagccc

SEQ ID NO: 9358158 - DNA, 22 bp, Homo sapiens
cttctgtgagtcagtgtttctg

SEQ ID NO: 9358159 - DNA, 22 bp, Homo sapiens
cttctgtgaagagcagaaccat

SEQ ID NO: 9358160 - DNA, 22 bp, Homo sapiens
cttcttcaagagaatgggagac

SEQ ID NO: 9358161 - DNA, 22 bp, Homo sapiens
cttcccttctgtgcagggcaga

SEQ ID NO: 9358162 - DNA, 22 bp, Homo sapiens
cttcccttggtgaacagagcat

SEQ ID NO: 9358163 - DNA, 22 bp, Homo sapiens
cttcccttctgtgcagggcaga

SEQ ID NO: 9358164 - DNA, 22 bp, Homo sapiens
cttcccttggtgaacagagcat

SEQ ID NO: 9358165 - DNA, 22 bp, Homo sapiens
cttcccttctgtgcagggcaga

SEQ ID NO: 9358166 - DNA, 22 bp, Homo sapiens
cttcccttctgcagatctttgg

SEQ ID NO: 9358167 - DNA, 22 bp, Homo sapiens
cttccctttctggtgacttctc

SEQ ID NO: 9358168 - DNA, 22 bp, Homo sapiens
cttccctttagcatatagtagt

SEQ ID NO: 9358169 - DNA, 22 bp, Homo sapiens
gaaaaatgagctgatgtcaggg

SEQ ID NO: 9358170 - DNA, 22 bp, Homo sapiens
gaaaaatgctccaaatctgtgg

SEQ ID NO: 9358171 - DNA, 22 bp, Homo sapiens
gaaaaatgctccaaatctgtgg

SEQ ID NO: 9358172 - DNA, 22 bp, Homo sapiens
ctttttgtgtatgctacagttg

SEQ ID NO: 9358173 - DNA, 22 bp, Homo sapiens
cttttttaaggtagctcctcct

SEQ ID NO: 9358174 - DNA, 22 bp, Homo sapiens
cttttttcctaaggcaacatga

SEQ ID NO: 9358175 - DNA, 22 bp, Homo sapiens
cttttttcctaaggcaacatga

SEQ ID NO: 9358176 - DNA, 22 bp, Homo sapiens
gaaacccaaactaagacagtag

SEQ ID NO: 9358177 - DNA, 22 bp, Homo sapiens
gaaactagatgtattagagatt

SEQ ID NO: 9358178 - DNA, 22 bp, Homo sapiens
gaaactgaatataagaaaggta

SEQ ID NO: 9358179 - DNA, 22 bp, Homo sapiens
gaaactgagtaggctagagcac

SEQ ID NO: 9358180 - DNA, 22 bp, Homo sapiens
gaaactggatgcagggatgcag

SEQ ID NO: 9358181 - DNA, 22 bp, Homo sapiens
gaaactgatattaactcagtgt

SEQ ID NO: 9358182 - DNA, 22 bp, Homo sapiens
gaaactgtatgtagtttttggg

SEQ ID NO: 9358183 - DNA, 22 bp, Homo sapiens
gaaactggatgcagggatgcag

SEQ ID NO: 9358184 - DNA, 22 bp, Homo sapiens
gaaactgtgaggatcttaactt

SEQ ID NO: 9358185 - DNA, 22 bp, Homo sapiens
gaaactgtgatcgtgttctggg

SEQ ID NO: 9358186 - DNA, 22 bp, Homo sapiens
ctttggcaagggttttaattgt

SEQ ID NO: 9358187 - DNA, 22 bp, Homo sapiens
ctttttcccaggtggagagagg

SEQ ID NO: 9358188 - DNA, 22 bp, Homo sapiens
cttttgttaggagaaaacatca

SEQ ID NO: 9358189 - DNA, 22 bp, Homo sapiens
ctttggcaatgtcattttcaat

SEQ ID NO: 9358190 - DNA, 22 bp, Homo sapiens
ctttggcacagtctcatttgat

SEQ ID NO: 9358191 - DNA, 22 bp, Homo sapiens
ctttttctaatcataattgtct

SEQ ID NO: 9358192 - DNA, 20 bp, Homo sapiens
ctttttctccagctctgagc

SEQ ID NO: 9358193 - DNA, 22 bp, Homo sapiens
ctttttctaatcataattgtct

SEQ ID NO: 9358194 - DNA, 22 bp, Homo sapiens
ctttttctaatcataattgtct

SEQ ID NO: 9358195 - DNA, 22 bp, Homo sapiens
ctttttcctcgtagagcctaat

SEQ ID NO: 9358196 - DNA, 22 bp, Homo sapiens
gaaatgttgtcctgtctcttga

SEQ ID NO: 9358197 - DNA, 22 bp, Homo sapiens
gaaattgaataccctgcatgaa

SEQ ID NO: 9358198 - DNA, 22 bp, Homo sapiens
gaaattgtaaaggattgcgcca

SEQ ID NO: 9358199 - DNA, 22 bp, Homo sapiens
gaaattgtcagcttctttcagt

SEQ ID NO: 9358200 - DNA, 22 bp, Homo sapiens
gaaattctgtgtcccagagtgc

SEQ ID NO: 9358201 - DNA, 20 bp, Homo sapiens
gaaattctcgtattagttta

SEQ ID NO: 9358202 - DNA, 22 bp, Homo sapiens
gaaattcactgtatttcttggg

SEQ ID NO: 9358203 - DNA, 22 bp, Homo sapiens
gaagaacacttcatgattcatt

SEQ ID NO: 9358204 - DNA, 22 bp, Homo sapiens
gaaattgtcagtgatatgatac

SEQ ID NO: 9358205 - DNA, 22 bp, Homo sapiens
gaagaagggagtgacaaatgca

SEQ ID NO: 9358206 - DNA, 19 bp, Homo sapiens
gaagaagcttgagaagtag

SEQ ID NO: 9358207 - DNA, 22 bp, Homo sapiens
gaagaagcaggagtgtgtagca

SEQ ID NO: 9358208 - DNA, 22 bp, Homo sapiens
gaagaagagataatggggagca

SEQ ID NO: 9358209 - DNA, 20 bp, Homo sapiens
gaaatgtatctcttgattct

SEQ ID NO: 9358210 - DNA, 20 bp, Homo sapiens
gaaatgtatctcttgattct

SEQ ID NO: 9358211 - DNA, 22 bp, Homo sapiens
gaaatgtaggcataattatttt

SEQ ID NO: 9358212 - DNA, 22 bp, Homo sapiens
gaaatgtataagctggtctttt

SEQ ID NO: 9358213 - DNA, 22 bp, Homo sapiens
gaaatgtatgtcttcccccatt

SEQ ID NO: 9358214 - DNA, 22 bp, Homo sapiens
gaaatgtatttgacagtccttg

SEQ ID NO: 9358215 - DNA, 22 bp, Homo sapiens
gaaatgtatttgacagtccttg

SEQ ID NO: 9358216 - DNA, 22 bp, Homo sapiens
gaaatattgtactggagatgtt

SEQ ID NO: 9358217 - DNA, 22 bp, Homo sapiens
gaaatgtagaattgcttaactg

SEQ ID NO: 9358218 - DNA, 22 bp, Homo sapiens
gaaatgtaggcataattatttt

SEQ ID NO: 9358219 - DNA, 22 bp, Homo sapiens
gaaatgtagagtatctgaggat

SEQ ID NO: 9358220 - DNA, 22 bp, Homo sapiens
gaaatgtaggcataattatttt

SEQ ID NO: 9358221 - DNA, 22 bp, Homo sapiens
gaaatattgtactggagatgtt

SEQ ID NO: 9358222 - DNA, 22 bp, Homo sapiens
gaaatattgtactggagatgtt

SEQ ID NO: 9358223 - DNA, 22 bp, Homo sapiens
gaaatattgtactggagatgtt

SEQ ID NO: 9358224 - DNA, 22 bp, Homo sapiens
gaaatattgggactcagagctt

SEQ ID NO: 9358225 - DNA, 22 bp, Homo sapiens
gaaatattgggactcagagctt

SEQ ID NO: 9358226 - DNA, 22 bp, Homo sapiens
gaaatattgggactcagagctt

SEQ ID NO: 9358227 - DNA, 22 bp, Homo sapiens
gaaatattgggactcagagctt

SEQ ID NO: 9358228 - DNA, 22 bp, Homo sapiens
gaaatattgtactggagatgtt

SEQ ID NO: 9358229 - DNA, 22 bp, Homo sapiens
gaaatattcttgtcttgttttc

SEQ ID NO: 9358230 - DNA, 22 bp, Homo sapiens
gaaatattcttgtcttgttttc

SEQ ID NO: 9358231 - DNA, 22 bp, Homo sapiens
gaaatattcttgtcttgttttc

SEQ ID NO: 9358232 - DNA, 22 bp, Homo sapiens
gaaatattacagtggaggggat

SEQ ID NO: 9358233 - DNA, 22 bp, Homo sapiens
gaaatattacagtggaggggat

SEQ ID NO: 9358234 - DNA, 22 bp, Homo sapiens
gaaatattcttgtcttgttttc

SEQ ID NO: 9358235 - DNA, 22 bp, Homo sapiens
gaaatatacattgcaggaagag

SEQ ID NO: 9358236 - DNA, 22 bp, Homo sapiens
gaaatatacattgcaggaagag

SEQ ID NO: 9358237 - DNA, 22 bp, Homo sapiens
gaaatattacagtggaggggat

SEQ ID NO: 9358238 - DNA, 22 bp, Homo sapiens
gaaatattacagtggaggggat

SEQ ID NO: 9358239 - DNA, 22 bp, Homo sapiens
gaaagacatagttgcaagatgg

SEQ ID NO: 9358240 - DNA, 22 bp, Homo sapiens
gaaagactaactagaaagtgca

SEQ ID NO: 9358241 - DNA, 22 bp, Homo sapiens
gaaatatacattgcaggaagag

SEQ ID NO: 9358242 - DNA, 22 bp, Homo sapiens
gaaatacaggaatgccacacag

SEQ ID NO: 9358243 - DNA, 22 bp, Homo sapiens
gaaatacaggaatgccacacag

SEQ ID NO: 9358244 - DNA, 22 bp, Homo sapiens
gaaagacttcctttgagagtac

SEQ ID NO: 9358245 - DNA, 22 bp, Homo sapiens
gaaagagaacctgggcctagat

SEQ ID NO: 9358246 - DNA, 22 bp, Homo sapiens
gaaatacagaaagggctgaatg

SEQ ID NO: 9358247 - DNA, 22 bp, Homo sapiens
gagagaagaacaatgtcattca

SEQ ID NO: 9358248 - DNA, 22 bp, Homo sapiens
gagagaagaaagccatggtcct

SEQ ID NO: 9358249 - DNA, 22 bp, Homo sapiens
gagagaagaaagccatggtcct

SEQ ID NO: 9358250 - DNA, 22 bp, Homo sapiens
gagagaagaatgttccgaggcc

SEQ ID NO: 9358251 - DNA, 22 bp, Homo sapiens
gagagaagaatgttccgaggcc

SEQ ID NO: 9358252 - DNA, 22 bp, Homo sapiens
gagagaagaatgttccgaggcc

SEQ ID NO: 9358253 - DNA, 22 bp, Homo sapiens
gagagaagggacttctacactt

SEQ ID NO: 9358254 - DNA, 22 bp, Homo sapiens
gagagaagggggatatgagcct

SEQ ID NO: 9358255 - DNA, 22 bp, Homo sapiens
gagagaagggacttctacactt

SEQ ID NO: 9358256 - DNA, 22 bp, Homo sapiens
gagagaagggggatatgagcct

SEQ ID NO: 9358257 - DNA, 22 bp, Homo sapiens
gagaagcaatcgtgacatctcc

SEQ ID NO: 9358258 - DNA, 22 bp, Homo sapiens
gagaagcaatcgtgacatctcc

SEQ ID NO: 9358259 - DNA, 22 bp, Homo sapiens
gagaagcaatcagtggccaccc

SEQ ID NO: 9358260 - DNA, 22 bp, Homo sapiens
gagaagcaatcagcagccaccc

SEQ ID NO: 9358261 - DNA, 22 bp, Homo sapiens
gagaagcaatcagcagccaccc

SEQ ID NO: 9358262 - DNA, 22 bp, Homo sapiens
gagaagccgagtcagctgagcc

SEQ ID NO: 9358263 - DNA, 22 bp, Homo sapiens
gagaagcaggtttagcagacaa

SEQ ID NO: 9358264 - DNA, 22 bp, Homo sapiens
gagaagcaggtttagcagacaa

SEQ ID NO: 9358265 - DNA, 22 bp, Homo sapiens
gagaagcaggtttagcagacaa

SEQ ID NO: 9358266 - DNA, 22 bp, Homo sapiens
gagaagcaggtttagcagacaa

SEQ ID NO: 9358267 - DNA, 22 bp, Homo sapiens
gagaagcaatttccaactgtgc

SEQ ID NO: 9358268 - DNA, 22 bp, Homo sapiens
gagaagcaatttccaactgtgc

SEQ ID NO: 9358269 - DNA, 19 bp, Homo sapiens
gactccaactttaagcatg

SEQ ID NO: 9358270 - DNA, 22 bp, Homo sapiens
gactcagatttagagggtaaga

SEQ ID NO: 9358271 - DNA, 19 bp, Homo sapiens
gactcacaccttccgctgt

SEQ ID NO: 9358272 - DNA, 22 bp, Homo sapiens
gactcagagatccctggaggtc

SEQ ID NO: 9358273 - DNA, 22 bp, Homo sapiens
gactcagagatccctggaggtc

SEQ ID NO: 9358274 - DNA, 22 bp, Homo sapiens
gagaacaggctctggagtcaga

SEQ ID NO: 9358275 - DNA, 22 bp, Homo sapiens
gagaaagggataatttgaagag

SEQ ID NO: 9358276 - DNA, 22 bp, Homo sapiens
gagaaagggaacttacagagtg

SEQ ID NO: 9358277 - DNA, 21 bp, Homo sapiens
gagaactgaaccagagcagct

SEQ ID NO: 9358278 - DNA, 22 bp, Homo sapiens
gagaactaatcatgcatggagt

SEQ ID NO: 9358279 - DNA, 22 bp, Homo sapiens
gagaagaacttgggcaaagtca

SEQ ID NO: 9358280 - DNA, 22 bp, Homo sapiens
gagaagaacttgggcaaagtca

SEQ ID NO: 9358281 - DNA, 16 bp, Homo sapiens
gagaagagcccggcag

SEQ ID NO: 9358282 - DNA, 22 bp, Homo sapiens
gagagagaaccccgtgcccttc

SEQ ID NO: 9358283 - DNA, 22 bp, Homo sapiens
gagagagaaggcctgtgggtgt

SEQ ID NO: 9358284 - DNA, 22 bp, Homo sapiens
gagagagaaggcctgtgggtgt

SEQ ID NO: 9358285 - DNA, 22 bp, Homo sapiens
gagagagaaggcctgtgggtgt

SEQ ID NO: 9358286 - DNA, 22 bp, Homo sapiens
gagagcagactctcaaagctgg

SEQ ID NO: 9358287 - DNA, 22 bp, Homo sapiens
gagagactgatgtggctatgta

SEQ ID NO: 9358288 - DNA, 22 bp, Homo sapiens
gagagagaaaatgactccggac

SEQ ID NO: 9358289 - DNA, 22 bp, Homo sapiens
gagagacagcagaacgtgcagc

SEQ ID NO: 9358290 - DNA, 22 bp, Homo sapiens
gagagacagcacacagtgtggg

SEQ ID NO: 9358291 - DNA, 22 bp, Homo sapiens
gagagacagcacacagtgtggg

SEQ ID NO: 9358292 - DNA, 22 bp, Homo sapiens
gagagacagcacacagtgtggg

SEQ ID NO: 9358293 - DNA, 22 bp, Homo sapiens
gagagacagcacacagtgtggg

SEQ ID NO: 9358294 - DNA, 22 bp, Homo sapiens
gagagcaggctctcgggggcca

SEQ ID NO: 9358295 - DNA, 22 bp, Homo sapiens
gagagcaggctctcgggggcca

SEQ ID NO: 9358296 - DNA, 22 bp, Homo sapiens
gagagcaggaggcagcgggacg

SEQ ID NO: 9358297 - DNA, 22 bp, Homo sapiens
gagagccatggtggagatgggg

SEQ ID NO: 9358298 - DNA, 22 bp, Homo sapiens
gagagccatggtggagatgggg

SEQ ID NO: 9358299 - DNA, 22 bp, Homo sapiens
gagagccagcagtaaagacatt

SEQ ID NO: 9358300 - DNA, 22 bp, Homo sapiens
gagaggagtaggctgatggtgc

SEQ ID NO: 9358301 - DNA, 22 bp, Homo sapiens
gagaggagtaggctgatggtgc

SEQ ID NO: 9358302 - DNA, 22 bp, Homo sapiens
gagaggagtaggctgatggtgc

SEQ ID NO: 9358303 - DNA, 22 bp, Homo sapiens
gagaggagtaggctgatggtgc

SEQ ID NO: 9358304 - DNA, 22 bp, Homo sapiens
gagaggagtaggctgatggtgc

SEQ ID NO: 9358305 - DNA, 22 bp, Homo sapiens
gagaggagtaggctgatggtgc

SEQ ID NO: 9358306 - DNA, 22 bp, Homo sapiens
gagaggagtagacactttggtt

SEQ ID NO: 9358307 - DNA, 22 bp, Homo sapiens
gagaggagtagacactttggtt

SEQ ID NO: 9358308 - DNA, 18 bp, Homo sapiens
gagaggagccagaatttt

SEQ ID NO: 9358309 - DNA, 22 bp, Homo sapiens
gagaggaggtggctatgacagc

SEQ ID NO: 9358310 - DNA, 22 bp, Homo sapiens
gagaggaggtggctatgacagc

SEQ ID NO: 9358311 - DNA, 22 bp, Homo sapiens
gagaggagaagcctgcgcttca

SEQ ID NO: 9358312 - DNA, 22 bp, Homo sapiens
gagaggagacttatccagattg

SEQ ID NO: 9358313 - DNA, 18 bp, Homo sapiens
gagaggagccagaatttt

SEQ ID NO: 9358314 - DNA, 22 bp, Homo sapiens
gagaggagacttatccagattg

SEQ ID NO: 9358315 - DNA, 22 bp, Homo sapiens
gagaggagacttatccagattg

SEQ ID NO: 9358316 - DNA, 22 bp, Homo sapiens
gagaggagaagcctgcgcttca

SEQ ID NO: 9358317 - DNA, 22 bp, Homo sapiens
gagagccctcactccttccctg

SEQ ID NO: 9358318 - DNA, 22 bp, Homo sapiens
gagagctgtaatagtcatgtct

SEQ ID NO: 9358319 - DNA, 22 bp, Homo sapiens
gagagccctgctcctatcccag

SEQ ID NO: 9358320 - DNA, 19 bp, Homo sapiens
gagcagcttcctatctggt

SEQ ID NO: 9358321 - DNA, 18 bp, Homo sapiens
gagcagaggctcaactgg

SEQ ID NO: 9358322 - DNA, 23 bp, Homo sapiens
gagcagagcgggcgggggtcctg

SEQ ID NO: 9358323 - DNA, 23 bp, Homo sapiens
gagcagagcgggcgggggtcctg

SEQ ID NO: 9358324 - DNA, 22 bp, Homo sapiens
gagcagagacagtacaactggc

SEQ ID NO: 9358325 - DNA, 22 bp, Homo sapiens
gagcagagaatccagctaagtg

SEQ ID NO: 9358326 - DNA, 22 bp, Homo sapiens
gagcaggaaggccagaagggtc

SEQ ID NO: 9358327 - DNA, 22 bp, Homo sapiens
gagcaggaaggccagaagggtc

SEQ ID NO: 9358328 - DNA, 22 bp, Homo sapiens
gagcaggacgtgggaatgggaa

SEQ ID NO: 9358329 - DNA, 22 bp, Homo sapiens
gagcaggacagcagcttcctgg

SEQ ID NO: 9358330 - DNA, 22 bp, Homo sapiens
gagcaggacagcagcttcctgg

SEQ ID NO: 9358331 - DNA, 22 bp, Homo sapiens
gagcaggaaggccagaagggtc

SEQ ID NO: 9358332 - DNA, 22 bp, Homo sapiens
gagcagcttgcgctgtcttcac

SEQ ID NO: 9358333 - DNA, 22 bp, Homo sapiens
gagcacagtgtgttgtgatttc

SEQ ID NO: 9358334 - DNA, 22 bp, Homo sapiens
gagcacagatcctggagccaca

SEQ ID NO: 9358335 - DNA, 20 bp, Homo sapiens
gagcacagtaatgactgcta

SEQ ID NO: 9358336 - DNA, 22 bp, Homo sapiens
gagcacctcaatttgctatttg

SEQ ID NO: 9358337 - DNA, 22 bp, Homo sapiens
gagcactgatttatttttgtct

SEQ ID NO: 9358338 - DNA, 18 bp, Homo sapiens
gagcactggtgttgaggt

SEQ ID NO: 9358339 - DNA, 22 bp, Homo sapiens
gagcactgatttatttttgtct

SEQ ID NO: 9358340 - DNA, 22 bp, Homo sapiens
gagcacttaatcctgttattca

SEQ ID NO: 9358341 - DNA, 22 bp, Homo sapiens
gagcagaaagttatgtcttgca

SEQ ID NO: 9358342 - DNA, 22 bp, Homo sapiens
gagcagaacaggccgggtggga

SEQ ID NO: 9358343 - DNA, 22 bp, Homo sapiens
gagcagacgctgcagtcttggg

SEQ ID NO: 9358344 - DNA, 22 bp, Homo sapiens
gagcagagaatccagctaagtg

SEQ ID NO: 9358345 - DNA, 22 bp, Homo sapiens
gagcaaggtagctctctggggc

SEQ ID NO: 9358346 - DNA, 22 bp, Homo sapiens
gagcaaggagggtggggccttt

SEQ ID NO: 9358347 - DNA, 22 bp, Homo sapiens
gagcaaggatggccggggccgt

SEQ ID NO: 9358348 - DNA, 22 bp, Homo sapiens
gagcacacagtgtgcctgtgta

SEQ ID NO: 9358349 - DNA, 22 bp, Homo sapiens
gagcacacagtgtgcctgtgta

SEQ ID NO: 9358350 - DNA, 22 bp, Homo sapiens
gagcacagaactaaatgctggt

SEQ ID NO: 9358351 - DNA, 22 bp, Homo sapiens
gagcacagaactaaatgctggt

SEQ ID NO: 9358352 - DNA, 22 bp, Homo sapiens
gagcaatagcaccaattaactc

SEQ ID NO: 9358353 - DNA, 22 bp, Homo sapiens
gagcaatagaaagaatactgct

SEQ ID NO: 9358354 - DNA, 22 bp, Homo sapiens
gagcaatacatggcatgaaatt

SEQ ID NO: 9358355 - DNA, 22 bp, Homo sapiens
gagcacagatcctggagccaca

SEQ ID NO: 9358356 - DNA, 22 bp, Homo sapiens
gagcacagatcctggagccaca

SEQ ID NO: 9358357 - DNA, 22 bp, Homo sapiens
gagcacagaatcttcccatgca

SEQ ID NO: 9358358 - DNA, 22 bp, Homo sapiens
gagcacagaatcttcccatgca

SEQ ID NO: 9358359 - DNA, 22 bp, Homo sapiens
gagcacagaatcttcccatgca

SEQ ID NO: 9358360 - DNA, 22 bp, Homo sapiens
gagcaaagcttttagggccttt

SEQ ID NO: 9358361 - DNA, 22 bp, Homo sapiens
gagcaaagcttttagggccttt

SEQ ID NO: 9358362 - DNA, 22 bp, Homo sapiens
gagcaaagcttttagggccttt

SEQ ID NO: 9358363 - DNA, 22 bp, Homo sapiens
gagcaaaataaattctgacaaa

SEQ ID NO: 9358364 - DNA, 22 bp, Homo sapiens
gagatttttcaacaagaatagg

SEQ ID NO: 9358365 - DNA, 22 bp, Homo sapiens
gagcaacactccacattgctag

SEQ ID NO: 9358366 - DNA, 22 bp, Homo sapiens
gagatttattgacttaacagta

SEQ ID NO: 9358367 - DNA, 22 bp, Homo sapiens
gagatttaggggggaagatacg

SEQ ID NO: 9358368 - DNA, 22 bp, Homo sapiens
gagaggcaggcgctgcaatggt

SEQ ID NO: 9358369 - DNA, 22 bp, Homo sapiens
gagaggcaggcgctgcaatggt

SEQ ID NO: 9358370 - DNA, 22 bp, Homo sapiens
gagattttcagcttgactggga

SEQ ID NO: 9358371 - DNA, 22 bp, Homo sapiens
gagatttccatattttgtaaca

SEQ ID NO: 9358372 - DNA, 22 bp, Homo sapiens
gagatttcttttgatgcctgtc

SEQ ID NO: 9358373 - DNA, 20 bp, Homo sapiens
gagatttccaatcatgccca

SEQ ID NO: 9358374 - DNA, 22 bp, Homo sapiens
gagatttcacccctcttaacct

SEQ ID NO: 9358375 - DNA, 22 bp, Homo sapiens
gagaggagtccctatcacagtt

SEQ ID NO: 9358376 - DNA, 22 bp, Homo sapiens
gagaggcagaggcctgaaaccg

SEQ ID NO: 9358377 - DNA, 22 bp, Homo sapiens
gagaggcagaggcctgaaaccg

SEQ ID NO: 9358378 - DNA, 22 bp, Homo sapiens
gagaggcagaggcctgaaaccg

SEQ ID NO: 9358379 - DNA, 22 bp, Homo sapiens
gacctggcctgcacagccctta

SEQ ID NO: 9358380 - DNA, 22 bp, Homo sapiens
gacctggggtaagcttggcaac

SEQ ID NO: 9358381 - DNA, 22 bp, Homo sapiens
gacctggggtaagcttggcaac

SEQ ID NO: 9358382 - DNA, 22 bp, Homo sapiens
gaccttcttgctgtgtcctaac

SEQ ID NO: 9358383 - DNA, 22 bp, Homo sapiens
gactacaggtgtgtgccaccat

SEQ ID NO: 9358384 - DNA, 19 bp, Homo sapiens
gactacagggggaagaagt

SEQ ID NO: 9358385 - DNA, 19 bp, Homo sapiens
gactacagggggaagaagt

SEQ ID NO: 9358386 - DNA, 22 bp, Homo sapiens
gactaggggcagcgtgggagct

SEQ ID NO: 9358387 - DNA, 22 bp, Homo sapiens
gactatgtaatggatggcatga

SEQ ID NO: 9358388 - DNA, 22 bp, Homo sapiens
gactatgtgtgctttgtgaatg

SEQ ID NO: 9358389 - DNA, 22 bp, Homo sapiens
gactattacatgctttcaagac

SEQ ID NO: 9358390 - DNA, 22 bp, Homo sapiens
gactatttagtttcagattagt

SEQ ID NO: 9358391 - DNA, 22 bp, Homo sapiens
gacctggaagaactgaggcctt

SEQ ID NO: 9358392 - DNA, 22 bp, Homo sapiens
gacctggaagatggtcctcacc

SEQ ID NO: 9358393 - DNA, 22 bp, Homo sapiens
gacctggaatgaagggtccctc

SEQ ID NO: 9358394 - DNA, 22 bp, Homo sapiens
gacctggaatttgtgtgtgttc

SEQ ID NO: 9358395 - DNA, 22 bp, Homo sapiens
gacctggaatttgtgtgtgttc

SEQ ID NO: 9358396 - DNA, 22 bp, Homo sapiens
gacctggaatttgtgtgtgttc

SEQ ID NO: 9358397 - DNA, 22 bp, Homo sapiens
gacctggattcaaattcagact

SEQ ID NO: 9358398 - DNA, 22 bp, Homo sapiens
gacctggactgagttagatggc

SEQ ID NO: 9358399 - DNA, 22 bp, Homo sapiens
gacatgtgagcaagcgtgcggc

SEQ ID NO: 9358400 - DNA, 22 bp, Homo sapiens
gacatgtgctgtctcttaaatt

SEQ ID NO: 9358401 - DNA, 22 bp, Homo sapiens
gacatgtgtctgcaagttgatc

SEQ ID NO: 9358402 - DNA, 22 bp, Homo sapiens
gacattaaatgtcttagttgcc

SEQ ID NO: 9358403 - DNA, 22 bp, Homo sapiens
gacattaatttctttggtaatt

SEQ ID NO: 9358404 - DNA, 22 bp, Homo sapiens
gacattaatggcaaattaatta

SEQ ID NO: 9358405 - DNA, 22 bp, Homo sapiens
gacctgcccactctgaggacat

SEQ ID NO: 9358406 - DNA, 22 bp, Homo sapiens
gacatgtgagagctcggttttc

SEQ ID NO: 9358407 - DNA, 22 bp, Homo sapiens
gacatgtattagtacatatggt

SEQ ID NO: 9358408 - DNA, 22 bp, Homo sapiens
gacatggcttctaggaagcttt

SEQ ID NO: 9358409 - DNA, 22 bp, Homo sapiens
gacatgcattaagacacactga

SEQ ID NO: 9358410 - DNA, 22 bp, Homo sapiens
gacatgcatgaatgcaggtctc

SEQ ID NO: 9358411 - DNA, 22 bp, Homo sapiens
gacatgcatattcactcttctt

SEQ ID NO: 9358412 - DNA, 22 bp, Homo sapiens
gacatgcaacaatttggcattt

SEQ ID NO: 9358413 - DNA, 22 bp, Homo sapiens
gacatgaatgttatactttatt

SEQ ID NO: 9358414 - DNA, 22 bp, Homo sapiens
gacagcagtcctggagttccca

SEQ ID NO: 9358415 - DNA, 22 bp, Homo sapiens
gacagcatccaagagggaggga

SEQ ID NO: 9358416 - DNA, 22 bp, Homo sapiens
gacagcatctgtgtggcaggag

SEQ ID NO: 9358417 - DNA, 22 bp, Homo sapiens
gacagccaggcatagggagtat

SEQ ID NO: 9358418 - DNA, 22 bp, Homo sapiens
gacagcattccatctgcaggtt

SEQ ID NO: 9358419 - DNA, 22 bp, Homo sapiens
gacagccaactggggagggcat

SEQ ID NO: 9358420 - DNA, 22 bp, Homo sapiens
gacagctgcctctgtgtagatc

SEQ ID NO: 9358421 - DNA, 22 bp, Homo sapiens
gacagctgcctctgtgtagatc

SEQ ID NO: 9358422 - DNA, 22 bp, Homo sapiens
gacagctgaacaggtgggataa

SEQ ID NO: 9358423 - DNA, 22 bp, Homo sapiens
gacagctggcagtggaaaggtg

SEQ ID NO: 9358424 - DNA, 22 bp, Homo sapiens
gacagctgaaaaatgtaaggta

SEQ ID NO: 9358425 - DNA, 21 bp, Homo sapiens
gacatccatgtgagtggcagt

SEQ ID NO: 9358426 - DNA, 22 bp, Homo sapiens
gacatccatcatttcctgttga

SEQ ID NO: 9358427 - DNA, 22 bp, Homo sapiens
gacatctgaggccctcagagcc

SEQ ID NO: 9358428 - DNA, 22 bp, Homo sapiens
gacatacagcatggtctatgaa

SEQ ID NO: 9358429 - DNA, 22 bp, Homo sapiens
gacatacatctctggaaaaaaa

SEQ ID NO: 9358430 - DNA, 22 bp, Homo sapiens
gacagctgggaggatgacataa

SEQ ID NO: 9358431 - DNA, 22 bp, Homo sapiens
gacagtcctgcaggttgaactc

SEQ ID NO: 9358432 - DNA, 17 bp, Homo sapiens
gacagctggttcctggc

SEQ ID NO: 9358433 - DNA, 22 bp, Homo sapiens
gacatacaagctggtacctcct

SEQ ID NO: 9358434 - DNA, 19 bp, Homo sapiens
gacagtgcagttgtagtac

SEQ ID NO: 9358435 - DNA, 22 bp, Homo sapiens
gacatacagaatctgcagactt

SEQ ID NO: 9358436 - DNA, 22 bp, Homo sapiens
gaattaattgtgtggtttgaat

SEQ ID NO: 9358437 - DNA, 22 bp, Homo sapiens
gaattacagagttgttaagtca

SEQ ID NO: 9358438 - DNA, 22 bp, Homo sapiens
gaattacaaagtgagacaagct

SEQ ID NO: 9358439 - DNA, 22 bp, Homo sapiens
gaatgtttttcattggtgactc

SEQ ID NO: 9358440 - DNA, 22 bp, Homo sapiens
gaattaaaatagttttggtcga

SEQ ID NO: 9358441 - DNA, 22 bp, Homo sapiens
gaatgtttgtgcagagtcatct

SEQ ID NO: 9358442 - DNA, 22 bp, Homo sapiens
gaatgtttttaggaatgttatg

SEQ ID NO: 9358443 - DNA, 22 bp, Homo sapiens
gaatgtttttataagtgttaca

SEQ ID NO: 9358444 - DNA, 22 bp, Homo sapiens
gaatgtttttcaaacctgtggc

SEQ ID NO: 9358445 - DNA, 22 bp, Homo sapiens
gaatgtaaaattgcctacaaga

SEQ ID NO: 9358446 - DNA, 19 bp, Homo sapiens
gaatgtttgtattcagcgc

SEQ ID NO: 9358447 - DNA, 22 bp, Homo sapiens
gaatggcatagctttctttaca

SEQ ID NO: 9358448 - DNA, 22 bp, Homo sapiens
gaagaatctgaggacagtcatt

SEQ ID NO: 9358449 - DNA, 22 bp, Homo sapiens
gaagaaggtgccagaggcttac

SEQ ID NO: 9358450 - DNA, 22 bp, Homo sapiens
gaagaaggtgctacacagggca

SEQ ID NO: 9358451 - DNA, 22 bp, Homo sapiens
gaagaaggtggcccaggggtag

SEQ ID NO: 9358452 - DNA, 21 bp, Homo sapiens
gaagacaaatgggaatagctg

SEQ ID NO: 9358453 - DNA, 22 bp, Homo sapiens
gaatgcagatggctggtgtatg

SEQ ID NO: 9358454 - DNA, 22 bp, Homo sapiens
gaatgcagctgacagtcgtttt

SEQ ID NO: 9358455 - DNA, 22 bp, Homo sapiens
gaatgcagatggctggtgtatg

SEQ ID NO: 9358456 - DNA, 22 bp, Homo sapiens
gaatgctaagcatgtgggagtt

SEQ ID NO: 9358457 - DNA, 22 bp, Homo sapiens
gaatgctaagcatgtgggagtt

SEQ ID NO: 9358458 - DNA, 22 bp, Homo sapiens
gaatgcattctcttagcatcta

SEQ ID NO: 9358459 - DNA, 22 bp, Homo sapiens
gaatgcagtgacggaggcttac

SEQ ID NO: 9358460 - DNA, 22 bp, Homo sapiens
gaatgcagtggtgagatcttgg

SEQ ID NO: 9358461 - DNA, 22 bp, Homo sapiens
gaatgcattccacggtagtgat

SEQ ID NO: 9358462 - DNA, 22 bp, Homo sapiens
gaatgcatgtgaagcaaagaat

SEQ ID NO: 9358463 - DNA, 22 bp, Homo sapiens
gaatttatctacgttaagtatg

SEQ ID NO: 9358464 - DNA, 22 bp, Homo sapiens
gaatttaaggaccaagcatttt

SEQ ID NO: 9358465 - DNA, 22 bp, Homo sapiens
gaatttacaagttgaataacaa

SEQ ID NO: 9358466 - DNA, 22 bp, Homo sapiens
gaatttacagggtgagcttcag

SEQ ID NO: 9358467 - DNA, 22 bp, Homo sapiens
gacaaaacacattagtttaaaa

SEQ ID NO: 9358468 - DNA, 22 bp, Homo sapiens
gacaaaacacattagtttaaaa

SEQ ID NO: 9358469 - DNA, 22 bp, Homo sapiens
gacaaaactgagatcacactgt

SEQ ID NO: 9358470 - DNA, 22 bp, Homo sapiens
gacaaaactgagatcacactgt

SEQ ID NO: 9358471 - DNA, 21 bp, Homo sapiens
gacaaacatttcatagcttta

SEQ ID NO: 9358472 - DNA, 22 bp, Homo sapiens
gacaaagagaagtaacagtacc

SEQ ID NO: 9358473 - DNA, 22 bp, Homo sapiens
gacaacaataatgtggagctga

SEQ ID NO: 9358474 - DNA, 22 bp, Homo sapiens
gacagcaggagatcatgataga

SEQ ID NO: 9358475 - DNA, 22 bp, Homo sapiens
gacaacagcatatggactgtca

SEQ ID NO: 9358476 - DNA, 20 bp, Homo sapiens
gacaacagagtaccaggaag

SEQ ID NO: 9358477 - DNA, 22 bp, Homo sapiens
gagggtgggctcctatctgggt

SEQ ID NO: 9358478 - DNA, 22 bp, Homo sapiens
gagggtgggccagatatgaggg

SEQ ID NO: 9358479 - DNA, 22 bp, Homo sapiens
gagggtgggccagatatgaggg

SEQ ID NO: 9358480 - DNA, 22 bp, Homo sapiens
gagggtggggaatagactgcta

SEQ ID NO: 9358481 - DNA, 22 bp, Homo sapiens
gagggtggggaatagactgcta

SEQ ID NO: 9358482 - DNA, 22 bp, Homo sapiens
gagggtggggaatagactgcta

SEQ ID NO: 9358483 - DNA, 22 bp, Homo sapiens
gagggtgggtacaccagccctc

SEQ ID NO: 9358484 - DNA, 22 bp, Homo sapiens
gagggtgggtacaccagccctc

SEQ ID NO: 9358485 - DNA, 22 bp, Homo sapiens
gaggtctgccttcaggagagtt

SEQ ID NO: 9358486 - DNA, 22 bp, Homo sapiens
gaggtctgccttcaggagagtt

SEQ ID NO: 9358487 - DNA, 22 bp, Homo sapiens
gaggtctggaccaagtcgcccc

SEQ ID NO: 9358488 - DNA, 22 bp, Homo sapiens
gaggtctgcttatctctcacag

SEQ ID NO: 9358489 - DNA, 22 bp, Homo sapiens
gaggtctgggatggggcctgaa

SEQ ID NO: 9358490 - DNA, 22 bp, Homo sapiens
gaggtctgggcttgggcctggt

SEQ ID NO: 9358491 - DNA, 22 bp, Homo sapiens
gaggtctgtgtcactttagtgc

SEQ ID NO: 9358492 - DNA, 22 bp, Homo sapiens
gaggtctgtgtcactttagtgc

SEQ ID NO: 9358493 - DNA, 22 bp, Homo sapiens
gagggtggtggcttaaggtgct

SEQ ID NO: 9358494 - DNA, 22 bp, Homo sapiens
gaggtctcactatgttgcccag

SEQ ID NO: 9358495 - DNA, 22 bp, Homo sapiens
gaggtctgagtgcggaaagcct

SEQ ID NO: 9358496 - DNA, 22 bp, Homo sapiens
gagggtgtctcacgtgaaagta

SEQ ID NO: 9358497 - DNA, 22 bp, Homo sapiens
gagggtggcctttagagcccat

SEQ ID NO: 9358498 - DNA, 22 bp, Homo sapiens
gagggtggcctttagagcccat

SEQ ID NO: 9358499 - DNA, 22 bp, Homo sapiens
gagggtggctcctccctgggcc

SEQ ID NO: 9358500 - DNA, 22 bp, Homo sapiens
gagggtggcctttagagcccat

SEQ ID NO: 9358501 - DNA, 22 bp, Homo sapiens
gagggtggagctccagaatctg

SEQ ID NO: 9358502 - DNA, 22 bp, Homo sapiens
gagggtggaagagctgctgaga

SEQ ID NO: 9358503 - DNA, 22 bp, Homo sapiens
gagggtggaagagctgctgaga

SEQ ID NO: 9358504 - DNA, 22 bp, Homo sapiens
gagggtggaagagctgctgaga

SEQ ID NO: 9358505 - DNA, 22 bp, Homo sapiens
gagggctgatgttgccacctca

SEQ ID NO: 9358506 - DNA, 22 bp, Homo sapiens
gagggtcttacctaagcagggt

SEQ ID NO: 9358507 - DNA, 22 bp, Homo sapiens
gagggtctcttaatgccagggg

SEQ ID NO: 9358508 - DNA, 22 bp, Homo sapiens
gagggctgataacaggaataca

SEQ ID NO: 9358509 - DNA, 22 bp, Homo sapiens
gagggctgatgcttacttattt

SEQ ID NO: 9358510 - DNA, 22 bp, Homo sapiens
gagggctgatgcttacttattt

SEQ ID NO: 9358511 - DNA, 22 bp, Homo sapiens
gagggtgcagctgggccccacg

SEQ ID NO: 9358512 - DNA, 22 bp, Homo sapiens
gagggtgcaggaggatggtagt

SEQ ID NO: 9358513 - DNA, 22 bp, Homo sapiens
gaggtggctccttcagggaata

SEQ ID NO: 9358514 - DNA, 22 bp, Homo sapiens
gaggtggctccttcagggaata

SEQ ID NO: 9358515 - DNA, 22 bp, Homo sapiens
gaggtggctgcttgctgggaaa

SEQ ID NO: 9358516 - DNA, 22 bp, Homo sapiens
gaggtggctccaggagcaatgc

SEQ ID NO: 9358517 - DNA, 22 bp, Homo sapiens
gaggtggctgtcagcttcactt

SEQ ID NO: 9358518 - DNA, 18 bp, Homo sapiens
gaggtggctgggccatct

SEQ ID NO: 9358519 - DNA, 22 bp, Homo sapiens
gaggtggctgcttgctgggaaa

SEQ ID NO: 9358520 - DNA, 22 bp, Homo sapiens
gaggtggctggctcagagccag

SEQ ID NO: 9358521 - DNA, 22 bp, Homo sapiens
gaggtgagaagggggtcagatg

SEQ ID NO: 9358522 - DNA, 22 bp, Homo sapiens
gaggtgagaagggggtcagatg

SEQ ID NO: 9358523 - DNA, 22 bp, Homo sapiens
gaggtcttgtctgatagggaaa

SEQ ID NO: 9358524 - DNA, 22 bp, Homo sapiens
gaggtgagtggatcacgaggtc

SEQ ID NO: 9358525 - DNA, 22 bp, Homo sapiens
gaggtgcccttgtgtattgctg

SEQ ID NO: 9358526 - DNA, 22 bp, Homo sapiens
gaggtgcctggcgatgtctctg

SEQ ID NO: 9358527 - DNA, 22 bp, Homo sapiens
gaggtgcctttttgtaattagt

SEQ ID NO: 9358528 - DNA, 22 bp, Homo sapiens
gaggtgctgctgtacttcttgc

SEQ ID NO: 9358529 - DNA, 22 bp, Homo sapiens
gaggtgtctggcctttgtagga

SEQ ID NO: 9358530 - DNA, 23 bp, Homo sapiens
gaggtgtgaattctgggtgctgc

SEQ ID NO: 9358531 - DNA, 23 bp, Homo sapiens
gaggtgtgaattctgggtgctgc

SEQ ID NO: 9358532 - DNA, 23 bp, Homo sapiens
gaggtgtgaattctgggtgctgc

SEQ ID NO: 9358533 - DNA, 22 bp, Homo sapiens
gaggttttaagttgaaggggga

SEQ ID NO: 9358534 - DNA, 22 bp, Homo sapiens
gaggttttaggctgccattatt

SEQ ID NO: 9358535 - DNA, 19 bp, Homo sapiens
gaggtgtctttcctgagta

SEQ ID NO: 9358536 - DNA, 19 bp, Homo sapiens
gaggtgtctttcctgagta

SEQ ID NO: 9358537 - DNA, 19 bp, Homo sapiens
gaggtgtctttcctgagta

SEQ ID NO: 9358538 - DNA, 22 bp, Homo sapiens
gaggtgtctgttaggaataggc

SEQ ID NO: 9358539 - DNA, 22 bp, Homo sapiens
gaggtgtctgttaggaataggc

SEQ ID NO: 9358540 - DNA, 22 bp, Homo sapiens
gaggtgggagggcagtccctaa

SEQ ID NO: 9358541 - DNA, 22 bp, Homo sapiens
gaggtggcttagtctctggaca

SEQ ID NO: 9358542 - DNA, 22 bp, Homo sapiens
gaggtggcttagtctctggaca

SEQ ID NO: 9358543 - DNA, 22 bp, Homo sapiens
gagtaatattctgtactggagg

SEQ ID NO: 9358544 - DNA, 22 bp, Homo sapiens
gagtaaaagttggattacaaag

SEQ ID NO: 9358545 - DNA, 22 bp, Homo sapiens
gagtaattttcttaaaacatca

SEQ ID NO: 9358546 - DNA, 22 bp, Homo sapiens
gagtaatttatccagtgaagta

SEQ ID NO: 9358547 - DNA, 22 bp, Homo sapiens
gagggaagaggcctgacatttt

SEQ ID NO: 9358548 - DNA, 22 bp, Homo sapiens
gagggaaggacccattttaagt

SEQ ID NO: 9358549 - DNA, 22 bp, Homo sapiens
gagggaagtcataatgttctag

SEQ ID NO: 9358550 - DNA, 22 bp, Homo sapiens
gaggctgtaacttgggcactgg

SEQ ID NO: 9358551 - DNA, 22 bp, Homo sapiens
gaggctgtaacttgggcactgg

SEQ ID NO: 9358552 - DNA, 22 bp, Homo sapiens
gaggctggtttgccttttggca

SEQ ID NO: 9358553 - DNA, 22 bp, Homo sapiens
gaggctgtctgttagcctggga

SEQ ID NO: 9358554 - DNA, 21 bp, Homo sapiens
gaggctgtctgctgctggcct

SEQ ID NO: 9358555 - DNA, 22 bp, Homo sapiens
gagggacagctaaagagaaatt

SEQ ID NO: 9358556 - DNA, 22 bp, Homo sapiens
gagggagaaggactatcaggct

SEQ ID NO: 9358557 - DNA, 22 bp, Homo sapiens
gagggccagagtcctggggtca

SEQ ID NO: 9358558 - DNA, 22 bp, Homo sapiens
gagggccacgttcagggctctc

SEQ ID NO: 9358559 - DNA, 22 bp, Homo sapiens
gagggagaattgcagccagcgt

SEQ ID NO: 9358560 - DNA, 22 bp, Homo sapiens
gagggccaatgtgtccctgagc

SEQ ID NO: 9358561 - DNA, 22 bp, Homo sapiens
gagggctgaagtgttttatgag

SEQ ID NO: 9358562 - DNA, 22 bp, Homo sapiens
gagggctgaagtgttttatgag

SEQ ID NO: 9358563 - DNA, 22 bp, Homo sapiens
gagggctgaagtgttttatgag

SEQ ID NO: 9358564 - DNA, 22 bp, Homo sapiens
gagggctgataaatgcgcatgg

SEQ ID NO: 9358565 - DNA, 22 bp, Homo sapiens
gagggctgataaatgcgcatgg

SEQ ID NO: 9358566 - DNA, 22 bp, Homo sapiens
gagggctgataaatgcgcatgg

SEQ ID NO: 9358567 - DNA, 22 bp, Homo sapiens
gagggctgataaatgcgcatgg

SEQ ID NO: 9358568 - DNA, 22 bp, Homo sapiens
gagggctgataaatgcgcatgg

SEQ ID NO: 9358569 - DNA, 22 bp, Homo sapiens
gagggctgataaatgcgcatgg

SEQ ID NO: 9358570 - DNA, 22 bp, Homo sapiens
gagggctgataaatgcgcatgg

SEQ ID NO: 9358571 - DNA, 22 bp, Homo sapiens
gagggctgataacaggaataca

SEQ ID NO: 9358572 - DNA, 22 bp, Homo sapiens
gagggctgataacaggaataca

SEQ ID NO: 9358573 - DNA, 22 bp, Homo sapiens
gagggctgataacaggaataca

SEQ ID NO: 9358574 - DNA, 22 bp, Homo sapiens
gagggccattctgagggggtga

SEQ ID NO: 9358575 - DNA, 22 bp, Homo sapiens
gagggccaggtagatatcagga

SEQ ID NO: 9358576 - DNA, 22 bp, Homo sapiens
gagggcctactggacatgtcag

SEQ ID NO: 9358577 - DNA, 22 bp, Homo sapiens
gagggccctggcttcttgctgg

SEQ ID NO: 9358578 - DNA, 22 bp, Homo sapiens
gagggcctctgctgctccacat

SEQ ID NO: 9358579 - DNA, 22 bp, Homo sapiens
gagggccagatcccaggaggaa

SEQ ID NO: 9358580 - DNA, 22 bp, Homo sapiens
gagggccagcagcctcagcatg

SEQ ID NO: 9358581 - DNA, 22 bp, Homo sapiens
gagggccagcagcctcagcatg

SEQ ID NO: 9358582 - DNA, 22 bp, Homo sapiens
gagggccaggcggagacaggcg

SEQ ID NO: 9358583 - DNA, 22 bp, Homo sapiens
gagggccagcctgccaagggcc

SEQ ID NO: 9358584 - DNA, 22 bp, Homo sapiens
gaggctggtggttagttccatt

SEQ ID NO: 9358585 - DNA, 22 bp, Homo sapiens
gaggctggtaggaaaggaaaca

SEQ ID NO: 9358586 - DNA, 22 bp, Homo sapiens
gaggctggtaggaaaggaaaca

SEQ ID NO: 9358587 - DNA, 22 bp, Homo sapiens
gaggctggtaggaaaggaaaca

SEQ ID NO: 9358588 - DNA, 22 bp, Homo sapiens
gaggctggtcagccctaagatc

SEQ ID NO: 9358589 - DNA, 22 bp, Homo sapiens
gaggctggttctgaagtactgt

SEQ ID NO: 9358590 - DNA, 22 bp, Homo sapiens
gaggctggtttgccttttggca

SEQ ID NO: 9358591 - DNA, 22 bp, Homo sapiens
gaggctggttctgaagtactgt

SEQ ID NO: 9358592 - DNA, 22 bp, Homo sapiens
gaggctggttctgaagtactgt

SEQ ID NO: 9358593 - DNA, 22 bp, Homo sapiens
gaggctggttctgaagtactgt

SEQ ID NO: 9358594 - DNA, 22 bp, Homo sapiens
gaggctggttcccttgatcttt

SEQ ID NO: 9358595 - DNA, 22 bp, Homo sapiens
gaggctggggtctgcctttctg

SEQ ID NO: 9358596 - DNA, 22 bp, Homo sapiens
gaggctcaaacctggacagagc

SEQ ID NO: 9358597 - DNA, 22 bp, Homo sapiens
gaggctcaaacctggacagagc

SEQ ID NO: 9358598 - DNA, 22 bp, Homo sapiens
gaggctggtaggaaaggaaaca

SEQ ID NO: 9358599 - DNA, 22 bp, Homo sapiens
gaggctggtaggaaaggaaaca

SEQ ID NO: 9358600 - DNA, 22 bp, Homo sapiens
gaggctggggtctgcctttctg

SEQ ID NO: 9358601 - DNA, 22 bp, Homo sapiens
gaggctggggtctgcctttctg

SEQ ID NO: 9358602 - DNA, 22 bp, Homo sapiens
gaggctggtaggaaaggaaaca

SEQ ID NO: 9358603 - DNA, 22 bp, Homo sapiens
gaggcggccagcgaggccgcaa

SEQ ID NO: 9358604 - DNA, 22 bp, Homo sapiens
gaggctcaaacctggacagagc

SEQ ID NO: 9358605 - DNA, 22 bp, Homo sapiens
gaggcctggtttgcatgagaat

SEQ ID NO: 9358606 - DNA, 22 bp, Homo sapiens
gaggcctggtttccagcatcct

SEQ ID NO: 9358607 - DNA, 22 bp, Homo sapiens
gaggcctggtttgcatgagaat

SEQ ID NO: 9358608 - DNA, 22 bp, Homo sapiens
gaggcctggtttgcatgagaat

SEQ ID NO: 9358609 - DNA, 22 bp, Homo sapiens
gaggcctgtagtcatggatgta

SEQ ID NO: 9358610 - DNA, 22 bp, Homo sapiens
gaggcctggtctatgagatgtt

SEQ ID NO: 9358611 - DNA, 22 bp, Homo sapiens
gaggcctggtgtgtctcccgct

SEQ ID NO: 9358612 - DNA, 22 bp, Homo sapiens
gaggcctggtgctgtgtccaca

SEQ ID NO: 9358613 - DNA, 22 bp, Homo sapiens
gaggcctggtgtgtctcccgct

SEQ ID NO: 9358614 - DNA, 22 bp, Homo sapiens
gaggcctggtctatgagatgtt

SEQ ID NO: 9358615 - DNA, 22 bp, Homo sapiens
gaggcctggtgctgtgtccaca

SEQ ID NO: 9358616 - DNA, 22 bp, Homo sapiens
gaggcctggtgctgtgtccaca

SEQ ID NO: 9358617 - DNA, 19 bp, Homo sapiens
gaggcgaggcgtgcaggag

SEQ ID NO: 9358618 - DNA, 19 bp, Homo sapiens
gaggcgaggcgtgcaggag

SEQ ID NO: 9358619 - DNA, 18 bp, Homo sapiens
gaggcgagctcttcagaa

SEQ ID NO: 9358620 - DNA, 22 bp, Homo sapiens
gaggcctgtagtcatggatgta

SEQ ID NO: 9358621 - DNA, 22 bp, Homo sapiens
gaggcctgtcgctaggcctctg

SEQ ID NO: 9358622 - DNA, 22 bp, Homo sapiens
gaggcctgtcgctaggcctctg

SEQ ID NO: 9358623 - DNA, 22 bp, Homo sapiens
gaggcctgtcgctaggcctctg

SEQ ID NO: 9358624 - DNA, 22 bp, Homo sapiens
gaggccttcacttatttaaggg

SEQ ID NO: 9358625 - DNA, 22 bp, Homo sapiens
gaggcctgtcgctaggcctctg

SEQ ID NO: 9358626 - DNA, 22 bp, Homo sapiens
gagctcagaggattctggggag

SEQ ID NO: 9358627 - DNA, 22 bp, Homo sapiens
gagctcagaggcgtctttgtcc

SEQ ID NO: 9358628 - DNA, 22 bp, Homo sapiens
gagctcagagcctatagttggt

SEQ ID NO: 9358629 - DNA, 22 bp, Homo sapiens
gagcaggctctgcctgtgtgtc

SEQ ID NO: 9358630 - DNA, 22 bp, Homo sapiens
gagcaggctctgcctgtgtgtc

SEQ ID NO: 9358631 - DNA, 22 bp, Homo sapiens
gagctcagactcgggcctgggg

SEQ ID NO: 9358632 - DNA, 22 bp, Homo sapiens
gagcaggctctgcctgtgtgtc

SEQ ID NO: 9358633 - DNA, 22 bp, Homo sapiens
gagcaggcctggggtgaggcct

SEQ ID NO: 9358634 - DNA, 22 bp, Homo sapiens
gagcaggccagcaatggaaggg

SEQ ID NO: 9358635 - DNA, 22 bp, Homo sapiens
gagcaggccagcaatggaaggg

SEQ ID NO: 9358636 - DNA, 22 bp, Homo sapiens
gagcaggcctggggtgaggcct

SEQ ID NO: 9358637 - DNA, 22 bp, Homo sapiens
gagcaggcaaagatgaaaggag

SEQ ID NO: 9358638 - DNA, 22 bp, Homo sapiens
gagcaggcaactctgcagtgcc

SEQ ID NO: 9358639 - DNA, 22 bp, Homo sapiens
gagcaggcaaagatgaaaggag

SEQ ID NO: 9358640 - DNA, 22 bp, Homo sapiens
gagcaggatggcacttctgtga

SEQ ID NO: 9358641 - DNA, 22 bp, Homo sapiens
gagcaggatgggagctggggcc

SEQ ID NO: 9358642 - DNA, 22 bp, Homo sapiens
gagcaggcaactctgcagtgcc

SEQ ID NO: 9358643 - DNA, 22 bp, Homo sapiens
gagcaggcattctagtggctga

SEQ ID NO: 9358644 - DNA, 19 bp, Homo sapiens
gagcaggccacacatgtgt

SEQ ID NO: 9358645 - DNA, 22 bp, Homo sapiens
gagctccaccaccttcaggcag

SEQ ID NO: 9358646 - DNA, 22 bp, Homo sapiens
gagctcattcattcattgcctg

SEQ ID NO: 9358647 - DNA, 22 bp, Homo sapiens
gagctccagcatctctgccaaa

SEQ ID NO: 9358648 - DNA, 22 bp, Homo sapiens
gagctccacttagcaaggccac

SEQ ID NO: 9358649 - DNA, 22 bp, Homo sapiens
gagctcagggcattgagcaaga

SEQ ID NO: 9358650 - DNA, 22 bp, Homo sapiens
gagctcagggcattgagcaaga

SEQ ID NO: 9358651 - DNA, 23 bp, Homo sapiens
gagctcaggtagggctcgcccgc

SEQ ID NO: 9358652 - DNA, 22 bp, Homo sapiens
gagctcaggtggtcaaaacaat

SEQ ID NO: 9358653 - DNA, 22 bp, Homo sapiens
gagctcagtgtagtcatggctt

SEQ ID NO: 9358654 - DNA, 22 bp, Homo sapiens
gagctcagtgtagtcatggctt

SEQ ID NO: 9358655 - DNA, 22 bp, Homo sapiens
gagctcatccccatggtccgtc

SEQ ID NO: 9358656 - DNA, 22 bp, Homo sapiens
gagctcagcaaaggtctgtgtg

SEQ ID NO: 9358657 - DNA, 22 bp, Homo sapiens
gagctcagcaaaggtctgtgtg

SEQ ID NO: 9358658 - DNA, 22 bp, Homo sapiens
gagctcagattctggtgtcaga

SEQ ID NO: 9358659 - DNA, 22 bp, Homo sapiens
gagctcagattctggtgtcaga

SEQ ID NO: 9358660 - DNA, 22 bp, Homo sapiens
gagctcagcccaaagagcagtg

SEQ ID NO: 9358661 - DNA, 22 bp, Homo sapiens
gagctcagcactaaaatcatgt

SEQ ID NO: 9358662 - DNA, 22 bp, Homo sapiens
gagctcagcccaaagagcagtg

SEQ ID NO: 9358663 - DNA, 22 bp, Homo sapiens
gagctcagcctgaggcctggct

SEQ ID NO: 9358664 - DNA, 22 bp, Homo sapiens
gagctcaggagcatcagaagaa

SEQ ID NO: 9358665 - DNA, 22 bp, Homo sapiens
gagctcaggagcatcagaagaa

SEQ ID NO: 9358666 - DNA, 22 bp, Homo sapiens
gagctcaggagcatcagaagaa

SEQ ID NO: 9358667 - DNA, 18 bp, Homo sapiens
gagctcagcgtgtttcta

SEQ ID NO: 9358668 - DNA, 22 bp, Homo sapiens
gagctgtgtgcctggatggtct

SEQ ID NO: 9358669 - DNA, 17 bp, Homo sapiens
gaggacagggaagtagg

SEQ ID NO: 9358670 - DNA, 17 bp, Homo sapiens
gaggacagggaagtagg

SEQ ID NO: 9358671 - DNA, 22 bp, Homo sapiens
gagctgtgattggtgtctcact

SEQ ID NO: 9358672 - DNA, 22 bp, Homo sapiens
gagctcctgctgcatcctgcct

SEQ ID NO: 9358673 - DNA, 22 bp, Homo sapiens
gagctcctggattgctcctagg

SEQ ID NO: 9358674 - DNA, 22 bp, Homo sapiens
gagctcctatggtcggtggctc

SEQ ID NO: 9358675 - DNA, 22 bp, Homo sapiens
gagctcctgaaacgttcctgcc

SEQ ID NO: 9358676 - DNA, 22 bp, Homo sapiens
gagctcctcccagggtagcact

SEQ ID NO: 9358677 - DNA, 22 bp, Homo sapiens
gagctgggatttgaacctggga

SEQ ID NO: 9358678 - DNA, 22 bp, Homo sapiens
gagctgggatttgaacctggga

SEQ ID NO: 9358679 - DNA, 22 bp, Homo sapiens
gagctgggattcatctatgtct

SEQ ID NO: 9358680 - DNA, 22 bp, Homo sapiens
gagctgggattcatctatgtct

SEQ ID NO: 9358681 - DNA, 22 bp, Homo sapiens
gagctgggattcatctatgtct

SEQ ID NO: 9358682 - DNA, 22 bp, Homo sapiens
gagctcctggattgctcctagg

SEQ ID NO: 9358683 - DNA, 22 bp, Homo sapiens
gagctctaaccagggacaatta

SEQ ID NO: 9358684 - DNA, 22 bp, Homo sapiens
gagctgggcacacgccacttga

SEQ ID NO: 9358685 - DNA, 22 bp, Homo sapiens
gagctgggtgtttatttgccaa

SEQ ID NO: 9358686 - DNA, 22 bp, Homo sapiens
gagctgggtctccaccttggca

SEQ ID NO: 9358687 - DNA, 22 bp, Homo sapiens
gagctgggtctccaccttggca

SEQ ID NO: 9358688 - DNA, 22 bp, Homo sapiens
gagctgggtatatggctttatg

SEQ ID NO: 9358689 - DNA, 22 bp, Homo sapiens
gagctgggtatatggctttatg

SEQ ID NO: 9358690 - DNA, 22 bp, Homo sapiens
gagctggtcagtttcaggagag

SEQ ID NO: 9358691 - DNA, 22 bp, Homo sapiens
gagctggtgatcagctggagga

SEQ ID NO: 9358692 - DNA, 22 bp, Homo sapiens
gagctggtggtgagaaagctct

SEQ ID NO: 9358693 - DNA, 22 bp, Homo sapiens
gagctggtgatcagctggagga

SEQ ID NO: 9358694 - DNA, 22 bp, Homo sapiens
gaggagagaacattcctccata

SEQ ID NO: 9358695 - DNA, 22 bp, Homo sapiens
gaggagagaagctaacggtgct

SEQ ID NO: 9358696 - DNA, 22 bp, Homo sapiens
gaggagagaacattcctccata

SEQ ID NO: 9358697 - DNA, 22 bp, Homo sapiens
gaggagactgacagcagattct

SEQ ID NO: 9358698 - DNA, 22 bp, Homo sapiens
gaggagagaacattcctccata

SEQ ID NO: 9358699 - DNA, 22 bp, Homo sapiens
gaggactgaaacttacaggaaa

SEQ ID NO: 9358700 - DNA, 21 bp, Homo sapiens
gaggactgcacactctgattg

SEQ ID NO: 9358701 - DNA, 22 bp, Homo sapiens
gaggactgcagatgggtgcatc

SEQ ID NO: 9358702 - DNA, 22 bp, Homo sapiens
gaggagaaagcagtgatttgtg

SEQ ID NO: 9358703 - DNA, 22 bp, Homo sapiens
gaggagacggggtgcctggagc

SEQ ID NO: 9358704 - DNA, 17 bp, Homo sapiens
gaggacagggaagtagg

SEQ ID NO: 9358705 - DNA, 22 bp, Homo sapiens
gaggacagtgtgatctgccagc

SEQ ID NO: 9358706 - DNA, 22 bp, Homo sapiens
gaggacagtgtgatctgccagc

SEQ ID NO: 9358707 - DNA, 22 bp, Homo sapiens
gaggacagtgtgatctgccagc

SEQ ID NO: 9358708 - DNA, 22 bp, Homo sapiens
gaggacagtgtgatctgccagc

SEQ ID NO: 9358709 - DNA, 22 bp, Homo sapiens
gaggaccacagatgagcctgca

SEQ ID NO: 9358710 - DNA, 22 bp, Homo sapiens
gaggacctggaatccaagagtc

SEQ ID NO: 9358711 - DNA, 22 bp, Homo sapiens
gaggactaaaataaattgggga

SEQ ID NO: 9358712 - DNA, 22 bp, Homo sapiens
gaggaccacagatgagcctgca

SEQ ID NO: 9358713 - DNA, 22 bp, Homo sapiens
gaggacatagtggactagggtt

SEQ ID NO: 9358714 - DNA, 22 bp, Homo sapiens
gaggacatagtggactagggtt

SEQ ID NO: 9358715 - DNA, 22 bp, Homo sapiens
gaggacatagtccagatggcaa

SEQ ID NO: 9358716 - DNA, 22 bp, Homo sapiens
gaggaggtggagtcatgcagag

SEQ ID NO: 9358717 - DNA, 22 bp, Homo sapiens
gaggaggttccgggtggagaag

SEQ ID NO: 9358718 - DNA, 22 bp, Homo sapiens
gaggaggttccgggtggagaag

SEQ ID NO: 9358719 - DNA, 22 bp, Homo sapiens
gaggaggtggagtcatgcagag

SEQ ID NO: 9358720 - DNA, 22 bp, Homo sapiens
gaggagagagggactgtctgca

SEQ ID NO: 9358721 - DNA, 22 bp, Homo sapiens
gaggagagagggactgtctgca

SEQ ID NO: 9358722 - DNA, 22 bp, Homo sapiens
gaggagtggagttgctgggttg

SEQ ID NO: 9358723 - DNA, 22 bp, Homo sapiens
gaggagtgccagccgtggagtc

SEQ ID NO: 9358724 - DNA, 22 bp, Homo sapiens
gaggagtctttttagggcctga

SEQ ID NO: 9358725 - DNA, 22 bp, Homo sapiens
gaggagtctttccctaagtcct

SEQ ID NO: 9358726 - DNA, 22 bp, Homo sapiens
gaggaggttgacggcactgtga

SEQ ID NO: 9358727 - DNA, 22 bp, Homo sapiens
gaggagtgggttagtgcttatt

SEQ ID NO: 9358728 - DNA, 18 bp, Homo sapiens
gaggatcagaaatctgta

SEQ ID NO: 9358729 - DNA, 22 bp, Homo sapiens
gaggagtgtattccacaccact

SEQ ID NO: 9358730 - DNA, 20 bp, Homo sapiens
gaggatgcagacagagggca

SEQ ID NO: 9358731 - DNA, 22 bp, Homo sapiens
gaggatcatttgagcctaggag

SEQ ID NO: 9358732 - DNA, 20 bp, Homo sapiens
gaggatgcagacagagggca

SEQ ID NO: 9358733 - DNA, 22 bp, Homo sapiens
gaggatgctgcagtgcaggaca

SEQ ID NO: 9358734 - DNA, 22 bp, Homo sapiens
gaggatgcctgggtcggggaag

SEQ ID NO: 9358735 - DNA, 18 bp, Homo sapiens
gaggatggaaggagatgc

SEQ ID NO: 9358736 - DNA, 18 bp, Homo sapiens
gaggatggaaggagatgc

SEQ ID NO: 9358737 - DNA, 22 bp, Homo sapiens
gaggatggaggcagttagggcc

SEQ ID NO: 9358738 - DNA, 22 bp, Homo sapiens
gaggccactgtccctgccttcc

SEQ ID NO: 9358739 - DNA, 21 bp, Homo sapiens
gaggccactaataggggcaga

SEQ ID NO: 9358740 - DNA, 22 bp, Homo sapiens
gaggccacggttttccttgggg

SEQ ID NO: 9358741 - DNA, 22 bp, Homo sapiens
gaggccacggaagggagctgtg

SEQ ID NO: 9358742 - DNA, 22 bp, Homo sapiens
gaggcatggcctgaggctagga

SEQ ID NO: 9358743 - DNA, 22 bp, Homo sapiens
gaggcatggcctgaggctagga

SEQ ID NO: 9358744 - DNA, 22 bp, Homo sapiens
gaggcatggcctgaggctagga

SEQ ID NO: 9358745 - DNA, 22 bp, Homo sapiens
gaggcatggcctgaggctagga

SEQ ID NO: 9358746 - DNA, 22 bp, Homo sapiens
gaggcatggcctgaggctagga

SEQ ID NO: 9358747 - DNA, 22 bp, Homo sapiens
gaggcatgcagagctggagcag

SEQ ID NO: 9358748 - DNA, 22 bp, Homo sapiens
gaggcatgcagagctggagcag

SEQ ID NO: 9358749 - DNA, 22 bp, Homo sapiens
gaggcatgcagagctggagcag

SEQ ID NO: 9358750 - DNA, 22 bp, Homo sapiens
gaggcaagagaagccagctttc

SEQ ID NO: 9358751 - DNA, 22 bp, Homo sapiens
gaggcaagagaagccagctttc

SEQ ID NO: 9358752 - DNA, 22 bp, Homo sapiens
gaggatggtatgaggcaagcaa

SEQ ID NO: 9358753 - DNA, 22 bp, Homo sapiens
gaggatggtatgaggcaagcaa

SEQ ID NO: 9358754 - DNA, 22 bp, Homo sapiens
gaggatggaggtgtgagctatg

SEQ ID NO: 9358755 - DNA, 22 bp, Homo sapiens
gaggatggaggtgtgagctatg

SEQ ID NO: 9358756 - DNA, 22 bp, Homo sapiens
gaggatggtgagcaggacccag

SEQ ID NO: 9358757 - DNA, 22 bp, Homo sapiens
gaggatggtgagcaggacccag

SEQ ID NO: 9358758 - DNA, 22 bp, Homo sapiens
gaggatgtgtctggtctgggca

SEQ ID NO: 9358759 - DNA, 22 bp, Homo sapiens
gaggccagaatgagtctctggg

SEQ ID NO: 9358760 - DNA, 22 bp, Homo sapiens
gaggccagaatgagtctctggg

SEQ ID NO: 9358761 - DNA, 22 bp, Homo sapiens
gaggccagaatgagtctctggg

SEQ ID NO: 9358762 - DNA, 22 bp, Homo sapiens
gaggccagaatgagtctctggg

SEQ ID NO: 9358763 - DNA, 22 bp, Homo sapiens
gaggccagagttccccgagtca

SEQ ID NO: 9358764 - DNA, 22 bp, Homo sapiens
gaggccagatactctcttctgc

SEQ ID NO: 9358765 - DNA, 22 bp, Homo sapiens
gaggccagagttccccgagtca

SEQ ID NO: 9358766 - DNA, 22 bp, Homo sapiens
gaggccagactgccttttatga

SEQ ID NO: 9358767 - DNA, 22 bp, Homo sapiens
gaggccagagttccccgagtca

SEQ ID NO: 9358768 - DNA, 22 bp, Homo sapiens
gaggcctggaccagccacagag

SEQ ID NO: 9358769 - DNA, 22 bp, Homo sapiens
gaggcctggaattccagcctgg

SEQ ID NO: 9358770 - DNA, 22 bp, Homo sapiens
gaggcctggaattccagcctgg

SEQ ID NO: 9358771 - DNA, 22 bp, Homo sapiens
gaggccagatactctcttctgc

SEQ ID NO: 9358772 - DNA, 22 bp, Homo sapiens
gaggcctggagccgcctaggcg

SEQ ID NO: 9358773 - DNA, 22 bp, Homo sapiens
gaggcctgggttggaggtgcat

SEQ ID NO: 9358774 - DNA, 22 bp, Homo sapiens
gaggcctggagccgcctaggcg

SEQ ID NO: 9358775 - DNA, 22 bp, Homo sapiens
gaggcctggaccagccacagag

SEQ ID NO: 9358776 - DNA, 22 bp, Homo sapiens
gaggcctggaccagccacagag

SEQ ID NO: 9358777 - DNA, 22 bp, Homo sapiens
gaggccagaagtctgagatcag

SEQ ID NO: 9358778 - DNA, 22 bp, Homo sapiens
gaggccagaagtctgagatcag

SEQ ID NO: 9358779 - DNA, 22 bp, Homo sapiens
gaggccagaagtctgagatcag

SEQ ID NO: 9358780 - DNA, 22 bp, Homo sapiens
gaggccagaagtctgagatcag

SEQ ID NO: 9358781 - DNA, 22 bp, Homo sapiens
gaggccagaagtctgagatcag

SEQ ID NO: 9358782 - DNA, 22 bp, Homo sapiens
gaggccagaagtgcctcgggct

SEQ ID NO: 9358783 - DNA, 22 bp, Homo sapiens
gaggccactgtccctgccttcc

SEQ ID NO: 9358784 - DNA, 22 bp, Homo sapiens
gaggccacttcctactggagga

SEQ ID NO: 9358785 - DNA, 22 bp, Homo sapiens
gaggccagaagtctgagatcag

SEQ ID NO: 9358786 - DNA, 22 bp, Homo sapiens
gaggccagaagtctgagatcag

SEQ ID NO: 9358787 - DNA, 22 bp, Homo sapiens
gaggccagaagtctgagatcag

SEQ ID NO: 9358788 - DNA, 22 bp, Homo sapiens
gaggccacttcctactggagga

SEQ ID NO: 9358789 - DNA, 22 bp, Homo sapiens
gaggccagaagtgcctcgggct

SEQ ID NO: 9358790 - DNA, 22 bp, Homo sapiens
gaggccagaagtgcctcgggct

SEQ ID NO: 9358791 - DNA, 22 bp, Homo sapiens
gaggccagaagtgcctcgggct

SEQ ID NO: 9358792 - DNA, 22 bp, Homo sapiens
gaggccagaagtgcctcgggct

SEQ ID NO: 9358793 - DNA, 22 bp, Homo sapiens
gaggccagaagtgcctcgggct

SEQ ID NO: 9358794 - DNA, 22 bp, Homo sapiens
gaggccagaatgagtctctggg

SEQ ID NO: 9358795 - DNA, 22 bp, Homo sapiens
gaggccagaatgagctgaatgc

SEQ ID NO: 9358796 - DNA, 22 bp, Homo sapiens
gaggccagaatgagctgaatgc

SEQ ID NO: 9358797 - DNA, 22 bp, Homo sapiens
gaggccagaatgagctgaatgc

SEQ ID NO: 9358798 - DNA, 22 bp, Homo sapiens
ttagttttctcatctatctcac

SEQ ID NO: 9358799 - DNA, 22 bp, Homo sapiens
ttagtttataattcatttctgt

SEQ ID NO: 9358800 - DNA, 22 bp, Homo sapiens
ttagtttataattcatttctgt

SEQ ID NO: 9358801 - DNA, 22 bp, Homo sapiens
ttagtttcctgtggtgtgaagt

SEQ ID NO: 9358802 - DNA, 22 bp, Homo sapiens
ccttgcctcattgtgcttctcc

SEQ ID NO: 9358803 - DNA, 22 bp, Homo sapiens
ccttgcctcattgtgcttctcc

SEQ ID NO: 9358804 - DNA, 22 bp, Homo sapiens
ccttgccctgagcaggggtcag

SEQ ID NO: 9358805 - DNA, 22 bp, Homo sapiens
ccttgcccgctgcctctgagtt

SEQ ID NO: 9358806 - DNA, 22 bp, Homo sapiens
ccttgcccgctgcctctgagtt

SEQ ID NO: 9358807 - DNA, 22 bp, Homo sapiens
ccttgaaatgttctcactgggg

SEQ ID NO: 9358808 - DNA, 22 bp, Homo sapiens
ccttgagagaagtctgtgcctt

SEQ ID NO: 9358809 - DNA, 22 bp, Homo sapiens
ccttgagaggaacgtggtcatg

SEQ ID NO: 9358810 - DNA, 22 bp, Homo sapiens
ccttgagccagggagctggcag

SEQ ID NO: 9358811 - DNA, 22 bp, Homo sapiens
ccttgagccagggagctggcag

SEQ ID NO: 9358812 - DNA, 22 bp, Homo sapiens
ccttgagaggaacgtggtcatg

SEQ ID NO: 9358813 - DNA, 22 bp, Homo sapiens
ccttgcagacatcagtagtggc

SEQ ID NO: 9358814 - DNA, 21 bp, Homo sapiens
ccttgaggcccaggccaggcc

SEQ ID NO: 9358815 - DNA, 22 bp, Homo sapiens
ccttgcagcatatagagtccct

SEQ ID NO: 9358816 - DNA, 22 bp, Homo sapiens
ccttgcagagcataggagccct

SEQ ID NO: 9358817 - DNA, 22 bp, Homo sapiens
ccttgcagagcataggagccct

SEQ ID NO: 9358818 - DNA, 22 bp, Homo sapiens
ccttgcaggggaacaggcagtg

SEQ ID NO: 9358819 - DNA, 22 bp, Homo sapiens
ccttgcaggggaacaggcagtg

SEQ ID NO: 9358820 - DNA, 22 bp, Homo sapiens
ccttgcagggaaactggaccca

SEQ ID NO: 9358821 - DNA, 22 bp, Homo sapiens
ccttgcagggaaactggaccca

SEQ ID NO: 9358822 - DNA, 22 bp, Homo sapiens
ccttgcatatattatatctttg

SEQ ID NO: 9358823 - DNA, 22 bp, Homo sapiens
ccttgcagttgttactgtagcc

SEQ ID NO: 9358824 - DNA, 22 bp, Homo sapiens
ttataaagtgagaagtgctatg

SEQ ID NO: 9358825 - DNA, 22 bp, Homo sapiens
ttataaagtgagaagtgctatg

SEQ ID NO: 9358826 - DNA, 23 bp, Homo sapiens
ttataaatattttcaggtgtgtt

SEQ ID NO: 9358827 - DNA, 23 bp, Homo sapiens
ttataaatattttcaggtgtgtt

SEQ ID NO: 9358828 - DNA, 23 bp, Homo sapiens
ttataaatattttcaggtgtgtt

SEQ ID NO: 9358829 - DNA, 23 bp, Homo sapiens
ttataaatattttcaggtgtgtt

SEQ ID NO: 9358830 - DNA, 22 bp, Homo sapiens
ttatattagttagacttgctgt

SEQ ID NO: 9358831 - DNA, 22 bp, Homo sapiens
ttatattagttagacttgctgt

SEQ ID NO: 9358832 - DNA, 22 bp, Homo sapiens
ttataacaacagtttactttaa

SEQ ID NO: 9358833 - DNA, 22 bp, Homo sapiens
ttataacatcaatcagagttaa

SEQ ID NO: 9358834 - DNA, 22 bp, Homo sapiens
ttatatttctggtagccttcag

SEQ ID NO: 9358835 - DNA, 22 bp, Homo sapiens
ttatcacttatgagctttttgc

SEQ ID NO: 9358836 - DNA, 22 bp, Homo sapiens
ttatatttctggtagccttcag

SEQ ID NO: 9358837 - DNA, 22 bp, Homo sapiens
ttatcagttgtgtgtatacacg

SEQ ID NO: 9358838 - DNA, 22 bp, Homo sapiens
ccttcaagttcctggtccctgg

SEQ ID NO: 9358839 - DNA, 22 bp, Homo sapiens
ccttcacactttcacttggata

SEQ ID NO: 9358840 - DNA, 22 bp, Homo sapiens
ccttcagccagttttctttgtt

SEQ ID NO: 9358841 - DNA, 22 bp, Homo sapiens
ccttcagcctagaacttgagag

SEQ ID NO: 9358842 - DNA, 22 bp, Homo sapiens
ttacatacttactagatctatg

SEQ ID NO: 9358843 - DNA, 22 bp, Homo sapiens
ttacatacctcatagactcagg

SEQ ID NO: 9358844 - DNA, 22 bp, Homo sapiens
ttacagtttctagtaatacttg

SEQ ID NO: 9358845 - DNA, 22 bp, Homo sapiens
ttacagtttatccaggaagagc

SEQ ID NO: 9358846 - DNA, 22 bp, Homo sapiens
ttacagtttctagtaatacttg

SEQ ID NO: 9358847 - DNA, 22 bp, Homo sapiens
ttacataaaagttcacgtaggc

SEQ ID NO: 9358848 - DNA, 22 bp, Homo sapiens
ttacataacggtatgaaaaatg

SEQ ID NO: 9358849 - DNA, 22 bp, Homo sapiens
ttagcaagaaagattgcagcac

SEQ ID NO: 9358850 - DNA, 22 bp, Homo sapiens
ttagcaaatatcttgaaacagg

SEQ ID NO: 9358851 - DNA, 22 bp, Homo sapiens
ccttcagcctttgtttatcaga

SEQ ID NO: 9358852 - DNA, 22 bp, Homo sapiens
ccttcagcgtcccctttacccg

SEQ ID NO: 9358853 - DNA, 22 bp, Homo sapiens
ttagacagtaaggcttcagttg

SEQ ID NO: 9358854 - DNA, 22 bp, Homo sapiens
ttagacagagctccttgagggc

SEQ ID NO: 9358855 - DNA, 22 bp, Homo sapiens
ttagacaggatgtatgaaagct

SEQ ID NO: 9358856 - DNA, 17 bp, Homo sapiens
ccttagggcagtgtggt

SEQ ID NO: 9358857 - DNA, 21 bp, Homo sapiens
ccttagtcttccacatagtcc

SEQ ID NO: 9358858 - DNA, 22 bp, Homo sapiens
ccttagtgaaacagaggcaatt

SEQ ID NO: 9358859 - DNA, 22 bp, Homo sapiens
ccttagtgtgaggggatacccc

SEQ ID NO: 9358860 - DNA, 22 bp, Homo sapiens
ccttatcacaatggagtgtcac

SEQ ID NO: 9358861 - DNA, 22 bp, Homo sapiens
ccttagtgtgcctgaggcagat

SEQ ID NO: 9358862 - DNA, 22 bp, Homo sapiens
ccttatcacaatggagtgtcac

SEQ ID NO: 9358863 - DNA, 22 bp, Homo sapiens
ccttacctgattgctggcatcc

SEQ ID NO: 9358864 - DNA, 22 bp, Homo sapiens
ttaagcacctatgttgtgccag

SEQ ID NO: 9358865 - DNA, 22 bp, Homo sapiens
ccttaaattctccatttgaaag

SEQ ID NO: 9358866 - DNA, 22 bp, Homo sapiens
ccttaaattctccatttgaaag

SEQ ID NO: 9358867 - DNA, 22 bp, Homo sapiens
ccttaaattctccatttgaaag

SEQ ID NO: 9358868 - DNA, 22 bp, Homo sapiens
ttacagttactggtactgttaa

SEQ ID NO: 9358869 - DNA, 22 bp, Homo sapiens
ttacagttaatgtgactaacca

SEQ ID NO: 9358870 - DNA, 22 bp, Homo sapiens
ttacagttgctacaaaggataa

SEQ ID NO: 9358871 - DNA, 22 bp, Homo sapiens
ttacagtgttacttgatgtcca

SEQ ID NO: 9358872 - DNA, 22 bp, Homo sapiens
ttacagtgtgcaatcccagaat

SEQ ID NO: 9358873 - DNA, 22 bp, Homo sapiens
ttacagtggtcatttgggaaaa

SEQ ID NO: 9358874 - DNA, 22 bp, Homo sapiens
ttacagtttaagaggaaacaaa

SEQ ID NO: 9358875 - DNA, 22 bp, Homo sapiens
ttacagtttacataagaattgt

SEQ ID NO: 9358876 - DNA, 22 bp, Homo sapiens
ttacagttgtagaaagtggttg

SEQ ID NO: 9358877 - DNA, 22 bp, Homo sapiens
ttacagttggtattagaccaaa

SEQ ID NO: 9358878 - DNA, 22 bp, Homo sapiens
ttacagtttaccaagaatattg

SEQ ID NO: 9358879 - DNA, 22 bp, Homo sapiens
ttacagtttagtccaagccaga

SEQ ID NO: 9358880 - DNA, 22 bp, Homo sapiens
ttacagtttacataagaattgt

SEQ ID NO: 9358881 - DNA, 22 bp, Homo sapiens
ttacagtttacataagaattgt

SEQ ID NO: 9358882 - DNA, 22 bp, Homo sapiens
ttacagtttaccaagaatattg

SEQ ID NO: 9358883 - DNA, 22 bp, Homo sapiens
ttacaaagattatattcagtta

SEQ ID NO: 9358884 - DNA, 22 bp, Homo sapiens
ttacaaagcaggtcagctgaaa

SEQ ID NO: 9358885 - DNA, 22 bp, Homo sapiens
ttacaaagcaggtcagctgaaa

SEQ ID NO: 9358886 - DNA, 22 bp, Homo sapiens
ttacaaagcgttgagacaagta

SEQ ID NO: 9358887 - DNA, 22 bp, Homo sapiens
ttaaattttagaaacagactct

SEQ ID NO: 9358888 - DNA, 22 bp, Homo sapiens
ttaagaggagatcatactggag

SEQ ID NO: 9358889 - DNA, 21 bp, Homo sapiens
ttaagagcttagcagtaggcc

SEQ ID NO: 9358890 - DNA, 22 bp, Homo sapiens
ttaagagcaacatatggtgaca

SEQ ID NO: 9358891 - DNA, 22 bp, Homo sapiens
ttaagagccaacttatccatct

SEQ ID NO: 9358892 - DNA, 18 bp, Homo sapiens
ttaagagctgaaagggga

SEQ ID NO: 9358893 - DNA, 22 bp, Homo sapiens
ttaagagggtgatgctagcatt

SEQ ID NO: 9358894 - DNA, 22 bp, Homo sapiens
ttaagaggagatcatactggag

SEQ ID NO: 9358895 - DNA, 22 bp, Homo sapiens
ttaagaggtggtcgtgtctgtg

SEQ ID NO: 9358896 - DNA, 22 bp, Homo sapiens
ttaagaggtgaggcctttaaga

SEQ ID NO: 9358897 - DNA, 22 bp, Homo sapiens
ttaagatagaacccagtagtct

SEQ ID NO: 9358898 - DNA, 22 bp, Homo sapiens
ttaagattttcttcagtattat

SEQ ID NO: 9358899 - DNA, 22 bp, Homo sapiens
ttaaattatttctagtgaggtg

SEQ ID NO: 9358900 - DNA, 22 bp, Homo sapiens
ttaaattgtcatttgagcaatg

SEQ ID NO: 9358901 - DNA, 22 bp, Homo sapiens
ttaaattccagcctcataatag

SEQ ID NO: 9358902 - DNA, 22 bp, Homo sapiens
tgtcagagagcaggcagtagaa

SEQ ID NO: 9358903 - DNA, 20 bp, Homo sapiens
tgtcagataactagctgtta

SEQ ID NO: 9358904 - DNA, 21 bp, Homo sapiens
tgtcagcaacaatactttctc

SEQ ID NO: 9358905 - DNA, 22 bp, Homo sapiens
tgtcagcagaaatctggtctgc

SEQ ID NO: 9358906 - DNA, 22 bp, Homo sapiens
tgtcagcagtttttagtggagg

SEQ ID NO: 9358907 - DNA, 22 bp, Homo sapiens
tgtcagcagctggtttgctgtt

SEQ ID NO: 9358908 - DNA, 22 bp, Homo sapiens
tgtcagcagatctcctgcagcc

SEQ ID NO: 9358909 - DNA, 22 bp, Homo sapiens
ttaaattagtcaagcttctctg

SEQ ID NO: 9358910 - DNA, 22 bp, Homo sapiens
ttaaattagtcaagcttctctg

SEQ ID NO: 9358911 - DNA, 22 bp, Homo sapiens
ccttttcttgccactgactcgg

SEQ ID NO: 9358912 - DNA, 22 bp, Homo sapiens
ccttttctgtttcctgtcactg

SEQ ID NO: 9358913 - DNA, 22 bp, Homo sapiens
ccttttgaaggtgttgttaagt

SEQ ID NO: 9358914 - DNA, 22 bp, Homo sapiens
ccttttctgtgtgggtaattta

SEQ ID NO: 9358915 - DNA, 22 bp, Homo sapiens
ccttttctgaaccacttaaata

SEQ ID NO: 9358916 - DNA, 22 bp, Homo sapiens
ccttttctggccaccaagcgct

SEQ ID NO: 9358917 - DNA, 22 bp, Homo sapiens
cctttggtaattctgtgtagag

SEQ ID NO: 9358918 - DNA, 22 bp, Homo sapiens
cctttggtaacattccaacctt

SEQ ID NO: 9358919 - DNA, 22 bp, Homo sapiens
ccttttctatgtaccagcagtg

SEQ ID NO: 9358920 - DNA, 16 bp, Homo sapiens
ccttttctcatctcta

SEQ ID NO: 9358921 - DNA, 22 bp, Homo sapiens
ccttttctaggatgctttatag

SEQ ID NO: 9358922 - DNA, 22 bp, Homo sapiens
ccttttctatccttctaggttc

SEQ ID NO: 9358923 - DNA, 22 bp, Homo sapiens
ccttttctacaagcaaatgtgc

SEQ ID NO: 9358924 - DNA, 22 bp, Homo sapiens
ccttttctagaaagggaggcaa

SEQ ID NO: 9358925 - DNA, 22 bp, Homo sapiens
ccttttctaatcttaagaatgt

SEQ ID NO: 9358926 - DNA, 22 bp, Homo sapiens
ccttttctaatcttaagaatgt

SEQ ID NO: 9358927 - DNA, 22 bp, Homo sapiens
cgagagatgggttggcaggggc

SEQ ID NO: 9358928 - DNA, 22 bp, Homo sapiens
cgagagatgggttggcaggggc

SEQ ID NO: 9358929 - DNA, 22 bp, Homo sapiens
cgagagatgggttggcaggggc

SEQ ID NO: 9358930 - DNA, 22 bp, Homo sapiens
cgagaaatgagaaacccatttt

SEQ ID NO: 9358931 - DNA, 19 bp, Homo sapiens
ccttttttaacttcagcaa

SEQ ID NO: 9358932 - DNA, 22 bp, Homo sapiens
ccttttttctatgccaactctg

SEQ ID NO: 9358933 - DNA, 22 bp, Homo sapiens
cgagagttagctaggagtcaca

SEQ ID NO: 9358934 - DNA, 22 bp, Homo sapiens
cgagagttagctaggagtcaca

SEQ ID NO: 9358935 - DNA, 22 bp, Homo sapiens
cgagatccttcagagcgcggac

SEQ ID NO: 9358936 - DNA, 22 bp, Homo sapiens
ttattgagttgtaagagctctt

SEQ ID NO: 9358937 - DNA, 22 bp, Homo sapiens
ttattgagtttacagctttaga

SEQ ID NO: 9358938 - DNA, 16 bp, Homo sapiens
ttattgaggccaagga

SEQ ID NO: 9358939 - DNA, 23 bp, Homo sapiens
ttattgagggtgtagattggtgt

SEQ ID NO: 9358940 - DNA, 22 bp, Homo sapiens
ttattgagtatctgcttggtgt

SEQ ID NO: 9358941 - DNA, 22 bp, Homo sapiens
ttattgagtttacagctttaga

SEQ ID NO: 9358942 - DNA, 22 bp, Homo sapiens
ttatttatgttaacagtcgaga

SEQ ID NO: 9358943 - DNA, 22 bp, Homo sapiens
ttatttatgttaacagtcgaga

SEQ ID NO: 9358944 - DNA, 22 bp, Homo sapiens
ttattgctagtgtcatttcaca

SEQ ID NO: 9358945 - DNA, 22 bp, Homo sapiens
ttattgctatgatgatgtgtag

SEQ ID NO: 9358946 - DNA, 22 bp, Homo sapiens
ttatttattcattctgtctgtc

SEQ ID NO: 9358947 - DNA, 22 bp, Homo sapiens
ttatttattgtgtacctactgt

SEQ ID NO: 9358948 - DNA, 22 bp, Homo sapiens
ttatttattgtgtacctactgt

SEQ ID NO: 9358949 - DNA, 21 bp, Homo sapiens
ttatttcacatggacttccag

SEQ ID NO: 9358950 - DNA, 20 bp, Homo sapiens
ttatttcagttgctagattg

SEQ ID NO: 9358951 - DNA, 22 bp, Homo sapiens
ttattgcaactttagggataga

SEQ ID NO: 9358952 - DNA, 22 bp, Homo sapiens
ttattgcaactcctaaatagag

SEQ ID NO: 9358953 - DNA, 22 bp, Homo sapiens
ttattgcactattgattttcta

SEQ ID NO: 9358954 - DNA, 22 bp, Homo sapiens
ttattgcagatggtgtgagaga

SEQ ID NO: 9358955 - DNA, 22 bp, Homo sapiens
cgctgccaggtcaccaggggta

SEQ ID NO: 9358956 - DNA, 22 bp, Homo sapiens
cgctgccaggatcccctgccgg

SEQ ID NO: 9358957 - DNA, 22 bp, Homo sapiens
cgctgcctccaggtgcagcagg

SEQ ID NO: 9358958 - DNA, 22 bp, Homo sapiens
cgctgcagctggctgcagggaa

SEQ ID NO: 9358959 - DNA, 22 bp, Homo sapiens
cgctgcgaggcgcccttgttgc

SEQ ID NO: 9358960 - DNA, 22 bp, Homo sapiens
cgctgcgaggcgcccttgttgc

SEQ ID NO: 9358961 - DNA, 22 bp, Homo sapiens
cgctggcattagggcagtggcc

SEQ ID NO: 9358962 - DNA, 22 bp, Homo sapiens
cgctggcagggctgatctgaag

SEQ ID NO: 9358963 - DNA, 22 bp, Homo sapiens
cgctggcattagggcagtggcc

SEQ ID NO: 9358964 - DNA, 22 bp, Homo sapiens
ttatttcatgtaaaatttatgt

SEQ ID NO: 9358965 - DNA, 22 bp, Homo sapiens
ttatttcatgtaaaatttatgt

SEQ ID NO: 9358966 - DNA, 22 bp, Homo sapiens
ttatttcatataatgttatcaa

SEQ ID NO: 9358967 - DNA, 22 bp, Homo sapiens
cgctccttgagcgtgtcggcct

SEQ ID NO: 9358968 - DNA, 22 bp, Homo sapiens
cgcctctctttttctcccagac

SEQ ID NO: 9358969 - DNA, 22 bp, Homo sapiens
cgctgataaacgtcacgttccc

SEQ ID NO: 9358970 - DNA, 22 bp, Homo sapiens
cgctctggcaggcacaggaggg

SEQ ID NO: 9358971 - DNA, 22 bp, Homo sapiens
cgctctggagaatagtagcttt

SEQ ID NO: 9358972 - DNA, 22 bp, Homo sapiens
cgctctggagaatagtagcttt

SEQ ID NO: 9358973 - DNA, 22 bp, Homo sapiens
cggggccctggggctgaaggtc

SEQ ID NO: 9358974 - DNA, 22 bp, Homo sapiens
cggggcaggagtccctgtagag

SEQ ID NO: 9358975 - DNA, 22 bp, Homo sapiens
cggggcaggagtccctgtagag

SEQ ID NO: 9358976 - DNA, 22 bp, Homo sapiens
cggggcaggagtccctgtagag

SEQ ID NO: 9358977 - DNA, 22 bp, Homo sapiens
cggggccctggggctgaaggtc

SEQ ID NO: 9358978 - DNA, 22 bp, Homo sapiens
cggggcaggagtccctgtagag

SEQ ID NO: 9358979 - DNA, 22 bp, Homo sapiens
cggggcagaaagttgtcttttg

SEQ ID NO: 9358980 - DNA, 22 bp, Homo sapiens
cggggcagagggtcttctccag

SEQ ID NO: 9358981 - DNA, 22 bp, Homo sapiens
cggggagggcagaggctccctc

SEQ ID NO: 9358982 - DNA, 22 bp, Homo sapiens
cggggagggcagaggctccctc

SEQ ID NO: 9358983 - DNA, 22 bp, Homo sapiens
cggggaggcttcggattaaagc

SEQ ID NO: 9358984 - DNA, 22 bp, Homo sapiens
cgggcttcctccagggaagtgc

SEQ ID NO: 9358985 - DNA, 22 bp, Homo sapiens
cgggctggctgcagctgctgga

SEQ ID NO: 9358986 - DNA, 22 bp, Homo sapiens
cgggctggctgcagctgctgga

SEQ ID NO: 9358987 - DNA, 22 bp, Homo sapiens
cgggcaaggcgagactaggccc

SEQ ID NO: 9358988 - DNA, 22 bp, Homo sapiens
cggcaggtgtgctcactctgcc

SEQ ID NO: 9358989 - DNA, 22 bp, Homo sapiens
cgggaggaaaggcgaggctctg

SEQ ID NO: 9358990 - DNA, 22 bp, Homo sapiens
cggggctgctcgtcctcctgtg

SEQ ID NO: 9358991 - DNA, 22 bp, Homo sapiens
cgtgggagtggtgggtgctcag

SEQ ID NO: 9358992 - DNA, 22 bp, Homo sapiens
cgtgggccccagccactccctc

SEQ ID NO: 9358993 - DNA, 22 bp, Homo sapiens
cgtggggcgggtggacacttgc

SEQ ID NO: 9358994 - DNA, 22 bp, Homo sapiens
cgtggtctcccacagaaagaag

SEQ ID NO: 9358995 - DNA, 22 bp, Homo sapiens
cgtgggtcgggactccgcctcg

SEQ ID NO: 9358996 - DNA, 22 bp, Homo sapiens
cggggccctggggctgaaggtc

SEQ ID NO: 9358997 - DNA, 22 bp, Homo sapiens
cggggctgacagcaggtgtgct

SEQ ID NO: 9358998 - DNA, 22 bp, Homo sapiens
cggggctgacagcaggtgtgct

SEQ ID NO: 9358999 - DNA, 22 bp, Homo sapiens
ttcaaattaccacatttgctta

SEQ ID NO: 9359000 - DNA, 20 bp, Homo sapiens
cggactttcttctcagggca

SEQ ID NO: 9359001 - DNA, 22 bp, Homo sapiens
cggagaggacctgcaactcgct

SEQ ID NO: 9359002 - DNA, 22 bp, Homo sapiens
ttcaaatggttagactgttagc

SEQ ID NO: 9359003 - DNA, 22 bp, Homo sapiens
cggagtcttgctatgttgccca

SEQ ID NO: 9359004 - DNA, 22 bp, Homo sapiens
cggagtggagaaggtcacagaa

SEQ ID NO: 9359005 - DNA, 22 bp, Homo sapiens
cggagtggggactggggtaatc

SEQ ID NO: 9359006 - DNA, 22 bp, Homo sapiens
cggaggttgaggctgcagtgag

SEQ ID NO: 9359007 - DNA, 23 bp, Homo sapiens
cggcagcgtccggctacgggagg

SEQ ID NO: 9359008 - DNA, 22 bp, Homo sapiens
cggcagcggttggaggttgtag

SEQ ID NO: 9359009 - DNA, 22 bp, Homo sapiens
cggcaggacctcatttccttct

SEQ ID NO: 9359010 - DNA, 22 bp, Homo sapiens
cggcaggacctcatttccttct

SEQ ID NO: 9359011 - DNA, 22 bp, Homo sapiens
cggcagggttggttttctctga

SEQ ID NO: 9359012 - DNA, 22 bp, Homo sapiens
cggcagggctccatgcatttct

SEQ ID NO: 9359013 - DNA, 22 bp, Homo sapiens
cggcagagtgtgtgcgtgcatg

SEQ ID NO: 9359014 - DNA, 22 bp, Homo sapiens
cggcagagtgtgtgcgtgcatg

SEQ ID NO: 9359015 - DNA, 22 bp, Homo sapiens
cggcagcaaaggaagccaggtc

SEQ ID NO: 9359016 - DNA, 18 bp, Homo sapiens
cggcagagtgcttctagc

SEQ ID NO: 9359017 - DNA, 22 bp, Homo sapiens
cggcagagcttcctgctcagcg

SEQ ID NO: 9359018 - DNA, 18 bp, Homo sapiens
cggcagagtgcttctagc

SEQ ID NO: 9359019 - DNA, 22 bp, Homo sapiens
cggcagagcggcgagcccctcc

SEQ ID NO: 9359020 - DNA, 22 bp, Homo sapiens
cggcagagcggcgagcccctcc

SEQ ID NO: 9359021 - DNA, 22 bp, Homo sapiens
cggcagagcttcctgctcagcg

SEQ ID NO: 9359022 - DNA, 22 bp, Homo sapiens
cggcagagccctgagtcagcct

SEQ ID NO: 9359023 - DNA, 22 bp, Homo sapiens
cggcagagccctgagtcagcct

SEQ ID NO: 9359024 - DNA, 22 bp, Homo sapiens
cggagttgtaagggatgtggct

SEQ ID NO: 9359025 - DNA, 22 bp, Homo sapiens
cggatgtctttgagggagagtc

SEQ ID NO: 9359026 - DNA, 22 bp, Homo sapiens
cggcacagccgggcaaggctgg

SEQ ID NO: 9359027 - DNA, 22 bp, Homo sapiens
cggcagagacggcgctttgaac

SEQ ID NO: 9359028 - DNA, 22 bp, Homo sapiens
cggcagagacggcgctttgaac

SEQ ID NO: 9359029 - DNA, 22 bp, Homo sapiens
ctccagagggtcagactctgag

SEQ ID NO: 9359030 - DNA, 22 bp, Homo sapiens
ctccagaggcgacttgcatcac

SEQ ID NO: 9359031 - DNA, 22 bp, Homo sapiens
ctccagaggcgacttgcatcac

SEQ ID NO: 9359032 - DNA, 22 bp, Homo sapiens
ctccagaggccctatcccacta

SEQ ID NO: 9359033 - DNA, 22 bp, Homo sapiens
ctccagaggtccccgcggcact

SEQ ID NO: 9359034 - DNA, 22 bp, Homo sapiens
ctccagagggtcagactctgag

SEQ ID NO: 9359035 - DNA, 22 bp, Homo sapiens
ctccagaggttctcatctggga

SEQ ID NO: 9359036 - DNA, 18 bp, Homo sapiens
ctccagagctgtgagaca

SEQ ID NO: 9359037 - DNA, 22 bp, Homo sapiens
ctccagaggaaagcacatagtg

SEQ ID NO: 9359038 - DNA, 22 bp, Homo sapiens
ctccagaggatgcaggtgaggg

SEQ ID NO: 9359039 - DNA, 22 bp, Homo sapiens
ctccagaggatgcaggtgaggg

SEQ ID NO: 9359040 - DNA, 22 bp, Homo sapiens
ctccagataggagggggtcccc

SEQ ID NO: 9359041 - DNA, 22 bp, Homo sapiens
ctccagagtcatcgagcattcc

SEQ ID NO: 9359042 - DNA, 22 bp, Homo sapiens
ctccagagtcacactgcctggg

SEQ ID NO: 9359043 - DNA, 22 bp, Homo sapiens
ctccagagtcacactgcctggg

SEQ ID NO: 9359044 - DNA, 22 bp, Homo sapiens
ctccagagtcacactgcctggg

SEQ ID NO: 9359045 - DNA, 22 bp, Homo sapiens
ctccagaggttctcatctggga

SEQ ID NO: 9359046 - DNA, 22 bp, Homo sapiens
ctccagaggttctcatctggga

SEQ ID NO: 9359047 - DNA, 22 bp, Homo sapiens
ttggctctggaactatttctga

SEQ ID NO: 9359048 - DNA, 22 bp, Homo sapiens
ttggctctgatggggatcagga

SEQ ID NO: 9359049 - DNA, 20 bp, Homo sapiens
ttggctctgatcagtggagc

SEQ ID NO: 9359050 - DNA, 17 bp, Homo sapiens
ttggctctattgcctct

SEQ ID NO: 9359051 - DNA, 22 bp, Homo sapiens
ttggctctaggaaccaaagtga

SEQ ID NO: 9359052 - DNA, 22 bp, Homo sapiens
ctccaggaccagggctcctgga

SEQ ID NO: 9359053 - DNA, 22 bp, Homo sapiens
ctccaggaccagggctcctgga

SEQ ID NO: 9359054 - DNA, 22 bp, Homo sapiens
ctccaggacactaacccaggct

SEQ ID NO: 9359055 - DNA, 22 bp, Homo sapiens
ctccaggactgaggacagagct

SEQ ID NO: 9359056 - DNA, 22 bp, Homo sapiens
ctccaggactcaggcccctggg

SEQ ID NO: 9359057 - DNA, 22 bp, Homo sapiens
ctccaggacccagtggctccag

SEQ ID NO: 9359058 - DNA, 22 bp, Homo sapiens
ctccaggacccagtggctccag

SEQ ID NO: 9359059 - DNA, 22 bp, Homo sapiens
ttggctgaactgagctccatcg

SEQ ID NO: 9359060 - DNA, 22 bp, Homo sapiens
ttggctgcaatcacagggactc

SEQ ID NO: 9359061 - DNA, 21 bp, Homo sapiens
ttggctgcctgagattagaat

SEQ ID NO: 9359062 - DNA, 22 bp, Homo sapiens
ttggctgccttcacccctggcc

SEQ ID NO: 9359063 - DNA, 22 bp, Homo sapiens
ttggctgcctgtggatcgcatt

SEQ ID NO: 9359064 - DNA, 22 bp, Homo sapiens
ttggctgccgagcgcatcccgg

SEQ ID NO: 9359065 - DNA, 22 bp, Homo sapiens
ttggctgcattttgggttcgtt

SEQ ID NO: 9359066 - DNA, 22 bp, Homo sapiens
ctccagcctcatctcctggctg

SEQ ID NO: 9359067 - DNA, 22 bp, Homo sapiens
ctccagcctcatctcctggctg

SEQ ID NO: 9359068 - DNA, 22 bp, Homo sapiens
ttggctgctaatggctgacagc

SEQ ID NO: 9359069 - DNA, 22 bp, Homo sapiens
ttggagtgacagatgaggaaac

SEQ ID NO: 9359070 - DNA, 20 bp, Homo sapiens
ttggaggtgcagtgcatgca

SEQ ID NO: 9359071 - DNA, 20 bp, Homo sapiens
ttggaggtgcagtgcatgca

SEQ ID NO: 9359072 - DNA, 18 bp, Homo sapiens
ctccagagctgtgagaca

SEQ ID NO: 9359073 - DNA, 22 bp, Homo sapiens
ctccactcaccagatgccagga

SEQ ID NO: 9359074 - DNA, 22 bp, Homo sapiens
ttggatccatctcaggcatagg

SEQ ID NO: 9359075 - DNA, 22 bp, Homo sapiens
ttggatccatctcaggcatagg

SEQ ID NO: 9359076 - DNA, 23 bp, Homo sapiens
ttggaagggaagagcatttgaga

SEQ ID NO: 9359077 - DNA, 22 bp, Homo sapiens
ttggaggggccactgcagagct

SEQ ID NO: 9359078 - DNA, 22 bp, Homo sapiens
ttggaggggccactgcagagct

SEQ ID NO: 9359079 - DNA, 22 bp, Homo sapiens
ttggagggtcttccacagccat

SEQ ID NO: 9359080 - DNA, 22 bp, Homo sapiens
ttggagggtcttccacagccat

SEQ ID NO: 9359081 - DNA, 22 bp, Homo sapiens
ttggagggacagatggctaggc

SEQ ID NO: 9359082 - DNA, 22 bp, Homo sapiens
ttggagggactgagcttcagtc

SEQ ID NO: 9359083 - DNA, 22 bp, Homo sapiens
ttggagggactgagcttcagtc

SEQ ID NO: 9359084 - DNA, 22 bp, Homo sapiens
ttggaagcgagcacatggagga

SEQ ID NO: 9359085 - DNA, 22 bp, Homo sapiens
ttggaagcgagcacatggagga

SEQ ID NO: 9359086 - DNA, 22 bp, Homo sapiens
ttggaagctactttaatgtaat

SEQ ID NO: 9359087 - DNA, 22 bp, Homo sapiens
ttggaaggccagcaccttgagt

SEQ ID NO: 9359088 - DNA, 23 bp, Homo sapiens
ttggaagccagacagctgtgcag

SEQ ID NO: 9359089 - DNA, 22 bp, Homo sapiens
ttggaagcattctgaatgtcca

SEQ ID NO: 9359090 - DNA, 23 bp, Homo sapiens
ttggaagccagacagctgtgcag

SEQ ID NO: 9359091 - DNA, 22 bp, Homo sapiens
ttggaagccctctgcaagatcc

SEQ ID NO: 9359092 - DNA, 22 bp, Homo sapiens
ttggaagccagaggaccaggga

SEQ ID NO: 9359093 - DNA, 22 bp, Homo sapiens
ttggaagccctgtgataggcca

SEQ ID NO: 9359094 - DNA, 22 bp, Homo sapiens
ttggaagccctgtgataggcca

SEQ ID NO: 9359095 - DNA, 22 bp, Homo sapiens
ttggaagcctagttaagatgaa

SEQ ID NO: 9359096 - DNA, 22 bp, Homo sapiens
ttggaagcgagcacatggagga

SEQ ID NO: 9359097 - DNA, 22 bp, Homo sapiens
ttggaagcagtgtacactgtac

SEQ ID NO: 9359098 - DNA, 22 bp, Homo sapiens
ttggaagcagtgtacactgtac

SEQ ID NO: 9359099 - DNA, 22 bp, Homo sapiens
ttggaagcaatgtaagtcgcat

SEQ ID NO: 9359100 - DNA, 22 bp, Homo sapiens
ttggaagattctgtgtctggtg

SEQ ID NO: 9359101 - DNA, 22 bp, Homo sapiens
ttggaagcaataaatggaaaga

SEQ ID NO: 9359102 - DNA, 22 bp, Homo sapiens
ttggaagatctaacagaggcat

SEQ ID NO: 9359103 - DNA, 22 bp, Homo sapiens
ctcagtcttctcctccaatgga

SEQ ID NO: 9359104 - DNA, 22 bp, Homo sapiens
ctcagtgcaaccaaagtgatct

SEQ ID NO: 9359105 - DNA, 22 bp, Homo sapiens
ctcagtgcaaccaaagtgatct

SEQ ID NO: 9359106 - DNA, 22 bp, Homo sapiens
ctcagtgcagctaggcatgaga

SEQ ID NO: 9359107 - DNA, 22 bp, Homo sapiens
ctcagtgctagaagtagattgc

SEQ ID NO: 9359108 - DNA, 22 bp, Homo sapiens
ctcagtgctgaggaaagttgaa

SEQ ID NO: 9359109 - DNA, 22 bp, Homo sapiens
ctcagtgctacggttaccatat

SEQ ID NO: 9359110 - DNA, 22 bp, Homo sapiens
ctcagtgcttagtgtgttttgg

SEQ ID NO: 9359111 - DNA, 22 bp, Homo sapiens
ttggaaaatgaggcacagagag

SEQ ID NO: 9359112 - DNA, 19 bp, Homo sapiens
ctcagtctggctctgcctg

SEQ ID NO: 9359113 - DNA, 22 bp, Homo sapiens
ctcagtccacgcagcctcctga

SEQ ID NO: 9359114 - DNA, 22 bp, Homo sapiens
ctcagtcatgacgctcaggacc

SEQ ID NO: 9359115 - DNA, 22 bp, Homo sapiens
ctcagtccgtcccgctaggtgc

SEQ ID NO: 9359116 - DNA, 22 bp, Homo sapiens
ttgcactttatagaaacttttg

SEQ ID NO: 9359117 - DNA, 22 bp, Homo sapiens
ttgcagaacttaaagacagagt

SEQ ID NO: 9359118 - DNA, 22 bp, Homo sapiens
ttgcactttgaaataacagtgg

SEQ ID NO: 9359119 - DNA, 23 bp, Homo sapiens
ttgcatagacatcctcatagatt

SEQ ID NO: 9359120 - DNA, 22 bp, Homo sapiens
ttgcataaagattttattgcat

SEQ ID NO: 9359121 - DNA, 22 bp, Homo sapiens
ctcaggaggatgactgccttgg

SEQ ID NO: 9359122 - DNA, 22 bp, Homo sapiens
ctcaggaggatgactgccttgg

SEQ ID NO: 9359123 - DNA, 22 bp, Homo sapiens
ctcaggaggatgactgccttgg

SEQ ID NO: 9359124 - DNA, 22 bp, Homo sapiens
ctcaggaggccattctcaaggt

SEQ ID NO: 9359125 - DNA, 22 bp, Homo sapiens
ctcaggagcttcctcagcccat

SEQ ID NO: 9359126 - DNA, 22 bp, Homo sapiens
ctcaggagcttcctcagcccat

SEQ ID NO: 9359127 - DNA, 22 bp, Homo sapiens
ctcaggaggtttcctgtctagg

SEQ ID NO: 9359128 - DNA, 22 bp, Homo sapiens
ctcaggaggtttcctgtctagg

SEQ ID NO: 9359129 - DNA, 22 bp, Homo sapiens
ctcaggagtagttcagcagctg

SEQ ID NO: 9359130 - DNA, 22 bp, Homo sapiens
ctcaggagtagttcagcagctg

SEQ ID NO: 9359131 - DNA, 22 bp, Homo sapiens
ctcaggagtagttcagcagctg

SEQ ID NO: 9359132 - DNA, 22 bp, Homo sapiens
ctcaggaggtggtagaggccct

SEQ ID NO: 9359133 - DNA, 22 bp, Homo sapiens
ctcaggaggtggtagaggccct

SEQ ID NO: 9359134 - DNA, 22 bp, Homo sapiens
ctcaggaaccgcggcagcagcc

SEQ ID NO: 9359135 - DNA, 22 bp, Homo sapiens
ctcaggacagattccagagaaa

SEQ ID NO: 9359136 - DNA, 22 bp, Homo sapiens
ctcaggagatgacagaaggtat

SEQ ID NO: 9359137 - DNA, 22 bp, Homo sapiens
ctcaggagatgacagaaggtat

SEQ ID NO: 9359138 - DNA, 22 bp, Homo sapiens
ctcaggagatgacagaaggtat

SEQ ID NO: 9359139 - DNA, 22 bp, Homo sapiens
ctcaggactttcaaatagaaat

SEQ ID NO: 9359140 - DNA, 22 bp, Homo sapiens
ctcaggagacagtgtccacatg

SEQ ID NO: 9359141 - DNA, 22 bp, Homo sapiens
ctcagccccaatttgccctctt

SEQ ID NO: 9359142 - DNA, 22 bp, Homo sapiens
ctcagccccaatttgccctctt

SEQ ID NO: 9359143 - DNA, 22 bp, Homo sapiens
ctcagccccaatttgccctctt

SEQ ID NO: 9359144 - DNA, 19 bp, Homo sapiens
ctcagctgtagctcatgtg

SEQ ID NO: 9359145 - DNA, 22 bp, Homo sapiens
ctcagctgtctcatgggtctgt

SEQ ID NO: 9359146 - DNA, 22 bp, Homo sapiens
ctcagcttctacctcctgagtg

SEQ ID NO: 9359147 - DNA, 22 bp, Homo sapiens
ctcagcttcatttgttccatga

SEQ ID NO: 9359148 - DNA, 22 bp, Homo sapiens
ctcagcttctacctcctgagtg

SEQ ID NO: 9359149 - DNA, 22 bp, Homo sapiens
ctcagcttttcccggataggtg

SEQ ID NO: 9359150 - DNA, 22 bp, Homo sapiens
ctcaggaaaggccatgcaaggg

SEQ ID NO: 9359151 - DNA, 22 bp, Homo sapiens
ctcaggaaccgcggcagcagcc

SEQ ID NO: 9359152 - DNA, 22 bp, Homo sapiens
ctcagggcggcgggcagcccag

SEQ ID NO: 9359153 - DNA, 23 bp, Homo sapiens
ctcagggatagaaaggaagacag

SEQ ID NO: 9359154 - DNA, 22 bp, Homo sapiens
ctcagggaattatttctgtcct

SEQ ID NO: 9359155 - DNA, 22 bp, Homo sapiens
ctcagggaagctatggtgaggg

SEQ ID NO: 9359156 - DNA, 22 bp, Homo sapiens
ctcagggaattgaatctccttg

SEQ ID NO: 9359157 - DNA, 22 bp, Homo sapiens
ctcagggatgggcagatgttaa

SEQ ID NO: 9359158 - DNA, 22 bp, Homo sapiens
ctcagggatgggcagatgttaa

SEQ ID NO: 9359159 - DNA, 22 bp, Homo sapiens
ctcagggcttgagtgtccagga

SEQ ID NO: 9359160 - DNA, 21 bp, Homo sapiens
ctcagggcttggtgtcctcat

SEQ ID NO: 9359161 - DNA, 21 bp, Homo sapiens
ctcaggggattttgagattag

SEQ ID NO: 9359162 - DNA, 22 bp, Homo sapiens
ctcagtaaggatgcttcagcgg

SEQ ID NO: 9359163 - DNA, 22 bp, Homo sapiens
ctcaggtagagtctgcatgggg

SEQ ID NO: 9359164 - DNA, 22 bp, Homo sapiens
ctcaggtcacaggatggccagg

SEQ ID NO: 9359165 - DNA, 22 bp, Homo sapiens
ttgccctggggctggcctggca

SEQ ID NO: 9359166 - DNA, 22 bp, Homo sapiens
ttgccctgtcttaagctggcaa

SEQ ID NO: 9359167 - DNA, 22 bp, Homo sapiens
ttgccctagggtcttatcctcc

SEQ ID NO: 9359168 - DNA, 17 bp, Homo sapiens
ttgccctgatttttaac

SEQ ID NO: 9359169 - DNA, 22 bp, Homo sapiens
ttgcatcttctggttgagcccc

SEQ ID NO: 9359170 - DNA, 22 bp, Homo sapiens
ttgcatagtgctgaggttcggg

SEQ ID NO: 9359171 - DNA, 22 bp, Homo sapiens
ttgcatatcctccaacacatgg

SEQ ID NO: 9359172 - DNA, 22 bp, Homo sapiens
ctcacccctgtaattccagcac

SEQ ID NO: 9359173 - DNA, 22 bp, Homo sapiens
ctcaccccactaccccttggtg

SEQ ID NO: 9359174 - DNA, 22 bp, Homo sapiens
ctcactgcaagctcagcctccc

SEQ ID NO: 9359175 - DNA, 22 bp, Homo sapiens
ctcactgcaacctctgcctccc

SEQ ID NO: 9359176 - DNA, 22 bp, Homo sapiens
ctcactgactgcaagtcaagtt

SEQ ID NO: 9359177 - DNA, 22 bp, Homo sapiens
ctcactcagacatccagtgcag

SEQ ID NO: 9359178 - DNA, 22 bp, Homo sapiens
ctcacccatatctccatgactc

SEQ ID NO: 9359179 - DNA, 22 bp, Homo sapiens
ctcacccatatctccatgactc

SEQ ID NO: 9359180 - DNA, 22 bp, Homo sapiens
ctcacaggttctgcagctcaca

SEQ ID NO: 9359181 - DNA, 22 bp, Homo sapiens
ctatagatgtcattttacatcc

SEQ ID NO: 9359182 - DNA, 22 bp, Homo sapiens
ctatactactatacagatgtaa

SEQ ID NO: 9359183 - DNA, 22 bp, Homo sapiens
ctatacagcagcttactagtta

SEQ ID NO: 9359184 - DNA, 22 bp, Homo sapiens
ctatacagtaaccacagtgatt

SEQ ID NO: 9359185 - DNA, 22 bp, Homo sapiens
ttctggctcatatgctaagaag

SEQ ID NO: 9359186 - DNA, 22 bp, Homo sapiens
ttctggctccactcagccccac

SEQ ID NO: 9359187 - DNA, 23 bp, Homo sapiens
ttctggctccgagctccatcttc

SEQ ID NO: 9359188 - DNA, 22 bp, Homo sapiens
ttctggctcgattctctgaccg

SEQ ID NO: 9359189 - DNA, 22 bp, Homo sapiens
ttctggctgtatgatatttaat

SEQ ID NO: 9359190 - DNA, 22 bp, Homo sapiens
ttctggctgtatgatatttaat

SEQ ID NO: 9359191 - DNA, 22 bp, Homo sapiens
ttctggctgcagtccctgtaat

SEQ ID NO: 9359192 - DNA, 22 bp, Homo sapiens
ttctggctgaaagtttatttga

SEQ ID NO: 9359193 - DNA, 22 bp, Homo sapiens
ttctggctgaaagtttatttga

SEQ ID NO: 9359194 - DNA, 22 bp, Homo sapiens
ttctggctctcccctgctgggt

SEQ ID NO: 9359195 - DNA, 22 bp, Homo sapiens
ttctggctcgattctctgaccg

SEQ ID NO: 9359196 - DNA, 18 bp, Homo sapiens
ttctggctcactcatgct

SEQ ID NO: 9359197 - DNA, 22 bp, Homo sapiens
ttctggccaaggctgccagatt

SEQ ID NO: 9359198 - DNA, 22 bp, Homo sapiens
ttctggccaaggctgccagatt

SEQ ID NO: 9359199 - DNA, 22 bp, Homo sapiens
ttctggctaccctcctaatgtt

SEQ ID NO: 9359200 - DNA, 22 bp, Homo sapiens
ttctggattagcatgatcccta

SEQ ID NO: 9359201 - DNA, 23 bp, Homo sapiens
ttctggctgtgggtggcgtctct

SEQ ID NO: 9359202 - DNA, 22 bp, Homo sapiens
ttctggcttacttcactcattt

SEQ ID NO: 9359203 - DNA, 22 bp, Homo sapiens
ttctggcttacttcactcattt

SEQ ID NO: 9359204 - DNA, 22 bp, Homo sapiens
ttctggcttagttgttgtatat

SEQ ID NO: 9359205 - DNA, 22 bp, Homo sapiens
ttctggctttacttcccatcca

SEQ ID NO: 9359206 - DNA, 22 bp, Homo sapiens
ttctggcttgacccctacttcc

SEQ ID NO: 9359207 - DNA, 22 bp, Homo sapiens
ctataaatctacccagcattgg

SEQ ID NO: 9359208 - DNA, 22 bp, Homo sapiens
ttctggctttaggcttttcaag

SEQ ID NO: 9359209 - DNA, 22 bp, Homo sapiens
ttctggcttcatctgacaagcc

SEQ ID NO: 9359210 - DNA, 22 bp, Homo sapiens
ttctggcttatgagctataatg

SEQ ID NO: 9359211 - DNA, 22 bp, Homo sapiens
ctataaatctacccagcattgg

SEQ ID NO: 9359212 - DNA, 22 bp, Homo sapiens
ctataaatctacccagcattgg

SEQ ID NO: 9359213 - DNA, 22 bp, Homo sapiens
ctataaatctacccagcattgg

SEQ ID NO: 9359214 - DNA, 22 bp, Homo sapiens
ctataaatctacccagcattgg

SEQ ID NO: 9359215 - DNA, 22 bp, Homo sapiens
ctataagacagatactgacttt

SEQ ID NO: 9359216 - DNA, 22 bp, Homo sapiens
ctatacactttttgaaaataga

SEQ ID NO: 9359217 - DNA, 22 bp, Homo sapiens
ctcagaggcaagcaaggagctg

SEQ ID NO: 9359218 - DNA, 22 bp, Homo sapiens
ctcagagctgaggccagggaca

SEQ ID NO: 9359219 - DNA, 22 bp, Homo sapiens
ctcagaggcaagcaaggagctg

SEQ ID NO: 9359220 - DNA, 22 bp, Homo sapiens
ctcagagctcagctttgttagt

SEQ ID NO: 9359221 - DNA, 22 bp, Homo sapiens
ctcagagctcgtgggaccttgg

SEQ ID NO: 9359222 - DNA, 22 bp, Homo sapiens
ctcagagcccagggtacacccg

SEQ ID NO: 9359223 - DNA, 22 bp, Homo sapiens
ctcagagcccagggtacacccg

SEQ ID NO: 9359224 - DNA, 22 bp, Homo sapiens
ctcagagccccaggagggtgtg

SEQ ID NO: 9359225 - DNA, 21 bp, Homo sapiens
ctcagagcagttcagagggat

SEQ ID NO: 9359226 - DNA, 17 bp, Homo sapiens
ctcagagcaggacagaa

SEQ ID NO: 9359227 - DNA, 17 bp, Homo sapiens
ctcagagcaggacagaa

SEQ ID NO: 9359228 - DNA, 22 bp, Homo sapiens
ctcagagcccagggtacacccg

SEQ ID NO: 9359229 - DNA, 22 bp, Homo sapiens
ctcagagccagttagcaggtgc

SEQ ID NO: 9359230 - DNA, 22 bp, Homo sapiens
ctcagagccagttagcaggtgc

SEQ ID NO: 9359231 - DNA, 22 bp, Homo sapiens
ctcagagcacagtttatgacag

SEQ ID NO: 9359232 - DNA, 22 bp, Homo sapiens
ctcagagcacttttgaaagctc

SEQ ID NO: 9359233 - DNA, 17 bp, Homo sapiens
ctcagagcaggacagaa

SEQ ID NO: 9359234 - DNA, 17 bp, Homo sapiens
ctcagagcaggacagaa

SEQ ID NO: 9359235 - DNA, 22 bp, Homo sapiens
ctcagagatatagtccctgctt

SEQ ID NO: 9359236 - DNA, 22 bp, Homo sapiens
ctcagagcaatgaacatgcaaa

SEQ ID NO: 9359237 - DNA, 22 bp, Homo sapiens
ctcagagcaatgaacatgcaaa

SEQ ID NO: 9359238 - DNA, 22 bp, Homo sapiens
ctcagagaggcagtggaagtca

SEQ ID NO: 9359239 - DNA, 17 bp, Homo sapiens
ctcagagagggtaagta

SEQ ID NO: 9359240 - DNA, 22 bp, Homo sapiens
ttctttctgtccataatgagac

SEQ ID NO: 9359241 - DNA, 22 bp, Homo sapiens
ttctttctgtccataatgagac

SEQ ID NO: 9359242 - DNA, 22 bp, Homo sapiens
ttctttctgtccataatgagac

SEQ ID NO: 9359243 - DNA, 22 bp, Homo sapiens
ttctttctgtcatggtgtactg

SEQ ID NO: 9359244 - DNA, 22 bp, Homo sapiens
ctcagaaagggttgctgagggc

SEQ ID NO: 9359245 - DNA, 22 bp, Homo sapiens
ctcagagaaaaggagcaagggt

SEQ ID NO: 9359246 - DNA, 22 bp, Homo sapiens
ctcagagaaaaggagcaagggt

SEQ ID NO: 9359247 - DNA, 22 bp, Homo sapiens
ctcagagaaaaggagcaagggt

SEQ ID NO: 9359248 - DNA, 21 bp, Homo sapiens
ctcagagacaaatgccatccc

SEQ ID NO: 9359249 - DNA, 22 bp, Homo sapiens
ctcagagaagatggatgaggta

SEQ ID NO: 9359250 - DNA, 22 bp, Homo sapiens
ctcagagaacctaagcggagga

SEQ ID NO: 9359251 - DNA, 22 bp, Homo sapiens
ctcagagaacctaagcggagga

SEQ ID NO: 9359252 - DNA, 21 bp, Homo sapiens
ttctttctgaatctgaagtat

SEQ ID NO: 9359253 - DNA, 21 bp, Homo sapiens
ttctttctgaatctgaagtat

SEQ ID NO: 9359254 - DNA, 22 bp, Homo sapiens
ttctttctgaatacagttgagt

SEQ ID NO: 9359255 - DNA, 21 bp, Homo sapiens
ttctttctgaatctgaagtat

SEQ ID NO: 9359256 - DNA, 21 bp, Homo sapiens
ttctttctgaatctgaagtat

SEQ ID NO: 9359257 - DNA, 21 bp, Homo sapiens
ttctttctgaatctgaagtat

SEQ ID NO: 9359258 - DNA, 22 bp, Homo sapiens
ttctttctgggaagagttcaga

SEQ ID NO: 9359259 - DNA, 22 bp, Homo sapiens
ttctttctgggaagagttcaga

SEQ ID NO: 9359260 - DNA, 22 bp, Homo sapiens
ttctttctgggaagagttcaga

SEQ ID NO: 9359261 - DNA, 22 bp, Homo sapiens
ttctttctggggtccttcggct

SEQ ID NO: 9359262 - DNA, 22 bp, Homo sapiens
ttctttctggggtccttcggct

SEQ ID NO: 9359263 - DNA, 22 bp, Homo sapiens
ttctttctgaatacagttgagt

SEQ ID NO: 9359264 - DNA, 22 bp, Homo sapiens
ttctttctgaatacagttgagt

SEQ ID NO: 9359265 - DNA, 22 bp, Homo sapiens
ttctttctctccacaaggcttg

SEQ ID NO: 9359266 - DNA, 22 bp, Homo sapiens
ttctttctctgtaaaaggaaaa

SEQ ID NO: 9359267 - DNA, 22 bp, Homo sapiens
ttctttctctgtaaaaggaaaa

SEQ ID NO: 9359268 - DNA, 22 bp, Homo sapiens
ttctttctctccacaaggcttg

SEQ ID NO: 9359269 - DNA, 22 bp, Homo sapiens
cgttggagacacttgaggactt

SEQ ID NO: 9359270 - DNA, 22 bp, Homo sapiens
cgtttattttgaagattccact

SEQ ID NO: 9359271 - DNA, 22 bp, Homo sapiens
cgttcctctactccagctaccc

SEQ ID NO: 9359272 - DNA, 20 bp, Homo sapiens
cgtgtgtggctattttgggt

SEQ ID NO: 9359273 - DNA, 22 bp, Homo sapiens
cgtgtgtgtacctgcgcattta

SEQ ID NO: 9359274 - DNA, 22 bp, Homo sapiens
cgtgtggtcccggcaaggcaag

SEQ ID NO: 9359275 - DNA, 17 bp, Homo sapiens
cgtgtgcttgtgtgcac

SEQ ID NO: 9359276 - DNA, 20 bp, Homo sapiens
cgtgtccttggcgggagagc

SEQ ID NO: 9359277 - DNA, 22 bp, Homo sapiens
cgtgtccttttagcttcaggtc

SEQ ID NO: 9359278 - DNA, 23 bp, Homo sapiens
cgtgtccttcagggagagtgtgg

SEQ ID NO: 9359279 - DNA, 22 bp, Homo sapiens
cgtggtctcccacagaaagaag

SEQ ID NO: 9359280 - DNA, 16 bp, Homo sapiens
cgtggtctgatttcct

SEQ ID NO: 9359281 - DNA, 22 bp, Homo sapiens
cgtgtacagtctatcttttttc

SEQ ID NO: 9359282 - DNA, 21 bp, Homo sapiens
cgtggtctggatttgggtttg

SEQ ID NO: 9359283 - DNA, 23 bp, Homo sapiens
cgtgtccttcagggagagtgtgg

SEQ ID NO: 9359284 - DNA, 22 bp, Homo sapiens
cgtgtccttttagcttcaggtc

SEQ ID NO: 9359285 - DNA, 20 bp, Homo sapiens
cgtgtccttggcgggagagc

SEQ ID NO: 9359286 - DNA, 22 bp, Homo sapiens
ctagaggtagaggcagtgggaa

SEQ ID NO: 9359287 - DNA, 22 bp, Homo sapiens
ctagataaggtggcttggaatt

SEQ ID NO: 9359288 - DNA, 17 bp, Homo sapiens
ctagagagaaagagcta

SEQ ID NO: 9359289 - DNA, 22 bp, Homo sapiens
ctagagaattgtcttgagagtt

SEQ ID NO: 9359290 - DNA, 17 bp, Homo sapiens
ctagagagaaagagcta

SEQ ID NO: 9359291 - DNA, 22 bp, Homo sapiens
ctagagaggtggtgttgggtgg

SEQ ID NO: 9359292 - DNA, 22 bp, Homo sapiens
ctagagagccgctgtggaaaat

SEQ ID NO: 9359293 - DNA, 22 bp, Homo sapiens
ctagagagccgctgtggaaaat

SEQ ID NO: 9359294 - DNA, 22 bp, Homo sapiens
ctagagaggtggtgttgggtgg

SEQ ID NO: 9359295 - DNA, 22 bp, Homo sapiens
ctagagctttctgctggtgttg

SEQ ID NO: 9359296 - DNA, 22 bp, Homo sapiens
ctagagaaaggcagtggagcaa

SEQ ID NO: 9359297 - DNA, 22 bp, Homo sapiens
ctagagaaaatgttaatacagt

SEQ ID NO: 9359298 - DNA, 22 bp, Homo sapiens
ctaaaaatccacactaggtgaa

SEQ ID NO: 9359299 - DNA, 22 bp, Homo sapiens
ctaaaaatccacactaggtgaa

SEQ ID NO: 9359300 - DNA, 22 bp, Homo sapiens
ctagaaagatacttaaatcaag

SEQ ID NO: 9359301 - DNA, 22 bp, Homo sapiens
ttctgcataggctatatttgtt

SEQ ID NO: 9359302 - DNA, 22 bp, Homo sapiens
ttctgcataggctatatttgtt

SEQ ID NO: 9359303 - DNA, 22 bp, Homo sapiens
ttctgcatacactgaatgtagt

SEQ ID NO: 9359304 - DNA, 22 bp, Homo sapiens
ttctgcatacactgaatgtagt

SEQ ID NO: 9359305 - DNA, 22 bp, Homo sapiens
ttctgcagtgtgcagggcctgt

SEQ ID NO: 9359306 - DNA, 22 bp, Homo sapiens
ttctgcagtgttaacaatgtca

SEQ ID NO: 9359307 - DNA, 22 bp, Homo sapiens
ttctgcaggagccctagtgtat

SEQ ID NO: 9359308 - DNA, 22 bp, Homo sapiens
ttctgcaggatgctctggtggt

SEQ ID NO: 9359309 - DNA, 22 bp, Homo sapiens
ttctgcaggatgctctggtggt

SEQ ID NO: 9359310 - DNA, 22 bp, Homo sapiens
ttctgaaggctcctcaggaaag

SEQ ID NO: 9359311 - DNA, 21 bp, Homo sapiens
ttctgcagccatgttggtttt

SEQ ID NO: 9359312 - DNA, 22 bp, Homo sapiens
ttctgcagcccaacagtagttt

SEQ ID NO: 9359313 - DNA, 22 bp, Homo sapiens
ttctgcagcccaacagtagttt

SEQ ID NO: 9359314 - DNA, 22 bp, Homo sapiens
ttctatttcttaatcttggctg

SEQ ID NO: 9359315 - DNA, 22 bp, Homo sapiens
ttctatttcttaatcttggctg

SEQ ID NO: 9359316 - DNA, 22 bp, Homo sapiens
ttctatttcttaatcttggctg

SEQ ID NO: 9359317 - DNA, 22 bp, Homo sapiens
ttctatttccagtccttcagag

SEQ ID NO: 9359318 - DNA, 22 bp, Homo sapiens
ttctattgcacacaaataatta

SEQ ID NO: 9359319 - DNA, 22 bp, Homo sapiens
ttctattgcacacaaataatta

SEQ ID NO: 9359320 - DNA, 22 bp, Homo sapiens
ttctatgtagataaggctgctc

SEQ ID NO: 9359321 - DNA, 22 bp, Homo sapiens
ttctatgtacctagcgttgtat

SEQ ID NO: 9359322 - DNA, 22 bp, Homo sapiens
ttctatgtcagtgtgctctgtg

SEQ ID NO: 9359323 - DNA, 22 bp, Homo sapiens
ttctatgtgaacgttatagttt

SEQ ID NO: 9359324 - DNA, 22 bp, Homo sapiens
ttctatgtgaacgttatagttt

SEQ ID NO: 9359325 - DNA, 22 bp, Homo sapiens
ttctatgtggcatcaagctcag

SEQ ID NO: 9359326 - DNA, 22 bp, Homo sapiens
ttctatgtgttgacaagcctga

SEQ ID NO: 9359327 - DNA, 22 bp, Homo sapiens
ttctatgttagtatgggtctcc

SEQ ID NO: 9359328 - DNA, 22 bp, Homo sapiens
ttctgcatgaacagtttattcc

SEQ ID NO: 9359329 - DNA, 22 bp, Homo sapiens
ttctgcatgatattaaatgtaa

SEQ ID NO: 9359330 - DNA, 17 bp, Homo sapiens
ttctgcatgtgaagatg

SEQ ID NO: 9359331 - DNA, 22 bp, Homo sapiens
ttctgcatgtgtttcaaatact

SEQ ID NO: 9359332 - DNA, 22 bp, Homo sapiens
ttctgcatggagaaactgagtc

SEQ ID NO: 9359333 - DNA, 22 bp, Homo sapiens
ttctgcatggagaaactgagtc

SEQ ID NO: 9359334 - DNA, 22 bp, Homo sapiens
ttctggaagagtaaaataagcc

SEQ ID NO: 9359335 - DNA, 22 bp, Homo sapiens
ttctggaagaggtgtaagtata

SEQ ID NO: 9359336 - DNA, 22 bp, Homo sapiens
ttctggaagagtaaaataagcc

SEQ ID NO: 9359337 - DNA, 22 bp, Homo sapiens
ttctggaagatacctctcctaa

SEQ ID NO: 9359338 - DNA, 22 bp, Homo sapiens
ttctggaactatactgttggtg

SEQ ID NO: 9359339 - DNA, 22 bp, Homo sapiens
ttctggaagaataatgggcaaa

SEQ ID NO: 9359340 - DNA, 22 bp, Homo sapiens
ttctggaagaataatgggcaaa

SEQ ID NO: 9359341 - DNA, 22 bp, Homo sapiens
ttctggaaccaacatgccagtt

SEQ ID NO: 9359342 - DNA, 22 bp, Homo sapiens
ttctggaaccaacatgccagtt

SEQ ID NO: 9359343 - DNA, 22 bp, Homo sapiens
ttctggaaccagcctgcctggg

SEQ ID NO: 9359344 - DNA, 22 bp, Homo sapiens
ttctggaaccagcctgcctggg

SEQ ID NO: 9359345 - DNA, 22 bp, Homo sapiens
ttctggaagccatgggaacagg

SEQ ID NO: 9359346 - DNA, 23 bp, Homo sapiens
ttctggaagatttacttgagaca

SEQ ID NO: 9359347 - DNA, 22 bp, Homo sapiens
ttctggaagcagtggggagtga

SEQ ID NO: 9359348 - DNA, 22 bp, Homo sapiens
ttctggaagctgcaggtggccg

SEQ ID NO: 9359349 - DNA, 22 bp, Homo sapiens
ttctggaagccctaagggagaa

SEQ ID NO: 9359350 - DNA, 22 bp, Homo sapiens
ttctggaagctgcaggtggccg

SEQ ID NO: 9359351 - DNA, 22 bp, Homo sapiens
ttctggaagccccagagtcaga

SEQ ID NO: 9359352 - DNA, 22 bp, Homo sapiens
ttctggatgatccatttacaga

SEQ ID NO: 9359353 - DNA, 22 bp, Homo sapiens
ttctggaagggtggagtagctt

SEQ ID NO: 9359354 - DNA, 22 bp, Homo sapiens
ttctggaagggtggagtagctt

SEQ ID NO: 9359355 - DNA, 22 bp, Homo sapiens
ttctggaaggatgtttctatct

SEQ ID NO: 9359356 - DNA, 22 bp, Homo sapiens
ttctggaaggcagggagaaccc

SEQ ID NO: 9359357 - DNA, 22 bp, Homo sapiens
ttctggaaggatgtttctatct

SEQ ID NO: 9359358 - DNA, 22 bp, Homo sapiens
ttctggaagcttttggagagaa

SEQ ID NO: 9359359 - DNA, 22 bp, Homo sapiens
ttctggaagctgggcagcaccc

SEQ ID NO: 9359360 - DNA, 22 bp, Homo sapiens
ttctggaagctggaaaaggcaa

SEQ ID NO: 9359361 - DNA, 22 bp, Homo sapiens
ttctggaagctggaaaaggcaa

SEQ ID NO: 9359362 - DNA, 22 bp, Homo sapiens
tttccactcctattgcatctca

SEQ ID NO: 9359363 - DNA, 22 bp, Homo sapiens
tttccactctggccaccatctt

SEQ ID NO: 9359364 - DNA, 22 bp, Homo sapiens
tttccactgggcacggggccag

SEQ ID NO: 9359365 - DNA, 22 bp, Homo sapiens
tttccaatttttaagtggatga

SEQ ID NO: 9359366 - DNA, 22 bp, Homo sapiens
tttccacactcactgcactcat

SEQ ID NO: 9359367 - DNA, 22 bp, Homo sapiens
tttccacactgcagccagcaaa

SEQ ID NO: 9359368 - DNA, 22 bp, Homo sapiens
tttccacaatttgagcagcaga

SEQ ID NO: 9359369 - DNA, 22 bp, Homo sapiens
tttctacaggttgatgggtttg

SEQ ID NO: 9359370 - DNA, 22 bp, Homo sapiens
tttctacaggttgatgggtttg

SEQ ID NO: 9359371 - DNA, 22 bp, Homo sapiens
tttctacagtactgatttcata

SEQ ID NO: 9359372 - DNA, 22 bp, Homo sapiens
tttctacagctggtgcaacttt

SEQ ID NO: 9359373 - DNA, 22 bp, Homo sapiens
tttctacagctggtgcaacttt

SEQ ID NO: 9359374 - DNA, 22 bp, Homo sapiens
tttctacagctggtgcaacttt

SEQ ID NO: 9359375 - DNA, 22 bp, Homo sapiens
tttctacagaagatacactgct

SEQ ID NO: 9359376 - DNA, 22 bp, Homo sapiens
tttctacagaagatacactgct

SEQ ID NO: 9359377 - DNA, 22 bp, Homo sapiens
tttctacacttcgtggtgtttt

SEQ ID NO: 9359378 - DNA, 22 bp, Homo sapiens
tttctacaatttttggcatgag

SEQ ID NO: 9359379 - DNA, 22 bp, Homo sapiens
tttctacaacacttctgaatct

SEQ ID NO: 9359380 - DNA, 22 bp, Homo sapiens
tttctacaatttttggcatgag

SEQ ID NO: 9359381 - DNA, 22 bp, Homo sapiens
tttctacagaagatacactgct

SEQ ID NO: 9359382 - DNA, 22 bp, Homo sapiens
tttctacacttcgtggtgtttt

SEQ ID NO: 9359383 - DNA, 22 bp, Homo sapiens
tttctacaacacttctgaatct

SEQ ID NO: 9359384 - DNA, 22 bp, Homo sapiens
tttctaattgtggccgaggtag

SEQ ID NO: 9359385 - DNA, 22 bp, Homo sapiens
tttctacaacacttctgaatct

SEQ ID NO: 9359386 - DNA, 22 bp, Homo sapiens
tttctacaacacttctgaatct

SEQ ID NO: 9359387 - DNA, 22 bp, Homo sapiens
tttcattaaagtcaaatctggt

SEQ ID NO: 9359388 - DNA, 22 bp, Homo sapiens
tttcattacgtgtttgacttgt

SEQ ID NO: 9359389 - DNA, 22 bp, Homo sapiens
tttcattaaagtcaaatctggt

SEQ ID NO: 9359390 - DNA, 22 bp, Homo sapiens
tttcatgtttatggaaaatgag

SEQ ID NO: 9359391 - DNA, 22 bp, Homo sapiens
tttcatgttggatactgtttca

SEQ ID NO: 9359392 - DNA, 22 bp, Homo sapiens
tttcatgttggatactgtttca

SEQ ID NO: 9359393 - DNA, 23 bp, Homo sapiens
tttcatgttggcatgactgactt

SEQ ID NO: 9359394 - DNA, 22 bp, Homo sapiens
tttcatgttacatttaaaatgt

SEQ ID NO: 9359395 - DNA, 22 bp, Homo sapiens
tttcatgttagttggttcttgg

SEQ ID NO: 9359396 - DNA, 22 bp, Homo sapiens
tttcattatacagcttcataaa

SEQ ID NO: 9359397 - DNA, 18 bp, Homo sapiens
tttcattataaagcaggc

SEQ ID NO: 9359398 - DNA, 22 bp, Homo sapiens
tttcattataaaaagttggctt

SEQ ID NO: 9359399 - DNA, 22 bp, Homo sapiens
tttcattagtatgacagcacgc

SEQ ID NO: 9359400 - DNA, 22 bp, Homo sapiens
tttcattagtatgacagcacgc

SEQ ID NO: 9359401 - DNA, 22 bp, Homo sapiens
tttccaagtactgagctgtcaa

SEQ ID NO: 9359402 - DNA, 18 bp, Homo sapiens
tttccaagaagagagctc

SEQ ID NO: 9359403 - DNA, 22 bp, Homo sapiens
tttccaagctgtcttggcccac

SEQ ID NO: 9359404 - DNA, 22 bp, Homo sapiens
tttccaagagcttatttctgaa

SEQ ID NO: 9359405 - DNA, 18 bp, Homo sapiens
ctctctttccactctttg

SEQ ID NO: 9359406 - DNA, 18 bp, Homo sapiens
ctctctttccactctttg

SEQ ID NO: 9359407 - DNA, 18 bp, Homo sapiens
ctctctttccactctttg

SEQ ID NO: 9359408 - DNA, 22 bp, Homo sapiens
ctctctttgatgtataaataat

SEQ ID NO: 9359409 - DNA, 22 bp, Homo sapiens
ctctgaaactcctgcaccttct

SEQ ID NO: 9359410 - DNA, 22 bp, Homo sapiens
ctctgaaagttagagaaaatag

SEQ ID NO: 9359411 - DNA, 22 bp, Homo sapiens
ctctgaaagcaaaactagagaa

SEQ ID NO: 9359412 - DNA, 22 bp, Homo sapiens
ctctgaaagagtttagtattat

SEQ ID NO: 9359413 - DNA, 22 bp, Homo sapiens
ctctgaaagagtttagtattat

SEQ ID NO: 9359414 - DNA, 22 bp, Homo sapiens
ctctgaaagagtttagtattat

SEQ ID NO: 9359415 - DNA, 22 bp, Homo sapiens
ctctctgttcattgagtcaaaa

SEQ ID NO: 9359416 - DNA, 22 bp, Homo sapiens
ctctcttcccgtgagtgttgca

SEQ ID NO: 9359417 - DNA, 22 bp, Homo sapiens
ctctcttcccgtgagtgttgca

SEQ ID NO: 9359418 - DNA, 22 bp, Homo sapiens
ctctctggtttcagcgaagggg

SEQ ID NO: 9359419 - DNA, 22 bp, Homo sapiens
ctctctggtttcagcgaagggg

SEQ ID NO: 9359420 - DNA, 22 bp, Homo sapiens
ctctctgtggtggctgtcccat

SEQ ID NO: 9359421 - DNA, 22 bp, Homo sapiens
ctctctgtggtggctgtcccat

SEQ ID NO: 9359422 - DNA, 22 bp, Homo sapiens
ctctctgtggtggctgtcccat

SEQ ID NO: 9359423 - DNA, 22 bp, Homo sapiens
ctctctgtggtggctgtcccat

SEQ ID NO: 9359424 - DNA, 22 bp, Homo sapiens
ctctctgtgctcacaagggcag

SEQ ID NO: 9359425 - DNA, 19 bp, Homo sapiens
ctctctggcggtgtctgcg

SEQ ID NO: 9359426 - DNA, 18 bp, Homo sapiens
ctctctggtctggatccc

SEQ ID NO: 9359427 - DNA, 19 bp, Homo sapiens
ctctctggcggtgtctgcg

SEQ ID NO: 9359428 - DNA, 22 bp, Homo sapiens
tttctcaactgtattatgcaga

SEQ ID NO: 9359429 - DNA, 22 bp, Homo sapiens
tttctcaaggtgtcatgtattt

SEQ ID NO: 9359430 - DNA, 22 bp, Homo sapiens
tttctcaagtactgcacatgaa

SEQ ID NO: 9359431 - DNA, 22 bp, Homo sapiens
tttctacatgtcaatccaaacc

SEQ ID NO: 9359432 - DNA, 22 bp, Homo sapiens
tttctacatgtcaatccaaacc

SEQ ID NO: 9359433 - DNA, 22 bp, Homo sapiens
tttctacatgtcaatccaaacc

SEQ ID NO: 9359434 - DNA, 22 bp, Homo sapiens
tttctacagtactgatttcata

SEQ ID NO: 9359435 - DNA, 17 bp, Homo sapiens
tttctacagttggcagc

SEQ ID NO: 9359436 - DNA, 17 bp, Homo sapiens
tttctacagttggcagc

SEQ ID NO: 9359437 - DNA, 22 bp, Homo sapiens
tttctattttaaaggcatatgg

SEQ ID NO: 9359438 - DNA, 22 bp, Homo sapiens
tttctacatgtcagtaactgat

SEQ ID NO: 9359439 - DNA, 22 bp, Homo sapiens
tttctacatgtcagtaactgat

SEQ ID NO: 9359440 - DNA, 22 bp, Homo sapiens
tttctacatgtcagtaactgat

SEQ ID NO: 9359441 - DNA, 22 bp, Homo sapiens
tttctacatgtcagtaactgat

SEQ ID NO: 9359442 - DNA, 23 bp, Homo sapiens
tttctcaaagagtggcagcttca

SEQ ID NO: 9359443 - DNA, 22 bp, Homo sapiens
tttctcaaaattcagtggtatc

SEQ ID NO: 9359444 - DNA, 22 bp, Homo sapiens
tttctcaaaagacagaagtgaa

SEQ ID NO: 9359445 - DNA, 22 bp, Homo sapiens
ctccaggagggcttcctgtgat

SEQ ID NO: 9359446 - DNA, 22 bp, Homo sapiens
ctccaggagtggcctggacacc

SEQ ID NO: 9359447 - DNA, 22 bp, Homo sapiens
ctccaggagggggatggctgta

SEQ ID NO: 9359448 - DNA, 19 bp, Homo sapiens
ctccaggatggctgggcga

SEQ ID NO: 9359449 - DNA, 22 bp, Homo sapiens
ctccaggccaagattaagtaat

SEQ ID NO: 9359450 - DNA, 19 bp, Homo sapiens
ctccaggatggctgggcga

SEQ ID NO: 9359451 - DNA, 22 bp, Homo sapiens
ctccaggcccctggccttctgc

SEQ ID NO: 9359452 - DNA, 23 bp, Homo sapiens
tttatattcctaatgtcttgagc

SEQ ID NO: 9359453 - DNA, 22 bp, Homo sapiens
tttatgattaatccaattctgt

SEQ ID NO: 9359454 - DNA, 22 bp, Homo sapiens
ctccaggcccacgtcgaggagg

SEQ ID NO: 9359455 - DNA, 22 bp, Homo sapiens
ctccaggccatggctgcggagg

SEQ ID NO: 9359456 - DNA, 22 bp, Homo sapiens
ctccaggccatggctgcggagg

SEQ ID NO: 9359457 - DNA, 22 bp, Homo sapiens
ctccaggccagggaagtggaca

SEQ ID NO: 9359458 - DNA, 22 bp, Homo sapiens
ctccaggccatggctgcggagg

SEQ ID NO: 9359459 - DNA, 22 bp, Homo sapiens
tttatgcagcctcagtatcaga

SEQ ID NO: 9359460 - DNA, 22 bp, Homo sapiens
tttatgattattttaaagcagc

SEQ ID NO: 9359461 - DNA, 22 bp, Homo sapiens
tttatgcacacttagacatggc

SEQ ID NO: 9359462 - DNA, 22 bp, Homo sapiens
tttatgtaagtggaatgatgcc

SEQ ID NO: 9359463 - DNA, 22 bp, Homo sapiens
tttatgtaagtggaatgatgcc

SEQ ID NO: 9359464 - DNA, 22 bp, Homo sapiens
tttatgtaagtggaatgatgcc

SEQ ID NO: 9359465 - DNA, 19 bp, Homo sapiens
tttattcacctttaccttg

SEQ ID NO: 9359466 - DNA, 22 bp, Homo sapiens
tttattcacttcagtgccaaag

SEQ ID NO: 9359467 - DNA, 22 bp, Homo sapiens
tttattcagcagcagcagtggt

SEQ ID NO: 9359468 - DNA, 22 bp, Homo sapiens
ctccttcacgcaggctgccatg

SEQ ID NO: 9359469 - DNA, 22 bp, Homo sapiens
ctccttcatgtcatgtgtccgg

SEQ ID NO: 9359470 - DNA, 22 bp, Homo sapiens
tttcagaatagcaaagcaagct

SEQ ID NO: 9359471 - DNA, 22 bp, Homo sapiens
ctcctgtggtcaagggtgggac

SEQ ID NO: 9359472 - DNA, 22 bp, Homo sapiens
ctcctgtgttcaagcgattctc

SEQ ID NO: 9359473 - DNA, 22 bp, Homo sapiens
tttcagaatatcgattcagtga

SEQ ID NO: 9359474 - DNA, 23 bp, Homo sapiens
tttcagaagtggtcctaggaagc

SEQ ID NO: 9359475 - DNA, 23 bp, Homo sapiens
tttcagaagtggtcctaggaagc

SEQ ID NO: 9359476 - DNA, 23 bp, Homo sapiens
tttcagaagtggtcctaggaagc

SEQ ID NO: 9359477 - DNA, 22 bp, Homo sapiens
ctccttccctaccatcaatgtt

SEQ ID NO: 9359478 - DNA, 22 bp, Homo sapiens
ctccttcccatgagtgtgggca

SEQ ID NO: 9359479 - DNA, 22 bp, Homo sapiens
ctccttcccatgagtgtgggca

SEQ ID NO: 9359480 - DNA, 22 bp, Homo sapiens
ctccttccaacaagagaaagag

SEQ ID NO: 9359481 - DNA, 22 bp, Homo sapiens
ctccttcctgccccagtgataa

SEQ ID NO: 9359482 - DNA, 22 bp, Homo sapiens
tttattcatcatctgttcatat

SEQ ID NO: 9359483 - DNA, 22 bp, Homo sapiens
tttattcatcatctgttcatat

SEQ ID NO: 9359484 - DNA, 22 bp, Homo sapiens
tttattcagcagcagcagtggt

SEQ ID NO: 9359485 - DNA, 22 bp, Homo sapiens
tttcagaaccgctaaaataaat

SEQ ID NO: 9359486 - DNA, 22 bp, Homo sapiens
tttcagaaccaagagagacatc

SEQ ID NO: 9359487 - DNA, 22 bp, Homo sapiens
tttcagaaggggagaaaggtca

SEQ ID NO: 9359488 - DNA, 22 bp, Homo sapiens
tttcagaagtcaactaggtaaa

SEQ ID NO: 9359489 - DNA, 22 bp, Homo sapiens
tttcagaaggggagaaaggtca

SEQ ID NO: 9359490 - DNA, 22 bp, Homo sapiens
tttcagaaattatattagatgc

SEQ ID NO: 9359491 - DNA, 22 bp, Homo sapiens
ctctgtgcttatgctccatggg

SEQ ID NO: 9359492 - DNA, 22 bp, Homo sapiens
ctctgtggaagaagaaagaagg

SEQ ID NO: 9359493 - DNA, 22 bp, Homo sapiens
ctctgtgcttatgctccatggg

SEQ ID NO: 9359494 - DNA, 22 bp, Homo sapiens
ctctgtgcgggccatggtcagg

SEQ ID NO: 9359495 - DNA, 22 bp, Homo sapiens
ctctgtgccagtctgcactcgg

SEQ ID NO: 9359496 - DNA, 22 bp, Homo sapiens
ctctgtgccctactgctcagct

SEQ ID NO: 9359497 - DNA, 22 bp, Homo sapiens
ctctgtgccctactgctcagct

SEQ ID NO: 9359498 - DNA, 22 bp, Homo sapiens
tttgttcattttgagctcatca

SEQ ID NO: 9359499 - DNA, 22 bp, Homo sapiens
tttgttctaacttctgcagaca

SEQ ID NO: 9359500 - DNA, 22 bp, Homo sapiens
tttgttctagatcgtgtttgtg

SEQ ID NO: 9359501 - DNA, 22 bp, Homo sapiens
ctctggtttcgcaggaaataga

SEQ ID NO: 9359502 - DNA, 22 bp, Homo sapiens
ctctggtttatttcttggaaag

SEQ ID NO: 9359503 - DNA, 22 bp, Homo sapiens
ctctggttgagtgagaaccaag

SEQ ID NO: 9359504 - DNA, 22 bp, Homo sapiens
ctctggttgcagctgaagttcc

SEQ ID NO: 9359505 - DNA, 22 bp, Homo sapiens
ctctgtggcttgcctttctgtc

SEQ ID NO: 9359506 - DNA, 22 bp, Homo sapiens
ctctgtggcttgcctttctgtc

SEQ ID NO: 9359507 - DNA, 22 bp, Homo sapiens
ctctgtggctacacaaacctcc

SEQ ID NO: 9359508 - DNA, 17 bp, Homo sapiens
ctctgtggaggtgttta

SEQ ID NO: 9359509 - DNA, 22 bp, Homo sapiens
ctctgtggctacacaaacctcc

SEQ ID NO: 9359510 - DNA, 17 bp, Homo sapiens
ctctgtggaggtgttta

SEQ ID NO: 9359511 - DNA, 22 bp, Homo sapiens
ctctgtgggaggaggagtaggc

SEQ ID NO: 9359512 - DNA, 22 bp, Homo sapiens
ctctgtgggaagctgggtgtga

SEQ ID NO: 9359513 - DNA, 22 bp, Homo sapiens
ctctgtgggaagctgggtgtga

SEQ ID NO: 9359514 - DNA, 22 bp, Homo sapiens
ctctgtgggccagagaggcccc

SEQ ID NO: 9359515 - DNA, 22 bp, Homo sapiens
ctctgtgggccagagaggcccc

SEQ ID NO: 9359516 - DNA, 22 bp, Homo sapiens
ctctgtgggaggaggagtaggc

SEQ ID NO: 9359517 - DNA, 22 bp, Homo sapiens
ctctgtggtggagtgggtcacc

SEQ ID NO: 9359518 - DNA, 22 bp, Homo sapiens
ctctgtggtggagtgggtcacc

SEQ ID NO: 9359519 - DNA, 22 bp, Homo sapiens
ctctgtggtggagtgggtcacc

SEQ ID NO: 9359520 - DNA, 22 bp, Homo sapiens
ctctgtgggtatttatatgtat

SEQ ID NO: 9359521 - DNA, 22 bp, Homo sapiens
ctctgtgggtatttatatgtat

SEQ ID NO: 9359522 - DNA, 22 bp, Homo sapiens
ctctgtggtaaaatagcagtat

SEQ ID NO: 9359523 - DNA, 22 bp, Homo sapiens
ctctgtggtaaaatagcagtat

SEQ ID NO: 9359524 - DNA, 22 bp, Homo sapiens
ctctgtgggggagaggcagctg

SEQ ID NO: 9359525 - DNA, 22 bp, Homo sapiens
ctctgtgggggagaggcagctg

SEQ ID NO: 9359526 - DNA, 22 bp, Homo sapiens
ctctgtgggggagaggcagctg

SEQ ID NO: 9359527 - DNA, 22 bp, Homo sapiens
ctctgtgggcctgtgctttagt

SEQ ID NO: 9359528 - DNA, 22 bp, Homo sapiens
ctctgtgggccagagaggcccc

SEQ ID NO: 9359529 - DNA, 22 bp, Homo sapiens
ctctgtgttcagcctagcagaa

SEQ ID NO: 9359530 - DNA, 22 bp, Homo sapiens
ctctgtgttcagcctagcagaa

SEQ ID NO: 9359531 - DNA, 22 bp, Homo sapiens
ctctgtgttcagcctagcagaa

SEQ ID NO: 9359532 - DNA, 22 bp, Homo sapiens
ctctgtggttagactatggctg

SEQ ID NO: 9359533 - DNA, 22 bp, Homo sapiens
ctctgtggttagactatggctg

SEQ ID NO: 9359534 - DNA, 22 bp, Homo sapiens
ctctgtggttagactatggctg

SEQ ID NO: 9359535 - DNA, 22 bp, Homo sapiens
ctctgtggttagactatggctg

SEQ ID NO: 9359536 - DNA, 22 bp, Homo sapiens
ctctgtgtatccaagttcaggt

SEQ ID NO: 9359537 - DNA, 22 bp, Homo sapiens
ttttgcctaagaatctctctga

SEQ ID NO: 9359538 - DNA, 22 bp, Homo sapiens
ttttgcctgagagtgaaaataa

SEQ ID NO: 9359539 - DNA, 17 bp, Homo sapiens
ttttctctcttggattc

SEQ ID NO: 9359540 - DNA, 17 bp, Homo sapiens
ttttctctcttggattc

SEQ ID NO: 9359541 - DNA, 22 bp, Homo sapiens
ttttgcttaatctagattttgc

SEQ ID NO: 9359542 - DNA, 22 bp, Homo sapiens
ttttgctgttatatgctattat

SEQ ID NO: 9359543 - DNA, 17 bp, Homo sapiens
ctctgggtctcctgctt

SEQ ID NO: 9359544 - DNA, 22 bp, Homo sapiens
ctctgggtctacctgtggccag

SEQ ID NO: 9359545 - DNA, 22 bp, Homo sapiens
ctctgggtctataatgcagctg

SEQ ID NO: 9359546 - DNA, 20 bp, Homo sapiens
ctctgggtcgagacagactt

SEQ ID NO: 9359547 - DNA, 22 bp, Homo sapiens
ctctgggtctataatgcagctg

SEQ ID NO: 9359548 - DNA, 20 bp, Homo sapiens
ctctgggtcgagacagactt

SEQ ID NO: 9359549 - DNA, 20 bp, Homo sapiens
ctctgggtcgagacagactt

SEQ ID NO: 9359550 - DNA, 22 bp, Homo sapiens
ctctgggtgcagcgctgaccgg

SEQ ID NO: 9359551 - DNA, 17 bp, Homo sapiens
ctctgggtgcctgtgtg

SEQ ID NO: 9359552 - DNA, 22 bp, Homo sapiens
ctctgggtgcagcgctgaccgg

SEQ ID NO: 9359553 - DNA, 22 bp, Homo sapiens
ctctgggtgagacagacctggt

SEQ ID NO: 9359554 - DNA, 22 bp, Homo sapiens
ctctgggtgggcagcagatgga

SEQ ID NO: 9359555 - DNA, 22 bp, Homo sapiens
ctctgggtgggcagcagatgga

SEQ ID NO: 9359556 - DNA, 22 bp, Homo sapiens
ctctgggtgtgacagcacctgg

SEQ ID NO: 9359557 - DNA, 22 bp, Homo sapiens
ctctgggtgtcttaggagctca

SEQ ID NO: 9359558 - DNA, 22 bp, Homo sapiens
ctctgggtggtctcactgagtg

SEQ ID NO: 9359559 - DNA, 22 bp, Homo sapiens
ctctgggtgtcttaggagctca

SEQ ID NO: 9359560 - DNA, 22 bp, Homo sapiens
ctctgggtggtctcactgagtg

SEQ ID NO: 9359561 - DNA, 22 bp, Homo sapiens
tttgttcagctctcattgatta

SEQ ID NO: 9359562 - DNA, 22 bp, Homo sapiens
ctctgggtgttaatgtcagtgt

SEQ ID NO: 9359563 - DNA, 22 bp, Homo sapiens
ctctgggtgtgacagcacctgg

SEQ ID NO: 9359564 - DNA, 21 bp, Homo sapiens
tttgttcaggcaagttacagt

SEQ ID NO: 9359565 - DNA, 22 bp, Homo sapiens
tttgttcattagtacagttgta

SEQ ID NO: 9359566 - DNA, 22 bp, Homo sapiens
ctctggctcccgcagcccccat

SEQ ID NO: 9359567 - DNA, 22 bp, Homo sapiens
tttggaagtcctgaaatagagg

SEQ ID NO: 9359568 - DNA, 22 bp, Homo sapiens
tttggaatattaaaatgtctca

SEQ ID NO: 9359569 - DNA, 23 bp, Homo sapiens
ctctgggtccgatgtcctgacag

SEQ ID NO: 9359570 - DNA, 23 bp, Homo sapiens
ctctgggtccgatgtcctgacag

SEQ ID NO: 9359571 - DNA, 22 bp, Homo sapiens
ctctgggtcccacgtcattgct

SEQ ID NO: 9359572 - DNA, 19 bp, Homo sapiens
ctctgggctgcatcttggt

SEQ ID NO: 9359573 - DNA, 19 bp, Homo sapiens
ctctgggctgcatcttggt

SEQ ID NO: 9359574 - DNA, 22 bp, Homo sapiens
tttggaatgtagtttaatcatc

SEQ ID NO: 9359575 - DNA, 22 bp, Homo sapiens
tttggaatggtaccttcagttg

SEQ ID NO: 9359576 - DNA, 22 bp, Homo sapiens
ctctgcaccttgtaggaggcaa

SEQ ID NO: 9359577 - DNA, 22 bp, Homo sapiens
ctctgcagaatttgagctgctc

SEQ ID NO: 9359578 - DNA, 22 bp, Homo sapiens
ctctgcagaggcccaaggctga

SEQ ID NO: 9359579 - DNA, 22 bp, Homo sapiens
ctctgcagaggcccaaggctga

SEQ ID NO: 9359580 - DNA, 22 bp, Homo sapiens
ctctgcagagcctccagcccag

SEQ ID NO: 9359581 - DNA, 22 bp, Homo sapiens
ctctgcagaatttgagctgctc

SEQ ID NO: 9359582 - DNA, 22 bp, Homo sapiens
tttgaccctgttattctccctg

SEQ ID NO: 9359583 - DNA, 22 bp, Homo sapiens
tttgaatagaggcccctcagaa

SEQ ID NO: 9359584 - DNA, 21 bp, Homo sapiens
tttgaatagaaatagtgctta

SEQ ID NO: 9359585 - DNA, 22 bp, Homo sapiens
tttgacattggcttattctgtt

SEQ ID NO: 9359586 - DNA, 22 bp, Homo sapiens
ctctgcacccccggctcctcgt

SEQ ID NO: 9359587 - DNA, 22 bp, Homo sapiens
ctctgcacctacacaacaggaa

SEQ ID NO: 9359588 - DNA, 22 bp, Homo sapiens
ctctgcacccccggctcctcgt

SEQ ID NO: 9359589 - DNA, 22 bp, Homo sapiens
ctctgcacccccggctcctcgt

SEQ ID NO: 9359590 - DNA, 22 bp, Homo sapiens
ctctgcaatctgagcacttgta

SEQ ID NO: 9359591 - DNA, 22 bp, Homo sapiens
ctctgcaacttctagcagtgtc

SEQ ID NO: 9359592 - DNA, 22 bp, Homo sapiens
ctctgagttgaggcaggagagt

SEQ ID NO: 9359593 - DNA, 22 bp, Homo sapiens
ctctgaggtttcctcacaagct

SEQ ID NO: 9359594 - DNA, 22 bp, Homo sapiens
ctctgaggttcctttgccctcg

SEQ ID NO: 9359595 - DNA, 22 bp, Homo sapiens
ctctgaggtctaggaccatggc

SEQ ID NO: 9359596 - DNA, 19 bp, Homo sapiens
tttgaaagagttttattgg

SEQ ID NO: 9359597 - DNA, 22 bp, Homo sapiens
ctctgacaagacagaccataac

SEQ ID NO: 9359598 - DNA, 21 bp, Homo sapiens
ctctgaatcctgcttctcagt

SEQ ID NO: 9359599 - DNA, 22 bp, Homo sapiens
ctctgacagccacatagaggct

SEQ ID NO: 9359600 - DNA, 22 bp, Homo sapiens
ctctgaaggtttctgttactgt

SEQ ID NO: 9359601 - DNA, 22 bp, Homo sapiens
ctctgaagccccaaatagtccg

SEQ ID NO: 9359602 - DNA, 22 bp, Homo sapiens
tttgaaaaaggcctttggtatg

SEQ ID NO: 9359603 - DNA, 22 bp, Homo sapiens
tttgaaaacttaatttggtcgt

SEQ ID NO: 9359604 - DNA, 22 bp, Homo sapiens
tttgaaaagaaccatcgcctta

SEQ ID NO: 9359605 - DNA, 22 bp, Homo sapiens
tttgaaacctagttatatgact

SEQ ID NO: 9359606 - DNA, 22 bp, Homo sapiens
tttgaaaatttaagtgctacac

SEQ ID NO: 9359607 - DNA, 22 bp, Homo sapiens
tttgaaacccgtcactttgagt

SEQ ID NO: 9359608 - DNA, 22 bp, Homo sapiens
tttgaaagacagaatatttttg

SEQ ID NO: 9359609 - DNA, 22 bp, Homo sapiens
tttgaaagaatttatgtacttt

SEQ ID NO: 9359610 - DNA, 22 bp, Homo sapiens
tttgaaagaatttatgtacttt

SEQ ID NO: 9359611 - DNA, 22 bp, Homo sapiens
tttgaaactctgaacatgtttc

SEQ ID NO: 9359612 - DNA, 22 bp, Homo sapiens
tttgagaagagtttgaggtatt

SEQ ID NO: 9359613 - DNA, 22 bp, Homo sapiens
tttgagaaccctgtattttaag

SEQ ID NO: 9359614 - DNA, 22 bp, Homo sapiens
tttgagaaactgattattatgg

SEQ ID NO: 9359615 - DNA, 22 bp, Homo sapiens
tttgagaaaggggatttaattc

SEQ ID NO: 9359616 - DNA, 22 bp, Homo sapiens
tttgagaaaaccagaaagatct

SEQ ID NO: 9359617 - DNA, 22 bp, Homo sapiens
tttgagaaaaccagaaagatct

SEQ ID NO: 9359618 - DNA, 22 bp, Homo sapiens
tttgagaaacagacgaaagaca

SEQ ID NO: 9359619 - DNA, 22 bp, Homo sapiens
tttgagaaacagacgaaagaca

SEQ ID NO: 9359620 - DNA, 22 bp, Homo sapiens
tttgactcctgtgtttctggaa

SEQ ID NO: 9359621 - DNA, 22 bp, Homo sapiens
ctctggagtgcagcctggtggc

SEQ ID NO: 9359622 - DNA, 22 bp, Homo sapiens
ctctggagtgcagcctggtggc

SEQ ID NO: 9359623 - DNA, 22 bp, Homo sapiens
ctctggcacactccttccaggt

SEQ ID NO: 9359624 - DNA, 20 bp, Homo sapiens
ctctggcaaaggatgcctat

SEQ ID NO: 9359625 - DNA, 22 bp, Homo sapiens
ctctggcaattgctgctgactc

SEQ ID NO: 9359626 - DNA, 20 bp, Homo sapiens
ctctggcaaaggatgcctat

SEQ ID NO: 9359627 - DNA, 22 bp, Homo sapiens
ctctggcctggggcctgctccc

SEQ ID NO: 9359628 - DNA, 22 bp, Homo sapiens
ctctggcctggggcctgctccc

SEQ ID NO: 9359629 - DNA, 22 bp, Homo sapiens
ctctggcctggggcctgctccc

SEQ ID NO: 9359630 - DNA, 22 bp, Homo sapiens
ctctggcctgcagatccatgct

SEQ ID NO: 9359631 - DNA, 22 bp, Homo sapiens
ctctggcctgcagatccatgct

SEQ ID NO: 9359632 - DNA, 22 bp, Homo sapiens
ctctggcctgcttcctcaggta

SEQ ID NO: 9359633 - DNA, 22 bp, Homo sapiens
ctctggcagagctgtagacttc

SEQ ID NO: 9359634 - DNA, 22 bp, Homo sapiens
ctctggcacactccttccaggt

SEQ ID NO: 9359635 - DNA, 22 bp, Homo sapiens
ctctggcacactccttccaggt

SEQ ID NO: 9359636 - DNA, 22 bp, Homo sapiens
ctctggccagagcctgcgggaa

SEQ ID NO: 9359637 - DNA, 22 bp, Homo sapiens
ctctggcagagctgtagacttc

SEQ ID NO: 9359638 - DNA, 22 bp, Homo sapiens
ctctggccgcagctcagctctg

SEQ ID NO: 9359639 - DNA, 22 bp, Homo sapiens
ctgcaggactgaaagatgaggt

SEQ ID NO: 9359640 - DNA, 22 bp, Homo sapiens
ctgcaggacagggaggagcaag

SEQ ID NO: 9359641 - DNA, 22 bp, Homo sapiens
ctgcaggaattcaaagtgagct

SEQ ID NO: 9359642 - DNA, 22 bp, Homo sapiens
ctgcaggacagggaggagcaag

SEQ ID NO: 9359643 - DNA, 22 bp, Homo sapiens
ctgcaggacagggaggagcaag

SEQ ID NO: 9359644 - DNA, 22 bp, Homo sapiens
ctgcagctttggaaacctgttt

SEQ ID NO: 9359645 - DNA, 22 bp, Homo sapiens
ctgcagctttcgctccatcagc

SEQ ID NO: 9359646 - DNA, 22 bp, Homo sapiens
ctgcagctttcgctccatcagc

SEQ ID NO: 9359647 - DNA, 22 bp, Homo sapiens
ctgcagcttatttgctgtgtga

SEQ ID NO: 9359648 - DNA, 22 bp, Homo sapiens
ctgcagctttttgtgcttgtaa

SEQ ID NO: 9359649 - DNA, 16 bp, Homo sapiens
ctgaggtttggccaca

SEQ ID NO: 9359650 - DNA, 23 bp, Homo sapiens
ctgcagccgcgtggggacgtgga

SEQ ID NO: 9359651 - DNA, 22 bp, Homo sapiens
ctgcagcctaggtgcagctggg

SEQ ID NO: 9359652 - DNA, 22 bp, Homo sapiens
ctgcagcctcaacctcctgagc

SEQ ID NO: 9359653 - DNA, 22 bp, Homo sapiens
ctgcagctgggccagggccacc

SEQ ID NO: 9359654 - DNA, 22 bp, Homo sapiens
ctgcagctgggccagggccacc

SEQ ID NO: 9359655 - DNA, 22 bp, Homo sapiens
ctgcagcctcaacctcctgagc

SEQ ID NO: 9359656 - DNA, 22 bp, Homo sapiens
ctgcagctgtctctactgggca

SEQ ID NO: 9359657 - DNA, 22 bp, Homo sapiens
ctgcagctgtagaggacagtgg

SEQ ID NO: 9359658 - DNA, 22 bp, Homo sapiens
ctgcagcttaaaggagttcaat

SEQ ID NO: 9359659 - DNA, 22 bp, Homo sapiens
ctgcagcttaagggaggggttg

SEQ ID NO: 9359660 - DNA, 22 bp, Homo sapiens
ctgcagctgtgagtgctggatg

SEQ ID NO: 9359661 - DNA, 22 bp, Homo sapiens
ctgcagctgtgagtgctggatg

SEQ ID NO: 9359662 - DNA, 22 bp, Homo sapiens
ctgcagctgtgagtgctggatg

SEQ ID NO: 9359663 - DNA, 22 bp, Homo sapiens
ctgaggtggaacagaggtgaag

SEQ ID NO: 9359664 - DNA, 22 bp, Homo sapiens
ctgaggtgatgtcaaatgggtt

SEQ ID NO: 9359665 - DNA, 22 bp, Homo sapiens
ctgaggtgatgtcaaatgggtt

SEQ ID NO: 9359666 - DNA, 22 bp, Homo sapiens
ctgaggtgctagggtccctgct

SEQ ID NO: 9359667 - DNA, 22 bp, Homo sapiens
ctgaggtgctagggtccctgct

SEQ ID NO: 9359668 - DNA, 19 bp, Homo sapiens
ctgaggtgaggggcatcat

SEQ ID NO: 9359669 - DNA, 22 bp, Homo sapiens
ctgaggtgagcttccctgggct

SEQ ID NO: 9359670 - DNA, 19 bp, Homo sapiens
ctgaggtgaggggcatcat

SEQ ID NO: 9359671 - DNA, 22 bp, Homo sapiens
ctgaggtggcatcctagctcta

SEQ ID NO: 9359672 - DNA, 22 bp, Homo sapiens
ctgaggtggcctctgccgggga

SEQ ID NO: 9359673 - DNA, 22 bp, Homo sapiens
ctgaggtggcatcctagctcta

SEQ ID NO: 9359674 - DNA, 22 bp, Homo sapiens
ctgaggtggcgcctctctttaa

SEQ ID NO: 9359675 - DNA, 22 bp, Homo sapiens
ctgaggtgtgaaatggtggcaa

SEQ ID NO: 9359676 - DNA, 22 bp, Homo sapiens
ctgaggtggggcctgggcatca

SEQ ID NO: 9359677 - DNA, 22 bp, Homo sapiens
ctgaggtgtggtctgggagtat

SEQ ID NO: 9359678 - DNA, 22 bp, Homo sapiens
ctgaggtgtgctttcaatgggt

SEQ ID NO: 9359679 - DNA, 22 bp, Homo sapiens
ctgaggttggagatattgcaga

SEQ ID NO: 9359680 - DNA, 22 bp, Homo sapiens
ctgaggtgtttagtaggggcgg

SEQ ID NO: 9359681 - DNA, 22 bp, Homo sapiens
ctgcaggagtgaaagcaggcct

SEQ ID NO: 9359682 - DNA, 22 bp, Homo sapiens
ctgcaggaggatcctgagagtg

SEQ ID NO: 9359683 - DNA, 22 bp, Homo sapiens
ctgcaggagcaaagcctctgct

SEQ ID NO: 9359684 - DNA, 22 bp, Homo sapiens
ctgcaggagcaagcctgggaga

SEQ ID NO: 9359685 - DNA, 22 bp, Homo sapiens
ctgcaggaggatcctgagagtg

SEQ ID NO: 9359686 - DNA, 22 bp, Homo sapiens
ctgcaggatttcatgggctgac

SEQ ID NO: 9359687 - DNA, 21 bp, Homo sapiens
ctgcaggatgctgaagccagg

SEQ ID NO: 9359688 - DNA, 22 bp, Homo sapiens
ctgcaggagtgaaagcaggcct

SEQ ID NO: 9359689 - DNA, 18 bp, Homo sapiens
ctgccatgtcctactgtc

SEQ ID NO: 9359690 - DNA, 22 bp, Homo sapiens
ctgccatgttacctgcacaggt

SEQ ID NO: 9359691 - DNA, 22 bp, Homo sapiens
ctgccatgttacctgcacaggt

SEQ ID NO: 9359692 - DNA, 22 bp, Homo sapiens
ctgcccagattttaccacctgc

SEQ ID NO: 9359693 - DNA, 22 bp, Homo sapiens
ctgcccacacctgagctgggcc

SEQ ID NO: 9359694 - DNA, 20 bp, Homo sapiens
ctgcccagccactgagggat

SEQ ID NO: 9359695 - DNA, 20 bp, Homo sapiens
ctgcccagccactgagggat

SEQ ID NO: 9359696 - DNA, 20 bp, Homo sapiens
ctgcccagccactgagggat

SEQ ID NO: 9359697 - DNA, 22 bp, Homo sapiens
ctgcccatctggccacacacag

SEQ ID NO: 9359698 - DNA, 22 bp, Homo sapiens
ctgccccacaggcttggtaggg

SEQ ID NO: 9359699 - DNA, 23 bp, Homo sapiens
ctgccccaattataaaagaagat

SEQ ID NO: 9359700 - DNA, 23 bp, Homo sapiens
ctgccccaattataaaagaagat

SEQ ID NO: 9359701 - DNA, 22 bp, Homo sapiens
ctgcccataaactttccacctg

SEQ ID NO: 9359702 - DNA, 22 bp, Homo sapiens
ctgcccatctgcagacatgcgt

SEQ ID NO: 9359703 - DNA, 22 bp, Homo sapiens
ctgcccagtttgggagcctttc

SEQ ID NO: 9359704 - DNA, 22 bp, Homo sapiens
ctgcccaggaaccagaggggca

SEQ ID NO: 9359705 - DNA, 22 bp, Homo sapiens
ctgccccaccccaacctgaggt

SEQ ID NO: 9359706 - DNA, 22 bp, Homo sapiens
ctgccccaggacctcttctgga

SEQ ID NO: 9359707 - DNA, 22 bp, Homo sapiens
ctgccccagcctggggccttct

SEQ ID NO: 9359708 - DNA, 22 bp, Homo sapiens
ctgccccagcctggggccttct

SEQ ID NO: 9359709 - DNA, 22 bp, Homo sapiens
ctgccccagcctggggccttct

SEQ ID NO: 9359710 - DNA, 22 bp, Homo sapiens
ctgccccaggacctcttctgga

SEQ ID NO: 9359711 - DNA, 22 bp, Homo sapiens
ctgccccaggcctccttttctt

SEQ ID NO: 9359712 - DNA, 22 bp, Homo sapiens
ctgccccaggacctcttctgga

SEQ ID NO: 9359713 - DNA, 22 bp, Homo sapiens
ctgccccaggcctccttttctt

SEQ ID NO: 9359714 - DNA, 22 bp, Homo sapiens
ctgccccaggcctccttttctt

SEQ ID NO: 9359715 - DNA, 22 bp, Homo sapiens
ctgccccaggcctccttttctt

SEQ ID NO: 9359716 - DNA, 22 bp, Homo sapiens
ctgccccaggcctcgggaggag

SEQ ID NO: 9359717 - DNA, 22 bp, Homo sapiens
ctgccccaggcctcgggaggag

SEQ ID NO: 9359718 - DNA, 22 bp, Homo sapiens
ctgccccagtgccaggcaggtg

SEQ ID NO: 9359719 - DNA, 22 bp, Homo sapiens
ctgccccagtgccaggcaggtg

SEQ ID NO: 9359720 - DNA, 22 bp, Homo sapiens
ctgccccagtgccaggcaggtg

SEQ ID NO: 9359721 - DNA, 22 bp, Homo sapiens
ctgcccctgccaggcagctgtc

SEQ ID NO: 9359722 - DNA, 22 bp, Homo sapiens
ctgccccatggtccctggtggg

SEQ ID NO: 9359723 - DNA, 22 bp, Homo sapiens
ctgccccatggtccctggtggg

SEQ ID NO: 9359724 - DNA, 22 bp, Homo sapiens
ctgccccatggtccctggtggg

SEQ ID NO: 9359725 - DNA, 22 bp, Homo sapiens
ctcttctctgcagcctttgaag

SEQ ID NO: 9359726 - DNA, 22 bp, Homo sapiens
ctcttcctttcccttgagggtg

SEQ ID NO: 9359727 - DNA, 22 bp, Homo sapiens
ctcttccttaagactataaaga

SEQ ID NO: 9359728 - DNA, 22 bp, Homo sapiens
ctcttcctagtgtgcagcgtgg

SEQ ID NO: 9359729 - DNA, 22 bp, Homo sapiens
ctcttcctctcatgcggtcata

SEQ ID NO: 9359730 - DNA, 22 bp, Homo sapiens
ctcttcctctcatgcggtcata

SEQ ID NO: 9359731 - DNA, 22 bp, Homo sapiens
ctcttcttatggccgtggctga

SEQ ID NO: 9359732 - DNA, 22 bp, Homo sapiens
ctgagcactgggcacatagctg

SEQ ID NO: 9359733 - DNA, 22 bp, Homo sapiens
ctcttctgtacctcggcctcca

SEQ ID NO: 9359734 - DNA, 22 bp, Homo sapiens
ctcttctctgcagcctttgaag

SEQ ID NO: 9359735 - DNA, 22 bp, Homo sapiens
ctcttctgtacctcggcctcca

SEQ ID NO: 9359736 - DNA, 22 bp, Homo sapiens
ctcttctctgcagcctttgaag

SEQ ID NO: 9359737 - DNA, 22 bp, Homo sapiens
ctcttcctacagtctgctatgc

SEQ ID NO: 9359738 - DNA, 22 bp, Homo sapiens
ctcttcctacagtctgctatgc

SEQ ID NO: 9359739 - DNA, 22 bp, Homo sapiens
ctcttcccagctccacgagagg

SEQ ID NO: 9359740 - DNA, 19 bp, Homo sapiens
ttttggaaatgtgaacagc

SEQ ID NO: 9359741 - DNA, 22 bp, Homo sapiens
ttttgcttgagtgcacaaaatg

SEQ ID NO: 9359742 - DNA, 22 bp, Homo sapiens
ctgagcagctccctgagtggtc

SEQ ID NO: 9359743 - DNA, 22 bp, Homo sapiens
ctgagcagcgtggggagctggc

SEQ ID NO: 9359744 - DNA, 22 bp, Homo sapiens
ctgagcagcgtggggagctggc

SEQ ID NO: 9359745 - DNA, 22 bp, Homo sapiens
ctgagcagcgtggggagctggc

SEQ ID NO: 9359746 - DNA, 22 bp, Homo sapiens
ctgagcaggatattcacagcag

SEQ ID NO: 9359747 - DNA, 22 bp, Homo sapiens
ctgagcaggatattcacagcag

SEQ ID NO: 9359748 - DNA, 22 bp, Homo sapiens
ctgagcaggatattcacagcag

SEQ ID NO: 9359749 - DNA, 22 bp, Homo sapiens
ctgagcagctgttacagagtgt

SEQ ID NO: 9359750 - DNA, 22 bp, Homo sapiens
ctgagcaggacagtgggagacc

SEQ ID NO: 9359751 - DNA, 22 bp, Homo sapiens
ctgagcaggacagtgggagacc

SEQ ID NO: 9359752 - DNA, 22 bp, Homo sapiens
ctgagcagaccatggcagaggt

SEQ ID NO: 9359753 - DNA, 22 bp, Homo sapiens
ctgagcagaccatggcagaggt

SEQ ID NO: 9359754 - DNA, 22 bp, Homo sapiens
ctgagcagaccatggcagaggt

SEQ ID NO: 9359755 - DNA, 22 bp, Homo sapiens
ctgagcagaccatggcagaggt

SEQ ID NO: 9359756 - DNA, 22 bp, Homo sapiens
ctgagcagaagggtgcacgtgc

SEQ ID NO: 9359757 - DNA, 22 bp, Homo sapiens
ctgagcagaagggtgcacgtgc

SEQ ID NO: 9359758 - DNA, 19 bp, Homo sapiens
ctgagcagcggcagcactt

SEQ ID NO: 9359759 - DNA, 22 bp, Homo sapiens
ctgagcagtgctttgcagtggg

SEQ ID NO: 9359760 - DNA, 22 bp, Homo sapiens
ctgagcagtgctttgcagtggg

SEQ ID NO: 9359761 - DNA, 22 bp, Homo sapiens
ctgagcagtctgactcaagcta

SEQ ID NO: 9359762 - DNA, 22 bp, Homo sapiens
ctgagcagtggttcttgagcgc

SEQ ID NO: 9359763 - DNA, 22 bp, Homo sapiens
ctgagcagtggttcttgagcgc

SEQ ID NO: 9359764 - DNA, 22 bp, Homo sapiens
ctgagcagtggttcttgagcgc

SEQ ID NO: 9359765 - DNA, 22 bp, Homo sapiens
ctgagcagtggttcttgagcgc

SEQ ID NO: 9359766 - DNA, 22 bp, Homo sapiens
ctgagcagtagagggtctcttt

SEQ ID NO: 9359767 - DNA, 22 bp, Homo sapiens
ctgagcagtctagccaggtgtt

SEQ ID NO: 9359768 - DNA, 22 bp, Homo sapiens
ctgagcagtctagccaggtgtt

SEQ ID NO: 9359769 - DNA, 22 bp, Homo sapiens
ctgagcaggatattcacagcag

SEQ ID NO: 9359770 - DNA, 19 bp, Homo sapiens
ctgagcaggcaggtaggat

SEQ ID NO: 9359771 - DNA, 22 bp, Homo sapiens
ctgagcaggcggtggagcggct

SEQ ID NO: 9359772 - DNA, 22 bp, Homo sapiens
ctgagcaggcggtggagcggct

SEQ ID NO: 9359773 - DNA, 22 bp, Homo sapiens
ctgagccaaaaagcagagcttg

SEQ ID NO: 9359774 - DNA, 22 bp, Homo sapiens
ctgaggccgtctgggtctgcag

SEQ ID NO: 9359775 - DNA, 22 bp, Homo sapiens
ctgaggccgttggtgggcctta

SEQ ID NO: 9359776 - DNA, 22 bp, Homo sapiens
ctgaggccgttggtgggcctta

SEQ ID NO: 9359777 - DNA, 22 bp, Homo sapiens
ctgagcagtttcttagggctca

SEQ ID NO: 9359778 - DNA, 22 bp, Homo sapiens
ctgagcagtttcttagggctca

SEQ ID NO: 9359779 - DNA, 22 bp, Homo sapiens
ctgagccaaaaagcagagcttg

SEQ ID NO: 9359780 - DNA, 22 bp, Homo sapiens
ctgaggctagtataaagagcat

SEQ ID NO: 9359781 - DNA, 22 bp, Homo sapiens
ctgaggctcaagggcaggtggg

SEQ ID NO: 9359782 - DNA, 22 bp, Homo sapiens
ctgaggctcaagggcaggtggg

SEQ ID NO: 9359783 - DNA, 22 bp, Homo sapiens
ctgaggctcaagggcaggtggg

SEQ ID NO: 9359784 - DNA, 22 bp, Homo sapiens
ctgaggctcaagggcaggtggg

SEQ ID NO: 9359785 - DNA, 22 bp, Homo sapiens
ctgaggctcaagggcaggtggg

SEQ ID NO: 9359786 - DNA, 22 bp, Homo sapiens
ctgaggcctggtgaggtggtga

SEQ ID NO: 9359787 - DNA, 22 bp, Homo sapiens
ctgaggcctggccccaccacag

SEQ ID NO: 9359788 - DNA, 22 bp, Homo sapiens
ctgaggcctggccccaccacag

SEQ ID NO: 9359789 - DNA, 22 bp, Homo sapiens
ctgaggctaacctcgagagaca

SEQ ID NO: 9359790 - DNA, 22 bp, Homo sapiens
ctgaggcctgtgttggggcagt

SEQ ID NO: 9359791 - DNA, 22 bp, Homo sapiens
ctgaggcctgtgttggggcagt

SEQ ID NO: 9359792 - DNA, 22 bp, Homo sapiens
ctgaggctggagtgcagtggtg

SEQ ID NO: 9359793 - DNA, 18 bp, Homo sapiens
ctgaggctggcaggagcc

SEQ ID NO: 9359794 - DNA, 22 bp, Homo sapiens
ctgaggctggagtgcagtggtg

SEQ ID NO: 9359795 - DNA, 23 bp, Homo sapiens
ctgaggggaaaagggcttcaggc

SEQ ID NO: 9359796 - DNA, 18 bp, Homo sapiens
ctgaggctggcaggagcc

SEQ ID NO: 9359797 - DNA, 17 bp, Homo sapiens
ctgaggggagtgctgtg

SEQ ID NO: 9359798 - DNA, 22 bp, Homo sapiens
ctgaggtcaggagttcaagctg

SEQ ID NO: 9359799 - DNA, 22 bp, Homo sapiens
ctgaggctcagcgtgaggaaag

SEQ ID NO: 9359800 - DNA, 22 bp, Homo sapiens
ctgaggctccctcgggtctgct

SEQ ID NO: 9359801 - DNA, 22 bp, Homo sapiens
ctgaggctctgagaaagccaaa

SEQ ID NO: 9359802 - DNA, 22 bp, Homo sapiens
ctgaggctgcccagggccaggt

SEQ ID NO: 9359803 - DNA, 22 bp, Homo sapiens
ctgaggctggagtgcagtggtg

SEQ ID NO: 9359804 - DNA, 22 bp, Homo sapiens
ctgaggctggagtgcagtggtg

SEQ ID NO: 9359805 - DNA, 22 bp, Homo sapiens
ctgaggctgaagagggcctacg

SEQ ID NO: 9359806 - DNA, 22 bp, Homo sapiens
ctgaggctgcccagggccaggt

SEQ ID NO: 9359807 - DNA, 22 bp, Homo sapiens
ctgaggctgagacaggtgaaat

SEQ ID NO: 9359808 - DNA, 22 bp, Homo sapiens
ctgcgcaggggtggcgccagaa

SEQ ID NO: 9359809 - DNA, 22 bp, Homo sapiens
ctgcgatgaccctctcttgctg

SEQ ID NO: 9359810 - DNA, 22 bp, Homo sapiens
ctgcctttggaagtccagagct

SEQ ID NO: 9359811 - DNA, 22 bp, Homo sapiens
ctgccttggttcccagccagca

SEQ ID NO: 9359812 - DNA, 22 bp, Homo sapiens
ctgctctgttcccccatcatct

SEQ ID NO: 9359813 - DNA, 22 bp, Homo sapiens
ctgctctgttcccccatcatct

SEQ ID NO: 9359814 - DNA, 22 bp, Homo sapiens
ctgctctgtttcttagctgggt

SEQ ID NO: 9359815 - DNA, 22 bp, Homo sapiens
ctgctcttcacactacacccgt

SEQ ID NO: 9359816 - DNA, 22 bp, Homo sapiens
ctgctctgtgcacttgttcagg

SEQ ID NO: 9359817 - DNA, 22 bp, Homo sapiens
ctgctctgtggtccatgagaca

SEQ ID NO: 9359818 - DNA, 22 bp, Homo sapiens
ctgctctgagaggctcttccta

SEQ ID NO: 9359819 - DNA, 22 bp, Homo sapiens
ctgctctgaccctttcaccttc

SEQ ID NO: 9359820 - DNA, 22 bp, Homo sapiens
ctgctctgaccctttcaccttc

SEQ ID NO: 9359821 - DNA, 22 bp, Homo sapiens
ctgccttccaaccccagactcc

SEQ ID NO: 9359822 - DNA, 22 bp, Homo sapiens
ctgccttccaaccccagactcc

SEQ ID NO: 9359823 - DNA, 22 bp, Homo sapiens
ctgccttccaaccccagactcc

SEQ ID NO: 9359824 - DNA, 22 bp, Homo sapiens
ctgccttgcaccggctctctgg

SEQ ID NO: 9359825 - DNA, 22 bp, Homo sapiens
ctgcctgtttcctcttgctccc

SEQ ID NO: 9359826 - DNA, 22 bp, Homo sapiens
ctgcctgtttcctcttgctccc

SEQ ID NO: 9359827 - DNA, 22 bp, Homo sapiens
ctgccttcatctctgagctggg

SEQ ID NO: 9359828 - DNA, 22 bp, Homo sapiens
ctgcctgttttctgatagattt

SEQ ID NO: 9359829 - DNA, 18 bp, Homo sapiens
ctgcctgttgctgagagg

SEQ ID NO: 9359830 - DNA, 22 bp, Homo sapiens
ctgcctggggaatgtgaggatt

SEQ ID NO: 9359831 - DNA, 22 bp, Homo sapiens
ctgcccctgccaggcagctgtc

SEQ ID NO: 9359832 - DNA, 22 bp, Homo sapiens
ctgcctgtggacaccctggagg

SEQ ID NO: 9359833 - DNA, 22 bp, Homo sapiens
ctgcctgtggacaccctggagg

SEQ ID NO: 9359834 - DNA, 22 bp, Homo sapiens
ctgcctggggcatcagtcaagg

SEQ ID NO: 9359835 - DNA, 22 bp, Homo sapiens
ctgcctggggaatgtgaggatt

SEQ ID NO: 9359836 - DNA, 22 bp, Homo sapiens
ctgcctggggaatgtgaggatt

SEQ ID NO: 9359837 - DNA, 22 bp, Homo sapiens
ctgcctgtgtgtgcctgcagaa

SEQ ID NO: 9359838 - DNA, 22 bp, Homo sapiens
ctgcctgtgtgtgcctgcagaa

SEQ ID NO: 9359839 - DNA, 22 bp, Homo sapiens
ctgcctgttagtctagcagtta

SEQ ID NO: 9359840 - DNA, 22 bp, Homo sapiens
ctgcctgtggtctgtgatctaa

SEQ ID NO: 9359841 - DNA, 22 bp, Homo sapiens
ctgcctgtgtctattccttttt

SEQ ID NO: 9359842 - DNA, 22 bp, Homo sapiens
ctgcctgtgtgtgcctgcagaa

SEQ ID NO: 9359843 - DNA, 22 bp, Homo sapiens
ctgcctgtgggtacaagtggaa

SEQ ID NO: 9359844 - DNA, 22 bp, Homo sapiens
ctgctgggatagaagtatctca

SEQ ID NO: 9359845 - DNA, 22 bp, Homo sapiens
ctgctgggcagaggctgcatga

SEQ ID NO: 9359846 - DNA, 22 bp, Homo sapiens
ctgctgggatagaagtatctca

SEQ ID NO: 9359847 - DNA, 22 bp, Homo sapiens
ctgctgagcatcagggctgccc

SEQ ID NO: 9359848 - DNA, 22 bp, Homo sapiens
ctgctgagcatcagggctgccc

SEQ ID NO: 9359849 - DNA, 22 bp, Homo sapiens
ctgctgggaaggtctgctcagt

SEQ ID NO: 9359850 - DNA, 22 bp, Homo sapiens
ctgctgggaaggtctgctcagt

SEQ ID NO: 9359851 - DNA, 22 bp, Homo sapiens
ctgctgagatgccaggagctct

SEQ ID NO: 9359852 - DNA, 22 bp, Homo sapiens
ctgctgagagctgaaggctgta

SEQ ID NO: 9359853 - DNA, 20 bp, Homo sapiens
ctgctgagagcctggcttgc

SEQ ID NO: 9359854 - DNA, 20 bp, Homo sapiens
ctgctgagagcctggcttgc

SEQ ID NO: 9359855 - DNA, 20 bp, Homo sapiens
ctgctgagagcctggcttgc

SEQ ID NO: 9359856 - DNA, 22 bp, Homo sapiens
ctgctgagagccacgtggcaca

SEQ ID NO: 9359857 - DNA, 22 bp, Homo sapiens
ctgctgagaaatgcatccagtt

SEQ ID NO: 9359858 - DNA, 22 bp, Homo sapiens
ctgctgagaaaagactgaggga

SEQ ID NO: 9359859 - DNA, 22 bp, Homo sapiens
ctgctgagactggctttgtgtc

SEQ ID NO: 9359860 - DNA, 22 bp, Homo sapiens
ctgctgagaaccagggagaatt

SEQ ID NO: 9359861 - DNA, 19 bp, Homo sapiens
ctgctgaattagctctgga

SEQ ID NO: 9359862 - DNA, 22 bp, Homo sapiens
ctgctcttgagggactgcggtc

SEQ ID NO: 9359863 - DNA, 22 bp, Homo sapiens
ctgctggtctctttggattgcg

SEQ ID NO: 9359864 - DNA, 22 bp, Homo sapiens
ctgctgggtccccctgctgatt

SEQ ID NO: 9359865 - DNA, 22 bp, Homo sapiens
ctgctgggtccccctgctgatt

SEQ ID NO: 9359866 - DNA, 22 bp, Homo sapiens
ctgctgggtccccctgctgatt

SEQ ID NO: 9359867 - DNA, 22 bp, Homo sapiens
ctgctgggcagaggctgcatga

SEQ ID NO: 9359868 - DNA, 22 bp, Homo sapiens
ctgctgggtctatgcaagtgga

SEQ ID NO: 9359869 - DNA, 22 bp, Homo sapiens
ctgctgggtctatgcaagtgga

SEQ ID NO: 9359870 - DNA, 22 bp, Homo sapiens
ctgctgtcccagcctcctcaca

SEQ ID NO: 9359871 - DNA, 22 bp, Homo sapiens
ctgctgtccaacctgcactcgc

SEQ ID NO: 9359872 - DNA, 22 bp, Homo sapiens
ctgctgtcatagccatccctcc

SEQ ID NO: 9359873 - DNA, 22 bp, Homo sapiens
ctgctgtcaaaaatcactccat

SEQ ID NO: 9359874 - DNA, 22 bp, Homo sapiens
ctgctgtcaaaggaaatatttg

SEQ ID NO: 9359875 - DNA, 22 bp, Homo sapiens
ctgctggtgggaatttacaaga

SEQ ID NO: 9359876 - DNA, 22 bp, Homo sapiens
ctgctggtgcagagtggggctg

SEQ ID NO: 9359877 - DNA, 22 bp, Homo sapiens
ctgctggttagtcttagtggga

SEQ ID NO: 9359878 - DNA, 22 bp, Homo sapiens
ctgctggtgggaatttacaaga

SEQ ID NO: 9359879 - DNA, 22 bp, Homo sapiens
ctgctggttgcacagagctagg

SEQ ID NO: 9359880 - DNA, 22 bp, Homo sapiens
ctgctgtgacagctgccgtgtt

SEQ ID NO: 9359881 - DNA, 22 bp, Homo sapiens
ctgctgtgagcactccagcctg

SEQ ID NO: 9359882 - DNA, 22 bp, Homo sapiens
ctgctgtgagtggttcttgcct

SEQ ID NO: 9359883 - DNA, 22 bp, Homo sapiens
ctgctgtctttatttcactgct

SEQ ID NO: 9359884 - DNA, 23 bp, Homo sapiens
ctgctgtgaaacatggttttggt

SEQ ID NO: 9359885 - DNA, 23 bp, Homo sapiens
ctgctgtgaaacatggttttggt

SEQ ID NO: 9359886 - DNA, 22 bp, Homo sapiens
ctgctgtgagtttggaggtcta

SEQ ID NO: 9359887 - DNA, 22 bp, Homo sapiens
ctggaaagtgaggagagttcca

SEQ ID NO: 9359888 - DNA, 22 bp, Homo sapiens
ctggaaagtcaggtcagaaact

SEQ ID NO: 9359889 - DNA, 22 bp, Homo sapiens
ctggaagagtaatataaattag

SEQ ID NO: 9359890 - DNA, 22 bp, Homo sapiens
ctggaagagtcctaaacagata

SEQ ID NO: 9359891 - DNA, 22 bp, Homo sapiens
ctggaagaggacacacgaatca

SEQ ID NO: 9359892 - DNA, 22 bp, Homo sapiens
ctggaagaggaagccagctgga

SEQ ID NO: 9359893 - DNA, 20 bp, Homo sapiens
ctggaagcctttccagagca

SEQ ID NO: 9359894 - DNA, 20 bp, Homo sapiens
ctggaagcctttccagagca

SEQ ID NO: 9359895 - DNA, 20 bp, Homo sapiens
ctggaagcctttccagagca

SEQ ID NO: 9359896 - DNA, 22 bp, Homo sapiens
ctggaagcgtcggaggaagggc

SEQ ID NO: 9359897 - DNA, 22 bp, Homo sapiens
ctggaagcgtcggaggaagggc

SEQ ID NO: 9359898 - DNA, 22 bp, Homo sapiens
ctggaagctaacatccttttcc

SEQ ID NO: 9359899 - DNA, 22 bp, Homo sapiens
ctggaagctaacatccttttcc

SEQ ID NO: 9359900 - DNA, 22 bp, Homo sapiens
ctggaaggagaaggaggctgtg

SEQ ID NO: 9359901 - DNA, 22 bp, Homo sapiens
ctggaaggagaaggaggctgtg

SEQ ID NO: 9359902 - DNA, 22 bp, Homo sapiens
ctggaagcttgtttgccagtct

SEQ ID NO: 9359903 - DNA, 22 bp, Homo sapiens
ctggaagctggaacaggtgtgg

SEQ ID NO: 9359904 - DNA, 22 bp, Homo sapiens
ctggaagctggaacaggtgtgg

SEQ ID NO: 9359905 - DNA, 22 bp, Homo sapiens
ctggagaaaatccatgtgtatg

SEQ ID NO: 9359906 - DNA, 22 bp, Homo sapiens
ctggagagaccgaaagaggctg

SEQ ID NO: 9359907 - DNA, 22 bp, Homo sapiens
ctggagagaccgaaagaggctg

SEQ ID NO: 9359908 - DNA, 22 bp, Homo sapiens
ctggaaggtggatggcgaggcc

SEQ ID NO: 9359909 - DNA, 22 bp, Homo sapiens
ctggaaggtgactgtcttgaat

SEQ ID NO: 9359910 - DNA, 22 bp, Homo sapiens
ctggaagggtcagagtgatgag

SEQ ID NO: 9359911 - DNA, 22 bp, Homo sapiens
ctggaagggtctacttagcaga

SEQ ID NO: 9359912 - DNA, 22 bp, Homo sapiens
ctggaaggcggaggttgtagtg

SEQ ID NO: 9359913 - DNA, 22 bp, Homo sapiens
ctggaaggctctgctgcctgtc

SEQ ID NO: 9359914 - DNA, 22 bp, Homo sapiens
ctggaaggcagaggttgcagtg

SEQ ID NO: 9359915 - DNA, 22 bp, Homo sapiens
ctggaaggcagaggttgcagtg

SEQ ID NO: 9359916 - DNA, 19 bp, Homo sapiens
ctggaaggagggactgttc

SEQ ID NO: 9359917 - DNA, 22 bp, Homo sapiens
ctggaaggggcagtctttgggc

SEQ ID NO: 9359918 - DNA, 22 bp, Homo sapiens
ctggaagggagcactgtagaga

SEQ ID NO: 9359919 - DNA, 22 bp, Homo sapiens
ctggagatgtccgggtgctgtt

SEQ ID NO: 9359920 - DNA, 22 bp, Homo sapiens
ctggagagttggaagatggact

SEQ ID NO: 9359921 - DNA, 22 bp, Homo sapiens
ctggagataagtaaagaggcaa

SEQ ID NO: 9359922 - DNA, 17 bp, Homo sapiens
ctggagcagacaaaagg

SEQ ID NO: 9359923 - DNA, 22 bp, Homo sapiens
ctggagcagcaggtggccaggg

SEQ ID NO: 9359924 - DNA, 22 bp, Homo sapiens
ctggagagtaatctctgtgtta

SEQ ID NO: 9359925 - DNA, 22 bp, Homo sapiens
ctggagagggagctgttggaag

SEQ ID NO: 9359926 - DNA, 22 bp, Homo sapiens
ctggagagggagctgttggaag

SEQ ID NO: 9359927 - DNA, 22 bp, Homo sapiens
ctggagagttggaagatggact

SEQ ID NO: 9359928 - DNA, 22 bp, Homo sapiens
ctggagagttggaagatggact

SEQ ID NO: 9359929 - DNA, 22 bp, Homo sapiens
ctggagagttggaagatggact

SEQ ID NO: 9359930 - DNA, 22 bp, Homo sapiens
ctggagagttggaagatggact

SEQ ID NO: 9359931 - DNA, 22 bp, Homo sapiens
ctggagagttggaagatggact

SEQ ID NO: 9359932 - DNA, 22 bp, Homo sapiens
ctggagagttggaagatggact

SEQ ID NO: 9359933 - DNA, 22 bp, Homo sapiens
ctggagagaccgaaagaggctg

SEQ ID NO: 9359934 - DNA, 22 bp, Homo sapiens
ctggagagagaaaaagccttaa

SEQ ID NO: 9359935 - DNA, 22 bp, Homo sapiens
ctggagagatcctcctgaaaaa

SEQ ID NO: 9359936 - DNA, 22 bp, Homo sapiens
ctggagagatcctcctgaaaaa

SEQ ID NO: 9359937 - DNA, 22 bp, Homo sapiens
ctggagaggctgggaacaggtt

SEQ ID NO: 9359938 - DNA, 22 bp, Homo sapiens
ctggagaggccccaagatattt

SEQ ID NO: 9359939 - DNA, 22 bp, Homo sapiens
ctggagaggccccaagatattt

SEQ ID NO: 9359940 - DNA, 22 bp, Homo sapiens
ctggagaggctgggaacaggtt

SEQ ID NO: 9359941 - DNA, 22 bp, Homo sapiens
ctggagagggagccctggcagt

SEQ ID NO: 9359942 - DNA, 22 bp, Homo sapiens
ctggagaggctgggaacaggtt

SEQ ID NO: 9359943 - DNA, 22 bp, Homo sapiens
ctggagaggctgggaacaggtt

SEQ ID NO: 9359944 - DNA, 22 bp, Homo sapiens
ctggagagggagccctggcagt

SEQ ID NO: 9359945 - DNA, 22 bp, Homo sapiens
ctggagagggagctgttggaag

SEQ ID NO: 9359946 - DNA, 22 bp, Homo sapiens
ctggagagggagccctggcagt

SEQ ID NO: 9359947 - DNA, 22 bp, Homo sapiens
ctggagagggagccctggcagt

SEQ ID NO: 9359948 - DNA, 22 bp, Homo sapiens
ctggagccgcatggagcaggga

SEQ ID NO: 9359949 - DNA, 22 bp, Homo sapiens
ctggagccggaccagggacggt

SEQ ID NO: 9359950 - DNA, 22 bp, Homo sapiens
ctggagccgcatggagcaggga

SEQ ID NO: 9359951 - DNA, 22 bp, Homo sapiens
ctggagccctgaatgggcagga

SEQ ID NO: 9359952 - DNA, 22 bp, Homo sapiens
ctggagccgcatggagcaggga

SEQ ID NO: 9359953 - DNA, 22 bp, Homo sapiens
ctggagccggcgagccccagcc

SEQ ID NO: 9359954 - DNA, 22 bp, Homo sapiens
ctggagcctgcagttttcactt

SEQ ID NO: 9359955 - DNA, 17 bp, Homo sapiens
ctggagcctccaactcc

SEQ ID NO: 9359956 - DNA, 22 bp, Homo sapiens
ctggagcctaggttgacctggg

SEQ ID NO: 9359957 - DNA, 22 bp, Homo sapiens
ctggagcagcaggtggccaggg

SEQ ID NO: 9359958 - DNA, 22 bp, Homo sapiens
ctggagcagcaggtggccaggg

SEQ ID NO: 9359959 - DNA, 22 bp, Homo sapiens
ctggagcagcaggtggccaggg

SEQ ID NO: 9359960 - DNA, 22 bp, Homo sapiens
ctggagcaggtttaggagtccc

SEQ ID NO: 9359961 - DNA, 22 bp, Homo sapiens
ctggagcaggcttgtcccagct

SEQ ID NO: 9359962 - DNA, 22 bp, Homo sapiens
ctggagcaggtttaggagtccc

SEQ ID NO: 9359963 - DNA, 22 bp, Homo sapiens
ctggagcaggtttaggagtccc

SEQ ID NO: 9359964 - DNA, 22 bp, Homo sapiens
ctggagccccaggctgtgcaga

SEQ ID NO: 9359965 - DNA, 22 bp, Homo sapiens
ctggagccctgaatgggcagga

SEQ ID NO: 9359966 - DNA, 22 bp, Homo sapiens
ctggagccctgaatgggcagga

SEQ ID NO: 9359967 - DNA, 22 bp, Homo sapiens
ctggagccccaggctgtgcaga

SEQ ID NO: 9359968 - DNA, 22 bp, Homo sapiens
ctggagcatccatgcccagggt

SEQ ID NO: 9359969 - DNA, 22 bp, Homo sapiens
ccaggtcaagctcccctgtggt

SEQ ID NO: 9359970 - DNA, 22 bp, Homo sapiens
ccaggtcaagctcccctgtggt

SEQ ID NO: 9359971 - DNA, 22 bp, Homo sapiens
ccagggtttagcaagcctacaa

SEQ ID NO: 9359972 - DNA, 22 bp, Homo sapiens
ccagggtttaaattctgactat

SEQ ID NO: 9359973 - DNA, 22 bp, Homo sapiens
ccagggttggtctctctgaggt

SEQ ID NO: 9359974 - DNA, 22 bp, Homo sapiens
ccagggttggatgagtcactta

SEQ ID NO: 9359975 - DNA, 22 bp, Homo sapiens
ccagggttgctgtatggcactt

SEQ ID NO: 9359976 - DNA, 22 bp, Homo sapiens
ccagggttgctgtatggcactt

SEQ ID NO: 9359977 - DNA, 22 bp, Homo sapiens
ccagggttgcagggagccagca

SEQ ID NO: 9359978 - DNA, 22 bp, Homo sapiens
ccagggttggtattcacctgga

SEQ ID NO: 9359979 - DNA, 22 bp, Homo sapiens
ccagggttggcaagcaaggctt

SEQ ID NO: 9359980 - DNA, 22 bp, Homo sapiens
ccagggttggcaagcaaggctt

SEQ ID NO: 9359981 - DNA, 22 bp, Homo sapiens
ccagggttgcagggagccagca

SEQ ID NO: 9359982 - DNA, 22 bp, Homo sapiens
ccagggtgtgagaaggaagtag

SEQ ID NO: 9359983 - DNA, 22 bp, Homo sapiens
ccagggtggggtccaggaacca

SEQ ID NO: 9359984 - DNA, 22 bp, Homo sapiens
ccagggtgtagggattccagat

SEQ ID NO: 9359985 - DNA, 22 bp, Homo sapiens
ccagggtggcgtagatgctggg

SEQ ID NO: 9359986 - DNA, 22 bp, Homo sapiens
ccagggtggggcaggcccactg

SEQ ID NO: 9359987 - DNA, 22 bp, Homo sapiens
ccagggtggggcaggcccactg

SEQ ID NO: 9359988 - DNA, 22 bp, Homo sapiens
ccagggtgggaggctgaaggcg

SEQ ID NO: 9359989 - DNA, 22 bp, Homo sapiens
tgagagtgaaatgtcacatgtc

SEQ ID NO: 9359990 - DNA, 22 bp, Homo sapiens
tgagagtggttcagctcagaag

SEQ ID NO: 9359991 - DNA, 22 bp, Homo sapiens
tgagagtggttcagctcagaag

SEQ ID NO: 9359992 - DNA, 22 bp, Homo sapiens
ccaggtcctgttttcaccacag

SEQ ID NO: 9359993 - DNA, 22 bp, Homo sapiens
ccaggtctatcaagttgggctc

SEQ ID NO: 9359994 - DNA, 22 bp, Homo sapiens
ccaggtctatcaagttgggctc

SEQ ID NO: 9359995 - DNA, 22 bp, Homo sapiens
tgagacgaagtcttgctctgtt

SEQ ID NO: 9359996 - DNA, 17 bp, Homo sapiens
ccaggtctccttgcttt

SEQ ID NO: 9359997 - DNA, 22 bp, Homo sapiens
tgagacttggcactgaggaact

SEQ ID NO: 9359998 - DNA, 22 bp, Homo sapiens
tgagactcagcacttgtgtgtc

SEQ ID NO: 9359999 - DNA, 22 bp, Homo sapiens
tgagcacctaccttgtccagtg

SEQ ID NO: 9360000 - DNA, 22 bp, Homo sapiens
tgaggaatgttttgagtgccga

SEQ ID NO: 9360001 - DNA, 22 bp, Homo sapiens
tgaggaatgctgagcagaggaa

SEQ ID NO: 9360002 - DNA, 22 bp, Homo sapiens
tgaggacatgagtgggacagag

SEQ ID NO: 9360003 - DNA, 22 bp, Homo sapiens
tgaggacaatccctaactcaga

SEQ ID NO: 9360004 - DNA, 22 bp, Homo sapiens
tgaggaagttgtttctcttcta

SEQ ID NO: 9360005 - DNA, 23 bp, Homo sapiens
tgagctgggcctgcaggggtctc

SEQ ID NO: 9360006 - DNA, 23 bp, Homo sapiens
tgagctgggcctgcaggggtctc

SEQ ID NO: 9360007 - DNA, 22 bp, Homo sapiens
tgaggacatgagtgggacagag

SEQ ID NO: 9360008 - DNA, 22 bp, Homo sapiens
tgaggacattaggaagtgaagg

SEQ ID NO: 9360009 - DNA, 22 bp, Homo sapiens
tgaggacattaggaagtgaagg

SEQ ID NO: 9360010 - DNA, 22 bp, Homo sapiens
tgaggacattaggaagtgaagg

SEQ ID NO: 9360011 - DNA, 22 bp, Homo sapiens
tgaggacattgagactggagac

SEQ ID NO: 9360012 - DNA, 22 bp, Homo sapiens
tgaggacattgagactggagac

SEQ ID NO: 9360013 - DNA, 22 bp, Homo sapiens
tgaggacattgagactggagac

SEQ ID NO: 9360014 - DNA, 22 bp, Homo sapiens
tgaggacattgagactggagac

SEQ ID NO: 9360015 - DNA, 22 bp, Homo sapiens
tgaggacattgagactggagac

SEQ ID NO: 9360016 - DNA, 22 bp, Homo sapiens
ccagtggccatgcacgagcagc

SEQ ID NO: 9360017 - DNA, 23 bp, Homo sapiens
ccagtggcgtaaactagaggata

SEQ ID NO: 9360018 - DNA, 23 bp, Homo sapiens
ccagtggcgtaaactagaggata

SEQ ID NO: 9360019 - DNA, 23 bp, Homo sapiens
ccagtggcgtaaactagaggata

SEQ ID NO: 9360020 - DNA, 22 bp, Homo sapiens
ccagtggccatgcacgagcagc

SEQ ID NO: 9360021 - DNA, 22 bp, Homo sapiens
tgaggacattggtcaggacatg

SEQ ID NO: 9360022 - DNA, 22 bp, Homo sapiens
ccagtgggaacactggcattgc

SEQ ID NO: 9360023 - DNA, 22 bp, Homo sapiens
ccagtggctacaggggggttga

SEQ ID NO: 9360024 - DNA, 22 bp, Homo sapiens
tgagcagacttgatgaggcagc

SEQ ID NO: 9360025 - DNA, 22 bp, Homo sapiens
tgagcccaggagttggaggctg

SEQ ID NO: 9360026 - DNA, 22 bp, Homo sapiens
tgagcagaagccctcctggact

SEQ ID NO: 9360027 - DNA, 22 bp, Homo sapiens
tgagcagaacacgggatccatg

SEQ ID NO: 9360028 - DNA, 22 bp, Homo sapiens
tgagctggcaggggctcaggga

SEQ ID NO: 9360029 - DNA, 22 bp, Homo sapiens
tgagctggcacttttcctggga

SEQ ID NO: 9360030 - DNA, 22 bp, Homo sapiens
tgagctggcttgtcaaccaggg

SEQ ID NO: 9360031 - DNA, 21 bp, Homo sapiens
tgagctgggagttctgaaaag

SEQ ID NO: 9360032 - DNA, 22 bp, Homo sapiens
tgaccctcttccccatgcgctc

SEQ ID NO: 9360033 - DNA, 19 bp, Homo sapiens
tgaccccacgctccagagc

SEQ ID NO: 9360034 - DNA, 22 bp, Homo sapiens
tgactttagacttagtcaagtt

SEQ ID NO: 9360035 - DNA, 22 bp, Homo sapiens
ccagggtctctgctgcctgaga

SEQ ID NO: 9360036 - DNA, 22 bp, Homo sapiens
ccagggtctctgctgcctgaga

SEQ ID NO: 9360037 - DNA, 22 bp, Homo sapiens
ccagggtggcgtagatgctggg

SEQ ID NO: 9360038 - DNA, 22 bp, Homo sapiens
ccagggtggaggctggatggag

SEQ ID NO: 9360039 - DNA, 22 bp, Homo sapiens
tgactttgtccctttcaaatcc

SEQ ID NO: 9360040 - DNA, 22 bp, Homo sapiens
tgacatctttgatctcatttag

SEQ ID NO: 9360041 - DNA, 22 bp, Homo sapiens
tgacatctagtaggtagagacc

SEQ ID NO: 9360042 - DNA, 22 bp, Homo sapiens
ccagggccagtaagattggcat

SEQ ID NO: 9360043 - DNA, 22 bp, Homo sapiens
ccagggccagtaagattggcat

SEQ ID NO: 9360044 - DNA, 22 bp, Homo sapiens
ccagggccagtaagattggcat

SEQ ID NO: 9360045 - DNA, 22 bp, Homo sapiens
tgaccagtggcgctgggtgcaa

SEQ ID NO: 9360046 - DNA, 22 bp, Homo sapiens
tgaccagtgcagggggagttag

SEQ ID NO: 9360047 - DNA, 22 bp, Homo sapiens
tgaccagtgacccgaggcaagt

SEQ ID NO: 9360048 - DNA, 22 bp, Homo sapiens
ccaggctttctcctgactcaca

SEQ ID NO: 9360049 - DNA, 22 bp, Homo sapiens
ccaggcttttagctgcatggca

SEQ ID NO: 9360050 - DNA, 22 bp, Homo sapiens
ccaggctttcccagcctctcca

SEQ ID NO: 9360051 - DNA, 22 bp, Homo sapiens
ccaggctttctcctgactcaca

SEQ ID NO: 9360052 - DNA, 22 bp, Homo sapiens
ccaggctttcccagcctctcca

SEQ ID NO: 9360053 - DNA, 22 bp, Homo sapiens
ccaggctttcccagcctctcca

SEQ ID NO: 9360054 - DNA, 22 bp, Homo sapiens
ccaggcttttctcatggagtca

SEQ ID NO: 9360055 - DNA, 21 bp, Homo sapiens
tgaaggagaggaccgagtgct

SEQ ID NO: 9360056 - DNA, 21 bp, Homo sapiens
tgaaggagaggaccgagtgct

SEQ ID NO: 9360057 - DNA, 22 bp, Homo sapiens
tgaaggagaattaataggcatt

SEQ ID NO: 9360058 - DNA, 22 bp, Homo sapiens
tgaaggagaattaataggcatt

SEQ ID NO: 9360059 - DNA, 22 bp, Homo sapiens
ccaggcttgaagggaagaatgg

SEQ ID NO: 9360060 - DNA, 22 bp, Homo sapiens
ccaggcttggtgtgtggtcagg

SEQ ID NO: 9360061 - DNA, 22 bp, Homo sapiens
ccaggctttaagaggtggaaac

SEQ ID NO: 9360062 - DNA, 19 bp, Homo sapiens
ccaggctttatgcaaatac

SEQ ID NO: 9360063 - DNA, 21 bp, Homo sapiens
ccagggaagaaatgagggcag

SEQ ID NO: 9360064 - DNA, 21 bp, Homo sapiens
ccagggaagaaatgagggcag

SEQ ID NO: 9360065 - DNA, 22 bp, Homo sapiens
tgacagactttacttctcctat

SEQ ID NO: 9360066 - DNA, 22 bp, Homo sapiens
tgacagactactgcctctattg

SEQ ID NO: 9360067 - DNA, 22 bp, Homo sapiens
tgacagagcaagatctagataa

SEQ ID NO: 9360068 - DNA, 23 bp, Homo sapiens
tgacagagcacagtgggggagat

SEQ ID NO: 9360069 - DNA, 22 bp, Homo sapiens
tgacagagcaagatctagataa

SEQ ID NO: 9360070 - DNA, 19 bp, Homo sapiens
tgacagagagcagggtggt

SEQ ID NO: 9360071 - DNA, 19 bp, Homo sapiens
tgacagagagcagggtggt

SEQ ID NO: 9360072 - DNA, 22 bp, Homo sapiens
tgacagagaggtaagttatgaa

SEQ ID NO: 9360073 - DNA, 22 bp, Homo sapiens
tgacagagcatgtagtgacagc

SEQ ID NO: 9360074 - DNA, 22 bp, Homo sapiens
tgacagagcatgtagtgacagc

SEQ ID NO: 9360075 - DNA, 22 bp, Homo sapiens
tgacagagcatgtagtgacagc

SEQ ID NO: 9360076 - DNA, 22 bp, Homo sapiens
tgacagagctggagaataattt

SEQ ID NO: 9360077 - DNA, 22 bp, Homo sapiens
tgacagagccaagatcagtact

SEQ ID NO: 9360078 - DNA, 22 bp, Homo sapiens
tgacagagtcggggcaagctgt

SEQ ID NO: 9360079 - DNA, 22 bp, Homo sapiens
ccagggcatgggaagaactgaa

SEQ ID NO: 9360080 - DNA, 22 bp, Homo sapiens
ccagggcatgggaagaactgaa

SEQ ID NO: 9360081 - DNA, 22 bp, Homo sapiens
ccagggcatgtccaagacttag

SEQ ID NO: 9360082 - DNA, 22 bp, Homo sapiens
ccagggcatgtaactaatggtg

SEQ ID NO: 9360083 - DNA, 22 bp, Homo sapiens
ccagggcatgtaactaatggtg

SEQ ID NO: 9360084 - DNA, 22 bp, Homo sapiens
ccagggcatgtaactaatggtg

SEQ ID NO: 9360085 - DNA, 22 bp, Homo sapiens
ccagggcatgggaagaactgaa

SEQ ID NO: 9360086 - DNA, 22 bp, Homo sapiens
ccagggcatgtccaagacttag

SEQ ID NO: 9360087 - DNA, 22 bp, Homo sapiens
ccagggcatgtccaagacttag

SEQ ID NO: 9360088 - DNA, 22 bp, Homo sapiens
ccagggccaagagacctcgagg

SEQ ID NO: 9360089 - DNA, 22 bp, Homo sapiens
ccaggctcacctggagcccctg

SEQ ID NO: 9360090 - DNA, 22 bp, Homo sapiens
ccaggctcactgactaccacat

SEQ ID NO: 9360091 - DNA, 22 bp, Homo sapiens
ccaggctcacctggagcccctg

SEQ ID NO: 9360092 - DNA, 22 bp, Homo sapiens
ccaggctcacctggagcccctg

SEQ ID NO: 9360093 - DNA, 22 bp, Homo sapiens
ccaggctcacctggagcccctg

SEQ ID NO: 9360094 - DNA, 22 bp, Homo sapiens
ccaggctcactgactaccacat

SEQ ID NO: 9360095 - DNA, 22 bp, Homo sapiens
ccaggctcagcgcgcacgtctg

SEQ ID NO: 9360096 - DNA, 22 bp, Homo sapiens
ccaggctcagcgcgcacgtctg

SEQ ID NO: 9360097 - DNA, 22 bp, Homo sapiens
ccaggctcactgactaccacat

SEQ ID NO: 9360098 - DNA, 17 bp, Homo sapiens
ccaggctataccaggct

SEQ ID NO: 9360099 - DNA, 22 bp, Homo sapiens
ccaggctagcccagaccacagg

SEQ ID NO: 9360100 - DNA, 22 bp, Homo sapiens
ccaggctcacagcatcccagga

SEQ ID NO: 9360101 - DNA, 22 bp, Homo sapiens
ccaggctcacagcatcccagga

SEQ ID NO: 9360102 - DNA, 22 bp, Homo sapiens
ccaggctcacagcatcccagga

SEQ ID NO: 9360103 - DNA, 22 bp, Homo sapiens
ccaggctagagagcagtggcat

SEQ ID NO: 9360104 - DNA, 22 bp, Homo sapiens
ccaggctagagtgcaatggcat

SEQ ID NO: 9360105 - DNA, 22 bp, Homo sapiens
ccaggctagagtgcaatggcat

SEQ ID NO: 9360106 - DNA, 22 bp, Homo sapiens
ccaggctagagtgcagtggcgt

SEQ ID NO: 9360107 - DNA, 22 bp, Homo sapiens
ccaggcgtggcttcagcagccc

SEQ ID NO: 9360108 - DNA, 22 bp, Homo sapiens
ccaggctagagtgcaatggcgc

SEQ ID NO: 9360109 - DNA, 22 bp, Homo sapiens
ccaggctagagtgcaatggcgc

SEQ ID NO: 9360110 - DNA, 22 bp, Homo sapiens
ccaggctagagtgcagtggcat

SEQ ID NO: 9360111 - DNA, 22 bp, Homo sapiens
ccaggctcagctattaagaaac

SEQ ID NO: 9360112 - DNA, 22 bp, Homo sapiens
ccaggctcagctattaagaaac

SEQ ID NO: 9360113 - DNA, 22 bp, Homo sapiens
ccaggctcagcgcgcacgtctg

SEQ ID NO: 9360114 - DNA, 22 bp, Homo sapiens
ccaggctcagcgcgcacgtctg

SEQ ID NO: 9360115 - DNA, 22 bp, Homo sapiens
ccaggctcaggcctgctcgttg

SEQ ID NO: 9360116 - DNA, 22 bp, Homo sapiens
ccaggctcagggcagactttca

SEQ ID NO: 9360117 - DNA, 22 bp, Homo sapiens
ccaggctcaggcctgctcgttg

SEQ ID NO: 9360118 - DNA, 22 bp, Homo sapiens
ccaggctcaggcctgctcgttg

SEQ ID NO: 9360119 - DNA, 22 bp, Homo sapiens
ccaggctcaggcctgctcgttg

SEQ ID NO: 9360120 - DNA, 22 bp, Homo sapiens
ccaggctccccaggaggccctt

SEQ ID NO: 9360121 - DNA, 22 bp, Homo sapiens
ccaggctccccaggaggccctt

SEQ ID NO: 9360122 - DNA, 17 bp, Homo sapiens
ccaggctccatcactgt

SEQ ID NO: 9360123 - DNA, 22 bp, Homo sapiens
ccaggctcaggtgcgagagaca

SEQ ID NO: 9360124 - DNA, 17 bp, Homo sapiens
ccaggctccatcactgt

SEQ ID NO: 9360125 - DNA, 17 bp, Homo sapiens
ccaggctccatcactgt

SEQ ID NO: 9360126 - DNA, 22 bp, Homo sapiens
ccaggctcagggcagactttca

SEQ ID NO: 9360127 - DNA, 22 bp, Homo sapiens
tctttatttctgaatcccccat

SEQ ID NO: 9360128 - DNA, 22 bp, Homo sapiens
tctttatttctgaatcccccat

SEQ ID NO: 9360129 - DNA, 19 bp, Homo sapiens
ccaggcctggcgtctccgc

SEQ ID NO: 9360130 - DNA, 23 bp, Homo sapiens
ccaggctaaatgttagagtctga

SEQ ID NO: 9360131 - DNA, 22 bp, Homo sapiens
ccaggctagagagcagtggcac

SEQ ID NO: 9360132 - DNA, 22 bp, Homo sapiens
ccaggctagaaactgaggcaca

SEQ ID NO: 9360133 - DNA, 19 bp, Homo sapiens
ccaggcctggcgtctccgc

SEQ ID NO: 9360134 - DNA, 22 bp, Homo sapiens
tctttattttatgcttgtgcaa

SEQ ID NO: 9360135 - DNA, 22 bp, Homo sapiens
tctttattttatgcttgtgcaa

SEQ ID NO: 9360136 - DNA, 22 bp, Homo sapiens
tctttattttatgcttgtgcaa

SEQ ID NO: 9360137 - DNA, 22 bp, Homo sapiens
tctttattttatgcttgtgcaa

SEQ ID NO: 9360138 - DNA, 22 bp, Homo sapiens
tctgcagacaggaagctgaggc

SEQ ID NO: 9360139 - DNA, 22 bp, Homo sapiens
tctgcagacaggaagctgaggc

SEQ ID NO: 9360140 - DNA, 22 bp, Homo sapiens
tctgcagagcctcaggagaaca

SEQ ID NO: 9360141 - DNA, 22 bp, Homo sapiens
tctgcagagggagtgctgggtc

SEQ ID NO: 9360142 - DNA, 17 bp, Homo sapiens
tctgcagaggcaaacct

SEQ ID NO: 9360143 - DNA, 22 bp, Homo sapiens
tctgcagagattctgggctgag

SEQ ID NO: 9360144 - DNA, 22 bp, Homo sapiens
ccagcccttgagatggaaggga

SEQ ID NO: 9360145 - DNA, 22 bp, Homo sapiens
ccagcccttgagatggaaggga

SEQ ID NO: 9360146 - DNA, 22 bp, Homo sapiens
ccagccctttgtggttcactga

SEQ ID NO: 9360147 - DNA, 22 bp, Homo sapiens
ccagcccttgaggtctgtccat

SEQ ID NO: 9360148 - DNA, 22 bp, Homo sapiens
ccagcctcactggcatcaccta

SEQ ID NO: 9360149 - DNA, 22 bp, Homo sapiens
tcttggggtagacctgagaatt

SEQ ID NO: 9360150 - DNA, 22 bp, Homo sapiens
tcttgggggactttggcatgga

SEQ ID NO: 9360151 - DNA, 18 bp, Homo sapiens
tcttgcctgcaccctctc

SEQ ID NO: 9360152 - DNA, 22 bp, Homo sapiens
ccagcctcactggcatcaccta

SEQ ID NO: 9360153 - DNA, 21 bp, Homo sapiens
ccagcctcagatcagggagct

SEQ ID NO: 9360154 - DNA, 18 bp, Homo sapiens
tcttgcctgcaccctctc

SEQ ID NO: 9360155 - DNA, 22 bp, Homo sapiens
tcttgcctcttcccctttccat

SEQ ID NO: 9360156 - DNA, 21 bp, Homo sapiens
ccagcctcagatcagggagct

SEQ ID NO: 9360157 - DNA, 22 bp, Homo sapiens
tcttgttttgaactcatcagga

SEQ ID NO: 9360158 - DNA, 22 bp, Homo sapiens
tcttgtgtggtggaagatatgg

SEQ ID NO: 9360159 - DNA, 21 bp, Homo sapiens
tcttgtccttgctctcccact

SEQ ID NO: 9360160 - DNA, 22 bp, Homo sapiens
tgaacagatgccttctcccatg

SEQ ID NO: 9360161 - DNA, 21 bp, Homo sapiens
tgaacactctacccatttttt

SEQ ID NO: 9360162 - DNA, 20 bp, Homo sapiens
tgaacactggggtgtttcag

SEQ ID NO: 9360163 - DNA, 20 bp, Homo sapiens
tgaacactggggtgtttcag

SEQ ID NO: 9360164 - DNA, 22 bp, Homo sapiens
tgaacactgccatatttaagaa

SEQ ID NO: 9360165 - DNA, 22 bp, Homo sapiens
tgaacactctggggtgggaggt

SEQ ID NO: 9360166 - DNA, 22 bp, Homo sapiens
tgaagaggccaaactatcattg

SEQ ID NO: 9360167 - DNA, 20 bp, Homo sapiens
tgaagaggaagaggacggcc

SEQ ID NO: 9360168 - DNA, 22 bp, Homo sapiens
tgaagaggccaaactatcattg

SEQ ID NO: 9360169 - DNA, 22 bp, Homo sapiens
tgaagagtattaggttatttga

SEQ ID NO: 9360170 - DNA, 22 bp, Homo sapiens
tgaagagtgattcatgcagtca

SEQ ID NO: 9360171 - DNA, 22 bp, Homo sapiens
tgaagagtcatttcattcccag

SEQ ID NO: 9360172 - DNA, 20 bp, Homo sapiens
tgaagagtgcgcacattgcc

SEQ ID NO: 9360173 - DNA, 22 bp, Homo sapiens
tgaagagtgcttgagattttaa

SEQ ID NO: 9360174 - DNA, 22 bp, Homo sapiens
tgaagagttaattatgaggtgc

SEQ ID NO: 9360175 - DNA, 22 bp, Homo sapiens
tgaacagtcaaaaagtgaccat

SEQ ID NO: 9360176 - DNA, 23 bp, Homo sapiens
tgaacagtatgtgggacattgag

SEQ ID NO: 9360177 - DNA, 22 bp, Homo sapiens
tgaagagatagaagtacatgct

SEQ ID NO: 9360178 - DNA, 22 bp, Homo sapiens
tgaagagatagaagtacatgct

SEQ ID NO: 9360179 - DNA, 22 bp, Homo sapiens
tgaaggaatgagtatactgttt

SEQ ID NO: 9360180 - DNA, 22 bp, Homo sapiens
tgaaggaatgagtatactgttt

SEQ ID NO: 9360181 - DNA, 22 bp, Homo sapiens
tgaaggaatgagggagtgggtc

SEQ ID NO: 9360182 - DNA, 22 bp, Homo sapiens
tgaaggagaattaataggcatt

SEQ ID NO: 9360183 - DNA, 22 bp, Homo sapiens
tgaaggagaaatggaaagtggg

SEQ ID NO: 9360184 - DNA, 22 bp, Homo sapiens
tgaaggaatggaggatcagagc

SEQ ID NO: 9360185 - DNA, 19 bp, Homo sapiens
tgaaggacagtgcacatca

SEQ ID NO: 9360186 - DNA, 17 bp, Homo sapiens
tgaaggaaggatgatgt

SEQ ID NO: 9360187 - DNA, 17 bp, Homo sapiens
tgaaggaaggatgatgt

SEQ ID NO: 9360188 - DNA, 17 bp, Homo sapiens
tgaaggaaggatgatgt

SEQ ID NO: 9360189 - DNA, 22 bp, Homo sapiens
tgaaggaagaataggcagtgtt

SEQ ID NO: 9360190 - DNA, 22 bp, Homo sapiens
tgaaggaaatgacggcagaaga

SEQ ID NO: 9360191 - DNA, 22 bp, Homo sapiens
tgaaggaagaataggcagtgtt

SEQ ID NO: 9360192 - DNA, 17 bp, Homo sapiens
tgaagatgcatggcagc

SEQ ID NO: 9360193 - DNA, 22 bp, Homo sapiens
tgaagatctgtcaaccccatat

SEQ ID NO: 9360194 - DNA, 22 bp, Homo sapiens
tgaagagtgtgactgcacctag

SEQ ID NO: 9360195 - DNA, 22 bp, Homo sapiens
tgaagagtttccagcctgcttg

SEQ ID NO: 9360196 - DNA, 22 bp, Homo sapiens
tgaagataaattgtactgaaga

SEQ ID NO: 9360197 - DNA, 22 bp, Homo sapiens
tgaagctttaggatgggttcat

SEQ ID NO: 9360198 - DNA, 22 bp, Homo sapiens
tgaaggaaagagggaacatccc

SEQ ID NO: 9360199 - DNA, 22 bp, Homo sapiens
tgaagatttccaccaaatcaca

SEQ ID NO: 9360200 - DNA, 22 bp, Homo sapiens
tgaagatttaagcatctcaatt

SEQ ID NO: 9360201 - DNA, 22 bp, Homo sapiens
tgaagctttaggatgggttcat

SEQ ID NO: 9360202 - DNA, 22 bp, Homo sapiens
tgaagatttccaccaaatcaca

SEQ ID NO: 9360203 - DNA, 22 bp, Homo sapiens
ccaggctgcagtcaaggggcat

SEQ ID NO: 9360204 - DNA, 22 bp, Homo sapiens
ccaggctgagcatgattggagc

SEQ ID NO: 9360205 - DNA, 22 bp, Homo sapiens
ccaggctgagcatgattggagc

SEQ ID NO: 9360206 - DNA, 22 bp, Homo sapiens
tgaaagggaacctgctggactg

SEQ ID NO: 9360207 - DNA, 22 bp, Homo sapiens
ccaggctgcagtcaaggggcat

SEQ ID NO: 9360208 - DNA, 22 bp, Homo sapiens
ccaggctgcagtcaaggggcat

SEQ ID NO: 9360209 - DNA, 22 bp, Homo sapiens
ccaggctgccgaggaaagaaag

SEQ ID NO: 9360210 - DNA, 22 bp, Homo sapiens
ccaggctgctcacaagctgccc

SEQ ID NO: 9360211 - DNA, 22 bp, Homo sapiens
tgaacacagttctgatgagctt

SEQ ID NO: 9360212 - DNA, 22 bp, Homo sapiens
ccaggctgctcacaagctgccc

SEQ ID NO: 9360213 - DNA, 22 bp, Homo sapiens
ccaggctgctcacaagctgccc

SEQ ID NO: 9360214 - DNA, 22 bp, Homo sapiens
ccaggctgctcacaagctgccc

SEQ ID NO: 9360215 - DNA, 22 bp, Homo sapiens
ccaggctgctcacaagctgccc

SEQ ID NO: 9360216 - DNA, 22 bp, Homo sapiens
tgaaatgattatatggtgtttg

SEQ ID NO: 9360217 - DNA, 22 bp, Homo sapiens
ccaggctccccaggaggccctt

SEQ ID NO: 9360218 - DNA, 22 bp, Homo sapiens
ccaggctccgcatagaccccac

SEQ ID NO: 9360219 - DNA, 22 bp, Homo sapiens
ccaggctcctcatgatcttgtt

SEQ ID NO: 9360220 - DNA, 22 bp, Homo sapiens
ccaggctccgcatagaccccac

SEQ ID NO: 9360221 - DNA, 22 bp, Homo sapiens
ccaggctccgcatagaccccac

SEQ ID NO: 9360222 - DNA, 22 bp, Homo sapiens
ccaggctccgcatagaccccac

SEQ ID NO: 9360223 - DNA, 21 bp, Homo sapiens
ccaggctcctgaggctggtca

SEQ ID NO: 9360224 - DNA, 22 bp, Homo sapiens
ccaggctcctcatgatcttgtt

SEQ ID NO: 9360225 - DNA, 21 bp, Homo sapiens
tgaaacagatggaagtatttg

SEQ ID NO: 9360226 - DNA, 22 bp, Homo sapiens
tgaaagcagatagctctgttgt

SEQ ID NO: 9360227 - DNA, 22 bp, Homo sapiens
tgaaagcagcaccaataccatt

SEQ ID NO: 9360228 - DNA, 22 bp, Homo sapiens
tgaaagctgaggacaggagggt

SEQ ID NO: 9360229 - DNA, 19 bp, Homo sapiens
ccatggagagagatgcatt

SEQ ID NO: 9360230 - DNA, 22 bp, Homo sapiens
tgatgaggtggattcaaagcag

SEQ ID NO: 9360231 - DNA, 21 bp, Homo sapiens
tgatgaggtcatagcaccctc

SEQ ID NO: 9360232 - DNA, 22 bp, Homo sapiens
ccatggaagaactgatgtgcca

SEQ ID NO: 9360233 - DNA, 19 bp, Homo sapiens
ccatggagagagatgcatt

SEQ ID NO: 9360234 - DNA, 22 bp, Homo sapiens
tgatgaggcatatgctacacat

SEQ ID NO: 9360235 - DNA, 22 bp, Homo sapiens
tgatgaggacccatcacctggt

SEQ ID NO: 9360236 - DNA, 22 bp, Homo sapiens
tgatgaggacctggtctctgct

SEQ ID NO: 9360237 - DNA, 22 bp, Homo sapiens
tgatgaggacccatcacctggt

SEQ ID NO: 9360238 - DNA, 18 bp, Homo sapiens
tgaggcagtcagtgatgg

SEQ ID NO: 9360239 - DNA, 18 bp, Homo sapiens
tgaggcagtcagtgatgg

SEQ ID NO: 9360240 - DNA, 22 bp, Homo sapiens
tgaggcagtgctgggaagcctg

SEQ ID NO: 9360241 - DNA, 22 bp, Homo sapiens
tgatgacatgtgggctgtggct

SEQ ID NO: 9360242 - DNA, 22 bp, Homo sapiens
tgatgacagcaaaaaatgctag

SEQ ID NO: 9360243 - DNA, 22 bp, Homo sapiens
tgatgacaatgttgctgcaata

SEQ ID NO: 9360244 - DNA, 22 bp, Homo sapiens
tgatgaattggaaattctgatt

SEQ ID NO: 9360245 - DNA, 22 bp, Homo sapiens
tgatgaattagtaacaaatgag

SEQ ID NO: 9360246 - DNA, 22 bp, Homo sapiens
tgatacataaaccatcattttg

SEQ ID NO: 9360247 - DNA, 22 bp, Homo sapiens
tgaggcagtcaccccctcctgc

SEQ ID NO: 9360248 - DNA, 18 bp, Homo sapiens
tgaggcagtcagtgatgg

SEQ ID NO: 9360249 - DNA, 18 bp, Homo sapiens
tgaggcagtcagtgatgg

SEQ ID NO: 9360250 - DNA, 22 bp, Homo sapiens
tgaggcagtattttagtgactt

SEQ ID NO: 9360251 - DNA, 22 bp, Homo sapiens
tgaggcagtattttagtgactt

SEQ ID NO: 9360252 - DNA, 22 bp, Homo sapiens
tgaggcagtattttagtgactt

SEQ ID NO: 9360253 - DNA, 22 bp, Homo sapiens
tgaggcagtattctccattcca

SEQ ID NO: 9360254 - DNA, 22 bp, Homo sapiens
tgaggcagtattctccattcca

SEQ ID NO: 9360255 - DNA, 22 bp, Homo sapiens
tgaggcaggtggattacaaggt

SEQ ID NO: 9360256 - DNA, 22 bp, Homo sapiens
tgaggcaggtaagcaagttttg

SEQ ID NO: 9360257 - DNA, 22 bp, Homo sapiens
ccagtgtgggcccggcctcctc

SEQ ID NO: 9360258 - DNA, 22 bp, Homo sapiens
ccagtgtggccaggtgctggta

SEQ ID NO: 9360259 - DNA, 22 bp, Homo sapiens
ccagtgtgggctggtggaggac

SEQ ID NO: 9360260 - DNA, 22 bp, Homo sapiens
ccatggagcgggtgagtgagtg

SEQ ID NO: 9360261 - DNA, 23 bp, Homo sapiens
ccatggagcatggctcactaggc

SEQ ID NO: 9360262 - DNA, 22 bp, Homo sapiens
ccatggagcgggtgagtgagtg

SEQ ID NO: 9360263 - DNA, 22 bp, Homo sapiens
ccatggagttcctctggtctat

SEQ ID NO: 9360264 - DNA, 22 bp, Homo sapiens
ccatggcattttatgtgtctta

SEQ ID NO: 9360265 - DNA, 22 bp, Homo sapiens
ccatggcagcctggcctggctt

SEQ ID NO: 9360266 - DNA, 22 bp, Homo sapiens
ccatggcagcctggcctggctt

SEQ ID NO: 9360267 - DNA, 22 bp, Homo sapiens
ccatggcagccatgggagccac

SEQ ID NO: 9360268 - DNA, 22 bp, Homo sapiens
cccaaaggcattttgctgacca

SEQ ID NO: 9360269 - DNA, 22 bp, Homo sapiens
cccaaagggcttcctgttctca

SEQ ID NO: 9360270 - DNA, 22 bp, Homo sapiens
cccaaaggctctggagatttga

SEQ ID NO: 9360271 - DNA, 22 bp, Homo sapiens
ccattgtaaattctgtggaagt

SEQ ID NO: 9360272 - DNA, 22 bp, Homo sapiens
ccattgtttatttagacttaat

SEQ ID NO: 9360273 - DNA, 19 bp, Homo sapiens
ccattgtttgttgcccaag

SEQ ID NO: 9360274 - DNA, 23 bp, Homo sapiens
ccattttgtgttttggagaaaca

SEQ ID NO: 9360275 - DNA, 22 bp, Homo sapiens
cccaactactctcaggcagctt

SEQ ID NO: 9360276 - DNA, 22 bp, Homo sapiens
cccaactactctcaggcagctt

SEQ ID NO: 9360277 - DNA, 22 bp, Homo sapiens
cccaaccccaacttcctatgtt

SEQ ID NO: 9360278 - DNA, 22 bp, Homo sapiens
cccaagaggtggaggttgcagt

SEQ ID NO: 9360279 - DNA, 19 bp, Homo sapiens
cccaacttgactattttct

SEQ ID NO: 9360280 - DNA, 22 bp, Homo sapiens
cccaagatctttcgtgcactaa

SEQ ID NO: 9360281 - DNA, 22 bp, Homo sapiens
cccaagcagggtgcagaggcat

SEQ ID NO: 9360282 - DNA, 22 bp, Homo sapiens
tgattacacaccacagtgctcc

SEQ ID NO: 9360283 - DNA, 22 bp, Homo sapiens
tgattacattggtaatgtttat

SEQ ID NO: 9360284 - DNA, 22 bp, Homo sapiens
tgattacagtctgacagatgtt

SEQ ID NO: 9360285 - DNA, 22 bp, Homo sapiens
cccagcagaatctgatgagggc

SEQ ID NO: 9360286 - DNA, 22 bp, Homo sapiens
cccagcactttgaatatgtcac

SEQ ID NO: 9360287 - DNA, 22 bp, Homo sapiens
cccagcactttgaatatgtcac

SEQ ID NO: 9360288 - DNA, 22 bp, Homo sapiens
cccagcactttgaatatgtcac

SEQ ID NO: 9360289 - DNA, 22 bp, Homo sapiens
cccagcactcagcaggctcata

SEQ ID NO: 9360290 - DNA, 22 bp, Homo sapiens
cccagcagaatctgatgagggc

SEQ ID NO: 9360291 - DNA, 18 bp, Homo sapiens
cccagcactttgggagcc

SEQ ID NO: 9360292 - DNA, 23 bp, Homo sapiens
cccagcagagatgaggaggggtc

SEQ ID NO: 9360293 - DNA, 22 bp, Homo sapiens
cccagcagaccgctgtgatggc

SEQ ID NO: 9360294 - DNA, 23 bp, Homo sapiens
cccagcagagatgaggaggggtc

SEQ ID NO: 9360295 - DNA, 23 bp, Homo sapiens
cccagcagagatgaggaggggtc

SEQ ID NO: 9360296 - DNA, 22 bp, Homo sapiens
tgcagcaggttccaaagggtta

SEQ ID NO: 9360297 - DNA, 22 bp, Homo sapiens
cccagcagccagaatgaggagc

SEQ ID NO: 9360298 - DNA, 22 bp, Homo sapiens
cccagcagccagaatgaggagc

SEQ ID NO: 9360299 - DNA, 22 bp, Homo sapiens
cccagcagccagaatgaggagc

SEQ ID NO: 9360300 - DNA, 22 bp, Homo sapiens
cccagagggtggaggttgcagt

SEQ ID NO: 9360301 - DNA, 22 bp, Homo sapiens
cccagagggtggaggttgcagt

SEQ ID NO: 9360302 - DNA, 22 bp, Homo sapiens
cccagcactcagcaggctcata

SEQ ID NO: 9360303 - DNA, 22 bp, Homo sapiens
cccagaggtgaaggaggtggga

SEQ ID NO: 9360304 - DNA, 22 bp, Homo sapiens
cccagaggtgaaggaggtggga

SEQ ID NO: 9360305 - DNA, 22 bp, Homo sapiens
tgcagaggtttccaggcaagtt

SEQ ID NO: 9360306 - DNA, 21 bp, Homo sapiens
cccaccccataaggcagaacc

SEQ ID NO: 9360307 - DNA, 22 bp, Homo sapiens
cccacccactctgaccagaagc

SEQ ID NO: 9360308 - DNA, 22 bp, Homo sapiens
cccaccagccatctgagagtgt

SEQ ID NO: 9360309 - DNA, 22 bp, Homo sapiens
cccaccatgtgcccattggctt

SEQ ID NO: 9360310 - DNA, 22 bp, Homo sapiens
tgcagaggtgaaagactagcaa

SEQ ID NO: 9360311 - DNA, 21 bp, Homo sapiens
tgcagagatatctgaagcaga

SEQ ID NO: 9360312 - DNA, 22 bp, Homo sapiens
tgcagaggtttccaggcaagtt

SEQ ID NO: 9360313 - DNA, 22 bp, Homo sapiens
tgcagaggtttccaggcaagtt

SEQ ID NO: 9360314 - DNA, 22 bp, Homo sapiens
tgcagaggtttccaggcaagtt

SEQ ID NO: 9360315 - DNA, 22 bp, Homo sapiens
tgcagaggtttccaggcaagtt

SEQ ID NO: 9360316 - DNA, 22 bp, Homo sapiens
tgcagaggtttccaggcaagtt

SEQ ID NO: 9360317 - DNA, 22 bp, Homo sapiens
tgcagaggtgttgctgagataa

SEQ ID NO: 9360318 - DNA, 22 bp, Homo sapiens
tgcagaggtgttgctgagataa

SEQ ID NO: 9360319 - DNA, 22 bp, Homo sapiens
cccacaggcaggtgcatgggct

SEQ ID NO: 9360320 - DNA, 22 bp, Homo sapiens
cccacaggccctgctgccttga

SEQ ID NO: 9360321 - DNA, 22 bp, Homo sapiens
cccacaggccctgctgccttga

SEQ ID NO: 9360322 - DNA, 22 bp, Homo sapiens
cccacaggccctgctgccttga

SEQ ID NO: 9360323 - DNA, 22 bp, Homo sapiens
cccacaggccctgctgccttga

SEQ ID NO: 9360324 - DNA, 22 bp, Homo sapiens
cccacaggcaggtgcatgggct

SEQ ID NO: 9360325 - DNA, 22 bp, Homo sapiens
cccacaggcaggggcagagaca

SEQ ID NO: 9360326 - DNA, 22 bp, Homo sapiens
cccacaggcaggggcagagaca

SEQ ID NO: 9360327 - DNA, 22 bp, Homo sapiens
cccaagggtgcccagcagagga

SEQ ID NO: 9360328 - DNA, 22 bp, Homo sapiens
cccaagggtgcccagcagagga

SEQ ID NO: 9360329 - DNA, 22 bp, Homo sapiens
cccacagaatgccaatgagacc

SEQ ID NO: 9360330 - DNA, 19 bp, Homo sapiens
cccacaggaggacatatgg

SEQ ID NO: 9360331 - DNA, 22 bp, Homo sapiens
cccacaggcaggggcagagaca

SEQ ID NO: 9360332 - DNA, 22 bp, Homo sapiens
cccacagggctgctgatggcag

SEQ ID NO: 9360333 - DNA, 22 bp, Homo sapiens
cccacaggtccccatgaactcg

SEQ ID NO: 9360334 - DNA, 22 bp, Homo sapiens
cccacagggctgctgatggcag

SEQ ID NO: 9360335 - DNA, 22 bp, Homo sapiens
cccacagggctgctgatggcag

SEQ ID NO: 9360336 - DNA, 22 bp, Homo sapiens
cccacagggctgctgatggcag

SEQ ID NO: 9360337 - DNA, 22 bp, Homo sapiens
cccacaggctaggggtagggca

SEQ ID NO: 9360338 - DNA, 22 bp, Homo sapiens
cccacaggctaggggtagggca

SEQ ID NO: 9360339 - DNA, 22 bp, Homo sapiens
cccacaggccctgctgccttga

SEQ ID NO: 9360340 - DNA, 22 bp, Homo sapiens
cccacaggtggaagcctcggaa

SEQ ID NO: 9360341 - DNA, 22 bp, Homo sapiens
cccacaggtggaagcctcggaa

SEQ ID NO: 9360342 - DNA, 22 bp, Homo sapiens
cccacaggtccccatgaactcg

SEQ ID NO: 9360343 - DNA, 22 bp, Homo sapiens
cccacaggtccccatgaactcg

SEQ ID NO: 9360344 - DNA, 22 bp, Homo sapiens
cccacaggtgtgagcttgctgg

SEQ ID NO: 9360345 - DNA, 22 bp, Homo sapiens
cccacaggtgtgagcttgctgg

SEQ ID NO: 9360346 - DNA, 22 bp, Homo sapiens
cccacaggtgtgagcttgctgg

SEQ ID NO: 9360347 - DNA, 22 bp, Homo sapiens
cccaggaggcctgcctggccgg

SEQ ID NO: 9360348 - DNA, 22 bp, Homo sapiens
cccaggaggcctgcctggccgg

SEQ ID NO: 9360349 - DNA, 21 bp, Homo sapiens
cccaggaggagctccggctcc

SEQ ID NO: 9360350 - DNA, 22 bp, Homo sapiens
cccaggaggcagaagttgcagt

SEQ ID NO: 9360351 - DNA, 22 bp, Homo sapiens
cccaggaggcagagcttgcagt

SEQ ID NO: 9360352 - DNA, 22 bp, Homo sapiens
tgcatattgtccttgatattat

SEQ ID NO: 9360353 - DNA, 22 bp, Homo sapiens
tgcatattgtccttgatattat

SEQ ID NO: 9360354 - DNA, 22 bp, Homo sapiens
tgcatatttgattgagatacct

SEQ ID NO: 9360355 - DNA, 19 bp, Homo sapiens
tgcatatatctatgaaaga

SEQ ID NO: 9360356 - DNA, 21 bp, Homo sapiens
tgcatatataagtgcatacac

SEQ ID NO: 9360357 - DNA, 22 bp, Homo sapiens
cccaggagacagaaacagaggt

SEQ ID NO: 9360358 - DNA, 22 bp, Homo sapiens
tgcatattctcctttattttgt

SEQ ID NO: 9360359 - DNA, 22 bp, Homo sapiens
tgcatattatgtgtatctgtct

SEQ ID NO: 9360360 - DNA, 22 bp, Homo sapiens
tgcatatatttgagattatggc

SEQ ID NO: 9360361 - DNA, 19 bp, Homo sapiens
tgcatatatctatgaaaga

SEQ ID NO: 9360362 - DNA, 22 bp, Homo sapiens
tgcatatcttcaatgctgttgc

SEQ ID NO: 9360363 - DNA, 22 bp, Homo sapiens
tgcatatccacaccttatctct

SEQ ID NO: 9360364 - DNA, 22 bp, Homo sapiens
tgccctcctcctgagcccatgt

SEQ ID NO: 9360365 - DNA, 22 bp, Homo sapiens
tgccctccctgtactgtcagga

SEQ ID NO: 9360366 - DNA, 22 bp, Homo sapiens
tgccctccacagtggctccacc

SEQ ID NO: 9360367 - DNA, 22 bp, Homo sapiens
tgccctcaggagtccctgacca

SEQ ID NO: 9360368 - DNA, 21 bp, Homo sapiens
cccaggaggctgagaagagca

SEQ ID NO: 9360369 - DNA, 22 bp, Homo sapiens
tgcccaggatctggcgatgctc

SEQ ID NO: 9360370 - DNA, 22 bp, Homo sapiens
tgccctgaggcactccatccat

SEQ ID NO: 9360371 - DNA, 19 bp, Homo sapiens
tgccctgcacgctgtcctg

SEQ ID NO: 9360372 - DNA, 19 bp, Homo sapiens
tgccctgcacgctgtcctg

SEQ ID NO: 9360373 - DNA, 22 bp, Homo sapiens
cccaggaggttggggctacagt

SEQ ID NO: 9360374 - DNA, 22 bp, Homo sapiens
cccaggaggttggggctacagt

SEQ ID NO: 9360375 - DNA, 22 bp, Homo sapiens
cccaggaggttggggctacagt

SEQ ID NO: 9360376 - DNA, 22 bp, Homo sapiens
cccaggagtaagtgacattgtt

SEQ ID NO: 9360377 - DNA, 22 bp, Homo sapiens
cccaggaggttggggctacagt

SEQ ID NO: 9360378 - DNA, 20 bp, Homo sapiens
cccaggagtgagcagcttta

SEQ ID NO: 9360379 - DNA, 20 bp, Homo sapiens
cccaggagtgagcagcttta

SEQ ID NO: 9360380 - DNA, 23 bp, Homo sapiens
tgcctcagtggaatgtgagggtg

SEQ ID NO: 9360381 - DNA, 22 bp, Homo sapiens
tgcctcagtttcatctgcagaa

SEQ ID NO: 9360382 - DNA, 22 bp, Homo sapiens
tgcctcagtttcatctgcagaa

SEQ ID NO: 9360383 - DNA, 22 bp, Homo sapiens
tgcagcagtttaatgcagggtt

SEQ ID NO: 9360384 - DNA, 22 bp, Homo sapiens
cccagcatctccaggcatggcc

SEQ ID NO: 9360385 - DNA, 22 bp, Homo sapiens
cccagcatggagtgaggactca

SEQ ID NO: 9360386 - DNA, 22 bp, Homo sapiens
cccagcatttctgggctgcact

SEQ ID NO: 9360387 - DNA, 22 bp, Homo sapiens
cccagccagcctcttcccatat

SEQ ID NO: 9360388 - DNA, 22 bp, Homo sapiens
cccagccaagtgatctgaccgc

SEQ ID NO: 9360389 - DNA, 20 bp, Homo sapiens
cccagcccctacctgttgcc

SEQ ID NO: 9360390 - DNA, 22 bp, Homo sapiens
cccagccctgacctattggaaa

SEQ ID NO: 9360391 - DNA, 20 bp, Homo sapiens
cccagcccgggccgcgctcg

SEQ ID NO: 9360392 - DNA, 22 bp, Homo sapiens
cccagcccccgagtgtctggaa

SEQ ID NO: 9360393 - DNA, 22 bp, Homo sapiens
cccagcccccgagtgtctggaa

SEQ ID NO: 9360394 - DNA, 20 bp, Homo sapiens
cccagcccctacctgttgcc

SEQ ID NO: 9360395 - DNA, 22 bp, Homo sapiens
cccagcccagcgttcgaggggt

SEQ ID NO: 9360396 - DNA, 22 bp, Homo sapiens
cccagcccagcgttcgaggggt

SEQ ID NO: 9360397 - DNA, 18 bp, Homo sapiens
cccagcccaccatttctc

SEQ ID NO: 9360398 - DNA, 18 bp, Homo sapiens
cccagcccaccatttctc

SEQ ID NO: 9360399 - DNA, 18 bp, Homo sapiens
cccagcccaccatttctc

SEQ ID NO: 9360400 - DNA, 18 bp, Homo sapiens
cccagcccaccatttctc

SEQ ID NO: 9360401 - DNA, 22 bp, Homo sapiens
tgcagtggaggccgtgagacag

SEQ ID NO: 9360402 - DNA, 22 bp, Homo sapiens
tgcagtggaggccgtgagacag

SEQ ID NO: 9360403 - DNA, 22 bp, Homo sapiens
tgcagtggaggccgtgagacag

SEQ ID NO: 9360404 - DNA, 22 bp, Homo sapiens
tgcagtggcgccatctcagctc

SEQ ID NO: 9360405 - DNA, 22 bp, Homo sapiens
tgcagtggaatctggagagcag

SEQ ID NO: 9360406 - DNA, 22 bp, Homo sapiens
tgcagtggaagaggtggagatc

SEQ ID NO: 9360407 - DNA, 18 bp, Homo sapiens
cccagctccacttccctc

SEQ ID NO: 9360408 - DNA, 18 bp, Homo sapiens
cccagctccacttccctc

SEQ ID NO: 9360409 - DNA, 22 bp, Homo sapiens
cccagctccaagggacagcgaa

SEQ ID NO: 9360410 - DNA, 22 bp, Homo sapiens
cccagctcatcaggagccgccc

SEQ ID NO: 9360411 - DNA, 22 bp, Homo sapiens
tgcagtggaagaggtggagatc

SEQ ID NO: 9360412 - DNA, 22 bp, Homo sapiens
tgcagtgctttggaacaaagtc

SEQ ID NO: 9360413 - DNA, 22 bp, Homo sapiens
tgcaggtggacacgggagacgg

SEQ ID NO: 9360414 - DNA, 22 bp, Homo sapiens
tgcagtctggatgtcctcagat

SEQ ID NO: 9360415 - DNA, 22 bp, Homo sapiens
tgcaggtggacacgggagacgg

SEQ ID NO: 9360416 - DNA, 22 bp, Homo sapiens
cccaggaccgcgcggctgagcg

SEQ ID NO: 9360417 - DNA, 22 bp, Homo sapiens
cccaggaccgcgcggctgagcg

SEQ ID NO: 9360418 - DNA, 22 bp, Homo sapiens
cccaggactaatgagctctacg

SEQ ID NO: 9360419 - DNA, 22 bp, Homo sapiens
cccaggaccatccttctgtgcc

SEQ ID NO: 9360420 - DNA, 22 bp, Homo sapiens
cccaggaccatccttctgtgcc

SEQ ID NO: 9360421 - DNA, 22 bp, Homo sapiens
cccaggactcttcactgcagcc

SEQ ID NO: 9360422 - DNA, 22 bp, Homo sapiens
cccaggactcttcactgcagcc

SEQ ID NO: 9360423 - DNA, 22 bp, Homo sapiens
cccagctccgagctccgagccg

SEQ ID NO: 9360424 - DNA, 22 bp, Homo sapiens
cccagctccgagctccgagccg

SEQ ID NO: 9360425 - DNA, 22 bp, Homo sapiens
cccagctccgagctccgagccg

SEQ ID NO: 9360426 - DNA, 22 bp, Homo sapiens
cccaggaaatagccaggaggtg

SEQ ID NO: 9360427 - DNA, 22 bp, Homo sapiens
cccagctcccaagttgctatgg

SEQ ID NO: 9360428 - DNA, 22 bp, Homo sapiens
cccagctcccatgttctccaat

SEQ ID NO: 9360429 - DNA, 22 bp, Homo sapiens
cccagctcccatgttctccaat

SEQ ID NO: 9360430 - DNA, 22 bp, Homo sapiens
cctcacagagcccagatgtcta

SEQ ID NO: 9360431 - DNA, 20 bp, Homo sapiens
cctaaatacctgtcaccagg

SEQ ID NO: 9360432 - DNA, 21 bp, Homo sapiens
cctaaacaagactgacacaca

SEQ ID NO: 9360433 - DNA, 22 bp, Homo sapiens
cctcacagccctcctctagcac

SEQ ID NO: 9360434 - DNA, 22 bp, Homo sapiens
cctcacccagtcacctaggtgg

SEQ ID NO: 9360435 - DNA, 22 bp, Homo sapiens
cctcacagcctcatgcccagcc

SEQ ID NO: 9360436 - DNA, 22 bp, Homo sapiens
ccgggagcaggcgccaccgcca

SEQ ID NO: 9360437 - DNA, 22 bp, Homo sapiens
ccgggcctcgggacaccgggta

SEQ ID NO: 9360438 - DNA, 22 bp, Homo sapiens
ccgggccccacggtgacctcag

SEQ ID NO: 9360439 - DNA, 22 bp, Homo sapiens
ccgggagagtggaaccaagagg

SEQ ID NO: 9360440 - DNA, 22 bp, Homo sapiens
ccggctcggcgaccaggctgaa

SEQ ID NO: 9360441 - DNA, 22 bp, Homo sapiens
ccgggagactttgagcaccatg

SEQ ID NO: 9360442 - DNA, 22 bp, Homo sapiens
ccgggagagtggaaccaagagg

SEQ ID NO: 9360443 - DNA, 22 bp, Homo sapiens
ccgggagactttgagcaccatg

SEQ ID NO: 9360444 - DNA, 22 bp, Homo sapiens
ccggctactcgggaggctgacg

SEQ ID NO: 9360445 - DNA, 22 bp, Homo sapiens
ccgtggagttgtgctgagtatg

SEQ ID NO: 9360446 - DNA, 22 bp, Homo sapiens
ccgtggagttgtgctgagtatg

SEQ ID NO: 9360447 - DNA, 22 bp, Homo sapiens
ccgtggtcacctgagctccttg

SEQ ID NO: 9360448 - DNA, 22 bp, Homo sapiens
ccggtcccaggtgccccggtga

SEQ ID NO: 9360449 - DNA, 22 bp, Homo sapiens
ccgtattataagtttttccttc

SEQ ID NO: 9360450 - DNA, 22 bp, Homo sapiens
ccggtgttcaaagtctggtatg

SEQ ID NO: 9360451 - DNA, 22 bp, Homo sapiens
ccgggttgaggttcccatagat

SEQ ID NO: 9360452 - DNA, 22 bp, Homo sapiens
ccctggagctgcttgcatgttg

SEQ ID NO: 9360453 - DNA, 22 bp, Homo sapiens
ccctggagctgcttgcatgttg

SEQ ID NO: 9360454 - DNA, 22 bp, Homo sapiens
ccctggaggaaaatctgaggct

SEQ ID NO: 9360455 - DNA, 22 bp, Homo sapiens
ccctggaggaaaatctgaggct

SEQ ID NO: 9360456 - DNA, 22 bp, Homo sapiens
ccctggaggaaaatctgaggct

SEQ ID NO: 9360457 - DNA, 22 bp, Homo sapiens
ccctggaggaaaatctgaggct

SEQ ID NO: 9360458 - DNA, 22 bp, Homo sapiens
ccctggaggaaaatctgaggct

SEQ ID NO: 9360459 - DNA, 22 bp, Homo sapiens
ccctggaggaagaaacaatggc

SEQ ID NO: 9360460 - DNA, 22 bp, Homo sapiens
ccctggaggaagaaacaatggc

SEQ ID NO: 9360461 - DNA, 22 bp, Homo sapiens
ccctggaggaagaaacaatggc

SEQ ID NO: 9360462 - DNA, 22 bp, Homo sapiens
ccctgggatggattggcaggaa

SEQ ID NO: 9360463 - DNA, 22 bp, Homo sapiens
ccctgggataccagacaccaga

SEQ ID NO: 9360464 - DNA, 22 bp, Homo sapiens
ccctgggataccagacaccaga

SEQ ID NO: 9360465 - DNA, 22 bp, Homo sapiens
ccctgggatggattggcaggaa

SEQ ID NO: 9360466 - DNA, 22 bp, Homo sapiens
ccctggtcagggaaggcgcctg

SEQ ID NO: 9360467 - DNA, 22 bp, Homo sapiens
ccctggttgacaagccagctca

SEQ ID NO: 9360468 - DNA, 21 bp, Homo sapiens
ccctggttccactgtcaccgc

SEQ ID NO: 9360469 - DNA, 22 bp, Homo sapiens
ccctggtggtacggcactggca

SEQ ID NO: 9360470 - DNA, 22 bp, Homo sapiens
ccctggtgtccactggaggaag

SEQ ID NO: 9360471 - DNA, 22 bp, Homo sapiens
ccctgtctgtaccgtgatgagc

SEQ ID NO: 9360472 - DNA, 22 bp, Homo sapiens
ccctgtctgtaccgtgatgagc

SEQ ID NO: 9360473 - DNA, 22 bp, Homo sapiens
ccctgtctcattgatcacttgt

SEQ ID NO: 9360474 - DNA, 22 bp, Homo sapiens
ccctgtcctgctaggccctggt

SEQ ID NO: 9360475 - DNA, 22 bp, Homo sapiens
ccgcgtggcaccctcctggagg

SEQ ID NO: 9360476 - DNA, 22 bp, Homo sapiens
ccggagaaactggcaaacccta

SEQ ID NO: 9360477 - DNA, 22 bp, Homo sapiens
ccggagtgtctggcctgctggg

SEQ ID NO: 9360478 - DNA, 22 bp, Homo sapiens
ccggcgtctcttccacttccta

SEQ ID NO: 9360479 - DNA, 22 bp, Homo sapiens
ccctgtgggaactcctgagttg

SEQ ID NO: 9360480 - DNA, 22 bp, Homo sapiens
ccctgtggcaggaggaggagca

SEQ ID NO: 9360481 - DNA, 22 bp, Homo sapiens
ccgcggggcgtgggctcttacc

SEQ ID NO: 9360482 - DNA, 22 bp, Homo sapiens
ccctttcattggcagagctctc

SEQ ID NO: 9360483 - DNA, 22 bp, Homo sapiens
ccctttcattggcagagctctc

SEQ ID NO: 9360484 - DNA, 22 bp, Homo sapiens
ccctgtggaggcagcatcctgc

SEQ ID NO: 9360485 - DNA, 22 bp, Homo sapiens
ccctgtgctgtcatgctgggcg

SEQ ID NO: 9360486 - DNA, 22 bp, Homo sapiens
ccctgtgcctagttggcctaaa

SEQ ID NO: 9360487 - DNA, 22 bp, Homo sapiens
ccctgtgcctcagtttcctcat

SEQ ID NO: 9360488 - DNA, 22 bp, Homo sapiens
ccctgtgccagagaggcaggag

SEQ ID NO: 9360489 - DNA, 22 bp, Homo sapiens
ccctgtgcagatggcagctggg

SEQ ID NO: 9360490 - DNA, 22 bp, Homo sapiens
ccctgtgcattggagggtgttt

SEQ ID NO: 9360491 - DNA, 22 bp, Homo sapiens
ccctgtgcacacacttcactct

SEQ ID NO: 9360492 - DNA, 22 bp, Homo sapiens
ccctgtgcacacacttcactct

SEQ ID NO: 9360493 - DNA, 22 bp, Homo sapiens
tggcctcggcatccagcaagag

SEQ ID NO: 9360494 - DNA, 22 bp, Homo sapiens
cctcagccttggccccaggcag

SEQ ID NO: 9360495 - DNA, 22 bp, Homo sapiens
cctcagcccctgaatggagaga

SEQ ID NO: 9360496 - DNA, 23 bp, Homo sapiens
cctcagcatggcaggagcccagc

SEQ ID NO: 9360497 - DNA, 22 bp, Homo sapiens
cctcagcatcctcctgctcagt

SEQ ID NO: 9360498 - DNA, 22 bp, Homo sapiens
cctcagcatcctggtgaagtag

SEQ ID NO: 9360499 - DNA, 22 bp, Homo sapiens
cctcagcatcctggtgaagtag

SEQ ID NO: 9360500 - DNA, 22 bp, Homo sapiens
cctcagctgctgcacagctttt

SEQ ID NO: 9360501 - DNA, 22 bp, Homo sapiens
cctcagctgcttccctggagcc

SEQ ID NO: 9360502 - DNA, 22 bp, Homo sapiens
cctcagctgcttccctggagcc

SEQ ID NO: 9360503 - DNA, 22 bp, Homo sapiens
cctcagctcttccctgtgcaca

SEQ ID NO: 9360504 - DNA, 22 bp, Homo sapiens
cctcagctcttccctgtgcaca

SEQ ID NO: 9360505 - DNA, 22 bp, Homo sapiens
cctcagctcccatgagatctgc

SEQ ID NO: 9360506 - DNA, 22 bp, Homo sapiens
cctcagctcccatgagatctgc

SEQ ID NO: 9360507 - DNA, 22 bp, Homo sapiens
tggcctgggtcacaccagggtc

SEQ ID NO: 9360508 - DNA, 22 bp, Homo sapiens
tggcctggggacctgtgagacc

SEQ ID NO: 9360509 - DNA, 22 bp, Homo sapiens
cctcagctgtcttttccgaggt

SEQ ID NO: 9360510 - DNA, 22 bp, Homo sapiens
tggctaacaaggtgaaaccccg

SEQ ID NO: 9360511 - DNA, 22 bp, Homo sapiens
tggctaacaaggtgaaaccccg

SEQ ID NO: 9360512 - DNA, 22 bp, Homo sapiens
tggctaacaaggtgaaaccccg

SEQ ID NO: 9360513 - DNA, 22 bp, Homo sapiens
cctcactctgcaccctgcagca

SEQ ID NO: 9360514 - DNA, 22 bp, Homo sapiens
cctcactgaagaggtgacattt

SEQ ID NO: 9360515 - DNA, 22 bp, Homo sapiens
cctcactgtcatcagtagttat

SEQ ID NO: 9360516 - DNA, 22 bp, Homo sapiens
cctcactgtcacttatagtggt

SEQ ID NO: 9360517 - DNA, 22 bp, Homo sapiens
cctcactggccagccaggggtg

SEQ ID NO: 9360518 - DNA, 22 bp, Homo sapiens
cctcactgctatgtgtttgctc

SEQ ID NO: 9360519 - DNA, 22 bp, Homo sapiens
cctcactgaagaggtgacattt

SEQ ID NO: 9360520 - DNA, 22 bp, Homo sapiens
tggcctcaatctgtcctccagc

SEQ ID NO: 9360521 - DNA, 22 bp, Homo sapiens
tggcctcaagtctgagggcctt

SEQ ID NO: 9360522 - DNA, 22 bp, Homo sapiens
cctcagaagctcaaggacattg

SEQ ID NO: 9360523 - DNA, 21 bp, Homo sapiens
tggccctggccacggctgcca

SEQ ID NO: 9360524 - DNA, 22 bp, Homo sapiens
tggcctcagatttcaggggtgg

SEQ ID NO: 9360525 - DNA, 22 bp, Homo sapiens
cctcccctcagacagagactgg

SEQ ID NO: 9360526 - DNA, 22 bp, Homo sapiens
cctcccagatgtgcccaatgga

SEQ ID NO: 9360527 - DNA, 22 bp, Homo sapiens
cctcccaggcattgccattttc

SEQ ID NO: 9360528 - DNA, 22 bp, Homo sapiens
cctcccagatgtgcccaatgga

SEQ ID NO: 9360529 - DNA, 22 bp, Homo sapiens
tggctcagctgactcggcttct

SEQ ID NO: 9360530 - DNA, 22 bp, Homo sapiens
tggctcagcggtggcagcagac

SEQ ID NO: 9360531 - DNA, 22 bp, Homo sapiens
tggctcagcggtggcagcagac

SEQ ID NO: 9360532 - DNA, 23 bp, Homo sapiens
tggctcagctagttttccatttc

SEQ ID NO: 9360533 - DNA, 22 bp, Homo sapiens
tggctcagcggtggcagcagac

SEQ ID NO: 9360534 - DNA, 22 bp, Homo sapiens
tggctcagcgcggcctggtctt

SEQ ID NO: 9360535 - DNA, 22 bp, Homo sapiens
cctccctccctcttatggttta

SEQ ID NO: 9360536 - DNA, 22 bp, Homo sapiens
cctccctccctgcagaagccac

SEQ ID NO: 9360537 - DNA, 22 bp, Homo sapiens
cctccctctttcagtcccacag

SEQ ID NO: 9360538 - DNA, 22 bp, Homo sapiens
cctccctctttcagtcccacag

SEQ ID NO: 9360539 - DNA, 23 bp, Homo sapiens
cctccccttcccacagctgggtg

SEQ ID NO: 9360540 - DNA, 19 bp, Homo sapiens
cctccccttggaccagcaa

SEQ ID NO: 9360541 - DNA, 18 bp, Homo sapiens
cctccctcattttcccag

SEQ ID NO: 9360542 - DNA, 18 bp, Homo sapiens
cctccctcattttcccag

SEQ ID NO: 9360543 - DNA, 22 bp, Homo sapiens
cctccctccattgccatcgtct

SEQ ID NO: 9360544 - DNA, 22 bp, Homo sapiens
cctccctccattgccatcgtct

SEQ ID NO: 9360545 - DNA, 22 bp, Homo sapiens
tggctaggctccaagagctgga

SEQ ID NO: 9360546 - DNA, 22 bp, Homo sapiens
tggctaggctccaagagctgga

SEQ ID NO: 9360547 - DNA, 22 bp, Homo sapiens
tggctaggacctctgcggagca

SEQ ID NO: 9360548 - DNA, 22 bp, Homo sapiens
tggctagggcctttaacgagta

SEQ ID NO: 9360549 - DNA, 22 bp, Homo sapiens
tggctagccgaggggtgggccc

SEQ ID NO: 9360550 - DNA, 22 bp, Homo sapiens
tggctagcccttgtggggagag

SEQ ID NO: 9360551 - DNA, 22 bp, Homo sapiens
tggctaggaatccatgactctc

SEQ ID NO: 9360552 - DNA, 22 bp, Homo sapiens
tggctaggaaagagttctggga

SEQ ID NO: 9360553 - DNA, 22 bp, Homo sapiens
tggctaggaaagagttctggga

SEQ ID NO: 9360554 - DNA, 22 bp, Homo sapiens
tggctagctgtgggctggaagc

SEQ ID NO: 9360555 - DNA, 23 bp, Homo sapiens
tggctagctgaagaggtatgggt

SEQ ID NO: 9360556 - DNA, 22 bp, Homo sapiens
tggctagatttattgctgagca

SEQ ID NO: 9360557 - DNA, 22 bp, Homo sapiens
tggctagatggcagaaagctgg

SEQ ID NO: 9360558 - DNA, 22 bp, Homo sapiens
tggctcagcgcggcctggtctt

SEQ ID NO: 9360559 - DNA, 22 bp, Homo sapiens
tggctcagcgcggcctggtctt

SEQ ID NO: 9360560 - DNA, 22 bp, Homo sapiens
tggctcagccattcgtgttgcc

SEQ ID NO: 9360561 - DNA, 22 bp, Homo sapiens
tggctcagccattcgtgttgcc

SEQ ID NO: 9360562 - DNA, 22 bp, Homo sapiens
tggctcagcctggccctttcat

SEQ ID NO: 9360563 - DNA, 22 bp, Homo sapiens
tggctcagcctggccctttcat

SEQ ID NO: 9360564 - DNA, 22 bp, Homo sapiens
tggctactgtacttgagctatt

SEQ ID NO: 9360565 - DNA, 22 bp, Homo sapiens
tggctactgtatttggacgaca

SEQ ID NO: 9360566 - DNA, 22 bp, Homo sapiens
tggctacagatttgctgacaat

SEQ ID NO: 9360567 - DNA, 22 bp, Homo sapiens
tggaggtctctgtctgggcagg

SEQ ID NO: 9360568 - DNA, 22 bp, Homo sapiens
tggaggtgaaatgagattttgt

SEQ ID NO: 9360569 - DNA, 19 bp, Homo sapiens
tggaggggtttgaatgtgg

SEQ ID NO: 9360570 - DNA, 19 bp, Homo sapiens
tggaggggtttgaatgtgg

SEQ ID NO: 9360571 - DNA, 22 bp, Homo sapiens
ccctggagctagtctgagcaga

SEQ ID NO: 9360572 - DNA, 22 bp, Homo sapiens
ccctggagctagtctgagcaga

SEQ ID NO: 9360573 - DNA, 23 bp, Homo sapiens
ccctggagctagtctgagcagag

SEQ ID NO: 9360574 - DNA, 23 bp, Homo sapiens
ccctggagctagtctgagcagag

SEQ ID NO: 9360575 - DNA, 23 bp, Homo sapiens
ccctggagctagtctgagcagag

SEQ ID NO: 9360576 - DNA, 22 bp, Homo sapiens
ccctggagctgcttgcatgttg

SEQ ID NO: 9360577 - DNA, 22 bp, Homo sapiens
ccctggagctgcttgcatgttg

SEQ ID NO: 9360578 - DNA, 23 bp, Homo sapiens
ccctggagctagtctgagcgggg

SEQ ID NO: 9360579 - DNA, 23 bp, Homo sapiens
ccctggagctagtctgagcgggg

SEQ ID NO: 9360580 - DNA, 23 bp, Homo sapiens
ccctggagctagtctgagcagag

SEQ ID NO: 9360581 - DNA, 23 bp, Homo sapiens
ccctggagctagtctgagcagag

SEQ ID NO: 9360582 - DNA, 22 bp, Homo sapiens
tggaggtggagttggaaactga

SEQ ID NO: 9360583 - DNA, 22 bp, Homo sapiens
ccctggagctagtctgagcaga

SEQ ID NO: 9360584 - DNA, 22 bp, Homo sapiens
tggaggtgacggggcctcgttg

SEQ ID NO: 9360585 - DNA, 22 bp, Homo sapiens
tggaggtgacggggcctcgttg

SEQ ID NO: 9360586 - DNA, 22 bp, Homo sapiens
tggaggtgagtgtggtacagca

SEQ ID NO: 9360587 - DNA, 22 bp, Homo sapiens
tggaggtgagtgtggtacagca

SEQ ID NO: 9360588 - DNA, 22 bp, Homo sapiens
tggaggtgacggggcctcgttg

SEQ ID NO: 9360589 - DNA, 22 bp, Homo sapiens
ccctgccttgtctgggctaggt

SEQ ID NO: 9360590 - DNA, 22 bp, Homo sapiens
ccctgccttggggtccacaccg

SEQ ID NO: 9360591 - DNA, 22 bp, Homo sapiens
ccctgccttggggtccacaccg

SEQ ID NO: 9360592 - DNA, 22 bp, Homo sapiens
ccctgccttgttggagcctatg

SEQ ID NO: 9360593 - DNA, 22 bp, Homo sapiens
ccctgccttgttggagcctatg

SEQ ID NO: 9360594 - DNA, 22 bp, Homo sapiens
ccctgccttgttggagcctatg

SEQ ID NO: 9360595 - DNA, 22 bp, Homo sapiens
ccctgccttgtctgggctaggt

SEQ ID NO: 9360596 - DNA, 22 bp, Homo sapiens
ccctgctcttagtgcctgtgtg

SEQ ID NO: 9360597 - DNA, 22 bp, Homo sapiens
ccctgctcttagtgcctgtgtg

SEQ ID NO: 9360598 - DNA, 23 bp, Homo sapiens
ccctgctcaggggtctgattctc

SEQ ID NO: 9360599 - DNA, 22 bp, Homo sapiens
ccctgctagttgtctcagtgat

SEQ ID NO: 9360600 - DNA, 22 bp, Homo sapiens
ccctgctcttctgactcaagct

SEQ ID NO: 9360601 - DNA, 22 bp, Homo sapiens
ccctgctcttctgactcaagct

SEQ ID NO: 9360602 - DNA, 22 bp, Homo sapiens
ccctgctcttctgactcaagct

SEQ ID NO: 9360603 - DNA, 22 bp, Homo sapiens
tggaggccaggaaggcagcgag

SEQ ID NO: 9360604 - DNA, 19 bp, Homo sapiens
tggaggccaggacacaggt

SEQ ID NO: 9360605 - DNA, 22 bp, Homo sapiens
tggaggggcaatggagcgcgga

SEQ ID NO: 9360606 - DNA, 22 bp, Homo sapiens
tggaggggcaatggagcgcgga

SEQ ID NO: 9360607 - DNA, 22 bp, Homo sapiens
ccctgctgaatcccatggagtc

SEQ ID NO: 9360608 - DNA, 22 bp, Homo sapiens
tggaagggaacaggtgggtgtt

SEQ ID NO: 9360609 - DNA, 22 bp, Homo sapiens
tggaagggaacaggtgggtgtt

SEQ ID NO: 9360610 - DNA, 22 bp, Homo sapiens
tggaagggaacaggtgggtgtt

SEQ ID NO: 9360611 - DNA, 21 bp, Homo sapiens
tggaagggaagtcttggttgt

SEQ ID NO: 9360612 - DNA, 22 bp, Homo sapiens
ccctgcagagagtgcttttgtg

SEQ ID NO: 9360613 - DNA, 22 bp, Homo sapiens
ccctgcagagccagccctgacc

SEQ ID NO: 9360614 - DNA, 22 bp, Homo sapiens
ccctgcagacgtcttgatgcct

SEQ ID NO: 9360615 - DNA, 22 bp, Homo sapiens
ccctgcagacgtcttgatgcct

SEQ ID NO: 9360616 - DNA, 22 bp, Homo sapiens
ccctgcagaccaatgccataga

SEQ ID NO: 9360617 - DNA, 22 bp, Homo sapiens
ccctgcagaccaatgccataga

SEQ ID NO: 9360618 - DNA, 22 bp, Homo sapiens
ccctgcagaaccacagacaaac

SEQ ID NO: 9360619 - DNA, 22 bp, Homo sapiens
tggacaggtgcacacagcagcc

SEQ ID NO: 9360620 - DNA, 22 bp, Homo sapiens
tggacaggttgagtaggaggag

SEQ ID NO: 9360621 - DNA, 22 bp, Homo sapiens
tggacaggttgagtaggaggag

SEQ ID NO: 9360622 - DNA, 22 bp, Homo sapiens
tggacaggtgcacacagcagcc

SEQ ID NO: 9360623 - DNA, 22 bp, Homo sapiens
ccctgcagccggccagctcatt

SEQ ID NO: 9360624 - DNA, 22 bp, Homo sapiens
ccctgcagatctagggtccttc

SEQ ID NO: 9360625 - DNA, 22 bp, Homo sapiens
ccctgcagagggatgggggcag

SEQ ID NO: 9360626 - DNA, 22 bp, Homo sapiens
ccctgcagatcagtgagaactt

SEQ ID NO: 9360627 - DNA, 22 bp, Homo sapiens
ccctgcctctgaagctgctcag

SEQ ID NO: 9360628 - DNA, 22 bp, Homo sapiens
ccctgcagtgtgacctcaccta

SEQ ID NO: 9360629 - DNA, 22 bp, Homo sapiens
ccctgcagtcctttcttggctc

SEQ ID NO: 9360630 - DNA, 22 bp, Homo sapiens
ccctgcctctgaagctgctcag

SEQ ID NO: 9360631 - DNA, 22 bp, Homo sapiens
ccctgcctctgaagctgctcag

SEQ ID NO: 9360632 - DNA, 22 bp, Homo sapiens
ccctgcctgtgggcatcaacat

SEQ ID NO: 9360633 - DNA, 22 bp, Homo sapiens
ccctgcctgtgggcatcaacat

SEQ ID NO: 9360634 - DNA, 22 bp, Homo sapiens
ccctgcctgtgggcatcaacat

SEQ ID NO: 9360635 - DNA, 22 bp, Homo sapiens
ccctgccttcttggcctttaaa

SEQ ID NO: 9360636 - DNA, 22 bp, Homo sapiens
tggacaggtttgggtgcctgtt

SEQ ID NO: 9360637 - DNA, 22 bp, Homo sapiens
tggacaggttgagtaggaggag

SEQ ID NO: 9360638 - DNA, 22 bp, Homo sapiens
tggacaggttgagtaggaggag

SEQ ID NO: 9360639 - DNA, 22 bp, Homo sapiens
tggacagtaggaagagtgtggg

SEQ ID NO: 9360640 - DNA, 22 bp, Homo sapiens
tggacatgagctgagtgggtgt

SEQ ID NO: 9360641 - DNA, 22 bp, Homo sapiens
tggacatgtaaaggctcaaggt

SEQ ID NO: 9360642 - DNA, 22 bp, Homo sapiens
tggacagttgtcttgtagctaa

SEQ ID NO: 9360643 - DNA, 22 bp, Homo sapiens
tggacatgacctcgagcgagat

SEQ ID NO: 9360644 - DNA, 22 bp, Homo sapiens
tgctttcagggatgtctgtgag

SEQ ID NO: 9360645 - DNA, 22 bp, Homo sapiens
tgctttcacatgtatgcacaaa

SEQ ID NO: 9360646 - DNA, 22 bp, Homo sapiens
tgctttcacctgtttgcaccca

SEQ ID NO: 9360647 - DNA, 22 bp, Homo sapiens
tgctttattttaaatatgccat

SEQ ID NO: 9360648 - DNA, 22 bp, Homo sapiens
tgctttcacaccatgcctataa

SEQ ID NO: 9360649 - DNA, 22 bp, Homo sapiens
tgctttatttataaaatagcaa

SEQ ID NO: 9360650 - DNA, 22 bp, Homo sapiens
tgctttattttaaatatgccat

SEQ ID NO: 9360651 - DNA, 22 bp, Homo sapiens
tgctttattggaacctcatcct

SEQ ID NO: 9360652 - DNA, 22 bp, Homo sapiens
tgctttattgcatcagtgtggg

SEQ ID NO: 9360653 - DNA, 22 bp, Homo sapiens
tgctttatttataaaatagcaa

SEQ ID NO: 9360654 - DNA, 22 bp, Homo sapiens
tgcctgctaggcactttcaaac

SEQ ID NO: 9360655 - DNA, 22 bp, Homo sapiens
tgcctgctaggccctgctgggt

SEQ ID NO: 9360656 - DNA, 22 bp, Homo sapiens
tgcctgctccagtcctgtccac

SEQ ID NO: 9360657 - DNA, 22 bp, Homo sapiens
tgctttattgcatcagtgtggg

SEQ ID NO: 9360658 - DNA, 22 bp, Homo sapiens
tgcttgtctcagataaaactat

SEQ ID NO: 9360659 - DNA, 19 bp, Homo sapiens
tgcctgctcctggcttcca

SEQ ID NO: 9360660 - DNA, 22 bp, Homo sapiens
tgcttgtccgaggtgagtactt

SEQ ID NO: 9360661 - DNA, 22 bp, Homo sapiens
tgcctccaggaggggcagctct

SEQ ID NO: 9360662 - DNA, 22 bp, Homo sapiens
tgcctccatgtttcagcatcta

SEQ ID NO: 9360663 - DNA, 23 bp, Homo sapiens
tgcctccaccgagggccaggcat

SEQ ID NO: 9360664 - DNA, 17 bp, Homo sapiens
tgcctccagcagggtga

SEQ ID NO: 9360665 - DNA, 22 bp, Homo sapiens
tgcctcagtttcatctgcagaa

SEQ ID NO: 9360666 - DNA, 22 bp, Homo sapiens
tgcctcagtttctccatatgaa

SEQ ID NO: 9360667 - DNA, 22 bp, Homo sapiens
tgcctcagtttctccatatgaa

SEQ ID NO: 9360668 - DNA, 22 bp, Homo sapiens
tgcctccaccattgctcacttt

SEQ ID NO: 9360669 - DNA, 22 bp, Homo sapiens
tgcctgccctttccacacagcc

SEQ ID NO: 9360670 - DNA, 22 bp, Homo sapiens
tgcctgcctgcatagtcccacg

SEQ ID NO: 9360671 - DNA, 22 bp, Homo sapiens
tgcctgctagatatccaggtga

SEQ ID NO: 9360672 - DNA, 22 bp, Homo sapiens
tgcctgcctctggcagccctgc

SEQ ID NO: 9360673 - DNA, 22 bp, Homo sapiens
tgcctgcctctggcagccctgc

SEQ ID NO: 9360674 - DNA, 22 bp, Homo sapiens
tgcctgcctctggagcccatcc

SEQ ID NO: 9360675 - DNA, 22 bp, Homo sapiens
ccctaaggacacctgctgtcca

SEQ ID NO: 9360676 - DNA, 22 bp, Homo sapiens
ccctaaggcagcccagtctgtg

SEQ ID NO: 9360677 - DNA, 23 bp, Homo sapiens
ccctaactaattctagggcctaa

SEQ ID NO: 9360678 - DNA, 21 bp, Homo sapiens
ccctaactctaaaggatccat

SEQ ID NO: 9360679 - DNA, 17 bp, Homo sapiens
cccgttctcttcgctgg

SEQ ID NO: 9360680 - DNA, 22 bp, Homo sapiens
cccgtgtgtgcgaggctcccgc

SEQ ID NO: 9360681 - DNA, 22 bp, Homo sapiens
cccgtgtgtgcgaggctcccgc

SEQ ID NO: 9360682 - DNA, 22 bp, Homo sapiens
cccgtgtggacagcgtgccagt

SEQ ID NO: 9360683 - DNA, 22 bp, Homo sapiens
cccgtcccttttgcccgctggt

SEQ ID NO: 9360684 - DNA, 22 bp, Homo sapiens
cccgggttgtccgcgcgtccgg

SEQ ID NO: 9360685 - DNA, 22 bp, Homo sapiens
cccgggaggtggaggttgcagt

SEQ ID NO: 9360686 - DNA, 22 bp, Homo sapiens
cccgggaggcggaggttgcagt

SEQ ID NO: 9360687 - DNA, 22 bp, Homo sapiens
cccgggaggcagaggttgcagt

SEQ ID NO: 9360688 - DNA, 18 bp, Homo sapiens
cccggctaatttttggta

SEQ ID NO: 9360689 - DNA, 22 bp, Homo sapiens
tggaagaatagaagatggttga

SEQ ID NO: 9360690 - DNA, 22 bp, Homo sapiens
tggaagaagctacaagcggtga

SEQ ID NO: 9360691 - DNA, 22 bp, Homo sapiens
tggaagaaggcagagaggcatt

SEQ ID NO: 9360692 - DNA, 22 bp, Homo sapiens
tggaagaataggatagaagaac

SEQ ID NO: 9360693 - DNA, 22 bp, Homo sapiens
tggaagaataggatagaagaac

SEQ ID NO: 9360694 - DNA, 22 bp, Homo sapiens
ccctagaacacgcagacactga

SEQ ID NO: 9360695 - DNA, 22 bp, Homo sapiens
tggaagacaatttgaaaacatt

SEQ ID NO: 9360696 - DNA, 22 bp, Homo sapiens
tggaagacaatgtacatgcagt

SEQ ID NO: 9360697 - DNA, 22 bp, Homo sapiens
tggaagacaatgtacatgcagt

SEQ ID NO: 9360698 - DNA, 20 bp, Homo sapiens
tggaagacactgaagggcca

SEQ ID NO: 9360699 - DNA, 22 bp, Homo sapiens
tggaagacaggagatgtgtgta

SEQ ID NO: 9360700 - DNA, 22 bp, Homo sapiens
tggaagacactatttaccaggt

SEQ ID NO: 9360701 - DNA, 22 bp, Homo sapiens
tggaagacaaagattcaatatt

SEQ ID NO: 9360702 - DNA, 22 bp, Homo sapiens
tggaagacaagtgttagcatgg

SEQ ID NO: 9360703 - DNA, 22 bp, Homo sapiens
tggaagacaagtgttagcatgg

SEQ ID NO: 9360704 - DNA, 22 bp, Homo sapiens
tggaagacagtgactggttgtg

SEQ ID NO: 9360705 - DNA, 22 bp, Homo sapiens
tggaagacagttgatgggagtt

SEQ ID NO: 9360706 - DNA, 22 bp, Homo sapiens
tggaagacatactgttttctta

SEQ ID NO: 9360707 - DNA, 22 bp, Homo sapiens
tggaagacaggctgtattttaa

SEQ ID NO: 9360708 - DNA, 22 bp, Homo sapiens
tggaagacagtgactggttgtg

SEQ ID NO: 9360709 - DNA, 22 bp, Homo sapiens
tggaagacaggctgtattttaa

SEQ ID NO: 9360710 - DNA, 22 bp, Homo sapiens
tggaagacaggcatggaagtgg

SEQ ID NO: 9360711 - DNA, 22 bp, Homo sapiens
tggaagggaaagtttggggtcc

SEQ ID NO: 9360712 - DNA, 22 bp, Homo sapiens
tggaagggaaagtttggggtcc

SEQ ID NO: 9360713 - DNA, 22 bp, Homo sapiens
tggaagggaaagtttggggtcc

SEQ ID NO: 9360714 - DNA, 22 bp, Homo sapiens
tggaaggctgagagtcctgggg

SEQ ID NO: 9360715 - DNA, 18 bp, Homo sapiens
cctgccagtctggagcag

SEQ ID NO: 9360716 - DNA, 18 bp, Homo sapiens
cctgccagtctggagcag

SEQ ID NO: 9360717 - DNA, 22 bp, Homo sapiens
cctgccagggccttggaagaaa

SEQ ID NO: 9360718 - DNA, 22 bp, Homo sapiens
cctgccagggccagaggccagc

SEQ ID NO: 9360719 - DNA, 22 bp, Homo sapiens
cctgccaggctttgggcttctg

SEQ ID NO: 9360720 - DNA, 22 bp, Homo sapiens
cctgccagggccagaggccagc

SEQ ID NO: 9360721 - DNA, 22 bp, Homo sapiens
cctgccaggctttcaggtttgg

SEQ ID NO: 9360722 - DNA, 22 bp, Homo sapiens
cctgccaggccagtgagcttcc

SEQ ID NO: 9360723 - DNA, 22 bp, Homo sapiens
cctgccaggcgagtctaggcca

SEQ ID NO: 9360724 - DNA, 22 bp, Homo sapiens
cctgccaggcgagtctaggcca

SEQ ID NO: 9360725 - DNA, 22 bp, Homo sapiens
cctgccaggcgagtctaggcca

SEQ ID NO: 9360726 - DNA, 22 bp, Homo sapiens
tgggtaggtgtggcctgaatgt

SEQ ID NO: 9360727 - DNA, 22 bp, Homo sapiens
tgggtagtttcccctgccctgc

SEQ ID NO: 9360728 - DNA, 22 bp, Homo sapiens
tgggtaggtgctggggattcag

SEQ ID NO: 9360729 - DNA, 22 bp, Homo sapiens
tgggtaggtgctggggattcag

SEQ ID NO: 9360730 - DNA, 18 bp, Homo sapiens
cctgccagtctggagcag

SEQ ID NO: 9360731 - DNA, 18 bp, Homo sapiens
cctgccagtctggagcag

SEQ ID NO: 9360732 - DNA, 22 bp, Homo sapiens
tgggtcagacagccagtgggcc

SEQ ID NO: 9360733 - DNA, 22 bp, Homo sapiens
tgggtcagacagccagtgggcc

SEQ ID NO: 9360734 - DNA, 22 bp, Homo sapiens
tgggtcagaatcagagagttgc

SEQ ID NO: 9360735 - DNA, 22 bp, Homo sapiens
tgggtcagaatcagagagttgc

SEQ ID NO: 9360736 - DNA, 22 bp, Homo sapiens
tgggtcagacagccagtgggcc

SEQ ID NO: 9360737 - DNA, 22 bp, Homo sapiens
tgggtcagagcagacctctgga

SEQ ID NO: 9360738 - DNA, 22 bp, Homo sapiens
tgggtcagacagccagtgggcc

SEQ ID NO: 9360739 - DNA, 22 bp, Homo sapiens
tgggtcagagctgtgctgccca

SEQ ID NO: 9360740 - DNA, 22 bp, Homo sapiens
tgggtcagagctgtgctgccca

SEQ ID NO: 9360741 - DNA, 23 bp, Homo sapiens
cctgcctgttctaactccatttc

SEQ ID NO: 9360742 - DNA, 23 bp, Homo sapiens
cctgcctgttctaactccatttc

SEQ ID NO: 9360743 - DNA, 22 bp, Homo sapiens
cctgcctgtctttatcccctgt

SEQ ID NO: 9360744 - DNA, 22 bp, Homo sapiens
cctgcctgtccctcagtccaca

SEQ ID NO: 9360745 - DNA, 22 bp, Homo sapiens
cctgcctgtctttatcccctgt

SEQ ID NO: 9360746 - DNA, 22 bp, Homo sapiens
cctgcctgtccctcagtccaca

SEQ ID NO: 9360747 - DNA, 22 bp, Homo sapiens
cctgcctgtactagagacccag

SEQ ID NO: 9360748 - DNA, 22 bp, Homo sapiens
cctgcctgggctcacttgccag

SEQ ID NO: 9360749 - DNA, 22 bp, Homo sapiens
cctgcctggggacaaaggaggg

SEQ ID NO: 9360750 - DNA, 22 bp, Homo sapiens
tgggtcaggctgggagtcctga

SEQ ID NO: 9360751 - DNA, 22 bp, Homo sapiens
tgggtcaggctgggagtcctga

SEQ ID NO: 9360752 - DNA, 22 bp, Homo sapiens
tgggtcaggctgggagtcctga

SEQ ID NO: 9360753 - DNA, 20 bp, Homo sapiens
cctgcctgcctcggctcatt

SEQ ID NO: 9360754 - DNA, 22 bp, Homo sapiens
cctgcctgcagaaagtatctcc

SEQ ID NO: 9360755 - DNA, 22 bp, Homo sapiens
tgggtcagtttgggggccagcc

SEQ ID NO: 9360756 - DNA, 23 bp, Homo sapiens
tgggtcagctgcctccaggacaa

SEQ ID NO: 9360757 - DNA, 22 bp, Homo sapiens
tgggtcagattgagcccctggt

SEQ ID NO: 9360758 - DNA, 22 bp, Homo sapiens
tgggtcagaggacctcgtggcc

SEQ ID NO: 9360759 - DNA, 22 bp, Homo sapiens
tgggtcagattgagcccctggt

SEQ ID NO: 9360760 - DNA, 22 bp, Homo sapiens
cctgctgtgaaactggcatatg

SEQ ID NO: 9360761 - DNA, 22 bp, Homo sapiens
cctgctgtctctgggcaggcag

SEQ ID NO: 9360762 - DNA, 22 bp, Homo sapiens
cctgctgtccctctgggctcca

SEQ ID NO: 9360763 - DNA, 22 bp, Homo sapiens
cctgctgtgaagccaggcctgt

SEQ ID NO: 9360764 - DNA, 22 bp, Homo sapiens
cctgctgtgaagccaggcctgt

SEQ ID NO: 9360765 - DNA, 22 bp, Homo sapiens
cctgctgtgaccggggagcagg

SEQ ID NO: 9360766 - DNA, 21 bp, Homo sapiens
cctgctgtgatcttagtgagt

SEQ ID NO: 9360767 - DNA, 22 bp, Homo sapiens
cctgctgtcagcatcctcgcga

SEQ ID NO: 9360768 - DNA, 22 bp, Homo sapiens
cctgctgtaatgtgtctttatt

SEQ ID NO: 9360769 - DNA, 22 bp, Homo sapiens
tggtctggggaccgagggttac

SEQ ID NO: 9360770 - DNA, 22 bp, Homo sapiens
tggtctgggcaaatccttctga

SEQ ID NO: 9360771 - DNA, 22 bp, Homo sapiens
tggtctggttatttcttaatga

SEQ ID NO: 9360772 - DNA, 20 bp, Homo sapiens
tggtctggagccagtgagga

SEQ ID NO: 9360773 - DNA, 22 bp, Homo sapiens
tggtctgctgaacagccgtatc

SEQ ID NO: 9360774 - DNA, 22 bp, Homo sapiens
tggtctggaactcctggcttca

SEQ ID NO: 9360775 - DNA, 17 bp, Homo sapiens
tggtctggaagaactga

SEQ ID NO: 9360776 - DNA, 17 bp, Homo sapiens
tggtctggaagaactga

SEQ ID NO: 9360777 - DNA, 22 bp, Homo sapiens
tggtcttaaaaacatcaaatgg

SEQ ID NO: 9360778 - DNA, 22 bp, Homo sapiens
cctgctctaaatctcatggaac

SEQ ID NO: 9360779 - DNA, 22 bp, Homo sapiens
cctgctcctgctattcttctgg

SEQ ID NO: 9360780 - DNA, 22 bp, Homo sapiens
cctgctctaaatctcatggaac

SEQ ID NO: 9360781 - DNA, 22 bp, Homo sapiens
cctgctctaaatctcatggaac

SEQ ID NO: 9360782 - DNA, 22 bp, Homo sapiens
tggtctcttcttccaagatggc

SEQ ID NO: 9360783 - DNA, 22 bp, Homo sapiens
tggtctcttttcagcctgggga

SEQ ID NO: 9360784 - DNA, 22 bp, Homo sapiens
tggtctgatggtcccaccaccg

SEQ ID NO: 9360785 - DNA, 22 bp, Homo sapiens
tggtctgaaggtggatttgaga

SEQ ID NO: 9360786 - DNA, 22 bp, Homo sapiens
cctggagggaccctggccctgt

SEQ ID NO: 9360787 - DNA, 22 bp, Homo sapiens
cctggagggaccctggccctgt

SEQ ID NO: 9360788 - DNA, 22 bp, Homo sapiens
cctggagggaccctggccctgt

SEQ ID NO: 9360789 - DNA, 22 bp, Homo sapiens
cctggagggcagcccattctgg

SEQ ID NO: 9360790 - DNA, 22 bp, Homo sapiens
cctggagggcgccgcacagtcc

SEQ ID NO: 9360791 - DNA, 22 bp, Homo sapiens
cctggagggcgccgcacagtcc

SEQ ID NO: 9360792 - DNA, 22 bp, Homo sapiens
cctggaggagcgctgaccagct

SEQ ID NO: 9360793 - DNA, 22 bp, Homo sapiens
cctggaggcagaaataggactt

SEQ ID NO: 9360794 - DNA, 22 bp, Homo sapiens
cctggaggcggaggttgcagtg

SEQ ID NO: 9360795 - DNA, 22 bp, Homo sapiens
cctggaggctctgggagggcag

SEQ ID NO: 9360796 - DNA, 22 bp, Homo sapiens
cctggaggctctgggagggcag

SEQ ID NO: 9360797 - DNA, 22 bp, Homo sapiens
cctggagcttttccatcctgga

SEQ ID NO: 9360798 - DNA, 22 bp, Homo sapiens
cctggagcttttccatcctgga

SEQ ID NO: 9360799 - DNA, 22 bp, Homo sapiens
cctggagcttttccatcctgga

SEQ ID NO: 9360800 - DNA, 22 bp, Homo sapiens
cctggagcttttccagttgaca

SEQ ID NO: 9360801 - DNA, 22 bp, Homo sapiens
cctggagcttttccatcctgga

SEQ ID NO: 9360802 - DNA, 22 bp, Homo sapiens
cctggaggagcgctgaccagct

SEQ ID NO: 9360803 - DNA, 22 bp, Homo sapiens
cctggaggagcgctgaccagct

SEQ ID NO: 9360804 - DNA, 22 bp, Homo sapiens
cctggaggagcgctgaccagct

SEQ ID NO: 9360805 - DNA, 22 bp, Homo sapiens
cctggagcttggtcacgctgcg

SEQ ID NO: 9360806 - DNA, 22 bp, Homo sapiens
cctggagcttggtcacgctgcg

SEQ ID NO: 9360807 - DNA, 22 bp, Homo sapiens
cctggagcttggtcacgctgcg

SEQ ID NO: 9360808 - DNA, 22 bp, Homo sapiens
cctggagcttttccagttgaca

SEQ ID NO: 9360809 - DNA, 18 bp, Homo sapiens
cctggagctccacagcaa

SEQ ID NO: 9360810 - DNA, 18 bp, Homo sapiens
cctggagctccacagcaa

SEQ ID NO: 9360811 - DNA, 22 bp, Homo sapiens
tgtcaacagatactagagagct

SEQ ID NO: 9360812 - DNA, 22 bp, Homo sapiens
tgtcaaccaggtattttggtct

SEQ ID NO: 9360813 - DNA, 22 bp, Homo sapiens
tgtcaaccacttcattatgaga

SEQ ID NO: 9360814 - DNA, 22 bp, Homo sapiens
tgtcaagtctagttgctggctt

SEQ ID NO: 9360815 - DNA, 22 bp, Homo sapiens
tgtcaagagtgcacacatctgc

SEQ ID NO: 9360816 - DNA, 23 bp, Homo sapiens
tgtcaagtatagcaggccctccc

SEQ ID NO: 9360817 - DNA, 22 bp, Homo sapiens
tgtcaaggacgtgcatgaaccc

SEQ ID NO: 9360818 - DNA, 22 bp, Homo sapiens
cctggagggcgccgcacagtcc

SEQ ID NO: 9360819 - DNA, 22 bp, Homo sapiens
cctggaggggaccaggaccagg

SEQ ID NO: 9360820 - DNA, 22 bp, Homo sapiens
cctggaggggaccaggaccagg

SEQ ID NO: 9360821 - DNA, 18 bp, Homo sapiens
cctggaggtcttcggggt

SEQ ID NO: 9360822 - DNA, 18 bp, Homo sapiens
cctggaggtcttcggggt

SEQ ID NO: 9360823 - DNA, 19 bp, Homo sapiens
cctggaggtgaaggttctc

SEQ ID NO: 9360824 - DNA, 18 bp, Homo sapiens
cctggaggtcttcggggt

SEQ ID NO: 9360825 - DNA, 16 bp, Homo sapiens
cctggaggtcacttca

SEQ ID NO: 9360826 - DNA, 22 bp, Homo sapiens
tgtcaaatagtagaaagatggc

SEQ ID NO: 9360827 - DNA, 22 bp, Homo sapiens
tgtcaaatttttattgcagtat

SEQ ID NO: 9360828 - DNA, 22 bp, Homo sapiens
tgtaatttgcatggctgaatgc

SEQ ID NO: 9360829 - DNA, 22 bp, Homo sapiens
tgtaatgttagaaacaattgct

SEQ ID NO: 9360830 - DNA, 22 bp, Homo sapiens
tgtacagtgtaaataagtggat

SEQ ID NO: 9360831 - DNA, 22 bp, Homo sapiens
tgtacagtgtagtcatgaggtt

SEQ ID NO: 9360832 - DNA, 22 bp, Homo sapiens
tgtacagtgccatgcagtttgc

SEQ ID NO: 9360833 - DNA, 22 bp, Homo sapiens
tgtacagtgccatgcagtttgc

SEQ ID NO: 9360834 - DNA, 22 bp, Homo sapiens
tgtacagtggaaaatggattcg

SEQ ID NO: 9360835 - DNA, 23 bp, Homo sapiens
tgtacagttgtttgactcagctc

SEQ ID NO: 9360836 - DNA, 18 bp, Homo sapiens
tgtacagttatgagcatt

SEQ ID NO: 9360837 - DNA, 18 bp, Homo sapiens
tgtacagttatgagcatt

SEQ ID NO: 9360838 - DNA, 22 bp, Homo sapiens
tgtacagttttaactctgaggg

SEQ ID NO: 9360839 - DNA, 22 bp, Homo sapiens
tgtacatacatagatatacaca

SEQ ID NO: 9360840 - DNA, 22 bp, Homo sapiens
tgtacatacatagatatacaca

SEQ ID NO: 9360841 - DNA, 22 bp, Homo sapiens
tgtacatacatagatatacaca

SEQ ID NO: 9360842 - DNA, 19 bp, Homo sapiens
tgtacatatagagctcagt

SEQ ID NO: 9360843 - DNA, 22 bp, Homo sapiens
tgtacatagatcttgaaaatta

SEQ ID NO: 9360844 - DNA, 22 bp, Homo sapiens
tgtacatgtgtctgtatatctt

SEQ ID NO: 9360845 - DNA, 22 bp, Homo sapiens
tgtacatgaataaaagatcttg

SEQ ID NO: 9360846 - DNA, 22 bp, Homo sapiens
tgtacattttctcagagtttat

SEQ ID NO: 9360847 - DNA, 22 bp, Homo sapiens
cctggagcactctccctggctg

SEQ ID NO: 9360848 - DNA, 22 bp, Homo sapiens
tgtaatcattacagtacatgga

SEQ ID NO: 9360849 - DNA, 22 bp, Homo sapiens
tgtaagtagtaatggaaggaca

SEQ ID NO: 9360850 - DNA, 21 bp, Homo sapiens
tgtaagtttcatctgaattgg

SEQ ID NO: 9360851 - DNA, 22 bp, Homo sapiens
tgtaataatgaggcatccagcc

SEQ ID NO: 9360852 - DNA, 22 bp, Homo sapiens
cctgctttgagatgggcagcag

SEQ ID NO: 9360853 - DNA, 22 bp, Homo sapiens
cctgcttcagggatgatggcac

SEQ ID NO: 9360854 - DNA, 22 bp, Homo sapiens
cctggaaaacatgggaatcaca

SEQ ID NO: 9360855 - DNA, 22 bp, Homo sapiens
cctgctttggcaggcagctcct

SEQ ID NO: 9360856 - DNA, 22 bp, Homo sapiens
tgtaagtagtaatggaaggaca

SEQ ID NO: 9360857 - DNA, 22 bp, Homo sapiens
tgtaaagaaatagcatttgtag

SEQ ID NO: 9360858 - DNA, 22 bp, Homo sapiens
cctgcttcagggatgatggcac

SEQ ID NO: 9360859 - DNA, 22 bp, Homo sapiens
cctgctgttttcttcacttcag

SEQ ID NO: 9360860 - DNA, 20 bp, Homo sapiens
cctgctgtgctttccatgga

SEQ ID NO: 9360861 - DNA, 22 bp, Homo sapiens
cctgctgtgtccctggctttct

SEQ ID NO: 9360862 - DNA, 22 bp, Homo sapiens
cctgctgttctgtttagtgaac

SEQ ID NO: 9360863 - DNA, 22 bp, Homo sapiens
cctgagctggcagtgacctgga

SEQ ID NO: 9360864 - DNA, 22 bp, Homo sapiens
cctgaggctccacctccagaga

SEQ ID NO: 9360865 - DNA, 22 bp, Homo sapiens
cctgaggctggcccttccatcc

SEQ ID NO: 9360866 - DNA, 22 bp, Homo sapiens
cctgaggctggcccttccatcc

SEQ ID NO: 9360867 - DNA, 22 bp, Homo sapiens
cctgaggctccacctccagaga

SEQ ID NO: 9360868 - DNA, 22 bp, Homo sapiens
cctgaggctcgcgcgcccctgg

SEQ ID NO: 9360869 - DNA, 22 bp, Homo sapiens
cctgaggctcgcgcgcccctgg

SEQ ID NO: 9360870 - DNA, 22 bp, Homo sapiens
cctgaggctctcctgaataatg

SEQ ID NO: 9360871 - DNA, 22 bp, Homo sapiens
cctgaggctctcctgaataatg

SEQ ID NO: 9360872 - DNA, 22 bp, Homo sapiens
cctgagggaacatgcacccaat

SEQ ID NO: 9360873 - DNA, 22 bp, Homo sapiens
cctgagggaacatgcacccaat

SEQ ID NO: 9360874 - DNA, 22 bp, Homo sapiens
cctgaggcttgggagttccgcc

SEQ ID NO: 9360875 - DNA, 22 bp, Homo sapiens
cctgagggaaggatgctaccca

SEQ ID NO: 9360876 - DNA, 22 bp, Homo sapiens
cctgagggagggtataggctgt

SEQ ID NO: 9360877 - DNA, 22 bp, Homo sapiens
cctgaggcttgggagttccgcc

SEQ ID NO: 9360878 - DNA, 22 bp, Homo sapiens
cctgaggcttgggagttccgcc

SEQ ID NO: 9360879 - DNA, 22 bp, Homo sapiens
cctgaggcttaatctgtcccaa

SEQ ID NO: 9360880 - DNA, 22 bp, Homo sapiens
cctgaggcttaatctgtcccaa

SEQ ID NO: 9360881 - DNA, 22 bp, Homo sapiens
cctgagggctcagcccccagcc

SEQ ID NO: 9360882 - DNA, 22 bp, Homo sapiens
cctgagggcgccgagctcccag

SEQ ID NO: 9360883 - DNA, 22 bp, Homo sapiens
cctgaggggaagcttcccaaga

SEQ ID NO: 9360884 - DNA, 22 bp, Homo sapiens
cctgaggggctgcaggccagct

SEQ ID NO: 9360885 - DNA, 22 bp, Homo sapiens
cctgagggtcaaggagccctag

SEQ ID NO: 9360886 - DNA, 22 bp, Homo sapiens
cctgaggggctgcaggccagct

SEQ ID NO: 9360887 - DNA, 22 bp, Homo sapiens
cctgaccatttgccacatgggt

SEQ ID NO: 9360888 - DNA, 21 bp, Homo sapiens
cctgaccattcagcttgtctt

SEQ ID NO: 9360889 - DNA, 22 bp, Homo sapiens
cctgacaggagaagcgcagcat

SEQ ID NO: 9360890 - DNA, 22 bp, Homo sapiens
cctgacaggagaagcgcagcat

SEQ ID NO: 9360891 - DNA, 22 bp, Homo sapiens
cctgaatggtctccaaatagat

SEQ ID NO: 9360892 - DNA, 22 bp, Homo sapiens
cctgaatgctggttcctctcct

SEQ ID NO: 9360893 - DNA, 22 bp, Homo sapiens
cctgacagtccttttctagtgt

SEQ ID NO: 9360894 - DNA, 22 bp, Homo sapiens
cctgacaggcggaggctgcagt

SEQ ID NO: 9360895 - DNA, 22 bp, Homo sapiens
cctgacagtggtagccttggca

SEQ ID NO: 9360896 - DNA, 22 bp, Homo sapiens
cctgacagttaattgtcctgta

SEQ ID NO: 9360897 - DNA, 21 bp, Homo sapiens
cctgaccaatacttgatcaaa

SEQ ID NO: 9360898 - DNA, 19 bp, Homo sapiens
cctgaccacacaggccttg

SEQ ID NO: 9360899 - DNA, 22 bp, Homo sapiens
cctgactcctgggcaaaaccaa

SEQ ID NO: 9360900 - DNA, 22 bp, Homo sapiens
cctgacttaagtctcctgttgg

SEQ ID NO: 9360901 - DNA, 22 bp, Homo sapiens
cctgagaaacctggtgcaatta

SEQ ID NO: 9360902 - DNA, 22 bp, Homo sapiens
cctgactctggccaggccagct

SEQ ID NO: 9360903 - DNA, 22 bp, Homo sapiens
cctgccaggccagtgagcttcc

SEQ ID NO: 9360904 - DNA, 22 bp, Homo sapiens
cctgccaggagctggtgctgca

SEQ ID NO: 9360905 - DNA, 22 bp, Homo sapiens
cctgccagacgcaccagggggc

SEQ ID NO: 9360906 - DNA, 22 bp, Homo sapiens
cctgcagaagagtccagctcat

SEQ ID NO: 9360907 - DNA, 22 bp, Homo sapiens
cctgccagacgcaccagggggc

SEQ ID NO: 9360908 - DNA, 22 bp, Homo sapiens
cctgccagacgcaccagggggc

SEQ ID NO: 9360909 - DNA, 22 bp, Homo sapiens
cctgcacttctcacagctgctg

SEQ ID NO: 9360910 - DNA, 22 bp, Homo sapiens
cctgcagaagagtccagctcat

SEQ ID NO: 9360911 - DNA, 22 bp, Homo sapiens
cctgcacctctgtgcttggaac

SEQ ID NO: 9360912 - DNA, 22 bp, Homo sapiens
cctgcacctgagcagcctgact

SEQ ID NO: 9360913 - DNA, 22 bp, Homo sapiens
cctgcacctgccatgtgagata

SEQ ID NO: 9360914 - DNA, 22 bp, Homo sapiens
cctgcacataggcttttcagaa

SEQ ID NO: 9360915 - DNA, 22 bp, Homo sapiens
cctgcaagagcggagaagccag

SEQ ID NO: 9360916 - DNA, 22 bp, Homo sapiens
cctgcaagactatttagttcca

SEQ ID NO: 9360917 - DNA, 22 bp, Homo sapiens
cctgcaagacctgagacacacc

SEQ ID NO: 9360918 - DNA, 22 bp, Homo sapiens
cctgattctgccactactagcc

SEQ ID NO: 9360919 - DNA, 22 bp, Homo sapiens
cctgattcagtggtgcccagag

SEQ ID NO: 9360920 - DNA, 22 bp, Homo sapiens
cctgattctgatgcctcatgga

SEQ ID NO: 9360921 - DNA, 22 bp, Homo sapiens
cctgatggtatattgttgggag

SEQ ID NO: 9360922 - DNA, 22 bp, Homo sapiens
cctgatggctgtctgggcctga

SEQ ID NO: 9360923 - DNA, 22 bp, Homo sapiens
tggggtaggagtcagcgagaga

SEQ ID NO: 9360924 - DNA, 22 bp, Homo sapiens
tggggtacttgtatcaaagcac

SEQ ID NO: 9360925 - DNA, 22 bp, Homo sapiens
tggggtacttgtatcaaagcac

SEQ ID NO: 9360926 - DNA, 22 bp, Homo sapiens
tggggtacacgtggggcaggat

SEQ ID NO: 9360927 - DNA, 22 bp, Homo sapiens
tggggtagggaaaagaagtcga

SEQ ID NO: 9360928 - DNA, 22 bp, Homo sapiens
tggggtaggtatgaaaactagg

SEQ ID NO: 9360929 - DNA, 22 bp, Homo sapiens
tggggtcagcaggcctggcctg

SEQ ID NO: 9360930 - DNA, 22 bp, Homo sapiens
cctgagggtcaaggagccctag

SEQ ID NO: 9360931 - DNA, 22 bp, Homo sapiens
cctgaggtcatggtccagtgtt

SEQ ID NO: 9360932 - DNA, 22 bp, Homo sapiens
cctgaggtcagcggttcccaca

SEQ ID NO: 9360933 - DNA, 22 bp, Homo sapiens
cctgaggtcagccattcttgcc

SEQ ID NO: 9360934 - DNA, 22 bp, Homo sapiens
cctgaggtcagccattcttgcc

SEQ ID NO: 9360935 - DNA, 22 bp, Homo sapiens
tgggggagagaggcattctttc

SEQ ID NO: 9360936 - DNA, 22 bp, Homo sapiens
tgggggagagaggcattctttc

SEQ ID NO: 9360937 - DNA, 22 bp, Homo sapiens
tgggggtggttcttgcctccag

SEQ ID NO: 9360938 - DNA, 22 bp, Homo sapiens
tgggggtgtcctggtgcacaca

SEQ ID NO: 9360939 - DNA, 22 bp, Homo sapiens
tgggccagatccatggcaataa

SEQ ID NO: 9360940 - DNA, 21 bp, Homo sapiens
tgggccagatctgagtttcta

SEQ ID NO: 9360941 - DNA, 22 bp, Homo sapiens
tgggccagatccatggcaataa

SEQ ID NO: 9360942 - DNA, 22 bp, Homo sapiens
tgggccagaggcatggagctat

SEQ ID NO: 9360943 - DNA, 22 bp, Homo sapiens
tgggccagatccatggcaataa

SEQ ID NO: 9360944 - DNA, 22 bp, Homo sapiens
tgggccagaagtatgcatgttt

SEQ ID NO: 9360945 - DNA, 22 bp, Homo sapiens
tgggccagaggcatggagctat

SEQ ID NO: 9360946 - DNA, 22 bp, Homo sapiens
tgggccagagagtaagaaaggt

SEQ ID NO: 9360947 - DNA, 22 bp, Homo sapiens
tgggcagggagctggaaccaca

SEQ ID NO: 9360948 - DNA, 22 bp, Homo sapiens
tgggccacgtgacccttaccct

SEQ ID NO: 9360949 - DNA, 22 bp, Homo sapiens
tgggcagggagctggaaccaca

SEQ ID NO: 9360950 - DNA, 22 bp, Homo sapiens
tgggcagggagctggaaccaca

SEQ ID NO: 9360951 - DNA, 22 bp, Homo sapiens
cctctggccagagaaaggccag

SEQ ID NO: 9360952 - DNA, 22 bp, Homo sapiens
cctctggcctaggccgggagag

SEQ ID NO: 9360953 - DNA, 22 bp, Homo sapiens
cctcttctgagtgagactccct

SEQ ID NO: 9360954 - DNA, 22 bp, Homo sapiens
cctcttctgcttcaggagcact

SEQ ID NO: 9360955 - DNA, 22 bp, Homo sapiens
cctcttgacagcctctgtttcc

SEQ ID NO: 9360956 - DNA, 22 bp, Homo sapiens
cctcttctgcttcaggagcact

SEQ ID NO: 9360957 - DNA, 22 bp, Homo sapiens
cctcttgaacctaggcaagact

SEQ ID NO: 9360958 - DNA, 22 bp, Homo sapiens
cctctttaatcccatccatgtg

SEQ ID NO: 9360959 - DNA, 22 bp, Homo sapiens
cctctttgacaagtacctgccc

SEQ ID NO: 9360960 - DNA, 22 bp, Homo sapiens
cctctttgactctcaggtcttt

SEQ ID NO: 9360961 - DNA, 22 bp, Homo sapiens
cctctttgactctcaggtcttt

SEQ ID NO: 9360962 - DNA, 22 bp, Homo sapiens
cctcttgccaatcagctacaga

SEQ ID NO: 9360963 - DNA, 20 bp, Homo sapiens
cctcttgcaaaagagatgac

SEQ ID NO: 9360964 - DNA, 22 bp, Homo sapiens
cctcttgagtgtctgttttcca

SEQ ID NO: 9360965 - DNA, 22 bp, Homo sapiens
cctcttgagaggcactcaggtt

SEQ ID NO: 9360966 - DNA, 22 bp, Homo sapiens
cctgaataggctctgctcaaaa

SEQ ID NO: 9360967 - DNA, 22 bp, Homo sapiens
cctgaatgcctgacatttcact

SEQ ID NO: 9360968 - DNA, 22 bp, Homo sapiens
cctgaataggctctgctcaaaa

SEQ ID NO: 9360969 - DNA, 22 bp, Homo sapiens
cctgaataatttgtgaaaagat

SEQ ID NO: 9360970 - DNA, 22 bp, Homo sapiens
cctgaatactggtgctgaaagt

SEQ ID NO: 9360971 - DNA, 22 bp, Homo sapiens
cctctttgtgcctgcaggctgc

SEQ ID NO: 9360972 - DNA, 22 bp, Homo sapiens
cctctttgttcaggctgctggc

SEQ ID NO: 9360973 - DNA, 22 bp, Homo sapiens
tgggagcctggcaggccagagg

SEQ ID NO: 9360974 - DNA, 23 bp, Homo sapiens
tgggagctcaagggaggctgccc

SEQ ID NO: 9360975 - DNA, 22 bp, Homo sapiens
tgggagccattttagaggctgc

SEQ ID NO: 9360976 - DNA, 22 bp, Homo sapiens
tgggagcccaagggagctgccg

SEQ ID NO: 9360977 - DNA, 22 bp, Homo sapiens
tgggagcccaagggagctgccg

SEQ ID NO: 9360978 - DNA, 22 bp, Homo sapiens
tgggagcagttcaggtgtggct

SEQ ID NO: 9360979 - DNA, 22 bp, Homo sapiens
tgggagcagttgtgaagctcag

SEQ ID NO: 9360980 - DNA, 22 bp, Homo sapiens
cctctggcaacttcacagccca

SEQ ID NO: 9360981 - DNA, 22 bp, Homo sapiens
cctctggcagccagccagttgt

SEQ ID NO: 9360982 - DNA, 22 bp, Homo sapiens
cctctggccacatgggacatag

SEQ ID NO: 9360983 - DNA, 22 bp, Homo sapiens
cctctggcagccagccagttgt

SEQ ID NO: 9360984 - DNA, 22 bp, Homo sapiens
tgggagctcagaaagggaggtc

SEQ ID NO: 9360985 - DNA, 22 bp, Homo sapiens
cctctggcaacttcacagccca

SEQ ID NO: 9360986 - DNA, 22 bp, Homo sapiens
cctctggagtcagaccagcttg

SEQ ID NO: 9360987 - DNA, 22 bp, Homo sapiens
cctctggcaacttcacagccca

SEQ ID NO: 9360988 - DNA, 21 bp, Homo sapiens
tgggagagcgttgctgtcctc

SEQ ID NO: 9360989 - DNA, 21 bp, Homo sapiens
tgggagagcgttgctgtcctc

SEQ ID NO: 9360990 - DNA, 22 bp, Homo sapiens
tggctctgaccaggtagaggag

SEQ ID NO: 9360991 - DNA, 21 bp, Homo sapiens
tgggagagcgttgctgtcctc

SEQ ID NO: 9360992 - DNA, 22 bp, Homo sapiens
tgggagcaggtgtgctagggaa

SEQ ID NO: 9360993 - DNA, 22 bp, Homo sapiens
tgggagcaggaagcaggaagta

SEQ ID NO: 9360994 - DNA, 22 bp, Homo sapiens
tgggagcaggctgatgataggt

SEQ ID NO: 9360995 - DNA, 22 bp, Homo sapiens
tggctctgaccaggtagaggag

SEQ ID NO: 9360996 - DNA, 21 bp, Homo sapiens
tggctctgaaagagtgctgca

SEQ ID NO: 9360997 - DNA, 22 bp, Homo sapiens
tggctctctgggaggtcctggc

SEQ ID NO: 9360998 - DNA, 21 bp, Homo sapiens
tggctctgaaagagtgctgca

SEQ ID NO: 9360999 - DNA, 22 bp, Homo sapiens
tggctctcttgtaaggtagtag

SEQ ID NO: 9361000 - DNA, 22 bp, Homo sapiens
tggctctcaggcctgctgcgtt

SEQ ID NO: 9361001 - DNA, 22 bp, Homo sapiens
tggctctctacaggtcaagacc

SEQ ID NO: 9361002 - DNA, 20 bp, Homo sapiens
tggctctctctagtaagtgg

SEQ ID NO: 9361003 - DNA, 22 bp, Homo sapiens
cctccctctttcagtcccacag

SEQ ID NO: 9361004 - DNA, 22 bp, Homo sapiens
cctccctgccggctggactagt

SEQ ID NO: 9361005 - DNA, 22 bp, Homo sapiens
cctccctgcgctcctgcggcgg

SEQ ID NO: 9361006 - DNA, 22 bp, Homo sapiens
cctccctgcgctcctgcggcgg

SEQ ID NO: 9361007 - DNA, 22 bp, Homo sapiens
cctccctgctcctcaactggca

SEQ ID NO: 9361008 - DNA, 22 bp, Homo sapiens
cctccctgctcctcaactggca

SEQ ID NO: 9361009 - DNA, 22 bp, Homo sapiens
cctccctgcgctcctgcggcgg

SEQ ID NO: 9361010 - DNA, 22 bp, Homo sapiens
tagctttaagacatggtgaatg

SEQ ID NO: 9361011 - DNA, 22 bp, Homo sapiens
cagggcaggaatttgacattgc

SEQ ID NO: 9361012 - DNA, 22 bp, Homo sapiens
cagggcaggaatttgacattgc

SEQ ID NO: 9361013 - DNA, 22 bp, Homo sapiens
taggaacacatcctcctctagc

SEQ ID NO: 9361014 - DNA, 22 bp, Homo sapiens
tagctacatttatacactgtag

SEQ ID NO: 9361015 - DNA, 22 bp, Homo sapiens
tagctcctggctgcagggcctc

SEQ ID NO: 9361016 - DNA, 22 bp, Homo sapiens
tagctcctggctgcagggcctc

SEQ ID NO: 9361017 - DNA, 22 bp, Homo sapiens
tagctcctccccatccaggttc

SEQ ID NO: 9361018 - DNA, 22 bp, Homo sapiens
tagctcagcaggtgggacaggt

SEQ ID NO: 9361019 - DNA, 22 bp, Homo sapiens
tagctcctacaagtacagcaaa

SEQ ID NO: 9361020 - DNA, 22 bp, Homo sapiens
tagctcagcaggtgggacaggt

SEQ ID NO: 9361021 - DNA, 22 bp, Homo sapiens
cagggcagagggaaactccttt

SEQ ID NO: 9361022 - DNA, 22 bp, Homo sapiens
cagggcagccaggccccgtggg

SEQ ID NO: 9361023 - DNA, 22 bp, Homo sapiens
cagggcagagggaaactccttt

SEQ ID NO: 9361024 - DNA, 22 bp, Homo sapiens
cagggcagagccaggatttcaa

SEQ ID NO: 9361025 - DNA, 22 bp, Homo sapiens
cagggcagagggaaactccttt

SEQ ID NO: 9361026 - DNA, 22 bp, Homo sapiens
cagggcagagccaggatttcaa

SEQ ID NO: 9361027 - DNA, 22 bp, Homo sapiens
cagggcagccaggccccgtggg

SEQ ID NO: 9361028 - DNA, 22 bp, Homo sapiens
cagggcagcttcctttgttagg

SEQ ID NO: 9361029 - DNA, 22 bp, Homo sapiens
cagggcagccaggccccgtggg

SEQ ID NO: 9361030 - DNA, 22 bp, Homo sapiens
cagggcaggaatttgacattgc

SEQ ID NO: 9361031 - DNA, 22 bp, Homo sapiens
cagggcaggaatttgacattgc

SEQ ID NO: 9361032 - DNA, 22 bp, Homo sapiens
cagggcagcttcctttgttagg

SEQ ID NO: 9361033 - DNA, 22 bp, Homo sapiens
cagggcctgtcacgacgctcat

SEQ ID NO: 9361034 - DNA, 22 bp, Homo sapiens
cagggcctgtcacgacgctcat

SEQ ID NO: 9361035 - DNA, 22 bp, Homo sapiens
cagggcctgtacaagtcccacc

SEQ ID NO: 9361036 - DNA, 22 bp, Homo sapiens
cagggccttatcctgccattga

SEQ ID NO: 9361037 - DNA, 22 bp, Homo sapiens
cagggccttcgtaagtgtccgg

SEQ ID NO: 9361038 - DNA, 22 bp, Homo sapiens
cagggccttatcctgccattga

SEQ ID NO: 9361039 - DNA, 22 bp, Homo sapiens
cagggccttcgtaagtgtccgg

SEQ ID NO: 9361040 - DNA, 21 bp, Homo sapiens
cagggctagagagaatgacaa

SEQ ID NO: 9361041 - DNA, 22 bp, Homo sapiens
cagggccttttagcatcttctc

SEQ ID NO: 9361042 - DNA, 22 bp, Homo sapiens
cagggccttgttcaggagtgaa

SEQ ID NO: 9361043 - DNA, 22 bp, Homo sapiens
cagggccttgttcaggagtgaa

SEQ ID NO: 9361044 - DNA, 22 bp, Homo sapiens
cagggcctttcagggtaaaagg

SEQ ID NO: 9361045 - DNA, 22 bp, Homo sapiens
cagggccttgttcaggagtgaa

SEQ ID NO: 9361046 - DNA, 22 bp, Homo sapiens
cagggctcaggaaatcagacgt

SEQ ID NO: 9361047 - DNA, 22 bp, Homo sapiens
cagggctcaggaaatcagacgt

SEQ ID NO: 9361048 - DNA, 22 bp, Homo sapiens
cagggctcagggactgcagaaa

SEQ ID NO: 9361049 - DNA, 22 bp, Homo sapiens
cagggctcagggactgcagaaa

SEQ ID NO: 9361050 - DNA, 22 bp, Homo sapiens
cagggctcagggactgcagaaa

SEQ ID NO: 9361051 - DNA, 22 bp, Homo sapiens
cagggctcagggactgcagaaa

SEQ ID NO: 9361052 - DNA, 22 bp, Homo sapiens
cagggctcaggaaatcagacgt

SEQ ID NO: 9361053 - DNA, 22 bp, Homo sapiens
cagggctcagaagacagacctc

SEQ ID NO: 9361054 - DNA, 22 bp, Homo sapiens
cagggctcagaagacagacctc

SEQ ID NO: 9361055 - DNA, 22 bp, Homo sapiens
taggaggaactttttgtttgga

SEQ ID NO: 9361056 - DNA, 23 bp, Homo sapiens
taggaggagaccgcagtgttacc

SEQ ID NO: 9361057 - DNA, 22 bp, Homo sapiens
taggagctgagacatctttaaa

SEQ ID NO: 9361058 - DNA, 22 bp, Homo sapiens
taggagctataatgtgaagtct

SEQ ID NO: 9361059 - DNA, 22 bp, Homo sapiens
cagggcctcattgtcagtcctg

SEQ ID NO: 9361060 - DNA, 22 bp, Homo sapiens
cagggcctcattgtcagtcctg

SEQ ID NO: 9361061 - DNA, 22 bp, Homo sapiens
taggaggagggcatttgaagta

SEQ ID NO: 9361062 - DNA, 22 bp, Homo sapiens
cagggcctccccggcagtcttt

SEQ ID NO: 9361063 - DNA, 22 bp, Homo sapiens
cagggcctcattgtcagtcctg

SEQ ID NO: 9361064 - DNA, 22 bp, Homo sapiens
cagggcctggagctgggcctgc

SEQ ID NO: 9361065 - DNA, 22 bp, Homo sapiens
cagggcctggagctgggcctgc

SEQ ID NO: 9361066 - DNA, 22 bp, Homo sapiens
cagggcctggagctgggcctgc

SEQ ID NO: 9361067 - DNA, 22 bp, Homo sapiens
cagggcctggagctgggcctgc

SEQ ID NO: 9361068 - DNA, 22 bp, Homo sapiens
cagggcctgcttccttcttgtt

SEQ ID NO: 9361069 - DNA, 22 bp, Homo sapiens
cagggcctgcctggttcctgga

SEQ ID NO: 9361070 - DNA, 22 bp, Homo sapiens
cagggcctgcttccttcttgtt

SEQ ID NO: 9361071 - DNA, 20 bp, Homo sapiens
taggagcaatgagagtagaa

SEQ ID NO: 9361072 - DNA, 22 bp, Homo sapiens
taggagatagtttttacctggc

SEQ ID NO: 9361073 - DNA, 22 bp, Homo sapiens
taggagagctgaactattgtct

SEQ ID NO: 9361074 - DNA, 22 bp, Homo sapiens
taggagaagagtcagggcctaa

SEQ ID NO: 9361075 - DNA, 22 bp, Homo sapiens
taggactttggcgtcagaactg

SEQ ID NO: 9361076 - DNA, 17 bp, Homo sapiens
taggagactggctgtcc

SEQ ID NO: 9361077 - DNA, 19 bp, Homo sapiens
taggaccctggtggccccc

SEQ ID NO: 9361078 - DNA, 22 bp, Homo sapiens
taggacttggtgactctcaatg

SEQ ID NO: 9361079 - DNA, 22 bp, Homo sapiens
caggggcaagaatgctgtcagc

SEQ ID NO: 9361080 - DNA, 22 bp, Homo sapiens
tagtctcttatcaggcacacac

SEQ ID NO: 9361081 - DNA, 22 bp, Homo sapiens
tagtcttaagtaattcatggaa

SEQ ID NO: 9361082 - DNA, 22 bp, Homo sapiens
tagtctggacttcttagtgtca

SEQ ID NO: 9361083 - DNA, 22 bp, Homo sapiens
caggggagttttatgcaacaga

SEQ ID NO: 9361084 - DNA, 22 bp, Homo sapiens
caggggagtgagtccctctctg

SEQ ID NO: 9361085 - DNA, 22 bp, Homo sapiens
tagtgaaacagttatcaatctg

SEQ ID NO: 9361086 - DNA, 22 bp, Homo sapiens
tagtgattccctatcaaccctg

SEQ ID NO: 9361087 - DNA, 22 bp, Homo sapiens
tagtgattcctgttgccctgga

SEQ ID NO: 9361088 - DNA, 22 bp, Homo sapiens
tagtgattccaatgtgaagtgg

SEQ ID NO: 9361089 - DNA, 22 bp, Homo sapiens
tagtgattataaaacagttttt

SEQ ID NO: 9361090 - DNA, 22 bp, Homo sapiens
tagtgattaaaggcagaatgtt

SEQ ID NO: 9361091 - DNA, 22 bp, Homo sapiens
tagtgattcgatgtgggtaagt

SEQ ID NO: 9361092 - DNA, 22 bp, Homo sapiens
tatatttaaatccaggttgaaa

SEQ ID NO: 9361093 - DNA, 22 bp, Homo sapiens
tatcaggagttgacagttgcta

SEQ ID NO: 9361094 - DNA, 22 bp, Homo sapiens
tagtgaaatatgtgctgatagc

SEQ ID NO: 9361095 - DNA, 22 bp, Homo sapiens
tatcatcattggcaggtgagaa

SEQ ID NO: 9361096 - DNA, 22 bp, Homo sapiens
tatcatctgcaaagcacatcta

SEQ ID NO: 9361097 - DNA, 22 bp, Homo sapiens
tatcatcactgtaatccgttga

SEQ ID NO: 9361098 - DNA, 22 bp, Homo sapiens
tatcatcagttcaggtattgat

SEQ ID NO: 9361099 - DNA, 22 bp, Homo sapiens
tatcatctgcaaagcacatcta

SEQ ID NO: 9361100 - DNA, 22 bp, Homo sapiens
tatcatgctaagattgattctt

SEQ ID NO: 9361101 - DNA, 22 bp, Homo sapiens
tatcatcacattacctcttggg

SEQ ID NO: 9361102 - DNA, 22 bp, Homo sapiens
tatcagtccagggttttgtgac

SEQ ID NO: 9361103 - DNA, 22 bp, Homo sapiens
tatcagtttaaaatctgtgaat

SEQ ID NO: 9361104 - DNA, 22 bp, Homo sapiens
tatcatgtgcgcttattgattt

SEQ ID NO: 9361105 - DNA, 22 bp, Homo sapiens
tatcatttaacagaatcattgc

SEQ ID NO: 9361106 - DNA, 22 bp, Homo sapiens
tatcatttaacagaatcattgc

SEQ ID NO: 9361107 - DNA, 22 bp, Homo sapiens
cagggtggcactcagcgcatct

SEQ ID NO: 9361108 - DNA, 22 bp, Homo sapiens
cagggtggcactcagcgcatct

SEQ ID NO: 9361109 - DNA, 22 bp, Homo sapiens
tatcatttaacagaatcattgc

SEQ ID NO: 9361110 - DNA, 22 bp, Homo sapiens
cagggtggcactcagcgcatct

SEQ ID NO: 9361111 - DNA, 22 bp, Homo sapiens
cagggtggcaggcaccatggcc

SEQ ID NO: 9361112 - DNA, 22 bp, Homo sapiens
cagggtggcaggcaccatggcc

SEQ ID NO: 9361113 - DNA, 22 bp, Homo sapiens
cagggtggccaggtagataata

SEQ ID NO: 9361114 - DNA, 22 bp, Homo sapiens
cagggtggccaggtagataata

SEQ ID NO: 9361115 - DNA, 22 bp, Homo sapiens
tagggcaggggaggaatctgaa

SEQ ID NO: 9361116 - DNA, 21 bp, Homo sapiens
tagggcaggcattggaagaga

SEQ ID NO: 9361117 - DNA, 22 bp, Homo sapiens
tagggcaggtgaagaaaagcta

SEQ ID NO: 9361118 - DNA, 22 bp, Homo sapiens
tagggcaggtgaagaaaagcta

SEQ ID NO: 9361119 - DNA, 22 bp, Homo sapiens
tagggcagttataacattagtg

SEQ ID NO: 9361120 - DNA, 21 bp, Homo sapiens
tagggcaggcattggaagaga

SEQ ID NO: 9361121 - DNA, 22 bp, Homo sapiens
tagggacaaagagctgaggcct

SEQ ID NO: 9361122 - DNA, 22 bp, Homo sapiens
tagggaagtgtataggggtcat

SEQ ID NO: 9361123 - DNA, 21 bp, Homo sapiens
tagggcaggcattggaagaga

SEQ ID NO: 9361124 - DNA, 22 bp, Homo sapiens
cagggctccatgcagggactcc

SEQ ID NO: 9361125 - DNA, 22 bp, Homo sapiens
cagggctcatctgtgtgaccag

SEQ ID NO: 9361126 - DNA, 22 bp, Homo sapiens
tagggaaggagaccaagccaca

SEQ ID NO: 9361127 - DNA, 22 bp, Homo sapiens
tagggaagtgtataggggtcat

SEQ ID NO: 9361128 - DNA, 22 bp, Homo sapiens
tagggaaggagaccaagccaca

SEQ ID NO: 9361129 - DNA, 22 bp, Homo sapiens
tagggctcgggcacaggacagg

SEQ ID NO: 9361130 - DNA, 22 bp, Homo sapiens
tagggcagtttcatgttatctt

SEQ ID NO: 9361131 - DNA, 22 bp, Homo sapiens
tagggcatttgtgggtgttgtt

SEQ ID NO: 9361132 - DNA, 21 bp, Homo sapiens
tagggcatattcagtggtctg

SEQ ID NO: 9361133 - DNA, 22 bp, Homo sapiens
tagggcctgacattcagtaggt

SEQ ID NO: 9361134 - DNA, 22 bp, Homo sapiens
cagggctttgaacaggcatcaa

SEQ ID NO: 9361135 - DNA, 22 bp, Homo sapiens
cagggctttttattagctgcct

SEQ ID NO: 9361136 - DNA, 22 bp, Homo sapiens
cagggctttgtgtgcctgggga

SEQ ID NO: 9361137 - DNA, 22 bp, Homo sapiens
cagggctttcccttgtagaaat

SEQ ID NO: 9361138 - DNA, 22 bp, Homo sapiens
cagggctttcctgagaagtgat

SEQ ID NO: 9361139 - DNA, 22 bp, Homo sapiens
cagggctttcctgagaagtgat

SEQ ID NO: 9361140 - DNA, 18 bp, Homo sapiens
cagggctgtggggtcact

SEQ ID NO: 9361141 - DNA, 22 bp, Homo sapiens
cagggctgtggctttgtgctgt

SEQ ID NO: 9361142 - DNA, 22 bp, Homo sapiens
caggggacattaaagctccata

SEQ ID NO: 9361143 - DNA, 22 bp, Homo sapiens
cagggctttttattagctgcct

SEQ ID NO: 9361144 - DNA, 22 bp, Homo sapiens
caggggaagatgccaagggaga

SEQ ID NO: 9361145 - DNA, 22 bp, Homo sapiens
cagggctttttattagctgcct

SEQ ID NO: 9361146 - DNA, 22 bp, Homo sapiens
caggggaaggagccttgaaact

SEQ ID NO: 9361147 - DNA, 22 bp, Homo sapiens
caggggaagatgccaagggaga

SEQ ID NO: 9361148 - DNA, 22 bp, Homo sapiens
taggtaggtaaacaggactaat

SEQ ID NO: 9361149 - DNA, 19 bp, Homo sapiens
taggtaggtaggtaggtat

SEQ ID NO: 9361150 - DNA, 22 bp, Homo sapiens
taggtacagtttctggtgtctt

SEQ ID NO: 9361151 - DNA, 22 bp, Homo sapiens
taggtacatggaattggacatt

SEQ ID NO: 9361152 - DNA, 22 bp, Homo sapiens
tagggtggttagaaggagtatg

SEQ ID NO: 9361153 - DNA, 22 bp, Homo sapiens
tagggtggttagaaggagtatg

SEQ ID NO: 9361154 - DNA, 22 bp, Homo sapiens
taggtacaaggagggattcttg

SEQ ID NO: 9361155 - DNA, 22 bp, Homo sapiens
tagggtgggcagttcttgggga

SEQ ID NO: 9361156 - DNA, 22 bp, Homo sapiens
tagggtggagactggaagcagg

SEQ ID NO: 9361157 - DNA, 22 bp, Homo sapiens
tagcaaggtgaagtatgggtga

SEQ ID NO: 9361158 - DNA, 22 bp, Homo sapiens
tagcaagtgtgagttcatttta

SEQ ID NO: 9361159 - DNA, 22 bp, Homo sapiens
tagcaagtggcaccacatttct

SEQ ID NO: 9361160 - DNA, 22 bp, Homo sapiens
tagcaaggacaacatatgagag

SEQ ID NO: 9361161 - DNA, 22 bp, Homo sapiens
cagggcagaaggcactctactc

SEQ ID NO: 9361162 - DNA, 22 bp, Homo sapiens
tagcgttttgtaatcaagtatg

SEQ ID NO: 9361163 - DNA, 22 bp, Homo sapiens
cagggcaaagagagcacatgct

SEQ ID NO: 9361164 - DNA, 21 bp, Homo sapiens
cagggcaaccaagtccagaga

SEQ ID NO: 9361165 - DNA, 22 bp, Homo sapiens
cagggcaaagagagcacatgct

SEQ ID NO: 9361166 - DNA, 22 bp, Homo sapiens
cagggatggcctggcgggccac

SEQ ID NO: 9361167 - DNA, 22 bp, Homo sapiens
cagggatggcgctggctgcccg

SEQ ID NO: 9361168 - DNA, 22 bp, Homo sapiens
cagggatggcgctggctgcccg

SEQ ID NO: 9361169 - DNA, 22 bp, Homo sapiens
cagggatggcgctggctgcccg

SEQ ID NO: 9361170 - DNA, 22 bp, Homo sapiens
tagataaattagaaagtttact

SEQ ID NO: 9361171 - DNA, 21 bp, Homo sapiens
cagggcacacagaggatggta

SEQ ID NO: 9361172 - DNA, 20 bp, Homo sapiens
cagggcacactgcagcctcg

SEQ ID NO: 9361173 - DNA, 20 bp, Homo sapiens
cagggcacactgcagcctcg

SEQ ID NO: 9361174 - DNA, 20 bp, Homo sapiens
cagggcacactgcagcctcg

SEQ ID NO: 9361175 - DNA, 21 bp, Homo sapiens
cagggcacacagaggatggta

SEQ ID NO: 9361176 - DNA, 22 bp, Homo sapiens
cagggcagaaggcactctactc

SEQ ID NO: 9361177 - DNA, 22 bp, Homo sapiens
cagggcagaaggcactctactc

SEQ ID NO: 9361178 - DNA, 22 bp, Homo sapiens
cagggcagaacatatagatagt

SEQ ID NO: 9361179 - DNA, 22 bp, Homo sapiens
cagggcagaacatatagatagt

SEQ ID NO: 9361180 - DNA, 22 bp, Homo sapiens
cagggcagaacatatagatagt

SEQ ID NO: 9361181 - DNA, 22 bp, Homo sapiens
cagggcacttaaattgcctcgt

SEQ ID NO: 9361182 - DNA, 22 bp, Homo sapiens
cagggcacggagaagtcacccc

SEQ ID NO: 9361183 - DNA, 22 bp, Homo sapiens
cagggcagaacatatagatagt

SEQ ID NO: 9361184 - DNA, 22 bp, Homo sapiens
tagagctgggcagtgctctgag

SEQ ID NO: 9361185 - DNA, 23 bp, Homo sapiens
tagagcttcagcgaatgtgctca

SEQ ID NO: 9361186 - DNA, 19 bp, Homo sapiens
tagagcttgttttaggaag

SEQ ID NO: 9361187 - DNA, 22 bp, Homo sapiens
tagaggaaatttccaaggtgag

SEQ ID NO: 9361188 - DNA, 22 bp, Homo sapiens
tagataaaagggcaaagggcat

SEQ ID NO: 9361189 - DNA, 22 bp, Homo sapiens
tagagttatgtggctccacagg

SEQ ID NO: 9361190 - DNA, 22 bp, Homo sapiens
tagagttatccttcacaggtat

SEQ ID NO: 9361191 - DNA, 22 bp, Homo sapiens
tagagtgtcataacagtgccca

SEQ ID NO: 9361192 - DNA, 22 bp, Homo sapiens
tagagtgtcataacagtgccca

SEQ ID NO: 9361193 - DNA, 22 bp, Homo sapiens
tagagtgtccaacacataggag

SEQ ID NO: 9361194 - DNA, 19 bp, Homo sapiens
tagaggagaagggaagtgg

SEQ ID NO: 9361195 - DNA, 19 bp, Homo sapiens
tagaggagaagggaagtgg

SEQ ID NO: 9361196 - DNA, 22 bp, Homo sapiens
tagagtgtcataacagtgccca

SEQ ID NO: 9361197 - DNA, 19 bp, Homo sapiens
tagaggagaagggaagtgg

SEQ ID NO: 9361198 - DNA, 22 bp, Homo sapiens
tagaggaaccaggcaggctgag

SEQ ID NO: 9361199 - DNA, 22 bp, Homo sapiens
tagaggaaccaggcaggctgag

SEQ ID NO: 9361200 - DNA, 22 bp, Homo sapiens
caggctgggctccggagataaa

SEQ ID NO: 9361201 - DNA, 22 bp, Homo sapiens
caggctgggctccggagataaa

SEQ ID NO: 9361202 - DNA, 22 bp, Homo sapiens
caggctgggcagcctccccggc

SEQ ID NO: 9361203 - DNA, 18 bp, Homo sapiens
tagaatcaaatattttac

SEQ ID NO: 9361204 - DNA, 22 bp, Homo sapiens
tagaatatgtggtaggatctgg

SEQ ID NO: 9361205 - DNA, 22 bp, Homo sapiens
tagaatatgattaattttctta

SEQ ID NO: 9361206 - DNA, 22 bp, Homo sapiens
tagaatatgattaattttctta

SEQ ID NO: 9361207 - DNA, 22 bp, Homo sapiens
tagaatatgtggtgtatacttt

SEQ ID NO: 9361208 - DNA, 22 bp, Homo sapiens
tagaatatgtggtgtatacttt

SEQ ID NO: 9361209 - DNA, 22 bp, Homo sapiens
tagacattttctcaacatctct

SEQ ID NO: 9361210 - DNA, 22 bp, Homo sapiens
caggctggtcccagagcattgc

SEQ ID NO: 9361211 - DNA, 22 bp, Homo sapiens
caggctggtcccagagcattgc

SEQ ID NO: 9361212 - DNA, 22 bp, Homo sapiens
caggctggtcccagagcattgc

SEQ ID NO: 9361213 - DNA, 22 bp, Homo sapiens
caggctggtcccagagcattgc

SEQ ID NO: 9361214 - DNA, 22 bp, Homo sapiens
caggctgggctggtgttagagt

SEQ ID NO: 9361215 - DNA, 22 bp, Homo sapiens
caggctgggctccggagataaa

SEQ ID NO: 9361216 - DNA, 22 bp, Homo sapiens
caggctgggctccggagataaa

SEQ ID NO: 9361217 - DNA, 22 bp, Homo sapiens
tactatttttgcaacgtataca

SEQ ID NO: 9361218 - DNA, 22 bp, Homo sapiens
tactatttttgcaacgtataca

SEQ ID NO: 9361219 - DNA, 22 bp, Homo sapiens
tactatttggaattttaaattg

SEQ ID NO: 9361220 - DNA, 22 bp, Homo sapiens
tactattttgacatgaaattga

SEQ ID NO: 9361221 - DNA, 22 bp, Homo sapiens
tactatttttgcaacgtataca

SEQ ID NO: 9361222 - DNA, 22 bp, Homo sapiens
tactcactattctatcagatag

SEQ ID NO: 9361223 - DNA, 22 bp, Homo sapiens
tactcatgactgatgaatacct

SEQ ID NO: 9361224 - DNA, 22 bp, Homo sapiens
tactcagagtcattgcccttct

SEQ ID NO: 9361225 - DNA, 22 bp, Homo sapiens
tactgtatgaattatgttattt

SEQ ID NO: 9361226 - DNA, 22 bp, Homo sapiens
tactgtatgaattatgttattt

SEQ ID NO: 9361227 - DNA, 23 bp, Homo sapiens
tactgtatattactgtgttatac

SEQ ID NO: 9361228 - DNA, 22 bp, Homo sapiens
tactgtatgatttcatgtatat

SEQ ID NO: 9361229 - DNA, 22 bp, Homo sapiens
tactgtatgatttcatgtatat

SEQ ID NO: 9361230 - DNA, 22 bp, Homo sapiens
tactgtattgttggctcttttg

SEQ ID NO: 9361231 - DNA, 22 bp, Homo sapiens
tactgtatatgcttgtatctga

SEQ ID NO: 9361232 - DNA, 22 bp, Homo sapiens
tactgtatttagaaagaactcc

SEQ ID NO: 9361233 - DNA, 22 bp, Homo sapiens
tactgtatttgataagtgaagt

SEQ ID NO: 9361234 - DNA, 22 bp, Homo sapiens
tactgtctaataagattgatgg

SEQ ID NO: 9361235 - DNA, 22 bp, Homo sapiens
tactgtctatacacttgattac

SEQ ID NO: 9361236 - DNA, 22 bp, Homo sapiens
tactgtctctgccctggccagg

SEQ ID NO: 9361237 - DNA, 22 bp, Homo sapiens
tactgtctgcttcttatagctt

SEQ ID NO: 9361238 - DNA, 22 bp, Homo sapiens
gtgaggggtggctgagcagttt

SEQ ID NO: 9361239 - DNA, 22 bp, Homo sapiens
gtgaggggccaagagtagggca

SEQ ID NO: 9361240 - DNA, 22 bp, Homo sapiens
gtgaggggtctggacgcacagt

SEQ ID NO: 9361241 - DNA, 22 bp, Homo sapiens
gtgaggggtctggacgcacagt

SEQ ID NO: 9361242 - DNA, 22 bp, Homo sapiens
tactatgtgaaaatactatagt

SEQ ID NO: 9361243 - DNA, 22 bp, Homo sapiens
tactatgtgaaaatactatagt

SEQ ID NO: 9361244 - DNA, 22 bp, Homo sapiens
tacctctctaaacccagggaca

SEQ ID NO: 9361245 - DNA, 22 bp, Homo sapiens
tacctgaaccaagcccagctct

SEQ ID NO: 9361246 - DNA, 22 bp, Homo sapiens
gtgaggggagtaaagccatgtt

SEQ ID NO: 9361247 - DNA, 22 bp, Homo sapiens
gtgaggggagtaaagccatgtt

SEQ ID NO: 9361248 - DNA, 17 bp, Homo sapiens
gtgagggcagaggatgg

SEQ ID NO: 9361249 - DNA, 17 bp, Homo sapiens
gtgagggcagaggatgg

SEQ ID NO: 9361250 - DNA, 22 bp, Homo sapiens
gtgagggcagcttggtcagtgt

SEQ ID NO: 9361251 - DNA, 22 bp, Homo sapiens
gtgaggggagtaaagccatgtt

SEQ ID NO: 9361252 - DNA, 22 bp, Homo sapiens
gtgaggggccaagagtagggca

SEQ ID NO: 9361253 - DNA, 20 bp, Homo sapiens
cagccctgtgacctggccct

SEQ ID NO: 9361254 - DNA, 22 bp, Homo sapiens
gtgagggcagaacccccaggcc

SEQ ID NO: 9361255 - DNA, 22 bp, Homo sapiens
gtgagggcaaattagaatcaaa

SEQ ID NO: 9361256 - DNA, 22 bp, Homo sapiens
gtgagggcaaattagaatcaaa

SEQ ID NO: 9361257 - DNA, 22 bp, Homo sapiens
gtgagggataatatgcggggtt

SEQ ID NO: 9361258 - DNA, 22 bp, Homo sapiens
gtgagggaggtagatttcatca

SEQ ID NO: 9361259 - DNA, 22 bp, Homo sapiens
caggctggagtgcagtggcgcc

SEQ ID NO: 9361260 - DNA, 22 bp, Homo sapiens
caggctggagtgcagtggcgct

SEQ ID NO: 9361261 - DNA, 22 bp, Homo sapiens
caggctggagtgcagtggcgct

SEQ ID NO: 9361262 - DNA, 22 bp, Homo sapiens
caggctggagtgcagtggcgct

SEQ ID NO: 9361263 - DNA, 22 bp, Homo sapiens
caggctggagtgcagtggggcg

SEQ ID NO: 9361264 - DNA, 22 bp, Homo sapiens
caggctggagtgcagtggggcg

SEQ ID NO: 9361265 - DNA, 22 bp, Homo sapiens
caggctggagtgcagtggcgct

SEQ ID NO: 9361266 - DNA, 22 bp, Homo sapiens
caggctggagtgcagtggggcg

SEQ ID NO: 9361267 - DNA, 22 bp, Homo sapiens
tagaatatacactacagcttaa

SEQ ID NO: 9361268 - DNA, 19 bp, Homo sapiens
tagaatagttacacagatt

SEQ ID NO: 9361269 - DNA, 22 bp, Homo sapiens
tagaatatacactacagcttaa

SEQ ID NO: 9361270 - DNA, 22 bp, Homo sapiens
tagaatatgattaattttctta

SEQ ID NO: 9361271 - DNA, 22 bp, Homo sapiens
caggctggagtgcagtggtgcc

SEQ ID NO: 9361272 - DNA, 22 bp, Homo sapiens
caggctggagtgcagtggtgcc

SEQ ID NO: 9361273 - DNA, 22 bp, Homo sapiens
tagaacataagtcattcatttg

SEQ ID NO: 9361274 - DNA, 22 bp, Homo sapiens
tagaataagttgatgatatatg

SEQ ID NO: 9361275 - DNA, 22 bp, Homo sapiens
tagaacatcaggttgaatttgg

SEQ ID NO: 9361276 - DNA, 21 bp, Homo sapiens
tagaatacaggtattttggat

SEQ ID NO: 9361277 - DNA, 22 bp, Homo sapiens
caggctggagtgagtgtagtgg

SEQ ID NO: 9361278 - DNA, 22 bp, Homo sapiens
caggctggagtgagtgtagtgg

SEQ ID NO: 9361279 - DNA, 22 bp, Homo sapiens
caggctgcctggaagaggactg

SEQ ID NO: 9361280 - DNA, 22 bp, Homo sapiens
caggctggagtgagtgtagtgg

SEQ ID NO: 9361281 - DNA, 22 bp, Homo sapiens
caggctgcctggaagaggactg

SEQ ID NO: 9361282 - DNA, 22 bp, Homo sapiens
tactgtctggcaattaagaatc

SEQ ID NO: 9361283 - DNA, 23 bp, Homo sapiens
tactgtcttctattaagtaagga

SEQ ID NO: 9361284 - DNA, 22 bp, Homo sapiens
tactgtctttaggggtagaaat

SEQ ID NO: 9361285 - DNA, 22 bp, Homo sapiens
tactgtcttttcctaaatgggt

SEQ ID NO: 9361286 - DNA, 22 bp, Homo sapiens
tactgtctttccatccttgcct

SEQ ID NO: 9361287 - DNA, 22 bp, Homo sapiens
caggctggagtgcagtggcgcc

SEQ ID NO: 9361288 - DNA, 22 bp, Homo sapiens
caggctggagtgcagtggcgcc

SEQ ID NO: 9361289 - DNA, 22 bp, Homo sapiens
caggctggagtgcagtggcgcc

SEQ ID NO: 9361290 - DNA, 22 bp, Homo sapiens
caggctggagtgcaatggtgct

SEQ ID NO: 9361291 - DNA, 22 bp, Homo sapiens
caggctggagtgcaatgacgcc

SEQ ID NO: 9361292 - DNA, 22 bp, Homo sapiens
caggctggagtgcaatgacgcc

SEQ ID NO: 9361293 - DNA, 22 bp, Homo sapiens
caggctggagtgcaatggcaca

SEQ ID NO: 9361294 - DNA, 22 bp, Homo sapiens
caggctggagtgcaatggcaca

SEQ ID NO: 9361295 - DNA, 22 bp, Homo sapiens
caggctggagtgcaatggcaca

SEQ ID NO: 9361296 - DNA, 22 bp, Homo sapiens
tcagatgcctgtggggtctagg

SEQ ID NO: 9361297 - DNA, 22 bp, Homo sapiens
cagttacagctgcaccagagcc

SEQ ID NO: 9361298 - DNA, 22 bp, Homo sapiens
cagttaaaggcccaatatctgg

SEQ ID NO: 9361299 - DNA, 22 bp, Homo sapiens
tcagcagacctgttatttggat

SEQ ID NO: 9361300 - DNA, 22 bp, Homo sapiens
tcagcagacattattttctggc

SEQ ID NO: 9361301 - DNA, 22 bp, Homo sapiens
tcagcagaggagtgtcttgccc

SEQ ID NO: 9361302 - DNA, 22 bp, Homo sapiens
tcagcagatgggttgtgttggc

SEQ ID NO: 9361303 - DNA, 22 bp, Homo sapiens
tcagcagagtttcatcttggga

SEQ ID NO: 9361304 - DNA, 22 bp, Homo sapiens
tcagcagaggggaaggcatctg

SEQ ID NO: 9361305 - DNA, 22 bp, Homo sapiens
tcagcagccgcagctgactcag

SEQ ID NO: 9361306 - DNA, 19 bp, Homo sapiens
cagtttaactaattttatc

SEQ ID NO: 9361307 - DNA, 19 bp, Homo sapiens
tcagcagcactgtgatttc

SEQ ID NO: 9361308 - DNA, 19 bp, Homo sapiens
tcagcagcactgtgatttc

SEQ ID NO: 9361309 - DNA, 22 bp, Homo sapiens
tcagcagcagctcagcatgttt

SEQ ID NO: 9361310 - DNA, 21 bp, Homo sapiens
tcagcagcatctgcctagagt

SEQ ID NO: 9361311 - DNA, 21 bp, Homo sapiens
tcagcagcatctgcctagagt

SEQ ID NO: 9361312 - DNA, 21 bp, Homo sapiens
tcagcagcatctgcctagagt

SEQ ID NO: 9361313 - DNA, 22 bp, Homo sapiens
tcagctttttggattgcccaag

SEQ ID NO: 9361314 - DNA, 22 bp, Homo sapiens
tcagctttttacatgtgaaata

SEQ ID NO: 9361315 - DNA, 18 bp, Homo sapiens
tcagcttttgaaaaccaa

SEQ ID NO: 9361316 - DNA, 22 bp, Homo sapiens
tcagcttttgtcagaaattgta

SEQ ID NO: 9361317 - DNA, 22 bp, Homo sapiens
cataaactcttgagattcttgt

SEQ ID NO: 9361318 - DNA, 22 bp, Homo sapiens
cataaaatggcttgttctttaa

SEQ ID NO: 9361319 - DNA, 22 bp, Homo sapiens
cataaaatggcttgttctttaa

SEQ ID NO: 9361320 - DNA, 22 bp, Homo sapiens
cataaagtagcagagcatgact

SEQ ID NO: 9361321 - DNA, 21 bp, Homo sapiens
cagtttaataacaaagaagga

SEQ ID NO: 9361322 - DNA, 22 bp, Homo sapiens
cagtttaagtagaactgagaat

SEQ ID NO: 9361323 - DNA, 22 bp, Homo sapiens
cagtttagcaaatttgtatcaa

SEQ ID NO: 9361324 - DNA, 22 bp, Homo sapiens
cagtttatagttgttatgtgtg

SEQ ID NO: 9361325 - DNA, 22 bp, Homo sapiens
cagtttatagttgttatgtgtg

SEQ ID NO: 9361326 - DNA, 22 bp, Homo sapiens
cagtttatatataagcacattg

SEQ ID NO: 9361327 - DNA, 22 bp, Homo sapiens
cagtttatagctctagcagctt

SEQ ID NO: 9361328 - DNA, 22 bp, Homo sapiens
cagtttatagctctagcagctt

SEQ ID NO: 9361329 - DNA, 22 bp, Homo sapiens
cagtttatagttgttatgtgtg

SEQ ID NO: 9361330 - DNA, 22 bp, Homo sapiens
cagtttatagctctagcagctt

SEQ ID NO: 9361331 - DNA, 21 bp, Homo sapiens
tcagctttgcaactgcacatc

SEQ ID NO: 9361332 - DNA, 22 bp, Homo sapiens
tcagctttgatctcaggcaatc

SEQ ID NO: 9361333 - DNA, 22 bp, Homo sapiens
tcagctttgatctcaggcaatc

SEQ ID NO: 9361334 - DNA, 22 bp, Homo sapiens
tcagctttgatctcaggcaatc

SEQ ID NO: 9361335 - DNA, 22 bp, Homo sapiens
cagtttatatataagcacattg

SEQ ID NO: 9361336 - DNA, 22 bp, Homo sapiens
tcagctgccccagtggccccag

SEQ ID NO: 9361337 - DNA, 22 bp, Homo sapiens
tcagctgccccagtggccccag

SEQ ID NO: 9361338 - DNA, 22 bp, Homo sapiens
tcagctttctcttctatcgata

SEQ ID NO: 9361339 - DNA, 22 bp, Homo sapiens
tcagctttggtcacattgagtt

SEQ ID NO: 9361340 - DNA, 22 bp, Homo sapiens
tcagctttggtcacattgagtt

SEQ ID NO: 9361341 - DNA, 22 bp, Homo sapiens
tcagctttggtcacattgagtt

SEQ ID NO: 9361342 - DNA, 22 bp, Homo sapiens
tcagcttttaaaaacaagaagt

SEQ ID NO: 9361343 - DNA, 22 bp, Homo sapiens
tcagcttttaaaaacaagaagt

SEQ ID NO: 9361344 - DNA, 22 bp, Homo sapiens
tcagctttgccaccagctgtaa

SEQ ID NO: 9361345 - DNA, 22 bp, Homo sapiens
tcagctttgggggtctcaggag

SEQ ID NO: 9361346 - DNA, 22 bp, Homo sapiens
tcagctttgcaagttagaaaat

SEQ ID NO: 9361347 - DNA, 22 bp, Homo sapiens
tcagctttgccaccagctgtaa

SEQ ID NO: 9361348 - DNA, 22 bp, Homo sapiens
tcagctttgccaccagctgtaa

SEQ ID NO: 9361349 - DNA, 22 bp, Homo sapiens
cagtggcttcttcctagagcca

SEQ ID NO: 9361350 - DNA, 22 bp, Homo sapiens
cagtggcttcttcctagagcca

SEQ ID NO: 9361351 - DNA, 22 bp, Homo sapiens
cagtggcttctcatgtcattca

SEQ ID NO: 9361352 - DNA, 22 bp, Homo sapiens
cagtggctgtttctggaaggca

SEQ ID NO: 9361353 - DNA, 22 bp, Homo sapiens
cagtggctgtttctggaaggca

SEQ ID NO: 9361354 - DNA, 22 bp, Homo sapiens
cagtggctgtttctggaaggca

SEQ ID NO: 9361355 - DNA, 22 bp, Homo sapiens
cagtggcttacaatgaactaga

SEQ ID NO: 9361356 - DNA, 22 bp, Homo sapiens
cagtggctggttagggacagga

SEQ ID NO: 9361357 - DNA, 22 bp, Homo sapiens
cagtggctggttagggacagga

SEQ ID NO: 9361358 - DNA, 22 bp, Homo sapiens
cagtggctgtgaccagggacct

SEQ ID NO: 9361359 - DNA, 22 bp, Homo sapiens
cagtggctgtgaccagggacct

SEQ ID NO: 9361360 - DNA, 21 bp, Homo sapiens
cagtggcagttcttgcctctg

SEQ ID NO: 9361361 - DNA, 22 bp, Homo sapiens
cagtggcaggggaagcaggtgt

SEQ ID NO: 9361362 - DNA, 22 bp, Homo sapiens
cagtggcagttagaaaatattc

SEQ ID NO: 9361363 - DNA, 22 bp, Homo sapiens
cagtgccacttaatgaggctgc

SEQ ID NO: 9361364 - DNA, 22 bp, Homo sapiens
cagtgccagaggtactagtgga

SEQ ID NO: 9361365 - DNA, 21 bp, Homo sapiens
cagtgccagccacaggacgcc

SEQ ID NO: 9361366 - DNA, 22 bp, Homo sapiens
cagtgccagctgcttggcctac

SEQ ID NO: 9361367 - DNA, 21 bp, Homo sapiens
cagtgccagccacaggacgcc

SEQ ID NO: 9361368 - DNA, 22 bp, Homo sapiens
cagtgccacttaatgaggctgc

SEQ ID NO: 9361369 - DNA, 22 bp, Homo sapiens
cagtgccacaggaatggccaat

SEQ ID NO: 9361370 - DNA, 22 bp, Homo sapiens
cagtgccaaggctcttggtctg

SEQ ID NO: 9361371 - DNA, 22 bp, Homo sapiens
cagtgccaaggatggcctggga

SEQ ID NO: 9361372 - DNA, 22 bp, Homo sapiens
cagtgccaaggagaaggacagc

SEQ ID NO: 9361373 - DNA, 22 bp, Homo sapiens
cagtgccagtggatgaactgtt

SEQ ID NO: 9361374 - DNA, 22 bp, Homo sapiens
cagtgccaggagacaagatcag

SEQ ID NO: 9361375 - DNA, 22 bp, Homo sapiens
cagtgccatgatgcagagcaat

SEQ ID NO: 9361376 - DNA, 22 bp, Homo sapiens
cagtgccatattgaaagacatt

SEQ ID NO: 9361377 - DNA, 22 bp, Homo sapiens
cagtggcaggggaagcaggtgt

SEQ ID NO: 9361378 - DNA, 23 bp, Homo sapiens
cagtgccatttgtcttgcctatg

SEQ ID NO: 9361379 - DNA, 22 bp, Homo sapiens
cagtgccatgatgcagagcaat

SEQ ID NO: 9361380 - DNA, 22 bp, Homo sapiens
cagtgccatgtctgagccccta

SEQ ID NO: 9361381 - DNA, 22 bp, Homo sapiens
cagtgggaatgaagtggaggcc

SEQ ID NO: 9361382 - DNA, 22 bp, Homo sapiens
cagtgggatatgggggcagcat

SEQ ID NO: 9361383 - DNA, 22 bp, Homo sapiens
cagtgggtcctaagtacagttc

SEQ ID NO: 9361384 - DNA, 22 bp, Homo sapiens
cagtgggtagtggggattagca

SEQ ID NO: 9361385 - DNA, 22 bp, Homo sapiens
cagtgggtatttactgattcct

SEQ ID NO: 9361386 - DNA, 22 bp, Homo sapiens
cagtgggtaggaaaggctcttc

SEQ ID NO: 9361387 - DNA, 22 bp, Homo sapiens
cagtgggtagtggggattagca

SEQ ID NO: 9361388 - DNA, 22 bp, Homo sapiens
cagtgggtaaataagtgggtaa

SEQ ID NO: 9361389 - DNA, 22 bp, Homo sapiens
cagtgggtaaataagtgggtaa

SEQ ID NO: 9361390 - DNA, 22 bp, Homo sapiens
cagtgggggtgaggccgaggta

SEQ ID NO: 9361391 - DNA, 22 bp, Homo sapiens
cagtggggggactgaggcctga

SEQ ID NO: 9361392 - DNA, 22 bp, Homo sapiens
cagtgggggtgaggccgaggta

SEQ ID NO: 9361393 - DNA, 22 bp, Homo sapiens
cagtggggaggccaggatagaa

SEQ ID NO: 9361394 - DNA, 22 bp, Homo sapiens
cagtggggaggccaggatagaa

SEQ ID NO: 9361395 - DNA, 23 bp, Homo sapiens
cagtgggcttctaactgctcctg

SEQ ID NO: 9361396 - DNA, 22 bp, Homo sapiens
cagtgtttccgtcagtatgtga

SEQ ID NO: 9361397 - DNA, 23 bp, Homo sapiens
cagtgtgacaaaacttattactt

SEQ ID NO: 9361398 - DNA, 23 bp, Homo sapiens
cagtgtgacgaggtgaggcaggc

SEQ ID NO: 9361399 - DNA, 22 bp, Homo sapiens
cagtgtctttcagactcagaaa

SEQ ID NO: 9361400 - DNA, 22 bp, Homo sapiens
cagtgtctttcagactcagaaa

SEQ ID NO: 9361401 - DNA, 22 bp, Homo sapiens
cagtgtctggttggctctacgt

SEQ ID NO: 9361402 - DNA, 22 bp, Homo sapiens
cagtgtcttatttgtagctcag

SEQ ID NO: 9361403 - DNA, 18 bp, Homo sapiens
cagtgtcttggtaaaata

SEQ ID NO: 9361404 - DNA, 22 bp, Homo sapiens
cagtgtctccagatgctccaat

SEQ ID NO: 9361405 - DNA, 22 bp, Homo sapiens
cagtgtctcccccaggttctgt

SEQ ID NO: 9361406 - DNA, 22 bp, Homo sapiens
cagtgtctcccccaggttctgt

SEQ ID NO: 9361407 - DNA, 22 bp, Homo sapiens
cagtgtctgaaataacaccgga

SEQ ID NO: 9361408 - DNA, 22 bp, Homo sapiens
cagtgtctgcctttctgtttgg

SEQ ID NO: 9361409 - DNA, 22 bp, Homo sapiens
cagtgtctgggacagaaagtca

SEQ ID NO: 9361410 - DNA, 22 bp, Homo sapiens
tcagagaaataattgctgagtt

SEQ ID NO: 9361411 - DNA, 22 bp, Homo sapiens
tcagagaaatgacaatatatag

SEQ ID NO: 9361412 - DNA, 22 bp, Homo sapiens
cagtgtctcagtttcacttgaa

SEQ ID NO: 9361413 - DNA, 22 bp, Homo sapiens
cagtgtctccagatgctccaat

SEQ ID NO: 9361414 - DNA, 22 bp, Homo sapiens
cagtgtctcaaaacaagttgct

SEQ ID NO: 9361415 - DNA, 22 bp, Homo sapiens
cagtgtctcagtttcacttgaa

SEQ ID NO: 9361416 - DNA, 21 bp, Homo sapiens
tcagagaacccggcaggcaag

SEQ ID NO: 9361417 - DNA, 22 bp, Homo sapiens
tcagactgaaagatacacctct

SEQ ID NO: 9361418 - DNA, 19 bp, Homo sapiens
tcagactgaaagtttagat

SEQ ID NO: 9361419 - DNA, 22 bp, Homo sapiens
tcagactggattttcacgtttt

SEQ ID NO: 9361420 - DNA, 22 bp, Homo sapiens
tcagagaaaatggaaactttta

SEQ ID NO: 9361421 - DNA, 22 bp, Homo sapiens
tcagagaaaggccaaaatatca

SEQ ID NO: 9361422 - DNA, 22 bp, Homo sapiens
tcagagaaaatggaaactttta

SEQ ID NO: 9361423 - DNA, 22 bp, Homo sapiens
tcacaggaggaacctggcctgg

SEQ ID NO: 9361424 - DNA, 22 bp, Homo sapiens
tcacaggacagccttccacccg

SEQ ID NO: 9361425 - DNA, 22 bp, Homo sapiens
tcacaggaaccatcagagaaat

SEQ ID NO: 9361426 - DNA, 22 bp, Homo sapiens
tcacagagaaatgtggcacaaa

SEQ ID NO: 9361427 - DNA, 22 bp, Homo sapiens
tcacagagaaatgtggcacaaa

SEQ ID NO: 9361428 - DNA, 22 bp, Homo sapiens
tcacagctttcagattgttccc

SEQ ID NO: 9361429 - DNA, 22 bp, Homo sapiens
tcacagtgttggaatcagagct

SEQ ID NO: 9361430 - DNA, 22 bp, Homo sapiens
tcacagtgttaaacctttcttt

SEQ ID NO: 9361431 - DNA, 22 bp, Homo sapiens
tcacaggagggagagacaccca

SEQ ID NO: 9361432 - DNA, 22 bp, Homo sapiens
tcacaggagggagagacaccca

SEQ ID NO: 9361433 - DNA, 22 bp, Homo sapiens
tcacagtgtggcaactcacaga

SEQ ID NO: 9361434 - DNA, 22 bp, Homo sapiens
cagtgccaagccacagatcact

SEQ ID NO: 9361435 - DNA, 22 bp, Homo sapiens
tcacaaatcattttatctgtgt

SEQ ID NO: 9361436 - DNA, 22 bp, Homo sapiens
tcacaaatttcagctccctgaa

SEQ ID NO: 9361437 - DNA, 22 bp, Homo sapiens
tcacaactcacagccaccggtg

SEQ ID NO: 9361438 - DNA, 22 bp, Homo sapiens
tcacaagacagaaaacatttag

SEQ ID NO: 9361439 - DNA, 22 bp, Homo sapiens
tatttcttttcgtgacttattg

SEQ ID NO: 9361440 - DNA, 22 bp, Homo sapiens
tatttcttttcgtgacttattg

SEQ ID NO: 9361441 - DNA, 22 bp, Homo sapiens
tatttcttttcgtgacttattg

SEQ ID NO: 9361442 - DNA, 22 bp, Homo sapiens
tatttcttttcgtgacttattg

SEQ ID NO: 9361443 - DNA, 22 bp, Homo sapiens
tatttgaaagtgtacaaaaact

SEQ ID NO: 9361444 - DNA, 22 bp, Homo sapiens
cagtgacaggttccatgccgca

SEQ ID NO: 9361445 - DNA, 22 bp, Homo sapiens
cagtgacagcaagcagtgctgg

SEQ ID NO: 9361446 - DNA, 22 bp, Homo sapiens
cagtgacacgggctggcccacg

SEQ ID NO: 9361447 - DNA, 22 bp, Homo sapiens
cagtgagaaaactaagacatta

SEQ ID NO: 9361448 - DNA, 22 bp, Homo sapiens
cagtgacgtaaactgcatgtgc

SEQ ID NO: 9361449 - DNA, 22 bp, Homo sapiens
tcacaagacagaaaacatttag

SEQ ID NO: 9361450 - DNA, 22 bp, Homo sapiens
tcacaagactgagcttgcttga

SEQ ID NO: 9361451 - DNA, 22 bp, Homo sapiens
cagtgaagtttaaagtgtagat

SEQ ID NO: 9361452 - DNA, 22 bp, Homo sapiens
tcacactttatttatttcatgc

SEQ ID NO: 9361453 - DNA, 22 bp, Homo sapiens
cagtgagctcctgtctgtccct

SEQ ID NO: 9361454 - DNA, 22 bp, Homo sapiens
cagtgaggaagctgtctggacc

SEQ ID NO: 9361455 - DNA, 22 bp, Homo sapiens
cagtgaggaagctgtctggacc

SEQ ID NO: 9361456 - DNA, 22 bp, Homo sapiens
cagtgaggaagctgtctggacc

SEQ ID NO: 9361457 - DNA, 22 bp, Homo sapiens
tcacacttagagcgaattgttt

SEQ ID NO: 9361458 - DNA, 22 bp, Homo sapiens
cagtgagataccacagagcaaa

SEQ ID NO: 9361459 - DNA, 22 bp, Homo sapiens
cagtgagataccacagagcaaa

SEQ ID NO: 9361460 - DNA, 22 bp, Homo sapiens
cagtgagataccacagagcaaa

SEQ ID NO: 9361461 - DNA, 22 bp, Homo sapiens
cagtgagataccacagagcaaa

SEQ ID NO: 9361462 - DNA, 22 bp, Homo sapiens
tatttccaaaaaggccatattc

SEQ ID NO: 9361463 - DNA, 21 bp, Homo sapiens
tatttagttttacaaatgtgg

SEQ ID NO: 9361464 - DNA, 22 bp, Homo sapiens
caggtttctagttctaagaata

SEQ ID NO: 9361465 - DNA, 22 bp, Homo sapiens
tatttataacagtgagaacggg

SEQ ID NO: 9361466 - DNA, 22 bp, Homo sapiens
caggttctgaggatggtgcctg

SEQ ID NO: 9361467 - DNA, 22 bp, Homo sapiens
caggttctgggtcctgggtcct

SEQ ID NO: 9361468 - DNA, 22 bp, Homo sapiens
caggttctggggctccactgtg

SEQ ID NO: 9361469 - DNA, 22 bp, Homo sapiens
caggttcttaagtaacagcaca

SEQ ID NO: 9361470 - DNA, 22 bp, Homo sapiens
caggttcttgaagccttctggc

SEQ ID NO: 9361471 - DNA, 22 bp, Homo sapiens
caggttcttgtttcaaacagac

SEQ ID NO: 9361472 - DNA, 22 bp, Homo sapiens
caggttcccttgcagctaagtg

SEQ ID NO: 9361473 - DNA, 22 bp, Homo sapiens
caggttccctagcagcaaagcc

SEQ ID NO: 9361474 - DNA, 22 bp, Homo sapiens
caggttcagcaggaggcatccc

SEQ ID NO: 9361475 - DNA, 22 bp, Homo sapiens
caggtgttttttattctgaaag

SEQ ID NO: 9361476 - DNA, 23 bp, Homo sapiens
caggtgttttacatatggtagtt

SEQ ID NO: 9361477 - DNA, 23 bp, Homo sapiens
caggtgttttacatatggtagtt

SEQ ID NO: 9361478 - DNA, 22 bp, Homo sapiens
caggtgtttcctgaagttgatg

SEQ ID NO: 9361479 - DNA, 22 bp, Homo sapiens
caggtgtttgtcaattccatcc

SEQ ID NO: 9361480 - DNA, 22 bp, Homo sapiens
caggtgtttcaaatgtgaaact

SEQ ID NO: 9361481 - DNA, 22 bp, Homo sapiens
caggtgtttaggtttcatggat

SEQ ID NO: 9361482 - DNA, 22 bp, Homo sapiens
caggtgtttcaatcccaagtca

SEQ ID NO: 9361483 - DNA, 22 bp, Homo sapiens
caggtgttgggagaagagataa

SEQ ID NO: 9361484 - DNA, 22 bp, Homo sapiens
caggtgttggaagggcagtggg

SEQ ID NO: 9361485 - DNA, 22 bp, Homo sapiens
caggtgttgggagaagagataa

SEQ ID NO: 9361486 - DNA, 22 bp, Homo sapiens
caggtgttgtctaaagcttcag

SEQ ID NO: 9361487 - DNA, 22 bp, Homo sapiens
caggtgttgtctaaagcttcag

SEQ ID NO: 9361488 - DNA, 22 bp, Homo sapiens
caggtgttggaagggcagtggg

SEQ ID NO: 9361489 - DNA, 22 bp, Homo sapiens
caggtgttgatgtttattgagt

SEQ ID NO: 9361490 - DNA, 22 bp, Homo sapiens
caggtgttgcagttgaagactg

SEQ ID NO: 9361491 - DNA, 22 bp, Homo sapiens
caggtgttgcctaaattgacaa

SEQ ID NO: 9361492 - DNA, 22 bp, Homo sapiens
caggtgttctggaaatcagcag

SEQ ID NO: 9361493 - DNA, 22 bp, Homo sapiens
caggtgttcaagctggaggcca

SEQ ID NO: 9361494 - DNA, 22 bp, Homo sapiens
caggtgttctaagccgggcagt

SEQ ID NO: 9361495 - DNA, 17 bp, Homo sapiens
caggtgttctgtttttc

SEQ ID NO: 9361496 - DNA, 22 bp, Homo sapiens
caggtgttgatactaatcgtgg

SEQ ID NO: 9361497 - DNA, 22 bp, Homo sapiens
caggtggtcaggcagatgggct

SEQ ID NO: 9361498 - DNA, 22 bp, Homo sapiens
caggtggtcaggcagatgggct

SEQ ID NO: 9361499 - DNA, 22 bp, Homo sapiens
caggtggtcaggcaaggacacg

SEQ ID NO: 9361500 - DNA, 22 bp, Homo sapiens
cagggtggggaaatagcgccct

SEQ ID NO: 9361501 - DNA, 22 bp, Homo sapiens
caggtgtctaattctcaccccc

SEQ ID NO: 9361502 - DNA, 22 bp, Homo sapiens
caggtgtgccgggagcagtttg

SEQ ID NO: 9361503 - DNA, 22 bp, Homo sapiens
caggtggtcaggcagatgggct

SEQ ID NO: 9361504 - DNA, 22 bp, Homo sapiens
caggtggtcaggcagatgggct

SEQ ID NO: 9361505 - DNA, 22 bp, Homo sapiens
caggtgtctaattctcaccccc

SEQ ID NO: 9361506 - DNA, 22 bp, Homo sapiens
caggtgttcaagctggaggcca

SEQ ID NO: 9361507 - DNA, 22 bp, Homo sapiens
caggtgttatacatgaaattta

SEQ ID NO: 9361508 - DNA, 22 bp, Homo sapiens
caggtgttaattgttggagcaa

SEQ ID NO: 9361509 - DNA, 22 bp, Homo sapiens
caggtgttaattgttggagcaa

SEQ ID NO: 9361510 - DNA, 22 bp, Homo sapiens
caggtgtgccgggagcagtttg

SEQ ID NO: 9361511 - DNA, 22 bp, Homo sapiens
caggtgttaatcacttttaagc

SEQ ID NO: 9361512 - DNA, 22 bp, Homo sapiens
cagggtgggcacccagcctcca

SEQ ID NO: 9361513 - DNA, 22 bp, Homo sapiens
cagggtgggcacccagcctcca

SEQ ID NO: 9361514 - DNA, 22 bp, Homo sapiens
cagggtggccctgtggtctcat

SEQ ID NO: 9361515 - DNA, 22 bp, Homo sapiens
cagggtggccctgtggtctcat

SEQ ID NO: 9361516 - DNA, 21 bp, Homo sapiens
tatttccaaccctttatcctt

SEQ ID NO: 9361517 - DNA, 21 bp, Homo sapiens
tatttccaaccctttatcctt

SEQ ID NO: 9361518 - DNA, 22 bp, Homo sapiens
tatttccaaaagcctattatga

SEQ ID NO: 9361519 - DNA, 22 bp, Homo sapiens
tatttccaaaagcctattatga

SEQ ID NO: 9361520 - DNA, 22 bp, Homo sapiens
tatttccaccctcagtaaggaa

SEQ ID NO: 9361521 - DNA, 22 bp, Homo sapiens
tatttccacaccttttgaatct

SEQ ID NO: 9361522 - DNA, 22 bp, Homo sapiens
tatttccaccctcagtaaggaa

SEQ ID NO: 9361523 - DNA, 22 bp, Homo sapiens
tatttccacaccttttgaatct

SEQ ID NO: 9361524 - DNA, 22 bp, Homo sapiens
tatttccacaccttttgaatct

SEQ ID NO: 9361525 - DNA, 22 bp, Homo sapiens
tatttccaagctgaatccaatg

SEQ ID NO: 9361526 - DNA, 22 bp, Homo sapiens
tatttccagaggagtatagaag

SEQ ID NO: 9361527 - DNA, 22 bp, Homo sapiens
tatttccagatgaggttacatt

SEQ ID NO: 9361528 - DNA, 22 bp, Homo sapiens
tatttccagaggagtatagaag

SEQ ID NO: 9361529 - DNA, 22 bp, Homo sapiens
cagtagcccactagtatgcagt

SEQ ID NO: 9361530 - DNA, 22 bp, Homo sapiens
cagtagccttatttggatcatt

SEQ ID NO: 9361531 - DNA, 22 bp, Homo sapiens
tatttccacctattattttctg

SEQ ID NO: 9361532 - DNA, 22 bp, Homo sapiens
tatttccacctattattttctg

SEQ ID NO: 9361533 - DNA, 22 bp, Homo sapiens
tatttccagaggagtatagaag

SEQ ID NO: 9361534 - DNA, 22 bp, Homo sapiens
tatttccacttaggtgcctgtt

SEQ ID NO: 9361535 - DNA, 22 bp, Homo sapiens
tatttccacctattattttctg

SEQ ID NO: 9361536 - DNA, 22 bp, Homo sapiens
cagtagggaatgtgggaggctg

SEQ ID NO: 9361537 - DNA, 22 bp, Homo sapiens
cagtaggaaggatgcagaaaaa

SEQ ID NO: 9361538 - DNA, 22 bp, Homo sapiens
cagtataagagtgaggaagggc

SEQ ID NO: 9361539 - DNA, 18 bp, Homo sapiens
cagtataaccagcaactc

SEQ ID NO: 9361540 - DNA, 21 bp, Homo sapiens
cagtataacgttgggctcttc

SEQ ID NO: 9361541 - DNA, 22 bp, Homo sapiens
cagtataatgccccctgtgggg

SEQ ID NO: 9361542 - DNA, 23 bp, Homo sapiens
cagtataatgtatggatggggca

SEQ ID NO: 9361543 - DNA, 22 bp, Homo sapiens
tatttctttcaggtatgtgttg

SEQ ID NO: 9361544 - DNA, 22 bp, Homo sapiens
tatttctttcaggtatgtgttg

SEQ ID NO: 9361545 - DNA, 22 bp, Homo sapiens
tatttctttcaggtatgtgttg

SEQ ID NO: 9361546 - DNA, 22 bp, Homo sapiens
tatttcttttcgtgacttattg

SEQ ID NO: 9361547 - DNA, 22 bp, Homo sapiens
tatttcttttcgtgacttattg

SEQ ID NO: 9361548 - DNA, 22 bp, Homo sapiens
cagtcccagaagagcctgggag

SEQ ID NO: 9361549 - DNA, 22 bp, Homo sapiens
cagtcccagaagagcctgggag

SEQ ID NO: 9361550 - DNA, 22 bp, Homo sapiens
tatttcttgttccctccaagtt

SEQ ID NO: 9361551 - DNA, 22 bp, Homo sapiens
cagtcccagacccagaaggtgg

SEQ ID NO: 9361552 - DNA, 22 bp, Homo sapiens
tatttcttgttccctccaagtt

SEQ ID NO: 9361553 - DNA, 22 bp, Homo sapiens
cagtcccaaggaggaagcagtc

SEQ ID NO: 9361554 - DNA, 22 bp, Homo sapiens
cagtcccaaggaggaagcagtc

SEQ ID NO: 9361555 - DNA, 22 bp, Homo sapiens
cagtccagagcccaccagagga

SEQ ID NO: 9361556 - DNA, 20 bp, Homo sapiens
cagtccaatcagaggccacc

SEQ ID NO: 9361557 - DNA, 22 bp, Homo sapiens
cagtcccaccaggatcgctctt

SEQ ID NO: 9361558 - DNA, 20 bp, Homo sapiens
cagtcccaatccagggccag

SEQ ID NO: 9361559 - DNA, 22 bp, Homo sapiens
tctcctggccgggctgtcccct

SEQ ID NO: 9361560 - DNA, 22 bp, Homo sapiens
tctcctggccgggctgtcccct

SEQ ID NO: 9361561 - DNA, 22 bp, Homo sapiens
tctcctggccgggctgtcccct

SEQ ID NO: 9361562 - DNA, 22 bp, Homo sapiens
tctcctggcctttaggttaagg

SEQ ID NO: 9361563 - DNA, 22 bp, Homo sapiens
tctcctggcctttaggttaagg

SEQ ID NO: 9361564 - DNA, 22 bp, Homo sapiens
tctcctggctcaccaggctgga

SEQ ID NO: 9361565 - DNA, 22 bp, Homo sapiens
tctcctggctcaccaggctgga

SEQ ID NO: 9361566 - DNA, 22 bp, Homo sapiens
tctcctggctcaccaggctgga

SEQ ID NO: 9361567 - DNA, 22 bp, Homo sapiens
tctcctggctcaccaggctgga

SEQ ID NO: 9361568 - DNA, 23 bp, Homo sapiens
tctcctggctgcactgtggccac

SEQ ID NO: 9361569 - DNA, 23 bp, Homo sapiens
tctcctggctgcactgtggccac

SEQ ID NO: 9361570 - DNA, 23 bp, Homo sapiens
tctcctggctgcactgtggccac

SEQ ID NO: 9361571 - DNA, 22 bp, Homo sapiens
tctcctggctctaaaaggctgt

SEQ ID NO: 9361572 - DNA, 22 bp, Homo sapiens
tctcctggctctaaaaggctgt

SEQ ID NO: 9361573 - DNA, 17 bp, Homo sapiens
tctcctggctctatcag

SEQ ID NO: 9361574 - DNA, 17 bp, Homo sapiens
tctcctggctctatcag

SEQ ID NO: 9361575 - DNA, 22 bp, Homo sapiens
tctcctggctctaaaaggctgt

SEQ ID NO: 9361576 - DNA, 22 bp, Homo sapiens
tctcctggctctaaaaggctgt

SEQ ID NO: 9361577 - DNA, 22 bp, Homo sapiens
tctcctggctcaccaggctgga

SEQ ID NO: 9361578 - DNA, 23 bp, Homo sapiens
tctctgagttgtactttcccttg

SEQ ID NO: 9361579 - DNA, 22 bp, Homo sapiens
tctctgagttctcctccagccc

SEQ ID NO: 9361580 - DNA, 22 bp, Homo sapiens
tctctcttgtcaccccatctgc

SEQ ID NO: 9361581 - DNA, 22 bp, Homo sapiens
tctctcttgtcaccccatctgc

SEQ ID NO: 9361582 - DNA, 19 bp, Homo sapiens
tctctgcagcgcgcccggc

SEQ ID NO: 9361583 - DNA, 22 bp, Homo sapiens
tctctgcaagatgagaaatatt

SEQ ID NO: 9361584 - DNA, 22 bp, Homo sapiens
tctctgcacagaagtagatagc

SEQ ID NO: 9361585 - DNA, 22 bp, Homo sapiens
tctctgcacttgcacataagct

SEQ ID NO: 9361586 - DNA, 22 bp, Homo sapiens
tctctgggaatgggcctgggta

SEQ ID NO: 9361587 - DNA, 22 bp, Homo sapiens
tctctgggaatgggcctgggta

SEQ ID NO: 9361588 - DNA, 22 bp, Homo sapiens
tctctgcccaagtttctcaagt

SEQ ID NO: 9361589 - DNA, 22 bp, Homo sapiens
tctctgcccatcctcagtccac

SEQ ID NO: 9361590 - DNA, 22 bp, Homo sapiens
tctctgcccatcctcagtccac

SEQ ID NO: 9361591 - DNA, 22 bp, Homo sapiens
tctctgcccatcctcagtccac

SEQ ID NO: 9361592 - DNA, 22 bp, Homo sapiens
tctctgcccatcctcagtccac

SEQ ID NO: 9361593 - DNA, 22 bp, Homo sapiens
tctctgccacagcttctgcctt

SEQ ID NO: 9361594 - DNA, 23 bp, Homo sapiens
tctctgcatgtcctgagcacatc

SEQ ID NO: 9361595 - DNA, 22 bp, Homo sapiens
tctctgccacagcttctgcctt

SEQ ID NO: 9361596 - DNA, 22 bp, Homo sapiens
tctctgccacagcttctgcctt

SEQ ID NO: 9361597 - DNA, 22 bp, Homo sapiens
tctctgggacactgggtcagtt

SEQ ID NO: 9361598 - DNA, 22 bp, Homo sapiens
tctctgggacactgggtcagtt

SEQ ID NO: 9361599 - DNA, 22 bp, Homo sapiens
tctctgggaattttttggacat

SEQ ID NO: 9361600 - DNA, 22 bp, Homo sapiens
tctctgggagcaattgtttgct

SEQ ID NO: 9361601 - DNA, 22 bp, Homo sapiens
tctctgggagcaattgtttgct

SEQ ID NO: 9361602 - DNA, 21 bp, Homo sapiens
tctctgggaggacttgtgaga

SEQ ID NO: 9361603 - DNA, 21 bp, Homo sapiens
tctctgggaggacttgtgaga

SEQ ID NO: 9361604 - DNA, 21 bp, Homo sapiens
tctctgggaggacttgtgaga

SEQ ID NO: 9361605 - DNA, 21 bp, Homo sapiens
tctctgggaggacttgtgaga

SEQ ID NO: 9361606 - DNA, 22 bp, Homo sapiens
ccagcactctgtcccagcttcc

SEQ ID NO: 9361607 - DNA, 22 bp, Homo sapiens
tctctgggagttgagcagcagc

SEQ ID NO: 9361608 - DNA, 22 bp, Homo sapiens
tctctgggagttgagcagcagc

SEQ ID NO: 9361609 - DNA, 22 bp, Homo sapiens
ccagcagcatcctgcagcactt

SEQ ID NO: 9361610 - DNA, 22 bp, Homo sapiens
ccagcagcatcctgcagcactt

SEQ ID NO: 9361611 - DNA, 22 bp, Homo sapiens
ccagcagcatcctgcagcactt

SEQ ID NO: 9361612 - DNA, 22 bp, Homo sapiens
ccagcagccagagaaggacctc

SEQ ID NO: 9361613 - DNA, 22 bp, Homo sapiens
ccagcagccagagaaggacctc

SEQ ID NO: 9361614 - DNA, 22 bp, Homo sapiens
ccagcagccaccttctcgaaat

SEQ ID NO: 9361615 - DNA, 22 bp, Homo sapiens
ccagcagccctcttccaagact

SEQ ID NO: 9361616 - DNA, 22 bp, Homo sapiens
ccagcagcgatagggtgagtgc

SEQ ID NO: 9361617 - DNA, 22 bp, Homo sapiens
ccagcagcccacaggcgtccct

SEQ ID NO: 9361618 - DNA, 22 bp, Homo sapiens
ccagcagcagcgtccaaggaga

SEQ ID NO: 9361619 - DNA, 22 bp, Homo sapiens
ccagcagcaggccaggccctcc

SEQ ID NO: 9361620 - DNA, 22 bp, Homo sapiens
ccagcagcagcgtccaaggaga

SEQ ID NO: 9361621 - DNA, 22 bp, Homo sapiens
ccagcagcagcgtccaaggaga

SEQ ID NO: 9361622 - DNA, 22 bp, Homo sapiens
ccagcactgctctcagactgag

SEQ ID NO: 9361623 - DNA, 22 bp, Homo sapiens
ccagcactgctctcagactgag

SEQ ID NO: 9361624 - DNA, 22 bp, Homo sapiens
ccagcaggggaatatttttagg

SEQ ID NO: 9361625 - DNA, 22 bp, Homo sapiens
ccagcagggcagtgccctggac

SEQ ID NO: 9361626 - DNA, 22 bp, Homo sapiens
ccagcagggcagtgccctggac

SEQ ID NO: 9361627 - DNA, 22 bp, Homo sapiens
ccagcagggcagtgccctggac

SEQ ID NO: 9361628 - DNA, 22 bp, Homo sapiens
ccagcagggcagtgccctggac

SEQ ID NO: 9361629 - DNA, 22 bp, Homo sapiens
ccagcagggcagtgccctggac

SEQ ID NO: 9361630 - DNA, 22 bp, Homo sapiens
ccagcagctttattggctctcc

SEQ ID NO: 9361631 - DNA, 22 bp, Homo sapiens
ccagcagctgtggctttgcctc

SEQ ID NO: 9361632 - DNA, 22 bp, Homo sapiens
ccagcagggaaaaacccaccaa

SEQ ID NO: 9361633 - DNA, 22 bp, Homo sapiens
ccagcagctgacaccagtccca

SEQ ID NO: 9361634 - DNA, 22 bp, Homo sapiens
ccagcagctgacaccagtccca

SEQ ID NO: 9361635 - DNA, 22 bp, Homo sapiens
ccagcagctgcaaagcctgggt

SEQ ID NO: 9361636 - DNA, 22 bp, Homo sapiens
ccagcagctgacaccagtccca

SEQ ID NO: 9361637 - DNA, 22 bp, Homo sapiens
ccagcagctgctatgtggtttt

SEQ ID NO: 9361638 - DNA, 22 bp, Homo sapiens
ccagcagctgcaaagcctgggt

SEQ ID NO: 9361639 - DNA, 22 bp, Homo sapiens
ccagcagctcagctactggtca

SEQ ID NO: 9361640 - DNA, 22 bp, Homo sapiens
ccagcagctccctcagggtccg

SEQ ID NO: 9361641 - DNA, 22 bp, Homo sapiens
ccagcagctccctcagggtccg

SEQ ID NO: 9361642 - DNA, 22 bp, Homo sapiens
ccagcatgagacgatgatgaag

SEQ ID NO: 9361643 - DNA, 18 bp, Homo sapiens
ccagcatgccagaggctg

SEQ ID NO: 9361644 - DNA, 22 bp, Homo sapiens
ccagcatctaacgctcctggga

SEQ ID NO: 9361645 - DNA, 22 bp, Homo sapiens
tctgaatttagtgattagcttt

SEQ ID NO: 9361646 - DNA, 22 bp, Homo sapiens
tctgaattcttagaattaaagg

SEQ ID NO: 9361647 - DNA, 22 bp, Homo sapiens
tctgaattctgacaatttgaat

SEQ ID NO: 9361648 - DNA, 18 bp, Homo sapiens
tctgaatattatgcagtg

SEQ ID NO: 9361649 - DNA, 19 bp, Homo sapiens
tctgaattatttatgtacc

SEQ ID NO: 9361650 - DNA, 22 bp, Homo sapiens
tctgaataatgtccttgtatca

SEQ ID NO: 9361651 - DNA, 22 bp, Homo sapiens
tctgaataatgtccttgtatca

SEQ ID NO: 9361652 - DNA, 19 bp, Homo sapiens
tctgaagtccagggcatac

SEQ ID NO: 9361653 - DNA, 22 bp, Homo sapiens
tctgaatatgtttatcatctct

SEQ ID NO: 9361654 - DNA, 22 bp, Homo sapiens
tctgaatatgtttatcatctct

SEQ ID NO: 9361655 - DNA, 22 bp, Homo sapiens
tctgaatatgtttatcatctct

SEQ ID NO: 9361656 - DNA, 22 bp, Homo sapiens
tctgaatagagagaggtccttt

SEQ ID NO: 9361657 - DNA, 22 bp, Homo sapiens
tctgaatagtatattgaaagca

SEQ ID NO: 9361658 - DNA, 22 bp, Homo sapiens
tctgaatagttctattttaaag

SEQ ID NO: 9361659 - DNA, 22 bp, Homo sapiens
tctctgttcatggcactatgtc

SEQ ID NO: 9361660 - DNA, 22 bp, Homo sapiens
tctctgttcatggcactatgtc

SEQ ID NO: 9361661 - DNA, 22 bp, Homo sapiens
tctctgtgttgcaggaaaatct

SEQ ID NO: 9361662 - DNA, 22 bp, Homo sapiens
tctgaaatgacctttccccact

SEQ ID NO: 9361663 - DNA, 22 bp, Homo sapiens
tctgaaatgaactcttgaactt

SEQ ID NO: 9361664 - DNA, 22 bp, Homo sapiens
tctctgtgtgttggctgtatat

SEQ ID NO: 9361665 - DNA, 22 bp, Homo sapiens
tctctgtgtgtgtgacagcatt

SEQ ID NO: 9361666 - DNA, 22 bp, Homo sapiens
tctctgtgtgttggctgtatat

SEQ ID NO: 9361667 - DNA, 22 bp, Homo sapiens
tctctgtgtgtgtgacagcatt

SEQ ID NO: 9361668 - DNA, 22 bp, Homo sapiens
tctctgtgtgggagatcttttt

SEQ ID NO: 9361669 - DNA, 22 bp, Homo sapiens
tctctgtgtgtgtgacagcatt

SEQ ID NO: 9361670 - DNA, 22 bp, Homo sapiens
tctctgtgttccctgttttctc

SEQ ID NO: 9361671 - DNA, 22 bp, Homo sapiens
tctctgtgtgttggctgtatat

SEQ ID NO: 9361672 - DNA, 21 bp, Homo sapiens
tctctgtgttcaaggtgccag

SEQ ID NO: 9361673 - DNA, 22 bp, Homo sapiens
ccagcaggtgtagggctcatgg

SEQ ID NO: 9361674 - DNA, 22 bp, Homo sapiens
ccagcaggtgtagggctcatgg

SEQ ID NO: 9361675 - DNA, 22 bp, Homo sapiens
ccagcaggggaatatttttagg

SEQ ID NO: 9361676 - DNA, 22 bp, Homo sapiens
ccagcagggttggtttcttctg

SEQ ID NO: 9361677 - DNA, 22 bp, Homo sapiens
ccagcaggtgtagggctcatgg

SEQ ID NO: 9361678 - DNA, 22 bp, Homo sapiens
ccagcagggttggtttcttctg

SEQ ID NO: 9361679 - DNA, 22 bp, Homo sapiens
ccagcaggtgtagggctcatgg

SEQ ID NO: 9361680 - DNA, 22 bp, Homo sapiens
ccagcatcagcattgtcttagg

SEQ ID NO: 9361681 - DNA, 19 bp, Homo sapiens
ccagcaggttcatttcagg

SEQ ID NO: 9361682 - DNA, 19 bp, Homo sapiens
ccagcaggttcatttcagg

SEQ ID NO: 9361683 - DNA, 22 bp, Homo sapiens
tctctgtgtgggagatcttttt

SEQ ID NO: 9361684 - DNA, 22 bp, Homo sapiens
tctctgtgtgccttcatctgcc

SEQ ID NO: 9361685 - DNA, 22 bp, Homo sapiens
tctctgtgtgccttcatctgcc

SEQ ID NO: 9361686 - DNA, 22 bp, Homo sapiens
tctctgtgtgccttcatctgcc

SEQ ID NO: 9361687 - DNA, 22 bp, Homo sapiens
tctgatatcgcactaaactctg

SEQ ID NO: 9361688 - DNA, 21 bp, Homo sapiens
tctgatatatccccaagttac

SEQ ID NO: 9361689 - DNA, 22 bp, Homo sapiens
tctgatataaaagtgacattca

SEQ ID NO: 9361690 - DNA, 22 bp, Homo sapiens
tctgcagaattcgaggaagaaa

SEQ ID NO: 9361691 - DNA, 22 bp, Homo sapiens
tctgcagaattcgaggaagaaa

SEQ ID NO: 9361692 - DNA, 22 bp, Homo sapiens
tctgcagaattcgaggaagaaa

SEQ ID NO: 9361693 - DNA, 22 bp, Homo sapiens
tctgcagaaggaatcagctgag

SEQ ID NO: 9361694 - DNA, 22 bp, Homo sapiens
ccagcccttcccaactggccag

SEQ ID NO: 9361695 - DNA, 22 bp, Homo sapiens
tctgagagatacaaggaggcaa

SEQ ID NO: 9361696 - DNA, 21 bp, Homo sapiens
tctgagagcaactgcccttta

SEQ ID NO: 9361697 - DNA, 22 bp, Homo sapiens
tctgagagatacaaggaggcaa

SEQ ID NO: 9361698 - DNA, 22 bp, Homo sapiens
tctgagagccactgaacagcaa

SEQ ID NO: 9361699 - DNA, 22 bp, Homo sapiens
tctgagagcaggaggagctgct

SEQ ID NO: 9361700 - DNA, 22 bp, Homo sapiens
tctgagagcaggaggagctgct

SEQ ID NO: 9361701 - DNA, 22 bp, Homo sapiens
tctgagaggcatctgcacttct

SEQ ID NO: 9361702 - DNA, 22 bp, Homo sapiens
tctgagaggtgaattcagcaaa

SEQ ID NO: 9361703 - DNA, 22 bp, Homo sapiens
tctgagaggttaagcaatttga

SEQ ID NO: 9361704 - DNA, 22 bp, Homo sapiens
ccagccacgaagctcccttcat

SEQ ID NO: 9361705 - DNA, 22 bp, Homo sapiens
ccagccctcactgaggcctctc

SEQ ID NO: 9361706 - DNA, 22 bp, Homo sapiens
ccagccctgcctctcagggccc

SEQ ID NO: 9361707 - DNA, 22 bp, Homo sapiens
ccagccctgcctctcagggccc

SEQ ID NO: 9361708 - DNA, 22 bp, Homo sapiens
ccagcatttgcttaatttggag

SEQ ID NO: 9361709 - DNA, 22 bp, Homo sapiens
ccagccacagcttccagctcct

SEQ ID NO: 9361710 - DNA, 22 bp, Homo sapiens
ccagcatgctcagtctaaattg

SEQ ID NO: 9361711 - DNA, 22 bp, Homo sapiens
ccagcatggcacctgagatgag

SEQ ID NO: 9361712 - DNA, 20 bp, Homo sapiens
ccagcatgtacacatgtgga

SEQ ID NO: 9361713 - DNA, 22 bp, Homo sapiens
ccagccctgtttatgtgtcact

SEQ ID NO: 9361714 - DNA, 19 bp, Homo sapiens
ccagccctgtcacttcttg

SEQ ID NO: 9361715 - DNA, 22 bp, Homo sapiens
ccagcccttagataaacctggc

SEQ ID NO: 9361716 - DNA, 22 bp, Homo sapiens
ccagccctgtcaccaactggag

SEQ ID NO: 9361717 - DNA, 22 bp, Homo sapiens
ccagccctgtcaccaactggag

SEQ ID NO: 9361718 - DNA, 22 bp, Homo sapiens
ccagccctgtaaggatgaggca

SEQ ID NO: 9361719 - DNA, 22 bp, Homo sapiens
ccagccctgtcaccaactggag

SEQ ID NO: 9361720 - DNA, 22 bp, Homo sapiens
ccagccctgtcaccaactggag

SEQ ID NO: 9361721 - DNA, 22 bp, Homo sapiens
tcctctccatgtctcacgccac

SEQ ID NO: 9361722 - DNA, 22 bp, Homo sapiens
tcctctctgcactggccctgcc

SEQ ID NO: 9361723 - DNA, 22 bp, Homo sapiens
tcctctctgcactggccctgcc

SEQ ID NO: 9361724 - DNA, 22 bp, Homo sapiens
tcctctgaattcgctctgtgat

SEQ ID NO: 9361725 - DNA, 18 bp, Homo sapiens
tcctctctttccccaggg

SEQ ID NO: 9361726 - DNA, 18 bp, Homo sapiens
tcctctctttccccaggg

SEQ ID NO: 9361727 - DNA, 22 bp, Homo sapiens
tcctgaatgagttgatcacaat

SEQ ID NO: 9361728 - DNA, 22 bp, Homo sapiens
tcctgaatccaggagagtaggg

SEQ ID NO: 9361729 - DNA, 22 bp, Homo sapiens
tcctgaatgagttgatcacaat

SEQ ID NO: 9361730 - DNA, 22 bp, Homo sapiens
tcctgaataaattagctgtcac

SEQ ID NO: 9361731 - DNA, 22 bp, Homo sapiens
tcctgaataaattagctgtcac

SEQ ID NO: 9361732 - DNA, 22 bp, Homo sapiens
tcctgaatccaggagagtaggg

SEQ ID NO: 9361733 - DNA, 22 bp, Homo sapiens
tcctgaattgaactcagttaat

SEQ ID NO: 9361734 - DNA, 22 bp, Homo sapiens
tcctgaattcctctttgcatcc

SEQ ID NO: 9361735 - DNA, 22 bp, Homo sapiens
tcctgaattgttgagaagcagc

SEQ ID NO: 9361736 - DNA, 22 bp, Homo sapiens
tcctgaattgaactcagttaat

SEQ ID NO: 9361737 - DNA, 22 bp, Homo sapiens
tcctgaattgccttagtttctg

SEQ ID NO: 9361738 - DNA, 20 bp, Homo sapiens
tcctgaatttcctttctgct

SEQ ID NO: 9361739 - DNA, 22 bp, Homo sapiens
tcctgaatttcccagcatgaac

SEQ ID NO: 9361740 - DNA, 22 bp, Homo sapiens
tcctgaattgttgagaagcagc

SEQ ID NO: 9361741 - DNA, 22 bp, Homo sapiens
tcctgaattgttgagaagcagc

SEQ ID NO: 9361742 - DNA, 22 bp, Homo sapiens
tcctgaatttcccagcatgaac

SEQ ID NO: 9361743 - DNA, 22 bp, Homo sapiens
ccacattgactgtctgtagatt

SEQ ID NO: 9361744 - DNA, 21 bp, Homo sapiens
ccacatggtgaaaccctatct

SEQ ID NO: 9361745 - DNA, 22 bp, Homo sapiens
ccacatgtgcactgctgtatgg

SEQ ID NO: 9361746 - DNA, 19 bp, Homo sapiens
ccacatggctggatgacag

SEQ ID NO: 9361747 - DNA, 19 bp, Homo sapiens
ccacatggctggatgacag

SEQ ID NO: 9361748 - DNA, 19 bp, Homo sapiens
ccacatggctggatgacag

SEQ ID NO: 9361749 - DNA, 22 bp, Homo sapiens
ccacatggagcaggaggtgggg

SEQ ID NO: 9361750 - DNA, 23 bp, Homo sapiens
ccacatggcaagatgatgcattc

SEQ ID NO: 9361751 - DNA, 22 bp, Homo sapiens
ccacatggatagatagggacat

SEQ ID NO: 9361752 - DNA, 23 bp, Homo sapiens
ccacatggcaagatgatgcattc

SEQ ID NO: 9361753 - DNA, 23 bp, Homo sapiens
ccacatggcaagatgatgcattc

SEQ ID NO: 9361754 - DNA, 22 bp, Homo sapiens
ccacatctgttcttagttctga

SEQ ID NO: 9361755 - DNA, 22 bp, Homo sapiens
ccacatctgcatttaatgtata

SEQ ID NO: 9361756 - DNA, 22 bp, Homo sapiens
ccacatctcggtcccctctttg

SEQ ID NO: 9361757 - DNA, 22 bp, Homo sapiens
ccacatctgcagtcccttctgt

SEQ ID NO: 9361758 - DNA, 22 bp, Homo sapiens
ccacatctcttgatgtacctac

SEQ ID NO: 9361759 - DNA, 22 bp, Homo sapiens
ccacatgaaattgcttatattt

SEQ ID NO: 9361760 - DNA, 22 bp, Homo sapiens
ccacatcttttttcctgaacag

SEQ ID NO: 9361761 - DNA, 22 bp, Homo sapiens
ccacatctgttcttagttctga

SEQ ID NO: 9361762 - DNA, 22 bp, Homo sapiens
tcctgactccaggtcctgtgtg

SEQ ID NO: 9361763 - DNA, 22 bp, Homo sapiens
ccacagtgatccctgcctgcga

SEQ ID NO: 9361764 - DNA, 20 bp, Homo sapiens
tcctgaatttcctttctgct

SEQ ID NO: 9361765 - DNA, 22 bp, Homo sapiens
tcggggtctttgacacgctctg

SEQ ID NO: 9361766 - DNA, 23 bp, Homo sapiens
tcggtgggcgtggaggccgaggc

SEQ ID NO: 9361767 - DNA, 22 bp, Homo sapiens
tcggtgacaaattctctgccat

SEQ ID NO: 9361768 - DNA, 21 bp, Homo sapiens
tcggtgaccagctgtccttca

SEQ ID NO: 9361769 - DNA, 21 bp, Homo sapiens
tcgggcttggctgcggtgctg

SEQ ID NO: 9361770 - DNA, 22 bp, Homo sapiens
tcgggctcgctctcctagcgga

SEQ ID NO: 9361771 - DNA, 22 bp, Homo sapiens
tcgcttgaacccaggaagtgga

SEQ ID NO: 9361772 - DNA, 22 bp, Homo sapiens
tcgctgtggtttctgtacatgg

SEQ ID NO: 9361773 - DNA, 22 bp, Homo sapiens
tcgcttgaacccaggaagtgga

SEQ ID NO: 9361774 - DNA, 22 bp, Homo sapiens
tcggagagttggaagtagcaga

SEQ ID NO: 9361775 - DNA, 22 bp, Homo sapiens
tcggagagctcacagctgtggc

SEQ ID NO: 9361776 - DNA, 22 bp, Homo sapiens
tcggagagttcatgaagacccg

SEQ ID NO: 9361777 - DNA, 22 bp, Homo sapiens
ccaccctgtgcaggcgtgggta

SEQ ID NO: 9361778 - DNA, 23 bp, Homo sapiens
tcggtgggcgtggaggccgaggc

SEQ ID NO: 9361779 - DNA, 23 bp, Homo sapiens
tcggtgggcgtggaggccgaggc

SEQ ID NO: 9361780 - DNA, 22 bp, Homo sapiens
ccacccttccattcttcctctt

SEQ ID NO: 9361781 - DNA, 22 bp, Homo sapiens
ccacccttgggttcggaggccg

SEQ ID NO: 9361782 - DNA, 22 bp, Homo sapiens
ccaccgccatggcgttgtacag

SEQ ID NO: 9361783 - DNA, 22 bp, Homo sapiens
ccaccgccatggcgttgtacag

SEQ ID NO: 9361784 - DNA, 22 bp, Homo sapiens
tcgcgctgtagccgcgcagagt

SEQ ID NO: 9361785 - DNA, 22 bp, Homo sapiens
tcgctggcctggaggggagcca

SEQ ID NO: 9361786 - DNA, 22 bp, Homo sapiens
tcgctgaggctgcacggctgcc

SEQ ID NO: 9361787 - DNA, 22 bp, Homo sapiens
ccaccaggacagccctgagggg

SEQ ID NO: 9361788 - DNA, 22 bp, Homo sapiens
ccaccaggacagccctgagggg

SEQ ID NO: 9361789 - DNA, 18 bp, Homo sapiens
tcctttcaccccttctct

SEQ ID NO: 9361790 - DNA, 22 bp, Homo sapiens
ccaccacatttgcctagacttt

SEQ ID NO: 9361791 - DNA, 22 bp, Homo sapiens
ccaccagatttactttactatt

SEQ ID NO: 9361792 - DNA, 22 bp, Homo sapiens
tctccctctcagatttattcac

SEQ ID NO: 9361793 - DNA, 22 bp, Homo sapiens
tctccctctgtaagatcagggg

SEQ ID NO: 9361794 - DNA, 22 bp, Homo sapiens
tctccctctcagatttattcac

SEQ ID NO: 9361795 - DNA, 22 bp, Homo sapiens
tctccctcattcctgcttccat

SEQ ID NO: 9361796 - DNA, 22 bp, Homo sapiens
tctccctcattcctgcttccat

SEQ ID NO: 9361797 - DNA, 22 bp, Homo sapiens
tctccctcattcctgcttccat

SEQ ID NO: 9361798 - DNA, 22 bp, Homo sapiens
ccagagaggccttggcaagaca

SEQ ID NO: 9361799 - DNA, 22 bp, Homo sapiens
tctccctctttgtctgctttgg

SEQ ID NO: 9361800 - DNA, 22 bp, Homo sapiens
tctccctctttgtctgctttgg

SEQ ID NO: 9361801 - DNA, 22 bp, Homo sapiens
tctccctctttgtctgctttgg

SEQ ID NO: 9361802 - DNA, 23 bp, Homo sapiens
tctccctgaggttgttagcatta

SEQ ID NO: 9361803 - DNA, 23 bp, Homo sapiens
tctccctgaggttgttagcatta

SEQ ID NO: 9361804 - DNA, 20 bp, Homo sapiens
tctccctgcccatctcagat

SEQ ID NO: 9361805 - DNA, 20 bp, Homo sapiens
tctccctgcccatctcagat

SEQ ID NO: 9361806 - DNA, 20 bp, Homo sapiens
tctccctgcccatctcagat

SEQ ID NO: 9361807 - DNA, 23 bp, Homo sapiens
tctccctgaggttgttagcatta

SEQ ID NO: 9361808 - DNA, 20 bp, Homo sapiens
tctccctgcccatctcagat

SEQ ID NO: 9361809 - DNA, 22 bp, Homo sapiens
tctcctggccgggctgtcccct

SEQ ID NO: 9361810 - DNA, 22 bp, Homo sapiens
tctcctggccctgtcgccatct

SEQ ID NO: 9361811 - DNA, 22 bp, Homo sapiens
tctccgatcacaggttttcaat

SEQ ID NO: 9361812 - DNA, 22 bp, Homo sapiens
tctcccttggtcacagattcct

SEQ ID NO: 9361813 - DNA, 22 bp, Homo sapiens
tctcccttggtcacagattcct

SEQ ID NO: 9361814 - DNA, 16 bp, Homo sapiens
tctcccttgtcacctg

SEQ ID NO: 9361815 - DNA, 22 bp, Homo sapiens
tctccctggagccctgaagcat

SEQ ID NO: 9361816 - DNA, 22 bp, Homo sapiens
tctccctggagccctgaagcat

SEQ ID NO: 9361817 - DNA, 22 bp, Homo sapiens
tctccctggagccctgaagcat

SEQ ID NO: 9361818 - DNA, 22 bp, Homo sapiens
tctccctgtggaggacccctta

SEQ ID NO: 9361819 - DNA, 16 bp, Homo sapiens
tctccctgttctccaa

SEQ ID NO: 9361820 - DNA, 22 bp, Homo sapiens
tctcccttctctggattccgtt

SEQ ID NO: 9361821 - DNA, 22 bp, Homo sapiens
tctcccttctctggattccgtt

SEQ ID NO: 9361822 - DNA, 22 bp, Homo sapiens
tctccaggaaccatcatggtaa

SEQ ID NO: 9361823 - DNA, 22 bp, Homo sapiens
tctccaggaaccatcatggtaa

SEQ ID NO: 9361824 - DNA, 22 bp, Homo sapiens
tctccaggaagccctccctgac

SEQ ID NO: 9361825 - DNA, 22 bp, Homo sapiens
tctccaggaagccctccctgac

SEQ ID NO: 9361826 - DNA, 22 bp, Homo sapiens
tctccaggaaagacactggact

SEQ ID NO: 9361827 - DNA, 19 bp, Homo sapiens
tctccagctttgggctttt

SEQ ID NO: 9361828 - DNA, 21 bp, Homo sapiens
tctccagagtgggaggaaatc

SEQ ID NO: 9361829 - DNA, 22 bp, Homo sapiens
tctccagagtaaccttggagca

SEQ ID NO: 9361830 - DNA, 21 bp, Homo sapiens
tctccagagtgggaggaaatc

SEQ ID NO: 9361831 - DNA, 22 bp, Homo sapiens
tctccagaggtcccttgtctct

SEQ ID NO: 9361832 - DNA, 21 bp, Homo sapiens
ccagagagagggaagtgggtt

SEQ ID NO: 9361833 - DNA, 22 bp, Homo sapiens
ccagagagctacaaggcataaa

SEQ ID NO: 9361834 - DNA, 22 bp, Homo sapiens
ccagagagctacaaggcataaa

SEQ ID NO: 9361835 - DNA, 22 bp, Homo sapiens
tctccacactttctctcccagg

SEQ ID NO: 9361836 - DNA, 22 bp, Homo sapiens
tctccacagtcccacctcgctt

SEQ ID NO: 9361837 - DNA, 22 bp, Homo sapiens
tctccactattttctagctctt

SEQ ID NO: 9361838 - DNA, 20 bp, Homo sapiens
tctccaccacagagagcaga

SEQ ID NO: 9361839 - DNA, 22 bp, Homo sapiens
tctccacaagctttctcctttt

SEQ ID NO: 9361840 - DNA, 22 bp, Homo sapiens
tctccacaagctttctcctttt

SEQ ID NO: 9361841 - DNA, 22 bp, Homo sapiens
ccacttttgggaacagtgagta

SEQ ID NO: 9361842 - DNA, 22 bp, Homo sapiens
ccactttttagagaacaaaact

SEQ ID NO: 9361843 - DNA, 22 bp, Homo sapiens
ccacttttttctccatctctga

SEQ ID NO: 9361844 - DNA, 22 bp, Homo sapiens
ccactttttcagtgtgcatgca

SEQ ID NO: 9361845 - DNA, 22 bp, Homo sapiens
ccactttttagagaacaaaact

SEQ ID NO: 9361846 - DNA, 22 bp, Homo sapiens
ccacttttcactaagatgaatt

SEQ ID NO: 9361847 - DNA, 22 bp, Homo sapiens
ccacttttctacccactgtgac

SEQ ID NO: 9361848 - DNA, 22 bp, Homo sapiens
ccacttttcactaagatgaatt

SEQ ID NO: 9361849 - DNA, 22 bp, Homo sapiens
tctcaaatttgttagataaaat

SEQ ID NO: 9361850 - DNA, 22 bp, Homo sapiens
tctcaaattcccttttcctcct

SEQ ID NO: 9361851 - DNA, 22 bp, Homo sapiens
tctcaaatttgctggaccagta

SEQ ID NO: 9361852 - DNA, 22 bp, Homo sapiens
tctcaaatttatacagagttca

SEQ ID NO: 9361853 - DNA, 22 bp, Homo sapiens
tctcaagctagtgtttatagta

SEQ ID NO: 9361854 - DNA, 22 bp, Homo sapiens
tctcaagcttgttggtatgttt

SEQ ID NO: 9361855 - DNA, 22 bp, Homo sapiens
tctcaagagggaggcaatcatg

SEQ ID NO: 9361856 - DNA, 22 bp, Homo sapiens
tctcaagactggttttcacagc

SEQ ID NO: 9361857 - DNA, 22 bp, Homo sapiens
ccacctccacctattgccagcc

SEQ ID NO: 9361858 - DNA, 22 bp, Homo sapiens
ccacctccacctattgccagcc

SEQ ID NO: 9361859 - DNA, 22 bp, Homo sapiens
ccacctcctaggcctggagaag

SEQ ID NO: 9361860 - DNA, 22 bp, Homo sapiens
ccacctcctaggcctggagaag

SEQ ID NO: 9361861 - DNA, 22 bp, Homo sapiens
ccacctctcagggtttcctaat

SEQ ID NO: 9361862 - DNA, 22 bp, Homo sapiens
ccacctcctcggccatgtgacg

SEQ ID NO: 9361863 - DNA, 22 bp, Homo sapiens
ccacctcctcggccatgtgacg

SEQ ID NO: 9361864 - DNA, 22 bp, Homo sapiens
ccacctctgagcccaaaccctg

SEQ ID NO: 9361865 - DNA, 22 bp, Homo sapiens
tctatagtttctgagtttcttc

SEQ ID NO: 9361866 - DNA, 22 bp, Homo sapiens
tctatataacctccacttctac

SEQ ID NO: 9361867 - DNA, 22 bp, Homo sapiens
tctatagtgtagataatttgaa

SEQ ID NO: 9361868 - DNA, 22 bp, Homo sapiens
tctcaaatgtaaagcatgattt

SEQ ID NO: 9361869 - DNA, 22 bp, Homo sapiens
tctcaaatgtaaagcatgattt

SEQ ID NO: 9361870 - DNA, 22 bp, Homo sapiens
tccacaggtatttctccttgct

SEQ ID NO: 9361871 - DNA, 22 bp, Homo sapiens
tccacaggtatttctccttgct

SEQ ID NO: 9361872 - DNA, 22 bp, Homo sapiens
tccacaggtatgaggccccacc

SEQ ID NO: 9361873 - DNA, 22 bp, Homo sapiens
tccacagggcctttctggtgtg

SEQ ID NO: 9361874 - DNA, 22 bp, Homo sapiens
tccacagtctatttttagtcta

SEQ ID NO: 9361875 - DNA, 22 bp, Homo sapiens
tccacagggcctttctggtgtg

SEQ ID NO: 9361876 - DNA, 22 bp, Homo sapiens
tccacagggcctttctggtgtg

SEQ ID NO: 9361877 - DNA, 22 bp, Homo sapiens
tcatttatttataccattgcct

SEQ ID NO: 9361878 - DNA, 22 bp, Homo sapiens
tcatttatttgactttggagtg

SEQ ID NO: 9361879 - DNA, 22 bp, Homo sapiens
tcatttatttataccattgcct

SEQ ID NO: 9361880 - DNA, 22 bp, Homo sapiens
tcatttatttataccattgcct

SEQ ID NO: 9361881 - DNA, 22 bp, Homo sapiens
tcatttatttgactttggagtg

SEQ ID NO: 9361882 - DNA, 22 bp, Homo sapiens
tccacatagtcattaatttctg

SEQ ID NO: 9361883 - DNA, 22 bp, Homo sapiens
tccacatccattgcttgacttt

SEQ ID NO: 9361884 - DNA, 22 bp, Homo sapiens
tccacagtggttgaactagttt

SEQ ID NO: 9361885 - DNA, 22 bp, Homo sapiens
tccacagttttgccactagctg

SEQ ID NO: 9361886 - DNA, 22 bp, Homo sapiens
tccacagtggttgaactagtaa

SEQ ID NO: 9361887 - DNA, 22 bp, Homo sapiens
tccagaccaaggaaggctgggc

SEQ ID NO: 9361888 - DNA, 22 bp, Homo sapiens
tccagaccatgtgagaggcgca

SEQ ID NO: 9361889 - DNA, 22 bp, Homo sapiens
tccagaccatggatggctgcaa

SEQ ID NO: 9361890 - DNA, 22 bp, Homo sapiens
tcatttatgcaggaatggcata

SEQ ID NO: 9361891 - DNA, 22 bp, Homo sapiens
tcatttatgtctttgccatcca

SEQ ID NO: 9361892 - DNA, 22 bp, Homo sapiens
tcatttatgtctttgccatcca

SEQ ID NO: 9361893 - DNA, 21 bp, Homo sapiens
tcatttattgagaaatgactg

SEQ ID NO: 9361894 - DNA, 21 bp, Homo sapiens
tcatttattgagaaatgactg

SEQ ID NO: 9361895 - DNA, 21 bp, Homo sapiens
tcatttattgagaaatgactg

SEQ ID NO: 9361896 - DNA, 21 bp, Homo sapiens
tcatttattgagaaatgactg

SEQ ID NO: 9361897 - DNA, 21 bp, Homo sapiens
tcatttattgagaaatgactg

SEQ ID NO: 9361898 - DNA, 21 bp, Homo sapiens
tcatttattgagaaatgactg

SEQ ID NO: 9361899 - DNA, 22 bp, Homo sapiens
tcatttatcgctgccttttaaa

SEQ ID NO: 9361900 - DNA, 22 bp, Homo sapiens
tcatttatcgctgccttttaaa

SEQ ID NO: 9361901 - DNA, 22 bp, Homo sapiens
tcatttatcgctgccttttaaa

SEQ ID NO: 9361902 - DNA, 22 bp, Homo sapiens
tcatttatcgctgccttttaaa

SEQ ID NO: 9361903 - DNA, 22 bp, Homo sapiens
tcatttatcatttgtgctgtag

SEQ ID NO: 9361904 - DNA, 22 bp, Homo sapiens
tcatttatcatttgtgctgtag

SEQ ID NO: 9361905 - DNA, 22 bp, Homo sapiens
tcatttatcatttgtgctgtag

SEQ ID NO: 9361906 - DNA, 22 bp, Homo sapiens
tcatttatcgctgccttttaaa

SEQ ID NO: 9361907 - DNA, 22 bp, Homo sapiens
tcatttatcgctgccttttaaa

SEQ ID NO: 9361908 - DNA, 22 bp, Homo sapiens
tcatttatgcaggaatggcata

SEQ ID NO: 9361909 - DNA, 22 bp, Homo sapiens
tcatttatgcaggaatggcata

SEQ ID NO: 9361910 - DNA, 22 bp, Homo sapiens
tcatttatgcaggaatggcata

SEQ ID NO: 9361911 - DNA, 22 bp, Homo sapiens
tcattcttgatcactagttagt

SEQ ID NO: 9361912 - DNA, 22 bp, Homo sapiens
tcattctgcatcactcttgctc

SEQ ID NO: 9361913 - DNA, 22 bp, Homo sapiens
tcattctgcatcactcttgctc

SEQ ID NO: 9361914 - DNA, 22 bp, Homo sapiens
tcattccctcattgttcactgg

SEQ ID NO: 9361915 - DNA, 22 bp, Homo sapiens
cataaattgtacccattccaac

SEQ ID NO: 9361916 - DNA, 22 bp, Homo sapiens
tcatcatcattctcccccactt

SEQ ID NO: 9361917 - DNA, 22 bp, Homo sapiens
tcatcatccttttttgaagagt

SEQ ID NO: 9361918 - DNA, 22 bp, Homo sapiens
tcatcatcactctggcaagcat

SEQ ID NO: 9361919 - DNA, 21 bp, Homo sapiens
tcatgaagcatcacttctgcc

SEQ ID NO: 9361920 - DNA, 20 bp, Homo sapiens
tcatgaagcctacaaacatc

SEQ ID NO: 9361921 - DNA, 22 bp, Homo sapiens
tcatgaagtccaaactaaagca

SEQ ID NO: 9361922 - DNA, 22 bp, Homo sapiens
tcatgaatcgtggaatgattta

SEQ ID NO: 9361923 - DNA, 22 bp, Homo sapiens
tcatgaatattgaatgcttcat

SEQ ID NO: 9361924 - DNA, 22 bp, Homo sapiens
tcatgagtttaaggtttaggct

SEQ ID NO: 9361925 - DNA, 22 bp, Homo sapiens
tcatgattaacatttccaagca

SEQ ID NO: 9361926 - DNA, 22 bp, Homo sapiens
tcatgattcttctaccacagca

SEQ ID NO: 9361927 - DNA, 22 bp, Homo sapiens
tcatgatttttctttacagttg

SEQ ID NO: 9361928 - DNA, 22 bp, Homo sapiens
tcatgatttttctttacagttg

SEQ ID NO: 9361929 - DNA, 22 bp, Homo sapiens
tcatgattggaatggaatatgt

SEQ ID NO: 9361930 - DNA, 22 bp, Homo sapiens
tcatgcaagaataataggaagg

SEQ ID NO: 9361931 - DNA, 22 bp, Homo sapiens
tcatgcaagaataataggaagg

SEQ ID NO: 9361932 - DNA, 22 bp, Homo sapiens
catgaaaaatttactgttaaca

SEQ ID NO: 9361933 - DNA, 23 bp, Homo sapiens
tcattccacaaatacttatctag

SEQ ID NO: 9361934 - DNA, 20 bp, Homo sapiens
tcattccaaatagttcagca

SEQ ID NO: 9361935 - DNA, 23 bp, Homo sapiens
tcattccacaaatacttatctag

SEQ ID NO: 9361936 - DNA, 22 bp, Homo sapiens
tcattcattcatccagcttgag

SEQ ID NO: 9361937 - DNA, 18 bp, Homo sapiens
tcattcattaaacttggc

SEQ ID NO: 9361938 - DNA, 22 bp, Homo sapiens
tcattcatttgctcactccaca

SEQ ID NO: 9361939 - DNA, 22 bp, Homo sapiens
tcattcatctggtgttagtcct

SEQ ID NO: 9361940 - DNA, 22 bp, Homo sapiens
tcattcatatctctcaagctta

SEQ ID NO: 9361941 - DNA, 21 bp, Homo sapiens
tcatgtgctgaggatgatgcc

SEQ ID NO: 9361942 - DNA, 23 bp, Homo sapiens
tcatgtggaaaaggatctggtct

SEQ ID NO: 9361943 - DNA, 22 bp, Homo sapiens
catctttgggctgcatggaagg

SEQ ID NO: 9361944 - DNA, 22 bp, Homo sapiens
tcatgcactacataacgatgtt

SEQ ID NO: 9361945 - DNA, 22 bp, Homo sapiens
catgtgttttgtcatttcaata

SEQ ID NO: 9361946 - DNA, 22 bp, Homo sapiens
catgtgtttcgagactgttgag

SEQ ID NO: 9361947 - DNA, 22 bp, Homo sapiens
catgtgtttcgagactgttgag

SEQ ID NO: 9361948 - DNA, 22 bp, Homo sapiens
catgtgtgtggctgacaatttt

SEQ ID NO: 9361949 - DNA, 22 bp, Homo sapiens
catgtgttgtctcatttaatcc

SEQ ID NO: 9361950 - DNA, 18 bp, Homo sapiens
catgtgttctacatcagt

SEQ ID NO: 9361951 - DNA, 22 bp, Homo sapiens
catgtgtgtccatgtgactaag

SEQ ID NO: 9361952 - DNA, 22 bp, Homo sapiens
catgtgtggttacctacttgac

SEQ ID NO: 9361953 - DNA, 22 bp, Homo sapiens
catgtgtccacccttgaacaca

SEQ ID NO: 9361954 - DNA, 21 bp, Homo sapiens
catgtgtcattggagagcaat

SEQ ID NO: 9361955 - DNA, 20 bp, Homo sapiens
catgtgtcagttctcaccca

SEQ ID NO: 9361956 - DNA, 22 bp, Homo sapiens
catgtgtgtctccaccagctgc

SEQ ID NO: 9361957 - DNA, 22 bp, Homo sapiens
catgtgtgtgagggaaacatgt

SEQ ID NO: 9361958 - DNA, 18 bp, Homo sapiens
tccaggctccaggctaac

SEQ ID NO: 9361959 - DNA, 18 bp, Homo sapiens
tccaggctccaggctaac

SEQ ID NO: 9361960 - DNA, 22 bp, Homo sapiens
tccaggctcagtcaagcacttc

SEQ ID NO: 9361961 - DNA, 22 bp, Homo sapiens
tccaggctcagtcaagcacttc

SEQ ID NO: 9361962 - DNA, 18 bp, Homo sapiens
tccaggctccaggctaac

SEQ ID NO: 9361963 - DNA, 19 bp, Homo sapiens
tccaggctccattggcaga

SEQ ID NO: 9361964 - DNA, 22 bp, Homo sapiens
tccaggctcccctgcgtgctcc

SEQ ID NO: 9361965 - DNA, 22 bp, Homo sapiens
tccaggctcccctgcgtgctcc

SEQ ID NO: 9361966 - DNA, 22 bp, Homo sapiens
tccaggctcccctgcgtgctcc

SEQ ID NO: 9361967 - DNA, 20 bp, Homo sapiens
tccaggctcctccacttagt

SEQ ID NO: 9361968 - DNA, 20 bp, Homo sapiens
catgtgtcagttctcaccca

SEQ ID NO: 9361969 - DNA, 21 bp, Homo sapiens
catgtgtcattggagagcaat

SEQ ID NO: 9361970 - DNA, 22 bp, Homo sapiens
tccaggctccctcaggatgcac

SEQ ID NO: 9361971 - DNA, 22 bp, Homo sapiens
tccaggctccctcaggatgcac

SEQ ID NO: 9361972 - DNA, 22 bp, Homo sapiens
tccaggctccctcaggatgcac

SEQ ID NO: 9361973 - DNA, 22 bp, Homo sapiens
tccaggccccagaccgtactgc

SEQ ID NO: 9361974 - DNA, 22 bp, Homo sapiens
tccaggccccagaccgtactgc

SEQ ID NO: 9361975 - DNA, 22 bp, Homo sapiens
tccaggccccccacgctaatgg

SEQ ID NO: 9361976 - DNA, 22 bp, Homo sapiens
tccaggccccccacgctaatgg

SEQ ID NO: 9361977 - DNA, 22 bp, Homo sapiens
tccaggccccagcaccttggga

SEQ ID NO: 9361978 - DNA, 22 bp, Homo sapiens
tccaggccccagcaccttggga

SEQ ID NO: 9361979 - DNA, 22 bp, Homo sapiens
tccaggcccctgcctgggcctg

SEQ ID NO: 9361980 - DNA, 22 bp, Homo sapiens
tccaggcccctgcctgggcctg

SEQ ID NO: 9361981 - DNA, 22 bp, Homo sapiens
tccaggcccgagatgggctgga

SEQ ID NO: 9361982 - DNA, 22 bp, Homo sapiens
tccaggcccgagatgggctgga

SEQ ID NO: 9361983 - DNA, 22 bp, Homo sapiens
tccaggctcagtcaagcacttc

SEQ ID NO: 9361984 - DNA, 22 bp, Homo sapiens
tccaggcccatggagcagagct

SEQ ID NO: 9361985 - DNA, 22 bp, Homo sapiens
tccaggccccactgaagcccct

SEQ ID NO: 9361986 - DNA, 22 bp, Homo sapiens
tccaggccccactgaagcccct

SEQ ID NO: 9361987 - DNA, 22 bp, Homo sapiens
tccaggccccactgaagcccct

SEQ ID NO: 9361988 - DNA, 22 bp, Homo sapiens
tccaggcccatggagcagagct

SEQ ID NO: 9361989 - DNA, 22 bp, Homo sapiens
tccaggcccatggagcagagct

SEQ ID NO: 9361990 - DNA, 22 bp, Homo sapiens
tccaggcccatagacacttctc

SEQ ID NO: 9361991 - DNA, 22 bp, Homo sapiens
tccaggcagcccttcctgactc

SEQ ID NO: 9361992 - DNA, 20 bp, Homo sapiens
tccagctgggaacagctgat

SEQ ID NO: 9361993 - DNA, 22 bp, Homo sapiens
tccagctggcttcggaagtgga

SEQ ID NO: 9361994 - DNA, 22 bp, Homo sapiens
tccagctggcccggccatgaat

SEQ ID NO: 9361995 - DNA, 22 bp, Homo sapiens
tccagcctaatgttcttcccac

SEQ ID NO: 9361996 - DNA, 22 bp, Homo sapiens
tccagcctaggggaacagctgc

SEQ ID NO: 9361997 - DNA, 22 bp, Homo sapiens
tccagcctcatttctcctgctt

SEQ ID NO: 9361998 - DNA, 22 bp, Homo sapiens
tccagcctcatttctcctgctt

SEQ ID NO: 9361999 - DNA, 22 bp, Homo sapiens
tccagcctcctatttaccctaa

SEQ ID NO: 9362000 - DNA, 22 bp, Homo sapiens
tccagcctcctatttaccctaa

SEQ ID NO: 9362001 - DNA, 17 bp, Homo sapiens
tccagcctcctctgctg

SEQ ID NO: 9362002 - DNA, 17 bp, Homo sapiens
tccagcctcctctgctg

SEQ ID NO: 9362003 - DNA, 22 bp, Homo sapiens
tccagctcttcagttctgcaaa

SEQ ID NO: 9362004 - DNA, 22 bp, Homo sapiens
tccagctgacatctcctgaggg

SEQ ID NO: 9362005 - DNA, 22 bp, Homo sapiens
tccagctgaggtggcctctgtg

SEQ ID NO: 9362006 - DNA, 22 bp, Homo sapiens
tccagctgaggtggcctctgtg

SEQ ID NO: 9362007 - DNA, 20 bp, Homo sapiens
tccagctgacattctctttc

SEQ ID NO: 9362008 - DNA, 22 bp, Homo sapiens
tccagctgcaaggggcacagct

SEQ ID NO: 9362009 - DNA, 22 bp, Homo sapiens
tccagctgcaaggggcacagct

SEQ ID NO: 9362010 - DNA, 23 bp, Homo sapiens
tccagctgcagtgggatggggaa

SEQ ID NO: 9362011 - DNA, 21 bp, Homo sapiens
tccagctgcacaagcatgggg

SEQ ID NO: 9362012 - DNA, 22 bp, Homo sapiens
tccagctgctgacccagtagcc

SEQ ID NO: 9362013 - DNA, 22 bp, Homo sapiens
tccagctgctgccagccaagct

SEQ ID NO: 9362014 - DNA, 22 bp, Homo sapiens
tccagccctgtggcttccaccc

SEQ ID NO: 9362015 - DNA, 22 bp, Homo sapiens
tccagccctgtggcttccaccc

SEQ ID NO: 9362016 - DNA, 22 bp, Homo sapiens
tccagccctgtgtctgggagag

SEQ ID NO: 9362017 - DNA, 22 bp, Homo sapiens
tccagccctgtgtctgggagag

SEQ ID NO: 9362018 - DNA, 22 bp, Homo sapiens
tccagccctgtgtctgggagag

SEQ ID NO: 9362019 - DNA, 19 bp, Homo sapiens
tccagccctgttccctttt

SEQ ID NO: 9362020 - DNA, 22 bp, Homo sapiens
tccagcccagctgtccccttca

SEQ ID NO: 9362021 - DNA, 22 bp, Homo sapiens
tccagcccagctgtccccttca

SEQ ID NO: 9362022 - DNA, 22 bp, Homo sapiens
tcctctccatattttctgattt

SEQ ID NO: 9362023 - DNA, 21 bp, Homo sapiens
tcctctccatgatctgtttgt

SEQ ID NO: 9362024 - DNA, 22 bp, Homo sapiens
tcctcccctcagggcaacggat

SEQ ID NO: 9362025 - DNA, 22 bp, Homo sapiens
tcctcaggctgcctggaagact

SEQ ID NO: 9362026 - DNA, 22 bp, Homo sapiens
tcctcagggaagatgagcctca

SEQ ID NO: 9362027 - DNA, 20 bp, Homo sapiens
catttgggatcatgaggttt

SEQ ID NO: 9362028 - DNA, 22 bp, Homo sapiens
tcctagaaggatcattctagtg

SEQ ID NO: 9362029 - DNA, 18 bp, Homo sapiens
tcctcagcctcacctagc

SEQ ID NO: 9362030 - DNA, 22 bp, Homo sapiens
tccctcactggttctgcatccc

SEQ ID NO: 9362031 - DNA, 22 bp, Homo sapiens
tccctcagaaattctctctgaa

SEQ ID NO: 9362032 - DNA, 22 bp, Homo sapiens
tccctcagaaattctctctgaa

SEQ ID NO: 9362033 - DNA, 22 bp, Homo sapiens
tccctaggtcctagtcacagta

SEQ ID NO: 9362034 - DNA, 22 bp, Homo sapiens
tcctcagctttggtttactcat

SEQ ID NO: 9362035 - DNA, 22 bp, Homo sapiens
tcctcaggatctaggagtgctt

SEQ ID NO: 9362036 - DNA, 22 bp, Homo sapiens
tcctcaggatgtggagtagaat

SEQ ID NO: 9362037 - DNA, 22 bp, Homo sapiens
tcctcaggcggtgaggaggggc

SEQ ID NO: 9362038 - DNA, 22 bp, Homo sapiens
tccccagaggtgaggcagcttt

SEQ ID NO: 9362039 - DNA, 22 bp, Homo sapiens
tccccagaggtgaggcagcttt

SEQ ID NO: 9362040 - DNA, 22 bp, Homo sapiens
tccccagaggaatatgagattg

SEQ ID NO: 9362041 - DNA, 19 bp, Homo sapiens
tccccagcacctctgagtc

SEQ ID NO: 9362042 - DNA, 19 bp, Homo sapiens
tccccagcacctctgagtc

SEQ ID NO: 9362043 - DNA, 19 bp, Homo sapiens
tccccagcacctctgagtc

SEQ ID NO: 9362044 - DNA, 22 bp, Homo sapiens
tccccagatgacatcaaaaggc

SEQ ID NO: 9362045 - DNA, 22 bp, Homo sapiens
tccccagatggccagctacatg

SEQ ID NO: 9362046 - DNA, 22 bp, Homo sapiens
tcccgttgatgacggtgcatcc

SEQ ID NO: 9362047 - DNA, 22 bp, Homo sapiens
tcccgtaggttgctgtagtcgg

SEQ ID NO: 9362048 - DNA, 22 bp, Homo sapiens
tccccaggaaattctgattctt

SEQ ID NO: 9362049 - DNA, 22 bp, Homo sapiens
tccccagcttgctacttctgct

SEQ ID NO: 9362050 - DNA, 22 bp, Homo sapiens
tccctagcttatttgtgctcta

SEQ ID NO: 9362051 - DNA, 22 bp, Homo sapiens
tccctaggagaattgccgcagc

SEQ ID NO: 9362052 - DNA, 22 bp, Homo sapiens
tccctaggagaattgccgcagc

SEQ ID NO: 9362053 - DNA, 22 bp, Homo sapiens
tccccagctctgtgcttccact

SEQ ID NO: 9362054 - DNA, 22 bp, Homo sapiens
tccccagccgtgaaggagagga

SEQ ID NO: 9362055 - DNA, 22 bp, Homo sapiens
cattgaaagagataaagccttt

SEQ ID NO: 9362056 - DNA, 22 bp, Homo sapiens
cattgcacatctgagaagagat

SEQ ID NO: 9362057 - DNA, 22 bp, Homo sapiens
tcccagggtcctcttctggaat

SEQ ID NO: 9362058 - DNA, 22 bp, Homo sapiens
cattgattatggaaagcagtgg

SEQ ID NO: 9362059 - DNA, 22 bp, Homo sapiens
cattgcaacttcaaactcctgg

SEQ ID NO: 9362060 - DNA, 22 bp, Homo sapiens
cattgagaatctgggctacagc

SEQ ID NO: 9362061 - DNA, 22 bp, Homo sapiens
cattgagagaatcacatagaag

SEQ ID NO: 9362062 - DNA, 22 bp, Homo sapiens
cattcagtcatgctggttttga

SEQ ID NO: 9362063 - DNA, 22 bp, Homo sapiens
cattcattacactcataaggtt

SEQ ID NO: 9362064 - DNA, 22 bp, Homo sapiens
cattcattagaatagatatgta

SEQ ID NO: 9362065 - DNA, 22 bp, Homo sapiens
cattcattagaatagatatgta

SEQ ID NO: 9362066 - DNA, 22 bp, Homo sapiens
cattcagagctttcttatcata

SEQ ID NO: 9362067 - DNA, 22 bp, Homo sapiens
cattcaggtacactcagtgcta

SEQ ID NO: 9362068 - DNA, 22 bp, Homo sapiens
cattcacaaaaccacatgccat

SEQ ID NO: 9362069 - DNA, 22 bp, Homo sapiens
cattcacagagggggaagcatc

SEQ ID NO: 9362070 - DNA, 22 bp, Homo sapiens
cattcacaaagctgattgatgg

SEQ ID NO: 9362071 - DNA, 22 bp, Homo sapiens
cattcacaatagttgaaaggtg

SEQ ID NO: 9362072 - DNA, 19 bp, Homo sapiens
catgttatgctgtagtatc

SEQ ID NO: 9362073 - DNA, 19 bp, Homo sapiens
catgttatgctgtagtatc

SEQ ID NO: 9362074 - DNA, 22 bp, Homo sapiens
catgttaagtgtttgataacca

SEQ ID NO: 9362075 - DNA, 22 bp, Homo sapiens
catgttaagtgtttgataacca

SEQ ID NO: 9362076 - DNA, 22 bp, Homo sapiens
catgttctaatattgtgacata

SEQ ID NO: 9362077 - DNA, 22 bp, Homo sapiens
cattatattacagcactgttaa

SEQ ID NO: 9362078 - DNA, 22 bp, Homo sapiens
cattatattttactgcatggga

SEQ ID NO: 9362079 - DNA, 22 bp, Homo sapiens
catgtttctgagaaaagtagga

SEQ ID NO: 9362080 - DNA, 22 bp, Homo sapiens
catgtttctgagaaaagtagga

SEQ ID NO: 9362081 - DNA, 22 bp, Homo sapiens
catgtttgtacaaaggtacaca

SEQ ID NO: 9362082 - DNA, 22 bp, Homo sapiens
catgtttaattgcgatgtttga

SEQ ID NO: 9362083 - DNA, 22 bp, Homo sapiens
catgtttaattgcgatgtttga

SEQ ID NO: 9362084 - DNA, 22 bp, Homo sapiens
tcccaggacatgggctctgctc

SEQ ID NO: 9362085 - DNA, 22 bp, Homo sapiens
tcccaggacatgggctctgctc

SEQ ID NO: 9362086 - DNA, 22 bp, Homo sapiens
tcccaggacaggccacatggaa

SEQ ID NO: 9362087 - DNA, 22 bp, Homo sapiens
tcccaggacaggccacatggaa

SEQ ID NO: 9362088 - DNA, 22 bp, Homo sapiens
tcccagcccagacttctccagt

SEQ ID NO: 9362089 - DNA, 22 bp, Homo sapiens
tcccagccaggctctaccactt

SEQ ID NO: 9362090 - DNA, 22 bp, Homo sapiens
cattcattcagcaactgttatt

SEQ ID NO: 9362091 - DNA, 22 bp, Homo sapiens
cattcattcacattttgtctat

SEQ ID NO: 9362092 - DNA, 22 bp, Homo sapiens
cattcattcacattttgtctat

SEQ ID NO: 9362093 - DNA, 22 bp, Homo sapiens
cattcattcagcaactgttatt

SEQ ID NO: 9362094 - DNA, 22 bp, Homo sapiens
cattcatttactttcaacagct

SEQ ID NO: 9362095 - DNA, 22 bp, Homo sapiens
cattcatttactttcaacagct

SEQ ID NO: 9362096 - DNA, 22 bp, Homo sapiens
cattcatttatgaaatatctat

SEQ ID NO: 9362097 - DNA, 22 bp, Homo sapiens
cattcattctgtaagtaactat

SEQ ID NO: 9362098 - DNA, 21 bp, Homo sapiens
tcccactctaaatggactgaa

SEQ ID NO: 9362099 - DNA, 21 bp, Homo sapiens
tcccactctaaatggactgaa

SEQ ID NO: 9362100 - DNA, 22 bp, Homo sapiens
tcccagagctctgacaccagct

SEQ ID NO: 9362101 - DNA, 22 bp, Homo sapiens
tcccagagctctgacaccagct

SEQ ID NO: 9362102 - DNA, 22 bp, Homo sapiens
tcccagagcctctgccactctg

SEQ ID NO: 9362103 - DNA, 22 bp, Homo sapiens
tcccagagctgataagccttta

SEQ ID NO: 9362104 - DNA, 22 bp, Homo sapiens
tcccagaggaaatggcagctga

SEQ ID NO: 9362105 - DNA, 22 bp, Homo sapiens
tttcacagcgtctttctcttgc

SEQ ID NO: 9362106 - DNA, 22 bp, Homo sapiens
tttcacagcagtgtgctgcttt

SEQ ID NO: 9362107 - DNA, 22 bp, Homo sapiens
tttcacagcatataggtgtact

SEQ ID NO: 9362108 - DNA, 22 bp, Homo sapiens
tttcacagcagtgtgctgcttt

SEQ ID NO: 9362109 - DNA, 22 bp, Homo sapiens
tttcacagctagtgagcttcta

SEQ ID NO: 9362110 - DNA, 22 bp, Homo sapiens
tttcacagcgtctttctcttgc

SEQ ID NO: 9362111 - DNA, 22 bp, Homo sapiens
tttcacagctgggaagagatat

SEQ ID NO: 9362112 - DNA, 22 bp, Homo sapiens
tttcacagctgtcttccgtctc

SEQ ID NO: 9362113 - DNA, 22 bp, Homo sapiens
tttcacagctgtcttccgtctc

SEQ ID NO: 9362114 - DNA, 22 bp, Homo sapiens
tttcacagctgggtggcagagt

SEQ ID NO: 9362115 - DNA, 22 bp, Homo sapiens
tttcacagctgggtggcagagt

SEQ ID NO: 9362116 - DNA, 22 bp, Homo sapiens
tttcacagctgggtggcagagt

SEQ ID NO: 9362117 - DNA, 22 bp, Homo sapiens
tttcacattttatacttaagcc

SEQ ID NO: 9362118 - DNA, 23 bp, Homo sapiens
tttcacagcttttattctgcatc

SEQ ID NO: 9362119 - DNA, 23 bp, Homo sapiens
tttcacagcttttattctgcatc

SEQ ID NO: 9362120 - DNA, 22 bp, Homo sapiens
tttcaccaaggtaacctttgat

SEQ ID NO: 9362121 - DNA, 22 bp, Homo sapiens
tttcaccatcttggccaggctg

SEQ ID NO: 9362122 - DNA, 20 bp, Homo sapiens
tttcaccatcttggccaggc

SEQ ID NO: 9362123 - DNA, 22 bp, Homo sapiens
tttcaccacagaggcaagacaa

SEQ ID NO: 9362124 - DNA, 20 bp, Homo sapiens
tttcactggcttgataaggt

SEQ ID NO: 9362125 - DNA, 20 bp, Homo sapiens
tttcactgtggtgctggaga

SEQ ID NO: 9362126 - DNA, 22 bp, Homo sapiens
tttcactgtgttggtcaggccg

SEQ ID NO: 9362127 - DNA, 22 bp, Homo sapiens
tttcagactgctgtgtgaaact

SEQ ID NO: 9362128 - DNA, 22 bp, Homo sapiens
tttcagactcatctcaagcttt

SEQ ID NO: 9362129 - DNA, 22 bp, Homo sapiens
tttcagactcatctcaagcttt

SEQ ID NO: 9362130 - DNA, 22 bp, Homo sapiens
tttcagagaattagaagctgat

SEQ ID NO: 9362131 - DNA, 22 bp, Homo sapiens
tttcagagaattagaagctgat

SEQ ID NO: 9362132 - DNA, 22 bp, Homo sapiens
tttcagagatgtctagcctatt

SEQ ID NO: 9362133 - DNA, 22 bp, Homo sapiens
tttcagaaaacttatcatcagt

SEQ ID NO: 9362134 - DNA, 22 bp, Homo sapiens
tttcagaaacgattatgaacac

SEQ ID NO: 9362135 - DNA, 22 bp, Homo sapiens
tttcagaaagcatcatcaaagt

SEQ ID NO: 9362136 - DNA, 22 bp, Homo sapiens
tttcagaaatggcactgaaatc

SEQ ID NO: 9362137 - DNA, 22 bp, Homo sapiens
tttcagaaatcaaaaccagggt

SEQ ID NO: 9362138 - DNA, 22 bp, Homo sapiens
tttcagaaagctgaacatatga

SEQ ID NO: 9362139 - DNA, 22 bp, Homo sapiens
tttcatgagattcctccacatc

SEQ ID NO: 9362140 - DNA, 22 bp, Homo sapiens
tttcatcttccttggcataggt

SEQ ID NO: 9362141 - DNA, 22 bp, Homo sapiens
tttcagagctcagcagctagag

SEQ ID NO: 9362142 - DNA, 22 bp, Homo sapiens
tttcatgctcatggaacacagc

SEQ ID NO: 9362143 - DNA, 22 bp, Homo sapiens
tttcatgtggcgatgtctctgg

SEQ ID NO: 9362144 - DNA, 22 bp, Homo sapiens
tttcatgtgcaattagcaatat

SEQ ID NO: 9362145 - DNA, 22 bp, Homo sapiens
tttcatgtgttgaatgtgtaca

SEQ ID NO: 9362146 - DNA, 22 bp, Homo sapiens
tttcatgtatttcccaaagctt

SEQ ID NO: 9362147 - DNA, 22 bp, Homo sapiens
tttcatgtatttcccaaagctt

SEQ ID NO: 9362148 - DNA, 22 bp, Homo sapiens
tttcatgtacttttttgataga

SEQ ID NO: 9362149 - DNA, 22 bp, Homo sapiens
tttcatgtcattccatttcaga

SEQ ID NO: 9362150 - DNA, 22 bp, Homo sapiens
tttcatgtctgaattctttagt

SEQ ID NO: 9362151 - DNA, 22 bp, Homo sapiens
tttcattatgttcctggaagag

SEQ ID NO: 9362152 - DNA, 22 bp, Homo sapiens
tttcattcatgtgttaaaggtg

SEQ ID NO: 9362153 - DNA, 21 bp, Homo sapiens
tttcattgaatgagataaggt

SEQ ID NO: 9362154 - DNA, 22 bp, Homo sapiens
tttcattgaactaaagaatctg

SEQ ID NO: 9362155 - DNA, 22 bp, Homo sapiens
tttcattcattatacagtagag

SEQ ID NO: 9362156 - DNA, 22 bp, Homo sapiens
tttcattgagaatataagattt

SEQ ID NO: 9362157 - DNA, 22 bp, Homo sapiens
tttcattgacagttgggggaaa

SEQ ID NO: 9362158 - DNA, 21 bp, Homo sapiens
tttcattgaatgagataaggt

SEQ ID NO: 9362159 - DNA, 21 bp, Homo sapiens
tttcattgaatgagataaggt

SEQ ID NO: 9362160 - DNA, 22 bp, Homo sapiens
tttcattgagactatagacatc

SEQ ID NO: 9362161 - DNA, 22 bp, Homo sapiens
tttcattgatgggtgatagaaa

SEQ ID NO: 9362162 - DNA, 21 bp, Homo sapiens
tttcccagcagagatagctgg

SEQ ID NO: 9362163 - DNA, 19 bp, Homo sapiens
tttcccagcccttgctgtg

SEQ ID NO: 9362164 - DNA, 19 bp, Homo sapiens
tttcccagcccttgctgtg

SEQ ID NO: 9362165 - DNA, 22 bp, Homo sapiens
tttcccaggctggaatgcagtg

SEQ ID NO: 9362166 - DNA, 19 bp, Homo sapiens
tttcccagtcccaggagtg

SEQ ID NO: 9362167 - DNA, 22 bp, Homo sapiens
tttcccaggccctcagggctgc

SEQ ID NO: 9362168 - DNA, 22 bp, Homo sapiens
tttcccagcctcctttgcagct

SEQ ID NO: 9362169 - DNA, 22 bp, Homo sapiens
tttcccagcctcctttgcagct

SEQ ID NO: 9362170 - DNA, 19 bp, Homo sapiens
tttcccagcccttgctgtg

SEQ ID NO: 9362171 - DNA, 22 bp, Homo sapiens
tttcccagcctcagctcagcag

SEQ ID NO: 9362172 - DNA, 22 bp, Homo sapiens
tttcccagttccctgctctata

SEQ ID NO: 9362173 - DNA, 22 bp, Homo sapiens
tttcccagttagtgaagacatg

SEQ ID NO: 9362174 - DNA, 22 bp, Homo sapiens
tttcccagttagtgaagacatg

SEQ ID NO: 9362175 - DNA, 22 bp, Homo sapiens
tttcccagttagtgaagacatg

SEQ ID NO: 9362176 - DNA, 19 bp, Homo sapiens
tttcccagtcccaggagtg

SEQ ID NO: 9362177 - DNA, 22 bp, Homo sapiens
tttcccatccatagccctgcaa

SEQ ID NO: 9362178 - DNA, 22 bp, Homo sapiens
tttcacagatataagatttcac

SEQ ID NO: 9362179 - DNA, 22 bp, Homo sapiens
tttcacagatataagatttcac

SEQ ID NO: 9362180 - DNA, 22 bp, Homo sapiens
tttcacagagaaatataacagg

SEQ ID NO: 9362181 - DNA, 22 bp, Homo sapiens
tttcacagagaaatataacagg

SEQ ID NO: 9362182 - DNA, 22 bp, Homo sapiens
tttcacagagaaatataacagg

SEQ ID NO: 9362183 - DNA, 22 bp, Homo sapiens
tttcacagaaagaagctagttt

SEQ ID NO: 9362184 - DNA, 22 bp, Homo sapiens
tttcacagaaaggataacatta

SEQ ID NO: 9362185 - DNA, 22 bp, Homo sapiens
tttcacagaaagacaacagata

SEQ ID NO: 9362186 - DNA, 22 bp, Homo sapiens
tttcacagagaaatataacagg

SEQ ID NO: 9362187 - DNA, 22 bp, Homo sapiens
tttcacagaactcactaaggag

SEQ ID NO: 9362188 - DNA, 22 bp, Homo sapiens
tttcacagaaaggataacatta

SEQ ID NO: 9362189 - DNA, 20 bp, Homo sapiens
tttcacaatgaacatgtctc

SEQ ID NO: 9362190 - DNA, 23 bp, Homo sapiens
tttcacaatgagcattacagaat

SEQ ID NO: 9362191 - DNA, 23 bp, Homo sapiens
tttcacaatgagcattacagaat

SEQ ID NO: 9362192 - DNA, 22 bp, Homo sapiens
tttcacaattttaaggagcaaa

SEQ ID NO: 9362193 - DNA, 22 bp, Homo sapiens
tttcacactagtcagaatacca

SEQ ID NO: 9362194 - DNA, 22 bp, Homo sapiens
tttcacactgcagcatcagaga

SEQ ID NO: 9362195 - DNA, 22 bp, Homo sapiens
tttcaagagggaactgaacaca

SEQ ID NO: 9362196 - DNA, 22 bp, Homo sapiens
tttcaagagcaggaaaaaggtc

SEQ ID NO: 9362197 - DNA, 22 bp, Homo sapiens
tttcaagactcattgagtattg

SEQ ID NO: 9362198 - DNA, 22 bp, Homo sapiens
tttcaacttgaagaattgatac

SEQ ID NO: 9362199 - DNA, 22 bp, Homo sapiens
tttcaacatcacctagcagttc

SEQ ID NO: 9362200 - DNA, 22 bp, Homo sapiens
tttcaacatataccataatgcc

SEQ ID NO: 9362201 - DNA, 22 bp, Homo sapiens
tttcaacataatgcctgctagg

SEQ ID NO: 9362202 - DNA, 22 bp, Homo sapiens
tttcaacaggatgataataggc

SEQ ID NO: 9362203 - DNA, 22 bp, Homo sapiens
tttcaacaggatgataataggc

SEQ ID NO: 9362204 - DNA, 22 bp, Homo sapiens
tttattctctagttggtcagat

SEQ ID NO: 9362205 - DNA, 21 bp, Homo sapiens
tttattctcagatacagggag

SEQ ID NO: 9362206 - DNA, 23 bp, Homo sapiens
tttattctcagatacataggtct

SEQ ID NO: 9362207 - DNA, 22 bp, Homo sapiens
tttattctgtgctacatgaaga

SEQ ID NO: 9362208 - DNA, 22 bp, Homo sapiens
tttattctgtgctacatgaaga

SEQ ID NO: 9362209 - DNA, 22 bp, Homo sapiens
tttattgaacacttgcactggc

SEQ ID NO: 9362210 - DNA, 22 bp, Homo sapiens
tttattcttgagagtgagaaga

SEQ ID NO: 9362211 - DNA, 22 bp, Homo sapiens
tttattgaattgtaaccctatt

SEQ ID NO: 9362212 - DNA, 22 bp, Homo sapiens
tttattgaattgtaaccctatt

SEQ ID NO: 9362213 - DNA, 22 bp, Homo sapiens
tttattgaacacttgcactggc

SEQ ID NO: 9362214 - DNA, 22 bp, Homo sapiens
tttattctagctcagaatagtt

SEQ ID NO: 9362215 - DNA, 22 bp, Homo sapiens
tttattctataggcattaagca

SEQ ID NO: 9362216 - DNA, 21 bp, Homo sapiens
tttattctcagatacagggag

SEQ ID NO: 9362217 - DNA, 22 bp, Homo sapiens
tttattctagctcagaatagtt

SEQ ID NO: 9362218 - DNA, 22 bp, Homo sapiens
tttattctagctcagaatagtt

SEQ ID NO: 9362219 - DNA, 23 bp, Homo sapiens
tttcaacaatgcttagagaaaac

SEQ ID NO: 9362220 - DNA, 23 bp, Homo sapiens
tttcaacaatgcttagagaaaac

SEQ ID NO: 9362221 - DNA, 22 bp, Homo sapiens
tttcaaaggtggaagagtgaat

SEQ ID NO: 9362222 - DNA, 22 bp, Homo sapiens
tttcaacagctctcaaatgatc

SEQ ID NO: 9362223 - DNA, 22 bp, Homo sapiens
tttcaacaccagagaccatgcg

SEQ ID NO: 9362224 - DNA, 22 bp, Homo sapiens
tttcaacaccagagaccatgcg

SEQ ID NO: 9362225 - DNA, 22 bp, Homo sapiens
tttattgcactgtctcaatacc

SEQ ID NO: 9362226 - DNA, 22 bp, Homo sapiens
tttattgagtatctactatgtg

SEQ ID NO: 9362227 - DNA, 22 bp, Homo sapiens
tttattgagtatctactatgtg

SEQ ID NO: 9362228 - DNA, 22 bp, Homo sapiens
tttattgagtatctactatgtg

SEQ ID NO: 9362229 - DNA, 22 bp, Homo sapiens
tttattgagcacccgttgtgcg

SEQ ID NO: 9362230 - DNA, 22 bp, Homo sapiens
tttattgacttcagtgagtctt

SEQ ID NO: 9362231 - DNA, 20 bp, Homo sapiens
tttattgagcacgtactgtg

SEQ ID NO: 9362232 - DNA, 22 bp, Homo sapiens
tttattgacttcagtgagtctt

SEQ ID NO: 9362233 - DNA, 22 bp, Homo sapiens
tttattgacccaaagcgagagt

SEQ ID NO: 9362234 - DNA, 22 bp, Homo sapiens
tttattgacccaaagcgagagt

SEQ ID NO: 9362235 - DNA, 22 bp, Homo sapiens
tttatctgaaaaaactcttgga

SEQ ID NO: 9362236 - DNA, 22 bp, Homo sapiens
tttatctgaggaaagcagacaa

SEQ ID NO: 9362237 - DNA, 22 bp, Homo sapiens
tttatctgaggaaagcagacaa

SEQ ID NO: 9362238 - DNA, 22 bp, Homo sapiens
tttatctattgtattgttgatg

SEQ ID NO: 9362239 - DNA, 22 bp, Homo sapiens
tttatcaaacaaattatccagc

SEQ ID NO: 9362240 - DNA, 22 bp, Homo sapiens
tttatcagaggctatgtttcat

SEQ ID NO: 9362241 - DNA, 22 bp, Homo sapiens
tttatcagaagttagagaaaga

SEQ ID NO: 9362242 - DNA, 22 bp, Homo sapiens
tttagcagagttatatggaagt

SEQ ID NO: 9362243 - DNA, 22 bp, Homo sapiens
tttagcaataaagggatattaa

SEQ ID NO: 9362244 - DNA, 22 bp, Homo sapiens
tttagcagaatttctctagaag

SEQ ID NO: 9362245 - DNA, 22 bp, Homo sapiens
tttatatagagatttgtgcatg

SEQ ID NO: 9362246 - DNA, 22 bp, Homo sapiens
tttatatagagatttgtgcatg

SEQ ID NO: 9362247 - DNA, 22 bp, Homo sapiens
tttatattgggagtcgttttga

SEQ ID NO: 9362248 - DNA, 22 bp, Homo sapiens
tttatattgggagtcgttttga

SEQ ID NO: 9362249 - DNA, 22 bp, Homo sapiens
tttatattgggagtcgttttga

SEQ ID NO: 9362250 - DNA, 22 bp, Homo sapiens
tttatattgggagtcgttttga

SEQ ID NO: 9362251 - DNA, 22 bp, Homo sapiens
tttatattgtaaaaatggttct

SEQ ID NO: 9362252 - DNA, 22 bp, Homo sapiens
tttatattgggagtcgttttga

SEQ ID NO: 9362253 - DNA, 22 bp, Homo sapiens
tttatattgggagtcgttttga

SEQ ID NO: 9362254 - DNA, 22 bp, Homo sapiens
tttatattgtaaaaatggttct

SEQ ID NO: 9362255 - DNA, 22 bp, Homo sapiens
tttatattgtaaaaatggttct

SEQ ID NO: 9362256 - DNA, 22 bp, Homo sapiens
tttatatttcccaggattggcc

SEQ ID NO: 9362257 - DNA, 22 bp, Homo sapiens
tttatatttcccaggattggcc

SEQ ID NO: 9362258 - DNA, 22 bp, Homo sapiens
tttatatttcccaggattggcc

SEQ ID NO: 9362259 - DNA, 22 bp, Homo sapiens
tttagaggggaaagtggctggt

SEQ ID NO: 9362260 - DNA, 22 bp, Homo sapiens
tttagaggttagaggctgatag

SEQ ID NO: 9362261 - DNA, 22 bp, Homo sapiens
tttagcaaattactcacagggt

SEQ ID NO: 9362262 - DNA, 22 bp, Homo sapiens
tttagcaaactttggagtttgt

SEQ ID NO: 9362263 - DNA, 22 bp, Homo sapiens
tttagagttgtagctctcagct

SEQ ID NO: 9362264 - DNA, 22 bp, Homo sapiens
tttagagtctttaggagaaatg

SEQ ID NO: 9362265 - DNA, 22 bp, Homo sapiens
tttaccaagctttaattacata

SEQ ID NO: 9362266 - DNA, 22 bp, Homo sapiens
tttaccacaataatcatcacaa

SEQ ID NO: 9362267 - DNA, 22 bp, Homo sapiens
tttaccaactgtagatctgcta

SEQ ID NO: 9362268 - DNA, 22 bp, Homo sapiens
tttaccaagagttgtcactgtt

SEQ ID NO: 9362269 - DNA, 20 bp, Homo sapiens
tttaccaactcaccagtatc

SEQ ID NO: 9362270 - DNA, 22 bp, Homo sapiens
tttagaagacagatgcacagcc

SEQ ID NO: 9362271 - DNA, 22 bp, Homo sapiens
tttagaagacagatgcacagcc

SEQ ID NO: 9362272 - DNA, 22 bp, Homo sapiens
tttagaaggactacagtgtgat

SEQ ID NO: 9362273 - DNA, 22 bp, Homo sapiens
tttagaagttcacacatttaaa

SEQ ID NO: 9362274 - DNA, 22 bp, Homo sapiens
tttagaagggctggtcagaaat

SEQ ID NO: 9362275 - DNA, 22 bp, Homo sapiens
tttacagtgagagcttagtgag

SEQ ID NO: 9362276 - DNA, 22 bp, Homo sapiens
tttacagtgagagcttagtgag

SEQ ID NO: 9362277 - DNA, 22 bp, Homo sapiens
tttacagtgagagcttagtgag

SEQ ID NO: 9362278 - DNA, 22 bp, Homo sapiens
tttacagtgtcttgttgactgt

SEQ ID NO: 9362279 - DNA, 22 bp, Homo sapiens
tttacatttccctctgtcagtt

SEQ ID NO: 9362280 - DNA, 22 bp, Homo sapiens
tttacagtgagagcttagtgag

SEQ ID NO: 9362281 - DNA, 22 bp, Homo sapiens
tttacagtctgtctagcaatgt

SEQ ID NO: 9362282 - DNA, 22 bp, Homo sapiens
tttacagtctgtctagcaatgt

SEQ ID NO: 9362283 - DNA, 22 bp, Homo sapiens
tttacagtctgtctagcaatgt

SEQ ID NO: 9362284 - DNA, 22 bp, Homo sapiens
tttacagtctgtctagcaatgt

SEQ ID NO: 9362285 - DNA, 22 bp, Homo sapiens
tttacagtctgtctagcaatgt

SEQ ID NO: 9362286 - DNA, 22 bp, Homo sapiens
tttacagtctgtctagcaatgt

SEQ ID NO: 9362287 - DNA, 20 bp, Homo sapiens
tttacattttgaaacagtga

SEQ ID NO: 9362288 - DNA, 20 bp, Homo sapiens
tttaccaaaggagttatgat

SEQ ID NO: 9362289 - DNA, 22 bp, Homo sapiens
ttgtgtgtactggttatgggca

SEQ ID NO: 9362290 - DNA, 22 bp, Homo sapiens
ttgtgtgtagactcagccattg

SEQ ID NO: 9362291 - DNA, 17 bp, Homo sapiens
ttgtgtgtagttctgat

SEQ ID NO: 9362292 - DNA, 22 bp, Homo sapiens
tttaaacatcttgttgccttaa

SEQ ID NO: 9362293 - DNA, 22 bp, Homo sapiens
tttaaactgttgattttatgaa

SEQ ID NO: 9362294 - DNA, 17 bp, Homo sapiens
tttaaactactacaagg

SEQ ID NO: 9362295 - DNA, 22 bp, Homo sapiens
tttaaactaacagtacacgttg

SEQ ID NO: 9362296 - DNA, 22 bp, Homo sapiens
tttaaagaaattcctcatcttt

SEQ ID NO: 9362297 - DNA, 22 bp, Homo sapiens
tttaaagagaatgtgaaggagt

SEQ ID NO: 9362298 - DNA, 22 bp, Homo sapiens
tttaaagtggtccatttcagaa

SEQ ID NO: 9362299 - DNA, 19 bp, Homo sapiens
tttaaagtgactggtattt

SEQ ID NO: 9362300 - DNA, 22 bp, Homo sapiens
tttaaagtgctgctcctatcct

SEQ ID NO: 9362301 - DNA, 22 bp, Homo sapiens
tttaaataggactcctgggggt

SEQ ID NO: 9362302 - DNA, 22 bp, Homo sapiens
tttaaataggactcctgggggt

SEQ ID NO: 9362303 - DNA, 22 bp, Homo sapiens
tttaaatgcagacgttgattca

SEQ ID NO: 9362304 - DNA, 22 bp, Homo sapiens
tttaaatgcagacgttgattca

SEQ ID NO: 9362305 - DNA, 22 bp, Homo sapiens
tttaaatgctttaagcaagggt

SEQ ID NO: 9362306 - DNA, 22 bp, Homo sapiens
tttaaatggcattttcccagat

SEQ ID NO: 9362307 - DNA, 22 bp, Homo sapiens
tttaaatggcattttcccagat

SEQ ID NO: 9362308 - DNA, 22 bp, Homo sapiens
tttaaatgtgttcttagtagct

SEQ ID NO: 9362309 - DNA, 22 bp, Homo sapiens
tttaaatgttcatgatactgaa

SEQ ID NO: 9362310 - DNA, 22 bp, Homo sapiens
tttaaatgtttatagagagtac

SEQ ID NO: 9362311 - DNA, 22 bp, Homo sapiens
tttaagatctatcccattttgt

SEQ ID NO: 9362312 - DNA, 22 bp, Homo sapiens
tttaagatggtattttataaag

SEQ ID NO: 9362313 - DNA, 22 bp, Homo sapiens
tttaagatggtattttataaag

SEQ ID NO: 9362314 - DNA, 22 bp, Homo sapiens
tttaaatgtttaaaactcgtga

SEQ ID NO: 9362315 - DNA, 22 bp, Homo sapiens
tttaagctgtggcattaattct

SEQ ID NO: 9362316 - DNA, 19 bp, Homo sapiens
tttaagcatagaggccaga

SEQ ID NO: 9362317 - DNA, 22 bp, Homo sapiens
tttaagctaatgtcataattag

SEQ ID NO: 9362318 - DNA, 22 bp, Homo sapiens
tttaagattcagtaaggcaaac

SEQ ID NO: 9362319 - DNA, 22 bp, Homo sapiens
tttaagattcagtaaggcaaac

SEQ ID NO: 9362320 - DNA, 22 bp, Homo sapiens
tttaagcacagggataaagtta

SEQ ID NO: 9362321 - DNA, 22 bp, Homo sapiens
tttaatctcccactctcagcct

SEQ ID NO: 9362322 - DNA, 22 bp, Homo sapiens
tttaagtcatggagaattgtgg

SEQ ID NO: 9362323 - DNA, 22 bp, Homo sapiens
tttaatctattccctaaacacc

SEQ ID NO: 9362324 - DNA, 16 bp, Homo sapiens
tttaatctctcaggaa

SEQ ID NO: 9362325 - DNA, 22 bp, Homo sapiens
tttaatcttcaaaatagtctta

SEQ ID NO: 9362326 - DNA, 22 bp, Homo sapiens
tttaatcttcaaaatagtctta

SEQ ID NO: 9362327 - DNA, 22 bp, Homo sapiens
tttaaggcagtgaaactattct

SEQ ID NO: 9362328 - DNA, 22 bp, Homo sapiens
tttaaggcagtgaaactattct

SEQ ID NO: 9362329 - DNA, 22 bp, Homo sapiens
tttaaggtggacatctaagtca

SEQ ID NO: 9362330 - DNA, 22 bp, Homo sapiens
tttaaggcttcaatttttggta

SEQ ID NO: 9362331 - DNA, 22 bp, Homo sapiens
tttaatgtagcgtgaaatgatt

SEQ ID NO: 9362332 - DNA, 22 bp, Homo sapiens
tttaatgtagcgtgaaatgatt

SEQ ID NO: 9362333 - DNA, 22 bp, Homo sapiens
tttaatggcaagaaggctgcag

SEQ ID NO: 9362334 - DNA, 22 bp, Homo sapiens
tttaatgggatccatctggtta

SEQ ID NO: 9362335 - DNA, 22 bp, Homo sapiens
tttacaggattaccctggctgc

SEQ ID NO: 9362336 - DNA, 22 bp, Homo sapiens
tttacaggaagctgaaaaacat

SEQ ID NO: 9362337 - DNA, 22 bp, Homo sapiens
tttacagcttctatactatgtg

SEQ ID NO: 9362338 - DNA, 22 bp, Homo sapiens
tttaatgtattctttggaacca

SEQ ID NO: 9362339 - DNA, 22 bp, Homo sapiens
tttacagtccccaggtgaggat

SEQ ID NO: 9362340 - DNA, 22 bp, Homo sapiens
tttacagtccccaggtgaggat

SEQ ID NO: 9362341 - DNA, 22 bp, Homo sapiens
tttacagtccccaggtgaggat

SEQ ID NO: 9362342 - DNA, 22 bp, Homo sapiens
tttacagtctatgttgaattaa

SEQ ID NO: 9362343 - DNA, 22 bp, Homo sapiens
tttacagtctatgttgaattaa

SEQ ID NO: 9362344 - DNA, 22 bp, Homo sapiens
tttacagtctatgttgaattaa

SEQ ID NO: 9362345 - DNA, 22 bp, Homo sapiens
tttacagtctatgttgaattaa

SEQ ID NO: 9362346 - DNA, 22 bp, Homo sapiens
tttacagtctctatagtcaaaa

SEQ ID NO: 9362347 - DNA, 22 bp, Homo sapiens
tttacagtctctatagtcaaaa

SEQ ID NO: 9362348 - DNA, 22 bp, Homo sapiens
tttacagtctctatagtcaaaa

SEQ ID NO: 9362349 - DNA, 22 bp, Homo sapiens
tttacagtctatgttgaattaa

SEQ ID NO: 9362350 - DNA, 22 bp, Homo sapiens
tttacagtctctatagtcaaaa

SEQ ID NO: 9362351 - DNA, 22 bp, Homo sapiens
tttacagtctctatagtcaaaa

SEQ ID NO: 9362352 - DNA, 23 bp, Homo sapiens
tttacagggcactcttatgcagc

SEQ ID NO: 9362353 - DNA, 22 bp, Homo sapiens
tttacagggttcaagaatgaaa

SEQ ID NO: 9362354 - DNA, 22 bp, Homo sapiens
tttacagtaaggtggatggtac

SEQ ID NO: 9362355 - DNA, 22 bp, Homo sapiens
tttacagtaaggtggatggtac

SEQ ID NO: 9362356 - DNA, 22 bp, Homo sapiens
tttacagtaaggtggatggtac

SEQ ID NO: 9362357 - DNA, 22 bp, Homo sapiens
tttacagtcaccaaactttgct

SEQ ID NO: 9362358 - DNA, 22 bp, Homo sapiens
tttacagtcaccaaactttgct

SEQ ID NO: 9362359 - DNA, 22 bp, Homo sapiens
tttacagtcaccaaactttgct

SEQ ID NO: 9362360 - DNA, 22 bp, Homo sapiens
tttacagtcaccaaactttgct

SEQ ID NO: 9362361 - DNA, 22 bp, Homo sapiens
tttacagtatagtaggactcat

SEQ ID NO: 9362362 - DNA, 22 bp, Homo sapiens
tttacagtatagtaggactcat

SEQ ID NO: 9362363 - DNA, 22 bp, Homo sapiens
tttacagtatagtaggactcat

SEQ ID NO: 9362364 - DNA, 22 bp, Homo sapiens
tttacagtcaccaaactttgct

SEQ ID NO: 9362365 - DNA, 22 bp, Homo sapiens
ttggagatatcacaccttcaca

SEQ ID NO: 9362366 - DNA, 22 bp, Homo sapiens
ttggagatatcacaccttcaca

SEQ ID NO: 9362367 - DNA, 22 bp, Homo sapiens
ttggagagttaattgacagtta

SEQ ID NO: 9362368 - DNA, 22 bp, Homo sapiens
ttggagccctgaggatctggat

SEQ ID NO: 9362369 - DNA, 22 bp, Homo sapiens
ttggagccatgcccagctctct

SEQ ID NO: 9362370 - DNA, 22 bp, Homo sapiens
ttggagccatgcccagctctct

SEQ ID NO: 9362371 - DNA, 22 bp, Homo sapiens
ttggagagatttaggtctcagt

SEQ ID NO: 9362372 - DNA, 22 bp, Homo sapiens
ttggagagcagtaaaccacact

SEQ ID NO: 9362373 - DNA, 22 bp, Homo sapiens
ttggagagatttaggtctcagt

SEQ ID NO: 9362374 - DNA, 22 bp, Homo sapiens
ttggagaggcagtcttgctctg

SEQ ID NO: 9362375 - DNA, 22 bp, Homo sapiens
ttggagagggcttggatcacac

SEQ ID NO: 9362376 - DNA, 22 bp, Homo sapiens
ttggagagtgatattcagatgc

SEQ ID NO: 9362377 - DNA, 23 bp, Homo sapiens
ttggagagggtgagtagtgtcag

SEQ ID NO: 9362378 - DNA, 23 bp, Homo sapiens
ttggagagggtgagtagtgtcag

SEQ ID NO: 9362379 - DNA, 22 bp, Homo sapiens
ttggagagggcttggatcacac

SEQ ID NO: 9362380 - DNA, 22 bp, Homo sapiens
ttggagaatgttttcctgcagt

SEQ ID NO: 9362381 - DNA, 22 bp, Homo sapiens
ttggagagaggctgctcaggct

SEQ ID NO: 9362382 - DNA, 22 bp, Homo sapiens
ttggagagaggctgctcaggct

SEQ ID NO: 9362383 - DNA, 22 bp, Homo sapiens
ttggagagattatcagaccagc

SEQ ID NO: 9362384 - DNA, 22 bp, Homo sapiens
ttggcagtaaaagaaaatgctt

SEQ ID NO: 9362385 - DNA, 22 bp, Homo sapiens
ttggcagggctgcttgtctagg

SEQ ID NO: 9362386 - DNA, 22 bp, Homo sapiens
ttggcagggccaggctctctct

SEQ ID NO: 9362387 - DNA, 22 bp, Homo sapiens
ttggcagggccaggctctctct

SEQ ID NO: 9362388 - DNA, 22 bp, Homo sapiens
ttggcaggaatattgcagaggt

SEQ ID NO: 9362389 - DNA, 22 bp, Homo sapiens
ttggcaggaatattgcagaggt

SEQ ID NO: 9362390 - DNA, 22 bp, Homo sapiens
ttggcaggaggcttcagttcct

SEQ ID NO: 9362391 - DNA, 22 bp, Homo sapiens
ttggcaggatgatagctttgtg

SEQ ID NO: 9362392 - DNA, 22 bp, Homo sapiens
ttggcaggatgatagctttgtg

SEQ ID NO: 9362393 - DNA, 22 bp, Homo sapiens
ttggcagggcatcagacacgtg

SEQ ID NO: 9362394 - DNA, 22 bp, Homo sapiens
ttggcagggcatcagacacgtg

SEQ ID NO: 9362395 - DNA, 22 bp, Homo sapiens
ttggcagtgatgcagcttgttc

SEQ ID NO: 9362396 - DNA, 22 bp, Homo sapiens
ttggcagtgtctgcaaaatgga

SEQ ID NO: 9362397 - DNA, 22 bp, Homo sapiens
ttggcagcggggaccctggctg

SEQ ID NO: 9362398 - DNA, 23 bp, Homo sapiens
ttggcagcgggtcaggctgtggg

SEQ ID NO: 9362399 - DNA, 22 bp, Homo sapiens
ttggcagctacttccccagtgc

SEQ ID NO: 9362400 - DNA, 22 bp, Homo sapiens
ttggcagctcttgatggcaccc

SEQ ID NO: 9362401 - DNA, 22 bp, Homo sapiens
ttggcagccctgacccaatggg

SEQ ID NO: 9362402 - DNA, 22 bp, Homo sapiens
ttggcagccaggacccgcctgg

SEQ ID NO: 9362403 - DNA, 22 bp, Homo sapiens
ttggcagcccagcttactagca

SEQ ID NO: 9362404 - DNA, 22 bp, Homo sapiens
ttggcaggaatattgcagaggt

SEQ ID NO: 9362405 - DNA, 22 bp, Homo sapiens
ttggcaggaatattgcagaggt

SEQ ID NO: 9362406 - DNA, 20 bp, Homo sapiens
ttggcagcttcagggtacta

SEQ ID NO: 9362407 - DNA, 22 bp, Homo sapiens
ttggcagctgcacagactccat

SEQ ID NO: 9362408 - DNA, 22 bp, Homo sapiens
ttggcagctgttggaccttgac

SEQ ID NO: 9362409 - DNA, 19 bp, Homo sapiens
ttggcagctgagatcctgc

SEQ ID NO: 9362410 - DNA, 22 bp, Homo sapiens
ttggaggaaattgcttttgtgg

SEQ ID NO: 9362411 - DNA, 22 bp, Homo sapiens
ttggaggaagctcatgggggat

SEQ ID NO: 9362412 - DNA, 22 bp, Homo sapiens
ttggaggaaagaaggttgatat

SEQ ID NO: 9362413 - DNA, 22 bp, Homo sapiens
ttggaggactagttaagagacc

SEQ ID NO: 9362414 - DNA, 22 bp, Homo sapiens
ttggcagcattccagccaagca

SEQ ID NO: 9362415 - DNA, 22 bp, Homo sapiens
ttggcagcatacagttggattg

SEQ ID NO: 9362416 - DNA, 22 bp, Homo sapiens
ttggcagcatccaagtctcggg

SEQ ID NO: 9362417 - DNA, 22 bp, Homo sapiens
ttggaggaggcattggaggatt

SEQ ID NO: 9362418 - DNA, 20 bp, Homo sapiens
ttggcagcagttccaagtga

SEQ ID NO: 9362419 - DNA, 22 bp, Homo sapiens
ttggccatctaagcccagccac

SEQ ID NO: 9362420 - DNA, 22 bp, Homo sapiens
ttggccagtggaaagaggagga

SEQ ID NO: 9362421 - DNA, 22 bp, Homo sapiens
ttggccaggtgtccagcccagg

SEQ ID NO: 9362422 - DNA, 22 bp, Homo sapiens
ttggccaggtgtaggtcacacc

SEQ ID NO: 9362423 - DNA, 22 bp, Homo sapiens
ttggccagtgcttgtgattttc

SEQ ID NO: 9362424 - DNA, 22 bp, Homo sapiens
ttggccagtgaaccaggcctgg

SEQ ID NO: 9362425 - DNA, 22 bp, Homo sapiens
ttggcataccttagtggtggag

SEQ ID NO: 9362426 - DNA, 22 bp, Homo sapiens
ttggcataccttagtggtggag

SEQ ID NO: 9362427 - DNA, 22 bp, Homo sapiens
ttggccagctctggaaagtggt

SEQ ID NO: 9362428 - DNA, 22 bp, Homo sapiens
ttggccaggcatgaataaaaga

SEQ ID NO: 9362429 - DNA, 22 bp, Homo sapiens
ttggccaggtccatttctccat

SEQ ID NO: 9362430 - DNA, 22 bp, Homo sapiens
ttggccaggtgtaggtcacacc

SEQ ID NO: 9362431 - DNA, 22 bp, Homo sapiens
ttggccagcgacgaccttctta

SEQ ID NO: 9362432 - DNA, 22 bp, Homo sapiens
ttggccagcagctctggcttag

SEQ ID NO: 9362433 - DNA, 22 bp, Homo sapiens
ttgggacagaaaaggagaagat

SEQ ID NO: 9362434 - DNA, 22 bp, Homo sapiens
ttgggaagaatggaggtggtta

SEQ ID NO: 9362435 - DNA, 22 bp, Homo sapiens
ttggccatgacaggacaggaag

SEQ ID NO: 9362436 - DNA, 22 bp, Homo sapiens
ttgggaagtttaatgacagact

SEQ ID NO: 9362437 - DNA, 22 bp, Homo sapiens
ttgggaagtaatatggtggtct

SEQ ID NO: 9362438 - DNA, 22 bp, Homo sapiens
ttgggaagaggcccctggattc

SEQ ID NO: 9362439 - DNA, 17 bp, Homo sapiens
ttgggagagaaaggtat

SEQ ID NO: 9362440 - DNA, 22 bp, Homo sapiens
ttgggagacaaaggctctgtct

SEQ ID NO: 9362441 - DNA, 22 bp, Homo sapiens
ttgggacatctggcatacagtt

SEQ ID NO: 9362442 - DNA, 22 bp, Homo sapiens
ttgggagctggaagcaaggcct

SEQ ID NO: 9362443 - DNA, 22 bp, Homo sapiens
ttgggagagtttacatcctttt

SEQ ID NO: 9362444 - DNA, 22 bp, Homo sapiens
ttgggcagggaaaggacaggca

SEQ ID NO: 9362445 - DNA, 22 bp, Homo sapiens
ttgggcagggaaaggacaggca

SEQ ID NO: 9362446 - DNA, 22 bp, Homo sapiens
ttgggcaggtgaagagagggct

SEQ ID NO: 9362447 - DNA, 22 bp, Homo sapiens
ttgggcaggtgaagagagggct

SEQ ID NO: 9362448 - DNA, 22 bp, Homo sapiens
ttgggcaggtgtggctctcctt

SEQ ID NO: 9362449 - DNA, 22 bp, Homo sapiens
ttgggcagtctggctgcagagt

SEQ ID NO: 9362450 - DNA, 22 bp, Homo sapiens
ttgtaacaggtactaaataact

SEQ ID NO: 9362451 - DNA, 22 bp, Homo sapiens
ttgtaaagctttgagactacat

SEQ ID NO: 9362452 - DNA, 22 bp, Homo sapiens
ttgtaaagatgcttcccattct

SEQ ID NO: 9362453 - DNA, 23 bp, Homo sapiens
ttgtaaaacagtgtgacggttcc

SEQ ID NO: 9362454 - DNA, 22 bp, Homo sapiens
ttgtactatcaccatgtcatgt

SEQ ID NO: 9362455 - DNA, 22 bp, Homo sapiens
ttgtacataatgaaaggaggct

SEQ ID NO: 9362456 - DNA, 22 bp, Homo sapiens
ttgtacataatgaaaggaggct

SEQ ID NO: 9362457 - DNA, 22 bp, Homo sapiens
ttgtacattctatgggtttgga

SEQ ID NO: 9362458 - DNA, 19 bp, Homo sapiens
ttgtacagcaaccaaccct

SEQ ID NO: 9362459 - DNA, 22 bp, Homo sapiens
ttgtatttcgatgcacgtgtag

SEQ ID NO: 9362460 - DNA, 22 bp, Homo sapiens
ttgtatttcgatgcacgtgtag

SEQ ID NO: 9362461 - DNA, 22 bp, Homo sapiens
ttgtatttcctataacctttct

SEQ ID NO: 9362462 - DNA, 22 bp, Homo sapiens
ttgtatttcgatgcacgtgtag

SEQ ID NO: 9362463 - DNA, 22 bp, Homo sapiens
ttgtatttcgatgcacgtgtag

SEQ ID NO: 9362464 - DNA, 23 bp, Homo sapiens
ttgtatttttagtagagacaggg

SEQ ID NO: 9362465 - DNA, 23 bp, Homo sapiens
ttgtatttttagtagagacaggg

SEQ ID NO: 9362466 - DNA, 23 bp, Homo sapiens
ttgtatttttagtagagacaggg

SEQ ID NO: 9362467 - DNA, 22 bp, Homo sapiens
ttgtattttttcctggcggtgg

SEQ ID NO: 9362468 - DNA, 22 bp, Homo sapiens
ttgtattttttcctggcggtgg

SEQ ID NO: 9362469 - DNA, 22 bp, Homo sapiens
ttgtacaagtattatgtgaaca

SEQ ID NO: 9362470 - DNA, 22 bp, Homo sapiens
ttgtacaagtattatgtgaaca

SEQ ID NO: 9362471 - DNA, 22 bp, Homo sapiens
ttgtacaagttttgagcttaag

SEQ ID NO: 9362472 - DNA, 22 bp, Homo sapiens
ttgtacaagttttgagcttaag

SEQ ID NO: 9362473 - DNA, 22 bp, Homo sapiens
ttgtacaagttttgagcttaag

SEQ ID NO: 9362474 - DNA, 22 bp, Homo sapiens
ttgtacaagtattatgtgaaca

SEQ ID NO: 9362475 - DNA, 22 bp, Homo sapiens
ttgtacagaccctgaaaagctc

SEQ ID NO: 9362476 - DNA, 22 bp, Homo sapiens
ttgtcaaggcttttaatattct

SEQ ID NO: 9362477 - DNA, 22 bp, Homo sapiens
ttgtcaggcctatgagagatct

SEQ ID NO: 9362478 - DNA, 22 bp, Homo sapiens
ttgtcaggaactatgattatgc

SEQ ID NO: 9362479 - DNA, 22 bp, Homo sapiens
ttgtccaaggtcccacagttag

SEQ ID NO: 9362480 - DNA, 22 bp, Homo sapiens
ttgtcattggggttatttgtta

SEQ ID NO: 9362481 - DNA, 22 bp, Homo sapiens
ttgtcattggggttatttgtta

SEQ ID NO: 9362482 - DNA, 23 bp, Homo sapiens
ttgtccagctggtttgggccaca

SEQ ID NO: 9362483 - DNA, 22 bp, Homo sapiens
ttgtccagcgaccaggctctgt

SEQ ID NO: 9362484 - DNA, 23 bp, Homo sapiens
ttgtcctctggatcggtttggtt

SEQ ID NO: 9362485 - DNA, 22 bp, Homo sapiens
ttgtccgtggtgagttcgcatt

SEQ ID NO: 9362486 - DNA, 22 bp, Homo sapiens
ttgtccattgtgacaagtgtgg

SEQ ID NO: 9362487 - DNA, 22 bp, Homo sapiens
ttgtcctgcaacctcacatggc

SEQ ID NO: 9362488 - DNA, 22 bp, Homo sapiens
ttgtcctgcaacctcacatggc

SEQ ID NO: 9362489 - DNA, 22 bp, Homo sapiens
ttgtcctgcaggtggctgggag

SEQ ID NO: 9362490 - DNA, 23 bp, Homo sapiens
ttgtcctgccgatctctgagaat

SEQ ID NO: 9362491 - DNA, 22 bp, Homo sapiens
ttgtcctgatttataaaatgaa

SEQ ID NO: 9362492 - DNA, 22 bp, Homo sapiens
ttgtcctgaggactgttatcag

SEQ ID NO: 9362493 - DNA, 22 bp, Homo sapiens
ttgtcctgagataaggaacaga

SEQ ID NO: 9362494 - DNA, 22 bp, Homo sapiens
ttgtcctgcaacctcacatggc

SEQ ID NO: 9362495 - DNA, 22 bp, Homo sapiens
ttgtcctgattttgcaacttct

SEQ ID NO: 9362496 - DNA, 22 bp, Homo sapiens
ttgtcctggaggttaatagagt

SEQ ID NO: 9362497 - DNA, 22 bp, Homo sapiens
ttgtcctggaggttaatagagt

SEQ ID NO: 9362498 - DNA, 22 bp, Homo sapiens
ttgtcctggaggttaatagagt

SEQ ID NO: 9362499 - DNA, 23 bp, Homo sapiens
ttgtcctgccgatctctgagaat

SEQ ID NO: 9362500 - DNA, 22 bp, Homo sapiens
ttgtcctgtgatttcagggcct

SEQ ID NO: 9362501 - DNA, 22 bp, Homo sapiens
ttgtcctgtcaggctgggggct

SEQ ID NO: 9362502 - DNA, 16 bp, Homo sapiens
ttgtcctgtctcactg

SEQ ID NO: 9362503 - DNA, 22 bp, Homo sapiens
ttgtcctgtcaggctgggggct

SEQ ID NO: 9362504 - DNA, 22 bp, Homo sapiens
ttgtcctggcccaaatgtcaac

SEQ ID NO: 9362505 - DNA, 22 bp, Homo sapiens
ttgtgtccccctttgagagcca

SEQ ID NO: 9362506 - DNA, 22 bp, Homo sapiens
ttgtgtcccctgttctacctgt

SEQ ID NO: 9362507 - DNA, 22 bp, Homo sapiens
ttgtgtccatttgagtcatgtg

SEQ ID NO: 9362508 - DNA, 22 bp, Homo sapiens
ttgtgtccaaggctatggtgat

SEQ ID NO: 9362509 - DNA, 22 bp, Homo sapiens
ttgtgtactgttggttgatatt

SEQ ID NO: 9362510 - DNA, 22 bp, Homo sapiens
ttgtgtcaggggcccatactca

SEQ ID NO: 9362511 - DNA, 22 bp, Homo sapiens
ttgtgtatttcctgaaggtaag

SEQ ID NO: 9362512 - DNA, 22 bp, Homo sapiens
ttgtcctgttacttgtttggat

SEQ ID NO: 9362513 - DNA, 22 bp, Homo sapiens
ttgtcctgtgtctgtttggatt

SEQ ID NO: 9362514 - DNA, 22 bp, Homo sapiens
ttgtcctgttacttgtttggat

SEQ ID NO: 9362515 - DNA, 22 bp, Homo sapiens
ttgtcctgtgtctgtttggatt

SEQ ID NO: 9362516 - DNA, 22 bp, Homo sapiens
ttgtcctgtgatttcagggcct

SEQ ID NO: 9362517 - DNA, 22 bp, Homo sapiens
ttgtcctgtttagggataagga

SEQ ID NO: 9362518 - DNA, 22 bp, Homo sapiens
ttgtggctcgtgagatgttagg

SEQ ID NO: 9362519 - DNA, 22 bp, Homo sapiens
ttgtgtcctaagcaccagatgg

SEQ ID NO: 9362520 - DNA, 22 bp, Homo sapiens
ttgtgtcctatatgcatgttct

SEQ ID NO: 9362521 - DNA, 22 bp, Homo sapiens
ttgtgtcctaacatctagttaa

SEQ ID NO: 9362522 - DNA, 22 bp, Homo sapiens
ttgtgtccctggagcttctgtg

SEQ ID NO: 9362523 - DNA, 22 bp, Homo sapiens
ttgtgtccctgtaagacaaagc

SEQ ID NO: 9362524 - DNA, 22 bp, Homo sapiens
ttgtgtccctgcggctgaggag

SEQ ID NO: 9362525 - DNA, 22 bp, Homo sapiens
ttgtgtcctgatttgacacaat

SEQ ID NO: 9362526 - DNA, 22 bp, Homo sapiens
ttgtgtcctctaatctcaccac

SEQ ID NO: 9362527 - DNA, 21 bp, Homo sapiens
ttgtgtccttctaaagggcca

SEQ ID NO: 9362528 - DNA, 21 bp, Homo sapiens
ttgtgtccttctaaagggcca

SEQ ID NO: 9362529 - DNA, 23 bp, Homo sapiens
ttgtgtctacttcctatctaggg

SEQ ID NO: 9362530 - DNA, 22 bp, Homo sapiens
ttgtgtctggaatgcgtggagc

SEQ ID NO: 9362531 - DNA, 22 bp, Homo sapiens
ttgacaagcgaagtaccataat

SEQ ID NO: 9362532 - DNA, 22 bp, Homo sapiens
ttgacaagtggagatatttaag

SEQ ID NO: 9362533 - DNA, 22 bp, Homo sapiens
ttgacaagtaatacttaaatta

SEQ ID NO: 9362534 - DNA, 22 bp, Homo sapiens
ttgacacagatcaatattcaac

SEQ ID NO: 9362535 - DNA, 22 bp, Homo sapiens
ttgacacaatgtatattttcaa

SEQ ID NO: 9362536 - DNA, 22 bp, Homo sapiens
ttgacaaaacaacacagatttc

SEQ ID NO: 9362537 - DNA, 22 bp, Homo sapiens
ttgacaaaaataacacagcata

SEQ ID NO: 9362538 - DNA, 22 bp, Homo sapiens
ttgacaaaaacctcatttcacc

SEQ ID NO: 9362539 - DNA, 22 bp, Homo sapiens
ttgacaaaaacctcatttcacc

SEQ ID NO: 9362540 - DNA, 22 bp, Homo sapiens
ttgacaaagatatattcatgct

SEQ ID NO: 9362541 - DNA, 22 bp, Homo sapiens
ttgcaattagttacaaaagtgg

SEQ ID NO: 9362542 - DNA, 22 bp, Homo sapiens
ttgcaattagttacaaaagtgg

SEQ ID NO: 9362543 - DNA, 22 bp, Homo sapiens
ttgcaattaacatatgtcaact

SEQ ID NO: 9362544 - DNA, 22 bp, Homo sapiens
ttgcaattgctatggagagcgt

SEQ ID NO: 9362545 - DNA, 22 bp, Homo sapiens
ttgacacagttttctcattaag

SEQ ID NO: 9362546 - DNA, 22 bp, Homo sapiens
ttgacacagatcaatattcaac

SEQ ID NO: 9362547 - DNA, 22 bp, Homo sapiens
ttgcagagaggttaggaactca

SEQ ID NO: 9362548 - DNA, 22 bp, Homo sapiens
ttgcagaattaagcagagagcc

SEQ ID NO: 9362549 - DNA, 22 bp, Homo sapiens
ttgcagagcagtaggaatatag

SEQ ID NO: 9362550 - DNA, 22 bp, Homo sapiens
ttgcagagccatgaggctggct

SEQ ID NO: 9362551 - DNA, 22 bp, Homo sapiens
ttgcagaggcaaaaatgaactc

SEQ ID NO: 9362552 - DNA, 22 bp, Homo sapiens
ttgcagagtggttgtgaggatt

SEQ ID NO: 9362553 - DNA, 22 bp, Homo sapiens
ttgcagcttctaacagcttcag

SEQ ID NO: 9362554 - DNA, 22 bp, Homo sapiens
ttgcagctgctgttcctcatgg

SEQ ID NO: 9362555 - DNA, 22 bp, Homo sapiens
ttgcagggataaaacaagtgaa

SEQ ID NO: 9362556 - DNA, 22 bp, Homo sapiens
ttgcagggacctgcagaaagct

SEQ ID NO: 9362557 - DNA, 22 bp, Homo sapiens
ttgcagggcaaatggtcagata

SEQ ID NO: 9362558 - DNA, 22 bp, Homo sapiens
ttgcagcttcttgcatcagaaa

SEQ ID NO: 9362559 - DNA, 22 bp, Homo sapiens
ttgcagggttgaccaataggct

SEQ ID NO: 9362560 - DNA, 22 bp, Homo sapiens
ttgcaggtctgggggtcctggt

SEQ ID NO: 9362561 - DNA, 18 bp, Homo sapiens
ttgcaggtacctctatct

SEQ ID NO: 9362562 - DNA, 22 bp, Homo sapiens
ttgcagggtcctgtggctctcc

SEQ ID NO: 9362563 - DNA, 22 bp, Homo sapiens
ttgcagggtcctgtggctctcc

SEQ ID NO: 9362564 - DNA, 22 bp, Homo sapiens
ttgcagggcaggaccatggaca

SEQ ID NO: 9362565 - DNA, 22 bp, Homo sapiens
ttgcaggggaaggagcagagct

SEQ ID NO: 9362566 - DNA, 22 bp, Homo sapiens
ttgcagggctggaacatggaat

SEQ ID NO: 9362567 - DNA, 22 bp, Homo sapiens
ttggaaacgtcaccttttcctt

SEQ ID NO: 9362568 - DNA, 22 bp, Homo sapiens
ttggaaacgtcaccttttcctt

SEQ ID NO: 9362569 - DNA, 22 bp, Homo sapiens
ttggaaacgtcaccttttcctt

SEQ ID NO: 9362570 - DNA, 22 bp, Homo sapiens
ttggaaagaagggctgagcaag

SEQ ID NO: 9362571 - DNA, 22 bp, Homo sapiens
ttggaaactttcaagcataatg

SEQ ID NO: 9362572 - DNA, 22 bp, Homo sapiens
ttggaaagggaggaatgtagac

SEQ ID NO: 9362573 - DNA, 22 bp, Homo sapiens
ttggaaagtgacgttcaactgt

SEQ ID NO: 9362574 - DNA, 22 bp, Homo sapiens
ttgcttatttgattaaatgtct

SEQ ID NO: 9362575 - DNA, 23 bp, Homo sapiens
ttgctttcatcatgagatgctcc

SEQ ID NO: 9362576 - DNA, 23 bp, Homo sapiens
ttgctttcatcatgagatgctcc

SEQ ID NO: 9362577 - DNA, 22 bp, Homo sapiens
ttgctttccgtcatgtgctaat

SEQ ID NO: 9362578 - DNA, 22 bp, Homo sapiens
ttggaaaatgtatttctagaag

SEQ ID NO: 9362579 - DNA, 22 bp, Homo sapiens
ttggaaacgtcaccttttcctt

SEQ ID NO: 9362580 - DNA, 23 bp, Homo sapiens
ttggaaacctgttttagctgttt

SEQ ID NO: 9362581 - DNA, 22 bp, Homo sapiens
ttggaaaatgtatttctagaag

SEQ ID NO: 9362582 - DNA, 22 bp, Homo sapiens
ttggaaaccaggctttgagacg

SEQ ID NO: 9362583 - DNA, 22 bp, Homo sapiens
ttggaaacaagatttctactta

SEQ ID NO: 9362584 - DNA, 22 bp, Homo sapiens
ttggaaacaattgctttcttcc

SEQ ID NO: 9362585 - DNA, 21 bp, Homo sapiens
ttggaacaagcagcagtttgc

SEQ ID NO: 9362586 - DNA, 22 bp, Homo sapiens
ttggaattttccaggtacagtg

SEQ ID NO: 9362587 - DNA, 21 bp, Homo sapiens
ttggaatttgggagctatgtg

SEQ ID NO: 9362588 - DNA, 22 bp, Homo sapiens
ttggaatttgagaccaagaaaa

SEQ ID NO: 9362589 - DNA, 22 bp, Homo sapiens
ttggacacagctggcctttcca

SEQ ID NO: 9362590 - DNA, 22 bp, Homo sapiens
ttggacagcacagacatagaat

SEQ ID NO: 9362591 - DNA, 22 bp, Homo sapiens
ttggacagtactttaaagcaga

SEQ ID NO: 9362592 - DNA, 22 bp, Homo sapiens
ttggaattgaggatttacatag

SEQ ID NO: 9362593 - DNA, 22 bp, Homo sapiens
ttggaacacaatgtttctttca

SEQ ID NO: 9362594 - DNA, 22 bp, Homo sapiens
ttggaacacaatgtttctttca

SEQ ID NO: 9362595 - DNA, 22 bp, Homo sapiens
ttggaattcagcttgcttataa

SEQ ID NO: 9362596 - DNA, 22 bp, Homo sapiens
ttggaattgctattgataacaa

SEQ ID NO: 9362597 - DNA, 22 bp, Homo sapiens
ttgcatgtttttgtaatacacc

SEQ ID NO: 9362598 - DNA, 22 bp, Homo sapiens
ttgcatgtgtataaaagttgga

SEQ ID NO: 9362599 - DNA, 22 bp, Homo sapiens
ttgcatgtgtaatttttctaaa

SEQ ID NO: 9362600 - DNA, 22 bp, Homo sapiens
ttgcatgttccaaagaattttg

SEQ ID NO: 9362601 - DNA, 20 bp, Homo sapiens
ttgcattggatgtgcaggtg

SEQ ID NO: 9362602 - DNA, 19 bp, Homo sapiens
ttgcattgtagttggactg

SEQ ID NO: 9362603 - DNA, 22 bp, Homo sapiens
ttgcatttaagtagatgttaca

SEQ ID NO: 9362604 - DNA, 22 bp, Homo sapiens
ttgcatttaagtagatgttaca

SEQ ID NO: 9362605 - DNA, 22 bp, Homo sapiens
ttgcatttatagactgccattt

SEQ ID NO: 9362606 - DNA, 22 bp, Homo sapiens
ttgcatttactgcaccgtgagt

SEQ ID NO: 9362607 - DNA, 22 bp, Homo sapiens
ttgctccaggctgcagactctg

SEQ ID NO: 9362608 - DNA, 22 bp, Homo sapiens
ttgctctccagaggctcacagc

SEQ ID NO: 9362609 - DNA, 22 bp, Homo sapiens
ttgctctcggggaggctgcagg

SEQ ID NO: 9362610 - DNA, 22 bp, Homo sapiens
ttgctctatgtttgtaaacaga

SEQ ID NO: 9362611 - DNA, 22 bp, Homo sapiens
ttgctctgaacccagggcacca

SEQ ID NO: 9362612 - DNA, 22 bp, Homo sapiens
ttgctctgattaggtggaaaca

SEQ ID NO: 9362613 - DNA, 18 bp, Homo sapiens
ttgctcttctatgtcaat

SEQ ID NO: 9362614 - DNA, 22 bp, Homo sapiens
ttgctctgtcagggcctcagtc

SEQ ID NO: 9362615 - DNA, 21 bp, Homo sapiens
ttgctgttttcccaatgcagt

SEQ ID NO: 9362616 - DNA, 22 bp, Homo sapiens
ttgctgttttacatctggtggg

SEQ ID NO: 9362617 - DNA, 22 bp, Homo sapiens
ttgctgtttaatgatgtcttat

SEQ ID NO: 9362618 - DNA, 23 bp, Homo sapiens
ttgcttagagacctcctcatcag

SEQ ID NO: 9362619 - DNA, 23 bp, Homo sapiens
ttgctgagataaagaatgcaggg

SEQ ID NO: 9362620 - DNA, 22 bp, Homo sapiens
ttgctgtgaaaccatgggaagt

SEQ ID NO: 9362621 - DNA, 22 bp, Homo sapiens
ttgctgtgtcatttgtttaatc

SEQ ID NO: 9362622 - DNA, 22 bp, Homo sapiens
ttgctgtgtaactcctggcctg

SEQ ID NO: 9362623 - DNA, 22 bp, Homo sapiens
ttgctgtgtctgatggctgaga

SEQ ID NO: 9362624 - DNA, 19 bp, Homo sapiens
ttctctgctacattctcag

SEQ ID NO: 9362625 - DNA, 22 bp, Homo sapiens
ttctctggaactgaaacaagat

SEQ ID NO: 9362626 - DNA, 22 bp, Homo sapiens
ttctctggaactgaaacaagat

SEQ ID NO: 9362627 - DNA, 22 bp, Homo sapiens
ttctctggaactgaaacaagat

SEQ ID NO: 9362628 - DNA, 22 bp, Homo sapiens
ttctctgcagcttaggcccagt

SEQ ID NO: 9362629 - DNA, 22 bp, Homo sapiens
ttctctgatcttgctagactga

SEQ ID NO: 9362630 - DNA, 22 bp, Homo sapiens
ttctctgatcttgctagactga

SEQ ID NO: 9362631 - DNA, 22 bp, Homo sapiens
ttctctgacccccttaaatatt

SEQ ID NO: 9362632 - DNA, 22 bp, Homo sapiens
ttctctgagatagactaagtgg

SEQ ID NO: 9362633 - DNA, 17 bp, Homo sapiens
ttctctgagctgtattg

SEQ ID NO: 9362634 - DNA, 22 bp, Homo sapiens
ttctctgagatagactaagtgg

SEQ ID NO: 9362635 - DNA, 22 bp, Homo sapiens
ttctctgagtacgtttcagtgt

SEQ ID NO: 9362636 - DNA, 22 bp, Homo sapiens
ttctctcttccagttcccactt

SEQ ID NO: 9362637 - DNA, 22 bp, Homo sapiens
ttctctcttttgggtaggaggt

SEQ ID NO: 9362638 - DNA, 22 bp, Homo sapiens
ttctctcttccagttcccactt

SEQ ID NO: 9362639 - DNA, 22 bp, Homo sapiens
ttctctgaaggccatgctcact

SEQ ID NO: 9362640 - DNA, 22 bp, Homo sapiens
ttctctgaaggttgtggaacta

SEQ ID NO: 9362641 - DNA, 22 bp, Homo sapiens
ttctctgaaggttgtggaacta

SEQ ID NO: 9362642 - DNA, 22 bp, Homo sapiens
ttctctgaaggccatgctcact

SEQ ID NO: 9362643 - DNA, 22 bp, Homo sapiens
ttctctgaaggccatgctcact

SEQ ID NO: 9362644 - DNA, 22 bp, Homo sapiens
ttctctcttactgccatgctgt

SEQ ID NO: 9362645 - DNA, 22 bp, Homo sapiens
ttctctcttactgccatgctgt

SEQ ID NO: 9362646 - DNA, 22 bp, Homo sapiens
ttctctctgttatggattttac

SEQ ID NO: 9362647 - DNA, 22 bp, Homo sapiens
ttctctctgttatggattttac

SEQ ID NO: 9362648 - DNA, 22 bp, Homo sapiens
ttctctctggacctgggatgcg

SEQ ID NO: 9362649 - DNA, 22 bp, Homo sapiens
ttctctctggacctgggatgcg

SEQ ID NO: 9362650 - DNA, 22 bp, Homo sapiens
ttctctctgtggtcccattttg

SEQ ID NO: 9362651 - DNA, 22 bp, Homo sapiens
ttctctctgtggtcccattttg

SEQ ID NO: 9362652 - DNA, 22 bp, Homo sapiens
ttctctctgtgtcattatggac

SEQ ID NO: 9362653 - DNA, 22 bp, Homo sapiens
ttctctccagtcctggattctg

SEQ ID NO: 9362654 - DNA, 22 bp, Homo sapiens
ttctctcattcaaattaaagtg

SEQ ID NO: 9362655 - DNA, 22 bp, Homo sapiens
ttctctcagttaaactttgtga

SEQ ID NO: 9362656 - DNA, 22 bp, Homo sapiens
ttctctctgagagcatctggaa

SEQ ID NO: 9362657 - DNA, 22 bp, Homo sapiens
ttctctctgagagcatctggaa

SEQ ID NO: 9362658 - DNA, 22 bp, Homo sapiens
ttctctctgagagcatctggaa

SEQ ID NO: 9362659 - DNA, 22 bp, Homo sapiens
ttctctcctacccagtatccat

SEQ ID NO: 9362660 - DNA, 22 bp, Homo sapiens
ttctctcccatgaagcttctat

SEQ ID NO: 9362661 - DNA, 22 bp, Homo sapiens
ttctctaagagttatatgaatt

SEQ ID NO: 9362662 - DNA, 22 bp, Homo sapiens
ttctctaaggtcccgttctgga

SEQ ID NO: 9362663 - DNA, 22 bp, Homo sapiens
ttctctaatggtgatgattaga

SEQ ID NO: 9362664 - DNA, 22 bp, Homo sapiens
ttctctaggagttctgggatca

SEQ ID NO: 9362665 - DNA, 22 bp, Homo sapiens
ttctctaggactttggagtcct

SEQ ID NO: 9362666 - DNA, 20 bp, Homo sapiens
ttctctagccttcccctggg

SEQ ID NO: 9362667 - DNA, 20 bp, Homo sapiens
ttctctagccttcccctggg

SEQ ID NO: 9362668 - DNA, 23 bp, Homo sapiens
ttctctagatgaggtgaagatgg

SEQ ID NO: 9362669 - DNA, 22 bp, Homo sapiens
ttctctattacagaaatggaat

SEQ ID NO: 9362670 - DNA, 22 bp, Homo sapiens
ttctctatcttgaatgcgtcaa

SEQ ID NO: 9362671 - DNA, 22 bp, Homo sapiens
ttctctatcttgaatgcgtcaa

SEQ ID NO: 9362672 - DNA, 22 bp, Homo sapiens
ttctccagacaggcagagggaa

SEQ ID NO: 9362673 - DNA, 22 bp, Homo sapiens
ttctccagaccctcctgcagac

SEQ ID NO: 9362674 - DNA, 22 bp, Homo sapiens
ttctccagaccctcctgcagac

SEQ ID NO: 9362675 - DNA, 22 bp, Homo sapiens
ttctccagaccctcctgcagac

SEQ ID NO: 9362676 - DNA, 22 bp, Homo sapiens
ttctccagagggctctgcagga

SEQ ID NO: 9362677 - DNA, 22 bp, Homo sapiens
ttctccagaccttgtgactatg

SEQ ID NO: 9362678 - DNA, 22 bp, Homo sapiens
ttctccagaccttgtgactatg

SEQ ID NO: 9362679 - DNA, 22 bp, Homo sapiens
ttctctaagagttatatgaatt

SEQ ID NO: 9362680 - DNA, 22 bp, Homo sapiens
ttctcctgagttcccaggtcta

SEQ ID NO: 9362681 - DNA, 23 bp, Homo sapiens
ttctcctgaggaagcagggactg

SEQ ID NO: 9362682 - DNA, 22 bp, Homo sapiens
ttctcctctgttggccttccct

SEQ ID NO: 9362683 - DNA, 22 bp, Homo sapiens
ttctccagagggctctgcagga

SEQ ID NO: 9362684 - DNA, 22 bp, Homo sapiens
ttctcctctgttggccttccct

SEQ ID NO: 9362685 - DNA, 22 bp, Homo sapiens
ttctcctctgttggccttccct

SEQ ID NO: 9362686 - DNA, 22 bp, Homo sapiens
ttctccagaggtggctagagtt

SEQ ID NO: 9362687 - DNA, 22 bp, Homo sapiens
ttctccagacacaaaatctaag

SEQ ID NO: 9362688 - DNA, 18 bp, Homo sapiens
ttctccagaaaacatagc

SEQ ID NO: 9362689 - DNA, 22 bp, Homo sapiens
ttctcagggtttgtgcaggctt

SEQ ID NO: 9362690 - DNA, 22 bp, Homo sapiens
ttctcagggtttgtgcaggctt

SEQ ID NO: 9362691 - DNA, 22 bp, Homo sapiens
ttctcagggtttgtgcaggctt

SEQ ID NO: 9362692 - DNA, 22 bp, Homo sapiens
ttctccaagatgaagctgtgta

SEQ ID NO: 9362693 - DNA, 22 bp, Homo sapiens
ttctcaggtagtgctgatgctg

SEQ ID NO: 9362694 - DNA, 22 bp, Homo sapiens
ttctcagggtctggatggcctg

SEQ ID NO: 9362695 - DNA, 22 bp, Homo sapiens
ttctcagggtctggatggcctg

SEQ ID NO: 9362696 - DNA, 22 bp, Homo sapiens
ttctcaggcctttgggatggga

SEQ ID NO: 9362697 - DNA, 22 bp, Homo sapiens
ttctcaggctctgagaccctat

SEQ ID NO: 9362698 - DNA, 22 bp, Homo sapiens
ttctcaggactcctgcctgctt

SEQ ID NO: 9362699 - DNA, 22 bp, Homo sapiens
ttctcaggactcctgcctgctt

SEQ ID NO: 9362700 - DNA, 22 bp, Homo sapiens
ttctcaggaactcagtgtcagc

SEQ ID NO: 9362701 - DNA, 21 bp, Homo sapiens
ttctcagatcgagtagtgaga

SEQ ID NO: 9362702 - DNA, 22 bp, Homo sapiens
ttctcagatgattcagataaac

SEQ ID NO: 9362703 - DNA, 22 bp, Homo sapiens
ttctcagatgattcagataaac

SEQ ID NO: 9362704 - DNA, 22 bp, Homo sapiens
ttctcagatccatcagaagtcc

SEQ ID NO: 9362705 - DNA, 22 bp, Homo sapiens
ttctcagatccatcagaagtcc

SEQ ID NO: 9362706 - DNA, 21 bp, Homo sapiens
ttctcagatcgagtagtgaga

SEQ ID NO: 9362707 - DNA, 22 bp, Homo sapiens
ttcctggggtgaagatattttt

SEQ ID NO: 9362708 - DNA, 22 bp, Homo sapiens
ttcctggggggatagatttcac

SEQ ID NO: 9362709 - DNA, 22 bp, Homo sapiens
ttcctggggtactggagaaaat

SEQ ID NO: 9362710 - DNA, 22 bp, Homo sapiens
ttcctgggggcagcagtcttga

SEQ ID NO: 9362711 - DNA, 22 bp, Homo sapiens
ttcctggggctccagctaccag

SEQ ID NO: 9362712 - DNA, 22 bp, Homo sapiens
ttcctggggcttagcaatggag

SEQ ID NO: 9362713 - DNA, 22 bp, Homo sapiens
ttcctgggtggtcctggtagag

SEQ ID NO: 9362714 - DNA, 22 bp, Homo sapiens
ttcctgggtggtcctggtagag

SEQ ID NO: 9362715 - DNA, 19 bp, Homo sapiens
ttcctggggttccattgtg

SEQ ID NO: 9362716 - DNA, 19 bp, Homo sapiens
ttcctggggttccattgtg

SEQ ID NO: 9362717 - DNA, 22 bp, Homo sapiens
ttcctgggtttacgtattgggt

SEQ ID NO: 9362718 - DNA, 22 bp, Homo sapiens
ttcctgggttgtgcattgtaca

SEQ ID NO: 9362719 - DNA, 22 bp, Homo sapiens
ttcctgggttgtgcattgtaca

SEQ ID NO: 9362720 - DNA, 22 bp, Homo sapiens
ttcctgggttccctctcattct

SEQ ID NO: 9362721 - DNA, 22 bp, Homo sapiens
ttcctgggttccctctcattct

SEQ ID NO: 9362722 - DNA, 22 bp, Homo sapiens
ttcctggtcactgctgttccct

SEQ ID NO: 9362723 - DNA, 22 bp, Homo sapiens
ttcctggtagtaagacatctgg

SEQ ID NO: 9362724 - DNA, 22 bp, Homo sapiens
ttcctggtctgtgccattcaga

SEQ ID NO: 9362725 - DNA, 22 bp, Homo sapiens
ttcctggtcccgttcttcactg

SEQ ID NO: 9362726 - DNA, 22 bp, Homo sapiens
ttcctggtgagatttcgttctg

SEQ ID NO: 9362727 - DNA, 22 bp, Homo sapiens
ttccttcttttacaccataaat

SEQ ID NO: 9362728 - DNA, 22 bp, Homo sapiens
ttccttctttgtggtagaaagt

SEQ ID NO: 9362729 - DNA, 22 bp, Homo sapiens
ttccttgcctcggggtaccttg

SEQ ID NO: 9362730 - DNA, 22 bp, Homo sapiens
ttccttctggaagcttcagggg

SEQ ID NO: 9362731 - DNA, 22 bp, Homo sapiens
ttccttctggaagcttcagggg

SEQ ID NO: 9362732 - DNA, 18 bp, Homo sapiens
ttccttctgatgtatatg

SEQ ID NO: 9362733 - DNA, 22 bp, Homo sapiens
ttccttctggagcccggggagc

SEQ ID NO: 9362734 - DNA, 22 bp, Homo sapiens
ttccttctggaggctccagggg

SEQ ID NO: 9362735 - DNA, 22 bp, Homo sapiens
ttccttctggaggctccagggg

SEQ ID NO: 9362736 - DNA, 22 bp, Homo sapiens
ttccttctggaggctccagggg

SEQ ID NO: 9362737 - DNA, 22 bp, Homo sapiens
ttccttcttcattgtgttacag

SEQ ID NO: 9362738 - DNA, 22 bp, Homo sapiens
ttccttcttgtaatgatctgcc

SEQ ID NO: 9362739 - DNA, 22 bp, Homo sapiens
ttccttcttcctttagtaacca

SEQ ID NO: 9362740 - DNA, 22 bp, Homo sapiens
ttccttcttccagaggctgccc

SEQ ID NO: 9362741 - DNA, 22 bp, Homo sapiens
ttccttcttccagaggctgccc

SEQ ID NO: 9362742 - DNA, 22 bp, Homo sapiens
ttccttcttccaaacccatcat

SEQ ID NO: 9362743 - DNA, 22 bp, Homo sapiens
ttccttcttccaaacccatcat

SEQ ID NO: 9362744 - DNA, 22 bp, Homo sapiens
ttccttcttccaaacccatcat

SEQ ID NO: 9362745 - DNA, 22 bp, Homo sapiens
ttcctgccctgcctgtgccact

SEQ ID NO: 9362746 - DNA, 22 bp, Homo sapiens
ttcctgccctgcctgtgccact

SEQ ID NO: 9362747 - DNA, 22 bp, Homo sapiens
ttcctgcccctgagagctccca

SEQ ID NO: 9362748 - DNA, 22 bp, Homo sapiens
ttcctgcccctgagagctccca

SEQ ID NO: 9362749 - DNA, 22 bp, Homo sapiens
ttcctgctccatttgctgagct

SEQ ID NO: 9362750 - DNA, 22 bp, Homo sapiens
ttcctgctccatttgctgagct

SEQ ID NO: 9362751 - DNA, 22 bp, Homo sapiens
ttcctgcttcctggcctcacaa

SEQ ID NO: 9362752 - DNA, 22 bp, Homo sapiens
ttcctggaaattatgctcacct

SEQ ID NO: 9362753 - DNA, 22 bp, Homo sapiens
ttcctggcacatagttagtgct

SEQ ID NO: 9362754 - DNA, 22 bp, Homo sapiens
ttcctggcacactcctgaatgt

SEQ ID NO: 9362755 - DNA, 21 bp, Homo sapiens
ttcctggaggcagaaacgtga

SEQ ID NO: 9362756 - DNA, 22 bp, Homo sapiens
ttcctggcaaagtgagcatcac

SEQ ID NO: 9362757 - DNA, 22 bp, Homo sapiens
ttcctggcaaagtgagcatcac

SEQ ID NO: 9362758 - DNA, 22 bp, Homo sapiens
ttcctggcaccaccacttctag

SEQ ID NO: 9362759 - DNA, 22 bp, Homo sapiens
ttcctggcaccaccacttctag

SEQ ID NO: 9362760 - DNA, 22 bp, Homo sapiens
ttcctggcaccctggacccggc

SEQ ID NO: 9362761 - DNA, 22 bp, Homo sapiens
ttcctggcaccctggacccggc

SEQ ID NO: 9362762 - DNA, 22 bp, Homo sapiens
ttcctggagagttttcccaaag

SEQ ID NO: 9362763 - DNA, 21 bp, Homo sapiens
ttcctggaggcagaaacgtga

SEQ ID NO: 9362764 - DNA, 21 bp, Homo sapiens
ttcctggaggcagaaacgtga

SEQ ID NO: 9362765 - DNA, 17 bp, Homo sapiens
ttcctggaagtcattcc

SEQ ID NO: 9362766 - DNA, 22 bp, Homo sapiens
ttcctggaaattatgctcacct

SEQ ID NO: 9362767 - DNA, 17 bp, Homo sapiens
ttcctggaagtcattcc

SEQ ID NO: 9362768 - DNA, 17 bp, Homo sapiens
ttcctggaagtcattcc

SEQ ID NO: 9362769 - DNA, 22 bp, Homo sapiens
ttcctggggcgactgtatctga

SEQ ID NO: 9362770 - DNA, 21 bp, Homo sapiens
ttcctggggacttccgtggga

SEQ ID NO: 9362771 - DNA, 22 bp, Homo sapiens
ttcctggctcacagcagtgggg

SEQ ID NO: 9362772 - DNA, 21 bp, Homo sapiens
ttcctggcggcagaaacgtga

SEQ ID NO: 9362773 - DNA, 22 bp, Homo sapiens
ttcctggctcacagcagtgggg

SEQ ID NO: 9362774 - DNA, 22 bp, Homo sapiens
ttcctggcctaaggtaggtgac

SEQ ID NO: 9362775 - DNA, 22 bp, Homo sapiens
ttcctggcctctctctgagcag

SEQ ID NO: 9362776 - DNA, 22 bp, Homo sapiens
ttcctggcctctctctgagcag

SEQ ID NO: 9362777 - DNA, 22 bp, Homo sapiens
ttcctggcctcttccaccacca

SEQ ID NO: 9362778 - DNA, 22 bp, Homo sapiens
ttcctggcctcttccaccacca

SEQ ID NO: 9362779 - DNA, 22 bp, Homo sapiens
ttcctggcgccacggagccggt

SEQ ID NO: 9362780 - DNA, 22 bp, Homo sapiens
ttcctggccaagcagagtggaa

SEQ ID NO: 9362781 - DNA, 22 bp, Homo sapiens
ttcctggcattatgggaggctg

SEQ ID NO: 9362782 - DNA, 22 bp, Homo sapiens
ttcctggccaagcagagtggaa

SEQ ID NO: 9362783 - DNA, 22 bp, Homo sapiens
ttcctggccagctgtggtgagt

SEQ ID NO: 9362784 - DNA, 22 bp, Homo sapiens
ttcctggccaagcagagtggaa

SEQ ID NO: 9362785 - DNA, 22 bp, Homo sapiens
ttcctggccccacccctggaga

SEQ ID NO: 9362786 - DNA, 22 bp, Homo sapiens
ttcctggccccatccatcttca

SEQ ID NO: 9362787 - DNA, 22 bp, Homo sapiens
ttcctggccccatccatcttca

SEQ ID NO: 9362788 - DNA, 22 bp, Homo sapiens
ttcctggcactgcagtggttga

SEQ ID NO: 9362789 - DNA, 22 bp, Homo sapiens
ttcctggcacccttgttagcct

SEQ ID NO: 9362790 - DNA, 22 bp, Homo sapiens
ttcctggcagaggccccgacag

SEQ ID NO: 9362791 - DNA, 23 bp, Homo sapiens
ttcctggcaggtacaacttttac

SEQ ID NO: 9362792 - DNA, 22 bp, Homo sapiens
ttcctggcatagagagggcaca

SEQ ID NO: 9362793 - DNA, 22 bp, Homo sapiens
ttcctggcatagagagggcaca

SEQ ID NO: 9362794 - DNA, 22 bp, Homo sapiens
ttcctggcattatgggaggctg

SEQ ID NO: 9362795 - DNA, 22 bp, Homo sapiens
ttcctggcattatgggaggctg

SEQ ID NO: 9362796 - DNA, 22 bp, Homo sapiens
ttcctggcatgaaaaatatcac

SEQ ID NO: 9362797 - DNA, 22 bp, Homo sapiens
ttcctgaatgctgttgtgctgt

SEQ ID NO: 9362798 - DNA, 22 bp, Homo sapiens
ttcctgaatcccaaggagagct

SEQ ID NO: 9362799 - DNA, 17 bp, Homo sapiens
ttccagtttagtattgt

SEQ ID NO: 9362800 - DNA, 17 bp, Homo sapiens
ttccagtttagtattgt

SEQ ID NO: 9362801 - DNA, 22 bp, Homo sapiens
ttccagttggtagaatgtaagg

SEQ ID NO: 9362802 - DNA, 22 bp, Homo sapiens
ttcctgagggacttttgagatt

SEQ ID NO: 9362803 - DNA, 22 bp, Homo sapiens
ttcctgaggaggaccaggacca

SEQ ID NO: 9362804 - DNA, 22 bp, Homo sapiens
ttcctgcacagcccttcctgag

SEQ ID NO: 9362805 - DNA, 22 bp, Homo sapiens
ttcctgcagcaaggagaagctg

SEQ ID NO: 9362806 - DNA, 22 bp, Homo sapiens
ttcctgcaaaactactagtagc

SEQ ID NO: 9362807 - DNA, 22 bp, Homo sapiens
ttcttttaatgttctgaagttt

SEQ ID NO: 9362808 - DNA, 22 bp, Homo sapiens
ttcttttcggcctgtgagaagg

SEQ ID NO: 9362809 - DNA, 22 bp, Homo sapiens
ttcttttaatgttctgaagttt

SEQ ID NO: 9362810 - DNA, 22 bp, Homo sapiens
ttcttttaattgtgggggagtg

SEQ ID NO: 9362811 - DNA, 22 bp, Homo sapiens
ttcttttctgcagctggtattt

SEQ ID NO: 9362812 - DNA, 22 bp, Homo sapiens
ttcttttcttggcaggagtaga

SEQ ID NO: 9362813 - DNA, 22 bp, Homo sapiens
ttcttttctgcagctggtattt

SEQ ID NO: 9362814 - DNA, 22 bp, Homo sapiens
ttcttttaaaagagagcagaaa

SEQ ID NO: 9362815 - DNA, 22 bp, Homo sapiens
ttcttttaaaagagagcagaaa

SEQ ID NO: 9362816 - DNA, 22 bp, Homo sapiens
ttcttttaaaagagagcagaaa

SEQ ID NO: 9362817 - DNA, 22 bp, Homo sapiens
ttcttttaatagagatcctgtg

SEQ ID NO: 9362818 - DNA, 22 bp, Homo sapiens
ttcttttaatagagatcctgtg

SEQ ID NO: 9362819 - DNA, 22 bp, Homo sapiens
ttcttttaatgtctggctttca

SEQ ID NO: 9362820 - DNA, 22 bp, Homo sapiens
ttcttttaatgtctggctttca

SEQ ID NO: 9362821 - DNA, 22 bp, Homo sapiens
ttcttttaatgttctgaagttt

SEQ ID NO: 9362822 - DNA, 22 bp, Homo sapiens
ttcttttaatgtctggctttca

SEQ ID NO: 9362823 - DNA, 22 bp, Homo sapiens
ttcttttaatgtctggctttca

SEQ ID NO: 9362824 - DNA, 22 bp, Homo sapiens
ttctttgtgctgaagaagccct

SEQ ID NO: 9362825 - DNA, 23 bp, Homo sapiens
ttctttgtggataatctccagtg

SEQ ID NO: 9362826 - DNA, 23 bp, Homo sapiens
ttctttgtggataatctccagtg

SEQ ID NO: 9362827 - DNA, 22 bp, Homo sapiens
ttctttgtggcagtgagctggg

SEQ ID NO: 9362828 - DNA, 22 bp, Homo sapiens
ttctttgttgtactttcctaca

SEQ ID NO: 9362829 - DNA, 22 bp, Homo sapiens
ttctttgtttgataagtatgct

SEQ ID NO: 9362830 - DNA, 22 bp, Homo sapiens
ttctttgttgtactttcctaca

SEQ ID NO: 9362831 - DNA, 22 bp, Homo sapiens
ttctttgttgagcaagtaggac

SEQ ID NO: 9362832 - DNA, 20 bp, Homo sapiens
ttctttgttccttacatttg

SEQ ID NO: 9362833 - DNA, 22 bp, Homo sapiens
ttcttcaacaaggacactgtta

SEQ ID NO: 9362834 - DNA, 22 bp, Homo sapiens
ttcttcaaccatctacataaac

SEQ ID NO: 9362835 - DNA, 22 bp, Homo sapiens
ttcttcaagggtaaaggcaacg

SEQ ID NO: 9362836 - DNA, 22 bp, Homo sapiens
ttcttcaataaattcccataag

SEQ ID NO: 9362837 - DNA, 22 bp, Homo sapiens
ttcttcagactactgatgattg

SEQ ID NO: 9362838 - DNA, 22 bp, Homo sapiens
ttcttattatgtgctctgtgaa

SEQ ID NO: 9362839 - DNA, 22 bp, Homo sapiens
ttcttattttcctgaggaagaa

SEQ ID NO: 9362840 - DNA, 23 bp, Homo sapiens
ttcttatttactttggaatctcc

SEQ ID NO: 9362841 - DNA, 22 bp, Homo sapiens
ttcttttggactcaaagagaac

SEQ ID NO: 9362842 - DNA, 22 bp, Homo sapiens
ttcttttctttaggcattgtgt

SEQ ID NO: 9362843 - DNA, 22 bp, Homo sapiens
ttcttttcttggcaggagtaga

SEQ ID NO: 9362844 - DNA, 22 bp, Homo sapiens
ttctttttaaagtgtgtatgca

SEQ ID NO: 9362845 - DNA, 22 bp, Homo sapiens
ttgaaaggaatacagaggccta

SEQ ID NO: 9362846 - DNA, 22 bp, Homo sapiens
ttgaaaggcacaggcacctggg

SEQ ID NO: 9362847 - DNA, 22 bp, Homo sapiens
ttgaaaggcctgtttatccagc

SEQ ID NO: 9362848 - DNA, 22 bp, Homo sapiens
ttctttttaaagtgtgtatgca

SEQ ID NO: 9362849 - DNA, 22 bp, Homo sapiens
ttctttttaaagtgtgtatgca

SEQ ID NO: 9362850 - DNA, 22 bp, Homo sapiens
ttgaaatatttgggagtgtttg

SEQ ID NO: 9362851 - DNA, 22 bp, Homo sapiens
ttgaaagggatatatctttctg

SEQ ID NO: 9362852 - DNA, 22 bp, Homo sapiens
ttgaaatatggattgaccttga

SEQ ID NO: 9362853 - DNA, 22 bp, Homo sapiens
ttgaaatggaagtgaaaattct

SEQ ID NO: 9362854 - DNA, 22 bp, Homo sapiens
ttgaactaataggtatcttgta

SEQ ID NO: 9362855 - DNA, 22 bp, Homo sapiens
ttgaagaaagtcatatataatg

SEQ ID NO: 9362856 - DNA, 22 bp, Homo sapiens
ttgaacattggcaatttcatat

SEQ ID NO: 9362857 - DNA, 22 bp, Homo sapiens
ttgaacattggcaatttcatat

SEQ ID NO: 9362858 - DNA, 22 bp, Homo sapiens
ttgaacattagaataagtaatt

SEQ ID NO: 9362859 - DNA, 22 bp, Homo sapiens
ttgaacattttctatgttatag

SEQ ID NO: 9362860 - DNA, 22 bp, Homo sapiens
ttgaatttagattgtatgttga

SEQ ID NO: 9362861 - DNA, 21 bp, Homo sapiens
ttgaattgtatgattaaactg

SEQ ID NO: 9362862 - DNA, 19 bp, Homo sapiens
ttgaattgttttgagtagg

SEQ ID NO: 9362863 - DNA, 22 bp, Homo sapiens
ttgaattggcaaaactgcagct

SEQ ID NO: 9362864 - DNA, 22 bp, Homo sapiens
ttgaattgaaacataccctggt

SEQ ID NO: 9362865 - DNA, 22 bp, Homo sapiens
ttgaagaaagtcatatataatg

SEQ ID NO: 9362866 - DNA, 19 bp, Homo sapiens
ttgaaattgtttgatatgg

SEQ ID NO: 9362867 - DNA, 22 bp, Homo sapiens
ttgaacattaacttcagtctat

SEQ ID NO: 9362868 - DNA, 22 bp, Homo sapiens
ttgaacataaatcactggtcag

SEQ ID NO: 9362869 - DNA, 22 bp, Homo sapiens
ttgaacagtcctaagagaccct

SEQ ID NO: 9362870 - DNA, 22 bp, Homo sapiens
ttcttataagttaatatttcca

SEQ ID NO: 9362871 - DNA, 22 bp, Homo sapiens
ttcttataagttaatatttcca

SEQ ID NO: 9362872 - DNA, 22 bp, Homo sapiens
ttcttagagatggttaaaaata

SEQ ID NO: 9362873 - DNA, 22 bp, Homo sapiens
ttcttactatgatttgagcctc

SEQ ID NO: 9362874 - DNA, 22 bp, Homo sapiens
ttcttagtggtagtcatctttg

SEQ ID NO: 9362875 - DNA, 19 bp, Homo sapiens
ttcttagtctcatgcatga

SEQ ID NO: 9362876 - DNA, 22 bp, Homo sapiens
ttcttagtagcatagctatatt

SEQ ID NO: 9362877 - DNA, 22 bp, Homo sapiens
ttctgtgttgtgacattctaga

SEQ ID NO: 9362878 - DNA, 22 bp, Homo sapiens
ttctgtgttgtgacattctaga

SEQ ID NO: 9362879 - DNA, 22 bp, Homo sapiens
ttctgtgtgtctcagcaagctg

SEQ ID NO: 9362880 - DNA, 22 bp, Homo sapiens
ttcttactacatttgcaggcta

SEQ ID NO: 9362881 - DNA, 22 bp, Homo sapiens
ttcttacattactttacatgtg

SEQ ID NO: 9362882 - DNA, 19 bp, Homo sapiens
ttctgtgttaattccttta

SEQ ID NO: 9362883 - DNA, 22 bp, Homo sapiens
ttctgtgtgggtagctcctgtt

SEQ ID NO: 9362884 - DNA, 22 bp, Homo sapiens
ttctgtgtgggtagctcctgtt

SEQ ID NO: 9362885 - DNA, 22 bp, Homo sapiens
ttctgtgtgctgtcttggcttt

SEQ ID NO: 9362886 - DNA, 22 bp, Homo sapiens
ttctgtgtgctgtcttggcttt

SEQ ID NO: 9362887 - DNA, 22 bp, Homo sapiens
ttctgtacccaacatttttact

SEQ ID NO: 9362888 - DNA, 19 bp, Homo sapiens
ttctgtaaggacattaatc

SEQ ID NO: 9362889 - DNA, 22 bp, Homo sapiens
ttctgtctgtaaacttctcaat

SEQ ID NO: 9362890 - DNA, 22 bp, Homo sapiens
ttctgtctgtaaacttctcaat

SEQ ID NO: 9362891 - DNA, 23 bp, Homo sapiens
ttctgtcttgctgtcagctttct

SEQ ID NO: 9362892 - DNA, 22 bp, Homo sapiens
ttctgtgtcttcttgttctgtg

SEQ ID NO: 9362893 - DNA, 22 bp, Homo sapiens
ttctgtggctgggagcctggct

SEQ ID NO: 9362894 - DNA, 22 bp, Homo sapiens
ttctgtggtctcccatgtctgt

SEQ ID NO: 9362895 - DNA, 22 bp, Homo sapiens
ttctgtgggtaatacctcatac

SEQ ID NO: 9362896 - DNA, 22 bp, Homo sapiens
ttctgtgaatggccatgacaag

SEQ ID NO: 9362897 - DNA, 22 bp, Homo sapiens
ttctgtgcccattttaaaatgg

SEQ ID NO: 9362898 - DNA, 22 bp, Homo sapiens
ttctgtgcgtaggcgatgcagt

SEQ ID NO: 9362899 - DNA, 22 bp, Homo sapiens
ttctctggggacttggttggag

SEQ ID NO: 9362900 - DNA, 22 bp, Homo sapiens
ttctctggggactgtctctatt

SEQ ID NO: 9362901 - DNA, 22 bp, Homo sapiens
ttctctgggttaggggaactat

SEQ ID NO: 9362902 - DNA, 16 bp, Homo sapiens
ttctctggggttgtgc

SEQ ID NO: 9362903 - DNA, 22 bp, Homo sapiens
ttctctgggacaggaacagttt

SEQ ID NO: 9362904 - DNA, 22 bp, Homo sapiens
ttctctgggatctggcaaaagg

SEQ ID NO: 9362905 - DNA, 22 bp, Homo sapiens
ttctctggacagtgaagagagg

SEQ ID NO: 9362906 - DNA, 22 bp, Homo sapiens
ttctctggacagtgaagagagg

SEQ ID NO: 9362907 - DNA, 19 bp, Homo sapiens
ttctctggactagatgctg

SEQ ID NO: 9362908 - DNA, 18 bp, Homo sapiens
ttctctggtggatgttat

SEQ ID NO: 9362909 - DNA, 22 bp, Homo sapiens
ttctggaaatgcacaactaatt

SEQ ID NO: 9362910 - DNA, 22 bp, Homo sapiens
ttctggaaatgaatgctaggaa

SEQ ID NO: 9362911 - DNA, 22 bp, Homo sapiens
ttctggaacatagcaagaagtt

SEQ ID NO: 9362912 - DNA, 22 bp, Homo sapiens
ttctggaaatgttgctgaggcc

SEQ ID NO: 9362913 - DNA, 22 bp, Homo sapiens
ttctggaaatgggtatagagca

SEQ ID NO: 9362914 - DNA, 22 bp, Homo sapiens
ttctggaaatgggtatagagca

SEQ ID NO: 9362915 - DNA, 22 bp, Homo sapiens
ttctggaatatttgacacaatt

SEQ ID NO: 9362916 - DNA, 22 bp, Homo sapiens
ttctggaatactaagttccttt

SEQ ID NO: 9362917 - DNA, 22 bp, Homo sapiens
ttctggaagttttctcctgtgg

SEQ ID NO: 9362918 - DNA, 22 bp, Homo sapiens
ttctggaagttggaaatagcag

SEQ ID NO: 9362919 - DNA, 22 bp, Homo sapiens
ttctggaagtgttagaatctgg

SEQ ID NO: 9362920 - DNA, 22 bp, Homo sapiens
ttctggaagttggaaatagcag

SEQ ID NO: 9362921 - DNA, 22 bp, Homo sapiens
ttctggaagtggaatttttgta

SEQ ID NO: 9362922 - DNA, 22 bp, Homo sapiens
ttctggaatcctcaaaacatga

SEQ ID NO: 9362923 - DNA, 22 bp, Homo sapiens
ttctggaattctggctatggta

SEQ ID NO: 9362924 - DNA, 22 bp, Homo sapiens
ttctggaatgcctgttctaatt

SEQ ID NO: 9362925 - DNA, 22 bp, Homo sapiens
ttctggaatgcctgttctaatt

SEQ ID NO: 9362926 - DNA, 22 bp, Homo sapiens
ttctggacacgtgactctcatt

SEQ ID NO: 9362927 - DNA, 22 bp, Homo sapiens
ttctggacttgccttgctgatg

SEQ ID NO: 9362928 - DNA, 23 bp, Homo sapiens
ttctggacattgggcaatagcag

SEQ ID NO: 9362929 - DNA, 22 bp, Homo sapiens
ttctggaattcttgcagccact

SEQ ID NO: 9362930 - DNA, 23 bp, Homo sapiens
ttctggacattgggcaatagcag

SEQ ID NO: 9362931 - DNA, 23 bp, Homo sapiens
ttctggagaaaggaccatagctt

SEQ ID NO: 9362932 - DNA, 23 bp, Homo sapiens
ttctggagaaaggaccatagctt

SEQ ID NO: 9362933 - DNA, 22 bp, Homo sapiens
ttctggagaataatcagcattg

SEQ ID NO: 9362934 - DNA, 22 bp, Homo sapiens
ttctggagaataatcagcattg

SEQ ID NO: 9362935 - DNA, 22 bp, Homo sapiens
ttctggagagaagaccagtgtg

SEQ ID NO: 9362936 - DNA, 22 bp, Homo sapiens
ttctggagaatcaccaccaggc

SEQ ID NO: 9362937 - DNA, 22 bp, Homo sapiens
ttctggagccgggcctgggcag

SEQ ID NO: 9362938 - DNA, 22 bp, Homo sapiens
ttctggagccccaagatctgta

SEQ ID NO: 9362939 - DNA, 22 bp, Homo sapiens
ttctggagccgggcctgggcag

SEQ ID NO: 9362940 - DNA, 22 bp, Homo sapiens
ttctgtaagctaccaagtttgt

SEQ ID NO: 9362941 - DNA, 22 bp, Homo sapiens
ttctggtttaagaaagtgctgg

SEQ ID NO: 9362942 - DNA, 22 bp, Homo sapiens
ttctggagctctcgaccccact

SEQ ID NO: 9362943 - DNA, 22 bp, Homo sapiens
ttctggttttactgaggaaatc

SEQ ID NO: 9362944 - DNA, 22 bp, Homo sapiens
ttctggagctaaagtccactct

SEQ ID NO: 9362945 - DNA, 22 bp, Homo sapiens
ttctggagattgagaaggcatt

SEQ ID NO: 9362946 - DNA, 22 bp, Homo sapiens
ttctggagatctgcctatggga

SEQ ID NO: 9362947 - DNA, 22 bp, Homo sapiens
ttctggagatgacttttagaaa

SEQ ID NO: 9362948 - DNA, 22 bp, Homo sapiens
ttctggagatagtcaggcatta

SEQ ID NO: 9362949 - DNA, 22 bp, Homo sapiens
ttatagtgattaaaattgctca

SEQ ID NO: 9362950 - DNA, 22 bp, Homo sapiens
ttatataaagataacttttctt

SEQ ID NO: 9362951 - DNA, 22 bp, Homo sapiens
ttatatactgtggtagtactgt

SEQ ID NO: 9362952 - DNA, 22 bp, Homo sapiens
ttatatactgtggtagtactgt

SEQ ID NO: 9362953 - DNA, 22 bp, Homo sapiens
ttatatactgtggtagtactgt

SEQ ID NO: 9362954 - DNA, 19 bp, Homo sapiens
ttatatacttggtttctct

SEQ ID NO: 9362955 - DNA, 22 bp, Homo sapiens
ttatacatgtgttttgagatga

SEQ ID NO: 9362956 - DNA, 22 bp, Homo sapiens
ttatacagtttatacttagaat

SEQ ID NO: 9362957 - DNA, 20 bp, Homo sapiens
ttagctttggcaatagtgac

SEQ ID NO: 9362958 - DNA, 20 bp, Homo sapiens
ttagctttggcaatagtgac

SEQ ID NO: 9362959 - DNA, 22 bp, Homo sapiens
ttagctttcctactaataaata

SEQ ID NO: 9362960 - DNA, 20 bp, Homo sapiens
tcctgctgccacctcttctt

SEQ ID NO: 9362961 - DNA, 22 bp, Homo sapiens
tcctgctgccatttcaagtgct

SEQ ID NO: 9362962 - DNA, 22 bp, Homo sapiens
tcctgcctgtttacctgtactt

SEQ ID NO: 9362963 - DNA, 22 bp, Homo sapiens
tcctgccttagagcaaggaaaa

SEQ ID NO: 9362964 - DNA, 22 bp, Homo sapiens
tcctgcctgcaatcccagcact

SEQ ID NO: 9362965 - DNA, 18 bp, Homo sapiens
tcctgcctgcgggctccc

SEQ ID NO: 9362966 - DNA, 19 bp, Homo sapiens
tcctgcctggggccgcctg

SEQ ID NO: 9362967 - DNA, 18 bp, Homo sapiens
tcctgcctgcgggctccc

SEQ ID NO: 9362968 - DNA, 18 bp, Homo sapiens
tcctgcctgcgggctccc

SEQ ID NO: 9362969 - DNA, 18 bp, Homo sapiens
tcctgcctgcgggctccc

SEQ ID NO: 9362970 - DNA, 18 bp, Homo sapiens
tcctgcctgtgccccagg

SEQ ID NO: 9362971 - DNA, 18 bp, Homo sapiens
tcctgcctgtgccccagg

SEQ ID NO: 9362972 - DNA, 22 bp, Homo sapiens
tcctgcctgtttacctgtactt

SEQ ID NO: 9362973 - DNA, 18 bp, Homo sapiens
tcctgcctgtgccccagg

SEQ ID NO: 9362974 - DNA, 18 bp, Homo sapiens
tcctgcctgtgccccagg

SEQ ID NO: 9362975 - DNA, 19 bp, Homo sapiens
tcctgcctggggccgcctg

SEQ ID NO: 9362976 - DNA, 22 bp, Homo sapiens
tcctgctggaaacttcctcttg

SEQ ID NO: 9362977 - DNA, 22 bp, Homo sapiens
tcctgctggaagtagggaatga

SEQ ID NO: 9362978 - DNA, 21 bp, Homo sapiens
tcctgctgctcctgtcgtgtt

SEQ ID NO: 9362979 - DNA, 22 bp, Homo sapiens
ttagccatgccctagaagagga

SEQ ID NO: 9362980 - DNA, 22 bp, Homo sapiens
ttagccatatagaaaaagagct

SEQ ID NO: 9362981 - DNA, 23 bp, Homo sapiens
ttagcgaggaaatcagtagagaa

SEQ ID NO: 9362982 - DNA, 22 bp, Homo sapiens
ttattgttaggcttttggaatt

SEQ ID NO: 9362983 - DNA, 22 bp, Homo sapiens
ttcaaacactggcttagccaat

SEQ ID NO: 9362984 - DNA, 22 bp, Homo sapiens
ttcaaacactgctttgagaggg

SEQ ID NO: 9362985 - DNA, 22 bp, Homo sapiens
ttcaaacacagacagcagcatg

SEQ ID NO: 9362986 - DNA, 22 bp, Homo sapiens
ttcaaacagatgactctgctct

SEQ ID NO: 9362987 - DNA, 22 bp, Homo sapiens
ttcaaacagatgactctgctct

SEQ ID NO: 9362988 - DNA, 22 bp, Homo sapiens
ttcaaaccatggcacaggaagg

SEQ ID NO: 9362989 - DNA, 22 bp, Homo sapiens
ttcaaacctatctaagaaatag

SEQ ID NO: 9362990 - DNA, 22 bp, Homo sapiens
ttcaaacagtgtagaatatatg

SEQ ID NO: 9362991 - DNA, 22 bp, Homo sapiens
ttcaaacagttgcacaacttat

SEQ ID NO: 9362992 - DNA, 22 bp, Homo sapiens
ttcaaacagttgcacaacttat

SEQ ID NO: 9362993 - DNA, 22 bp, Homo sapiens
ttattgctgctaacattttatg

SEQ ID NO: 9362994 - DNA, 22 bp, Homo sapiens
ttattgcttttgtgcaggtgag

SEQ ID NO: 9362995 - DNA, 22 bp, Homo sapiens
ttattgctgatagtgtttataa

SEQ ID NO: 9362996 - DNA, 22 bp, Homo sapiens
ttattgctgatagtgtttataa

SEQ ID NO: 9362997 - DNA, 22 bp, Homo sapiens
ttattgagcacctactatgtgt

SEQ ID NO: 9362998 - DNA, 22 bp, Homo sapiens
ttattgagcacctactatgtgt

SEQ ID NO: 9362999 - DNA, 22 bp, Homo sapiens
ttattgagcacatagtatgtgg

SEQ ID NO: 9363000 - DNA, 22 bp, Homo sapiens
ttattgtaggcctattgtagaa

SEQ ID NO: 9363001 - DNA, 22 bp, Homo sapiens
ttattgtaggcctattgtagaa

SEQ ID NO: 9363002 - DNA, 22 bp, Homo sapiens
ttattgtaggcctattgtagaa

SEQ ID NO: 9363003 - DNA, 22 bp, Homo sapiens
ttattgtcaaaaacaggacact

SEQ ID NO: 9363004 - DNA, 22 bp, Homo sapiens
ttattgtaggcctattgtagaa

SEQ ID NO: 9363005 - DNA, 22 bp, Homo sapiens
ttattgtagcactttggcagtg

SEQ ID NO: 9363006 - DNA, 22 bp, Homo sapiens
ttattgtagcactttggcagtg

SEQ ID NO: 9363007 - DNA, 18 bp, Homo sapiens
ttattggtgctgctgttc

SEQ ID NO: 9363008 - DNA, 22 bp, Homo sapiens
ttattgacacatctggatgttt

SEQ ID NO: 9363009 - DNA, 22 bp, Homo sapiens
ttattgacacatctggatgttt

SEQ ID NO: 9363010 - DNA, 22 bp, Homo sapiens
ttattgaaggaactgaaataaa

SEQ ID NO: 9363011 - DNA, 22 bp, Homo sapiens
ttattcttttctccagaatccc

SEQ ID NO: 9363012 - DNA, 21 bp, Homo sapiens
ttattgagacatttgtggaaa

SEQ ID NO: 9363013 - DNA, 21 bp, Homo sapiens
ttattgagacatttgtggaaa

SEQ ID NO: 9363014 - DNA, 22 bp, Homo sapiens
ttattgagaccgtaagtcaggt

SEQ ID NO: 9363015 - DNA, 22 bp, Homo sapiens
ttattgagaccgtaagtcaggt

SEQ ID NO: 9363016 - DNA, 22 bp, Homo sapiens
ttattgagagctgttttatggc

SEQ ID NO: 9363017 - DNA, 22 bp, Homo sapiens
ttattgagagctgttttatggc

SEQ ID NO: 9363018 - DNA, 22 bp, Homo sapiens
ttattgagcaactctggggctc

SEQ ID NO: 9363019 - DNA, 22 bp, Homo sapiens
ttattgagcacatagtatgtgg

SEQ ID NO: 9363020 - DNA, 22 bp, Homo sapiens
ttattgactgatcagagaggga

SEQ ID NO: 9363021 - DNA, 22 bp, Homo sapiens
ttattgactgaaatgagagtga

SEQ ID NO: 9363022 - DNA, 22 bp, Homo sapiens
ttattgactgaaatgagagtga

SEQ ID NO: 9363023 - DNA, 22 bp, Homo sapiens
ttattgactcccagcttttcca

SEQ ID NO: 9363024 - DNA, 22 bp, Homo sapiens
ttattgactgaaatgagagtga

SEQ ID NO: 9363025 - DNA, 22 bp, Homo sapiens
ttattgacttattaattgtgct

SEQ ID NO: 9363026 - DNA, 22 bp, Homo sapiens
ttattatggcagttttctaggt

SEQ ID NO: 9363027 - DNA, 22 bp, Homo sapiens
ttattatagattatgcaagatt

SEQ ID NO: 9363028 - DNA, 22 bp, Homo sapiens
ttattctttaaacatatatgtt

SEQ ID NO: 9363029 - DNA, 22 bp, Homo sapiens
ttattcttttctccagaatccc

SEQ ID NO: 9363030 - DNA, 22 bp, Homo sapiens
ttattagatctgttagggatcc

SEQ ID NO: 9363031 - DNA, 22 bp, Homo sapiens
ttattacagtcccagggagtag

SEQ ID NO: 9363032 - DNA, 22 bp, Homo sapiens
ttattacagtcccagggagtag

SEQ ID NO: 9363033 - DNA, 22 bp, Homo sapiens
ttattacactgaaagaattgcg

SEQ ID NO: 9363034 - DNA, 22 bp, Homo sapiens
ttattagagtgctttgagaaag

SEQ ID NO: 9363035 - DNA, 22 bp, Homo sapiens
ttattacactgaaagaattgcg

SEQ ID NO: 9363036 - DNA, 22 bp, Homo sapiens
ttattacactgaaagaattgcg

SEQ ID NO: 9363037 - DNA, 22 bp, Homo sapiens
ttattacactgaaagaattgcg

SEQ ID NO: 9363038 - DNA, 22 bp, Homo sapiens
ttatatatatgtagaggtcacg

SEQ ID NO: 9363039 - DNA, 22 bp, Homo sapiens
ttatatatatgtagaggtcacg

SEQ ID NO: 9363040 - DNA, 22 bp, Homo sapiens
ttatatatcttgatttgttcca

SEQ ID NO: 9363041 - DNA, 22 bp, Homo sapiens
ttatatatcttgatttgttcca

SEQ ID NO: 9363042 - DNA, 22 bp, Homo sapiens
ttatatatcttgatttgttcca

SEQ ID NO: 9363043 - DNA, 22 bp, Homo sapiens
ttattaaaatgcggatttggct

SEQ ID NO: 9363044 - DNA, 22 bp, Homo sapiens
ttattacaatgcagaaaataga

SEQ ID NO: 9363045 - DNA, 22 bp, Homo sapiens
ttattacaatgcagaaaataga

SEQ ID NO: 9363046 - DNA, 22 bp, Homo sapiens
ttattaatgagtacaagttatt

SEQ ID NO: 9363047 - DNA, 22 bp, Homo sapiens
ttattaatcttatctttggaaa

SEQ ID NO: 9363048 - DNA, 22 bp, Homo sapiens
ttattaatacatgcacctgcat

SEQ ID NO: 9363049 - DNA, 22 bp, Homo sapiens
ttattaataaagtggcatagcc

SEQ ID NO: 9363050 - DNA, 22 bp, Homo sapiens
ttattaagtgcgtactgtatgc

SEQ ID NO: 9363051 - DNA, 22 bp, Homo sapiens
ttattaagtgcctacaataaag

SEQ ID NO: 9363052 - DNA, 22 bp, Homo sapiens
ttattaagtgcctacaataaag

SEQ ID NO: 9363053 - DNA, 22 bp, Homo sapiens
ttcacagcttaataaggctcag

SEQ ID NO: 9363054 - DNA, 22 bp, Homo sapiens
ttcacagctcatactgttctca

SEQ ID NO: 9363055 - DNA, 22 bp, Homo sapiens
ttcacagatttccctgcacatg

SEQ ID NO: 9363056 - DNA, 22 bp, Homo sapiens
ttcacagagttatttttatgct

SEQ ID NO: 9363057 - DNA, 21 bp, Homo sapiens
ttcacagatgggaaaactgag

SEQ ID NO: 9363058 - DNA, 21 bp, Homo sapiens
ttcaaagacttgatgctgacc

SEQ ID NO: 9363059 - DNA, 22 bp, Homo sapiens
ttcaaagaccttacttggcaaa

SEQ ID NO: 9363060 - DNA, 22 bp, Homo sapiens
ttcaaagaattttgagacctga

SEQ ID NO: 9363061 - DNA, 22 bp, Homo sapiens
ttcaaactgtgtaatttataaa

SEQ ID NO: 9363062 - DNA, 22 bp, Homo sapiens
ttcaaagattagcatacgcaat

SEQ ID NO: 9363063 - DNA, 23 bp, Homo sapiens
ttcaaagatcttctgaaatctgt

SEQ ID NO: 9363064 - DNA, 22 bp, Homo sapiens
ttcacaatctggcttagcattg

SEQ ID NO: 9363065 - DNA, 22 bp, Homo sapiens
ttcacaatgccttgttgatggt

SEQ ID NO: 9363066 - DNA, 22 bp, Homo sapiens
ttcagagctggtgtctacagct

SEQ ID NO: 9363067 - DNA, 22 bp, Homo sapiens
ttcagagctcagaaaagtgtct

SEQ ID NO: 9363068 - DNA, 16 bp, Homo sapiens
ttcagagcggctcata

SEQ ID NO: 9363069 - DNA, 22 bp, Homo sapiens
ttcagagccacttcaagtctaa

SEQ ID NO: 9363070 - DNA, 22 bp, Homo sapiens
ttcagagccagcaacactaggc

SEQ ID NO: 9363071 - DNA, 22 bp, Homo sapiens
ttcagagcccaaatggagatta

SEQ ID NO: 9363072 - DNA, 22 bp, Homo sapiens
ttcagagcttagaatggactac

SEQ ID NO: 9363073 - DNA, 22 bp, Homo sapiens
ttcagaggacaaccagccatct

SEQ ID NO: 9363074 - DNA, 22 bp, Homo sapiens
ttcagcaagtgtctctactgtc

SEQ ID NO: 9363075 - DNA, 21 bp, Homo sapiens
ttcagcaagcactctggacac

SEQ ID NO: 9363076 - DNA, 22 bp, Homo sapiens
ttcagcacagttcaagatggta

SEQ ID NO: 9363077 - DNA, 22 bp, Homo sapiens
ttcagtgtcacaagagcaagcc

SEQ ID NO: 9363078 - DNA, 22 bp, Homo sapiens
ttcagtgtcacaagagcaagcc

SEQ ID NO: 9363079 - DNA, 22 bp, Homo sapiens
ttcagtgtccctagtagaagtt

SEQ ID NO: 9363080 - DNA, 22 bp, Homo sapiens
ttcacagggcagcagctgagcc

SEQ ID NO: 9363081 - DNA, 22 bp, Homo sapiens
ttcagagacatgttctagatca

SEQ ID NO: 9363082 - DNA, 22 bp, Homo sapiens
ttcagagcatctctaaagccag

SEQ ID NO: 9363083 - DNA, 22 bp, Homo sapiens
ttcagagcagatattgaagggt

SEQ ID NO: 9363084 - DNA, 22 bp, Homo sapiens
ttccaggctattccctttggag

SEQ ID NO: 9363085 - DNA, 19 bp, Homo sapiens
ttccagttctaatctcttc

SEQ ID NO: 9363086 - DNA, 22 bp, Homo sapiens
ttccagttcactccatttctgg

SEQ ID NO: 9363087 - DNA, 22 bp, Homo sapiens
ttccagtgaaacatgaggtgtg

SEQ ID NO: 9363088 - DNA, 22 bp, Homo sapiens
ttccagtctagtacctggatgc

SEQ ID NO: 9363089 - DNA, 22 bp, Homo sapiens
ttccagtctggcctgtgcttag

SEQ ID NO: 9363090 - DNA, 22 bp, Homo sapiens
ttccagtccagggctgtttcca

SEQ ID NO: 9363091 - DNA, 22 bp, Homo sapiens
ttcatttgtctgctatagatcc

SEQ ID NO: 9363092 - DNA, 22 bp, Homo sapiens
ttcatttggcctctgcttaaaa

SEQ ID NO: 9363093 - DNA, 22 bp, Homo sapiens
ttcatttgtaactctgttaggg

SEQ ID NO: 9363094 - DNA, 22 bp, Homo sapiens
ttcattttataaaccctgctga

SEQ ID NO: 9363095 - DNA, 22 bp, Homo sapiens
ttcattttctttcacgctgctg

SEQ ID NO: 9363096 - DNA, 22 bp, Homo sapiens
ttcatttttaccgcgtgtcaaa

SEQ ID NO: 9363097 - DNA, 22 bp, Homo sapiens
ttccaggcagaacaatcatgct

SEQ ID NO: 9363098 - DNA, 22 bp, Homo sapiens
ttccaggaattcagctctcagt

SEQ ID NO: 9363099 - DNA, 22 bp, Homo sapiens
ttcatttaatttgtgtattaac

SEQ ID NO: 9363100 - DNA, 22 bp, Homo sapiens
ttcatttaatttgtgtattaac

SEQ ID NO: 9363101 - DNA, 23 bp, Homo sapiens
ttcatttaggagttcataagagc

SEQ ID NO: 9363102 - DNA, 22 bp, Homo sapiens
ttcatttgcactggattactgg

SEQ ID NO: 9363103 - DNA, 22 bp, Homo sapiens
ttcatttattcagcaggtattt

SEQ ID NO: 9363104 - DNA, 22 bp, Homo sapiens
ttcatttattcagcaggtattt

SEQ ID NO: 9363105 - DNA, 22 bp, Homo sapiens
ttcataagttggtgttgacttt

SEQ ID NO: 9363106 - DNA, 22 bp, Homo sapiens
ttcattgtgtctatttttatct

SEQ ID NO: 9363107 - DNA, 22 bp, Homo sapiens
ttcattggtcctgctcctggac

SEQ ID NO: 9363108 - DNA, 22 bp, Homo sapiens
ttcattgtagcttgactaatta

SEQ ID NO: 9363109 - DNA, 22 bp, Homo sapiens
ttcagtgttactcaaggggcag

SEQ ID NO: 9363110 - DNA, 22 bp, Homo sapiens
ttcagtgttaatcttgggagaa

SEQ ID NO: 9363111 - DNA, 22 bp, Homo sapiens
ttcagtgtggcccatgaagagg

SEQ ID NO: 9363112 - DNA, 22 bp, Homo sapiens
ttcagtgtgcttcaggacgtta

SEQ ID NO: 9363113 - DNA, 22 bp, Homo sapiens
ttcataaacaactgatggtaat

SEQ ID NO: 9363114 - DNA, 23 bp, Homo sapiens
ttcataactcaaggtgatataat

SEQ ID NO: 9363115 - DNA, 22 bp, Homo sapiens
ttcagttttattgtactgctat

SEQ ID NO: 9363116 - DNA, 22 bp, Homo sapiens
ttttctgcctgcgtgtttagga

SEQ ID NO: 9363117 - DNA, 22 bp, Homo sapiens
ttttctgcctgcgtgtttagga

SEQ ID NO: 9363118 - DNA, 22 bp, Homo sapiens
ttttctgactctattgaggtat

SEQ ID NO: 9363119 - DNA, 22 bp, Homo sapiens
ttttctgacctatctacattta

SEQ ID NO: 9363120 - DNA, 22 bp, Homo sapiens
ttttctggtcacatgttattaa

SEQ ID NO: 9363121 - DNA, 22 bp, Homo sapiens
ttttctgtgtatccaggcttcc

SEQ ID NO: 9363122 - DNA, 20 bp, Homo sapiens
ttttctgtgccaagaaaact

SEQ ID NO: 9363123 - DNA, 22 bp, Homo sapiens
ttttctgtgattctgaggttgg

SEQ ID NO: 9363124 - DNA, 22 bp, Homo sapiens
ttttctgtgattctgaggttgg

SEQ ID NO: 9363125 - DNA, 22 bp, Homo sapiens
ttttctgtgccctgctagctgg

SEQ ID NO: 9363126 - DNA, 22 bp, Homo sapiens
ttttcttatgtgcagctatatg

SEQ ID NO: 9363127 - DNA, 22 bp, Homo sapiens
ttttcttatggtgaagcacaaa

SEQ ID NO: 9363128 - DNA, 22 bp, Homo sapiens
ttttcttatggtgaagcacaaa

SEQ ID NO: 9363129 - DNA, 22 bp, Homo sapiens
ttttcttaggtgctccaagtag

SEQ ID NO: 9363130 - DNA, 22 bp, Homo sapiens
ttttcttatagagcttaaagtt

SEQ ID NO: 9363131 - DNA, 22 bp, Homo sapiens
ttttcttactgtctgtgatcct

SEQ ID NO: 9363132 - DNA, 22 bp, Homo sapiens
ttttcttactgtctgtgatcct

SEQ ID NO: 9363133 - DNA, 22 bp, Homo sapiens
ttttctgaagtttaagacattt

SEQ ID NO: 9363134 - DNA, 22 bp, Homo sapiens
ttttctgaagtttaagacattt

SEQ ID NO: 9363135 - DNA, 22 bp, Homo sapiens
ttttctgaagtttaagacattt

SEQ ID NO: 9363136 - DNA, 22 bp, Homo sapiens
ttttctgaagtttaagacattt

SEQ ID NO: 9363137 - DNA, 22 bp, Homo sapiens
ttttctcttgttaatgtactga

SEQ ID NO: 9363138 - DNA, 22 bp, Homo sapiens
ttttctcttgttaatgtactga

SEQ ID NO: 9363139 - DNA, 22 bp, Homo sapiens
ttttctcagctgcactgtatta

SEQ ID NO: 9363140 - DNA, 22 bp, Homo sapiens
ttttctcagctgcactgtatta

SEQ ID NO: 9363141 - DNA, 22 bp, Homo sapiens
ttttctcttccctctggacctg

SEQ ID NO: 9363142 - DNA, 19 bp, Homo sapiens
ttttccacagaaatatgtt

SEQ ID NO: 9363143 - DNA, 22 bp, Homo sapiens
ttttccacagcaccataagatt

SEQ ID NO: 9363144 - DNA, 22 bp, Homo sapiens
ttttccacagcaccataagatt

SEQ ID NO: 9363145 - DNA, 22 bp, Homo sapiens
ttttccacctggttccagggct

SEQ ID NO: 9363146 - DNA, 22 bp, Homo sapiens
ttttccaccttctagagattgt

SEQ ID NO: 9363147 - DNA, 22 bp, Homo sapiens
ttttcacacaaggtgataagtt

SEQ ID NO: 9363148 - DNA, 22 bp, Homo sapiens
ttttcacacaaggtgataagtt

SEQ ID NO: 9363149 - DNA, 22 bp, Homo sapiens
ttttattggagtgataccaagc

SEQ ID NO: 9363150 - DNA, 22 bp, Homo sapiens
ttttcacattgtcccagcacta

SEQ ID NO: 9363151 - DNA, 22 bp, Homo sapiens
ttttcagtttgcactgcagtgc

SEQ ID NO: 9363152 - DNA, 22 bp, Homo sapiens
ttttcagtttgcactgcagtgc

SEQ ID NO: 9363153 - DNA, 19 bp, Homo sapiens
ttttcacatactggatcct

SEQ ID NO: 9363154 - DNA, 19 bp, Homo sapiens
ttttcacatactggatcct

SEQ ID NO: 9363155 - DNA, 22 bp, Homo sapiens
ttttcagttttccaggtagccg

SEQ ID NO: 9363156 - DNA, 22 bp, Homo sapiens
ttttcatctctgctttgtacct

SEQ ID NO: 9363157 - DNA, 22 bp, Homo sapiens
ttttcatgaggaaatactgccc

SEQ ID NO: 9363158 - DNA, 22 bp, Homo sapiens
ttttcattgttcctcgagcatt

SEQ ID NO: 9363159 - DNA, 22 bp, Homo sapiens
ttttcatgttccttgttaagtg

SEQ ID NO: 9363160 - DNA, 22 bp, Homo sapiens
ttttcatgttccttgttaagtg

SEQ ID NO: 9363161 - DNA, 22 bp, Homo sapiens
ttttcattgtaaatcaggaaac

SEQ ID NO: 9363162 - DNA, 22 bp, Homo sapiens
ttttattagtggctagatgggg

SEQ ID NO: 9363163 - DNA, 22 bp, Homo sapiens
ttttattagtggctagatgggg

SEQ ID NO: 9363164 - DNA, 22 bp, Homo sapiens
ttttattagtggctagatgggg

SEQ ID NO: 9363165 - DNA, 22 bp, Homo sapiens
ttttatgttcctctttatgcga

SEQ ID NO: 9363166 - DNA, 21 bp, Homo sapiens
ttttattgatgaatggccact

SEQ ID NO: 9363167 - DNA, 21 bp, Homo sapiens
ttttattgatgaatggccact

SEQ ID NO: 9363168 - DNA, 22 bp, Homo sapiens
ttttattgcaataaagtgtgta

SEQ ID NO: 9363169 - DNA, 22 bp, Homo sapiens
ttttattgcaataaagtgtgta

SEQ ID NO: 9363170 - DNA, 22 bp, Homo sapiens
ttttattgcaataaagtgtgta

SEQ ID NO: 9363171 - DNA, 22 bp, Homo sapiens
ttttattgcaataaagtgtgta

SEQ ID NO: 9363172 - DNA, 22 bp, Homo sapiens
ttttattggagtgataccaagc

SEQ ID NO: 9363173 - DNA, 22 bp, Homo sapiens
ttttattggagtgataccaagc

SEQ ID NO: 9363174 - DNA, 22 bp, Homo sapiens
ttttattggagtgataccaagc

SEQ ID NO: 9363175 - DNA, 22 bp, Homo sapiens
ttttattggagtgataccaagc

SEQ ID NO: 9363176 - DNA, 22 bp, Homo sapiens
ttttattggagtgataccaagc

SEQ ID NO: 9363177 - DNA, 22 bp, Homo sapiens
tttgtaaggaatattcttggtg

SEQ ID NO: 9363178 - DNA, 22 bp, Homo sapiens
tttgtgtcgtcactgtcttctc

SEQ ID NO: 9363179 - DNA, 22 bp, Homo sapiens
tttgtaagagcatatgtaaagg

SEQ ID NO: 9363180 - DNA, 22 bp, Homo sapiens
tttgtgtgtatatccttccaga

SEQ ID NO: 9363181 - DNA, 22 bp, Homo sapiens
tttgtaaaattagggaattcaa

SEQ ID NO: 9363182 - DNA, 22 bp, Homo sapiens
tttgtaaaaggaggaagcatgg

SEQ ID NO: 9363183 - DNA, 22 bp, Homo sapiens
tttgtaaaaggaggaagcatgg

SEQ ID NO: 9363184 - DNA, 22 bp, Homo sapiens
tttgtaaaaggaggaagcatgg

SEQ ID NO: 9363185 - DNA, 22 bp, Homo sapiens
tttgtaaagtctgttctgagtt

SEQ ID NO: 9363186 - DNA, 22 bp, Homo sapiens
tttgtaaaggcctgaatttcag

SEQ ID NO: 9363187 - DNA, 22 bp, Homo sapiens
tttgtgttttcccatactattg

SEQ ID NO: 9363188 - DNA, 22 bp, Homo sapiens
tttgttaaatatttattgagtg

SEQ ID NO: 9363189 - DNA, 22 bp, Homo sapiens
tttgttaaaatgcagattctgt

SEQ ID NO: 9363190 - DNA, 22 bp, Homo sapiens
tttgttaaaatgcagattctgt

SEQ ID NO: 9363191 - DNA, 22 bp, Homo sapiens
tttgttaaaatgcagattctgt

SEQ ID NO: 9363192 - DNA, 22 bp, Homo sapiens
tttgtgtttatgaagttattct

SEQ ID NO: 9363193 - DNA, 22 bp, Homo sapiens
tttgtgttgtacttctgtgcat

SEQ ID NO: 9363194 - DNA, 22 bp, Homo sapiens
tttgtgttggaagaaatgctac

SEQ ID NO: 9363195 - DNA, 22 bp, Homo sapiens
tttgttcaacaggtgaaataga

SEQ ID NO: 9363196 - DNA, 22 bp, Homo sapiens
tttgttcaacaggtgaaataga

SEQ ID NO: 9363197 - DNA, 22 bp, Homo sapiens
tttgttcaaggaatagtaaatg

SEQ ID NO: 9363198 - DNA, 22 bp, Homo sapiens
tttgttataacaataaaaagtc

SEQ ID NO: 9363199 - DNA, 22 bp, Homo sapiens
tttgttcaaaaattataagata

SEQ ID NO: 9363200 - DNA, 22 bp, Homo sapiens
tttgttaaggagtattgcttct

SEQ ID NO: 9363201 - DNA, 22 bp, Homo sapiens
tttgttaaggagtattgcttct

SEQ ID NO: 9363202 - DNA, 22 bp, Homo sapiens
tttgttaaggagtattgcttct

SEQ ID NO: 9363203 - DNA, 22 bp, Homo sapiens
ttttaatgggcgactattatgg

SEQ ID NO: 9363204 - DNA, 22 bp, Homo sapiens
ttttaatgtgctctgcaatgat

SEQ ID NO: 9363205 - DNA, 22 bp, Homo sapiens
ttttaattgcaattatggtccc

SEQ ID NO: 9363206 - DNA, 22 bp, Homo sapiens
ttttaattcaaagtgaatagtg

SEQ ID NO: 9363207 - DNA, 22 bp, Homo sapiens
ttttaattcaaagtgaatagtg

SEQ ID NO: 9363208 - DNA, 22 bp, Homo sapiens
ttttatgtgctggactggcagt

SEQ ID NO: 9363209 - DNA, 22 bp, Homo sapiens
ttttatgtgtcaaagcagtggt

SEQ ID NO: 9363210 - DNA, 22 bp, Homo sapiens
tttgttcaatccagacaatagc

SEQ ID NO: 9363211 - DNA, 22 bp, Homo sapiens
ttttaacttaaaatacatagat

SEQ ID NO: 9363212 - DNA, 22 bp, Homo sapiens
ttttaacttaaaatacatagat

SEQ ID NO: 9363213 - DNA, 22 bp, Homo sapiens
ttttaaatctccagttgacccc

SEQ ID NO: 9363214 - DNA, 22 bp, Homo sapiens
ttttaaaggctgtatgaccaag

SEQ ID NO: 9363215 - DNA, 22 bp, Homo sapiens
ttttaaaggctgtatgaccaag

SEQ ID NO: 9363216 - DNA, 18 bp, Homo sapiens
tttgctttccttcttcag

SEQ ID NO: 9363217 - DNA, 22 bp, Homo sapiens
tttgcttgttcaagatttctgt

SEQ ID NO: 9363218 - DNA, 22 bp, Homo sapiens
tttgctttctgttgaacagagt

SEQ ID NO: 9363219 - DNA, 22 bp, Homo sapiens
tttgctttctgttgaacagagt

SEQ ID NO: 9363220 - DNA, 22 bp, Homo sapiens
tttgctttgggaggttgtctgg

SEQ ID NO: 9363221 - DNA, 22 bp, Homo sapiens
tttgatgacctgtatctttttc

SEQ ID NO: 9363222 - DNA, 22 bp, Homo sapiens
tttgatgacttcagatctttgt

SEQ ID NO: 9363223 - DNA, 22 bp, Homo sapiens
tttgatgtcaaaatatcctgtt

SEQ ID NO: 9363224 - DNA, 22 bp, Homo sapiens
tttgattgcaatagttttatga

SEQ ID NO: 9363225 - DNA, 18 bp, Homo sapiens
tttgattgctgtcatcca

SEQ ID NO: 9363226 - DNA, 22 bp, Homo sapiens
tttgattgtcacctaccttgca

SEQ ID NO: 9363227 - DNA, 22 bp, Homo sapiens
tttgatttactggatattctca

SEQ ID NO: 9363228 - DNA, 22 bp, Homo sapiens
tttgaggttagctagcagatca

SEQ ID NO: 9363229 - DNA, 22 bp, Homo sapiens
tttgaggttagctagcagatca

SEQ ID NO: 9363230 - DNA, 22 bp, Homo sapiens
tttgaggttagctagcagatca

SEQ ID NO: 9363231 - DNA, 22 bp, Homo sapiens
tttgaggttagctagcagatca

SEQ ID NO: 9363232 - DNA, 22 bp, Homo sapiens
tttgaggttagctagcagatca

SEQ ID NO: 9363233 - DNA, 22 bp, Homo sapiens
tttgaggaagatcggagggaaa

SEQ ID NO: 9363234 - DNA, 22 bp, Homo sapiens
tttgacagatccttaactcagc

SEQ ID NO: 9363235 - DNA, 22 bp, Homo sapiens
tttgatccgttgctggtgagga

SEQ ID NO: 9363236 - DNA, 22 bp, Homo sapiens
tttgatccgttgctggtgagga

SEQ ID NO: 9363237 - DNA, 22 bp, Homo sapiens
tttgatatgcaaaattatggac

SEQ ID NO: 9363238 - DNA, 22 bp, Homo sapiens
tttgatatcttggtatacagat

SEQ ID NO: 9363239 - DNA, 19 bp, Homo sapiens
tttgatatctgaattatgc

SEQ ID NO: 9363240 - DNA, 22 bp, Homo sapiens
tttgatatcctatacaagtaaa

SEQ ID NO: 9363241 - DNA, 22 bp, Homo sapiens
tttgatatcctatacaagtaaa

SEQ ID NO: 9363242 - DNA, 22 bp, Homo sapiens
tttgataattaaaaattgtagt

SEQ ID NO: 9363243 - DNA, 22 bp, Homo sapiens
tttggtcctaagctgctctcta

SEQ ID NO: 9363244 - DNA, 22 bp, Homo sapiens
tttggtccaagttttactcttt

SEQ ID NO: 9363245 - DNA, 22 bp, Homo sapiens
tttggtttagggtcatttaaca

SEQ ID NO: 9363246 - DNA, 22 bp, Homo sapiens
tttggtttattaaattgtaggc

SEQ ID NO: 9363247 - DNA, 22 bp, Homo sapiens
tttggtttgaatgagcataaga

SEQ ID NO: 9363248 - DNA, 22 bp, Homo sapiens
tttggtttgcctgagtaccctc

SEQ ID NO: 9363249 - DNA, 22 bp, Homo sapiens
tttgtaaaagcccaagctgtag

SEQ ID NO: 9363250 - DNA, 22 bp, Homo sapiens
tttgtaaaagcccaagctgtag

SEQ ID NO: 9363251 - DNA, 22 bp, Homo sapiens
tttggtttttaatacaaagtac

SEQ ID NO: 9363252 - DNA, 22 bp, Homo sapiens
tttgtaaaagcccaagctgtag

SEQ ID NO: 9363253 - DNA, 22 bp, Homo sapiens
tttggtttttacctgctgagag

SEQ ID NO: 9363254 - DNA, 22 bp, Homo sapiens
tttggttgtatcattctatgaa

SEQ ID NO: 9363255 - DNA, 22 bp, Homo sapiens
tttggttgtatcattctatgaa

SEQ ID NO: 9363256 - DNA, 22 bp, Homo sapiens
tttggttggaaggatggatagc

SEQ ID NO: 9363257 - DNA, 22 bp, Homo sapiens
tttggtgttccggtcattgctg

SEQ ID NO: 9363258 - DNA, 22 bp, Homo sapiens
tttgcttttgtgctctagtggt

SEQ ID NO: 9363259 - DNA, 22 bp, Homo sapiens
tttgcttttgtgctctagtggt

SEQ ID NO: 9363260 - DNA, 22 bp, Homo sapiens
tttggaaatttcatcaatagcc

SEQ ID NO: 9363261 - DNA, 22 bp, Homo sapiens
tttggaaagtgtacaaatttga

SEQ ID NO: 9363262 - DNA, 22 bp, Homo sapiens
tttccctttgcactctacaatt

SEQ ID NO: 9363263 - DNA, 19 bp, Homo sapiens
tttcctaaaaagctgtgct

SEQ ID NO: 9363264 - DNA, 22 bp, Homo sapiens
tttcctaacacaatgcatgaga

SEQ ID NO: 9363265 - DNA, 22 bp, Homo sapiens
tttcccttgttccttcctctga

SEQ ID NO: 9363266 - DNA, 22 bp, Homo sapiens
tttccctctgtgccagcttctc

SEQ ID NO: 9363267 - DNA, 22 bp, Homo sapiens
tttccctgaggcctggacatta

SEQ ID NO: 9363268 - DNA, 22 bp, Homo sapiens
tttcctctgactgctcccctgc

SEQ ID NO: 9363269 - DNA, 22 bp, Homo sapiens
tttcctctccggggcctccagg

SEQ ID NO: 9363270 - DNA, 22 bp, Homo sapiens
tttcctcatttatctgctggga

SEQ ID NO: 9363271 - DNA, 22 bp, Homo sapiens
tttcctcacttcatgagagttt

SEQ ID NO: 9363272 - DNA, 21 bp, Homo sapiens
tttctttctggctctcacagt

SEQ ID NO: 9363273 - DNA, 18 bp, Homo sapiens
tttctttctgcctggggc

SEQ ID NO: 9363274 - DNA, 21 bp, Homo sapiens
tttctttctggctctcacagt

SEQ ID NO: 9363275 - DNA, 21 bp, Homo sapiens
tttctttctggctctcacagt

SEQ ID NO: 9363276 - DNA, 18 bp, Homo sapiens
tttctttctgcctggggc

SEQ ID NO: 9363277 - DNA, 22 bp, Homo sapiens
tttcttttacagtgtggctatt

SEQ ID NO: 9363278 - DNA, 22 bp, Homo sapiens
tttcttttacagtgtggctatt

SEQ ID NO: 9363279 - DNA, 22 bp, Homo sapiens
tttctttgttgttatcacatca

SEQ ID NO: 9363280 - DNA, 22 bp, Homo sapiens
tttctttgtagtagcataatca

SEQ ID NO: 9363281 - DNA, 22 bp, Homo sapiens
tttcttttgaatagtgtgtggt

SEQ ID NO: 9363282 - DNA, 22 bp, Homo sapiens
tttcttttgaatagtgtgtggt

SEQ ID NO: 9363283 - DNA, 22 bp, Homo sapiens
tttcttttgaatagtgtgtggt

SEQ ID NO: 9363284 - DNA, 22 bp, Homo sapiens
tttcttttgccctgtgggttag

SEQ ID NO: 9363285 - DNA, 22 bp, Homo sapiens
tttcttttgccctgtgggttag

SEQ ID NO: 9363286 - DNA, 22 bp, Homo sapiens
tttcttttgccctgtgggttag

SEQ ID NO: 9363287 - DNA, 22 bp, Homo sapiens
tttgaaagcaccatttgagtag

SEQ ID NO: 9363288 - DNA, 22 bp, Homo sapiens
tttcttttgctgagaggggcac

SEQ ID NO: 9363289 - DNA, 22 bp, Homo sapiens
tttcttttgccctgtgggttag

SEQ ID NO: 9363290 - DNA, 22 bp, Homo sapiens
tttcttttgctgagaggggcac

SEQ ID NO: 9363291 - DNA, 19 bp, Homo sapiens
tttcttttcccctcagcac

SEQ ID NO: 9363292 - DNA, 19 bp, Homo sapiens
tttcttttcccctcagcac

SEQ ID NO: 9363293 - DNA, 22 bp, Homo sapiens
tttcttttgaatagtgtgtggt

SEQ ID NO: 9363294 - DNA, 22 bp, Homo sapiens
tttcttttccaatatccctact

SEQ ID NO: 9363295 - DNA, 21 bp, Homo sapiens
tttgaaagccctatgttttca

SEQ ID NO: 9363296 - DNA, 22 bp, Homo sapiens
tttgaaagcaggtgtgggaggg

SEQ ID NO: 9363297 - DNA, 22 bp, Homo sapiens
tttgaaagcctggcttttctct

SEQ ID NO: 9363298 - DNA, 21 bp, Homo sapiens
tttgaaagccctatgttttca

SEQ ID NO: 9363299 - DNA, 22 bp, Homo sapiens
tttgaaaggagctttatccaga

SEQ ID NO: 9363300 - DNA, 22 bp, Homo sapiens
tttgaaaggaattaggatgaca

SEQ ID NO: 9363301 - DNA, 17 bp, Homo sapiens
tttgaaaggatgtcagt

SEQ ID NO: 9363302 - DNA, 19 bp, Homo sapiens
tttgaaaggattgttattt

SEQ ID NO: 9363303 - DNA, 22 bp, Homo sapiens
tttgaatgagaattattgtcat

SEQ ID NO: 9363304 - DNA, 22 bp, Homo sapiens
tttgaatatcacaaactttcaa

SEQ ID NO: 9363305 - DNA, 22 bp, Homo sapiens
tttgaatatacttcaaacaaag

SEQ ID NO: 9363306 - DNA, 19 bp, Homo sapiens
tttgaatataatgcagcta

SEQ ID NO: 9363307 - DNA, 22 bp, Homo sapiens
tttgaagcaccaaaggagaaaa

SEQ ID NO: 9363308 - DNA, 22 bp, Homo sapiens
tttgaatagcataggattacat

SEQ ID NO: 9363309 - DNA, 22 bp, Homo sapiens
tttgaatagcataggattacat

SEQ ID NO: 9363310 - DNA, 23 bp, Homo sapiens
tttgaagcattttgtatcttagt

SEQ ID NO: 9363311 - DNA, 22 bp, Homo sapiens
tttgaagagccacagtgaaatt

SEQ ID NO: 9363312 - DNA, 22 bp, Homo sapiens
tttgaaaggtgtcgagatgtgt

SEQ ID NO: 9363313 - DNA, 22 bp, Homo sapiens
tttgacaacacgttatttgcct

SEQ ID NO: 9363314 - DNA, 22 bp, Homo sapiens
tttgacaaatatttattggcac

SEQ ID NO: 9363315 - DNA, 22 bp, Homo sapiens
tttgaatgtaaatgctgcagct

SEQ ID NO: 9363316 - DNA, 22 bp, Homo sapiens
tttgaattattccttgagttga

SEQ ID NO: 9363317 - DNA, 22 bp, Homo sapiens
tttgaatgttttaggtacttaa

SEQ ID NO: 9363318 - DNA, 22 bp, Homo sapiens
tttgaatgttttaggtacttaa

SEQ ID NO: 9363319 - DNA, 23 bp, Homo sapiens
tttgaatgggtctatttttctta

SEQ ID NO: 9363320 - DNA, 22 bp, Homo sapiens
tttgaatgagaattattgtcat

SEQ ID NO: 9363321 - DNA, 22 bp, Homo sapiens
tttgaatgagggaaccacagtt

SEQ ID NO: 9363322 - DNA, 22 bp, Homo sapiens
tttgacaattcatgacatttat

SEQ ID NO: 9363323 - DNA, 22 bp, Homo sapiens
tttgacagacatttactacatt

SEQ ID NO: 9363324 - DNA, 22 bp, Homo sapiens
tttgacagacatttactacatt

SEQ ID NO: 9363325 - DNA, 22 bp, Homo sapiens
tttgacaataattgcatttata

SEQ ID NO: 9363326 - DNA, 22 bp, Homo sapiens
tttgacaactgtgcagtttgta

SEQ ID NO: 9363327 - DNA, 22 bp, Homo sapiens
tttgacaactgtgcagtttgta

SEQ ID NO: 9363328 - DNA, 22 bp, Homo sapiens
tttgacaacgttgttgtgagga

SEQ ID NO: 9363329 - DNA, 22 bp, Homo sapiens
tttgacaaccaggcaggtaaga

SEQ ID NO: 9363330 - DNA, 22 bp, Homo sapiens
tttgacaacagcaaatgtcaca

SEQ ID NO: 9363331 - DNA, 22 bp, Homo sapiens
tttttatactttgctcaagatt

SEQ ID NO: 9363332 - DNA, 22 bp, Homo sapiens
tttttatactttgctcaagatt

SEQ ID NO: 9363333 - DNA, 22 bp, Homo sapiens
tttttataccacctctcactta

SEQ ID NO: 9363334 - DNA, 22 bp, Homo sapiens
tttttatatgaaggatagtgcg

SEQ ID NO: 9363335 - DNA, 22 bp, Homo sapiens
tttttcagccatgaattacact

SEQ ID NO: 9363336 - DNA, 19 bp, Homo sapiens
tttttacaagtaggtgtga

SEQ ID NO: 9363337 - DNA, 19 bp, Homo sapiens
tttttacaagtaggtgtga

SEQ ID NO: 9363338 - DNA, 22 bp, Homo sapiens
tttttacacttagcattgagcg

SEQ ID NO: 9363339 - DNA, 22 bp, Homo sapiens
tttttacacttagcattgagcg

SEQ ID NO: 9363340 - DNA, 22 bp, Homo sapiens
tttttacacttagcattgagcg

SEQ ID NO: 9363341 - DNA, 22 bp, Homo sapiens
ttttgttgtaatatacctatcc

SEQ ID NO: 9363342 - DNA, 22 bp, Homo sapiens
ttttcttatgtgcagctatatg

SEQ ID NO: 9363343 - DNA, 22 bp, Homo sapiens
tttttataactcttttgtgaca

SEQ ID NO: 9363344 - DNA, 22 bp, Homo sapiens
tttttataccacctctcactta

SEQ ID NO: 9363345 - DNA, 22 bp, Homo sapiens
tttttataactcttttgtgaca

SEQ ID NO: 9363346 - DNA, 22 bp, Homo sapiens
tttttagagtgttaccagtata

SEQ ID NO: 9363347 - DNA, 22 bp, Homo sapiens
tttttagaattggctgagaatt

SEQ ID NO: 9363348 - DNA, 22 bp, Homo sapiens
caagtgtgtaattactgggagc

SEQ ID NO: 9363349 - DNA, 22 bp, Homo sapiens
caagtgatcctcccatcttggc

SEQ ID NO: 9363350 - DNA, 23 bp, Homo sapiens
caagtgcaccagatatacaggtc

SEQ ID NO: 9363351 - DNA, 22 bp, Homo sapiens
caagtgcatggtggcaaagaat

SEQ ID NO: 9363352 - DNA, 22 bp, Homo sapiens
caagtgatcagacactgaagtc

SEQ ID NO: 9363353 - DNA, 22 bp, Homo sapiens
caagtcaatgattataagagtc

SEQ ID NO: 9363354 - DNA, 22 bp, Homo sapiens
caagtcacatggccaactgatg

SEQ ID NO: 9363355 - DNA, 22 bp, Homo sapiens
gctgggctcaccaggccactag

SEQ ID NO: 9363356 - DNA, 22 bp, Homo sapiens
caagttattcctttacactata

SEQ ID NO: 9363357 - DNA, 22 bp, Homo sapiens
caagttatcagggcagttagag

SEQ ID NO: 9363358 - DNA, 22 bp, Homo sapiens
caagttatcagggcagttagag

SEQ ID NO: 9363359 - DNA, 22 bp, Homo sapiens
caagttatttcattggaacaat

SEQ ID NO: 9363360 - DNA, 22 bp, Homo sapiens
caagtttaaagtgaggtttgaa

SEQ ID NO: 9363361 - DNA, 22 bp, Homo sapiens
gctggtgagattttatgtttcc

SEQ ID NO: 9363362 - DNA, 22 bp, Homo sapiens
gctggtggtaaggaggaaaaag

SEQ ID NO: 9363363 - DNA, 20 bp, Homo sapiens
gctggtgggggcttgacatg

SEQ ID NO: 9363364 - DNA, 22 bp, Homo sapiens
gctggtgcattagctgcagttc

SEQ ID NO: 9363365 - DNA, 22 bp, Homo sapiens
gctggtgtctaacctggctctt

SEQ ID NO: 9363366 - DNA, 22 bp, Homo sapiens
gctggtgtctaacctggctctt

SEQ ID NO: 9363367 - DNA, 22 bp, Homo sapiens
gctggtggtgggccagttctgt

SEQ ID NO: 9363368 - DNA, 22 bp, Homo sapiens
gctgtaaagaacattaggaatc

SEQ ID NO: 9363369 - DNA, 22 bp, Homo sapiens
gctggtttccttatctataaag

SEQ ID NO: 9363370 - DNA, 22 bp, Homo sapiens
gctggtttccttatctataaag

SEQ ID NO: 9363371 - DNA, 22 bp, Homo sapiens
gctggttagaaaacagagctca

SEQ ID NO: 9363372 - DNA, 22 bp, Homo sapiens
caatgcatacttcgaaatttca

SEQ ID NO: 9363373 - DNA, 22 bp, Homo sapiens
caatgattgctatttacataaa

SEQ ID NO: 9363374 - DNA, 22 bp, Homo sapiens
gcttccacttgggaacctctct

SEQ ID NO: 9363375 - DNA, 22 bp, Homo sapiens
gcttccagaccccagtccctca

SEQ ID NO: 9363376 - DNA, 22 bp, Homo sapiens
caatgtactacaaagattgtca

SEQ ID NO: 9363377 - DNA, 22 bp, Homo sapiens
caatgtaaatattttctaatca

SEQ ID NO: 9363378 - DNA, 22 bp, Homo sapiens
gcttccagagagccccgcctgg

SEQ ID NO: 9363379 - DNA, 22 bp, Homo sapiens
gcttccagagactgagctcttc

SEQ ID NO: 9363380 - DNA, 22 bp, Homo sapiens
caatggctggagacaatctgct

SEQ ID NO: 9363381 - DNA, 21 bp, Homo sapiens
caatggcgagatcttggctca

SEQ ID NO: 9363382 - DNA, 22 bp, Homo sapiens
caatggaggtttactctgcagc

SEQ ID NO: 9363383 - DNA, 19 bp, Homo sapiens
gcttccagcactgcaggag

SEQ ID NO: 9363384 - DNA, 20 bp, Homo sapiens
gcttccaggagggctgatat

SEQ ID NO: 9363385 - DNA, 22 bp, Homo sapiens
gcttccagccttttctcctctg

SEQ ID NO: 9363386 - DNA, 22 bp, Homo sapiens
gcttccaggcttcctacctttg

SEQ ID NO: 9363387 - DNA, 22 bp, Homo sapiens
ggaaatgacttggtgcttcgtt

SEQ ID NO: 9363388 - DNA, 22 bp, Homo sapiens
ggaaaatttccttcaaaatgtg

SEQ ID NO: 9363389 - DNA, 18 bp, Homo sapiens
ggaaatgtttggtactag

SEQ ID NO: 9363390 - DNA, 22 bp, Homo sapiens
gctgggagccctggtctgctcc

SEQ ID NO: 9363391 - DNA, 22 bp, Homo sapiens
gctgggagccctggtctgctcc

SEQ ID NO: 9363392 - DNA, 22 bp, Homo sapiens
gctgggagccctggtctgctcc

SEQ ID NO: 9363393 - DNA, 22 bp, Homo sapiens
gctgggagccctggtctgctcc

SEQ ID NO: 9363394 - DNA, 22 bp, Homo sapiens
gctgggagccccgagccagcgc

SEQ ID NO: 9363395 - DNA, 21 bp, Homo sapiens
gctggctgtctcttacacggt

SEQ ID NO: 9363396 - DNA, 22 bp, Homo sapiens
gctgggagcaaagccatgcata

SEQ ID NO: 9363397 - DNA, 22 bp, Homo sapiens
gctgggagcaaagccatgcata

SEQ ID NO: 9363398 - DNA, 22 bp, Homo sapiens
gctgggagcaagtactcatctt

SEQ ID NO: 9363399 - DNA, 19 bp, Homo sapiens
gctgggagcagaccctccc

SEQ ID NO: 9363400 - DNA, 22 bp, Homo sapiens
gctggccatatattttgctgtt

SEQ ID NO: 9363401 - DNA, 22 bp, Homo sapiens
gctggccatagaagccaaagag

SEQ ID NO: 9363402 - DNA, 22 bp, Homo sapiens
gctggccatggcctgcgccatc

SEQ ID NO: 9363403 - DNA, 22 bp, Homo sapiens
gctggccatggcctgcgccatc

SEQ ID NO: 9363404 - DNA, 22 bp, Homo sapiens
gctggccatggggagtgaggag

SEQ ID NO: 9363405 - DNA, 22 bp, Homo sapiens
gctggccatggggagtgaggag

SEQ ID NO: 9363406 - DNA, 22 bp, Homo sapiens
gctggccatggggagtgaggag

SEQ ID NO: 9363407 - DNA, 22 bp, Homo sapiens
gctggccatggggagtgaggag

SEQ ID NO: 9363408 - DNA, 22 bp, Homo sapiens
gctggcccagcgcccagggcag

SEQ ID NO: 9363409 - DNA, 22 bp, Homo sapiens
gctggcccagcgcccagggcag

SEQ ID NO: 9363410 - DNA, 21 bp, Homo sapiens
gctggctgtcccagggaagca

SEQ ID NO: 9363411 - DNA, 22 bp, Homo sapiens
gctggcccagcgcccagggcag

SEQ ID NO: 9363412 - DNA, 21 bp, Homo sapiens
gctggctgtcccagggaagca

SEQ ID NO: 9363413 - DNA, 22 bp, Homo sapiens
gctgggcccagatcccaggatc

SEQ ID NO: 9363414 - DNA, 22 bp, Homo sapiens
gctgggaggaatttggggaata

SEQ ID NO: 9363415 - DNA, 22 bp, Homo sapiens
gctgggaggaatttggggaata

SEQ ID NO: 9363416 - DNA, 22 bp, Homo sapiens
gctgggaggaatttggggaata

SEQ ID NO: 9363417 - DNA, 22 bp, Homo sapiens
gctgggagccgtacctgtcacg

SEQ ID NO: 9363418 - DNA, 22 bp, Homo sapiens
gctgggagccgtacctgtcacg

SEQ ID NO: 9363419 - DNA, 22 bp, Homo sapiens
gctgggccccatccctcgagca

SEQ ID NO: 9363420 - DNA, 22 bp, Homo sapiens
gctgggccctgggtgccctagc

SEQ ID NO: 9363421 - DNA, 21 bp, Homo sapiens
gctgggcctgtacttgccctg

SEQ ID NO: 9363422 - DNA, 22 bp, Homo sapiens
gctgggccgacctgggctgcag

SEQ ID NO: 9363423 - DNA, 20 bp, Homo sapiens
gctgggctaccactggccct

SEQ ID NO: 9363424 - DNA, 20 bp, Homo sapiens
gctgggctaccactggccct

SEQ ID NO: 9363425 - DNA, 20 bp, Homo sapiens
gctgggctaccactggccct

SEQ ID NO: 9363426 - DNA, 22 bp, Homo sapiens
caaattgcttgtctgtagtgga

SEQ ID NO: 9363427 - DNA, 20 bp, Homo sapiens
caaattctgttgaatacacc

SEQ ID NO: 9363428 - DNA, 22 bp, Homo sapiens
caaattgatctgtctttatgaa

SEQ ID NO: 9363429 - DNA, 22 bp, Homo sapiens
caaattgtgtttgcttttctct

SEQ ID NO: 9363430 - DNA, 22 bp, Homo sapiens
caaatttaagttagaaagcaat

SEQ ID NO: 9363431 - DNA, 22 bp, Homo sapiens
caaatttaagttagaaagcaat

SEQ ID NO: 9363432 - DNA, 22 bp, Homo sapiens
caaattctcaccctgtttgatt

SEQ ID NO: 9363433 - DNA, 18 bp, Homo sapiens
caaattctcattgatttc

SEQ ID NO: 9363434 - DNA, 22 bp, Homo sapiens
caaattctcttactgtttgaca

SEQ ID NO: 9363435 - DNA, 22 bp, Homo sapiens
caaattcctcagaatcagaaaa

SEQ ID NO: 9363436 - DNA, 20 bp, Homo sapiens
gctgaggtccctgtggtttt

SEQ ID NO: 9363437 - DNA, 20 bp, Homo sapiens
gctgaggtccctgtggtttt

SEQ ID NO: 9363438 - DNA, 20 bp, Homo sapiens
gctgaggtccctgtggtttt

SEQ ID NO: 9363439 - DNA, 23 bp, Homo sapiens
gctgaggtcctgctgagtggtgg

SEQ ID NO: 9363440 - DNA, 23 bp, Homo sapiens
gctgaggtcctgctgagtggtgg

SEQ ID NO: 9363441 - DNA, 22 bp, Homo sapiens
gctgaggtgaggctggaaagga

SEQ ID NO: 9363442 - DNA, 22 bp, Homo sapiens
gctgaggtgaggctggaaagga

SEQ ID NO: 9363443 - DNA, 22 bp, Homo sapiens
gctgaggtggagattgcagtga

SEQ ID NO: 9363444 - DNA, 22 bp, Homo sapiens
gctgaggtcaggagctgtgggg

SEQ ID NO: 9363445 - DNA, 22 bp, Homo sapiens
gctgaggtaggaggttgcagtg

SEQ ID NO: 9363446 - DNA, 22 bp, Homo sapiens
gctggcagcattagaccctggg

SEQ ID NO: 9363447 - DNA, 22 bp, Homo sapiens
gctggcagcattagaccctggg

SEQ ID NO: 9363448 - DNA, 22 bp, Homo sapiens
gctggcagccaagtgaagaggg

SEQ ID NO: 9363449 - DNA, 22 bp, Homo sapiens
gctggcagccaagtgaagaggg

SEQ ID NO: 9363450 - DNA, 22 bp, Homo sapiens
gctggcagccaagtgaagaggg

SEQ ID NO: 9363451 - DNA, 22 bp, Homo sapiens
gctggccagtgtggtgaccacc

SEQ ID NO: 9363452 - DNA, 22 bp, Homo sapiens
gctggccagtgtggtgaccacc

SEQ ID NO: 9363453 - DNA, 22 bp, Homo sapiens
gctggccagtgtggtgaccacc

SEQ ID NO: 9363454 - DNA, 22 bp, Homo sapiens
gctggcagccaagtgaagaggg

SEQ ID NO: 9363455 - DNA, 19 bp, Homo sapiens
gctggcagatgtggccgtg

SEQ ID NO: 9363456 - DNA, 20 bp, Homo sapiens
gctggcagatgtcttgagat

SEQ ID NO: 9363457 - DNA, 19 bp, Homo sapiens
gctggcagatgtggccgtg

SEQ ID NO: 9363458 - DNA, 19 bp, Homo sapiens
gctggcagatgtggccgtg

SEQ ID NO: 9363459 - DNA, 22 bp, Homo sapiens
gctggcagcattagaccctggg

SEQ ID NO: 9363460 - DNA, 22 bp, Homo sapiens
gctggcagcattagaccctggg

SEQ ID NO: 9363461 - DNA, 16 bp, Homo sapiens
gctggagggaggggtt

SEQ ID NO: 9363462 - DNA, 22 bp, Homo sapiens
gctggcagagagctggtgagga

SEQ ID NO: 9363463 - DNA, 22 bp, Homo sapiens
gctggcagagagctggtgagga

SEQ ID NO: 9363464 - DNA, 22 bp, Homo sapiens
gctggcagagagctggtgagga

SEQ ID NO: 9363465 - DNA, 19 bp, Homo sapiens
gctgaggtggaggaaggag

SEQ ID NO: 9363466 - DNA, 19 bp, Homo sapiens
gctgaggtggaggaaggag

SEQ ID NO: 9363467 - DNA, 22 bp, Homo sapiens
gctgaggtggagattgcagtga

SEQ ID NO: 9363468 - DNA, 22 bp, Homo sapiens
gctggcagagctctgggctggg

SEQ ID NO: 9363469 - DNA, 20 bp, Homo sapiens
gctggcagatgtcttgagat

SEQ ID NO: 9363470 - DNA, 22 bp, Homo sapiens
gctggcagagctctgggctggg

SEQ ID NO: 9363471 - DNA, 22 bp, Homo sapiens
gctggcagagctctgggctggg

SEQ ID NO: 9363472 - DNA, 22 bp, Homo sapiens
gctggcagagctctgggctggg

SEQ ID NO: 9363473 - DNA, 22 bp, Homo sapiens
gctggcagagctctgggctggg

SEQ ID NO: 9363474 - DNA, 22 bp, Homo sapiens
gctggcagagagctggtgagga

SEQ ID NO: 9363475 - DNA, 22 bp, Homo sapiens
gctggcagagagctggtgagga

SEQ ID NO: 9363476 - DNA, 18 bp, Homo sapiens
ggagagtgacagagtcgt

SEQ ID NO: 9363477 - DNA, 18 bp, Homo sapiens
ggagagtgacagagtcgt

SEQ ID NO: 9363478 - DNA, 22 bp, Homo sapiens
ggagagtctgctggccacagtg

SEQ ID NO: 9363479 - DNA, 22 bp, Homo sapiens
ggagagctgacatcatgatgtt

SEQ ID NO: 9363480 - DNA, 16 bp, Homo sapiens
ggagagtgtctgcaaa

SEQ ID NO: 9363481 - DNA, 18 bp, Homo sapiens
ggagagtgagatcaaaca

SEQ ID NO: 9363482 - DNA, 22 bp, Homo sapiens
ggagagtggattccagctgtat

SEQ ID NO: 9363483 - DNA, 22 bp, Homo sapiens
ggacagcagcctcttacatgaa

SEQ ID NO: 9363484 - DNA, 22 bp, Homo sapiens
ggacagcatatcagcagggcag

SEQ ID NO: 9363485 - DNA, 22 bp, Homo sapiens
ggacagcattctactgtaggca

SEQ ID NO: 9363486 - DNA, 22 bp, Homo sapiens
ggacagcgtggctggtggaggg

SEQ ID NO: 9363487 - DNA, 22 bp, Homo sapiens
ggacagcgtggctggtggaggg

SEQ ID NO: 9363488 - DNA, 22 bp, Homo sapiens
cacagagaccccttctggggcc

SEQ ID NO: 9363489 - DNA, 22 bp, Homo sapiens
cacagagacagatctattttgc

SEQ ID NO: 9363490 - DNA, 22 bp, Homo sapiens
cacagcaaagacactctcaact

SEQ ID NO: 9363491 - DNA, 22 bp, Homo sapiens
cacagcaggcactatacagggc

SEQ ID NO: 9363492 - DNA, 22 bp, Homo sapiens
cacagagaattcccatatgtga

SEQ ID NO: 9363493 - DNA, 22 bp, Homo sapiens
cacagagaatgatgagtcactg

SEQ ID NO: 9363494 - DNA, 22 bp, Homo sapiens
ggagatatggtctagtatagag

SEQ ID NO: 9363495 - DNA, 22 bp, Homo sapiens
ggagatagtccaggtgaaggga

SEQ ID NO: 9363496 - DNA, 22 bp, Homo sapiens
ggagagttgtttttgcctagat

SEQ ID NO: 9363497 - DNA, 22 bp, Homo sapiens
ggagatagacttggtgagccac

SEQ ID NO: 9363498 - DNA, 22 bp, Homo sapiens
ggagatctcagttttataatca

SEQ ID NO: 9363499 - DNA, 19 bp, Homo sapiens
ggagatcccgctgcagatg

SEQ ID NO: 9363500 - DNA, 22 bp, Homo sapiens
ggagatccaggcaaggccgcag

SEQ ID NO: 9363501 - DNA, 22 bp, Homo sapiens
ggagatccaggctgagtctttc

SEQ ID NO: 9363502 - DNA, 23 bp, Homo sapiens
ggagatcagagactagggcagtt

SEQ ID NO: 9363503 - DNA, 22 bp, Homo sapiens
ggaacaggaaaggagggatgct

SEQ ID NO: 9363504 - DNA, 22 bp, Homo sapiens
ggaacaggaaaggagggatgct

SEQ ID NO: 9363505 - DNA, 22 bp, Homo sapiens
ggaacagggatttggcctggtt

SEQ ID NO: 9363506 - DNA, 22 bp, Homo sapiens
ggaagagaaatgagtcaagact

SEQ ID NO: 9363507 - DNA, 22 bp, Homo sapiens
ggaagagaaatgagtcaagact

SEQ ID NO: 9363508 - DNA, 22 bp, Homo sapiens
ggaagagaaatgagtcaagact

SEQ ID NO: 9363509 - DNA, 22 bp, Homo sapiens
ggaagacatctgcttgcaccag

SEQ ID NO: 9363510 - DNA, 22 bp, Homo sapiens
ggaagactagtgttttaagtta

SEQ ID NO: 9363511 - DNA, 22 bp, Homo sapiens
ggaagacagaagcctacagctt

SEQ ID NO: 9363512 - DNA, 22 bp, Homo sapiens
ggaagactgcatggcatagtga

SEQ ID NO: 9363513 - DNA, 19 bp, Homo sapiens
ggaagagaggaaaggtgga

SEQ ID NO: 9363514 - DNA, 22 bp, Homo sapiens
ggaagagagatcccatagatgt

SEQ ID NO: 9363515 - DNA, 22 bp, Homo sapiens
ggaagagaatgatggctatggg

SEQ ID NO: 9363516 - DNA, 22 bp, Homo sapiens
ggaagagaatttctctcttttt

SEQ ID NO: 9363517 - DNA, 22 bp, Homo sapiens
ggaagagagatcccatagatgt

SEQ ID NO: 9363518 - DNA, 22 bp, Homo sapiens
ggaagagagggctgggcctcaa

SEQ ID NO: 9363519 - DNA, 22 bp, Homo sapiens
ggaagagagggctgggcctcaa

SEQ ID NO: 9363520 - DNA, 19 bp, Homo sapiens
ggaagagaggaaaggtgga

SEQ ID NO: 9363521 - DNA, 19 bp, Homo sapiens
ggaagagaggaaaggtgga

SEQ ID NO: 9363522 - DNA, 22 bp, Homo sapiens
ggaagagattctttacattcat

SEQ ID NO: 9363523 - DNA, 22 bp, Homo sapiens
ggaagagaggttcagccctaag

SEQ ID NO: 9363524 - DNA, 22 bp, Homo sapiens
ggaaggggtcacctcctgatga

SEQ ID NO: 9363525 - DNA, 22 bp, Homo sapiens
ggacaaagctctgctgcctccc

SEQ ID NO: 9363526 - DNA, 22 bp, Homo sapiens
ggacaaagggctagccacaact

SEQ ID NO: 9363527 - DNA, 22 bp, Homo sapiens
ggacaaagggtggagcctctga

SEQ ID NO: 9363528 - DNA, 22 bp, Homo sapiens
ggacaaattccctatttgcatg

SEQ ID NO: 9363529 - DNA, 22 bp, Homo sapiens
ggacaaatctcattatttctga

SEQ ID NO: 9363530 - DNA, 22 bp, Homo sapiens
ggacaaaggtctggggaacctg

SEQ ID NO: 9363531 - DNA, 22 bp, Homo sapiens
ggacaaaggtctggggaacctg

SEQ ID NO: 9363532 - DNA, 22 bp, Homo sapiens
ggacaagcctgtgagtgggttt

SEQ ID NO: 9363533 - DNA, 19 bp, Homo sapiens
ggacacagaaagctgcatt

SEQ ID NO: 9363534 - DNA, 19 bp, Homo sapiens
ggacacagaaagctgcatt

SEQ ID NO: 9363535 - DNA, 22 bp, Homo sapiens
ggacacagacctttctgttcta

SEQ ID NO: 9363536 - DNA, 22 bp, Homo sapiens
ggacagattgagctaggcgttt

SEQ ID NO: 9363537 - DNA, 22 bp, Homo sapiens
ggacagagggttgacagagtat

SEQ ID NO: 9363538 - DNA, 22 bp, Homo sapiens
ggacagagggttgacagagtat

SEQ ID NO: 9363539 - DNA, 22 bp, Homo sapiens
ggacagagggttgacagagtat

SEQ ID NO: 9363540 - DNA, 22 bp, Homo sapiens
ggagggagtttcattcctgccc

SEQ ID NO: 9363541 - DNA, 22 bp, Homo sapiens
cacagctaggaggaaagcagag

SEQ ID NO: 9363542 - DNA, 22 bp, Homo sapiens
cacagctgaagtagccatgtgg

SEQ ID NO: 9363543 - DNA, 19 bp, Homo sapiens
cacagctctgctcagggaa

SEQ ID NO: 9363544 - DNA, 22 bp, Homo sapiens
ggaggggatttagtagatgcta

SEQ ID NO: 9363545 - DNA, 22 bp, Homo sapiens
ggaggggatggtttgaccctgg

SEQ ID NO: 9363546 - DNA, 22 bp, Homo sapiens
ggaggggatggtttgaccctgg

SEQ ID NO: 9363547 - DNA, 19 bp, Homo sapiens
cacagcgaagacaaggtgg

SEQ ID NO: 9363548 - DNA, 22 bp, Homo sapiens
cacagctaactttcactgagca

SEQ ID NO: 9363549 - DNA, 22 bp, Homo sapiens
cacagcctccttcagagagcat

SEQ ID NO: 9363550 - DNA, 22 bp, Homo sapiens
cacagccttactgagatccact

SEQ ID NO: 9363551 - DNA, 22 bp, Homo sapiens
cacagcctgctgcactcaagaa

SEQ ID NO: 9363552 - DNA, 22 bp, Homo sapiens
cacaggagagctgggaggtgcc

SEQ ID NO: 9363553 - DNA, 22 bp, Homo sapiens
cacaggagagctgggaggtgcc

SEQ ID NO: 9363554 - DNA, 22 bp, Homo sapiens
cacaggagaacccacagattct

SEQ ID NO: 9363555 - DNA, 22 bp, Homo sapiens
cacaggagaacccacagattct

SEQ ID NO: 9363556 - DNA, 22 bp, Homo sapiens
cacaggagaaaggggaagctcg

SEQ ID NO: 9363557 - DNA, 22 bp, Homo sapiens
cacaggagaaaggggaagctcg

SEQ ID NO: 9363558 - DNA, 22 bp, Homo sapiens
cacaggagaaaggggaagctcg

SEQ ID NO: 9363559 - DNA, 22 bp, Homo sapiens
cacaggagaggttaatgggggc

SEQ ID NO: 9363560 - DNA, 22 bp, Homo sapiens
cacaggagaggttaatgggggc

SEQ ID NO: 9363561 - DNA, 22 bp, Homo sapiens
cacaggagaggttaatgggggc

SEQ ID NO: 9363562 - DNA, 18 bp, Homo sapiens
cacaggagatgacctgac

SEQ ID NO: 9363563 - DNA, 18 bp, Homo sapiens
cacaggagatgacctgac

SEQ ID NO: 9363564 - DNA, 18 bp, Homo sapiens
cacaggagatgacctgac

SEQ ID NO: 9363565 - DNA, 22 bp, Homo sapiens
cacaggagattgatctattggt

SEQ ID NO: 9363566 - DNA, 22 bp, Homo sapiens
cacaggagattgatctattggt

SEQ ID NO: 9363567 - DNA, 22 bp, Homo sapiens
ggaggggccggctgcctgccac

SEQ ID NO: 9363568 - DNA, 22 bp, Homo sapiens
ggaggggccggctgcctgccac

SEQ ID NO: 9363569 - DNA, 22 bp, Homo sapiens
ggaggggccggctgcctgccac

SEQ ID NO: 9363570 - DNA, 22 bp, Homo sapiens
ggaggggcatagttcaccatca

SEQ ID NO: 9363571 - DNA, 22 bp, Homo sapiens
ggaggggcagccatggaactcc

SEQ ID NO: 9363572 - DNA, 22 bp, Homo sapiens
ggaggggcagccatggaactcc

SEQ ID NO: 9363573 - DNA, 22 bp, Homo sapiens
ggaggggcagccatggaactcc

SEQ ID NO: 9363574 - DNA, 22 bp, Homo sapiens
ggaggggatttagtagatgcta

SEQ ID NO: 9363575 - DNA, 22 bp, Homo sapiens
cacagcaggcagaacgtgggca

SEQ ID NO: 9363576 - DNA, 22 bp, Homo sapiens
cacagcaggcagaacgtgggca

SEQ ID NO: 9363577 - DNA, 22 bp, Homo sapiens
cacagcagggatgaatggagtg

SEQ ID NO: 9363578 - DNA, 22 bp, Homo sapiens
cacagcagggatgaatggagtg

SEQ ID NO: 9363579 - DNA, 21 bp, Homo sapiens
cacagcagggttcctgggctc

SEQ ID NO: 9363580 - DNA, 22 bp, Homo sapiens
cacagcataatgaaatatactt

SEQ ID NO: 9363581 - DNA, 22 bp, Homo sapiens
cacagcataatgaaatatactt

SEQ ID NO: 9363582 - DNA, 22 bp, Homo sapiens
cacagcattgccttccaaaagg

SEQ ID NO: 9363583 - DNA, 22 bp, Homo sapiens
cacagccatgtcctcattcttc

SEQ ID NO: 9363584 - DNA, 22 bp, Homo sapiens
cacagccctgcgccccagtttg

SEQ ID NO: 9363585 - DNA, 22 bp, Homo sapiens
ggagcagccgcgtctcagggca

SEQ ID NO: 9363586 - DNA, 22 bp, Homo sapiens
ggagcagccgcgtctcagggca

SEQ ID NO: 9363587 - DNA, 22 bp, Homo sapiens
ggagcagccgcgtctcagggca

SEQ ID NO: 9363588 - DNA, 22 bp, Homo sapiens
ggagcagccacgtctcagggca

SEQ ID NO: 9363589 - DNA, 22 bp, Homo sapiens
ggagcagccacgtctcagggca

SEQ ID NO: 9363590 - DNA, 22 bp, Homo sapiens
ggagcagccacgtctcagggca

SEQ ID NO: 9363591 - DNA, 22 bp, Homo sapiens
ggagcaggagtctcttgaattt

SEQ ID NO: 9363592 - DNA, 22 bp, Homo sapiens
ggagcagcttgcatgctcaggg

SEQ ID NO: 9363593 - DNA, 22 bp, Homo sapiens
ggagcagcttgcatgctcaggg

SEQ ID NO: 9363594 - DNA, 22 bp, Homo sapiens
ggagcagcttgcatgctcaggg

SEQ ID NO: 9363595 - DNA, 22 bp, Homo sapiens
ggagcagcttgcatgctcaggg

SEQ ID NO: 9363596 - DNA, 22 bp, Homo sapiens
ggagcagcctgtgtagacgggg

SEQ ID NO: 9363597 - DNA, 22 bp, Homo sapiens
ggagcaggagtctcttgaattt

SEQ ID NO: 9363598 - DNA, 22 bp, Homo sapiens
ggagctggccgcctatgtgcag

SEQ ID NO: 9363599 - DNA, 22 bp, Homo sapiens
ggaggactcaggtctggccatg

SEQ ID NO: 9363600 - DNA, 22 bp, Homo sapiens
ggaggagacagtaaaaagcacg

SEQ ID NO: 9363601 - DNA, 22 bp, Homo sapiens
ggaggagacggagtgattagtg

SEQ ID NO: 9363602 - DNA, 22 bp, Homo sapiens
ggaggagcatgagagggtagtg

SEQ ID NO: 9363603 - DNA, 22 bp, Homo sapiens
ggaggagcacttgacggggtct

SEQ ID NO: 9363604 - DNA, 22 bp, Homo sapiens
ggaggagcacttgacggggtct

SEQ ID NO: 9363605 - DNA, 22 bp, Homo sapiens
ggaggagcacttctgagctcag

SEQ ID NO: 9363606 - DNA, 22 bp, Homo sapiens
ggaggagcacttctgagctcag

SEQ ID NO: 9363607 - DNA, 22 bp, Homo sapiens
ggaggagcacttctgagctcag

SEQ ID NO: 9363608 - DNA, 22 bp, Homo sapiens
ggaggagcacttctgagctcag

SEQ ID NO: 9363609 - DNA, 22 bp, Homo sapiens
ggaggagcacttctgagctcag

SEQ ID NO: 9363610 - DNA, 22 bp, Homo sapiens
cagaacacattttcagagtcaa

SEQ ID NO: 9363611 - DNA, 22 bp, Homo sapiens
cagaaatgtttatgcttttgaa

SEQ ID NO: 9363612 - DNA, 23 bp, Homo sapiens
ggctgggagctccgggtgcacgt

SEQ ID NO: 9363613 - DNA, 23 bp, Homo sapiens
ggctgggagctccgggtgcacgt

SEQ ID NO: 9363614 - DNA, 23 bp, Homo sapiens
ggctgggagctccgggtgcacgt

SEQ ID NO: 9363615 - DNA, 23 bp, Homo sapiens
ggctgggagctccgggtgcacgt

SEQ ID NO: 9363616 - DNA, 23 bp, Homo sapiens
ggctgggagctccgggtgcacgt

SEQ ID NO: 9363617 - DNA, 23 bp, Homo sapiens
ggctgggagctccgggtgcacgt

SEQ ID NO: 9363618 - DNA, 22 bp, Homo sapiens
ggctgggagccccacagagtca

SEQ ID NO: 9363619 - DNA, 23 bp, Homo sapiens
ggctgggagctccgggtgcacgt

SEQ ID NO: 9363620 - DNA, 22 bp, Homo sapiens
ggctgggagccccacagagtca

SEQ ID NO: 9363621 - DNA, 22 bp, Homo sapiens
ggctgggagccccacagagtca

SEQ ID NO: 9363622 - DNA, 22 bp, Homo sapiens
ggctggctttctctccgcacct

SEQ ID NO: 9363623 - DNA, 22 bp, Homo sapiens
ggctggctttctctccgcacct

SEQ ID NO: 9363624 - DNA, 22 bp, Homo sapiens
ggctgggacgatgaggattagt

SEQ ID NO: 9363625 - DNA, 22 bp, Homo sapiens
cagaacagacttaacagggctg

SEQ ID NO: 9363626 - DNA, 22 bp, Homo sapiens
ggctggctttctctccgcacct

SEQ ID NO: 9363627 - DNA, 20 bp, Homo sapiens
ggctgctggtttggctctgt

SEQ ID NO: 9363628 - DNA, 20 bp, Homo sapiens
ggctgctggtttggctctgt

SEQ ID NO: 9363629 - DNA, 20 bp, Homo sapiens
ggctgctggtttggctctgt

SEQ ID NO: 9363630 - DNA, 22 bp, Homo sapiens
ggctgctgtactgatgtcagtt

SEQ ID NO: 9363631 - DNA, 22 bp, Homo sapiens
ggctgctgtactgatgtcagtt

SEQ ID NO: 9363632 - DNA, 22 bp, Homo sapiens
ggctgctgtactgatgtcagtt

SEQ ID NO: 9363633 - DNA, 22 bp, Homo sapiens
ggctgctggtggaatggtaggc

SEQ ID NO: 9363634 - DNA, 22 bp, Homo sapiens
ggctgctggtaggggtaggaag

SEQ ID NO: 9363635 - DNA, 22 bp, Homo sapiens
ggctgctgggtcatgatgcaga

SEQ ID NO: 9363636 - DNA, 22 bp, Homo sapiens
ggctgctggtaggggtaggaag

SEQ ID NO: 9363637 - DNA, 22 bp, Homo sapiens
cagaaatggaattttccatcac

SEQ ID NO: 9363638 - DNA, 22 bp, Homo sapiens
cagaaatggagcccaggaatct

SEQ ID NO: 9363639 - DNA, 22 bp, Homo sapiens
cagaaatgtactgacatgcagt

SEQ ID NO: 9363640 - DNA, 21 bp, Homo sapiens
ggctgctgtcaccgctgtcac

SEQ ID NO: 9363641 - DNA, 22 bp, Homo sapiens
ggcttggcccaggcctcactcc

SEQ ID NO: 9363642 - DNA, 22 bp, Homo sapiens
ggcttggaattggtaggatgta

SEQ ID NO: 9363643 - DNA, 20 bp, Homo sapiens
ggcttgagtcagatcttgga

SEQ ID NO: 9363644 - DNA, 22 bp, Homo sapiens
ggcttgcttcttgtccaggaat

SEQ ID NO: 9363645 - DNA, 22 bp, Homo sapiens
ggcttggaaactagagtgtgca

SEQ ID NO: 9363646 - DNA, 22 bp, Homo sapiens
ggcttgcttcttgtccaggaat

SEQ ID NO: 9363647 - DNA, 22 bp, Homo sapiens
ggctgggagctggacaggccgg

SEQ ID NO: 9363648 - DNA, 22 bp, Homo sapiens
ggctgggagctggacaggccgg

SEQ ID NO: 9363649 - DNA, 22 bp, Homo sapiens
ggcttcaggggcccagtcagca

SEQ ID NO: 9363650 - DNA, 22 bp, Homo sapiens
ggcttcttcctggctcctatta

SEQ ID NO: 9363651 - DNA, 22 bp, Homo sapiens
ggcttcttctctgtgtccagca

SEQ ID NO: 9363652 - DNA, 22 bp, Homo sapiens
ggcttcttgtgtgtcaggctct

SEQ ID NO: 9363653 - DNA, 20 bp, Homo sapiens
ggcttctttacatctgtgtt

SEQ ID NO: 9363654 - DNA, 22 bp, Homo sapiens
ggcttgaagactatgacatttc

SEQ ID NO: 9363655 - DNA, 22 bp, Homo sapiens
ggcttctttgtaacgtgccagc

SEQ ID NO: 9363656 - DNA, 22 bp, Homo sapiens
cagaacattcactcatatgtgg

SEQ ID NO: 9363657 - DNA, 22 bp, Homo sapiens
cagaacatgatataaacagaag

SEQ ID NO: 9363658 - DNA, 20 bp, Homo sapiens
cagaacatgagcatcgagcc

SEQ ID NO: 9363659 - DNA, 22 bp, Homo sapiens
cagaagaggactgggtagctca

SEQ ID NO: 9363660 - DNA, 22 bp, Homo sapiens
cagaagagtagctgaacaagtt

SEQ ID NO: 9363661 - DNA, 22 bp, Homo sapiens
cagaacattcactcatatgtgg

SEQ ID NO: 9363662 - DNA, 22 bp, Homo sapiens
cagaacattcttgccagtacat

SEQ ID NO: 9363663 - DNA, 22 bp, Homo sapiens
cagaagaggactgggtagctca

SEQ ID NO: 9363664 - DNA, 19 bp, Homo sapiens
cagaacaggaccaggggcc

SEQ ID NO: 9363665 - DNA, 22 bp, Homo sapiens
ggctgctcggagcctcctgtga

SEQ ID NO: 9363666 - DNA, 22 bp, Homo sapiens
ggctgctcctttaccctggcag

SEQ ID NO: 9363667 - DNA, 22 bp, Homo sapiens
ggctgctcctttaccctggcag

SEQ ID NO: 9363668 - DNA, 22 bp, Homo sapiens
ggctgctcctttaccctggcag

SEQ ID NO: 9363669 - DNA, 21 bp, Homo sapiens
ggctgctcacctaggtcccaa

SEQ ID NO: 9363670 - DNA, 21 bp, Homo sapiens
ggctgctcacctaggtcccaa

SEQ ID NO: 9363671 - DNA, 21 bp, Homo sapiens
ggctgctcacctaggtcccaa

SEQ ID NO: 9363672 - DNA, 18 bp, Homo sapiens
ggctgctcctctccctac

SEQ ID NO: 9363673 - DNA, 22 bp, Homo sapiens
ggctgctcacgcagccctccct

SEQ ID NO: 9363674 - DNA, 22 bp, Homo sapiens
ggctgctcacgcagccctccct

SEQ ID NO: 9363675 - DNA, 23 bp, Homo sapiens
ggctgcgagtgcctgggcctgtg

SEQ ID NO: 9363676 - DNA, 22 bp, Homo sapiens
ggctgctcaaggactctgatcg

SEQ ID NO: 9363677 - DNA, 19 bp, Homo sapiens
ggctgcctttccttaccag

SEQ ID NO: 9363678 - DNA, 19 bp, Homo sapiens
ggctgcctttccttaccag

SEQ ID NO: 9363679 - DNA, 22 bp, Homo sapiens
cactgtcttttgtgaagacaat

SEQ ID NO: 9363680 - DNA, 22 bp, Homo sapiens
cactgtgaaaaatggagtggtc

SEQ ID NO: 9363681 - DNA, 22 bp, Homo sapiens
ggctgcctcaattaatcttaca

SEQ ID NO: 9363682 - DNA, 22 bp, Homo sapiens
cactgtctgggacatgtggtct

SEQ ID NO: 9363683 - DNA, 22 bp, Homo sapiens
cactgtctgcttcgactcttca

SEQ ID NO: 9363684 - DNA, 22 bp, Homo sapiens
ggctgcagattgtagtctgtta

SEQ ID NO: 9363685 - DNA, 22 bp, Homo sapiens
ggctgcagcagagggactcacg

SEQ ID NO: 9363686 - DNA, 22 bp, Homo sapiens
ggctgcagccctcgcctagcca

SEQ ID NO: 9363687 - DNA, 22 bp, Homo sapiens
ggctgcagccctcgcctagcca

SEQ ID NO: 9363688 - DNA, 22 bp, Homo sapiens
ggctgcagccctcgcctagcca

SEQ ID NO: 9363689 - DNA, 22 bp, Homo sapiens
ggctgcagccctcgcctagcca

SEQ ID NO: 9363690 - DNA, 22 bp, Homo sapiens
ggctgcagcggattggggattg

SEQ ID NO: 9363691 - DNA, 22 bp, Homo sapiens
ggctgcagcggattggggattg

SEQ ID NO: 9363692 - DNA, 22 bp, Homo sapiens
cactgtctattaatataactta

SEQ ID NO: 9363693 - DNA, 22 bp, Homo sapiens
cactgcctgctggctgtcactt

SEQ ID NO: 9363694 - DNA, 22 bp, Homo sapiens
ggctgaggctcatgccatcttg

SEQ ID NO: 9363695 - DNA, 22 bp, Homo sapiens
cactgcctctgcctcctgggtt

SEQ ID NO: 9363696 - DNA, 22 bp, Homo sapiens
ggctgcagaggcgatctgaggt

SEQ ID NO: 9363697 - DNA, 22 bp, Homo sapiens
ggctgaggctcatgccatcttg

SEQ ID NO: 9363698 - DNA, 22 bp, Homo sapiens
ggctgcagatagccagccacca

SEQ ID NO: 9363699 - DNA, 22 bp, Homo sapiens
ggctgcagatagccagccacca

SEQ ID NO: 9363700 - DNA, 22 bp, Homo sapiens
ggctgcagatagccagccacca

SEQ ID NO: 9363701 - DNA, 22 bp, Homo sapiens
ggctgcagattgtagtctgtta

SEQ ID NO: 9363702 - DNA, 22 bp, Homo sapiens
ggctgcagatagccagccacca

SEQ ID NO: 9363703 - DNA, 22 bp, Homo sapiens
ggctcctgtcctcctggagctc

SEQ ID NO: 9363704 - DNA, 22 bp, Homo sapiens
ggctcctgtcctcctggagctc

SEQ ID NO: 9363705 - DNA, 22 bp, Homo sapiens
ggctcctgtcctcctggagctc

SEQ ID NO: 9363706 - DNA, 22 bp, Homo sapiens
ggctcctgtggcaagacagctt

SEQ ID NO: 9363707 - DNA, 22 bp, Homo sapiens
ggctcctgtggcaagacagctt

SEQ ID NO: 9363708 - DNA, 19 bp, Homo sapiens
ggctcctgtggctgcagcc

SEQ ID NO: 9363709 - DNA, 22 bp, Homo sapiens
ggctcctgtggcaagacagctt

SEQ ID NO: 9363710 - DNA, 16 bp, Homo sapiens
ggctcctggttccttc

SEQ ID NO: 9363711 - DNA, 22 bp, Homo sapiens
ggctcctgtcccctcagctgct

SEQ ID NO: 9363712 - DNA, 22 bp, Homo sapiens
ggctcctgtcccctcagctgct

SEQ ID NO: 9363713 - DNA, 22 bp, Homo sapiens
cactgcccagcgtcttaggcac

SEQ ID NO: 9363714 - DNA, 19 bp, Homo sapiens
ggctcctgtggctgcagcc

SEQ ID NO: 9363715 - DNA, 22 bp, Homo sapiens
cactgcccaggacctgccaccc

SEQ ID NO: 9363716 - DNA, 22 bp, Homo sapiens
cactgcccaggacctgccaccc

SEQ ID NO: 9363717 - DNA, 22 bp, Homo sapiens
cactgcccaggcacccatcttg

SEQ ID NO: 9363718 - DNA, 22 bp, Homo sapiens
cactgcccttacatgccctgca

SEQ ID NO: 9363719 - DNA, 22 bp, Homo sapiens
cactgcccttacatgccctgca

SEQ ID NO: 9363720 - DNA, 22 bp, Homo sapiens
cactgcccaggcacccatcttg

SEQ ID NO: 9363721 - DNA, 22 bp, Homo sapiens
cactgcccaggcacccatcttg

SEQ ID NO: 9363722 - DNA, 20 bp, Homo sapiens
cactgccctccagcctgagc

SEQ ID NO: 9363723 - DNA, 22 bp, Homo sapiens
ggctcctgggggtgctcctgcc

SEQ ID NO: 9363724 - DNA, 22 bp, Homo sapiens
ggctccagtttgtgccttcagc

SEQ ID NO: 9363725 - DNA, 19 bp, Homo sapiens
ggctcctggggctcagccc

SEQ ID NO: 9363726 - DNA, 19 bp, Homo sapiens
ggctcctggggctcagccc

SEQ ID NO: 9363727 - DNA, 22 bp, Homo sapiens
ggctccagtttccccttggggc

SEQ ID NO: 9363728 - DNA, 22 bp, Homo sapiens
cactgaggtatctgtctctcct

SEQ ID NO: 9363729 - DNA, 20 bp, Homo sapiens
cactgaggtgcagctcatgc

SEQ ID NO: 9363730 - DNA, 22 bp, Homo sapiens
cactgaggtttgttaactgagt

SEQ ID NO: 9363731 - DNA, 20 bp, Homo sapiens
cactgaggtgcagctcatgc

SEQ ID NO: 9363732 - DNA, 22 bp, Homo sapiens
cactgatactatagagacctca

SEQ ID NO: 9363733 - DNA, 22 bp, Homo sapiens
cactgcaacctccacctcctgg

SEQ ID NO: 9363734 - DNA, 22 bp, Homo sapiens
cactgaggcttccttaggcaat

SEQ ID NO: 9363735 - DNA, 22 bp, Homo sapiens
cactgagggcggagcccaggga

SEQ ID NO: 9363736 - DNA, 22 bp, Homo sapiens
cactgagggcggagcccaggga

SEQ ID NO: 9363737 - DNA, 22 bp, Homo sapiens
cactgagggagggtttcttctg

SEQ ID NO: 9363738 - DNA, 22 bp, Homo sapiens
cactgagggcggagcccaggga

SEQ ID NO: 9363739 - DNA, 22 bp, Homo sapiens
cactgaggtatctgtctctcct

SEQ ID NO: 9363740 - DNA, 22 bp, Homo sapiens
cactgaggtatctgtctctcct

SEQ ID NO: 9363741 - DNA, 22 bp, Homo sapiens
cactgaggtatctgtctctcct

SEQ ID NO: 9363742 - DNA, 22 bp, Homo sapiens
cactgagggggtggtttcagga

SEQ ID NO: 9363743 - DNA, 22 bp, Homo sapiens
ggcgctctggacctggctctcg

SEQ ID NO: 9363744 - DNA, 22 bp, Homo sapiens
ggcgctggccacggtggctctg

SEQ ID NO: 9363745 - DNA, 22 bp, Homo sapiens
ggcgctctggacctggctctcg

SEQ ID NO: 9363746 - DNA, 20 bp, Homo sapiens
ggcgcctggcctcatggctg

SEQ ID NO: 9363747 - DNA, 22 bp, Homo sapiens
ggcgctcagtgttgccccagag

SEQ ID NO: 9363748 - DNA, 22 bp, Homo sapiens
ggcagctgcaaatctgctctgt

SEQ ID NO: 9363749 - DNA, 22 bp, Homo sapiens
ggcagctgcaaatctgctctgt

SEQ ID NO: 9363750 - DNA, 22 bp, Homo sapiens
ggcaggaaaacaatgagccagg

SEQ ID NO: 9363751 - DNA, 22 bp, Homo sapiens
ggcagcttttccaggctctcca

SEQ ID NO: 9363752 - DNA, 22 bp, Homo sapiens
ggcaggaaaacaatgagccagg

SEQ ID NO: 9363753 - DNA, 22 bp, Homo sapiens
ggcaggaagaggagggtgaact

SEQ ID NO: 9363754 - DNA, 22 bp, Homo sapiens
ggcaggaagaggagggtgaact

SEQ ID NO: 9363755 - DNA, 22 bp, Homo sapiens
ggcaggaagctcatgtggactg

SEQ ID NO: 9363756 - DNA, 22 bp, Homo sapiens
ggcaggaagtagcagtctgagc

SEQ ID NO: 9363757 - DNA, 19 bp, Homo sapiens
ggatccagaggatctgcca

SEQ ID NO: 9363758 - DNA, 22 bp, Homo sapiens
ggatcaggctgaagctaggact

SEQ ID NO: 9363759 - DNA, 22 bp, Homo sapiens
ggatcaggcgccatgggaagtg

SEQ ID NO: 9363760 - DNA, 22 bp, Homo sapiens
ggatcaggctgaagctaggact

SEQ ID NO: 9363761 - DNA, 20 bp, Homo sapiens
ggatcagatggagcctctgc

SEQ ID NO: 9363762 - DNA, 22 bp, Homo sapiens
ggatcagaggatcagggacagt

SEQ ID NO: 9363763 - DNA, 22 bp, Homo sapiens
ggatcagaatctttgggtgtaa

SEQ ID NO: 9363764 - DNA, 22 bp, Homo sapiens
ggatcagaatctctgagagttt

SEQ ID NO: 9363765 - DNA, 22 bp, Homo sapiens
ggatcagaatctctgagagttt

SEQ ID NO: 9363766 - DNA, 22 bp, Homo sapiens
ggatcagaacgtgatggctgtg

SEQ ID NO: 9363767 - DNA, 19 bp, Homo sapiens
ggataaggttggagtgatc

SEQ ID NO: 9363768 - DNA, 22 bp, Homo sapiens
ggatatatgcatgttatcattt

SEQ ID NO: 9363769 - DNA, 22 bp, Homo sapiens
ggaggtggaggttgcagtgagc

SEQ ID NO: 9363770 - DNA, 22 bp, Homo sapiens
ggaggtggaggttgcagtgagc

SEQ ID NO: 9363771 - DNA, 22 bp, Homo sapiens
ggagtgaaaggtaagttgagct

SEQ ID NO: 9363772 - DNA, 22 bp, Homo sapiens
ggagtctgggaattggagagaa

SEQ ID NO: 9363773 - DNA, 22 bp, Homo sapiens
ggagtgactctcggggccacta

SEQ ID NO: 9363774 - DNA, 19 bp, Homo sapiens
ggagtttccaatgggtaaa

SEQ ID NO: 9363775 - DNA, 22 bp, Homo sapiens
ggagtgactctcggggccacta

SEQ ID NO: 9363776 - DNA, 22 bp, Homo sapiens
ggagtgactcacagctgggaca

SEQ ID NO: 9363777 - DNA, 22 bp, Homo sapiens
ggagtgactcacagctgggaca

SEQ ID NO: 9363778 - DNA, 22 bp, Homo sapiens
ggagtgactcacagctgggaca

SEQ ID NO: 9363779 - DNA, 22 bp, Homo sapiens
ggagtgactcacagctgggaca

SEQ ID NO: 9363780 - DNA, 22 bp, Homo sapiens
ggagtgaatcactagatgcaga

SEQ ID NO: 9363781 - DNA, 22 bp, Homo sapiens
ggagtgaagtggcgcgatctcg

SEQ ID NO: 9363782 - DNA, 22 bp, Homo sapiens
ggagtgaagtggcgcgatctcg

SEQ ID NO: 9363783 - DNA, 23 bp, Homo sapiens
cacatgcaggcagtggccttcaa

SEQ ID NO: 9363784 - DNA, 22 bp, Homo sapiens
cacatgcagtttacgtcactga

SEQ ID NO: 9363785 - DNA, 22 bp, Homo sapiens
ggcaggagaaaggtctcttctt

SEQ ID NO: 9363786 - DNA, 22 bp, Homo sapiens
ggcaggagaaaggtctcttctt

SEQ ID NO: 9363787 - DNA, 22 bp, Homo sapiens
ggcaggactcttctgtgggccg

SEQ ID NO: 9363788 - DNA, 20 bp, Homo sapiens
ggcaggacccggtagggagc

SEQ ID NO: 9363789 - DNA, 22 bp, Homo sapiens
cacatgcattggcaaaagtgta

SEQ ID NO: 9363790 - DNA, 22 bp, Homo sapiens
cacatgcatgccaggctcacag

SEQ ID NO: 9363791 - DNA, 21 bp, Homo sapiens
cacatgcatgcacaggttgta

SEQ ID NO: 9363792 - DNA, 22 bp, Homo sapiens
cacatgcatctgtcatgtttgg

SEQ ID NO: 9363793 - DNA, 22 bp, Homo sapiens
cacatgcatacctatgtgtata

SEQ ID NO: 9363794 - DNA, 22 bp, Homo sapiens
cacatgcatcacgacttccttt

SEQ ID NO: 9363795 - DNA, 22 bp, Homo sapiens
cacatgcagttttccagcagtc

SEQ ID NO: 9363796 - DNA, 22 bp, Homo sapiens
cacatgcagttttccagcagtc

SEQ ID NO: 9363797 - DNA, 22 bp, Homo sapiens
ggcaggtgtggtgaccagagat

SEQ ID NO: 9363798 - DNA, 22 bp, Homo sapiens
ggcaggtgtggtgaccagagat

SEQ ID NO: 9363799 - DNA, 22 bp, Homo sapiens
ggcaggtgtggagtgttatttt

SEQ ID NO: 9363800 - DNA, 22 bp, Homo sapiens
ggcaggtgtggagtgttatttt

SEQ ID NO: 9363801 - DNA, 19 bp, Homo sapiens
ggcaggtgtgcttatgctt

SEQ ID NO: 9363802 - DNA, 19 bp, Homo sapiens
ggcaggtgtgcttatgctt

SEQ ID NO: 9363803 - DNA, 22 bp, Homo sapiens
ggcaggtgtgagctgtaaagga

SEQ ID NO: 9363804 - DNA, 22 bp, Homo sapiens
ggcaggtgtgagctgtaaagga

SEQ ID NO: 9363805 - DNA, 22 bp, Homo sapiens
ggcaggtgtgagctgtaaagga

SEQ ID NO: 9363806 - DNA, 22 bp, Homo sapiens
ggcaggtgtgagatcgaggcca

SEQ ID NO: 9363807 - DNA, 22 bp, Homo sapiens
ggcaggtgccttctgtgctagc

SEQ ID NO: 9363808 - DNA, 22 bp, Homo sapiens
ggcaggtgccttctgtgctagc

SEQ ID NO: 9363809 - DNA, 22 bp, Homo sapiens
ggcaggtgccttctgtgctagc

SEQ ID NO: 9363810 - DNA, 22 bp, Homo sapiens
ggcaggtgtgagatcgaggcca

SEQ ID NO: 9363811 - DNA, 22 bp, Homo sapiens
ggcaggtgtttttatattaaag

SEQ ID NO: 9363812 - DNA, 22 bp, Homo sapiens
ggcaggtgtttttatattaaag

SEQ ID NO: 9363813 - DNA, 22 bp, Homo sapiens
ggcaggtgtggtgaccagagat

SEQ ID NO: 9363814 - DNA, 22 bp, Homo sapiens
ggcagtatgagttcaaataatt

SEQ ID NO: 9363815 - DNA, 21 bp, Homo sapiens
ggcagtaagccaaatccattt

SEQ ID NO: 9363816 - DNA, 22 bp, Homo sapiens
cacatttctggaattgacttgg

SEQ ID NO: 9363817 - DNA, 22 bp, Homo sapiens
cacccaggacaggccagatgtg

SEQ ID NO: 9363818 - DNA, 22 bp, Homo sapiens
cacccaggacaggccagatgtg

SEQ ID NO: 9363819 - DNA, 22 bp, Homo sapiens
cacccaggcaggtggctgagaa

SEQ ID NO: 9363820 - DNA, 22 bp, Homo sapiens
cacccaggcaggtggctgagaa

SEQ ID NO: 9363821 - DNA, 22 bp, Homo sapiens
ggccagggcctggggactgtcc

SEQ ID NO: 9363822 - DNA, 22 bp, Homo sapiens
ggccagggcctggggactgtcc

SEQ ID NO: 9363823 - DNA, 22 bp, Homo sapiens
cacccaggctagagtgcagtgg

SEQ ID NO: 9363824 - DNA, 22 bp, Homo sapiens
cacccagcttttgcatcctccg

SEQ ID NO: 9363825 - DNA, 21 bp, Homo sapiens
ggccagctcggaaggtcccat

SEQ ID NO: 9363826 - DNA, 18 bp, Homo sapiens
ggccagctcctgaggcag

SEQ ID NO: 9363827 - DNA, 18 bp, Homo sapiens
ggccagctcctgaggcag

SEQ ID NO: 9363828 - DNA, 22 bp, Homo sapiens
ggccagctccttggcagtgcct

SEQ ID NO: 9363829 - DNA, 22 bp, Homo sapiens
ggccagctccttggcagtgcct

SEQ ID NO: 9363830 - DNA, 22 bp, Homo sapiens
caccaataattttatatcacat

SEQ ID NO: 9363831 - DNA, 22 bp, Homo sapiens
caccaagactgtataccaggca

SEQ ID NO: 9363832 - DNA, 19 bp, Homo sapiens
caccaagatggctctagtc

SEQ ID NO: 9363833 - DNA, 17 bp, Homo sapiens
caccaattaagaccctc

SEQ ID NO: 9363834 - DNA, 19 bp, Homo sapiens
caccaagatggctctagtc

SEQ ID NO: 9363835 - DNA, 22 bp, Homo sapiens
caccacagcatccactagaagg

SEQ ID NO: 9363836 - DNA, 22 bp, Homo sapiens
caccacagcatccactagaagg

SEQ ID NO: 9363837 - DNA, 22 bp, Homo sapiens
ggccactgtttcctgggcagtt

SEQ ID NO: 9363838 - DNA, 22 bp, Homo sapiens
ggccactgtttcctgggcagtt

SEQ ID NO: 9363839 - DNA, 22 bp, Homo sapiens
ggccacttggcagatggcagct

SEQ ID NO: 9363840 - DNA, 22 bp, Homo sapiens
ggccagcccagtggtcctctct

SEQ ID NO: 9363841 - DNA, 22 bp, Homo sapiens
ggccagcccagtggtcctctct

SEQ ID NO: 9363842 - DNA, 18 bp, Homo sapiens
ggccagccccaggccagc

SEQ ID NO: 9363843 - DNA, 18 bp, Homo sapiens
ggccagccccaggccagc

SEQ ID NO: 9363844 - DNA, 18 bp, Homo sapiens
ggccagccccaggccagc

SEQ ID NO: 9363845 - DNA, 22 bp, Homo sapiens
ggccagccctcctccctgggtt

SEQ ID NO: 9363846 - DNA, 18 bp, Homo sapiens
ggccagccccaggccagc

SEQ ID NO: 9363847 - DNA, 18 bp, Homo sapiens
ggccagccccaggccagc

SEQ ID NO: 9363848 - DNA, 22 bp, Homo sapiens
ggccagctacccatctgcgtca

SEQ ID NO: 9363849 - DNA, 22 bp, Homo sapiens
ggccagcggcacagcctggccc

SEQ ID NO: 9363850 - DNA, 22 bp, Homo sapiens
ggccagcggcacagcctggccc

SEQ ID NO: 9363851 - DNA, 22 bp, Homo sapiens
ggccagcctggggctcccagac

SEQ ID NO: 9363852 - DNA, 22 bp, Homo sapiens
ggccagcctggggctcccagac

SEQ ID NO: 9363853 - DNA, 22 bp, Homo sapiens
ggccagcctggggctcccagac

SEQ ID NO: 9363854 - DNA, 22 bp, Homo sapiens
ggccagccctcctccctgggtt

SEQ ID NO: 9363855 - DNA, 22 bp, Homo sapiens
ggccagcctggggctcccagac

SEQ ID NO: 9363856 - DNA, 22 bp, Homo sapiens
ggccagccctcctccctgggtt

SEQ ID NO: 9363857 - DNA, 22 bp, Homo sapiens
ggcccagagctccctggcacct

SEQ ID NO: 9363858 - DNA, 22 bp, Homo sapiens
ggcccagacccaagagtggtgg

SEQ ID NO: 9363859 - DNA, 22 bp, Homo sapiens
ggcccagaagccagaagcctcc

SEQ ID NO: 9363860 - DNA, 22 bp, Homo sapiens
ggcccagcacagtgcttggggg

SEQ ID NO: 9363861 - DNA, 22 bp, Homo sapiens
ggcccagcacagtgcttggggg

SEQ ID NO: 9363862 - DNA, 22 bp, Homo sapiens
ggcccagcacagtgcttggggg

SEQ ID NO: 9363863 - DNA, 22 bp, Homo sapiens
ggcccagagggtcaggagctga

SEQ ID NO: 9363864 - DNA, 22 bp, Homo sapiens
ggcccagagtctgcaatggagt

SEQ ID NO: 9363865 - DNA, 22 bp, Homo sapiens
ggcccagagggtcaggagctga

SEQ ID NO: 9363866 - DNA, 22 bp, Homo sapiens
ggccccagcagaccctcctctg

SEQ ID NO: 9363867 - DNA, 22 bp, Homo sapiens
ggcccagcatcttgtgaagttt

SEQ ID NO: 9363868 - DNA, 22 bp, Homo sapiens
ggcccagcccgagtcagccttc

SEQ ID NO: 9363869 - DNA, 22 bp, Homo sapiens
ggcgaggccgggacaggctgga

SEQ ID NO: 9363870 - DNA, 22 bp, Homo sapiens
ggcgaggtgtctgccatcaagc

SEQ ID NO: 9363871 - DNA, 22 bp, Homo sapiens
ggcgagggagcagtgcggtggg

SEQ ID NO: 9363872 - DNA, 22 bp, Homo sapiens
ggcgcaggccttggatcctggt

SEQ ID NO: 9363873 - DNA, 22 bp, Homo sapiens
ggcgcaggccttggatcctggt

SEQ ID NO: 9363874 - DNA, 22 bp, Homo sapiens
ggcgcagtgtgcagaggagtga

SEQ ID NO: 9363875 - DNA, 22 bp, Homo sapiens
ggcgcccatcggtgcagagggc

SEQ ID NO: 9363876 - DNA, 22 bp, Homo sapiens
ggcgcccccttcaaacagagca

SEQ ID NO: 9363877 - DNA, 22 bp, Homo sapiens
ggccccaggcctttggtctggc

SEQ ID NO: 9363878 - DNA, 22 bp, Homo sapiens
ggccccagggaagaaggtggtc

SEQ ID NO: 9363879 - DNA, 22 bp, Homo sapiens
ggccccagggaagaaggtggtc

SEQ ID NO: 9363880 - DNA, 17 bp, Homo sapiens
ggcctgtgtggctgcag

SEQ ID NO: 9363881 - DNA, 22 bp, Homo sapiens
ggccccagggattaggccaacc

SEQ ID NO: 9363882 - DNA, 22 bp, Homo sapiens
ggccccagcctcagtcccctga

SEQ ID NO: 9363883 - DNA, 22 bp, Homo sapiens
gggggaggtgaatgcaataagg

SEQ ID NO: 9363884 - DNA, 22 bp, Homo sapiens
gggggaggtgaatgcaataagg

SEQ ID NO: 9363885 - DNA, 22 bp, Homo sapiens
gggggaggtgaatgcaataagg

SEQ ID NO: 9363886 - DNA, 22 bp, Homo sapiens
cagaggaagggtgctgcgaaag

SEQ ID NO: 9363887 - DNA, 22 bp, Homo sapiens
cagaggaaggctctgggaatgt

SEQ ID NO: 9363888 - DNA, 22 bp, Homo sapiens
cagaggaagggtgctgcgaaag

SEQ ID NO: 9363889 - DNA, 22 bp, Homo sapiens
cagaggaagttccttgatgaga

SEQ ID NO: 9363890 - DNA, 22 bp, Homo sapiens
cagaggaagttccttgatgaga

SEQ ID NO: 9363891 - DNA, 22 bp, Homo sapiens
cagaggacaatagaatggaaag

SEQ ID NO: 9363892 - DNA, 22 bp, Homo sapiens
cagaggaagcagacacatcttg

SEQ ID NO: 9363893 - DNA, 22 bp, Homo sapiens
cagaggaagcagacacatcttg

SEQ ID NO: 9363894 - DNA, 22 bp, Homo sapiens
cagaggaagagatacaagccct

SEQ ID NO: 9363895 - DNA, 22 bp, Homo sapiens
cagaggaagagatacaagccct

SEQ ID NO: 9363896 - DNA, 22 bp, Homo sapiens
cagaggaagcagacacatcttg

SEQ ID NO: 9363897 - DNA, 22 bp, Homo sapiens
cagaggaaggctctgggaatgt

SEQ ID NO: 9363898 - DNA, 22 bp, Homo sapiens
cagaggaaggctctgggaatgt

SEQ ID NO: 9363899 - DNA, 22 bp, Homo sapiens
cagaggaagctgggtgtggagt

SEQ ID NO: 9363900 - DNA, 22 bp, Homo sapiens
cagaggaagctgggtgtggagt

SEQ ID NO: 9363901 - DNA, 22 bp, Homo sapiens
cagaggcaggaagatgggcagt

SEQ ID NO: 9363902 - DNA, 22 bp, Homo sapiens
cagaggcaggaagatgggcagt

SEQ ID NO: 9363903 - DNA, 22 bp, Homo sapiens
cagaggcaggaagatgggcagt

SEQ ID NO: 9363904 - DNA, 22 bp, Homo sapiens
cagaggcaggaagatgggcagt

SEQ ID NO: 9363905 - DNA, 22 bp, Homo sapiens
cagaggcaggaagatgggcagt

SEQ ID NO: 9363906 - DNA, 22 bp, Homo sapiens
cagaggcagccgggggagaacg

SEQ ID NO: 9363907 - DNA, 22 bp, Homo sapiens
cagaggcagccgggggagaacg

SEQ ID NO: 9363908 - DNA, 22 bp, Homo sapiens
cagaggcagccgggggagaacg

SEQ ID NO: 9363909 - DNA, 22 bp, Homo sapiens
cagaggcagaggtcatctctgg

SEQ ID NO: 9363910 - DNA, 22 bp, Homo sapiens
cagaggcagaggtcatctctgg

SEQ ID NO: 9363911 - DNA, 22 bp, Homo sapiens
cagaggcagaatggagatttgg

SEQ ID NO: 9363912 - DNA, 22 bp, Homo sapiens
cagaggcagaatggagatttgg

SEQ ID NO: 9363913 - DNA, 22 bp, Homo sapiens
cagaggcagaatggagatttgg

SEQ ID NO: 9363914 - DNA, 22 bp, Homo sapiens
cagaggcagaatggagatttgg

SEQ ID NO: 9363915 - DNA, 22 bp, Homo sapiens
cagaggcagaccctccagggcg

SEQ ID NO: 9363916 - DNA, 22 bp, Homo sapiens
gggggcagtaacctcaaagtgt

SEQ ID NO: 9363917 - DNA, 22 bp, Homo sapiens
gggggcagtaacctcaaagtgt

SEQ ID NO: 9363918 - DNA, 22 bp, Homo sapiens
gggggcagtaaggatatggaaa

SEQ ID NO: 9363919 - DNA, 22 bp, Homo sapiens
gggggcagtaaggatatggaaa

SEQ ID NO: 9363920 - DNA, 19 bp, Homo sapiens
cagaggcactttctcttag

SEQ ID NO: 9363921 - DNA, 19 bp, Homo sapiens
cagaggcactttctcttag

SEQ ID NO: 9363922 - DNA, 22 bp, Homo sapiens
gggggatgctcaggaggctgct

SEQ ID NO: 9363923 - DNA, 22 bp, Homo sapiens
gggggcagaatgtactcttgtc

SEQ ID NO: 9363924 - DNA, 22 bp, Homo sapiens
gggggcaggtctggaactttga

SEQ ID NO: 9363925 - DNA, 22 bp, Homo sapiens
cagaggaacgtttggattgatt

SEQ ID NO: 9363926 - DNA, 22 bp, Homo sapiens
cagaggaagagatacaagccct

SEQ ID NO: 9363927 - DNA, 22 bp, Homo sapiens
cagaggaacgtttggattgatt

SEQ ID NO: 9363928 - DNA, 22 bp, Homo sapiens
cagaggaaatgggaaggagata

SEQ ID NO: 9363929 - DNA, 22 bp, Homo sapiens
cagaggaaatgggaaggagata

SEQ ID NO: 9363930 - DNA, 22 bp, Homo sapiens
cagaggaaatgggaaggagata

SEQ ID NO: 9363931 - DNA, 22 bp, Homo sapiens
cagaggaaagtatttctggaag

SEQ ID NO: 9363932 - DNA, 22 bp, Homo sapiens
cagaggaaagtatttctggaag

SEQ ID NO: 9363933 - DNA, 22 bp, Homo sapiens
cagagcttgaatgtccatggtt

SEQ ID NO: 9363934 - DNA, 22 bp, Homo sapiens
cagagcttctgacagctgctgc

SEQ ID NO: 9363935 - DNA, 22 bp, Homo sapiens
cagagctgtcatttgccagtga

SEQ ID NO: 9363936 - DNA, 22 bp, Homo sapiens
gggctctgcgctcagctccagc

SEQ ID NO: 9363937 - DNA, 22 bp, Homo sapiens
gggctctgcgctcagctccagc

SEQ ID NO: 9363938 - DNA, 22 bp, Homo sapiens
gggctctgcgctcagctccagc

SEQ ID NO: 9363939 - DNA, 22 bp, Homo sapiens
gggctctgcgctcagctccagc

SEQ ID NO: 9363940 - DNA, 22 bp, Homo sapiens
gggctctgcctggctgggagta

SEQ ID NO: 9363941 - DNA, 22 bp, Homo sapiens
gggctctgcctggctgggagta

SEQ ID NO: 9363942 - DNA, 21 bp, Homo sapiens
gggctctgccctcctggagct

SEQ ID NO: 9363943 - DNA, 21 bp, Homo sapiens
gggctctgccctcctggagct

SEQ ID NO: 9363944 - DNA, 21 bp, Homo sapiens
gggctctgccctcctggagct

SEQ ID NO: 9363945 - DNA, 20 bp, Homo sapiens
gggctctgcatccatcagcc

SEQ ID NO: 9363946 - DNA, 20 bp, Homo sapiens
gggctctgcatccatcagcc

SEQ ID NO: 9363947 - DNA, 20 bp, Homo sapiens
gggctctgcatccatcagcc

SEQ ID NO: 9363948 - DNA, 20 bp, Homo sapiens
gggctctgcatccatcagcc

SEQ ID NO: 9363949 - DNA, 18 bp, Homo sapiens
gggctctgatccttcacc

SEQ ID NO: 9363950 - DNA, 18 bp, Homo sapiens
gggctctgatccttcacc

SEQ ID NO: 9363951 - DNA, 22 bp, Homo sapiens
gggctctgatagagattattgc

SEQ ID NO: 9363952 - DNA, 22 bp, Homo sapiens
gggctctgatagagattattgc

SEQ ID NO: 9363953 - DNA, 22 bp, Homo sapiens
gggctctgcacgttctggcgtc

SEQ ID NO: 9363954 - DNA, 18 bp, Homo sapiens
gggctctgatccttcacc

SEQ ID NO: 9363955 - DNA, 22 bp, Homo sapiens
gggctctgcagtgacttgaggg

SEQ ID NO: 9363956 - DNA, 22 bp, Homo sapiens
gggctctgcagagaactggctc

SEQ ID NO: 9363957 - DNA, 22 bp, Homo sapiens
gggctctgcagtgacttgaggg

SEQ ID NO: 9363958 - DNA, 22 bp, Homo sapiens
gggctctgcagtgacttgaggg

SEQ ID NO: 9363959 - DNA, 22 bp, Homo sapiens
gggctctgcagagaactggctc

SEQ ID NO: 9363960 - DNA, 22 bp, Homo sapiens
gggctctgcagagaactggctc

SEQ ID NO: 9363961 - DNA, 22 bp, Homo sapiens
gggctctgcacgttctggcgtc

SEQ ID NO: 9363962 - DNA, 22 bp, Homo sapiens
gggctctgcacgttctggcgtc

SEQ ID NO: 9363963 - DNA, 22 bp, Homo sapiens
gggctcagtctggcgtggaatg

SEQ ID NO: 9363964 - DNA, 21 bp, Homo sapiens
gggctcagtggaaaagagtgt

SEQ ID NO: 9363965 - DNA, 22 bp, Homo sapiens
gggctcagtcggcaagcccctt

SEQ ID NO: 9363966 - DNA, 22 bp, Homo sapiens
gggctcagtctgcggcgcgcgg

SEQ ID NO: 9363967 - DNA, 22 bp, Homo sapiens
gggctcaggagtttgaggctgc

SEQ ID NO: 9363968 - DNA, 22 bp, Homo sapiens
gggctcaggagtttgaggctgc

SEQ ID NO: 9363969 - DNA, 22 bp, Homo sapiens
gggctcaggcctggcctctcac

SEQ ID NO: 9363970 - DNA, 22 bp, Homo sapiens
gggctcaggcctggcctctcac

SEQ ID NO: 9363971 - DNA, 22 bp, Homo sapiens
gggctcaggcctggcctctcac

SEQ ID NO: 9363972 - DNA, 22 bp, Homo sapiens
gggctcaggcctggcctctcac

SEQ ID NO: 9363973 - DNA, 22 bp, Homo sapiens
gggctcaggtcagggcatcagc

SEQ ID NO: 9363974 - DNA, 22 bp, Homo sapiens
gggctcagggacacatgtgtgt

SEQ ID NO: 9363975 - DNA, 22 bp, Homo sapiens
gggctcagggacacatgtgtgt

SEQ ID NO: 9363976 - DNA, 22 bp, Homo sapiens
gggctcagtcctggttctaccc

SEQ ID NO: 9363977 - DNA, 21 bp, Homo sapiens
cagagcagcgttctgctgtgg

SEQ ID NO: 9363978 - DNA, 21 bp, Homo sapiens
cagagcagcgttctgctgtgg

SEQ ID NO: 9363979 - DNA, 21 bp, Homo sapiens
cagagcagcgttctgctgtgg

SEQ ID NO: 9363980 - DNA, 22 bp, Homo sapiens
gggcgccgtgggaaacagccgg

SEQ ID NO: 9363981 - DNA, 22 bp, Homo sapiens
cagagcaggcccactgccctcc

SEQ ID NO: 9363982 - DNA, 21 bp, Homo sapiens
cagagcagcgttctgctgtgg

SEQ ID NO: 9363983 - DNA, 22 bp, Homo sapiens
cagagcaggaatagggtgttga

SEQ ID NO: 9363984 - DNA, 22 bp, Homo sapiens
cagagcaggaatagggtgttga

SEQ ID NO: 9363985 - DNA, 22 bp, Homo sapiens
cagagcaggcccactgccctcc

SEQ ID NO: 9363986 - DNA, 22 bp, Homo sapiens
cagagcaggcccactgccctcc

SEQ ID NO: 9363987 - DNA, 18 bp, Homo sapiens
cagagcagaggtggagcg

SEQ ID NO: 9363988 - DNA, 18 bp, Homo sapiens
cagagcagaggtggagcg

SEQ ID NO: 9363989 - DNA, 18 bp, Homo sapiens
cagagcagaggtggagcg

SEQ ID NO: 9363990 - DNA, 22 bp, Homo sapiens
cagagcagcagagcttccatgg

SEQ ID NO: 9363991 - DNA, 22 bp, Homo sapiens
cagagcagcagagcttccatgg

SEQ ID NO: 9363992 - DNA, 22 bp, Homo sapiens
gggccctgggattcagagcaag

SEQ ID NO: 9363993 - DNA, 18 bp, Homo sapiens
gggccctggcgtccgccc

SEQ ID NO: 9363994 - DNA, 22 bp, Homo sapiens
gggccctggctttcctgttctt

SEQ ID NO: 9363995 - DNA, 22 bp, Homo sapiens
gggccctggctttcctgttctt

SEQ ID NO: 9363996 - DNA, 16 bp, Homo sapiens
cagagaggacagaggc

SEQ ID NO: 9363997 - DNA, 22 bp, Homo sapiens
cagagagagtctgtccctgaag

SEQ ID NO: 9363998 - DNA, 22 bp, Homo sapiens
cagagagagtggggtgtggatt

SEQ ID NO: 9363999 - DNA, 22 bp, Homo sapiens
cagagagagtggggtgtggatt

SEQ ID NO: 9364000 - DNA, 22 bp, Homo sapiens
cagagagagtggggtgtggatt

SEQ ID NO: 9364001 - DNA, 22 bp, Homo sapiens
cagagagagtggggtgtggatt

SEQ ID NO: 9364002 - DNA, 22 bp, Homo sapiens
gggccctgcgtccggaagtctg

SEQ ID NO: 9364003 - DNA, 22 bp, Homo sapiens
gggccctgcgtccggaagtctg

SEQ ID NO: 9364004 - DNA, 22 bp, Homo sapiens
gggccctggacgtggcggcaga

SEQ ID NO: 9364005 - DNA, 22 bp, Homo sapiens
gggccagctctgtgatgtaggg

SEQ ID NO: 9364006 - DNA, 22 bp, Homo sapiens
gggccagctctgtgatgtaggg

SEQ ID NO: 9364007 - DNA, 22 bp, Homo sapiens
gggccaggagtggagatatggg

SEQ ID NO: 9364008 - DNA, 22 bp, Homo sapiens
gggccctggccgaatccctctg

SEQ ID NO: 9364009 - DNA, 22 bp, Homo sapiens
gggccctggccgaatccctctg

SEQ ID NO: 9364010 - DNA, 22 bp, Homo sapiens
gggccctggacgtggcggcaga

SEQ ID NO: 9364011 - DNA, 22 bp, Homo sapiens
gggccctggatttaagcatgga

SEQ ID NO: 9364012 - DNA, 20 bp, Homo sapiens
cagaagcaaggcaggtacct

SEQ ID NO: 9364013 - DNA, 22 bp, Homo sapiens
cagaagcaagagccggagctag

SEQ ID NO: 9364014 - DNA, 22 bp, Homo sapiens
cagaagcaagtagtgattcttt

SEQ ID NO: 9364015 - DNA, 22 bp, Homo sapiens
cagaagcaagtagtgattcttt

SEQ ID NO: 9364016 - DNA, 22 bp, Homo sapiens
cagaagcaaatgccttgctgag

SEQ ID NO: 9364017 - DNA, 22 bp, Homo sapiens
cagaagcaaatgccttgctgag

SEQ ID NO: 9364018 - DNA, 23 bp, Homo sapiens
cagaagcacctgttgactgctgc

SEQ ID NO: 9364019 - DNA, 22 bp, Homo sapiens
cagaagcacatgtttacatgta

SEQ ID NO: 9364020 - DNA, 22 bp, Homo sapiens
cagaagcactaggaggaaacgt

SEQ ID NO: 9364021 - DNA, 22 bp, Homo sapiens
cagaagcactaggaggaaacgt

SEQ ID NO: 9364022 - DNA, 18 bp, Homo sapiens
cagaagcaggcagtgcag

SEQ ID NO: 9364023 - DNA, 22 bp, Homo sapiens
cagaagcagattctaaagcaag

SEQ ID NO: 9364024 - DNA, 18 bp, Homo sapiens
cagaagcaggcagtgcag

SEQ ID NO: 9364025 - DNA, 18 bp, Homo sapiens
cagaagcaggcagtgcag

SEQ ID NO: 9364026 - DNA, 22 bp, Homo sapiens
cagagagaatcttggcagctga

SEQ ID NO: 9364027 - DNA, 22 bp, Homo sapiens
cagagagaatcttggcagctga

SEQ ID NO: 9364028 - DNA, 22 bp, Homo sapiens
cagagagaatcttggcagctga

SEQ ID NO: 9364029 - DNA, 22 bp, Homo sapiens
cagagagaatcttggcagctga

SEQ ID NO: 9364030 - DNA, 22 bp, Homo sapiens
cagagagaatcttggcagctga

SEQ ID NO: 9364031 - DNA, 22 bp, Homo sapiens
cagagagaatatgtagtatgga

SEQ ID NO: 9364032 - DNA, 22 bp, Homo sapiens
cagagagaatatgtagtatgga

SEQ ID NO: 9364033 - DNA, 22 bp, Homo sapiens
cagagagaggggctgcctggcc

SEQ ID NO: 9364034 - DNA, 22 bp, Homo sapiens
cagagagaggtgccgataatgg

SEQ ID NO: 9364035 - DNA, 19 bp, Homo sapiens
cagagagaccaaggcgcca

SEQ ID NO: 9364036 - DNA, 22 bp, Homo sapiens
cagagagagcaggaaacctccg

SEQ ID NO: 9364037 - DNA, 19 bp, Homo sapiens
cagagagaccaaggcgcca

SEQ ID NO: 9364038 - DNA, 22 bp, Homo sapiens
cagagagagcaggaaacctccg

SEQ ID NO: 9364039 - DNA, 22 bp, Homo sapiens
cagagagagcaggaaacctccg

SEQ ID NO: 9364040 - DNA, 22 bp, Homo sapiens
cagatggcaacagctctgtgac

SEQ ID NO: 9364041 - DNA, 22 bp, Homo sapiens
ggtgctggttcagggtggctgt

SEQ ID NO: 9364042 - DNA, 22 bp, Homo sapiens
ggtggcagggagtgtccctggg

SEQ ID NO: 9364043 - DNA, 22 bp, Homo sapiens
ggtggcagggagtgtccctggg

SEQ ID NO: 9364044 - DNA, 22 bp, Homo sapiens
ggtggcaggctggcattggcaa

SEQ ID NO: 9364045 - DNA, 22 bp, Homo sapiens
cagatgcttttgattctggggt

SEQ ID NO: 9364046 - DNA, 22 bp, Homo sapiens
cagatggaacacagaaaggaga

SEQ ID NO: 9364047 - DNA, 22 bp, Homo sapiens
cagatgcttgttggctggtctc

SEQ ID NO: 9364048 - DNA, 22 bp, Homo sapiens
cagatgcttggaggacacttgg

SEQ ID NO: 9364049 - DNA, 22 bp, Homo sapiens
cagatggagtcccgtggagttc

SEQ ID NO: 9364050 - DNA, 18 bp, Homo sapiens
ggtggcaggtcagatgcc

SEQ ID NO: 9364051 - DNA, 18 bp, Homo sapiens
ggtggcaggtcagatgcc

SEQ ID NO: 9364052 - DNA, 18 bp, Homo sapiens
ggtggcaggtcagatgcc

SEQ ID NO: 9364053 - DNA, 22 bp, Homo sapiens
ggtggcagtagcactgggcctg

SEQ ID NO: 9364054 - DNA, 22 bp, Homo sapiens
ggtggcagtagcactgggcctg

SEQ ID NO: 9364055 - DNA, 22 bp, Homo sapiens
ggtggcagtagcactgggcctg

SEQ ID NO: 9364056 - DNA, 22 bp, Homo sapiens
ggtggcagtcttaagagatctt

SEQ ID NO: 9364057 - DNA, 22 bp, Homo sapiens
ggtggcagtagcactgggcctg

SEQ ID NO: 9364058 - DNA, 22 bp, Homo sapiens
ggtggcagtagcactgggcctg

SEQ ID NO: 9364059 - DNA, 22 bp, Homo sapiens
ggtggcagtcttaagagatctt

SEQ ID NO: 9364060 - DNA, 22 bp, Homo sapiens
ggtggctggaggagctgatgga

SEQ ID NO: 9364061 - DNA, 22 bp, Homo sapiens
ggtggctggaggagctgatgga

SEQ ID NO: 9364062 - DNA, 22 bp, Homo sapiens
ggtggcagtggtctctgacaga

SEQ ID NO: 9364063 - DNA, 22 bp, Homo sapiens
ggtggcagtggtctctgacaga

SEQ ID NO: 9364064 - DNA, 22 bp, Homo sapiens
ggtggcagtgcttgcgggtcta

SEQ ID NO: 9364065 - DNA, 22 bp, Homo sapiens
ggtggctgcttcctcaagagga

SEQ ID NO: 9364066 - DNA, 22 bp, Homo sapiens
ggtggctggaggagctgatgga

SEQ ID NO: 9364067 - DNA, 22 bp, Homo sapiens
ggtgggaaggccactgaaggtt

SEQ ID NO: 9364068 - DNA, 22 bp, Homo sapiens
ggtgggaaggccactgaaggtt

SEQ ID NO: 9364069 - DNA, 22 bp, Homo sapiens
ggtgggaaggggccagtgtgcg

SEQ ID NO: 9364070 - DNA, 22 bp, Homo sapiens
ggtgggaaggggccagtgtgcg

SEQ ID NO: 9364071 - DNA, 22 bp, Homo sapiens
cagcactgctgctgtacacaca

SEQ ID NO: 9364072 - DNA, 22 bp, Homo sapiens
cagcagagacggtaagcagaac

SEQ ID NO: 9364073 - DNA, 20 bp, Homo sapiens
cagcagagacccatggggag

SEQ ID NO: 9364074 - DNA, 22 bp, Homo sapiens
gtaagcagaggttaatgttaac

SEQ ID NO: 9364075 - DNA, 22 bp, Homo sapiens
gtaaggcaatagtaaggagtcc

SEQ ID NO: 9364076 - DNA, 17 bp, Homo sapiens
gtaaggcttgcagatgc

SEQ ID NO: 9364077 - DNA, 22 bp, Homo sapiens
gtaagaggatcaaggcggtgca

SEQ ID NO: 9364078 - DNA, 22 bp, Homo sapiens
gtaagcaaacagcaaatgattt

SEQ ID NO: 9364079 - DNA, 22 bp, Homo sapiens
gtaagcacatgtgtgtgcatgg

SEQ ID NO: 9364080 - DNA, 22 bp, Homo sapiens
gtaagaggagtgggaagcctca

SEQ ID NO: 9364081 - DNA, 22 bp, Homo sapiens
gtaaacatcgacccaacagggg

SEQ ID NO: 9364082 - DNA, 22 bp, Homo sapiens
gtaaacatcagccactctattt

SEQ ID NO: 9364083 - DNA, 22 bp, Homo sapiens
ggtgtgactcgccctcagggac

SEQ ID NO: 9364084 - DNA, 22 bp, Homo sapiens
ggtgtgattatgacatgtgact

SEQ ID NO: 9364085 - DNA, 19 bp, Homo sapiens
ggtgtgaagtgaggagtta

SEQ ID NO: 9364086 - DNA, 20 bp, Homo sapiens
cagcagagacccatggggag

SEQ ID NO: 9364087 - DNA, 18 bp, Homo sapiens
cagcagagacattcaaaa

SEQ ID NO: 9364088 - DNA, 22 bp, Homo sapiens
cagcagagaaattacatatttg

SEQ ID NO: 9364089 - DNA, 22 bp, Homo sapiens
cagcagagaaattaaacttctg

SEQ ID NO: 9364090 - DNA, 22 bp, Homo sapiens
cagcagagaaattacatatttg

SEQ ID NO: 9364091 - DNA, 21 bp, Homo sapiens
cagcagaagcatctatggaag

SEQ ID NO: 9364092 - DNA, 22 bp, Homo sapiens
cagcagactggagtaggcagtg

SEQ ID NO: 9364093 - DNA, 22 bp, Homo sapiens
cagcagactggagtaggcagtg

SEQ ID NO: 9364094 - DNA, 22 bp, Homo sapiens
ggtgtcctttgggggctccgag

SEQ ID NO: 9364095 - DNA, 22 bp, Homo sapiens
ggtgtccttgttgaacgaaaat

SEQ ID NO: 9364096 - DNA, 22 bp, Homo sapiens
ggtgtcctttgggggctccgag

SEQ ID NO: 9364097 - DNA, 22 bp, Homo sapiens
ggtgtccttgttgaacgaaaat

SEQ ID NO: 9364098 - DNA, 22 bp, Homo sapiens
ggtgtcctttgggggctccgag

SEQ ID NO: 9364099 - DNA, 22 bp, Homo sapiens
ggtgtccttgtcctttggtacc

SEQ ID NO: 9364100 - DNA, 22 bp, Homo sapiens
ggtgtccttgtcctttggtacc

SEQ ID NO: 9364101 - DNA, 20 bp, Homo sapiens
cagcagagacccatggggag

SEQ ID NO: 9364102 - DNA, 22 bp, Homo sapiens
ggtgtctcagctgctggcaggg

SEQ ID NO: 9364103 - DNA, 22 bp, Homo sapiens
ggtgtctatgattcagtttatg

SEQ ID NO: 9364104 - DNA, 22 bp, Homo sapiens
ggtgtctatgattcagtttatg

SEQ ID NO: 9364105 - DNA, 19 bp, Homo sapiens
ggtgtgaagtgaggagtta

SEQ ID NO: 9364106 - DNA, 22 bp, Homo sapiens
ggtgtctgttgcctcctggtta

SEQ ID NO: 9364107 - DNA, 22 bp, Homo sapiens
ggtgtctgttgcctcctggtta

SEQ ID NO: 9364108 - DNA, 22 bp, Homo sapiens
ggtgtctgatggtggcttctca

SEQ ID NO: 9364109 - DNA, 22 bp, Homo sapiens
cagaggcaggataagaactgcg

SEQ ID NO: 9364110 - DNA, 22 bp, Homo sapiens
cagaggcctttctacagtgata

SEQ ID NO: 9364111 - DNA, 21 bp, Homo sapiens
cagaggctgagagggcaatct

SEQ ID NO: 9364112 - DNA, 22 bp, Homo sapiens
cagaggctgaccctgctgttgt

SEQ ID NO: 9364113 - DNA, 22 bp, Homo sapiens
cagaggctgatggctgtagcca

SEQ ID NO: 9364114 - DNA, 22 bp, Homo sapiens
cagaggctgatgtgggatgggc

SEQ ID NO: 9364115 - DNA, 21 bp, Homo sapiens
cagaggctgagagggcaatct

SEQ ID NO: 9364116 - DNA, 22 bp, Homo sapiens
cagaggctgagcagtcagtttg

SEQ ID NO: 9364117 - DNA, 22 bp, Homo sapiens
cagaggctgatggctgtagcca

SEQ ID NO: 9364118 - DNA, 22 bp, Homo sapiens
cagaggctgagcagtcagtttg

SEQ ID NO: 9364119 - DNA, 22 bp, Homo sapiens
cagaggctgatgtgggatgggc

SEQ ID NO: 9364120 - DNA, 22 bp, Homo sapiens
cagaggctgccagccatgtgca

SEQ ID NO: 9364121 - DNA, 22 bp, Homo sapiens
cagaggctgccagccatgtgca

SEQ ID NO: 9364122 - DNA, 22 bp, Homo sapiens
cagaggctgctctgggtggcat

SEQ ID NO: 9364123 - DNA, 22 bp, Homo sapiens
ggggtagggtgattgtgaagta

SEQ ID NO: 9364124 - DNA, 22 bp, Homo sapiens
cagaggctgctctgggtggcat

SEQ ID NO: 9364125 - DNA, 22 bp, Homo sapiens
cagaggctgctctgggtggcat

SEQ ID NO: 9364126 - DNA, 22 bp, Homo sapiens
ggggtaggtcatagcccctcta

SEQ ID NO: 9364127 - DNA, 22 bp, Homo sapiens
ggggtagggtgattgtgaagta

SEQ ID NO: 9364128 - DNA, 22 bp, Homo sapiens
ggggtagggtgattgtgaagta

SEQ ID NO: 9364129 - DNA, 22 bp, Homo sapiens
ggggtatgcttagtaagtacca

SEQ ID NO: 9364130 - DNA, 22 bp, Homo sapiens
cagagtggtgcaagggcagtgt

SEQ ID NO: 9364131 - DNA, 22 bp, Homo sapiens
cagagtgtggcatcttccaact

SEQ ID NO: 9364132 - DNA, 22 bp, Homo sapiens
cagagtggtgcaagggcagtgt

SEQ ID NO: 9364133 - DNA, 22 bp, Homo sapiens
cagagtgggctgtcagccacca

SEQ ID NO: 9364134 - DNA, 22 bp, Homo sapiens
cagagtgtttctttgggtgggt

SEQ ID NO: 9364135 - DNA, 22 bp, Homo sapiens
cagagtgtttctttgggtgggt

SEQ ID NO: 9364136 - DNA, 22 bp, Homo sapiens
cagagttcaaagcctgctggga

SEQ ID NO: 9364137 - DNA, 22 bp, Homo sapiens
cagagtttcggtaagcatagaa

SEQ ID NO: 9364138 - DNA, 19 bp, Homo sapiens
cagagtttgcaggcagagg

SEQ ID NO: 9364139 - DNA, 22 bp, Homo sapiens
ggggtctgctgcggagcagaga

SEQ ID NO: 9364140 - DNA, 22 bp, Homo sapiens
cagagtgaaaactgagctcaaa

SEQ ID NO: 9364141 - DNA, 22 bp, Homo sapiens
ggggtgagatcaaggaagccct

SEQ ID NO: 9364142 - DNA, 22 bp, Homo sapiens
ggggtctgctgcggagcagaga

SEQ ID NO: 9364143 - DNA, 22 bp, Homo sapiens
ggggtcggggcatagccactta

SEQ ID NO: 9364144 - DNA, 21 bp, Homo sapiens
ggggtcaagtgaatggtgttg

SEQ ID NO: 9364145 - DNA, 22 bp, Homo sapiens
ggtgcagctgcagcctgggagc

SEQ ID NO: 9364146 - DNA, 22 bp, Homo sapiens
ggtgcaggaaaattacctggag

SEQ ID NO: 9364147 - DNA, 18 bp, Homo sapiens
cagatgctaggcctccag

SEQ ID NO: 9364148 - DNA, 22 bp, Homo sapiens
ggtgcagagtccacagaaagct

SEQ ID NO: 9364149 - DNA, 22 bp, Homo sapiens
ggtgcagcctccccagtgacag

SEQ ID NO: 9364150 - DNA, 22 bp, Homo sapiens
ggtgcagagtccacagaaagct

SEQ ID NO: 9364151 - DNA, 22 bp, Homo sapiens
ggtgcagagtccacagaaagct

SEQ ID NO: 9364152 - DNA, 22 bp, Homo sapiens
ggtgcagaggagccagctgggg

SEQ ID NO: 9364153 - DNA, 22 bp, Homo sapiens
cagatgctgctcacctgattat

SEQ ID NO: 9364154 - DNA, 22 bp, Homo sapiens
cagatgctgctatttcaccctg

SEQ ID NO: 9364155 - DNA, 22 bp, Homo sapiens
cagatgctgcctgggaatgtct

SEQ ID NO: 9364156 - DNA, 22 bp, Homo sapiens
cagatgctatagtgctgccata

SEQ ID NO: 9364157 - DNA, 20 bp, Homo sapiens
cagatgctggatcttggtcc

SEQ ID NO: 9364158 - DNA, 22 bp, Homo sapiens
cagatgctggtatgggggaggt

SEQ ID NO: 9364159 - DNA, 22 bp, Homo sapiens
cagatgcttcgtgggtgagcac

SEQ ID NO: 9364160 - DNA, 22 bp, Homo sapiens
ggtgcagaaggaagggagctgg

SEQ ID NO: 9364161 - DNA, 22 bp, Homo sapiens
ggtgcagaagaaagcagtcatt

SEQ ID NO: 9364162 - DNA, 22 bp, Homo sapiens
ggtgcagaaggaagggagctgg

SEQ ID NO: 9364163 - DNA, 22 bp, Homo sapiens
ggtgcagagcagtgtcagagca

SEQ ID NO: 9364164 - DNA, 22 bp, Homo sapiens
ggtgcagaggagccagctgggg

SEQ ID NO: 9364165 - DNA, 22 bp, Homo sapiens
ggtgcaaggccaccatctagtg

SEQ ID NO: 9364166 - DNA, 22 bp, Homo sapiens
ggtgcaaggccaccatctagtg

SEQ ID NO: 9364167 - DNA, 22 bp, Homo sapiens
ggtgcaaaagtagttctgcttt

SEQ ID NO: 9364168 - DNA, 22 bp, Homo sapiens
ggtgcaaaagtagttctgcttt

SEQ ID NO: 9364169 - DNA, 22 bp, Homo sapiens
ggtgcaagagctccaggccctg

SEQ ID NO: 9364170 - DNA, 22 bp, Homo sapiens
cagatagctgactactcttctt

SEQ ID NO: 9364171 - DNA, 22 bp, Homo sapiens
cagataggaaaagctaggcata

SEQ ID NO: 9364172 - DNA, 22 bp, Homo sapiens
cagatagtaacctttctagagc

SEQ ID NO: 9364173 - DNA, 20 bp, Homo sapiens
cagataggttagtgtttcag

SEQ ID NO: 9364174 - DNA, 22 bp, Homo sapiens
cagatagcgtttgagagcataa

SEQ ID NO: 9364175 - DNA, 22 bp, Homo sapiens
cagatatatattcatcaggctg

SEQ ID NO: 9364176 - DNA, 22 bp, Homo sapiens
cagatatattcatttgcagtgc

SEQ ID NO: 9364177 - DNA, 22 bp, Homo sapiens
cagatataagaaagctattgtc

SEQ ID NO: 9364178 - DNA, 22 bp, Homo sapiens
cagatataaatggatgtggtag

SEQ ID NO: 9364179 - DNA, 22 bp, Homo sapiens
cagatataaatggatgtggtag

SEQ ID NO: 9364180 - DNA, 22 bp, Homo sapiens
cagatatattttatttggtcaa

SEQ ID NO: 9364181 - DNA, 22 bp, Homo sapiens
cagatatattcatttgcagtgc

SEQ ID NO: 9364182 - DNA, 22 bp, Homo sapiens
cagatatattttccttattagg

SEQ ID NO: 9364183 - DNA, 22 bp, Homo sapiens
cagatatattttccttattagg

SEQ ID NO: 9364184 - DNA, 20 bp, Homo sapiens
cagataaacgggaaagaagc

SEQ ID NO: 9364185 - DNA, 20 bp, Homo sapiens
cagataaacgggaaagaagc

SEQ ID NO: 9364186 - DNA, 22 bp, Homo sapiens
cagataaatagatagataaact

SEQ ID NO: 9364187 - DNA, 22 bp, Homo sapiens
cagataaatagatagataaact

SEQ ID NO: 9364188 - DNA, 22 bp, Homo sapiens
cagataaatagatagataaact

SEQ ID NO: 9364189 - DNA, 22 bp, Homo sapiens
cagatacagctagctccgtggc

SEQ ID NO: 9364190 - DNA, 22 bp, Homo sapiens
cagctcctagatcggcgaagtg

SEQ ID NO: 9364191 - DNA, 22 bp, Homo sapiens
cagctcctctggccagccctgc

SEQ ID NO: 9364192 - DNA, 22 bp, Homo sapiens
cagctcctctggccagccctgc

SEQ ID NO: 9364193 - DNA, 22 bp, Homo sapiens
cagctcctctgttagccctggg

SEQ ID NO: 9364194 - DNA, 22 bp, Homo sapiens
cagctcctctgttagccctggg

SEQ ID NO: 9364195 - DNA, 22 bp, Homo sapiens
cagctcctctggccagccctgc

SEQ ID NO: 9364196 - DNA, 22 bp, Homo sapiens
cagctcctcagccctgccttgg

SEQ ID NO: 9364197 - DNA, 22 bp, Homo sapiens
cagctcctcacgagtcttgaaa

SEQ ID NO: 9364198 - DNA, 22 bp, Homo sapiens
cagctcctcagccctgccttgg

SEQ ID NO: 9364199 - DNA, 22 bp, Homo sapiens
cagctcctgcagctggctccca

SEQ ID NO: 9364200 - DNA, 22 bp, Homo sapiens
cagctcctgcagctggctccca

SEQ ID NO: 9364201 - DNA, 22 bp, Homo sapiens
cagctcctgcagctggctccca

SEQ ID NO: 9364202 - DNA, 22 bp, Homo sapiens
cagctctgagactgaggctatg

SEQ ID NO: 9364203 - DNA, 22 bp, Homo sapiens
cagctcctgcagctgctgccgt

SEQ ID NO: 9364204 - DNA, 22 bp, Homo sapiens
cagctcctgaggactgctggga

SEQ ID NO: 9364205 - DNA, 22 bp, Homo sapiens
cagctcctgaggactgctggga

SEQ ID NO: 9364206 - DNA, 22 bp, Homo sapiens
cagctcctctgttagccctggg

SEQ ID NO: 9364207 - DNA, 22 bp, Homo sapiens
cagctctgatgaaatgtaccag

SEQ ID NO: 9364208 - DNA, 17 bp, Homo sapiens
cagctctgcagacttcc

SEQ ID NO: 9364209 - DNA, 22 bp, Homo sapiens
cagctctgaggaacactccttt

SEQ ID NO: 9364210 - DNA, 21 bp, Homo sapiens
cagctctgagatttctactag

SEQ ID NO: 9364211 - DNA, 22 bp, Homo sapiens
cagctctgaggaacactccttt

SEQ ID NO: 9364212 - DNA, 22 bp, Homo sapiens
gtgcaggagcttctggcctgac

SEQ ID NO: 9364213 - DNA, 22 bp, Homo sapiens
gtgcatcaatttcccatgtgtc

SEQ ID NO: 9364214 - DNA, 21 bp, Homo sapiens
gtgcatggagaaaggcttgct

SEQ ID NO: 9364215 - DNA, 22 bp, Homo sapiens
gtgcatggccagggtggtctgg

SEQ ID NO: 9364216 - DNA, 22 bp, Homo sapiens
gtgcatgctgcagtatgatttc

SEQ ID NO: 9364217 - DNA, 18 bp, Homo sapiens
gtgcatgcatgctctgcc

SEQ ID NO: 9364218 - DNA, 22 bp, Homo sapiens
gtgcatgccctaagatatttat

SEQ ID NO: 9364219 - DNA, 22 bp, Homo sapiens
gtgcatgcacacatgtgtgagg

SEQ ID NO: 9364220 - DNA, 22 bp, Homo sapiens
gtgcatgcagtaagtgttttaa

SEQ ID NO: 9364221 - DNA, 22 bp, Homo sapiens
gtgcatgcaaattactgtaaag

SEQ ID NO: 9364222 - DNA, 22 bp, Homo sapiens
gtgcatgaagcaggcagctcct

SEQ ID NO: 9364223 - DNA, 22 bp, Homo sapiens
gtgcatgaagactcagaaagtc

SEQ ID NO: 9364224 - DNA, 22 bp, Homo sapiens
gtgcatgtgcatccatgtgtac

SEQ ID NO: 9364225 - DNA, 22 bp, Homo sapiens
gtgcatgtcggggtgcatgtca

SEQ ID NO: 9364226 - DNA, 22 bp, Homo sapiens
gtgcatggggagggaagcgctc

SEQ ID NO: 9364227 - DNA, 22 bp, Homo sapiens
cagccctgtgcggagggccctg

SEQ ID NO: 9364228 - DNA, 20 bp, Homo sapiens
cagccctttatcctcctatg

SEQ ID NO: 9364229 - DNA, 22 bp, Homo sapiens
cagcccttggcccagggcacag

SEQ ID NO: 9364230 - DNA, 22 bp, Homo sapiens
cagccgcgctcgtgccagacag

SEQ ID NO: 9364231 - DNA, 22 bp, Homo sapiens
cagcccttccaggcagaattct

SEQ ID NO: 9364232 - DNA, 23 bp, Homo sapiens
cagcccttcctgcatgtttttgt

SEQ ID NO: 9364233 - DNA, 22 bp, Homo sapiens
cagccctgttgcgcttccggcg

SEQ ID NO: 9364234 - DNA, 22 bp, Homo sapiens
cagccctgttgcgcttccggcg

SEQ ID NO: 9364235 - DNA, 22 bp, Homo sapiens
gtgcctggggttgagctatgaa

SEQ ID NO: 9364236 - DNA, 22 bp, Homo sapiens
gtgcctgggggtaatgtaggat

SEQ ID NO: 9364237 - DNA, 22 bp, Homo sapiens
gtgcctgggacttgctccggat

SEQ ID NO: 9364238 - DNA, 22 bp, Homo sapiens
gtgcctgggacttgctccggat

SEQ ID NO: 9364239 - DNA, 22 bp, Homo sapiens
gtgcctgggacacagcagatac

SEQ ID NO: 9364240 - DNA, 22 bp, Homo sapiens
gtgcctgggacacagcagatac

SEQ ID NO: 9364241 - DNA, 20 bp, Homo sapiens
cagcctccactcactcagct

SEQ ID NO: 9364242 - DNA, 19 bp, Homo sapiens
cagcctcaatccctcgggc

SEQ ID NO: 9364243 - DNA, 19 bp, Homo sapiens
cagcctcaatccctcgggc

SEQ ID NO: 9364244 - DNA, 22 bp, Homo sapiens
gtgctgagcacagctgcccagg

SEQ ID NO: 9364245 - DNA, 22 bp, Homo sapiens
gtgctgagcatcatgaggcact

SEQ ID NO: 9364246 - DNA, 22 bp, Homo sapiens
gtgctgagattggagtgagcag

SEQ ID NO: 9364247 - DNA, 22 bp, Homo sapiens
gtgctgagattacaggtgtgag

SEQ ID NO: 9364248 - DNA, 22 bp, Homo sapiens
gtgctgaggagagggggtggtc

SEQ ID NO: 9364249 - DNA, 22 bp, Homo sapiens
gtgctgagctgcagatgcgctc

SEQ ID NO: 9364250 - DNA, 22 bp, Homo sapiens
gtgctgagcatcatgaggcact

SEQ ID NO: 9364251 - DNA, 22 bp, Homo sapiens
gtgcctggtatgtaggtagcgg

SEQ ID NO: 9364252 - DNA, 22 bp, Homo sapiens
gtgcctggtatgtaggtagcgg

SEQ ID NO: 9364253 - DNA, 22 bp, Homo sapiens
gtgcctggtttggggaatgttc

SEQ ID NO: 9364254 - DNA, 22 bp, Homo sapiens
gtgcctggtttggggagtgttc

SEQ ID NO: 9364255 - DNA, 22 bp, Homo sapiens
gtgcctggtatgtaggtagcgg

SEQ ID NO: 9364256 - DNA, 22 bp, Homo sapiens
gtgctgagatcttccctcactg

SEQ ID NO: 9364257 - DNA, 17 bp, Homo sapiens
gtgcctgttgtcctgga

SEQ ID NO: 9364258 - DNA, 22 bp, Homo sapiens
cagctccagctctgggcgcctc

SEQ ID NO: 9364259 - DNA, 23 bp, Homo sapiens
cagctccagtgcactcaggtagc

SEQ ID NO: 9364260 - DNA, 22 bp, Homo sapiens
cagctccagcctgacaccaaga

SEQ ID NO: 9364261 - DNA, 21 bp, Homo sapiens
cagctccactaaagcagctgt

SEQ ID NO: 9364262 - DNA, 22 bp, Homo sapiens
cagctcagcttcctgggtgtgt

SEQ ID NO: 9364263 - DNA, 22 bp, Homo sapiens
cagctcaggaaggaaggccggc

SEQ ID NO: 9364264 - DNA, 22 bp, Homo sapiens
gtgctgaggtgggtgggcagcc

SEQ ID NO: 9364265 - DNA, 22 bp, Homo sapiens
gtgctgaggtgggtgggcagcc

SEQ ID NO: 9364266 - DNA, 22 bp, Homo sapiens
cagcagggaagctgtgctgttt

SEQ ID NO: 9364267 - DNA, 22 bp, Homo sapiens
cagcagagctgtgtgggaaggg

SEQ ID NO: 9364268 - DNA, 22 bp, Homo sapiens
cagcagggaagctgtgctgttt

SEQ ID NO: 9364269 - DNA, 22 bp, Homo sapiens
cagcaggtcccactgagggccc

SEQ ID NO: 9364270 - DNA, 18 bp, Homo sapiens
cagcaggtagagtttggt

SEQ ID NO: 9364271 - DNA, 22 bp, Homo sapiens
cagcaggtctcagcagctcctt

SEQ ID NO: 9364272 - DNA, 22 bp, Homo sapiens
cagcaggtcctgggcgtggcct

SEQ ID NO: 9364273 - DNA, 22 bp, Homo sapiens
cagcagagacggtaagcagaac

SEQ ID NO: 9364274 - DNA, 22 bp, Homo sapiens
cagcagagctgggctttgaatt

SEQ ID NO: 9364275 - DNA, 22 bp, Homo sapiens
cagcaggttaacagaggctggt

SEQ ID NO: 9364276 - DNA, 22 bp, Homo sapiens
cagcaggttaacagaggctggt

SEQ ID NO: 9364277 - DNA, 22 bp, Homo sapiens
cagcaggttaacagaggctggt

SEQ ID NO: 9364278 - DNA, 22 bp, Homo sapiens
cagcaggtgtctagcaagggtc

SEQ ID NO: 9364279 - DNA, 22 bp, Homo sapiens
cagcaggtgggctttgcggatg

SEQ ID NO: 9364280 - DNA, 22 bp, Homo sapiens
cagcaggtgtccttttggtgga

SEQ ID NO: 9364281 - DNA, 22 bp, Homo sapiens
cagcaggtgctgcctgtcaccc

SEQ ID NO: 9364282 - DNA, 22 bp, Homo sapiens
cagcaggtctgcatttgaggtc

SEQ ID NO: 9364283 - DNA, 22 bp, Homo sapiens
cagcagtgcttcagtgtgagat

SEQ ID NO: 9364284 - DNA, 22 bp, Homo sapiens
cagcagtggctgcaggcagctg

SEQ ID NO: 9364285 - DNA, 22 bp, Homo sapiens
cagcagtggctgcaggcagctg

SEQ ID NO: 9364286 - DNA, 22 bp, Homo sapiens
cagcagtggaactacccaggga

SEQ ID NO: 9364287 - DNA, 22 bp, Homo sapiens
cagcatcttgaagggtaaacca

SEQ ID NO: 9364288 - DNA, 18 bp, Homo sapiens
cagcatcttcattaggcc

SEQ ID NO: 9364289 - DNA, 22 bp, Homo sapiens
cagcatcttcatgtgcatctcc

SEQ ID NO: 9364290 - DNA, 22 bp, Homo sapiens
cagcatcttattttctatggaa

SEQ ID NO: 9364291 - DNA, 22 bp, Homo sapiens
cagcatctttctcttctggagt

SEQ ID NO: 9364292 - DNA, 22 bp, Homo sapiens
cagcatctttctcttctggagt

SEQ ID NO: 9364293 - DNA, 22 bp, Homo sapiens
cagcatgatgagtgcagtttgg

SEQ ID NO: 9364294 - DNA, 22 bp, Homo sapiens
cagcatgactcactgtggtcac

SEQ ID NO: 9364295 - DNA, 22 bp, Homo sapiens
cagcatgaccctggagcctgca

SEQ ID NO: 9364296 - DNA, 22 bp, Homo sapiens
gtctcagaccaccctctttggc

SEQ ID NO: 9364297 - DNA, 22 bp, Homo sapiens
gtctcagagtcctacttattcc

SEQ ID NO: 9364298 - DNA, 22 bp, Homo sapiens
gtctcagagagctactctctta

SEQ ID NO: 9364299 - DNA, 22 bp, Homo sapiens
gtcctgtgtaagccaggacaat

SEQ ID NO: 9364300 - DNA, 22 bp, Homo sapiens
gtctatttgggatcatgatatg

SEQ ID NO: 9364301 - DNA, 22 bp, Homo sapiens
cagcatgcattttctctctttg

SEQ ID NO: 9364302 - DNA, 22 bp, Homo sapiens
gtcctgtgctcagacatggggg

SEQ ID NO: 9364303 - DNA, 22 bp, Homo sapiens
gtcctgtggaaagctagccgct

SEQ ID NO: 9364304 - DNA, 22 bp, Homo sapiens
gtcctgtggaaagctagccgct

SEQ ID NO: 9364305 - DNA, 22 bp, Homo sapiens
cagcatgcaggggcctgagcac

SEQ ID NO: 9364306 - DNA, 22 bp, Homo sapiens
cagcatgcagcccctggcagct

SEQ ID NO: 9364307 - DNA, 22 bp, Homo sapiens
cagcatgcaagtccagatgtgg

SEQ ID NO: 9364308 - DNA, 22 bp, Homo sapiens
cagcatgcagcccctggcagct

SEQ ID NO: 9364309 - DNA, 22 bp, Homo sapiens
cagcatgcagcccctggcagct

SEQ ID NO: 9364310 - DNA, 22 bp, Homo sapiens
cagcatgattggtgtctggtga

SEQ ID NO: 9364311 - DNA, 22 bp, Homo sapiens
cagcatgattggtgtctggtga

SEQ ID NO: 9364312 - DNA, 22 bp, Homo sapiens
cagcatgcaagtccagatgtgg

SEQ ID NO: 9364313 - DNA, 22 bp, Homo sapiens
cagcagtgtacaaggtgtcaga

SEQ ID NO: 9364314 - DNA, 22 bp, Homo sapiens
gtcctctgtttccatctgactt

SEQ ID NO: 9364315 - DNA, 22 bp, Homo sapiens
gtcctctgttagaaatgtgctt

SEQ ID NO: 9364316 - DNA, 22 bp, Homo sapiens
gtcctctgtgtaggctgcagac

SEQ ID NO: 9364317 - DNA, 22 bp, Homo sapiens
gtcctgacggctgattggcctg

SEQ ID NO: 9364318 - DNA, 22 bp, Homo sapiens
gtcctgaatgcctttaggcaga

SEQ ID NO: 9364319 - DNA, 22 bp, Homo sapiens
gtcctgagccctcagcacagca

SEQ ID NO: 9364320 - DNA, 22 bp, Homo sapiens
gtcctgaggatgcagagataaa

SEQ ID NO: 9364321 - DNA, 22 bp, Homo sapiens
gtcctgaggatgcagagataaa

SEQ ID NO: 9364322 - DNA, 22 bp, Homo sapiens
gtcctgaggcaggatgggtttc

SEQ ID NO: 9364323 - DNA, 22 bp, Homo sapiens
gtcctgagggcccaggcattct

SEQ ID NO: 9364324 - DNA, 22 bp, Homo sapiens
gtcctgagtcaagtgtgggcag

SEQ ID NO: 9364325 - DNA, 19 bp, Homo sapiens
gtcctgcaactggctctcc

SEQ ID NO: 9364326 - DNA, 22 bp, Homo sapiens
gtgaatggggcaggaaggatgg

SEQ ID NO: 9364327 - DNA, 22 bp, Homo sapiens
gtgaataattttttagtataag

SEQ ID NO: 9364328 - DNA, 22 bp, Homo sapiens
gtgaataatattgtttataaaa

SEQ ID NO: 9364329 - DNA, 22 bp, Homo sapiens
gtgcaaaagtaatggcagtttt

SEQ ID NO: 9364330 - DNA, 22 bp, Homo sapiens
gtgcagctgtggtggagccagg

SEQ ID NO: 9364331 - DNA, 22 bp, Homo sapiens
gtgcagctgaaggctggccagc

SEQ ID NO: 9364332 - DNA, 22 bp, Homo sapiens
gtgcaaaatgatatcctgaagc

SEQ ID NO: 9364333 - DNA, 22 bp, Homo sapiens
gtgcaaatgagatggattcaag

SEQ ID NO: 9364334 - DNA, 22 bp, Homo sapiens
gtgcaaatacatatgctgtgga

SEQ ID NO: 9364335 - DNA, 22 bp, Homo sapiens
gtgcaaatgtaattgcagtttt

SEQ ID NO: 9364336 - DNA, 22 bp, Homo sapiens
gtgcaaatgattctaatgggta

SEQ ID NO: 9364337 - DNA, 22 bp, Homo sapiens
gtgcagctactccttggtccta

SEQ ID NO: 9364338 - DNA, 22 bp, Homo sapiens
gtcttaaaatcagaggatatag

SEQ ID NO: 9364339 - DNA, 16 bp, Homo sapiens
gtctcttccctgctga

SEQ ID NO: 9364340 - DNA, 22 bp, Homo sapiens
gtctcttctttgccggtcctgc

SEQ ID NO: 9364341 - DNA, 16 bp, Homo sapiens
gtctcttccctgctga

SEQ ID NO: 9364342 - DNA, 22 bp, Homo sapiens
gtctttcttaattcaagtgctt

SEQ ID NO: 9364343 - DNA, 22 bp, Homo sapiens
gtctttcttcagagcttggact

SEQ ID NO: 9364344 - DNA, 22 bp, Homo sapiens
gtctttctgccatgtgaagaga

SEQ ID NO: 9364345 - DNA, 22 bp, Homo sapiens
gtctttctgctgcacggactgc

SEQ ID NO: 9364346 - DNA, 18 bp, Homo sapiens
gtctttggagtggaggta

SEQ ID NO: 9364347 - DNA, 22 bp, Homo sapiens
gtgaagttcaagcttgccatct

SEQ ID NO: 9364348 - DNA, 22 bp, Homo sapiens
gtctttggaggcactgttgagt

SEQ ID NO: 9364349 - DNA, 22 bp, Homo sapiens
gtctttcttcagagcttggact

SEQ ID NO: 9364350 - DNA, 22 bp, Homo sapiens
gtctctgggtgtgtgatgccaa

SEQ ID NO: 9364351 - DNA, 22 bp, Homo sapiens
gtctctggctttatgctggttt

SEQ ID NO: 9364352 - DNA, 22 bp, Homo sapiens
gtctctgggttaagcagtgcat

SEQ ID NO: 9364353 - DNA, 22 bp, Homo sapiens
gtctctgtcatttcaccttccc

SEQ ID NO: 9364354 - DNA, 22 bp, Homo sapiens
gtctctgtcttaggccaggcct

SEQ ID NO: 9364355 - DNA, 22 bp, Homo sapiens
gtctctgttatttccagggtca

SEQ ID NO: 9364356 - DNA, 22 bp, Homo sapiens
gtctctgtggtacgtttcatcc

SEQ ID NO: 9364357 - DNA, 18 bp, Homo sapiens
gtctctgtgggaattggc

SEQ ID NO: 9364358 - DNA, 17 bp, Homo sapiens
gtctctgtcttgctttt

SEQ ID NO: 9364359 - DNA, 22 bp, Homo sapiens
gtctctgtcttaggccaggcct

SEQ ID NO: 9364360 - DNA, 20 bp, Homo sapiens
gtctccactgggggttaacc

SEQ ID NO: 9364361 - DNA, 20 bp, Homo sapiens
gtctccactgggggttaacc

SEQ ID NO: 9364362 - DNA, 22 bp, Homo sapiens
gtctcagtgtcacctccagctg

SEQ ID NO: 9364363 - DNA, 22 bp, Homo sapiens
gtctcagggactgcttctgggg

SEQ ID NO: 9364364 - DNA, 18 bp, Homo sapiens
gtctcaggagtggcacgt

SEQ ID NO: 9364365 - DNA, 22 bp, Homo sapiens
gaaaatgagcctcagctacatt

SEQ ID NO: 9364366 - DNA, 22 bp, Homo sapiens
gaaatatacatgaagtcggctg

SEQ ID NO: 9364367 - DNA, 22 bp, Homo sapiens
gaaatctactttgggttagaca

SEQ ID NO: 9364368 - DNA, 22 bp, Homo sapiens
gaaatcttccaatggtcacatc

SEQ ID NO: 9364369 - DNA, 22 bp, Homo sapiens
gaaatcttccaatggtcacatc

SEQ ID NO: 9364370 - DNA, 22 bp, Homo sapiens
gaaatctgcggtgaggcctgag

SEQ ID NO: 9364371 - DNA, 22 bp, Homo sapiens
gaaatctgcttcttgcatagta

SEQ ID NO: 9364372 - DNA, 22 bp, Homo sapiens
gaaatcttttcatctcatttga

SEQ ID NO: 9364373 - DNA, 22 bp, Homo sapiens
gaaatcttttaaccattcattt

SEQ ID NO: 9364374 - DNA, 22 bp, Homo sapiens
atgaggcatgtgaggagaaggg

SEQ ID NO: 9364375 - DNA, 23 bp, Homo sapiens
atgaggcattaaacaggcttttt

SEQ ID NO: 9364376 - DNA, 22 bp, Homo sapiens
atgaggcattcacagaaggcac

SEQ ID NO: 9364377 - DNA, 22 bp, Homo sapiens
atgaggcattccactcaaactc

SEQ ID NO: 9364378 - DNA, 22 bp, Homo sapiens
gaacataactattgtgaatagt

SEQ ID NO: 9364379 - DNA, 22 bp, Homo sapiens
gaacaatgagtcattcaggtga

SEQ ID NO: 9364380 - DNA, 22 bp, Homo sapiens
gaacataactattgtgaatagt

SEQ ID NO: 9364381 - DNA, 22 bp, Homo sapiens
atgaggcatctaacattgcaaa

SEQ ID NO: 9364382 - DNA, 16 bp, Homo sapiens
atgaggcataggctgc

SEQ ID NO: 9364383 - DNA, 22 bp, Homo sapiens
atgaggcatagcagggatcgga

SEQ ID NO: 9364384 - DNA, 22 bp, Homo sapiens
atgaggcagtctggcctgaggg

SEQ ID NO: 9364385 - DNA, 22 bp, Homo sapiens
atgcaagagatggacttgtgtt

SEQ ID NO: 9364386 - DNA, 22 bp, Homo sapiens
gaagaaagatcaaatagtttcc

SEQ ID NO: 9364387 - DNA, 22 bp, Homo sapiens
gaagaaagatcaaatagtttcc

SEQ ID NO: 9364388 - DNA, 22 bp, Homo sapiens
gaagaaagattggcatgcttca

SEQ ID NO: 9364389 - DNA, 22 bp, Homo sapiens
gaagaaagattggcatgcttca

SEQ ID NO: 9364390 - DNA, 22 bp, Homo sapiens
atgcaaggacatgtaatgatgt

SEQ ID NO: 9364391 - DNA, 22 bp, Homo sapiens
atgcaagggtaaccccagacat

SEQ ID NO: 9364392 - DNA, 22 bp, Homo sapiens
atgcaagggttgcctttccagc

SEQ ID NO: 9364393 - DNA, 22 bp, Homo sapiens
gaactttaattagcttttgtct

SEQ ID NO: 9364394 - DNA, 22 bp, Homo sapiens
gaacatttgatgatgacattgg

SEQ ID NO: 9364395 - DNA, 22 bp, Homo sapiens
gaacatttgatgatgacattgg

SEQ ID NO: 9364396 - DNA, 22 bp, Homo sapiens
gaactttaaaacaaagtacagt

SEQ ID NO: 9364397 - DNA, 22 bp, Homo sapiens
gaactttaaaacaaagtacagt

SEQ ID NO: 9364398 - DNA, 22 bp, Homo sapiens
gaactttaaaacaaagtacagt

SEQ ID NO: 9364399 - DNA, 22 bp, Homo sapiens
gaactttattccagaagaaagc

SEQ ID NO: 9364400 - DNA, 22 bp, Homo sapiens
gaactttggatcatgttcttgg

SEQ ID NO: 9364401 - DNA, 22 bp, Homo sapiens
gaacattgctttatttcttcta

SEQ ID NO: 9364402 - DNA, 22 bp, Homo sapiens
gaacatttatattagatagcta

SEQ ID NO: 9364403 - DNA, 22 bp, Homo sapiens
gaacattcttggaggaaataac

SEQ ID NO: 9364404 - DNA, 22 bp, Homo sapiens
gaacatttatgatgcaatacct

SEQ ID NO: 9364405 - DNA, 22 bp, Homo sapiens
gaacatttatgatgcaatacct

SEQ ID NO: 9364406 - DNA, 22 bp, Homo sapiens
gaacatttccagaaaggaacta

SEQ ID NO: 9364407 - DNA, 22 bp, Homo sapiens
gaacattattgtacaaatgtct

SEQ ID NO: 9364408 - DNA, 22 bp, Homo sapiens
gaaaagaactgcatgggattaa

SEQ ID NO: 9364409 - DNA, 22 bp, Homo sapiens
gaaaagaactgcatgggattaa

SEQ ID NO: 9364410 - DNA, 22 bp, Homo sapiens
gaaaactaacggaaaagttagg

SEQ ID NO: 9364411 - DNA, 22 bp, Homo sapiens
gaaaactaacggaaaagttagg

SEQ ID NO: 9364412 - DNA, 22 bp, Homo sapiens
gaaaactattggcctagaacaa

SEQ ID NO: 9364413 - DNA, 22 bp, Homo sapiens
gaaaactattggcctagaacaa

SEQ ID NO: 9364414 - DNA, 22 bp, Homo sapiens
gaaaatgagcctcagctacatt

SEQ ID NO: 9364415 - DNA, 22 bp, Homo sapiens
gaaaatgagcctcagctacatt

SEQ ID NO: 9364416 - DNA, 22 bp, Homo sapiens
gaaaatagcagatagaccaatg

SEQ ID NO: 9364417 - DNA, 22 bp, Homo sapiens
gaaaatagcagatagaccaatg

SEQ ID NO: 9364418 - DNA, 22 bp, Homo sapiens
ctttttccagcttcagggtggg

SEQ ID NO: 9364419 - DNA, 22 bp, Homo sapiens
gaaaacatccagagatagacct

SEQ ID NO: 9364420 - DNA, 22 bp, Homo sapiens
gaaaacatccagagatagacct

SEQ ID NO: 9364421 - DNA, 22 bp, Homo sapiens
atgaatgtttggtgatcagata

SEQ ID NO: 9364422 - DNA, 22 bp, Homo sapiens
atgaattgaaagaagaatatct

SEQ ID NO: 9364423 - DNA, 22 bp, Homo sapiens
atgaattgaggaaaacagtcgt

SEQ ID NO: 9364424 - DNA, 22 bp, Homo sapiens
atgaatgactgtctactttggg

SEQ ID NO: 9364425 - DNA, 22 bp, Homo sapiens
atgaatgagaaacaggtgagat

SEQ ID NO: 9364426 - DNA, 22 bp, Homo sapiens
atgaatgagagaatagtggagc

SEQ ID NO: 9364427 - DNA, 22 bp, Homo sapiens
atgaatgagattaccaatgtga

SEQ ID NO: 9364428 - DNA, 22 bp, Homo sapiens
atgaatgatgccagttgaaatg

SEQ ID NO: 9364429 - DNA, 22 bp, Homo sapiens
atgaatgattaaagagtacagt

SEQ ID NO: 9364430 - DNA, 22 bp, Homo sapiens
atgaatgatgccagttgaaatg

SEQ ID NO: 9364431 - DNA, 22 bp, Homo sapiens
atgaatgcaaactagtttgtgt

SEQ ID NO: 9364432 - DNA, 22 bp, Homo sapiens
atgaatgattttatgtaaatga

SEQ ID NO: 9364433 - DNA, 22 bp, Homo sapiens
atgaatgcatggtagactctgt

SEQ ID NO: 9364434 - DNA, 19 bp, Homo sapiens
atgaatgcattgcatggat

SEQ ID NO: 9364435 - DNA, 22 bp, Homo sapiens
atgaatgcatacatttgtcaag

SEQ ID NO: 9364436 - DNA, 22 bp, Homo sapiens
atgaatgctgaattatgaactg

SEQ ID NO: 9364437 - DNA, 22 bp, Homo sapiens
atcttcaaggaaaaaatacagt

SEQ ID NO: 9364438 - DNA, 21 bp, Homo sapiens
atcttcaactgattggaggag

SEQ ID NO: 9364439 - DNA, 22 bp, Homo sapiens
atcttccaagctccctggtgta

SEQ ID NO: 9364440 - DNA, 19 bp, Homo sapiens
atcttcattttacaggcag

SEQ ID NO: 9364441 - DNA, 22 bp, Homo sapiens
atcttcatcaagttcacagtgg

SEQ ID NO: 9364442 - DNA, 22 bp, Homo sapiens
atcttcatcaagttcacagtgg

SEQ ID NO: 9364443 - DNA, 22 bp, Homo sapiens
atcttcaattgaaaactagcct

SEQ ID NO: 9364444 - DNA, 22 bp, Homo sapiens
atcttcaatatttttgtgtaga

SEQ ID NO: 9364445 - DNA, 22 bp, Homo sapiens
atcttcccaggctggggagagg

SEQ ID NO: 9364446 - DNA, 22 bp, Homo sapiens
atcttcccaggctggggagagg

SEQ ID NO: 9364447 - DNA, 22 bp, Homo sapiens
atcttcccaggctggggagagg

SEQ ID NO: 9364448 - DNA, 22 bp, Homo sapiens
cttgagaagcattaagaggtag

SEQ ID NO: 9364449 - DNA, 22 bp, Homo sapiens
cttgagaatgtgagccacagat

SEQ ID NO: 9364450 - DNA, 21 bp, Homo sapiens
cttgagaattaactgttcatt

SEQ ID NO: 9364451 - DNA, 22 bp, Homo sapiens
cttgagagggagtagtttagga

SEQ ID NO: 9364452 - DNA, 22 bp, Homo sapiens
cttgagcacagcggcttcagga

SEQ ID NO: 9364453 - DNA, 22 bp, Homo sapiens
cttgaggttttgactcagcttt

SEQ ID NO: 9364454 - DNA, 22 bp, Homo sapiens
atgaataaaacattttaatcag

SEQ ID NO: 9364455 - DNA, 22 bp, Homo sapiens
atgaagcaggcacagcttcagg

SEQ ID NO: 9364456 - DNA, 22 bp, Homo sapiens
atgaatatgtacacatctgtca

SEQ ID NO: 9364457 - DNA, 22 bp, Homo sapiens
atgaatatgtacacatctgtca

SEQ ID NO: 9364458 - DNA, 22 bp, Homo sapiens
atgaatacgcggtcatacacat

SEQ ID NO: 9364459 - DNA, 22 bp, Homo sapiens
atgaataagtaaactcctttgg

SEQ ID NO: 9364460 - DNA, 22 bp, Homo sapiens
atgaatcaaactgtacactgag

SEQ ID NO: 9364461 - DNA, 22 bp, Homo sapiens
atgaatatgtacacatctgtca

SEQ ID NO: 9364462 - DNA, 22 bp, Homo sapiens
atgaatattgaatgtcttatga

SEQ ID NO: 9364463 - DNA, 22 bp, Homo sapiens
atgaatgaagaacatctgtgcc

SEQ ID NO: 9364464 - DNA, 22 bp, Homo sapiens
atgaatctgttttttgtcaata

SEQ ID NO: 9364465 - DNA, 22 bp, Homo sapiens
atgaatgaaatacagagtactt

SEQ ID NO: 9364466 - DNA, 22 bp, Homo sapiens
atgaatgaataccatgcaacta

SEQ ID NO: 9364467 - DNA, 22 bp, Homo sapiens
atgaatgacatctgattccata

SEQ ID NO: 9364468 - DNA, 23 bp, Homo sapiens
atgaatgaataaggcaggaaagc

SEQ ID NO: 9364469 - DNA, 22 bp, Homo sapiens
atgaatcagaatctgcatttta

SEQ ID NO: 9364470 - DNA, 22 bp, Homo sapiens
atgcttgtactaaaaaaatatt

SEQ ID NO: 9364471 - DNA, 22 bp, Homo sapiens
atgcttgtagtgtaatcactgt

SEQ ID NO: 9364472 - DNA, 22 bp, Homo sapiens
atgctttatacaaaacacttaa

SEQ ID NO: 9364473 - DNA, 22 bp, Homo sapiens
gacataaaattcaataatttgt

SEQ ID NO: 9364474 - DNA, 22 bp, Homo sapiens
gacataaaccttgagatattaa

SEQ ID NO: 9364475 - DNA, 22 bp, Homo sapiens
gacataaaatggaattctgttg

SEQ ID NO: 9364476 - DNA, 22 bp, Homo sapiens
gacataaagttcttgcttgaat

SEQ ID NO: 9364477 - DNA, 22 bp, Homo sapiens
atgcttgtactaaaaaaatatt

SEQ ID NO: 9364478 - DNA, 22 bp, Homo sapiens
atgcttgtagtgtaatcactgt

SEQ ID NO: 9364479 - DNA, 22 bp, Homo sapiens
gacagtgtccctctggggtgga

SEQ ID NO: 9364480 - DNA, 22 bp, Homo sapiens
gacagtggttccaaggcagctt

SEQ ID NO: 9364481 - DNA, 22 bp, Homo sapiens
gacagtggttccaaggcagctt

SEQ ID NO: 9364482 - DNA, 22 bp, Homo sapiens
gacagtgcatttcctggcatgg

SEQ ID NO: 9364483 - DNA, 22 bp, Homo sapiens
gacagtggattcatctagtcaa

SEQ ID NO: 9364484 - DNA, 22 bp, Homo sapiens
gacagtgctatggtaggacatt

SEQ ID NO: 9364485 - DNA, 22 bp, Homo sapiens
gacagggaggaaagagactgct

SEQ ID NO: 9364486 - DNA, 22 bp, Homo sapiens
gacagggaggaaagagactgct

SEQ ID NO: 9364487 - DNA, 22 bp, Homo sapiens
gacagggaggagcagagcttct

SEQ ID NO: 9364488 - DNA, 22 bp, Homo sapiens
gacagggaggagcagagcttct

SEQ ID NO: 9364489 - DNA, 22 bp, Homo sapiens
gacagggcaagactctgtctaa

SEQ ID NO: 9364490 - DNA, 22 bp, Homo sapiens
gacagggccaaaccggctgatc

SEQ ID NO: 9364491 - DNA, 22 bp, Homo sapiens
gacagggcatggtgcagagttc

SEQ ID NO: 9364492 - DNA, 22 bp, Homo sapiens
gacagggcatggtgcagagttc

SEQ ID NO: 9364493 - DNA, 22 bp, Homo sapiens
gacagggccgcagatggagact

SEQ ID NO: 9364494 - DNA, 22 bp, Homo sapiens
gacagggccgcagatggagact

SEQ ID NO: 9364495 - DNA, 23 bp, Homo sapiens
gacagggctgacttggcagctgc

SEQ ID NO: 9364496 - DNA, 22 bp, Homo sapiens
gacagggcgagactcagtctca

SEQ ID NO: 9364497 - DNA, 22 bp, Homo sapiens
gacagggcgagactcagtctca

SEQ ID NO: 9364498 - DNA, 20 bp, Homo sapiens
atgctttcttgtgtgctgct

SEQ ID NO: 9364499 - DNA, 22 bp, Homo sapiens
atgcttttccaggagaaatata

SEQ ID NO: 9364500 - DNA, 22 bp, Homo sapiens
gactttgagggatacaaacatt

SEQ ID NO: 9364501 - DNA, 22 bp, Homo sapiens
gactttcttgcagaaatattcc

SEQ ID NO: 9364502 - DNA, 22 bp, Homo sapiens
gaccctctagatggaagcactg

SEQ ID NO: 9364503 - DNA, 22 bp, Homo sapiens
gaccctggagccgtctgaggca

SEQ ID NO: 9364504 - DNA, 22 bp, Homo sapiens
gaccctggaactttcagcagag

SEQ ID NO: 9364505 - DNA, 22 bp, Homo sapiens
gactggggtaaggtgaggaggt

SEQ ID NO: 9364506 - DNA, 22 bp, Homo sapiens
gactggggtaaggtgaggaggt

SEQ ID NO: 9364507 - DNA, 22 bp, Homo sapiens
gactttctgatgtaaacattta

SEQ ID NO: 9364508 - DNA, 22 bp, Homo sapiens
gactttctgagtcaaagaaagg

SEQ ID NO: 9364509 - DNA, 22 bp, Homo sapiens
gaccccaaccctagagtctgac

SEQ ID NO: 9364510 - DNA, 21 bp, Homo sapiens
gaccccagaccagcagacaca

SEQ ID NO: 9364511 - DNA, 22 bp, Homo sapiens
gaccccaagggatgcgtgtgct

SEQ ID NO: 9364512 - DNA, 22 bp, Homo sapiens
gaccccagaggaaggggcgccg

SEQ ID NO: 9364513 - DNA, 22 bp, Homo sapiens
gacccggctccaggcccagcag

SEQ ID NO: 9364514 - DNA, 22 bp, Homo sapiens
gaccccaggcagatcagggggt

SEQ ID NO: 9364515 - DNA, 22 bp, Homo sapiens
gaccctcctactaccctggaaa

SEQ ID NO: 9364516 - DNA, 22 bp, Homo sapiens
gaccctcattgtcaccgtgagc

SEQ ID NO: 9364517 - DNA, 22 bp, Homo sapiens
atgcccacaacactgcactttt

SEQ ID NO: 9364518 - DNA, 22 bp, Homo sapiens
atgcccacaacactgcactttt

SEQ ID NO: 9364519 - DNA, 22 bp, Homo sapiens
atgcccaccctcagcccaggct

SEQ ID NO: 9364520 - DNA, 22 bp, Homo sapiens
atgcccaatgtcacaatttttg

SEQ ID NO: 9364521 - DNA, 22 bp, Homo sapiens
atgccacttcattccagcctcg

SEQ ID NO: 9364522 - DNA, 22 bp, Homo sapiens
atgcatatgcaatgcacaattt

SEQ ID NO: 9364523 - DNA, 22 bp, Homo sapiens
atgcccagaaccccctggatgg

SEQ ID NO: 9364524 - DNA, 22 bp, Homo sapiens
atgcctccgcatgtgcctttga

SEQ ID NO: 9364525 - DNA, 20 bp, Homo sapiens
atgcctctaattttgcaaac

SEQ ID NO: 9364526 - DNA, 22 bp, Homo sapiens
atgcctcctgtgccactgtgat

SEQ ID NO: 9364527 - DNA, 22 bp, Homo sapiens
atgcctcctcaaatctgccaca

SEQ ID NO: 9364528 - DNA, 22 bp, Homo sapiens
gacagggacgaggcttcaggca

SEQ ID NO: 9364529 - DNA, 22 bp, Homo sapiens
gacagggactccctggttagaa

SEQ ID NO: 9364530 - DNA, 22 bp, Homo sapiens
gacagggacgaggcttcaggca

SEQ ID NO: 9364531 - DNA, 22 bp, Homo sapiens
gacaggaaatatgggggttgtt

SEQ ID NO: 9364532 - DNA, 22 bp, Homo sapiens
gacaggaaatatgggggttgtt

SEQ ID NO: 9364533 - DNA, 22 bp, Homo sapiens
atgcctggactgacatgcactg

SEQ ID NO: 9364534 - DNA, 22 bp, Homo sapiens
gaatgtttaaggaaggcgtggc

SEQ ID NO: 9364535 - DNA, 22 bp, Homo sapiens
gaatgtttaaaaggtgcagttt

SEQ ID NO: 9364536 - DNA, 20 bp, Homo sapiens
gaatgtttcacttgctccat

SEQ ID NO: 9364537 - DNA, 22 bp, Homo sapiens
gaatgtttcatgtgtatgttag

SEQ ID NO: 9364538 - DNA, 22 bp, Homo sapiens
atgcataatgtatgtattgact

SEQ ID NO: 9364539 - DNA, 22 bp, Homo sapiens
atgcataaagaaagctatctgg

SEQ ID NO: 9364540 - DNA, 22 bp, Homo sapiens
gaatgtttgactaaaggtagct

SEQ ID NO: 9364541 - DNA, 19 bp, Homo sapiens
gaatgtttctgtctcttct

SEQ ID NO: 9364542 - DNA, 22 bp, Homo sapiens
atgcatataaggcacatgtatt

SEQ ID NO: 9364543 - DNA, 22 bp, Homo sapiens
gaatgtcagttgcgggcatttc

SEQ ID NO: 9364544 - DNA, 22 bp, Homo sapiens
gaatgtcttctgttcccagctg

SEQ ID NO: 9364545 - DNA, 22 bp, Homo sapiens
gaatgtgaggttgtatgtgaaa

SEQ ID NO: 9364546 - DNA, 22 bp, Homo sapiens
gaatgttattgaactacgagct

SEQ ID NO: 9364547 - DNA, 22 bp, Homo sapiens
gaagcacatggctatagctatt

SEQ ID NO: 9364548 - DNA, 22 bp, Homo sapiens
atgcacaagaggctagaaaaga

SEQ ID NO: 9364549 - DNA, 22 bp, Homo sapiens
atgcacaagcaagagataatgg

SEQ ID NO: 9364550 - DNA, 22 bp, Homo sapiens
gaatcatgctcaataatgcttg

SEQ ID NO: 9364551 - DNA, 22 bp, Homo sapiens
gaatcatggctgtgtcttcagc

SEQ ID NO: 9364552 - DNA, 22 bp, Homo sapiens
gaatgtaatagtcagtagaaca

SEQ ID NO: 9364553 - DNA, 22 bp, Homo sapiens
gaatcatgtctagaagcagtgg

SEQ ID NO: 9364554 - DNA, 22 bp, Homo sapiens
gaagcagagcctaaggcagaca

SEQ ID NO: 9364555 - DNA, 22 bp, Homo sapiens
gaagcagagcctaaggcagaca

SEQ ID NO: 9364556 - DNA, 22 bp, Homo sapiens
gaagcagaacccactccccaac

SEQ ID NO: 9364557 - DNA, 22 bp, Homo sapiens
gaagcagagcctaaggcagaca

SEQ ID NO: 9364558 - DNA, 22 bp, Homo sapiens
gagcagctcgagaaggaagcag

SEQ ID NO: 9364559 - DNA, 22 bp, Homo sapiens
gagcagctcgagaaggaagcag

SEQ ID NO: 9364560 - DNA, 22 bp, Homo sapiens
gagcagctcgagaaggaagcag

SEQ ID NO: 9364561 - DNA, 22 bp, Homo sapiens
gagcagctcagaggactagtgt

SEQ ID NO: 9364562 - DNA, 22 bp, Homo sapiens
gagcagctaaaattctcatgca

SEQ ID NO: 9364563 - DNA, 16 bp, Homo sapiens
gagcagcctgggcctt

SEQ ID NO: 9364564 - DNA, 22 bp, Homo sapiens
gagaggtgaaggctgccctggg

SEQ ID NO: 9364565 - DNA, 22 bp, Homo sapiens
gagaggtgaaggctgccctggg

SEQ ID NO: 9364566 - DNA, 22 bp, Homo sapiens
gagaggtgaatgtggatgccac

SEQ ID NO: 9364567 - DNA, 22 bp, Homo sapiens
gagaggtgaatgtggatgccac

SEQ ID NO: 9364568 - DNA, 22 bp, Homo sapiens
gagaggtgaaatagttgtccgg

SEQ ID NO: 9364569 - DNA, 22 bp, Homo sapiens
gagaggtgaaatagttgtccgg

SEQ ID NO: 9364570 - DNA, 22 bp, Homo sapiens
gagaggtgaaatagttgtccgg

SEQ ID NO: 9364571 - DNA, 22 bp, Homo sapiens
gagaggtgaaggctgccctggg

SEQ ID NO: 9364572 - DNA, 22 bp, Homo sapiens
gagaggtgaaggctgccctggg

SEQ ID NO: 9364573 - DNA, 22 bp, Homo sapiens
gagaggtggaggttgcagtgag

SEQ ID NO: 9364574 - DNA, 22 bp, Homo sapiens
gagaggtggaggttgcagtgag

SEQ ID NO: 9364575 - DNA, 22 bp, Homo sapiens
gagaggtggaggttgcagtgag

SEQ ID NO: 9364576 - DNA, 22 bp, Homo sapiens
gagaggtggaggttgcagtgag

SEQ ID NO: 9364577 - DNA, 22 bp, Homo sapiens
gagaggtggtgaggacttgtct

SEQ ID NO: 9364578 - DNA, 22 bp, Homo sapiens
gagaggtgtgtttcagataaga

SEQ ID NO: 9364579 - DNA, 22 bp, Homo sapiens
gagaggtggtgaggacttgtct

SEQ ID NO: 9364580 - DNA, 22 bp, Homo sapiens
gagaggtggaggttgcagtgag

SEQ ID NO: 9364581 - DNA, 22 bp, Homo sapiens
gagaggtagcagtaagaacagg

SEQ ID NO: 9364582 - DNA, 22 bp, Homo sapiens
gagaggctgcatatgcacactg

SEQ ID NO: 9364583 - DNA, 22 bp, Homo sapiens
gagaggctggcagtgccaggtt

SEQ ID NO: 9364584 - DNA, 22 bp, Homo sapiens
gagaggctgactggctgtcctg

SEQ ID NO: 9364585 - DNA, 22 bp, Homo sapiens
gagaggctgaaatcacaggagc

SEQ ID NO: 9364586 - DNA, 22 bp, Homo sapiens
gagaggctgatcctgcagagaa

SEQ ID NO: 9364587 - DNA, 22 bp, Homo sapiens
gagaggctgactggctgtcctg

SEQ ID NO: 9364588 - DNA, 22 bp, Homo sapiens
gagaggctgactggctgtcctg

SEQ ID NO: 9364589 - DNA, 22 bp, Homo sapiens
gagaggaagccttctgtacttg

SEQ ID NO: 9364590 - DNA, 22 bp, Homo sapiens
gagaggaagccttctgtacttg

SEQ ID NO: 9364591 - DNA, 21 bp, Homo sapiens
atggaaaaacaggtagagcat

SEQ ID NO: 9364592 - DNA, 21 bp, Homo sapiens
atggaaaaacaggtagagcat

SEQ ID NO: 9364593 - DNA, 22 bp, Homo sapiens
atgcttttcctaaaatgatgcc

SEQ ID NO: 9364594 - DNA, 22 bp, Homo sapiens
gagaggaatgaggttaaggact

SEQ ID NO: 9364595 - DNA, 22 bp, Homo sapiens
gagaggctccatgaccccggca

SEQ ID NO: 9364596 - DNA, 22 bp, Homo sapiens
gagaggctccgccactgctcag

SEQ ID NO: 9364597 - DNA, 22 bp, Homo sapiens
gagaggctccgccactgctcag

SEQ ID NO: 9364598 - DNA, 22 bp, Homo sapiens
gagaggctctgaggactggggt

SEQ ID NO: 9364599 - DNA, 22 bp, Homo sapiens
gagaggctctgaggactggggt

SEQ ID NO: 9364600 - DNA, 22 bp, Homo sapiens
gagaggctccgccactgctcag

SEQ ID NO: 9364601 - DNA, 22 bp, Homo sapiens
gagaggctctgaggactggggt

SEQ ID NO: 9364602 - DNA, 22 bp, Homo sapiens
gagcagctgagctggaatgaga

SEQ ID NO: 9364603 - DNA, 22 bp, Homo sapiens
gagcagctgagctggaatgaga

SEQ ID NO: 9364604 - DNA, 22 bp, Homo sapiens
gagcagctgagctggaatgaga

SEQ ID NO: 9364605 - DNA, 22 bp, Homo sapiens
gagcagctctgggtgacccagt

SEQ ID NO: 9364606 - DNA, 22 bp, Homo sapiens
gagcagggagacaactctggtg

SEQ ID NO: 9364607 - DNA, 22 bp, Homo sapiens
gagcagctgagctggaatgaga

SEQ ID NO: 9364608 - DNA, 19 bp, Homo sapiens
gagcagctgcacccattga

SEQ ID NO: 9364609 - DNA, 17 bp, Homo sapiens
gagcagggatgcggttc

SEQ ID NO: 9364610 - DNA, 22 bp, Homo sapiens
gagcagggagacaactctggtg

SEQ ID NO: 9364611 - DNA, 17 bp, Homo sapiens
gagcagggatgcggttc

SEQ ID NO: 9364612 - DNA, 22 bp, Homo sapiens
gagcagggccacttctgtacct

SEQ ID NO: 9364613 - DNA, 22 bp, Homo sapiens
gagcagggccacttctgtacct

SEQ ID NO: 9364614 - DNA, 22 bp, Homo sapiens
gagcaggtctttcatggtgcat

SEQ ID NO: 9364615 - DNA, 22 bp, Homo sapiens
gagcagtgactggagcatgaga

SEQ ID NO: 9364616 - DNA, 22 bp, Homo sapiens
gagccctgaacaacagcaggaa

SEQ ID NO: 9364617 - DNA, 22 bp, Homo sapiens
gagcctggggaccctcctgagt

SEQ ID NO: 9364618 - DNA, 22 bp, Homo sapiens
gagcctggggaccctcctgagt

SEQ ID NO: 9364619 - DNA, 22 bp, Homo sapiens
gagcctggggaccctcctgagt

SEQ ID NO: 9364620 - DNA, 22 bp, Homo sapiens
gagcctgggactgggggtcatg

SEQ ID NO: 9364621 - DNA, 22 bp, Homo sapiens
gagcctgggactgggggtcatg

SEQ ID NO: 9364622 - DNA, 22 bp, Homo sapiens
gagcctgggtccttccctggga

SEQ ID NO: 9364623 - DNA, 22 bp, Homo sapiens
gagcctgggtccttccctggga

SEQ ID NO: 9364624 - DNA, 22 bp, Homo sapiens
gagcctgggtccttccctggga

SEQ ID NO: 9364625 - DNA, 22 bp, Homo sapiens
gagcctggcctcctgcctcagc

SEQ ID NO: 9364626 - DNA, 22 bp, Homo sapiens
gagcctggcctcctgcctcagc

SEQ ID NO: 9364627 - DNA, 22 bp, Homo sapiens
gagcctggcctcctgcctcagc

SEQ ID NO: 9364628 - DNA, 20 bp, Homo sapiens
gagcctgggaagtctaaggt

SEQ ID NO: 9364629 - DNA, 22 bp, Homo sapiens
gagcctgggactgggggtcatg

SEQ ID NO: 9364630 - DNA, 18 bp, Homo sapiens
gagctctgcctcccagtc

SEQ ID NO: 9364631 - DNA, 18 bp, Homo sapiens
gagctctgcctcccagtc

SEQ ID NO: 9364632 - DNA, 22 bp, Homo sapiens
gagctctgccatggctcccacc

SEQ ID NO: 9364633 - DNA, 22 bp, Homo sapiens
gagctctgccatggctcccacc

SEQ ID NO: 9364634 - DNA, 18 bp, Homo sapiens
gagctctgcctcccagtc

SEQ ID NO: 9364635 - DNA, 23 bp, Homo sapiens
gagctctgcactaggccctggga

SEQ ID NO: 9364636 - DNA, 22 bp, Homo sapiens
gagctctgcagattgttttagg

SEQ ID NO: 9364637 - DNA, 22 bp, Homo sapiens
gagctctgcagattgttttagg

SEQ ID NO: 9364638 - DNA, 22 bp, Homo sapiens
gagctctgcagattgttttagg

SEQ ID NO: 9364639 - DNA, 23 bp, Homo sapiens
gagctctgcactaggccctggga

SEQ ID NO: 9364640 - DNA, 22 bp, Homo sapiens
gaggaaggctaaggggcttaga

SEQ ID NO: 9364641 - DNA, 22 bp, Homo sapiens
atggttattggccagatgccat

SEQ ID NO: 9364642 - DNA, 22 bp, Homo sapiens
gaggaaggatttagtttgaggg

SEQ ID NO: 9364643 - DNA, 22 bp, Homo sapiens
gaggaaggatttagtttgaggg

SEQ ID NO: 9364644 - DNA, 22 bp, Homo sapiens
gaggaaggctaaggggcttaga

SEQ ID NO: 9364645 - DNA, 22 bp, Homo sapiens
gaggaaggatttagtttgaggg

SEQ ID NO: 9364646 - DNA, 22 bp, Homo sapiens
gaggaaggatttagtttgaggg

SEQ ID NO: 9364647 - DNA, 22 bp, Homo sapiens
gaggaaggaatgcagtgtatgc

SEQ ID NO: 9364648 - DNA, 22 bp, Homo sapiens
gaggaaggaatgcagtgtatgc

SEQ ID NO: 9364649 - DNA, 22 bp, Homo sapiens
gaggaaggaatgcagtgtatgc

SEQ ID NO: 9364650 - DNA, 22 bp, Homo sapiens
gaggaaggagggaaagcgcgcg

SEQ ID NO: 9364651 - DNA, 22 bp, Homo sapiens
gaggaaggagggaaagcgcgcg

SEQ ID NO: 9364652 - DNA, 22 bp, Homo sapiens
gaggaaggagggaaagcgcgcg

SEQ ID NO: 9364653 - DNA, 22 bp, Homo sapiens
gagctttgtgctggtaggtggt

SEQ ID NO: 9364654 - DNA, 22 bp, Homo sapiens
gagctttgtctcctggagaccc

SEQ ID NO: 9364655 - DNA, 22 bp, Homo sapiens
gagctttgcctaaaactagaat

SEQ ID NO: 9364656 - DNA, 22 bp, Homo sapiens
gagctttgctggaagcctgggg

SEQ ID NO: 9364657 - DNA, 22 bp, Homo sapiens
gaggaagatggttgagtggtcc

SEQ ID NO: 9364658 - DNA, 22 bp, Homo sapiens
gaggaagatggttgagtggtcc

SEQ ID NO: 9364659 - DNA, 22 bp, Homo sapiens
gaggaagctgcgtggcatttca

SEQ ID NO: 9364660 - DNA, 22 bp, Homo sapiens
gagctttagctgagacctgctt

SEQ ID NO: 9364661 - DNA, 22 bp, Homo sapiens
gagctttaggagaaggaggtca

SEQ ID NO: 9364662 - DNA, 22 bp, Homo sapiens
gagcttggggcatatggtgcta

SEQ ID NO: 9364663 - DNA, 22 bp, Homo sapiens
gagctggggcggatactcagct

SEQ ID NO: 9364664 - DNA, 22 bp, Homo sapiens
gagctggggcggatactcagct

SEQ ID NO: 9364665 - DNA, 22 bp, Homo sapiens
gagctctggacgaggggagtgg

SEQ ID NO: 9364666 - DNA, 22 bp, Homo sapiens
gagctctggcagggcaggtctg

SEQ ID NO: 9364667 - DNA, 22 bp, Homo sapiens
gagctctgggaaacaaagtgta

SEQ ID NO: 9364668 - DNA, 22 bp, Homo sapiens
gagctctggcagggcaggtctg

SEQ ID NO: 9364669 - DNA, 22 bp, Homo sapiens
gagctctgctactcaaagtatg

SEQ ID NO: 9364670 - DNA, 22 bp, Homo sapiens
gagctctgctactcaaagtatg

SEQ ID NO: 9364671 - DNA, 22 bp, Homo sapiens
gagctctgcggaaaacgtgccg

SEQ ID NO: 9364672 - DNA, 22 bp, Homo sapiens
gagctctgcttgggttcttagg

SEQ ID NO: 9364673 - DNA, 22 bp, Homo sapiens
gagctctgcttgggttcttagg

SEQ ID NO: 9364674 - DNA, 22 bp, Homo sapiens
gagctctgggaaacaaagtgta

SEQ ID NO: 9364675 - DNA, 22 bp, Homo sapiens
gagctctgggtggcaggtgtct

SEQ ID NO: 9364676 - DNA, 22 bp, Homo sapiens
gagctctggttcatgatctatt

SEQ ID NO: 9364677 - DNA, 22 bp, Homo sapiens
gagctctggttcatgatctatt

SEQ ID NO: 9364678 - DNA, 22 bp, Homo sapiens
gagctctgggtgtgttgtcagt

SEQ ID NO: 9364679 - DNA, 22 bp, Homo sapiens
gagctctgggtgtgttgtcagt

SEQ ID NO: 9364680 - DNA, 22 bp, Homo sapiens
gagctctgtacacagagggtgt

SEQ ID NO: 9364681 - DNA, 22 bp, Homo sapiens
gagctctgtccacacttggaga

SEQ ID NO: 9364682 - DNA, 22 bp, Homo sapiens
gagctggggcggatactcagct

SEQ ID NO: 9364683 - DNA, 22 bp, Homo sapiens
atgtaaggttcagagtatgtga

SEQ ID NO: 9364684 - DNA, 22 bp, Homo sapiens
atgtaagtattcaaaatatttc

SEQ ID NO: 9364685 - DNA, 22 bp, Homo sapiens
atgtaaatcaagcagtgctggt

SEQ ID NO: 9364686 - DNA, 22 bp, Homo sapiens
atgtaaagttacttgagttttg

SEQ ID NO: 9364687 - DNA, 22 bp, Homo sapiens
atgtaaagtataaagtaagggg

SEQ ID NO: 9364688 - DNA, 22 bp, Homo sapiens
atggtttacaatgttttcagtt

SEQ ID NO: 9364689 - DNA, 22 bp, Homo sapiens
atggtttaagggagaatattga

SEQ ID NO: 9364690 - DNA, 22 bp, Homo sapiens
atgtaacaaatggtatacatgt

SEQ ID NO: 9364691 - DNA, 22 bp, Homo sapiens
atgtacaacctgcatgacagtc

SEQ ID NO: 9364692 - DNA, 22 bp, Homo sapiens
atgtacaacctgcatgacagtc

SEQ ID NO: 9364693 - DNA, 22 bp, Homo sapiens
atgtacaacctgcatgacagtc

SEQ ID NO: 9364694 - DNA, 22 bp, Homo sapiens
atgtacaacctgcatgacagtc

SEQ ID NO: 9364695 - DNA, 22 bp, Homo sapiens
atgtacaagctgttttactgca

SEQ ID NO: 9364696 - DNA, 22 bp, Homo sapiens
atgtacaagctgttttactgca

SEQ ID NO: 9364697 - DNA, 22 bp, Homo sapiens
atgtacaatctagggtttgcat

SEQ ID NO: 9364698 - DNA, 22 bp, Homo sapiens
atgtacaaaatgccactgaatt

SEQ ID NO: 9364699 - DNA, 22 bp, Homo sapiens
atgtacaaaatgccactgaatt

SEQ ID NO: 9364700 - DNA, 22 bp, Homo sapiens
atgtacaaaatgccactgaatt

SEQ ID NO: 9364701 - DNA, 22 bp, Homo sapiens
atgtacaacctgcatgacagtc

SEQ ID NO: 9364702 - DNA, 22 bp, Homo sapiens
atgtacaaaatgttttgaaatg

SEQ ID NO: 9364703 - DNA, 22 bp, Homo sapiens
atgtacaaaatgttttgaaatg

SEQ ID NO: 9364704 - DNA, 21 bp, Homo sapiens
atgtcaaatgctttattttat

SEQ ID NO: 9364705 - DNA, 22 bp, Homo sapiens
atgtatttctatgtagtgaaga

SEQ ID NO: 9364706 - DNA, 22 bp, Homo sapiens
atgtatttctatgtagtgaaga

SEQ ID NO: 9364707 - DNA, 22 bp, Homo sapiens
atgtacaatctatcacaagaag

SEQ ID NO: 9364708 - DNA, 22 bp, Homo sapiens
atgtttcatttagatatcaggc

SEQ ID NO: 9364709 - DNA, 22 bp, Homo sapiens
atgtttccaggttcttcctatg

SEQ ID NO: 9364710 - DNA, 22 bp, Homo sapiens
gatctggaatctgaaggctgag

SEQ ID NO: 9364711 - DNA, 22 bp, Homo sapiens
atgtttccgtgagcatccttga

SEQ ID NO: 9364712 - DNA, 22 bp, Homo sapiens
atgtttccattttcttgtatca

SEQ ID NO: 9364713 - DNA, 22 bp, Homo sapiens
gatctctgaatctgaagccttc

SEQ ID NO: 9364714 - DNA, 22 bp, Homo sapiens
gatctctgtggactcttagcac

SEQ ID NO: 9364715 - DNA, 21 bp, Homo sapiens
gatctctggaaggagaaagct

SEQ ID NO: 9364716 - DNA, 22 bp, Homo sapiens
gatctggaagaaagggagggca

SEQ ID NO: 9364717 - DNA, 18 bp, Homo sapiens
gatcgggggcgccccaag

SEQ ID NO: 9364718 - DNA, 22 bp, Homo sapiens
gatcctgggactgaatgggtgc

SEQ ID NO: 9364719 - DNA, 22 bp, Homo sapiens
gatcctgggcccttctgggtca

SEQ ID NO: 9364720 - DNA, 22 bp, Homo sapiens
gatcctgacatcctgacatgga

SEQ ID NO: 9364721 - DNA, 22 bp, Homo sapiens
gatcctggcacaggttggtccc

SEQ ID NO: 9364722 - DNA, 22 bp, Homo sapiens
gatcctgggactgaatgggtgc

SEQ ID NO: 9364723 - DNA, 22 bp, Homo sapiens
gatcctgggactgaatgggtgc

SEQ ID NO: 9364724 - DNA, 22 bp, Homo sapiens
gagttagcaaagggtggcaggg

SEQ ID NO: 9364725 - DNA, 22 bp, Homo sapiens
gagttagcaaagggtggcaggg

SEQ ID NO: 9364726 - DNA, 22 bp, Homo sapiens
gagttatagatggactattatt

SEQ ID NO: 9364727 - DNA, 22 bp, Homo sapiens
gagttatatcctgagtcatatt

SEQ ID NO: 9364728 - DNA, 22 bp, Homo sapiens
gagttactgggtggaaggcact

SEQ ID NO: 9364729 - DNA, 22 bp, Homo sapiens
gagttacattcattgttacgct

SEQ ID NO: 9364730 - DNA, 22 bp, Homo sapiens
atgtttcatttagatatcaggc

SEQ ID NO: 9364731 - DNA, 22 bp, Homo sapiens
atgtttcatgactgagcaaaat

SEQ ID NO: 9364732 - DNA, 22 bp, Homo sapiens
atgtttcagttctaaagttaga

SEQ ID NO: 9364733 - DNA, 22 bp, Homo sapiens
atgtttcaccagttttataaga

SEQ ID NO: 9364734 - DNA, 22 bp, Homo sapiens
atgtttcaccagttttataaga

SEQ ID NO: 9364735 - DNA, 22 bp, Homo sapiens
atgtttcaccagttttataaga

SEQ ID NO: 9364736 - DNA, 22 bp, Homo sapiens
atgtttcaggaaatcagctaga

SEQ ID NO: 9364737 - DNA, 22 bp, Homo sapiens
atgtttcaggcgaactaacatg

SEQ ID NO: 9364738 - DNA, 22 bp, Homo sapiens
atgtttattgttttaagctgct

SEQ ID NO: 9364739 - DNA, 22 bp, Homo sapiens
atgtttattttgcagagtaggg

SEQ ID NO: 9364740 - DNA, 22 bp, Homo sapiens
atgtttattttgcagagtaggg

SEQ ID NO: 9364741 - DNA, 21 bp, Homo sapiens
gagtgcaggtctgatgccatc

SEQ ID NO: 9364742 - DNA, 22 bp, Homo sapiens
atgtttaattatctgggttttg

SEQ ID NO: 9364743 - DNA, 22 bp, Homo sapiens
atgtttaattatctgggttttg

SEQ ID NO: 9364744 - DNA, 20 bp, Homo sapiens
atgtttaatgttgtccaccc

SEQ ID NO: 9364745 - DNA, 22 bp, Homo sapiens
atgtttcaatgcactttagcct

SEQ ID NO: 9364746 - DNA, 23 bp, Homo sapiens
gagtgcagaatagacatgcagtg

SEQ ID NO: 9364747 - DNA, 23 bp, Homo sapiens
gagtgcagaatagacatgcagtg

SEQ ID NO: 9364748 - DNA, 17 bp, Homo sapiens
gagtgcagacacaagca

SEQ ID NO: 9364749 - DNA, 22 bp, Homo sapiens
gagtgcagatgaacagaagatt

SEQ ID NO: 9364750 - DNA, 22 bp, Homo sapiens
gagtgcagatgccagccccagt

SEQ ID NO: 9364751 - DNA, 21 bp, Homo sapiens
gagtgcagcaaggtagagtct

SEQ ID NO: 9364752 - DNA, 22 bp, Homo sapiens
gagtgcaggcctgagcaccatc

SEQ ID NO: 9364753 - DNA, 22 bp, Homo sapiens
gagtgcaggcctgagcaccatc

SEQ ID NO: 9364754 - DNA, 22 bp, Homo sapiens
gagtccagttctttccagcagt

SEQ ID NO: 9364755 - DNA, 22 bp, Homo sapiens
gagtccagttagtgaggctggg

SEQ ID NO: 9364756 - DNA, 22 bp, Homo sapiens
gagtccagttagtgaggctggg

SEQ ID NO: 9364757 - DNA, 22 bp, Homo sapiens
gagtccagttagtgaggctggg

SEQ ID NO: 9364758 - DNA, 20 bp, Homo sapiens
gagtccaggggcctgtagca

SEQ ID NO: 9364759 - DNA, 22 bp, Homo sapiens
gagtccagtgatgttcctggtc

SEQ ID NO: 9364760 - DNA, 22 bp, Homo sapiens
gagtccagtagttaggacagag

SEQ ID NO: 9364761 - DNA, 22 bp, Homo sapiens
gaggggggcgccctgcagtgca

SEQ ID NO: 9364762 - DNA, 22 bp, Homo sapiens
gaggggggcgccctgcagtgca

SEQ ID NO: 9364763 - DNA, 22 bp, Homo sapiens
gaggggggcgccctgcagtgca

SEQ ID NO: 9364764 - DNA, 22 bp, Homo sapiens
gagggggtctatgaggtagagc

SEQ ID NO: 9364765 - DNA, 22 bp, Homo sapiens
gagggggctccctgaagccagt

SEQ ID NO: 9364766 - DNA, 22 bp, Homo sapiens
gagggggctagcgcagtgccca

SEQ ID NO: 9364767 - DNA, 22 bp, Homo sapiens
gagggggcgtgcaaggctccgc

SEQ ID NO: 9364768 - DNA, 22 bp, Homo sapiens
gagggggcgaacagaagcaagg

SEQ ID NO: 9364769 - DNA, 19 bp, Homo sapiens
gaggggaggaattgacaag

SEQ ID NO: 9364770 - DNA, 22 bp, Homo sapiens
gagggcagaaaattatgcggtg

SEQ ID NO: 9364771 - DNA, 22 bp, Homo sapiens
gagggcagaaaattatgcggtg

SEQ ID NO: 9364772 - DNA, 22 bp, Homo sapiens
gagggcaccagaagagccagat

SEQ ID NO: 9364773 - DNA, 22 bp, Homo sapiens
gagtccaggatttgagctctgt

SEQ ID NO: 9364774 - DNA, 22 bp, Homo sapiens
gaggtagggcagaggctgaatg

SEQ ID NO: 9364775 - DNA, 22 bp, Homo sapiens
gagtccagctcattgtctggga

SEQ ID NO: 9364776 - DNA, 17 bp, Homo sapiens
gaggtaggaagtgagtc

SEQ ID NO: 9364777 - DNA, 17 bp, Homo sapiens
gaggtaggaagtgagtc

SEQ ID NO: 9364778 - DNA, 17 bp, Homo sapiens
gaggtaggaagtgagtc

SEQ ID NO: 9364779 - DNA, 17 bp, Homo sapiens
gaggtaggaagtgagtc

SEQ ID NO: 9364780 - DNA, 22 bp, Homo sapiens
gaggtaggctgtgaaagggggt

SEQ ID NO: 9364781 - DNA, 22 bp, Homo sapiens
gaggtaagggcaggagagtgaa

SEQ ID NO: 9364782 - DNA, 22 bp, Homo sapiens
gagggggtctatgaggtagagc

SEQ ID NO: 9364783 - DNA, 22 bp, Homo sapiens
gagggaaacagatgggttgtgg

SEQ ID NO: 9364784 - DNA, 22 bp, Homo sapiens
gagggatggtgtgagaggctca

SEQ ID NO: 9364785 - DNA, 22 bp, Homo sapiens
gagggatggtgtgagaggctca

SEQ ID NO: 9364786 - DNA, 22 bp, Homo sapiens
gagggatggtgtgagaggctca

SEQ ID NO: 9364787 - DNA, 22 bp, Homo sapiens
gagggatgtgcctgaaggcagg

SEQ ID NO: 9364788 - DNA, 22 bp, Homo sapiens
gagggatgtgcctgaaggcagg

SEQ ID NO: 9364789 - DNA, 22 bp, Homo sapiens
gagggatgtgcctgaaggcagg

SEQ ID NO: 9364790 - DNA, 22 bp, Homo sapiens
gagggatgtcaggggaccttgg

SEQ ID NO: 9364791 - DNA, 22 bp, Homo sapiens
gagggatgtgcctgaaggcagg

SEQ ID NO: 9364792 - DNA, 22 bp, Homo sapiens
gagggatgtcaggggaccttgg

SEQ ID NO: 9364793 - DNA, 22 bp, Homo sapiens
gagggatgtcaggggaccttgg

SEQ ID NO: 9364794 - DNA, 22 bp, Homo sapiens
gagggatggtgtgagaggctca

SEQ ID NO: 9364795 - DNA, 22 bp, Homo sapiens
gaggcttgcaccatgagcacca

SEQ ID NO: 9364796 - DNA, 22 bp, Homo sapiens
gaggcttcccgcccatgctgga

SEQ ID NO: 9364797 - DNA, 22 bp, Homo sapiens
gaggcttctgttcactcacgct

SEQ ID NO: 9364798 - DNA, 22 bp, Homo sapiens
gagggaaaataaaattgcagta

SEQ ID NO: 9364799 - DNA, 22 bp, Homo sapiens
gaggctgtgtgtccctctggac

SEQ ID NO: 9364800 - DNA, 22 bp, Homo sapiens
gaggctgttaggagggactctg

SEQ ID NO: 9364801 - DNA, 22 bp, Homo sapiens
gaggctggaatattagaaatgt

SEQ ID NO: 9364802 - DNA, 23 bp, Homo sapiens
gaggccacattcccctgcttgag

SEQ ID NO: 9364803 - DNA, 23 bp, Homo sapiens
gaggccacattcccctgcttgag

SEQ ID NO: 9364804 - DNA, 22 bp, Homo sapiens
gaggccacagtgtctgggggcc

SEQ ID NO: 9364805 - DNA, 22 bp, Homo sapiens
gaggccacagtcctgaggcatc

SEQ ID NO: 9364806 - DNA, 22 bp, Homo sapiens
gaggccacagtcctgaggcatc

SEQ ID NO: 9364807 - DNA, 22 bp, Homo sapiens
gaggccacagctatcagggaca

SEQ ID NO: 9364808 - DNA, 22 bp, Homo sapiens
gaggccaagggagaagatctct

SEQ ID NO: 9364809 - DNA, 22 bp, Homo sapiens
atttaaagtggtagattggcag

SEQ ID NO: 9364810 - DNA, 22 bp, Homo sapiens
atttaaagtggtagattggcag

SEQ ID NO: 9364811 - DNA, 22 bp, Homo sapiens
atttaaagtggtagattggcag

SEQ ID NO: 9364812 - DNA, 22 bp, Homo sapiens
atttaaatgcttaagagggttt

SEQ ID NO: 9364813 - DNA, 22 bp, Homo sapiens
atttaaatgcttaagagggttt

SEQ ID NO: 9364814 - DNA, 22 bp, Homo sapiens
atttaaatgcttaagagggttt

SEQ ID NO: 9364815 - DNA, 22 bp, Homo sapiens
atttaaattttctgatggagag

SEQ ID NO: 9364816 - DNA, 20 bp, Homo sapiens
gccactgggcaccagcaggg

SEQ ID NO: 9364817 - DNA, 22 bp, Homo sapiens
gccactggcatctagttggtag

SEQ ID NO: 9364818 - DNA, 21 bp, Homo sapiens
gccactgcactccagcctggg

SEQ ID NO: 9364819 - DNA, 21 bp, Homo sapiens
gccactgcactccagcctggg

SEQ ID NO: 9364820 - DNA, 21 bp, Homo sapiens
gccactgcactccagcctggg

SEQ ID NO: 9364821 - DNA, 22 bp, Homo sapiens
gccactggacccagggttatca

SEQ ID NO: 9364822 - DNA, 22 bp, Homo sapiens
gccactggagacagtggggaag

SEQ ID NO: 9364823 - DNA, 22 bp, Homo sapiens
gccaccttccaaaataatcaca

SEQ ID NO: 9364824 - DNA, 22 bp, Homo sapiens
gccactcatgggaggtgtgcaa

SEQ ID NO: 9364825 - DNA, 22 bp, Homo sapiens
gccactcatgggaggtgtgcaa

SEQ ID NO: 9364826 - DNA, 22 bp, Homo sapiens
gcattcatcaaaaatgttcctc

SEQ ID NO: 9364827 - DNA, 22 bp, Homo sapiens
gcattcatcttcctccatgcag

SEQ ID NO: 9364828 - DNA, 22 bp, Homo sapiens
gcattcatcttcatgaaagcac

SEQ ID NO: 9364829 - DNA, 22 bp, Homo sapiens
gcattcatatggaaggaaacta

SEQ ID NO: 9364830 - DNA, 22 bp, Homo sapiens
gcattcactgggtgttcatggg

SEQ ID NO: 9364831 - DNA, 22 bp, Homo sapiens
gcattccttgagttccctgtgc

SEQ ID NO: 9364832 - DNA, 22 bp, Homo sapiens
gcattcattcattcattaggta

SEQ ID NO: 9364833 - DNA, 22 bp, Homo sapiens
gcattcatgcctgtgtgagctc

SEQ ID NO: 9364834 - DNA, 22 bp, Homo sapiens
gcattcattcattcattaggta

SEQ ID NO: 9364835 - DNA, 22 bp, Homo sapiens
attgttcaatgtaataattttg

SEQ ID NO: 9364836 - DNA, 22 bp, Homo sapiens
attgttcaaagtgctttgcatg

SEQ ID NO: 9364837 - DNA, 21 bp, Homo sapiens
attgttatcattgtgctgtgt

SEQ ID NO: 9364838 - DNA, 22 bp, Homo sapiens
attgttaatgttgcactaaggt

SEQ ID NO: 9364839 - DNA, 22 bp, Homo sapiens
attgtgcacctactgtgtgcag

SEQ ID NO: 9364840 - DNA, 20 bp, Homo sapiens
gcagtgctggtgcctctgct

SEQ ID NO: 9364841 - DNA, 22 bp, Homo sapiens
attgtgcagatagtaattagga

SEQ ID NO: 9364842 - DNA, 22 bp, Homo sapiens
attgtgcagaattggaattgca

SEQ ID NO: 9364843 - DNA, 22 bp, Homo sapiens
attgtgcagctctgctcttatt

SEQ ID NO: 9364844 - DNA, 22 bp, Homo sapiens
attgtgcaggtcagttattgca

SEQ ID NO: 9364845 - DNA, 22 bp, Homo sapiens
attgtgcagtaaagtccttttc

SEQ ID NO: 9364846 - DNA, 20 bp, Homo sapiens
attgtgcagcccttggcaga

SEQ ID NO: 9364847 - DNA, 22 bp, Homo sapiens
attgtgcagcagtggtacctgg

SEQ ID NO: 9364848 - DNA, 22 bp, Homo sapiens
attgtgcagcacagatcatgac

SEQ ID NO: 9364849 - DNA, 22 bp, Homo sapiens
gcattattaactggaggaaaag

SEQ ID NO: 9364850 - DNA, 22 bp, Homo sapiens
gcattattaatagctgcatgag

SEQ ID NO: 9364851 - DNA, 22 bp, Homo sapiens
attgtttacactaacttcataa

SEQ ID NO: 9364852 - DNA, 20 bp, Homo sapiens
attgttgctgctgctgttga

SEQ ID NO: 9364853 - DNA, 22 bp, Homo sapiens
attgttgataatcgtgttgtca

SEQ ID NO: 9364854 - DNA, 22 bp, Homo sapiens
attgttgtctttacctgtattt

SEQ ID NO: 9364855 - DNA, 22 bp, Homo sapiens
attgttgggtctcactcctaga

SEQ ID NO: 9364856 - DNA, 22 bp, Homo sapiens
attgttctggatatttacattg

SEQ ID NO: 9364857 - DNA, 22 bp, Homo sapiens
attgttgaggagactcttcaat

SEQ ID NO: 9364858 - DNA, 22 bp, Homo sapiens
gcagtgcaggacaaatcagtgc

SEQ ID NO: 9364859 - DNA, 22 bp, Homo sapiens
gcagtgccacaagatgggagga

SEQ ID NO: 9364860 - DNA, 22 bp, Homo sapiens
gcagtgcatgtcggaactcatt

SEQ ID NO: 9364861 - DNA, 22 bp, Homo sapiens
gcagtgctaagtagctggccca

SEQ ID NO: 9364862 - DNA, 22 bp, Homo sapiens
gcagtgctaaggattctgcctt

SEQ ID NO: 9364863 - DNA, 18 bp, Homo sapiens
gcagtgccagcctctcct

SEQ ID NO: 9364864 - DNA, 22 bp, Homo sapiens
gcagtgctgatcccatggcaga

SEQ ID NO: 9364865 - DNA, 22 bp, Homo sapiens
gcagtgctagcctcacagggtc

SEQ ID NO: 9364866 - DNA, 22 bp, Homo sapiens
attgtacaagtttggttattta

SEQ ID NO: 9364867 - DNA, 22 bp, Homo sapiens
attgtacaagtttggttattta

SEQ ID NO: 9364868 - DNA, 22 bp, Homo sapiens
attgtacaatgcctggaacatt

SEQ ID NO: 9364869 - DNA, 22 bp, Homo sapiens
attgtacaatgctgaggtttgg

SEQ ID NO: 9364870 - DNA, 22 bp, Homo sapiens
attgtacaatgcctggaacatt

SEQ ID NO: 9364871 - DNA, 22 bp, Homo sapiens
gcagtgattggatcagagatgg

SEQ ID NO: 9364872 - DNA, 22 bp, Homo sapiens
attgtacaatgctgaggtttgg

SEQ ID NO: 9364873 - DNA, 22 bp, Homo sapiens
attgtacaatgcctggaacatt

SEQ ID NO: 9364874 - DNA, 21 bp, Homo sapiens
gcagtgcagcttggagggtag

SEQ ID NO: 9364875 - DNA, 21 bp, Homo sapiens
gcagtgcagcttggagggtag

SEQ ID NO: 9364876 - DNA, 22 bp, Homo sapiens
attgtacaatgctgaggtttgg

SEQ ID NO: 9364877 - DNA, 22 bp, Homo sapiens
attgtaaatagtgccacaataa

SEQ ID NO: 9364878 - DNA, 22 bp, Homo sapiens
attggttttgttatctccattc

SEQ ID NO: 9364879 - DNA, 22 bp, Homo sapiens
attggcagggccagcatctccc

SEQ ID NO: 9364880 - DNA, 15 bp, Homo sapiens
gcaggtggatcactt

SEQ ID NO: 9364881 - DNA, 22 bp, Homo sapiens
attggcaggaaccgaggagggg

SEQ ID NO: 9364882 - DNA, 22 bp, Homo sapiens
attggtggtgaggacatgccag

SEQ ID NO: 9364883 - DNA, 22 bp, Homo sapiens
attggcagttagtgacgaggct

SEQ ID NO: 9364884 - DNA, 22 bp, Homo sapiens
gcaggtggatcacctgaggtca

SEQ ID NO: 9364885 - DNA, 16 bp, Homo sapiens
gcaggtggatcacctg

SEQ ID NO: 9364886 - DNA, 16 bp, Homo sapiens
gcaggtggatcacctg

SEQ ID NO: 9364887 - DNA, 22 bp, Homo sapiens
gcaggtggatcacctgaggtca

SEQ ID NO: 9364888 - DNA, 22 bp, Homo sapiens
gcaggtggatcacctgaggtca

SEQ ID NO: 9364889 - DNA, 15 bp, Homo sapiens
gcaggtggatcactt

SEQ ID NO: 9364890 - DNA, 14 bp, Homo sapiens
gcaggtggatcact

SEQ ID NO: 9364891 - DNA, 14 bp, Homo sapiens
gcaggtggatcact

SEQ ID NO: 9364892 - DNA, 22 bp, Homo sapiens
gcaggtggatcacctgaggtca

SEQ ID NO: 9364893 - DNA, 22 bp, Homo sapiens
gcaggtggatcacctgaggtca

SEQ ID NO: 9364894 - DNA, 22 bp, Homo sapiens
gcaggtggatcacctgaggtca

SEQ ID NO: 9364895 - DNA, 22 bp, Homo sapiens
gcaggtggatattgctacttga

SEQ ID NO: 9364896 - DNA, 22 bp, Homo sapiens
gcaggtggatattgctacttga

SEQ ID NO: 9364897 - DNA, 22 bp, Homo sapiens
gcaggtggatattgctacttga

SEQ ID NO: 9364898 - DNA, 22 bp, Homo sapiens
gcaggtggatattgctacttga

SEQ ID NO: 9364899 - DNA, 22 bp, Homo sapiens
gcagggtgaaggtcacatagaa

SEQ ID NO: 9364900 - DNA, 22 bp, Homo sapiens
gcaggtggatcaccacgtcagg

SEQ ID NO: 9364901 - DNA, 22 bp, Homo sapiens
gcaggtggatcaccacgtcagg

SEQ ID NO: 9364902 - DNA, 14 bp, Homo sapiens
gcaggtggatcacc

SEQ ID NO: 9364903 - DNA, 22 bp, Homo sapiens
gcaggtggatcaccacgtcagg

SEQ ID NO: 9364904 - DNA, 22 bp, Homo sapiens
gcaggtggatcaccacgtcagg

SEQ ID NO: 9364905 - DNA, 14 bp, Homo sapiens
gcaggtggatcacc

SEQ ID NO: 9364906 - DNA, 22 bp, Homo sapiens
gcaggtggatcaccacgtcagg

SEQ ID NO: 9364907 - DNA, 22 bp, Homo sapiens
gcaggtggatcaccacgtcagg

SEQ ID NO: 9364908 - DNA, 22 bp, Homo sapiens
gcagggattgtcaatgctgctc

SEQ ID NO: 9364909 - DNA, 22 bp, Homo sapiens
gcagggctgggatttgagccca

SEQ ID NO: 9364910 - DNA, 22 bp, Homo sapiens
gcagggattgtgcagggggcta

SEQ ID NO: 9364911 - DNA, 22 bp, Homo sapiens
gcagggatgctgaggctcagtg

SEQ ID NO: 9364912 - DNA, 22 bp, Homo sapiens
gcagggattgtcaatgctgctc

SEQ ID NO: 9364913 - DNA, 22 bp, Homo sapiens
gcagggattgtcaatgctgctc

SEQ ID NO: 9364914 - DNA, 22 bp, Homo sapiens
gcagggatgctgaggctcagtg

SEQ ID NO: 9364915 - DNA, 22 bp, Homo sapiens
gcagggctggggctgctcctga

SEQ ID NO: 9364916 - DNA, 22 bp, Homo sapiens
gcagggctgggatttgagccca

SEQ ID NO: 9364917 - DNA, 22 bp, Homo sapiens
gcagggctgggatttgagccca

SEQ ID NO: 9364918 - DNA, 22 bp, Homo sapiens
gcaggggtagagattgctggtg

SEQ ID NO: 9364919 - DNA, 22 bp, Homo sapiens
gcaggggtggaggctgtcctgt

SEQ ID NO: 9364920 - DNA, 22 bp, Homo sapiens
gcaggggtagtgtcttcctgag

SEQ ID NO: 9364921 - DNA, 22 bp, Homo sapiens
gcaggggtagtgtcttcctgag

SEQ ID NO: 9364922 - DNA, 21 bp, Homo sapiens
gcagggtcctttccattccta

SEQ ID NO: 9364923 - DNA, 22 bp, Homo sapiens
gcagggtcttgagaggcagcca

SEQ ID NO: 9364924 - DNA, 22 bp, Homo sapiens
gcagggtcttgagaggcagcca

SEQ ID NO: 9364925 - DNA, 22 bp, Homo sapiens
gcagggtcttgagaggcagcca

SEQ ID NO: 9364926 - DNA, 22 bp, Homo sapiens
gcagggtccatggaggcagccc

SEQ ID NO: 9364927 - DNA, 22 bp, Homo sapiens
gcagggtccatggaggcagccc

SEQ ID NO: 9364928 - DNA, 22 bp, Homo sapiens
gcagggtccatggaggcagccc

SEQ ID NO: 9364929 - DNA, 22 bp, Homo sapiens
gcaggggttttctgacttgagt

SEQ ID NO: 9364930 - DNA, 22 bp, Homo sapiens
gcagggtacattgggatgggat

SEQ ID NO: 9364931 - DNA, 22 bp, Homo sapiens
gcagggtaggtgacaggtagtc

SEQ ID NO: 9364932 - DNA, 22 bp, Homo sapiens
gcaggagcagtcaggggcagct

SEQ ID NO: 9364933 - DNA, 22 bp, Homo sapiens
gcaggatgaactaacacctgca

SEQ ID NO: 9364934 - DNA, 23 bp, Homo sapiens
gcaggagttcctggactccagga

SEQ ID NO: 9364935 - DNA, 22 bp, Homo sapiens
gcaggatgaactaacacctgca

SEQ ID NO: 9364936 - DNA, 22 bp, Homo sapiens
gcaggatgaactaacacctgca

SEQ ID NO: 9364937 - DNA, 22 bp, Homo sapiens
gcaggatgggagcttcactttg

SEQ ID NO: 9364938 - DNA, 22 bp, Homo sapiens
gcaggatgggagcttcactctg

SEQ ID NO: 9364939 - DNA, 22 bp, Homo sapiens
gcaggatgccagggcagcagcg

SEQ ID NO: 9364940 - DNA, 22 bp, Homo sapiens
gcaggatgccagggcagcagcg

SEQ ID NO: 9364941 - DNA, 22 bp, Homo sapiens
gcaggatgccagggcagcagcg

SEQ ID NO: 9364942 - DNA, 22 bp, Homo sapiens
gcaggatgaaggcagaggctga

SEQ ID NO: 9364943 - DNA, 22 bp, Homo sapiens
gcaggatgaaggcagaggctga

SEQ ID NO: 9364944 - DNA, 21 bp, Homo sapiens
gcaggatgcatcttggtgtct

SEQ ID NO: 9364945 - DNA, 22 bp, Homo sapiens
gcaggatgcaacagcttgtagt

SEQ ID NO: 9364946 - DNA, 22 bp, Homo sapiens
gcaggatgagtgagtacattta

SEQ ID NO: 9364947 - DNA, 22 bp, Homo sapiens
gcaggcgtgtttcacgtgccag

SEQ ID NO: 9364948 - DNA, 14 bp, Homo sapiens
gcaggcggatcact

SEQ ID NO: 9364949 - DNA, 22 bp, Homo sapiens
gcaggcggatcactggaagtca

SEQ ID NO: 9364950 - DNA, 22 bp, Homo sapiens
gcaggatgggtgtagcccagca

SEQ ID NO: 9364951 - DNA, 22 bp, Homo sapiens
gcaggatggtggaaggcctgct

SEQ ID NO: 9364952 - DNA, 22 bp, Homo sapiens
gcaggatggtgccctttctgcc

SEQ ID NO: 9364953 - DNA, 22 bp, Homo sapiens
gcaggctgtctaaagttagagt

SEQ ID NO: 9364954 - DNA, 22 bp, Homo sapiens
gcaggctgtctaaagttagagt

SEQ ID NO: 9364955 - DNA, 22 bp, Homo sapiens
gcaggctgtagacaccaaacta

SEQ ID NO: 9364956 - DNA, 22 bp, Homo sapiens
gcaggctggtctgaccatccct

SEQ ID NO: 9364957 - DNA, 22 bp, Homo sapiens
gcaggctgtgaggctcagatgg

SEQ ID NO: 9364958 - DNA, 22 bp, Homo sapiens
gcaggctgtgaggctcagatgg

SEQ ID NO: 9364959 - DNA, 22 bp, Homo sapiens
gcaggctgtgaggctcagatgg

SEQ ID NO: 9364960 - DNA, 22 bp, Homo sapiens
gcaggctgtctaaagttagagt

SEQ ID NO: 9364961 - DNA, 22 bp, Homo sapiens
gcaggctgtctaaagttagagt

SEQ ID NO: 9364962 - DNA, 22 bp, Homo sapiens
gcaggctgtggtatgttgggca

SEQ ID NO: 9364963 - DNA, 22 bp, Homo sapiens
gcaggctgtgaggctcagatgg

SEQ ID NO: 9364964 - DNA, 22 bp, Homo sapiens
gcaggctgtgaggctcagatgg

SEQ ID NO: 9364965 - DNA, 22 bp, Homo sapiens
gcaggctgtgaggctcagatgg

SEQ ID NO: 9364966 - DNA, 22 bp, Homo sapiens
gcagggactgtgatctcacaga

SEQ ID NO: 9364967 - DNA, 22 bp, Homo sapiens
gcagggactgtgatctcacaga

SEQ ID NO: 9364968 - DNA, 22 bp, Homo sapiens
gcagggacgccagggacagcaa

SEQ ID NO: 9364969 - DNA, 22 bp, Homo sapiens
gcaggctgtggtatgttgggca

SEQ ID NO: 9364970 - DNA, 22 bp, Homo sapiens
gcagggactttggcaacaggtg

SEQ ID NO: 9364971 - DNA, 22 bp, Homo sapiens
gcagccaggctacagcgggctt

SEQ ID NO: 9364972 - DNA, 22 bp, Homo sapiens
gcagccaggctacagcgggctt

SEQ ID NO: 9364973 - DNA, 22 bp, Homo sapiens
gcagccagggagagaaccaggg

SEQ ID NO: 9364974 - DNA, 22 bp, Homo sapiens
gcagccagggagagaaccaggg

SEQ ID NO: 9364975 - DNA, 22 bp, Homo sapiens
gcagccagggctaagctgggga

SEQ ID NO: 9364976 - DNA, 22 bp, Homo sapiens
gcagccagggctaagctgggga

SEQ ID NO: 9364977 - DNA, 22 bp, Homo sapiens
gcagccagggctaagctgggga

SEQ ID NO: 9364978 - DNA, 19 bp, Homo sapiens
gcagccaggtgctctacct

SEQ ID NO: 9364979 - DNA, 22 bp, Homo sapiens
gcagccagggttaattatattt

SEQ ID NO: 9364980 - DNA, 22 bp, Homo sapiens
gcagccaggggctgtgacctgt

SEQ ID NO: 9364981 - DNA, 22 bp, Homo sapiens
gcagccaggtttgaggaccact

SEQ ID NO: 9364982 - DNA, 22 bp, Homo sapiens
gcagccaggtttgaggaccact

SEQ ID NO: 9364983 - DNA, 22 bp, Homo sapiens
gcagatgcaactgcaggtgagt

SEQ ID NO: 9364984 - DNA, 19 bp, Homo sapiens
gcagatgatgaggctggtc

SEQ ID NO: 9364985 - DNA, 22 bp, Homo sapiens
gcagcaggtccgcatcatcatc

SEQ ID NO: 9364986 - DNA, 22 bp, Homo sapiens
gcagcaggtctgtcaatgtcat

SEQ ID NO: 9364987 - DNA, 22 bp, Homo sapiens
gcagcaggtccgcatcatcatc

SEQ ID NO: 9364988 - DNA, 22 bp, Homo sapiens
gcagccaggaagcctttccctc

SEQ ID NO: 9364989 - DNA, 21 bp, Homo sapiens
gcagccaggactttgggctgg

SEQ ID NO: 9364990 - DNA, 22 bp, Homo sapiens
gcagcctgggcaacagagtgag

SEQ ID NO: 9364991 - DNA, 22 bp, Homo sapiens
gcagcctgttgtaccagcctgt

SEQ ID NO: 9364992 - DNA, 22 bp, Homo sapiens
gcagcctgggcaacagagtgag

SEQ ID NO: 9364993 - DNA, 17 bp, Homo sapiens
gcagcctcttggtagtg

SEQ ID NO: 9364994 - DNA, 22 bp, Homo sapiens
gcagccaggtttgaggaccact

SEQ ID NO: 9364995 - DNA, 22 bp, Homo sapiens
gcaggagagtctgtgccaggtt

SEQ ID NO: 9364996 - DNA, 22 bp, Homo sapiens
gcaggagagtctgtgccaggtt

SEQ ID NO: 9364997 - DNA, 18 bp, Homo sapiens
gcaggagatgggtggggt

SEQ ID NO: 9364998 - DNA, 18 bp, Homo sapiens
gcaggagatgggtggggt

SEQ ID NO: 9364999 - DNA, 22 bp, Homo sapiens
gcaggagagtctgtgccaggtt

SEQ ID NO: 9365000 - DNA, 22 bp, Homo sapiens
gcaggagagtctgtgccaggtt

SEQ ID NO: 9365001 - DNA, 22 bp, Homo sapiens
gcaggagagtctgtgccaggtt

SEQ ID NO: 9365002 - DNA, 22 bp, Homo sapiens
gcaggagagtctgtgccaggtt

SEQ ID NO: 9365003 - DNA, 22 bp, Homo sapiens
gcagccttccgtggacctggac

SEQ ID NO: 9365004 - DNA, 22 bp, Homo sapiens
gcagccttggttgtgagatgaa

SEQ ID NO: 9365005 - DNA, 22 bp, Homo sapiens
gcagccttatcattagagtgtt

SEQ ID NO: 9365006 - DNA, 22 bp, Homo sapiens
gcagctttaaaggaggctctga

SEQ ID NO: 9365007 - DNA, 22 bp, Homo sapiens
gcagctttaaacattggaaata

SEQ ID NO: 9365008 - DNA, 22 bp, Homo sapiens
gcagctttctaagctttattgc

SEQ ID NO: 9365009 - DNA, 22 bp, Homo sapiens
gcagaaggttgtttgggaaagg

SEQ ID NO: 9365010 - DNA, 22 bp, Homo sapiens
gcagaaggttgtttgggaaagg

SEQ ID NO: 9365011 - DNA, 22 bp, Homo sapiens
gcagaaggtcaaagcaagatgt

SEQ ID NO: 9365012 - DNA, 22 bp, Homo sapiens
gcagaagggaataaggagcttt

SEQ ID NO: 9365013 - DNA, 22 bp, Homo sapiens
gcactgtgacccagagcaggtg

SEQ ID NO: 9365014 - DNA, 22 bp, Homo sapiens
gcagaagggaataaggagcttt

SEQ ID NO: 9365015 - DNA, 22 bp, Homo sapiens
gcagaatgtccaagctgggccc

SEQ ID NO: 9365016 - DNA, 22 bp, Homo sapiens
gcagaatactgagagctgattg

SEQ ID NO: 9365017 - DNA, 16 bp, Homo sapiens
gcagaggaaaggggag

SEQ ID NO: 9365018 - DNA, 16 bp, Homo sapiens
gcagaggaaaggggag

SEQ ID NO: 9365019 - DNA, 22 bp, Homo sapiens
gcagaattgaaatgtgtcactt

SEQ ID NO: 9365020 - DNA, 22 bp, Homo sapiens
gcagaggcctaggtggaaggcc

SEQ ID NO: 9365021 - DNA, 22 bp, Homo sapiens
gcagatagggtattaggagtaa

SEQ ID NO: 9365022 - DNA, 22 bp, Homo sapiens
gcagagtttgaagtcaagatgt

SEQ ID NO: 9365023 - DNA, 19 bp, Homo sapiens
gcagatgatgaggctggtc

SEQ ID NO: 9365024 - DNA, 22 bp, Homo sapiens
gcagaggggaagctgaggaatt

SEQ ID NO: 9365025 - DNA, 22 bp, Homo sapiens
gcagaggcctgaaggtggcggg

SEQ ID NO: 9365026 - DNA, 22 bp, Homo sapiens
gcagaggcctgaaggtggcggg

SEQ ID NO: 9365027 - DNA, 22 bp, Homo sapiens
gcagaggctctttaatgcttag

SEQ ID NO: 9365028 - DNA, 22 bp, Homo sapiens
gcagaggctgtagggaaggttg

SEQ ID NO: 9365029 - DNA, 22 bp, Homo sapiens
gcagaggctgtagggaaggttg

SEQ ID NO: 9365030 - DNA, 22 bp, Homo sapiens
gcactgggggcagcagtgaggg

SEQ ID NO: 9365031 - DNA, 22 bp, Homo sapiens
gcactcaggactctcatcagta

SEQ ID NO: 9365032 - DNA, 22 bp, Homo sapiens
gcacagggccctgtgcgtaggt

SEQ ID NO: 9365033 - DNA, 22 bp, Homo sapiens
gcacagggcaacaggtctgtta

SEQ ID NO: 9365034 - DNA, 22 bp, Homo sapiens
gcacagggagcaggtctctggt

SEQ ID NO: 9365035 - DNA, 22 bp, Homo sapiens
gcacagggaggctggcctggcc

SEQ ID NO: 9365036 - DNA, 22 bp, Homo sapiens
gcactggggtcatagcctccag

SEQ ID NO: 9365037 - DNA, 22 bp, Homo sapiens
gcactgtgaatatactagcaaa

SEQ ID NO: 9365038 - DNA, 22 bp, Homo sapiens
gcacagggagacagccgtggcc

SEQ ID NO: 9365039 - DNA, 22 bp, Homo sapiens
gcacagaggatgaggcagctct

SEQ ID NO: 9365040 - DNA, 22 bp, Homo sapiens
gcacaggctctcttggggacac

SEQ ID NO: 9365041 - DNA, 22 bp, Homo sapiens
gcacaggctgttggccttcaga

SEQ ID NO: 9365042 - DNA, 23 bp, Homo sapiens
gcacagagcagttaggggaagat

SEQ ID NO: 9365043 - DNA, 23 bp, Homo sapiens
gcacagagcagttaggggaagat

SEQ ID NO: 9365044 - DNA, 22 bp, Homo sapiens
gcacagaggaagcacagactct

SEQ ID NO: 9365045 - DNA, 22 bp, Homo sapiens
gcacagaggaagcacagactct

SEQ ID NO: 9365046 - DNA, 22 bp, Homo sapiens
gcacagagctggccctccaggc

SEQ ID NO: 9365047 - DNA, 22 bp, Homo sapiens
gcaaattgctagctttctctgc

SEQ ID NO: 9365048 - DNA, 22 bp, Homo sapiens
gcaaattgggaaatttctctag

SEQ ID NO: 9365049 - DNA, 22 bp, Homo sapiens
gcaaattgggctgactcaaggt

SEQ ID NO: 9365050 - DNA, 22 bp, Homo sapiens
gcaaacaaggacatacatcctg

SEQ ID NO: 9365051 - DNA, 22 bp, Homo sapiens
gcaaacaagctgcctgaagatt

SEQ ID NO: 9365052 - DNA, 22 bp, Homo sapiens
gcaactgaacatgtgtgtggcc

SEQ ID NO: 9365053 - DNA, 22 bp, Homo sapiens
gcaactgaacatgtgtgtggcc

SEQ ID NO: 9365054 - DNA, 22 bp, Homo sapiens
gcaacattcatgttctgtaacc

SEQ ID NO: 9365055 - DNA, 22 bp, Homo sapiens
gcaacatcggtattggaggagt

SEQ ID NO: 9365056 - DNA, 22 bp, Homo sapiens
gcaacagcccaggttctgtgtg

SEQ ID NO: 9365057 - DNA, 22 bp, Homo sapiens
gatttctgggctttatttcaga

SEQ ID NO: 9365058 - DNA, 22 bp, Homo sapiens
atgtttctagagctttgtccca

SEQ ID NO: 9365059 - DNA, 22 bp, Homo sapiens
atgtttctagttgtatgtcact

SEQ ID NO: 9365060 - DNA, 22 bp, Homo sapiens
gcaaaagtacagccggatttct

SEQ ID NO: 9365061 - DNA, 22 bp, Homo sapiens
gcaaaaattccagggacgactc

SEQ ID NO: 9365062 - DNA, 22 bp, Homo sapiens
gcaaaaattccagggacgactc

SEQ ID NO: 9365063 - DNA, 20 bp, Homo sapiens
gcaaaataggctctgttggt

SEQ ID NO: 9365064 - DNA, 22 bp, Homo sapiens
caaattagaggtttgttttgat

SEQ ID NO: 9365065 - DNA, 22 bp, Homo sapiens
caaattcaatgaacatgtttaa

SEQ ID NO: 9365066 - DNA, 22 bp, Homo sapiens
caaattcaaatttcatcagtgt

SEQ ID NO: 9365067 - DNA, 22 bp, Homo sapiens
caaattcacatgattgcttctg

SEQ ID NO: 9365068 - DNA, 22 bp, Homo sapiens
caaatgaatttccctgcaaatg

SEQ ID NO: 9365069 - DNA, 22 bp, Homo sapiens
caaatgtgttttttcttctaca

SEQ ID NO: 9365070 - DNA, 22 bp, Homo sapiens
caaatgaagggagctgaagtct

SEQ ID NO: 9365071 - DNA, 22 bp, Homo sapiens
caaatgaagtccaaagggctta

SEQ ID NO: 9365072 - DNA, 22 bp, Homo sapiens
gctgagctgaggcagggctggg

SEQ ID NO: 9365073 - DNA, 22 bp, Homo sapiens
gctgagctgggacagtcctggg

SEQ ID NO: 9365074 - DNA, 22 bp, Homo sapiens
gctctggtaccagctactccta

SEQ ID NO: 9365075 - DNA, 22 bp, Homo sapiens
gctctggtctgcttatatctat

SEQ ID NO: 9365076 - DNA, 22 bp, Homo sapiens
gctctggtagatcctcaggctc

SEQ ID NO: 9365077 - DNA, 22 bp, Homo sapiens
gctctggtagatcctcaggctc

SEQ ID NO: 9365078 - DNA, 22 bp, Homo sapiens
gctctggttaaaaagaattaaa

SEQ ID NO: 9365079 - DNA, 22 bp, Homo sapiens
gctgagaaatgcagacatgctg

SEQ ID NO: 9365080 - DNA, 22 bp, Homo sapiens
gctctggtggtgatcagacgct

SEQ ID NO: 9365081 - DNA, 22 bp, Homo sapiens
gctctggtgagtgtagttcagg

SEQ ID NO: 9365082 - DNA, 22 bp, Homo sapiens
gctctggtgagtgtagttcagg

SEQ ID NO: 9365083 - DNA, 22 bp, Homo sapiens
gctctggtggtgatcagacgct

SEQ ID NO: 9365084 - DNA, 22 bp, Homo sapiens
gctgaggaagtcaggtggccca

SEQ ID NO: 9365085 - DNA, 22 bp, Homo sapiens
gctgaggaaaccaatgctcaga

SEQ ID NO: 9365086 - DNA, 22 bp, Homo sapiens
gctgaggaaaccaatgctcaga

SEQ ID NO: 9365087 - DNA, 22 bp, Homo sapiens
gctgaggaaaccaatgctcaga

SEQ ID NO: 9365088 - DNA, 22 bp, Homo sapiens
gctgaggacatacacattgtgc

SEQ ID NO: 9365089 - DNA, 22 bp, Homo sapiens
gctgaggaagtcaggtggccca

SEQ ID NO: 9365090 - DNA, 22 bp, Homo sapiens
gctgaggacatacacattgtgc

SEQ ID NO: 9365091 - DNA, 20 bp, Homo sapiens
gctgaggagcagtgtggttg

SEQ ID NO: 9365092 - DNA, 22 bp, Homo sapiens
caaatctatatgttgatattct

SEQ ID NO: 9365093 - DNA, 20 bp, Homo sapiens
caaatccctgctctgtgctg

SEQ ID NO: 9365094 - DNA, 22 bp, Homo sapiens
caaatcctggagccatggtaac

SEQ ID NO: 9365095 - DNA, 22 bp, Homo sapiens
caaatcatggctctagcttaca

SEQ ID NO: 9365096 - DNA, 20 bp, Homo sapiens
caaatccctgctctgtgctg

SEQ ID NO: 9365097 - DNA, 22 bp, Homo sapiens
caaatcatggctctagcttaca

SEQ ID NO: 9365098 - DNA, 22 bp, Homo sapiens
caaatcatggaataactagaga

SEQ ID NO: 9365099 - DNA, 22 bp, Homo sapiens
caaatcatggaataactagaga

SEQ ID NO: 9365100 - DNA, 22 bp, Homo sapiens
caaatcatggaataactagaga

SEQ ID NO: 9365101 - DNA, 22 bp, Homo sapiens
gctctgggtgaatggcagattg

SEQ ID NO: 9365102 - DNA, 22 bp, Homo sapiens
gctctgggtgaagggtaccatt

SEQ ID NO: 9365103 - DNA, 22 bp, Homo sapiens
gctctgggtgaatggcagattg

SEQ ID NO: 9365104 - DNA, 22 bp, Homo sapiens
gctctgggtgaacttggagcaa

SEQ ID NO: 9365105 - DNA, 22 bp, Homo sapiens
gctctgggtgaacttggagcaa

SEQ ID NO: 9365106 - DNA, 22 bp, Homo sapiens
gctctgggtgaacttggagcaa

SEQ ID NO: 9365107 - DNA, 22 bp, Homo sapiens
caaatattccaggtacatccct

SEQ ID NO: 9365108 - DNA, 22 bp, Homo sapiens
caaatattccaggtacatccct

SEQ ID NO: 9365109 - DNA, 22 bp, Homo sapiens
caaatattccaggtacatccct

SEQ ID NO: 9365110 - DNA, 22 bp, Homo sapiens
gctctgagaggtgcagcagtaa

SEQ ID NO: 9365111 - DNA, 22 bp, Homo sapiens
gctctgagaggtgcagcagtaa

SEQ ID NO: 9365112 - DNA, 22 bp, Homo sapiens
gctctgagaggtgcagcagtaa

SEQ ID NO: 9365113 - DNA, 19 bp, Homo sapiens
gctctgagaggggcatggg

SEQ ID NO: 9365114 - DNA, 19 bp, Homo sapiens
gctctgagaggggcatggg

SEQ ID NO: 9365115 - DNA, 19 bp, Homo sapiens
gctctgagaggggcatggg

SEQ ID NO: 9365116 - DNA, 22 bp, Homo sapiens
gctctgaatcaatcagataagg

SEQ ID NO: 9365117 - DNA, 20 bp, Homo sapiens
gctctgaccatatcaagaca

SEQ ID NO: 9365118 - DNA, 22 bp, Homo sapiens
gctctgaagggtgagctgttcg

SEQ ID NO: 9365119 - DNA, 22 bp, Homo sapiens
gctctgaagggtgagctgttcg

SEQ ID NO: 9365120 - DNA, 20 bp, Homo sapiens
gctctgaaccaagagctgtc

SEQ ID NO: 9365121 - DNA, 20 bp, Homo sapiens
gctctgaaccaagagctgtc

SEQ ID NO: 9365122 - DNA, 22 bp, Homo sapiens
gctctgagagctacacagggta

SEQ ID NO: 9365123 - DNA, 22 bp, Homo sapiens
gctctgagaggatgctgagcag

SEQ ID NO: 9365124 - DNA, 22 bp, Homo sapiens
gctctgagagctacacagggta

SEQ ID NO: 9365125 - DNA, 22 bp, Homo sapiens
gctctgagaggatgctgagcag

SEQ ID NO: 9365126 - DNA, 22 bp, Homo sapiens
gctctgagacagtagagatggc

SEQ ID NO: 9365127 - DNA, 22 bp, Homo sapiens
gctctgagacagtagagatggc

SEQ ID NO: 9365128 - DNA, 22 bp, Homo sapiens
gctctgagacagtagagatggc

SEQ ID NO: 9365129 - DNA, 22 bp, Homo sapiens
gctccaggcgagctggaccaga

SEQ ID NO: 9365130 - DNA, 17 bp, Homo sapiens
gctccaggcgtgagtga

SEQ ID NO: 9365131 - DNA, 22 bp, Homo sapiens
gctccaggccccagcgttccgc

SEQ ID NO: 9365132 - DNA, 22 bp, Homo sapiens
gctccaggcgagctggaccaga

SEQ ID NO: 9365133 - DNA, 22 bp, Homo sapiens
gctccaggccacggcttcttgg

SEQ ID NO: 9365134 - DNA, 22 bp, Homo sapiens
gctccaggccccagcgttccgc

SEQ ID NO: 9365135 - DNA, 22 bp, Homo sapiens
gctccaggcagcatagtggatg

SEQ ID NO: 9365136 - DNA, 22 bp, Homo sapiens
gctccaggcagcatagtggatg

SEQ ID NO: 9365137 - DNA, 20 bp, Homo sapiens
gctcaggtttgggctttgtg

SEQ ID NO: 9365138 - DNA, 18 bp, Homo sapiens
gctcaggtatagacaggg

SEQ ID NO: 9365139 - DNA, 18 bp, Homo sapiens
gctcaggtatagacaggg

SEQ ID NO: 9365140 - DNA, 18 bp, Homo sapiens
gctcaggtatagacaggg

SEQ ID NO: 9365141 - DNA, 22 bp, Homo sapiens
gctcaggtcttacccatgcctg

SEQ ID NO: 9365142 - DNA, 18 bp, Homo sapiens
gctcaggtatagacaggg

SEQ ID NO: 9365143 - DNA, 22 bp, Homo sapiens
gctcaggtcttacccatgcctg

SEQ ID NO: 9365144 - DNA, 22 bp, Homo sapiens
gctcagggtgcagtgtccatga

SEQ ID NO: 9365145 - DNA, 22 bp, Homo sapiens
gctcaggtagatggggttgtcc

SEQ ID NO: 9365146 - DNA, 23 bp, Homo sapiens
gctcaggtggctcagggactgat

SEQ ID NO: 9365147 - DNA, 20 bp, Homo sapiens
gctcaggtgacagtcaggag

SEQ ID NO: 9365148 - DNA, 20 bp, Homo sapiens
gctcaggtgacagtcaggag

SEQ ID NO: 9365149 - DNA, 20 bp, Homo sapiens
gctcaggtgacagtcaggag

SEQ ID NO: 9365150 - DNA, 22 bp, Homo sapiens
gctcaggtgttacctcctctag

SEQ ID NO: 9365151 - DNA, 23 bp, Homo sapiens
gctcaggtggctcagggactgat

SEQ ID NO: 9365152 - DNA, 23 bp, Homo sapiens
gctcaggtggctcagggactgat

SEQ ID NO: 9365153 - DNA, 20 bp, Homo sapiens
gctcaggtttgggctttgtg

SEQ ID NO: 9365154 - DNA, 22 bp, Homo sapiens
gctcaggtgttacctcctctag

SEQ ID NO: 9365155 - DNA, 22 bp, Homo sapiens
gctcaggtgttacctcctctag

SEQ ID NO: 9365156 - DNA, 22 bp, Homo sapiens
gctcaggggaatgggctgccgt

SEQ ID NO: 9365157 - DNA, 22 bp, Homo sapiens
gctcaggggaatgggctgccgt

SEQ ID NO: 9365158 - DNA, 22 bp, Homo sapiens
gctcagggctaaggctgagggg

SEQ ID NO: 9365159 - DNA, 22 bp, Homo sapiens
gctcagggtcccttggtgctgg

SEQ ID NO: 9365160 - DNA, 22 bp, Homo sapiens
gctcagggtcccttggtgctgg

SEQ ID NO: 9365161 - DNA, 22 bp, Homo sapiens
gctcagggtcccttggtgctgg

SEQ ID NO: 9365162 - DNA, 22 bp, Homo sapiens
gctccaggctgctctgtcccat

SEQ ID NO: 9365163 - DNA, 22 bp, Homo sapiens
gctccaggctgctctgtcccat

SEQ ID NO: 9365164 - DNA, 17 bp, Homo sapiens
gctccaggcgtgagtga

SEQ ID NO: 9365165 - DNA, 17 bp, Homo sapiens
gctccaggcgtgagtga

SEQ ID NO: 9365166 - DNA, 22 bp, Homo sapiens
gctcctggatgttcaagtcggc

SEQ ID NO: 9365167 - DNA, 22 bp, Homo sapiens
gctcctggatgttcaagtcggc

SEQ ID NO: 9365168 - DNA, 22 bp, Homo sapiens
gctccaggctgctctgtcccat

SEQ ID NO: 9365169 - DNA, 22 bp, Homo sapiens
gctccagggaacagaatgtact

SEQ ID NO: 9365170 - DNA, 22 bp, Homo sapiens
gctcgtacaccagcgtggaggt

SEQ ID NO: 9365171 - DNA, 22 bp, Homo sapiens
gctcggtggccagcctgaggcc

SEQ ID NO: 9365172 - DNA, 22 bp, Homo sapiens
gctcggagtcccacctgggaaa

SEQ ID NO: 9365173 - DNA, 22 bp, Homo sapiens
gctcggagaactgggggctccg

SEQ ID NO: 9365174 - DNA, 22 bp, Homo sapiens
gctccttctggctcccttttgg

SEQ ID NO: 9365175 - DNA, 17 bp, Homo sapiens
gctccttctaacttcca

SEQ ID NO: 9365176 - DNA, 22 bp, Homo sapiens
gctctaggagaggggcagtcca

SEQ ID NO: 9365177 - DNA, 22 bp, Homo sapiens
gctctaggagaggggcagtcca

SEQ ID NO: 9365178 - DNA, 22 bp, Homo sapiens
gctctagctggcgctgacctgg

SEQ ID NO: 9365179 - DNA, 22 bp, Homo sapiens
gctctagctggcgctgacctgg

SEQ ID NO: 9365180 - DNA, 22 bp, Homo sapiens
gctctagcaaggctggcctggg

SEQ ID NO: 9365181 - DNA, 22 bp, Homo sapiens
gctctagcccatttcctgcttg

SEQ ID NO: 9365182 - DNA, 22 bp, Homo sapiens
gctctagcaaggctggcctggg

SEQ ID NO: 9365183 - DNA, 22 bp, Homo sapiens
gctctagatcataggtcattat

SEQ ID NO: 9365184 - DNA, 22 bp, Homo sapiens
gctctatgaatcacacgagggt

SEQ ID NO: 9365185 - DNA, 20 bp, Homo sapiens
gctctgaaccaagagctgtc

SEQ ID NO: 9365186 - DNA, 22 bp, Homo sapiens
gctctgaaaaatggaggttggc

SEQ ID NO: 9365187 - DNA, 22 bp, Homo sapiens
gctctaggttcctagccaagtc

SEQ ID NO: 9365188 - DNA, 22 bp, Homo sapiens
gctctaggttcctagccaagtc

SEQ ID NO: 9365189 - DNA, 22 bp, Homo sapiens
gctctagacagaaagaccagtg

SEQ ID NO: 9365190 - DNA, 22 bp, Homo sapiens
gctctagaaagaaggatgtggg

SEQ ID NO: 9365191 - DNA, 18 bp, Homo sapiens
gctctaattttagaaagg

SEQ ID NO: 9365192 - DNA, 22 bp, Homo sapiens
gctctaattgaaaaatactgca

SEQ ID NO: 9365193 - DNA, 20 bp, Homo sapiens
gctctaaagccacagattga

SEQ ID NO: 9365194 - DNA, 22 bp, Homo sapiens
gctcagggctaaggctgagggg

SEQ ID NO: 9365195 - DNA, 22 bp, Homo sapiens
gctcagggctaaggctgagggg

SEQ ID NO: 9365196 - DNA, 23 bp, Homo sapiens
gctcaggcatcattcttcctggc

SEQ ID NO: 9365197 - DNA, 23 bp, Homo sapiens
gctcaggcatcattcttcctggc

SEQ ID NO: 9365198 - DNA, 23 bp, Homo sapiens
gctcaggcatcattcttcctggc

SEQ ID NO: 9365199 - DNA, 22 bp, Homo sapiens
gctatttttgagccatttataa

SEQ ID NO: 9365200 - DNA, 22 bp, Homo sapiens
gctatttttgagccatttataa

SEQ ID NO: 9365201 - DNA, 22 bp, Homo sapiens
gctatttttgagccatttataa

SEQ ID NO: 9365202 - DNA, 22 bp, Homo sapiens
gctatttattaaaatggtgaag

SEQ ID NO: 9365203 - DNA, 22 bp, Homo sapiens
gctaataattcctttgtgaact

SEQ ID NO: 9365204 - DNA, 22 bp, Homo sapiens
gctaataattcctttgtgaact

SEQ ID NO: 9365205 - DNA, 22 bp, Homo sapiens
gctatgcaggagcctaatgaca

SEQ ID NO: 9365206 - DNA, 22 bp, Homo sapiens
gctatgggatgtgctgtggatg

SEQ ID NO: 9365207 - DNA, 22 bp, Homo sapiens
gctattgtacatttcttgtttg

SEQ ID NO: 9365208 - DNA, 22 bp, Homo sapiens
gctattgcaggttaccttatcc

SEQ ID NO: 9365209 - DNA, 22 bp, Homo sapiens
gcctggctcctaagagcacaac

SEQ ID NO: 9365210 - DNA, 22 bp, Homo sapiens
gcctggctcctaaggactggct

SEQ ID NO: 9365211 - DNA, 22 bp, Homo sapiens
gcctggctcctaagagcacaac

SEQ ID NO: 9365212 - DNA, 22 bp, Homo sapiens
gcctggctcctaaggactggct

SEQ ID NO: 9365213 - DNA, 22 bp, Homo sapiens
gcctggctcctaaggactggct

SEQ ID NO: 9365214 - DNA, 22 bp, Homo sapiens
gcgcaggtgatgcgtctgcctt

SEQ ID NO: 9365215 - DNA, 22 bp, Homo sapiens
gcgcaggtgctgctggagcagc

SEQ ID NO: 9365216 - DNA, 22 bp, Homo sapiens
gcgcaggagccgcggagggccg

SEQ ID NO: 9365217 - DNA, 22 bp, Homo sapiens
gcgcaggcccgggtcagggccg

SEQ ID NO: 9365218 - DNA, 21 bp, Homo sapiens
gcctggctctcactggcctgg

SEQ ID NO: 9365219 - DNA, 22 bp, Homo sapiens
gcctggctctgagggagctcct

SEQ ID NO: 9365220 - DNA, 22 bp, Homo sapiens
gcgtggggtaggtagacatgga

SEQ ID NO: 9365221 - DNA, 22 bp, Homo sapiens
gcgtggggtaggtagacatgga

SEQ ID NO: 9365222 - DNA, 22 bp, Homo sapiens
gcgccccatctacagtactttt

SEQ ID NO: 9365223 - DNA, 22 bp, Homo sapiens
gctaagaattctgagcagctga

SEQ ID NO: 9365224 - DNA, 22 bp, Homo sapiens
gctaagaggagcctccttctga

SEQ ID NO: 9365225 - DNA, 22 bp, Homo sapiens
gctaagaggctatatctttctc

SEQ ID NO: 9365226 - DNA, 22 bp, Homo sapiens
gctaaggccttaactcatggag

SEQ ID NO: 9365227 - DNA, 22 bp, Homo sapiens
gctaaggcacaaatagctttgc

SEQ ID NO: 9365228 - DNA, 22 bp, Homo sapiens
gctaaataatcttcttctgaca

SEQ ID NO: 9365229 - DNA, 22 bp, Homo sapiens
gctaaaataactgagtttttgc

SEQ ID NO: 9365230 - DNA, 22 bp, Homo sapiens
gcctggctcacagagcagcctt

SEQ ID NO: 9365231 - DNA, 22 bp, Homo sapiens
gcctggctcacagagcagcctt

SEQ ID NO: 9365232 - DNA, 22 bp, Homo sapiens
gcctggctccctctgcagctcc

SEQ ID NO: 9365233 - DNA, 22 bp, Homo sapiens
gcctggctcctaagagcacaac

SEQ ID NO: 9365234 - DNA, 18 bp, Homo sapiens
attttgaactgggaatat

SEQ ID NO: 9365235 - DNA, 22 bp, Homo sapiens
attttctgtgtgcagataaata

SEQ ID NO: 9365236 - DNA, 22 bp, Homo sapiens
attttctgtgtgcagataaata

SEQ ID NO: 9365237 - DNA, 22 bp, Homo sapiens
attttctagatagatgatgcat

SEQ ID NO: 9365238 - DNA, 22 bp, Homo sapiens
attttcttctctccctggctgc

SEQ ID NO: 9365239 - DNA, 22 bp, Homo sapiens
attttgaaaccaagttatttcc

SEQ ID NO: 9365240 - DNA, 22 bp, Homo sapiens
gcctgcccacggggctggcata

SEQ ID NO: 9365241 - DNA, 22 bp, Homo sapiens
attttactaagtggatatctgt

SEQ ID NO: 9365242 - DNA, 22 bp, Homo sapiens
attttactaagtggatatctgt

SEQ ID NO: 9365243 - DNA, 18 bp, Homo sapiens
gcctgccatccccacagc

SEQ ID NO: 9365244 - DNA, 22 bp, Homo sapiens
attttacataaggaaggtttaa

SEQ ID NO: 9365245 - DNA, 22 bp, Homo sapiens
attttacataaggaaggtttaa

SEQ ID NO: 9365246 - DNA, 23 bp, Homo sapiens
attttacaggtcagttccttgaa

SEQ ID NO: 9365247 - DNA, 23 bp, Homo sapiens
attttacaggtcagttccttgaa

SEQ ID NO: 9365248 - DNA, 23 bp, Homo sapiens
attttacaggtcagttccttgaa

SEQ ID NO: 9365249 - DNA, 23 bp, Homo sapiens
attttacaggtcagttccttgaa

SEQ ID NO: 9365250 - DNA, 23 bp, Homo sapiens
attttacaggtcagttccttgaa

SEQ ID NO: 9365251 - DNA, 22 bp, Homo sapiens
gcctgccccttcctgggcaggg

SEQ ID NO: 9365252 - DNA, 21 bp, Homo sapiens
gcctgccccatgtttctgttg

SEQ ID NO: 9365253 - DNA, 22 bp, Homo sapiens
gcctgccccttcctgggcaggg

SEQ ID NO: 9365254 - DNA, 22 bp, Homo sapiens
gcctgccccttcctgggcaggg

SEQ ID NO: 9365255 - DNA, 21 bp, Homo sapiens
gcctgccctctgtgatggcca

SEQ ID NO: 9365256 - DNA, 21 bp, Homo sapiens
gcctgccctctgtgatggcca

SEQ ID NO: 9365257 - DNA, 22 bp, Homo sapiens
gcctgccctgaaagaggtgaag

SEQ ID NO: 9365258 - DNA, 22 bp, Homo sapiens
gcctgcctagaattgcagcttt

SEQ ID NO: 9365259 - DNA, 18 bp, Homo sapiens
gcctgcctagagcttgcc

SEQ ID NO: 9365260 - DNA, 22 bp, Homo sapiens
gcctgcctagaattgcagcttt

SEQ ID NO: 9365261 - DNA, 23 bp, Homo sapiens
gcctgccgcctggctgagaactg

SEQ ID NO: 9365262 - DNA, 23 bp, Homo sapiens
gcctgccgcctggctgagaactg

SEQ ID NO: 9365263 - DNA, 22 bp, Homo sapiens
attttaataagattcccaagta

SEQ ID NO: 9365264 - DNA, 22 bp, Homo sapiens
attttaaggcttatttaaaggc

SEQ ID NO: 9365265 - DNA, 22 bp, Homo sapiens
attttaaggcttatttaaaggc

SEQ ID NO: 9365266 - DNA, 22 bp, Homo sapiens
atttgtctgcttgctgccttcc

SEQ ID NO: 9365267 - DNA, 22 bp, Homo sapiens
atttgtcttcagtaggttcttc

SEQ ID NO: 9365268 - DNA, 22 bp, Homo sapiens
atttgtctttggacctgtgaga

SEQ ID NO: 9365269 - DNA, 22 bp, Homo sapiens
attttaaggcttatttaaaggc

SEQ ID NO: 9365270 - DNA, 23 bp, Homo sapiens
attttaaccttgactaacatgca

SEQ ID NO: 9365271 - DNA, 23 bp, Homo sapiens
attttaaccttgactaacatgca

SEQ ID NO: 9365272 - DNA, 22 bp, Homo sapiens
atttgcctttcgaatcaacagg

SEQ ID NO: 9365273 - DNA, 22 bp, Homo sapiens
atttgcctgtaagacaaggcct

SEQ ID NO: 9365274 - DNA, 22 bp, Homo sapiens
atttgccttactgaagaaggag

SEQ ID NO: 9365275 - DNA, 22 bp, Homo sapiens
atttgcatttacatagcataga

SEQ ID NO: 9365276 - DNA, 22 bp, Homo sapiens
atttgcatatctgatagactaa

SEQ ID NO: 9365277 - DNA, 22 bp, Homo sapiens
atttgcagttattgttcatgaa

SEQ ID NO: 9365278 - DNA, 22 bp, Homo sapiens
atttgcaggtgtcgattagtct

SEQ ID NO: 9365279 - DNA, 22 bp, Homo sapiens
atttgcaggtgtcgattagtct

SEQ ID NO: 9365280 - DNA, 22 bp, Homo sapiens
atttgcaattttactttgcagt

SEQ ID NO: 9365281 - DNA, 22 bp, Homo sapiens
atttgcacatagtattatcttt

SEQ ID NO: 9365282 - DNA, 18 bp, Homo sapiens
atttgcaggcatgcaggc

SEQ ID NO: 9365283 - DNA, 22 bp, Homo sapiens
atttgcagattctgtcaggttt

SEQ ID NO: 9365284 - DNA, 22 bp, Homo sapiens
atttgcaattactcatgtcatt

SEQ ID NO: 9365285 - DNA, 22 bp, Homo sapiens
atttgcaagagtaagaatttct

SEQ ID NO: 9365286 - DNA, 22 bp, Homo sapiens
atttgatttgtagatagtgtag

SEQ ID NO: 9365287 - DNA, 22 bp, Homo sapiens
atttgcaaagtcgtatctgtga

SEQ ID NO: 9365288 - DNA, 23 bp, Homo sapiens
atttgagaaagtatttttaagac

SEQ ID NO: 9365289 - DNA, 22 bp, Homo sapiens
atttgaggatagttgggtactc

SEQ ID NO: 9365290 - DNA, 22 bp, Homo sapiens
atttgatttgtagatagtgtag

SEQ ID NO: 9365291 - DNA, 22 bp, Homo sapiens
atttgattagctgtgtaatttt

SEQ ID NO: 9365292 - DNA, 22 bp, Homo sapiens
atttgattagctgtgtaatttt

SEQ ID NO: 9365293 - DNA, 22 bp, Homo sapiens
atttcttgattccaccagtgaa

SEQ ID NO: 9365294 - DNA, 22 bp, Homo sapiens
atttgacattgacacacctatg

SEQ ID NO: 9365295 - DNA, 22 bp, Homo sapiens
atttgacattattctctcagtc

SEQ ID NO: 9365296 - DNA, 23 bp, Homo sapiens
atttgacagagcatagcatttct

SEQ ID NO: 9365297 - DNA, 23 bp, Homo sapiens
atttgacagagcatagcatttct

SEQ ID NO: 9365298 - DNA, 22 bp, Homo sapiens
atttgacattgacacacctatg

SEQ ID NO: 9365299 - DNA, 22 bp, Homo sapiens
atttgagaaaggagggaacttt

SEQ ID NO: 9365300 - DNA, 22 bp, Homo sapiens
gccctgccctgttgaaactaga

SEQ ID NO: 9365301 - DNA, 23 bp, Homo sapiens
gccctgcccttagcacactcaca

SEQ ID NO: 9365302 - DNA, 22 bp, Homo sapiens
gccctgcctgccggtgtgggtc

SEQ ID NO: 9365303 - DNA, 22 bp, Homo sapiens
atttcttccttctcctagaaga

SEQ ID NO: 9365304 - DNA, 23 bp, Homo sapiens
gccctgcccttagcacactcaca

SEQ ID NO: 9365305 - DNA, 22 bp, Homo sapiens
gccctgccctctcggcactcgc

SEQ ID NO: 9365306 - DNA, 22 bp, Homo sapiens
gccctgccctgagccgtagacc

SEQ ID NO: 9365307 - DNA, 22 bp, Homo sapiens
gccctgccctgagccgtagacc

SEQ ID NO: 9365308 - DNA, 22 bp, Homo sapiens
gccctgccctctcggcactcgc

SEQ ID NO: 9365309 - DNA, 19 bp, Homo sapiens
gccctgcaggaggtggggc

SEQ ID NO: 9365310 - DNA, 22 bp, Homo sapiens
gccctccatggtgatccaggcc

SEQ ID NO: 9365311 - DNA, 22 bp, Homo sapiens
gccctcctggcaggcagtgatg

SEQ ID NO: 9365312 - DNA, 22 bp, Homo sapiens
gccctcctggcaggcagtgatg

SEQ ID NO: 9365313 - DNA, 22 bp, Homo sapiens
gccctcctgagctagcacgtgt

SEQ ID NO: 9365314 - DNA, 22 bp, Homo sapiens
gccctcctgcaggggcttctgg

SEQ ID NO: 9365315 - DNA, 22 bp, Homo sapiens
gccctcctgcaggggcttctgg

SEQ ID NO: 9365316 - DNA, 19 bp, Homo sapiens
gccctcctcactgagctct

SEQ ID NO: 9365317 - DNA, 19 bp, Homo sapiens
gccctcctcactgagctct

SEQ ID NO: 9365318 - DNA, 19 bp, Homo sapiens
gccctcctcactgagctct

SEQ ID NO: 9365319 - DNA, 22 bp, Homo sapiens
gcccaggagttgaagggctgac

SEQ ID NO: 9365320 - DNA, 22 bp, Homo sapiens
gcccaggagttgaagggctgac

SEQ ID NO: 9365321 - DNA, 22 bp, Homo sapiens
gccctccacctggtctctctgg

SEQ ID NO: 9365322 - DNA, 22 bp, Homo sapiens
gccctccacctggtctctctgg

SEQ ID NO: 9365323 - DNA, 22 bp, Homo sapiens
gccctccatgagacacagtgta

SEQ ID NO: 9365324 - DNA, 22 bp, Homo sapiens
gccctccatgagacacagtgta

SEQ ID NO: 9365325 - DNA, 22 bp, Homo sapiens
gccctccatgagacacagtgta

SEQ ID NO: 9365326 - DNA, 22 bp, Homo sapiens
gccctccagcctgtggaaccgg

SEQ ID NO: 9365327 - DNA, 22 bp, Homo sapiens
gccctccatgagacacagtgta

SEQ ID NO: 9365328 - DNA, 22 bp, Homo sapiens
gccctccagctgttgcgcgtcg

SEQ ID NO: 9365329 - DNA, 22 bp, Homo sapiens
gcccaggagttcaaggctgcag

SEQ ID NO: 9365330 - DNA, 22 bp, Homo sapiens
gcccaggagttcaaggctgcag

SEQ ID NO: 9365331 - DNA, 22 bp, Homo sapiens
gcccaggaggttgggctgtgca

SEQ ID NO: 9365332 - DNA, 22 bp, Homo sapiens
gcccaggaggtggaggtgcagt

SEQ ID NO: 9365333 - DNA, 22 bp, Homo sapiens
gcccaggaggtggaggtgcagt

SEQ ID NO: 9365334 - DNA, 22 bp, Homo sapiens
gcccaggaggtcaagtagctat

SEQ ID NO: 9365335 - DNA, 22 bp, Homo sapiens
gcccaggaggtcaagtagctat

SEQ ID NO: 9365336 - DNA, 22 bp, Homo sapiens
gccagaggtatcaaagatagta

SEQ ID NO: 9365337 - DNA, 22 bp, Homo sapiens
gccagaggtatcaaagatagta

SEQ ID NO: 9365338 - DNA, 22 bp, Homo sapiens
gccagaggggctcgaaggcgcg

SEQ ID NO: 9365339 - DNA, 22 bp, Homo sapiens
gcccagccagagctgtgtgatg

SEQ ID NO: 9365340 - DNA, 22 bp, Homo sapiens
gcccagccacagtcactttcat

SEQ ID NO: 9365341 - DNA, 22 bp, Homo sapiens
gcccagccagagctgtgtgatg

SEQ ID NO: 9365342 - DNA, 22 bp, Homo sapiens
gcccagccagagctgtgtgatg

SEQ ID NO: 9365343 - DNA, 22 bp, Homo sapiens
gcccagcccctgggtggacgtg

SEQ ID NO: 9365344 - DNA, 22 bp, Homo sapiens
gcccagcccagaaaggttcgga

SEQ ID NO: 9365345 - DNA, 22 bp, Homo sapiens
gcccagcaggggatggcagctc

SEQ ID NO: 9365346 - DNA, 22 bp, Homo sapiens
gcccagcaggggatggcagctc

SEQ ID NO: 9365347 - DNA, 22 bp, Homo sapiens
gcccagccacagtcactttcat

SEQ ID NO: 9365348 - DNA, 22 bp, Homo sapiens
atttacagtttagcatttcaag

SEQ ID NO: 9365349 - DNA, 22 bp, Homo sapiens
atttacagtttagcatttcaag

SEQ ID NO: 9365350 - DNA, 22 bp, Homo sapiens
atttacagtttagcatttcaag

SEQ ID NO: 9365351 - DNA, 22 bp, Homo sapiens
atttacataatagactttaggt

SEQ ID NO: 9365352 - DNA, 22 bp, Homo sapiens
atttacataatagactttaggt

SEQ ID NO: 9365353 - DNA, 22 bp, Homo sapiens
atttacattccatggtggttac

SEQ ID NO: 9365354 - DNA, 22 bp, Homo sapiens
atttacataatagactttaggt

SEQ ID NO: 9365355 - DNA, 22 bp, Homo sapiens
atttacattccatggtggttac

SEQ ID NO: 9365356 - DNA, 22 bp, Homo sapiens
atttacagaccctcccactaag

SEQ ID NO: 9365357 - DNA, 22 bp, Homo sapiens
atttacagaccctcccactaag

SEQ ID NO: 9365358 - DNA, 22 bp, Homo sapiens
atttacagtgtgcctactatat

SEQ ID NO: 9365359 - DNA, 22 bp, Homo sapiens
atttacagtgtgcctactatat

SEQ ID NO: 9365360 - DNA, 22 bp, Homo sapiens
atttacagtgtgcctactatat

SEQ ID NO: 9365361 - DNA, 22 bp, Homo sapiens
atttacagtttagcatttcaag

SEQ ID NO: 9365362 - DNA, 22 bp, Homo sapiens
atttacagtttagcatttcaag

SEQ ID NO: 9365363 - DNA, 22 bp, Homo sapiens
atttacatttatttgagaaggt

SEQ ID NO: 9365364 - DNA, 22 bp, Homo sapiens
atttacatttatttgagaaggt

SEQ ID NO: 9365365 - DNA, 22 bp, Homo sapiens
atttaccatatgtactgagtat

SEQ ID NO: 9365366 - DNA, 22 bp, Homo sapiens
atttaccagtgctgacatttga

SEQ ID NO: 9365367 - DNA, 22 bp, Homo sapiens
atttacatttatttgagaaggt

SEQ ID NO: 9365368 - DNA, 17 bp, Homo sapiens
atttacattgtcaccga

SEQ ID NO: 9365369 - DNA, 18 bp, Homo sapiens
gccagagggaagcaggtg

SEQ ID NO: 9365370 - DNA, 18 bp, Homo sapiens
gccagagggaagcaggtg

SEQ ID NO: 9365371 - DNA, 18 bp, Homo sapiens
gccagagggaagcaggtg

SEQ ID NO: 9365372 - DNA, 18 bp, Homo sapiens
gccagagggaagcaggtg

SEQ ID NO: 9365373 - DNA, 22 bp, Homo sapiens
agttaacatttgagctaaaagg

SEQ ID NO: 9365374 - DNA, 22 bp, Homo sapiens
ctgagcagccccaccagccatt

SEQ ID NO: 9365375 - DNA, 19 bp, Homo sapiens
ctgagcagcggcagcactt

SEQ ID NO: 9365376 - DNA, 22 bp, Homo sapiens
ctgagcagccccaccagccatt

SEQ ID NO: 9365377 - DNA, 22 bp, Homo sapiens
ctgagccactgcttgttcagtg

SEQ ID NO: 9365378 - DNA, 22 bp, Homo sapiens
ctgagccaaggggacagtgaca

SEQ ID NO: 9365379 - DNA, 22 bp, Homo sapiens
ctgagccagcgggctcactttt

SEQ ID NO: 9365380 - DNA, 22 bp, Homo sapiens
ctgagccagcgggctcactttt

SEQ ID NO: 9365381 - DNA, 22 bp, Homo sapiens
ctgagctcaagcgatcctccca

SEQ ID NO: 9365382 - DNA, 22 bp, Homo sapiens
ctgagccagctggcatgtgcta

SEQ ID NO: 9365383 - DNA, 22 bp, Homo sapiens
ctgagccagctggcatgtgcta

SEQ ID NO: 9365384 - DNA, 22 bp, Homo sapiens
ctgagctgctcccgctgcagcg

SEQ ID NO: 9365385 - DNA, 22 bp, Homo sapiens
ctgagctgctcccgctgcagcg

SEQ ID NO: 9365386 - DNA, 22 bp, Homo sapiens
agttatttcagtaacataatag

SEQ ID NO: 9365387 - DNA, 22 bp, Homo sapiens
agttatttcagtaacataatag

SEQ ID NO: 9365388 - DNA, 22 bp, Homo sapiens
ctgagctgcggcaggcacctgg

SEQ ID NO: 9365389 - DNA, 22 bp, Homo sapiens
ctgagctgctcccgctgcagcg

SEQ ID NO: 9365390 - DNA, 22 bp, Homo sapiens
ctgagctgcagtcctggctctg

SEQ ID NO: 9365391 - DNA, 22 bp, Homo sapiens
ctgagctgctcccgctgcagcg

SEQ ID NO: 9365392 - DNA, 22 bp, Homo sapiens
ctgagctgcagtcctggctctg

SEQ ID NO: 9365393 - DNA, 20 bp, Homo sapiens
ctgagctgagctccatgggt

SEQ ID NO: 9365394 - DNA, 22 bp, Homo sapiens
ctgagctgaaacttgagaggct

SEQ ID NO: 9365395 - DNA, 22 bp, Homo sapiens
ctgagctgaaacttgagaggct

SEQ ID NO: 9365396 - DNA, 22 bp, Homo sapiens
agttccagctgtgaccagaaaa

SEQ ID NO: 9365397 - DNA, 22 bp, Homo sapiens
agttccatccttccactgccct

SEQ ID NO: 9365398 - DNA, 22 bp, Homo sapiens
agttcccaaattacaggccaca

SEQ ID NO: 9365399 - DNA, 22 bp, Homo sapiens
agtgttttggagtgggaaggca

SEQ ID NO: 9365400 - DNA, 22 bp, Homo sapiens
agtgtttttcaggagcagaaca

SEQ ID NO: 9365401 - DNA, 22 bp, Homo sapiens
agtgtttttgggtagggtgagt

SEQ ID NO: 9365402 - DNA, 22 bp, Homo sapiens
agtgttttatttcagcactttg

SEQ ID NO: 9365403 - DNA, 22 bp, Homo sapiens
agtgtttgtcccgttagaaatg

SEQ ID NO: 9365404 - DNA, 22 bp, Homo sapiens
agtgttttattagaacacagcc

SEQ ID NO: 9365405 - DNA, 22 bp, Homo sapiens
agtgttttatttcagcactttg

SEQ ID NO: 9365406 - DNA, 22 bp, Homo sapiens
agttaaactctagtagatacaa

SEQ ID NO: 9365407 - DNA, 22 bp, Homo sapiens
agttaacacaagtaagattcca

SEQ ID NO: 9365408 - DNA, 22 bp, Homo sapiens
agtgtttcaccgtatgttctca

SEQ ID NO: 9365409 - DNA, 20 bp, Homo sapiens
agtgtttctcaacatggggc

SEQ ID NO: 9365410 - DNA, 17 bp, Homo sapiens
agtgtttccttatcatt

SEQ ID NO: 9365411 - DNA, 22 bp, Homo sapiens
agtgtttgagacacatttcact

SEQ ID NO: 9365412 - DNA, 22 bp, Homo sapiens
agtgtttctgtgccccagtgtt

SEQ ID NO: 9365413 - DNA, 22 bp, Homo sapiens
agtgtttctggaatcagtgttt

SEQ ID NO: 9365414 - DNA, 22 bp, Homo sapiens
agtgtttctggaatcagtgttt

SEQ ID NO: 9365415 - DNA, 22 bp, Homo sapiens
agtgtttgagacacatttcact

SEQ ID NO: 9365416 - DNA, 22 bp, Homo sapiens
agtgtttattagatttcccttt

SEQ ID NO: 9365417 - DNA, 18 bp, Homo sapiens
agtgtttatttaggtgaa

SEQ ID NO: 9365418 - DNA, 22 bp, Homo sapiens
agtgtttatggaatcttagtta

SEQ ID NO: 9365419 - DNA, 18 bp, Homo sapiens
agtgttctcgttttataa

SEQ ID NO: 9365420 - DNA, 18 bp, Homo sapiens
agtgttctcgttttataa

SEQ ID NO: 9365421 - DNA, 22 bp, Homo sapiens
agtgtgggcccccaggttagcc

SEQ ID NO: 9365422 - DNA, 22 bp, Homo sapiens
agtgtgggcccccaggttagcc

SEQ ID NO: 9365423 - DNA, 22 bp, Homo sapiens
agtgtgggccacgcagctgagc

SEQ ID NO: 9365424 - DNA, 22 bp, Homo sapiens
agtgtggatttagttgtgcttt

SEQ ID NO: 9365425 - DNA, 22 bp, Homo sapiens
agtgtggcaggaatgactagaa

SEQ ID NO: 9365426 - DNA, 22 bp, Homo sapiens
agtgtgcccagtaattggctga

SEQ ID NO: 9365427 - DNA, 20 bp, Homo sapiens
agtgtgcatttagagtctgc

SEQ ID NO: 9365428 - DNA, 22 bp, Homo sapiens
agtgtgagttacaaagtgtgaa

SEQ ID NO: 9365429 - DNA, 22 bp, Homo sapiens
agtgtgagtttggttgagactt

SEQ ID NO: 9365430 - DNA, 22 bp, Homo sapiens
agtgtggacttttcctaggagg

SEQ ID NO: 9365431 - DNA, 22 bp, Homo sapiens
agtgtggacttttcctaggagg

SEQ ID NO: 9365432 - DNA, 22 bp, Homo sapiens
agtgtggattggctggagctat

SEQ ID NO: 9365433 - DNA, 22 bp, Homo sapiens
agtgtggatttagttgtgcttt

SEQ ID NO: 9365434 - DNA, 22 bp, Homo sapiens
agtgtgctgtttccagaagggc

SEQ ID NO: 9365435 - DNA, 22 bp, Homo sapiens
agtgtgctgtttccagaagggc

SEQ ID NO: 9365436 - DNA, 22 bp, Homo sapiens
agtggggccgcggtcctgccct

SEQ ID NO: 9365437 - DNA, 21 bp, Homo sapiens
agtggggtctctgtggaggcc

SEQ ID NO: 9365438 - DNA, 22 bp, Homo sapiens
agtggggagtttccagatgtgt

SEQ ID NO: 9365439 - DNA, 21 bp, Homo sapiens
agtggctctcagcttgctaag

SEQ ID NO: 9365440 - DNA, 22 bp, Homo sapiens
agtggctccaaaccgtagtcat

SEQ ID NO: 9365441 - DNA, 22 bp, Homo sapiens
agtggctcttgggtcactgggc

SEQ ID NO: 9365442 - DNA, 22 bp, Homo sapiens
agtggctcttgggtcactgggc

SEQ ID NO: 9365443 - DNA, 22 bp, Homo sapiens
agtggctcttgggtcactgggc

SEQ ID NO: 9365444 - DNA, 22 bp, Homo sapiens
agtggctctccaagaagtcaca

SEQ ID NO: 9365445 - DNA, 20 bp, Homo sapiens
agtgggtgatgaaggaatag

SEQ ID NO: 9365446 - DNA, 22 bp, Homo sapiens
agtgggtgagcttggtctagat

SEQ ID NO: 9365447 - DNA, 22 bp, Homo sapiens
agtgggtgagcttggtctagat

SEQ ID NO: 9365448 - DNA, 22 bp, Homo sapiens
agtgggtgagcttggtctagat

SEQ ID NO: 9365449 - DNA, 22 bp, Homo sapiens
agtgggtcagagagctccagat

SEQ ID NO: 9365450 - DNA, 22 bp, Homo sapiens
agtgggtgacagtgaacacgta

SEQ ID NO: 9365451 - DNA, 22 bp, Homo sapiens
agtgggtaggcctctggtgcct

SEQ ID NO: 9365452 - DNA, 22 bp, Homo sapiens
agtgggtactgggcaggcagag

SEQ ID NO: 9365453 - DNA, 22 bp, Homo sapiens
agtggccatggcaggtgagcat

SEQ ID NO: 9365454 - DNA, 22 bp, Homo sapiens
agtggccatggcaggtgagcat

SEQ ID NO: 9365455 - DNA, 22 bp, Homo sapiens
agtggccatggcaggtgagcat

SEQ ID NO: 9365456 - DNA, 22 bp, Homo sapiens
agtggccatccctcaggtaggc

SEQ ID NO: 9365457 - DNA, 22 bp, Homo sapiens
agtggccccacagtagggctta

SEQ ID NO: 9365458 - DNA, 22 bp, Homo sapiens
agtggccaggaaaggtccagcc

SEQ ID NO: 9365459 - DNA, 22 bp, Homo sapiens
agtggccagtgaaggcggcagc

SEQ ID NO: 9365460 - DNA, 22 bp, Homo sapiens
agtggccagtgctgctctgggg

SEQ ID NO: 9365461 - DNA, 22 bp, Homo sapiens
agtggccagtgaaggcggcagc

SEQ ID NO: 9365462 - DNA, 22 bp, Homo sapiens
agtggccagtgctgctctgggg

SEQ ID NO: 9365463 - DNA, 22 bp, Homo sapiens
agtggccatccctcaggtaggc

SEQ ID NO: 9365464 - DNA, 22 bp, Homo sapiens
agtggccagtgctgctctgggg

SEQ ID NO: 9365465 - DNA, 22 bp, Homo sapiens
agtggcgtcctaggaaaggagg

SEQ ID NO: 9365466 - DNA, 22 bp, Homo sapiens
agtggcggggattagcagtgtt

SEQ ID NO: 9365467 - DNA, 22 bp, Homo sapiens
agtggcggggattagcagtgtt

SEQ ID NO: 9365468 - DNA, 22 bp, Homo sapiens
agtggctagatcatgagtgagc

SEQ ID NO: 9365469 - DNA, 22 bp, Homo sapiens
agtggctcagagtctattgagg

SEQ ID NO: 9365470 - DNA, 22 bp, Homo sapiens
agtgggtggcgcagaggaggaa

SEQ ID NO: 9365471 - DNA, 22 bp, Homo sapiens
agtgggtgggtgtctgacagtt

SEQ ID NO: 9365472 - DNA, 22 bp, Homo sapiens
agtgggtggcgcagaggaggaa

SEQ ID NO: 9365473 - DNA, 22 bp, Homo sapiens
agtgggtggcgcagaggaggaa

SEQ ID NO: 9365474 - DNA, 22 bp, Homo sapiens
agtgggtggcgcagaggaggaa

SEQ ID NO: 9365475 - DNA, 22 bp, Homo sapiens
agtgggtgcaaccatggctagg

SEQ ID NO: 9365476 - DNA, 22 bp, Homo sapiens
agtgggtgcaaccatggctagg

SEQ ID NO: 9365477 - DNA, 20 bp, Homo sapiens
agtgggtgatgaaggaatag

SEQ ID NO: 9365478 - DNA, 20 bp, Homo sapiens
agtggtctagtttctctgca

SEQ ID NO: 9365479 - DNA, 22 bp, Homo sapiens
agtggtctagtctgaggattat

SEQ ID NO: 9365480 - DNA, 22 bp, Homo sapiens
agtggtagaaaatgcagctcga

SEQ ID NO: 9365481 - DNA, 19 bp, Homo sapiens
agtggtagatgagcaggag

SEQ ID NO: 9365482 - DNA, 19 bp, Homo sapiens
agtggtagatgagcaggag

SEQ ID NO: 9365483 - DNA, 22 bp, Homo sapiens
agtggtctatttaatagttttc

SEQ ID NO: 9365484 - DNA, 22 bp, Homo sapiens
ctctggagtgtctggccagggt

SEQ ID NO: 9365485 - DNA, 22 bp, Homo sapiens
ctctggagtgtctggccagggt

SEQ ID NO: 9365486 - DNA, 22 bp, Homo sapiens
ctctggagtgtctggccagggt

SEQ ID NO: 9365487 - DNA, 22 bp, Homo sapiens
ctctggagttagtgatctgggc

SEQ ID NO: 9365488 - DNA, 22 bp, Homo sapiens
ctctggagttcccttgatctga

SEQ ID NO: 9365489 - DNA, 22 bp, Homo sapiens
ctctggagttctcatgaggaac

SEQ ID NO: 9365490 - DNA, 22 bp, Homo sapiens
ctctggagttcttcaagctact

SEQ ID NO: 9365491 - DNA, 22 bp, Homo sapiens
ctctggagttctcatgaggaac

SEQ ID NO: 9365492 - DNA, 22 bp, Homo sapiens
ctctggagttctcatgaggaac

SEQ ID NO: 9365493 - DNA, 22 bp, Homo sapiens
ctctggagttcttcaagctact

SEQ ID NO: 9365494 - DNA, 20 bp, Homo sapiens
ctctggagttggggaacatt

SEQ ID NO: 9365495 - DNA, 20 bp, Homo sapiens
ctctggagttggggaacatt

SEQ ID NO: 9365496 - DNA, 21 bp, Homo sapiens
ctctggagtttgaaggctggg

SEQ ID NO: 9365497 - DNA, 20 bp, Homo sapiens
ctctggagttggggaacatt

SEQ ID NO: 9365498 - DNA, 22 bp, Homo sapiens
agtgtattgattggaacagcct

SEQ ID NO: 9365499 - DNA, 22 bp, Homo sapiens
agtgtacaaaatgatagataaa

SEQ ID NO: 9365500 - DNA, 21 bp, Homo sapiens
ctctggagtttgaaggctggg

SEQ ID NO: 9365501 - DNA, 21 bp, Homo sapiens
ctctggagtttgaaggctggg

SEQ ID NO: 9365502 - DNA, 21 bp, Homo sapiens
ctctggagtttgaaggctggg

SEQ ID NO: 9365503 - DNA, 22 bp, Homo sapiens
agtgtattgtctcacagttctt

SEQ ID NO: 9365504 - DNA, 19 bp, Homo sapiens
agtgtatttttttctgtag

SEQ ID NO: 9365505 - DNA, 20 bp, Homo sapiens
agtgtatttgggtagagtgt

SEQ ID NO: 9365506 - DNA, 22 bp, Homo sapiens
agtgtattttcttgctaggaat

SEQ ID NO: 9365507 - DNA, 19 bp, Homo sapiens
agtgtatttttttctgtag

SEQ ID NO: 9365508 - DNA, 22 bp, Homo sapiens
agtgtatttgcctataaaaatg

SEQ ID NO: 9365509 - DNA, 22 bp, Homo sapiens
agtgtcaactcggaataaggat

SEQ ID NO: 9365510 - DNA, 22 bp, Homo sapiens
agtgtcagttgccttgtcataa

SEQ ID NO: 9365511 - DNA, 22 bp, Homo sapiens
agtgtcagctaattattcatga

SEQ ID NO: 9365512 - DNA, 22 bp, Homo sapiens
agtgtcagctaattattcatga

SEQ ID NO: 9365513 - DNA, 21 bp, Homo sapiens
agtgtcatttgatcattgtta

SEQ ID NO: 9365514 - DNA, 19 bp, Homo sapiens
agtgtcatcagctactcag

SEQ ID NO: 9365515 - DNA, 22 bp, Homo sapiens
agtgtcatatgccactgcatcc

SEQ ID NO: 9365516 - DNA, 19 bp, Homo sapiens
agtgtcagaattcattgaa

SEQ ID NO: 9365517 - DNA, 19 bp, Homo sapiens
agtgtcctagtcatttgcc

SEQ ID NO: 9365518 - DNA, 22 bp, Homo sapiens
agtgtcctacagctcctgcctg

SEQ ID NO: 9365519 - DNA, 22 bp, Homo sapiens
agtgtcctagcaagccggtcct

SEQ ID NO: 9365520 - DNA, 22 bp, Homo sapiens
agtgtcctacagctcctgcctg

SEQ ID NO: 9365521 - DNA, 22 bp, Homo sapiens
agtgtcctcaggctttgttcct

SEQ ID NO: 9365522 - DNA, 19 bp, Homo sapiens
agtgtcctagtcatttgcc

SEQ ID NO: 9365523 - DNA, 22 bp, Homo sapiens
agtgtcctagcaagccggtcct

SEQ ID NO: 9365524 - DNA, 22 bp, Homo sapiens
agtgtcctcaggctttgttcct

SEQ ID NO: 9365525 - DNA, 22 bp, Homo sapiens
agtgtcctcatctgtaaaatga

SEQ ID NO: 9365526 - DNA, 22 bp, Homo sapiens
agtgtcctcaggctttgttcct

SEQ ID NO: 9365527 - DNA, 22 bp, Homo sapiens
agtgtcctacagctcctgcctg

SEQ ID NO: 9365528 - DNA, 22 bp, Homo sapiens
agtgtcctcctctgggagccag

SEQ ID NO: 9365529 - DNA, 22 bp, Homo sapiens
agtgtcctcatctgtaaaatga

SEQ ID NO: 9365530 - DNA, 22 bp, Homo sapiens
agtgtcctcctctgggagccag

SEQ ID NO: 9365531 - DNA, 20 bp, Homo sapiens
agtgtctgggcctcaggccc

SEQ ID NO: 9365532 - DNA, 22 bp, Homo sapiens
agtgtctttgtcaaattacagg

SEQ ID NO: 9365533 - DNA, 22 bp, Homo sapiens
agtgtctggtctctgaactaaa

SEQ ID NO: 9365534 - DNA, 22 bp, Homo sapiens
agtgtgagatgattgaggagca

SEQ ID NO: 9365535 - DNA, 19 bp, Homo sapiens
agtgtgagactccatctca

SEQ ID NO: 9365536 - DNA, 22 bp, Homo sapiens
agtgtgagtaattcagggaggg

SEQ ID NO: 9365537 - DNA, 22 bp, Homo sapiens
agtgtgaggggttctttgatat

SEQ ID NO: 9365538 - DNA, 22 bp, Homo sapiens
agtgtgagcctacaggccaaag

SEQ ID NO: 9365539 - DNA, 22 bp, Homo sapiens
ctcaccacagagcctgtccagc

SEQ ID NO: 9365540 - DNA, 22 bp, Homo sapiens
ctcaccacagagcctgtccagc

SEQ ID NO: 9365541 - DNA, 22 bp, Homo sapiens
ctcacatgagatctgtacatcc

SEQ ID NO: 9365542 - DNA, 18 bp, Homo sapiens
agtcttctgatccatttt

SEQ ID NO: 9365543 - DNA, 22 bp, Homo sapiens
agtctttatacagaaatatatg

SEQ ID NO: 9365544 - DNA, 22 bp, Homo sapiens
agtctttcctgcttgactgttc

SEQ ID NO: 9365545 - DNA, 19 bp, Homo sapiens
agtctttcccactcgtctt

SEQ ID NO: 9365546 - DNA, 22 bp, Homo sapiens
agtctacaatcttaaatgaact

SEQ ID NO: 9365547 - DNA, 22 bp, Homo sapiens
agtcctgggtctggagaatgga

SEQ ID NO: 9365548 - DNA, 22 bp, Homo sapiens
agtctatttttggttcttcggg

SEQ ID NO: 9365549 - DNA, 22 bp, Homo sapiens
agtctatttcagtcttactagt

SEQ ID NO: 9365550 - DNA, 22 bp, Homo sapiens
agtgaaaacctaatcatgcagt

SEQ ID NO: 9365551 - DNA, 22 bp, Homo sapiens
agtgaaaagatgcatttctctg

SEQ ID NO: 9365552 - DNA, 22 bp, Homo sapiens
agtgaaaacactagttcttgcc

SEQ ID NO: 9365553 - DNA, 22 bp, Homo sapiens
agtgaaatactgtcgtttttag

SEQ ID NO: 9365554 - DNA, 22 bp, Homo sapiens
agtgaaatagcatttatgaagc

SEQ ID NO: 9365555 - DNA, 22 bp, Homo sapiens
agtgaaatagcatttatgaagc

SEQ ID NO: 9365556 - DNA, 22 bp, Homo sapiens
agtgaaatcaggttttgactgc

SEQ ID NO: 9365557 - DNA, 22 bp, Homo sapiens
agtgaaatcaggttttgactgc

SEQ ID NO: 9365558 - DNA, 22 bp, Homo sapiens
agtgaaatatgcccattgctgt

SEQ ID NO: 9365559 - DNA, 22 bp, Homo sapiens
agtgaaatcctggtcaacaggt

SEQ ID NO: 9365560 - DNA, 22 bp, Homo sapiens
agtgaaatcctggtcaacaggt

SEQ ID NO: 9365561 - DNA, 22 bp, Homo sapiens
agtgaaatgatagtgtaaatac

SEQ ID NO: 9365562 - DNA, 22 bp, Homo sapiens
agtgaaatgactgaatcagata

SEQ ID NO: 9365563 - DNA, 22 bp, Homo sapiens
agtgaaatgattctgagcaaga

SEQ ID NO: 9365564 - DNA, 22 bp, Homo sapiens
agtgaaatgatagtgtaaatac

SEQ ID NO: 9365565 - DNA, 22 bp, Homo sapiens
agtgaaattcctggtctttgtt

SEQ ID NO: 9365566 - DNA, 21 bp, Homo sapiens
agtgaaattgcatcagaggga

SEQ ID NO: 9365567 - DNA, 22 bp, Homo sapiens
agtgaaattgctgtaagaggaa

SEQ ID NO: 9365568 - DNA, 22 bp, Homo sapiens
agtgaggctaataggcaatggt

SEQ ID NO: 9365569 - DNA, 22 bp, Homo sapiens
agtgagggactagtgctgggga

SEQ ID NO: 9365570 - DNA, 17 bp, Homo sapiens
agtgacttggaaagagc

SEQ ID NO: 9365571 - DNA, 22 bp, Homo sapiens
agtgacttggcatgatgagaag

SEQ ID NO: 9365572 - DNA, 22 bp, Homo sapiens
agtgaggggattcaggcaaggt

SEQ ID NO: 9365573 - DNA, 22 bp, Homo sapiens
agtgaggggattcaggcaaggt

SEQ ID NO: 9365574 - DNA, 22 bp, Homo sapiens
agtgaggggcagctgagtgggc

SEQ ID NO: 9365575 - DNA, 22 bp, Homo sapiens
agtgagggactagtgctgggga

SEQ ID NO: 9365576 - DNA, 22 bp, Homo sapiens
agtgagggactagtgctgggga

SEQ ID NO: 9365577 - DNA, 22 bp, Homo sapiens
agtgagggatgaagaactgcgg

SEQ ID NO: 9365578 - DNA, 22 bp, Homo sapiens
agtgagggactccatgactcct

SEQ ID NO: 9365579 - DNA, 22 bp, Homo sapiens
agtgagggactccatgactcct

SEQ ID NO: 9365580 - DNA, 22 bp, Homo sapiens
agtgaggtggggtcacagggac

SEQ ID NO: 9365581 - DNA, 22 bp, Homo sapiens
agtgagtatttgttgagtgcta

SEQ ID NO: 9365582 - DNA, 22 bp, Homo sapiens
agtgagtcaaacatatcctgac

SEQ ID NO: 9365583 - DNA, 22 bp, Homo sapiens
agtgaggtcatactggagaggg

SEQ ID NO: 9365584 - DNA, 22 bp, Homo sapiens
agtgaggtcaggatctcaggga

SEQ ID NO: 9365585 - DNA, 22 bp, Homo sapiens
agtgaggtaattagagctgctg

SEQ ID NO: 9365586 - DNA, 22 bp, Homo sapiens
agtgagttgatggaaaactcag

SEQ ID NO: 9365587 - DNA, 20 bp, Homo sapiens
agtgagttatcagctacagt

SEQ ID NO: 9365588 - DNA, 22 bp, Homo sapiens
agtgagtttagggtgcaggtgt

SEQ ID NO: 9365589 - DNA, 22 bp, Homo sapiens
agtgatctgactcccagttaga

SEQ ID NO: 9365590 - DNA, 23 bp, Homo sapiens
agtgatctgtgtttgaagaatgc

SEQ ID NO: 9365591 - DNA, 22 bp, Homo sapiens
agtgatggagcttcctctgcta

SEQ ID NO: 9365592 - DNA, 22 bp, Homo sapiens
agtgatggggccctgcactgat

SEQ ID NO: 9365593 - DNA, 22 bp, Homo sapiens
agtgatggttcagcttggttag

SEQ ID NO: 9365594 - DNA, 22 bp, Homo sapiens
agtgatggtttccagtcactga

SEQ ID NO: 9365595 - DNA, 22 bp, Homo sapiens
agtgatgtaacaaacagagtta

SEQ ID NO: 9365596 - DNA, 22 bp, Homo sapiens
agtgatgtaggtggattctggc

SEQ ID NO: 9365597 - DNA, 22 bp, Homo sapiens
agtgattaaagctaggataaaa

SEQ ID NO: 9365598 - DNA, 22 bp, Homo sapiens
agtgatgttgactagctataag

SEQ ID NO: 9365599 - DNA, 22 bp, Homo sapiens
agtgatgtgggagagtatagct

SEQ ID NO: 9365600 - DNA, 22 bp, Homo sapiens
agtgatgttgactagctataag

SEQ ID NO: 9365601 - DNA, 22 bp, Homo sapiens
agtgatgtgaggtgtgagaggg

SEQ ID NO: 9365602 - DNA, 22 bp, Homo sapiens
agtgatgtcttttaaattacat

SEQ ID NO: 9365603 - DNA, 23 bp, Homo sapiens
agtgatgtcacccacagacaagg

SEQ ID NO: 9365604 - DNA, 22 bp, Homo sapiens
agtgatgtcacaaactatggtg

SEQ ID NO: 9365605 - DNA, 22 bp, Homo sapiens
agtgcagggcctgcccagcagg

SEQ ID NO: 9365606 - DNA, 22 bp, Homo sapiens
agtgcagggggaaagggtgtct

SEQ ID NO: 9365607 - DNA, 22 bp, Homo sapiens
agtgatttcatcattttatcaa

SEQ ID NO: 9365608 - DNA, 22 bp, Homo sapiens
agtgatttcacgcttagggcta

SEQ ID NO: 9365609 - DNA, 22 bp, Homo sapiens
agtgatttatggaaggccaaaa

SEQ ID NO: 9365610 - DNA, 22 bp, Homo sapiens
agtgatttatgtatgtgcacgt

SEQ ID NO: 9365611 - DNA, 21 bp, Homo sapiens
agtgatttatgagagaatgac

SEQ ID NO: 9365612 - DNA, 20 bp, Homo sapiens
agtgatttatctttttccac

SEQ ID NO: 9365613 - DNA, 22 bp, Homo sapiens
agtgatttactaccatattggg

SEQ ID NO: 9365614 - DNA, 22 bp, Homo sapiens
agtgattgttttaaaaatgcct

SEQ ID NO: 9365615 - DNA, 22 bp, Homo sapiens
agtgattgtgtagaaccatccc

SEQ ID NO: 9365616 - DNA, 22 bp, Homo sapiens
agtgattagaaagtacacttgg

SEQ ID NO: 9365617 - DNA, 22 bp, Homo sapiens
agtgattgcttgcttaaggaca

SEQ ID NO: 9365618 - DNA, 22 bp, Homo sapiens
agtgattgagtgttagcagtct

SEQ ID NO: 9365619 - DNA, 22 bp, Homo sapiens
agtgccagctccacacagcagc

SEQ ID NO: 9365620 - DNA, 22 bp, Homo sapiens
agtgcattcagtattcataggc

SEQ ID NO: 9365621 - DNA, 22 bp, Homo sapiens
agtgcattatatgtttcaatgg

SEQ ID NO: 9365622 - DNA, 22 bp, Homo sapiens
agtgcattctctaattacaggt

SEQ ID NO: 9365623 - DNA, 22 bp, Homo sapiens
agtgcattcctggggaagaagc

SEQ ID NO: 9365624 - DNA, 22 bp, Homo sapiens
agtgcattctggcagaacaggt

SEQ ID NO: 9365625 - DNA, 22 bp, Homo sapiens
agtgcattctctaattacaggt

SEQ ID NO: 9365626 - DNA, 22 bp, Homo sapiens
agtgcattgcatctctgcttca

SEQ ID NO: 9365627 - DNA, 22 bp, Homo sapiens
agtgccctcgtgcccagggcct

SEQ ID NO: 9365628 - DNA, 20 bp, Homo sapiens
agtgccctccgacattgttt

SEQ ID NO: 9365629 - DNA, 22 bp, Homo sapiens
agtgcccagttaggttggagca

SEQ ID NO: 9365630 - DNA, 22 bp, Homo sapiens
agtgccctggcccagctggacc

SEQ ID NO: 9365631 - DNA, 22 bp, Homo sapiens
agtgccctggacggcggcccca

SEQ ID NO: 9365632 - DNA, 22 bp, Homo sapiens
agtgccctgctggggcaggaga

SEQ ID NO: 9365633 - DNA, 23 bp, Homo sapiens
agtgccattgaccctatgtctat

SEQ ID NO: 9365634 - DNA, 22 bp, Homo sapiens
agtgccatgtagtccagcagaa

SEQ ID NO: 9365635 - DNA, 22 bp, Homo sapiens
agtgccaggagcaaggagctcc

SEQ ID NO: 9365636 - DNA, 20 bp, Homo sapiens
agtgccagggcaggtgagag

SEQ ID NO: 9365637 - DNA, 23 bp, Homo sapiens
agtgccagggagatcaggacgga

SEQ ID NO: 9365638 - DNA, 22 bp, Homo sapiens
agtgccaggagcaaggagctcc

SEQ ID NO: 9365639 - DNA, 22 bp, Homo sapiens
agtgccttgtgtgtgggcagcc

SEQ ID NO: 9365640 - DNA, 22 bp, Homo sapiens
agtgctgggtactgttcccatt

SEQ ID NO: 9365641 - DNA, 22 bp, Homo sapiens
agtgctgtaacaacttatttgg

SEQ ID NO: 9365642 - DNA, 22 bp, Homo sapiens
agtgctgtcagttttatagata

SEQ ID NO: 9365643 - DNA, 22 bp, Homo sapiens
agtgcctggcacatggaaggtg

SEQ ID NO: 9365644 - DNA, 22 bp, Homo sapiens
agtgccttcagatttgccccag

SEQ ID NO: 9365645 - DNA, 22 bp, Homo sapiens
agtgcccttcatgaagcaagag

SEQ ID NO: 9365646 - DNA, 22 bp, Homo sapiens
agtgcctggaccccatgacata

SEQ ID NO: 9365647 - DNA, 22 bp, Homo sapiens
agtgctttggtatagaactatt

SEQ ID NO: 9365648 - DNA, 22 bp, Homo sapiens
agtgctttgtagtttcattgtg

SEQ ID NO: 9365649 - DNA, 22 bp, Homo sapiens
agtgctttgtgctctcactgca

SEQ ID NO: 9365650 - DNA, 22 bp, Homo sapiens
agtgctttgtgctctcactgca

SEQ ID NO: 9365651 - DNA, 22 bp, Homo sapiens
agtgctttgtgctctcactgca

SEQ ID NO: 9365652 - DNA, 22 bp, Homo sapiens
agtgcttttgtcattgaatctt

SEQ ID NO: 9365653 - DNA, 22 bp, Homo sapiens
agtgcttttatatcattaatcc

SEQ ID NO: 9365654 - DNA, 22 bp, Homo sapiens
agtggacaaccatgctgagatt

SEQ ID NO: 9365655 - DNA, 18 bp, Homo sapiens
agtggaaaacaaatacac

SEQ ID NO: 9365656 - DNA, 22 bp, Homo sapiens
agtggaaagaaccctggactca

SEQ ID NO: 9365657 - DNA, 22 bp, Homo sapiens
agtggagaagaggatggtctcc

SEQ ID NO: 9365658 - DNA, 22 bp, Homo sapiens
agtggagaatatgcagaaagcc

SEQ ID NO: 9365659 - DNA, 22 bp, Homo sapiens
agtggagacaggacagtcgata

SEQ ID NO: 9365660 - DNA, 22 bp, Homo sapiens
agtggagaccccacttctacat

SEQ ID NO: 9365661 - DNA, 22 bp, Homo sapiens
agtggagaagaggatggtctcc

SEQ ID NO: 9365662 - DNA, 22 bp, Homo sapiens
agtggaggttacagctgtacat

SEQ ID NO: 9365663 - DNA, 22 bp, Homo sapiens
agtggaggttacagctgtacat

SEQ ID NO: 9365664 - DNA, 22 bp, Homo sapiens
agtggaggcactaattggattt

SEQ ID NO: 9365665 - DNA, 22 bp, Homo sapiens
agtggagaccccacttctacat

SEQ ID NO: 9365666 - DNA, 22 bp, Homo sapiens
agtggagtgagtggcagaagga

SEQ ID NO: 9365667 - DNA, 22 bp, Homo sapiens
agtggatggtattgggaccagg

SEQ ID NO: 9365668 - DNA, 22 bp, Homo sapiens
agtggatggtattgggaccagg

SEQ ID NO: 9365669 - DNA, 22 bp, Homo sapiens
agtggattgcatgagctcagga

SEQ ID NO: 9365670 - DNA, 22 bp, Homo sapiens
agtggcaagtcaatgatagtga

SEQ ID NO: 9365671 - DNA, 22 bp, Homo sapiens
agtggcagtggggcagggccct

SEQ ID NO: 9365672 - DNA, 22 bp, Homo sapiens
agtggcagtggggcagggccct

SEQ ID NO: 9365673 - DNA, 22 bp, Homo sapiens
agtggcaattgacaacaaagga

SEQ ID NO: 9365674 - DNA, 22 bp, Homo sapiens
agtggcaggcggagatgtagga

SEQ ID NO: 9365675 - DNA, 22 bp, Homo sapiens
agtggcacaactgtttagctac

SEQ ID NO: 9365676 - DNA, 22 bp, Homo sapiens
agtggccacccactgagacagg

SEQ ID NO: 9365677 - DNA, 22 bp, Homo sapiens
agtggccacccactgagacagg

SEQ ID NO: 9365678 - DNA, 22 bp, Homo sapiens
agtggccactagaagctcagct

SEQ ID NO: 9365679 - DNA, 22 bp, Homo sapiens
agtggccactagaagctcagct

SEQ ID NO: 9365680 - DNA, 22 bp, Homo sapiens
agtggccaccatgccagctctc

SEQ ID NO: 9365681 - DNA, 22 bp, Homo sapiens
agtggccaccatgccagctctc

SEQ ID NO: 9365682 - DNA, 22 bp, Homo sapiens
agtggccactgacttggaaatc

SEQ ID NO: 9365683 - DNA, 22 bp, Homo sapiens
agtggccactgacttggaaatc

SEQ ID NO: 9365684 - DNA, 22 bp, Homo sapiens
agtggccactagaagctcagct

SEQ ID NO: 9365685 - DNA, 20 bp, Homo sapiens
agtggccactgcagagatgc

SEQ ID NO: 9365686 - DNA, 22 bp, Homo sapiens
agtggccaggaaaggtccagcc

SEQ ID NO: 9365687 - DNA, 22 bp, Homo sapiens
agtggccaggaaaggtccagcc

SEQ ID NO: 9365688 - DNA, 22 bp, Homo sapiens
agtggccagcagcctagcctag

SEQ ID NO: 9365689 - DNA, 22 bp, Homo sapiens
agtggccagcagcctagcctag

SEQ ID NO: 9365690 - DNA, 22 bp, Homo sapiens
agtggccaacttatatgaaaaa

SEQ ID NO: 9365691 - DNA, 22 bp, Homo sapiens
agtggccaacttatatgaaaaa

SEQ ID NO: 9365692 - DNA, 22 bp, Homo sapiens
agtggccaatatgtcatgctct

SEQ ID NO: 9365693 - DNA, 22 bp, Homo sapiens
agtggcattttaatggatgtca

SEQ ID NO: 9365694 - DNA, 22 bp, Homo sapiens
agtggcattttaatggatgtca

SEQ ID NO: 9365695 - DNA, 22 bp, Homo sapiens
agtggcatctctctaatgacga

SEQ ID NO: 9365696 - DNA, 22 bp, Homo sapiens
agtggcatcaactttatctgta

SEQ ID NO: 9365697 - DNA, 22 bp, Homo sapiens
agtggcatctaagttttagaaa

SEQ ID NO: 9365698 - DNA, 22 bp, Homo sapiens
agtggcatccctttaacagggt

SEQ ID NO: 9365699 - DNA, 22 bp, Homo sapiens
agtggcatcaactttatctgta

SEQ ID NO: 9365700 - DNA, 22 bp, Homo sapiens
agtggcatcaaatcaaggtttg

SEQ ID NO: 9365701 - DNA, 22 bp, Homo sapiens
agtggcatatcatagctctctt

SEQ ID NO: 9365702 - DNA, 22 bp, Homo sapiens
agtggcagtttgggagctacag

SEQ ID NO: 9365703 - DNA, 22 bp, Homo sapiens
cctgtgggaggggcctggcgcg

SEQ ID NO: 9365704 - DNA, 22 bp, Homo sapiens
cctgtgggaggttctgtgagtc

SEQ ID NO: 9365705 - DNA, 22 bp, Homo sapiens
cctgtgggaggttctgtgagtc

SEQ ID NO: 9365706 - DNA, 22 bp, Homo sapiens
cctgtgggaggttctgtgagtc

SEQ ID NO: 9365707 - DNA, 22 bp, Homo sapiens
cctgtgggagggagcggctgga

SEQ ID NO: 9365708 - DNA, 22 bp, Homo sapiens
cctgtgggagggagcggctgga

SEQ ID NO: 9365709 - DNA, 22 bp, Homo sapiens
cctgtgggcgcagctggagtca

SEQ ID NO: 9365710 - DNA, 22 bp, Homo sapiens
cctgtgggcgcagctggagtca

SEQ ID NO: 9365711 - DNA, 22 bp, Homo sapiens
cctgtgggcctgcacgtgggga

SEQ ID NO: 9365712 - DNA, 22 bp, Homo sapiens
cctgtgggccctggacagagac

SEQ ID NO: 9365713 - DNA, 22 bp, Homo sapiens
cctgtgggccaaggacctgcca

SEQ ID NO: 9365714 - DNA, 22 bp, Homo sapiens
aggtggcagagctggcccagcg

SEQ ID NO: 9365715 - DNA, 22 bp, Homo sapiens
aggtggcagagctggcccagcg

SEQ ID NO: 9365716 - DNA, 22 bp, Homo sapiens
aggtggcagaggactcctcctg

SEQ ID NO: 9365717 - DNA, 22 bp, Homo sapiens
aggtggcagaggactcctcctg

SEQ ID NO: 9365718 - DNA, 22 bp, Homo sapiens
aggtggcagagtgacaggctga

SEQ ID NO: 9365719 - DNA, 22 bp, Homo sapiens
aggtggcagagtgacaggctga

SEQ ID NO: 9365720 - DNA, 22 bp, Homo sapiens
cctgtgggcttgagtgtagggt

SEQ ID NO: 9365721 - DNA, 22 bp, Homo sapiens
cctgtgggcgcagctggagtca

SEQ ID NO: 9365722 - DNA, 22 bp, Homo sapiens
cctgtgggcttgagtgtagggt

SEQ ID NO: 9365723 - DNA, 22 bp, Homo sapiens
cctgtgggcttgagtgtagggt

SEQ ID NO: 9365724 - DNA, 22 bp, Homo sapiens
cctgtggggagagatctcttag

SEQ ID NO: 9365725 - DNA, 22 bp, Homo sapiens
cctgtggggccatctcagtcac

SEQ ID NO: 9365726 - DNA, 22 bp, Homo sapiens
aggtggcaaggggcgcctctct

SEQ ID NO: 9365727 - DNA, 22 bp, Homo sapiens
cctgtggggctgaaagaggctt

SEQ ID NO: 9365728 - DNA, 22 bp, Homo sapiens
cctgtgggtacaacagggtcac

SEQ ID NO: 9365729 - DNA, 22 bp, Homo sapiens
ccttccagagttcagtctgccc

SEQ ID NO: 9365730 - DNA, 22 bp, Homo sapiens
ccttccagaggcgtgacaccct

SEQ ID NO: 9365731 - DNA, 21 bp, Homo sapiens
ccttccaccttctgccatgtg

SEQ ID NO: 9365732 - DNA, 22 bp, Homo sapiens
ccttccagaggcgtgacaccct

SEQ ID NO: 9365733 - DNA, 22 bp, Homo sapiens
ccttccaggagtctctgcaggt

SEQ ID NO: 9365734 - DNA, 22 bp, Homo sapiens
ccttccagatgtaagagctgat

SEQ ID NO: 9365735 - DNA, 22 bp, Homo sapiens
ccttccaggctggaggcttggg

SEQ ID NO: 9365736 - DNA, 22 bp, Homo sapiens
ccttccagggagcaggcagtgt

SEQ ID NO: 9365737 - DNA, 22 bp, Homo sapiens
ccttccagggctctccagaacc

SEQ ID NO: 9365738 - DNA, 22 bp, Homo sapiens
aggtggcaggaggtcagagaaa

SEQ ID NO: 9365739 - DNA, 22 bp, Homo sapiens
ccttcattcattaatttagccc

SEQ ID NO: 9365740 - DNA, 22 bp, Homo sapiens
ccttcattcagctatagcatcc

SEQ ID NO: 9365741 - DNA, 22 bp, Homo sapiens
aggtggcagcagcctggtgaaa

SEQ ID NO: 9365742 - DNA, 22 bp, Homo sapiens
aggtggcagcaggagatgtgga

SEQ ID NO: 9365743 - DNA, 22 bp, Homo sapiens
aggtggcagcagcctggtgaaa

SEQ ID NO: 9365744 - DNA, 22 bp, Homo sapiens
aggtggcagcaggagatgtgga

SEQ ID NO: 9365745 - DNA, 22 bp, Homo sapiens
aggtggcagagtgacaggctga

SEQ ID NO: 9365746 - DNA, 22 bp, Homo sapiens
aggtggcagatgggggtgctcg

SEQ ID NO: 9365747 - DNA, 22 bp, Homo sapiens
aggtggcagatgggggtgctcg

SEQ ID NO: 9365748 - DNA, 22 bp, Homo sapiens
cctgggtccaccctgtgaagta

SEQ ID NO: 9365749 - DNA, 22 bp, Homo sapiens
cctgggtccaccctgtgaagta

SEQ ID NO: 9365750 - DNA, 17 bp, Homo sapiens
aggtgcagaggcagagc

SEQ ID NO: 9365751 - DNA, 17 bp, Homo sapiens
aggtgcagaggcagagc

SEQ ID NO: 9365752 - DNA, 21 bp, Homo sapiens
aggtgcagagccagggaccag

SEQ ID NO: 9365753 - DNA, 17 bp, Homo sapiens
aggtgcagaggcagagc

SEQ ID NO: 9365754 - DNA, 22 bp, Homo sapiens
cctggggtcagggacgctgtgc

SEQ ID NO: 9365755 - DNA, 22 bp, Homo sapiens
cctggggtcacttgcagccgca

SEQ ID NO: 9365756 - DNA, 22 bp, Homo sapiens
cctggggtcacttgcagccgca

SEQ ID NO: 9365757 - DNA, 22 bp, Homo sapiens
cctggggtcacttgcagccgca

SEQ ID NO: 9365758 - DNA, 22 bp, Homo sapiens
cctgggtagactttgaagcatt

SEQ ID NO: 9365759 - DNA, 22 bp, Homo sapiens
cctgggtacgcagggctcctct

SEQ ID NO: 9365760 - DNA, 22 bp, Homo sapiens
cctggggtcagggacgctgtgc

SEQ ID NO: 9365761 - DNA, 22 bp, Homo sapiens
cctgggtacgcagggctcctct

SEQ ID NO: 9365762 - DNA, 22 bp, Homo sapiens
cctgggtcactcaggcaggcgg

SEQ ID NO: 9365763 - DNA, 22 bp, Homo sapiens
cctgggtcaccaggcccaggca

SEQ ID NO: 9365764 - DNA, 22 bp, Homo sapiens
aggtgcaggagctgtgcaggga

SEQ ID NO: 9365765 - DNA, 22 bp, Homo sapiens
cctgtgccagctgggccctgcc

SEQ ID NO: 9365766 - DNA, 22 bp, Homo sapiens
cctgtgggagcccaggcagata

SEQ ID NO: 9365767 - DNA, 22 bp, Homo sapiens
aggtgcagctgacaccatgtgg

SEQ ID NO: 9365768 - DNA, 22 bp, Homo sapiens
aggtgcagctggtggagtctgg

SEQ ID NO: 9365769 - DNA, 22 bp, Homo sapiens
aggtgcagctgacaccatgtgg

SEQ ID NO: 9365770 - DNA, 22 bp, Homo sapiens
aggtgcagctggtggagtctgg

SEQ ID NO: 9365771 - DNA, 22 bp, Homo sapiens
aggtgcagcatgagtccaacgg

SEQ ID NO: 9365772 - DNA, 18 bp, Homo sapiens
aggtgcagcctctgaggc

SEQ ID NO: 9365773 - DNA, 22 bp, Homo sapiens
aggtcctgatgatctctgagag

SEQ ID NO: 9365774 - DNA, 22 bp, Homo sapiens
aggtcctgatgatctctgagag

SEQ ID NO: 9365775 - DNA, 23 bp, Homo sapiens
aggtcctggacatatgtgcatca

SEQ ID NO: 9365776 - DNA, 23 bp, Homo sapiens
aggtcctggacatatgtgcatca

SEQ ID NO: 9365777 - DNA, 22 bp, Homo sapiens
aggtcctggactgctcttgtta

SEQ ID NO: 9365778 - DNA, 22 bp, Homo sapiens
aggtcctggactgctcttgtta

SEQ ID NO: 9365779 - DNA, 22 bp, Homo sapiens
aggtcctggtgaccatggagtt

SEQ ID NO: 9365780 - DNA, 22 bp, Homo sapiens
aggtcctggtgaccatggagtt

SEQ ID NO: 9365781 - DNA, 22 bp, Homo sapiens
aggtcctggtcttgagtcttaa

SEQ ID NO: 9365782 - DNA, 22 bp, Homo sapiens
aggtcctggtcttgagtcttaa

SEQ ID NO: 9365783 - DNA, 22 bp, Homo sapiens
aggtcctgggagttctagtgtg

SEQ ID NO: 9365784 - DNA, 20 bp, Homo sapiens
aggtcctgggactggcagag

SEQ ID NO: 9365785 - DNA, 20 bp, Homo sapiens
aggtcctgggactggcagag

SEQ ID NO: 9365786 - DNA, 20 bp, Homo sapiens
aggtcctgggactggcagag

SEQ ID NO: 9365787 - DNA, 22 bp, Homo sapiens
cctgggctttgagggcaggatg

SEQ ID NO: 9365788 - DNA, 22 bp, Homo sapiens
cctgggctttgagggcaggatg

SEQ ID NO: 9365789 - DNA, 20 bp, Homo sapiens
aggtcctggttctctgggat

SEQ ID NO: 9365790 - DNA, 20 bp, Homo sapiens
aggtcctggttctctgggat

SEQ ID NO: 9365791 - DNA, 20 bp, Homo sapiens
aggtcctggttctctgggat

SEQ ID NO: 9365792 - DNA, 22 bp, Homo sapiens
cctggggctctgcacagagcag

SEQ ID NO: 9365793 - DNA, 22 bp, Homo sapiens
cctggggctctgcacagagcag

SEQ ID NO: 9365794 - DNA, 22 bp, Homo sapiens
cctggggtatataggtgaatat

SEQ ID NO: 9365795 - DNA, 20 bp, Homo sapiens
cctggggtacactggcatgt

SEQ ID NO: 9365796 - DNA, 22 bp, Homo sapiens
cctgggggccaggaaggtgtga

SEQ ID NO: 9365797 - DNA, 22 bp, Homo sapiens
cctggggctttctttgtatcat

SEQ ID NO: 9365798 - DNA, 22 bp, Homo sapiens
aggtaaggctgtaagctaagcc

SEQ ID NO: 9365799 - DNA, 22 bp, Homo sapiens
aggtaaggaaattgaggcaatt

SEQ ID NO: 9365800 - DNA, 22 bp, Homo sapiens
aggtaaggctgtaagctaagcc

SEQ ID NO: 9365801 - DNA, 22 bp, Homo sapiens
aggtaagcatggtggctgctgt

SEQ ID NO: 9365802 - DNA, 22 bp, Homo sapiens
aggtaagcctggaggcttctat

SEQ ID NO: 9365803 - DNA, 22 bp, Homo sapiens
aggtaaagactgcaaggagaat

SEQ ID NO: 9365804 - DNA, 22 bp, Homo sapiens
aggtaaagactgcaaggagaat

SEQ ID NO: 9365805 - DNA, 22 bp, Homo sapiens
aggtaaagacagtgaaagaggg

SEQ ID NO: 9365806 - DNA, 22 bp, Homo sapiens
aggtaaagacagtgaaagaggg

SEQ ID NO: 9365807 - DNA, 22 bp, Homo sapiens
aggtaaagacagtgaaagaggg

SEQ ID NO: 9365808 - DNA, 22 bp, Homo sapiens
aggtaaattcagcagtgacatt

SEQ ID NO: 9365809 - DNA, 22 bp, Homo sapiens
aggtaacactacttagtatact

SEQ ID NO: 9365810 - DNA, 22 bp, Homo sapiens
aggtacagcaatataagaggtc

SEQ ID NO: 9365811 - DNA, 22 bp, Homo sapiens
aggtcacacaactgtcagaggc

SEQ ID NO: 9365812 - DNA, 22 bp, Homo sapiens
aggtatttatgagagcacatat

SEQ ID NO: 9365813 - DNA, 22 bp, Homo sapiens
aggtaaggtttggaggcagtgg

SEQ ID NO: 9365814 - DNA, 22 bp, Homo sapiens
aggtaatagggttcagaattat

SEQ ID NO: 9365815 - DNA, 22 bp, Homo sapiens
aggtacagatgaaagtctagtt

SEQ ID NO: 9365816 - DNA, 22 bp, Homo sapiens
aggtacaaaagagtatatgaga

SEQ ID NO: 9365817 - DNA, 22 bp, Homo sapiens
cctgaggttgaagtataaattg

SEQ ID NO: 9365818 - DNA, 19 bp, Homo sapiens
cctgaggtggggtggaagg

SEQ ID NO: 9365819 - DNA, 18 bp, Homo sapiens
cctgaggtgggaggaagg

SEQ ID NO: 9365820 - DNA, 22 bp, Homo sapiens
cctgaggtggctgcagcactgc

SEQ ID NO: 9365821 - DNA, 22 bp, Homo sapiens
cctgagtaacatggtgagaacc

SEQ ID NO: 9365822 - DNA, 22 bp, Homo sapiens
cctgaggtttttggatagttgt

SEQ ID NO: 9365823 - DNA, 22 bp, Homo sapiens
cctgagtagctggaattaaagg

SEQ ID NO: 9365824 - DNA, 23 bp, Homo sapiens
agggtggcttgctttgcttcctt

SEQ ID NO: 9365825 - DNA, 22 bp, Homo sapiens
agggttgcagcagaggcccagt

SEQ ID NO: 9365826 - DNA, 22 bp, Homo sapiens
agggttgcaggggccatgccca

SEQ ID NO: 9365827 - DNA, 22 bp, Homo sapiens
aggtaaagaaaggtgtaacatt

SEQ ID NO: 9365828 - DNA, 22 bp, Homo sapiens
agggttttggctgaagttcagc

SEQ ID NO: 9365829 - DNA, 23 bp, Homo sapiens
agggttgtgtgcttcatgatcat

SEQ ID NO: 9365830 - DNA, 22 bp, Homo sapiens
agggttgcttgagcccaggagt

SEQ ID NO: 9365831 - DNA, 22 bp, Homo sapiens
cctgggaggtggaggttgcagc

SEQ ID NO: 9365832 - DNA, 22 bp, Homo sapiens
cctgggaggtggaggttgcagc

SEQ ID NO: 9365833 - DNA, 22 bp, Homo sapiens
cctgggaggtggaggttgcagc

SEQ ID NO: 9365834 - DNA, 22 bp, Homo sapiens
cctgggaggtggaggttgcagt

SEQ ID NO: 9365835 - DNA, 22 bp, Homo sapiens
cctgggaggtggaggttgcagt

SEQ ID NO: 9365836 - DNA, 22 bp, Homo sapiens
cctgggaggtggaggttgcagt

SEQ ID NO: 9365837 - DNA, 22 bp, Homo sapiens
cctgggaggctgtttccagcct

SEQ ID NO: 9365838 - DNA, 22 bp, Homo sapiens
cctgggagggcaagtgctgatg

SEQ ID NO: 9365839 - DNA, 22 bp, Homo sapiens
cctgggagggcaagtgctgatg

SEQ ID NO: 9365840 - DNA, 22 bp, Homo sapiens
cctgggagggcaagtgctgatg

SEQ ID NO: 9365841 - DNA, 22 bp, Homo sapiens
cctgggaggctgtttccagcct

SEQ ID NO: 9365842 - DNA, 22 bp, Homo sapiens
cctgggaggctgtttccagcct

SEQ ID NO: 9365843 - DNA, 22 bp, Homo sapiens
cctgggaggctgtgggtctgct

SEQ ID NO: 9365844 - DNA, 22 bp, Homo sapiens
aggtcaggtatcagcaggtatt

SEQ ID NO: 9365845 - DNA, 22 bp, Homo sapiens
aggtcaggtatcagcaggtatt

SEQ ID NO: 9365846 - DNA, 22 bp, Homo sapiens
aggtcaggaggttaagagtctt

SEQ ID NO: 9365847 - DNA, 22 bp, Homo sapiens
aggtcaggaggttaagagtctt

SEQ ID NO: 9365848 - DNA, 22 bp, Homo sapiens
aggtcagggtattcacgtctgt

SEQ ID NO: 9365849 - DNA, 22 bp, Homo sapiens
aggtcaggaggttaagagtctt

SEQ ID NO: 9365850 - DNA, 20 bp, Homo sapiens
aggtcagtagaatgattttg

SEQ ID NO: 9365851 - DNA, 22 bp, Homo sapiens
aggtcaggtatcagcaggtatt

SEQ ID NO: 9365852 - DNA, 22 bp, Homo sapiens
aggtcaggtatcagcaggtatt

SEQ ID NO: 9365853 - DNA, 22 bp, Homo sapiens
cctgggagaactgctgggttgg

SEQ ID NO: 9365854 - DNA, 22 bp, Homo sapiens
cctgggaggctgaggctgcagt

SEQ ID NO: 9365855 - DNA, 22 bp, Homo sapiens
cctgggaggctgaggctgcagt

SEQ ID NO: 9365856 - DNA, 22 bp, Homo sapiens
cctgggaggctgtgggtctgct

SEQ ID NO: 9365857 - DNA, 22 bp, Homo sapiens
cctgggaggctgtgggtctgct

SEQ ID NO: 9365858 - DNA, 22 bp, Homo sapiens
cctgggaggctgaggctgcagt

SEQ ID NO: 9365859 - DNA, 22 bp, Homo sapiens
cctgggaggctgaggctgcagt

SEQ ID NO: 9365860 - DNA, 22 bp, Homo sapiens
aggtcacagggttgaagtactt

SEQ ID NO: 9365861 - DNA, 22 bp, Homo sapiens
aggtcacccgtttgactatcca

SEQ ID NO: 9365862 - DNA, 22 bp, Homo sapiens
aggtcacccgtttgactatcca

SEQ ID NO: 9365863 - DNA, 22 bp, Homo sapiens
aggtcaccatggcatgctccac

SEQ ID NO: 9365864 - DNA, 22 bp, Homo sapiens
aggtcaccatggcatgctccac

SEQ ID NO: 9365865 - DNA, 22 bp, Homo sapiens
aggtcagaagtgccagggaatt

SEQ ID NO: 9365866 - DNA, 22 bp, Homo sapiens
aggtcagaaaaggagagcattg

SEQ ID NO: 9365867 - DNA, 22 bp, Homo sapiens
aggtcacttcctgtctggataa

SEQ ID NO: 9365868 - DNA, 22 bp, Homo sapiens
aggtcacgtcctgtgatgtcat

SEQ ID NO: 9365869 - DNA, 23 bp, Homo sapiens
aggtcagcaggcaaggaaatggc

SEQ ID NO: 9365870 - DNA, 22 bp, Homo sapiens
aggtcagcatgagtagaaggta

SEQ ID NO: 9365871 - DNA, 22 bp, Homo sapiens
aggtcagatgggagatgggatg

SEQ ID NO: 9365872 - DNA, 22 bp, Homo sapiens
aggtcagctgcactggtgtaat

SEQ ID NO: 9365873 - DNA, 21 bp, Homo sapiens
aggtcagcccagctctggaag

SEQ ID NO: 9365874 - DNA, 22 bp, Homo sapiens
aggtcagccctctctgggcagg

SEQ ID NO: 9365875 - DNA, 22 bp, Homo sapiens
aggtcagcatgagtagaaggta

SEQ ID NO: 9365876 - DNA, 22 bp, Homo sapiens
aggtcagctgctgataggcagc

SEQ ID NO: 9365877 - DNA, 22 bp, Homo sapiens
aggtcagctgctgataggcagc

SEQ ID NO: 9365878 - DNA, 18 bp, Homo sapiens
aggtcaggaaagcagagt

SEQ ID NO: 9365879 - DNA, 22 bp, Homo sapiens
aggtcaggaggcctctgccatt

SEQ ID NO: 9365880 - DNA, 22 bp, Homo sapiens
aggtcaggaggcctctgccatt

SEQ ID NO: 9365881 - DNA, 22 bp, Homo sapiens
agtagaaagttgcaggaggaat

SEQ ID NO: 9365882 - DNA, 22 bp, Homo sapiens
agtaacagaaggcctgacttaa

SEQ ID NO: 9365883 - DNA, 22 bp, Homo sapiens
agtagacatgagcaatgataat

SEQ ID NO: 9365884 - DNA, 19 bp, Homo sapiens
agtagacattttcatgttt

SEQ ID NO: 9365885 - DNA, 22 bp, Homo sapiens
agtagatttttgaatgtaagtt

SEQ ID NO: 9365886 - DNA, 22 bp, Homo sapiens
agtagattttagattacatagt

SEQ ID NO: 9365887 - DNA, 19 bp, Homo sapiens
agtagcagaaagtgcagtg

SEQ ID NO: 9365888 - DNA, 19 bp, Homo sapiens
agtagcagaaagtgcagtg

SEQ ID NO: 9365889 - DNA, 20 bp, Homo sapiens
agtagcagtaatatggaaga

SEQ ID NO: 9365890 - DNA, 22 bp, Homo sapiens
agtagcagagttggactatgca

SEQ ID NO: 9365891 - DNA, 20 bp, Homo sapiens
agtagcagtgtgacattgac

SEQ ID NO: 9365892 - DNA, 22 bp, Homo sapiens
agtagcagtgacagctgaggta

SEQ ID NO: 9365893 - DNA, 22 bp, Homo sapiens
agtagcagtgacagctgaggta

SEQ ID NO: 9365894 - DNA, 22 bp, Homo sapiens
agtagcagtgacagctgaggta

SEQ ID NO: 9365895 - DNA, 22 bp, Homo sapiens
agtaggaggcgggagcatgaag

SEQ ID NO: 9365896 - DNA, 22 bp, Homo sapiens
agtagccaattaagtggcaagc

SEQ ID NO: 9365897 - DNA, 22 bp, Homo sapiens
agtaggaggcgggagcatgaag

SEQ ID NO: 9365898 - DNA, 22 bp, Homo sapiens
agtaggaggcgggagcatgaag

SEQ ID NO: 9365899 - DNA, 22 bp, Homo sapiens
agtagggaatacattggggtaa

SEQ ID NO: 9365900 - DNA, 22 bp, Homo sapiens
agtagggagaccggaggccgcc

SEQ ID NO: 9365901 - DNA, 22 bp, Homo sapiens
agtagggaatacattggggtaa

SEQ ID NO: 9365902 - DNA, 22 bp, Homo sapiens
agtagggagaccggaggccgcc

SEQ ID NO: 9365903 - DNA, 22 bp, Homo sapiens
agtagggagaccggaggccgcc

SEQ ID NO: 9365904 - DNA, 22 bp, Homo sapiens
agtcaagattctggcactagca

SEQ ID NO: 9365905 - DNA, 22 bp, Homo sapiens
agtatttctgaatattatcata

SEQ ID NO: 9365906 - DNA, 22 bp, Homo sapiens
ccttctcccctctgcagggtgt

SEQ ID NO: 9365907 - DNA, 22 bp, Homo sapiens
ccttctccctctgagaggaacc

SEQ ID NO: 9365908 - DNA, 22 bp, Homo sapiens
ccttctcccctctgcagggtgt

SEQ ID NO: 9365909 - DNA, 22 bp, Homo sapiens
ccttctcccctctgcagggtgt

SEQ ID NO: 9365910 - DNA, 22 bp, Homo sapiens
ccttctcccctctgcagggtgt

SEQ ID NO: 9365911 - DNA, 21 bp, Homo sapiens
ccttctccattacagtaagct

SEQ ID NO: 9365912 - DNA, 21 bp, Homo sapiens
ccttctccattacagtaagct

SEQ ID NO: 9365913 - DNA, 22 bp, Homo sapiens
ccttccagtgactaaggaggaa

SEQ ID NO: 9365914 - DNA, 20 bp, Homo sapiens
ccttctccagcttgttcttg

SEQ ID NO: 9365915 - DNA, 21 bp, Homo sapiens
ccttctccattacagtaagct

SEQ ID NO: 9365916 - DNA, 20 bp, Homo sapiens
ccttctccagcttgttcttg

SEQ ID NO: 9365917 - DNA, 21 bp, Homo sapiens
ccttctccattacagtaagct

SEQ ID NO: 9365918 - DNA, 21 bp, Homo sapiens
ccttctccattacagtaagct

SEQ ID NO: 9365919 - DNA, 22 bp, Homo sapiens
agtaaaaatatgcttgtggcta

SEQ ID NO: 9365920 - DNA, 22 bp, Homo sapiens
agtaaacagtttcttagaagaa

SEQ ID NO: 9365921 - DNA, 22 bp, Homo sapiens
agtaaacagtaggaactgagaa

SEQ ID NO: 9365922 - DNA, 22 bp, Homo sapiens
agtaaacagtaggaactgagaa

SEQ ID NO: 9365923 - DNA, 22 bp, Homo sapiens
ccttctcctgccttgggttcat

SEQ ID NO: 9365924 - DNA, 22 bp, Homo sapiens
ccttctcctgccttgggttcat

SEQ ID NO: 9365925 - DNA, 22 bp, Homo sapiens
ccttctccctctgagaggaacc

SEQ ID NO: 9365926 - DNA, 22 bp, Homo sapiens
ccttctccctctgagaggaacc

SEQ ID NO: 9365927 - DNA, 22 bp, Homo sapiens
ccttctccctctgagaggaacc

SEQ ID NO: 9365928 - DNA, 22 bp, Homo sapiens
ccttctcctgccttgggttcat

SEQ ID NO: 9365929 - DNA, 22 bp, Homo sapiens
ccttctctactcctgatgcatg

SEQ ID NO: 9365930 - DNA, 22 bp, Homo sapiens
ccttctctactcctgatgcatg

SEQ ID NO: 9365931 - DNA, 22 bp, Homo sapiens
agtaaagtaccaaagtgtgagt

SEQ ID NO: 9365932 - DNA, 22 bp, Homo sapiens
agtaaataacagagaaaatggg

SEQ ID NO: 9365933 - DNA, 18 bp, Homo sapiens
agtaaatgttaaatattg

SEQ ID NO: 9365934 - DNA, 22 bp, Homo sapiens
agtaaagcagagttgcagtaca

SEQ ID NO: 9365935 - DNA, 22 bp, Homo sapiens
agtaaactgtgggtacagatgt

SEQ ID NO: 9365936 - DNA, 22 bp, Homo sapiens
agtaaacatttcagatttattt

SEQ ID NO: 9365937 - DNA, 22 bp, Homo sapiens
agtaaacattttcatattttct

SEQ ID NO: 9365938 - DNA, 22 bp, Homo sapiens
agtaaacagtttcttagaagaa

SEQ ID NO: 9365939 - DNA, 22 bp, Homo sapiens
agtaaacagtttcttagaagaa

SEQ ID NO: 9365940 - DNA, 22 bp, Homo sapiens
agtaaacatttcagatttattt

SEQ ID NO: 9365941 - DNA, 22 bp, Homo sapiens
agtaaacatgtaattgttcatt

SEQ ID NO: 9365942 - DNA, 22 bp, Homo sapiens
agtaaacatgtaattgttcatt

SEQ ID NO: 9365943 - DNA, 22 bp, Homo sapiens
agtaaacatgtaattgttcatt

SEQ ID NO: 9365944 - DNA, 22 bp, Homo sapiens
agtcacagaaacccaggtgtgg

SEQ ID NO: 9365945 - DNA, 20 bp, Homo sapiens
agtcacaggcctggaacatg

SEQ ID NO: 9365946 - DNA, 22 bp, Homo sapiens
agtcacaggcaagagggctcca

SEQ ID NO: 9365947 - DNA, 22 bp, Homo sapiens
agtcacaggttcttgggattag

SEQ ID NO: 9365948 - DNA, 22 bp, Homo sapiens
agtcacatcgattataaaattt

SEQ ID NO: 9365949 - DNA, 22 bp, Homo sapiens
ctagacttcagctttgtgatct

SEQ ID NO: 9365950 - DNA, 22 bp, Homo sapiens
ctagcctgggatttgaacttat

SEQ ID NO: 9365951 - DNA, 22 bp, Homo sapiens
ctagcctgggatttgaacttat

SEQ ID NO: 9365952 - DNA, 19 bp, Homo sapiens
ctagcttgtcatttgtgtg

SEQ ID NO: 9365953 - DNA, 22 bp, Homo sapiens
ctagctttgtccattgtcttgc

SEQ ID NO: 9365954 - DNA, 22 bp, Homo sapiens
ctagctttttatgacaatcttg

SEQ ID NO: 9365955 - DNA, 22 bp, Homo sapiens
ctaggaaagacacagagagttt

SEQ ID NO: 9365956 - DNA, 22 bp, Homo sapiens
ctaggaatagcaaagtaggaca

SEQ ID NO: 9365957 - DNA, 22 bp, Homo sapiens
ctaggcacttgtaaggccgctc

SEQ ID NO: 9365958 - DNA, 22 bp, Homo sapiens
ctaggcactcacgtggctttag

SEQ ID NO: 9365959 - DNA, 22 bp, Homo sapiens
ctaggcagactgagctctaggg

SEQ ID NO: 9365960 - DNA, 22 bp, Homo sapiens
ctaggcagactgagctctaggg

SEQ ID NO: 9365961 - DNA, 22 bp, Homo sapiens
ctaggaggcgggggctgcagta

SEQ ID NO: 9365962 - DNA, 22 bp, Homo sapiens
ctaggaggcgggggctgcagta

SEQ ID NO: 9365963 - DNA, 22 bp, Homo sapiens
ctaggaatggtacctcttacaa

SEQ ID NO: 9365964 - DNA, 22 bp, Homo sapiens
ctaggaatcaccaagattctag

SEQ ID NO: 9365965 - DNA, 22 bp, Homo sapiens
ctaggaatccttttagagttgg

SEQ ID NO: 9365966 - DNA, 22 bp, Homo sapiens
ctatatttggtgagggatgtct

SEQ ID NO: 9365967 - DNA, 22 bp, Homo sapiens
ctatatttcttggctttaaaca

SEQ ID NO: 9365968 - DNA, 22 bp, Homo sapiens
ctatatttcttggctttaaaca

SEQ ID NO: 9365969 - DNA, 22 bp, Homo sapiens
ctatatttggtgagggatgtct

SEQ ID NO: 9365970 - DNA, 22 bp, Homo sapiens
ctatatttggtgagggatgtct

SEQ ID NO: 9365971 - DNA, 22 bp, Homo sapiens
ctatccatatcctgggcatggc

SEQ ID NO: 9365972 - DNA, 22 bp, Homo sapiens
ctatatctacatttgctgtttg

SEQ ID NO: 9365973 - DNA, 22 bp, Homo sapiens
ctagtgaaatttgcaagtaatt

SEQ ID NO: 9365974 - DNA, 22 bp, Homo sapiens
agtcaggatttaaactcagaca

SEQ ID NO: 9365975 - DNA, 22 bp, Homo sapiens
ctaggcagactgagctctaggg

SEQ ID NO: 9365976 - DNA, 22 bp, Homo sapiens
agtcagcagcctggccaggaga

SEQ ID NO: 9365977 - DNA, 22 bp, Homo sapiens
agtcagcagtgaaagcacagcc

SEQ ID NO: 9365978 - DNA, 22 bp, Homo sapiens
agtcagcagtgaaagcacagcc

SEQ ID NO: 9365979 - DNA, 22 bp, Homo sapiens
agtcagcattttcactgagcta

SEQ ID NO: 9365980 - DNA, 22 bp, Homo sapiens
agtcagctgcagcagctttggt

SEQ ID NO: 9365981 - DNA, 22 bp, Homo sapiens
agtcaggagctgctgcattgta

SEQ ID NO: 9365982 - DNA, 22 bp, Homo sapiens
agtcaggatatgccttgtgggc

SEQ ID NO: 9365983 - DNA, 22 bp, Homo sapiens
agtcaggagctgctgcattgta

SEQ ID NO: 9365984 - DNA, 22 bp, Homo sapiens
agtcaggaacctcagcaagtct

SEQ ID NO: 9365985 - DNA, 18 bp, Homo sapiens
ctatccctggagcttggg

SEQ ID NO: 9365986 - DNA, 22 bp, Homo sapiens
ctatccattttcctatgacact

SEQ ID NO: 9365987 - DNA, 22 bp, Homo sapiens
ctatccattaaagccttggaaa

SEQ ID NO: 9365988 - DNA, 22 bp, Homo sapiens
ctatctgtaaatttgaggttct

SEQ ID NO: 9365989 - DNA, 22 bp, Homo sapiens
ctattctgcttgaaattattct

SEQ ID NO: 9365990 - DNA, 22 bp, Homo sapiens
ctatttatctatttctgaatga

SEQ ID NO: 9365991 - DNA, 22 bp, Homo sapiens
ctatttacgctgctggggatca

SEQ ID NO: 9365992 - DNA, 22 bp, Homo sapiens
ctatttatctatttctgaatga

SEQ ID NO: 9365993 - DNA, 22 bp, Homo sapiens
agtcctgggtctggagaatgga

SEQ ID NO: 9365994 - DNA, 22 bp, Homo sapiens
ctattggtatttgaaacataaa

SEQ ID NO: 9365995 - DNA, 22 bp, Homo sapiens
ctattgtttctatgctctgagg

SEQ ID NO: 9365996 - DNA, 22 bp, Homo sapiens
ctattgttataattgttgacat

SEQ ID NO: 9365997 - DNA, 22 bp, Homo sapiens
ctattgaggacataaggactct

SEQ ID NO: 9365998 - DNA, 22 bp, Homo sapiens
atctggttcttcttaggcatca

SEQ ID NO: 9365999 - DNA, 22 bp, Homo sapiens
atctggtttggggatccttgtg

SEQ ID NO: 9366000 - DNA, 22 bp, Homo sapiens
atctgtaacatcagtagcagaa

SEQ ID NO: 9366001 - DNA, 22 bp, Homo sapiens
atctgtatatttttcaatgcaa

SEQ ID NO: 9366002 - DNA, 22 bp, Homo sapiens
atctgtagaagatactctgaga

SEQ ID NO: 9366003 - DNA, 22 bp, Homo sapiens
atctgtcaggagcaaggactac

SEQ ID NO: 9366004 - DNA, 22 bp, Homo sapiens
atctgtcaagatagactctgca

SEQ ID NO: 9366005 - DNA, 22 bp, Homo sapiens
atctggctcgctaggctctggg

SEQ ID NO: 9366006 - DNA, 22 bp, Homo sapiens
atctgggtttcaaagaagcctt

SEQ ID NO: 9366007 - DNA, 22 bp, Homo sapiens
atctgggtttaaatctcagctt

SEQ ID NO: 9366008 - DNA, 22 bp, Homo sapiens
cttcttaaatatttggctgact

SEQ ID NO: 9366009 - DNA, 22 bp, Homo sapiens
cttctgttactgttagctgaag

SEQ ID NO: 9366010 - DNA, 22 bp, Homo sapiens
atctgttatttacccatctctg

SEQ ID NO: 9366011 - DNA, 22 bp, Homo sapiens
atcttatttaacacagcaaaac

SEQ ID NO: 9366012 - DNA, 22 bp, Homo sapiens
atctgtggctggtgagaggcag

SEQ ID NO: 9366013 - DNA, 22 bp, Homo sapiens
atctgtgtgttattgtttatca

SEQ ID NO: 9366014 - DNA, 23 bp, Homo sapiens
atctgtgtgtgggtagggatgat

SEQ ID NO: 9366015 - DNA, 22 bp, Homo sapiens
atctgtgatcaagacagacagt

SEQ ID NO: 9366016 - DNA, 22 bp, Homo sapiens
atctgtggaaattggcaagtgc

SEQ ID NO: 9366017 - DNA, 22 bp, Homo sapiens
atctgtcttgccttgcatattt

SEQ ID NO: 9366018 - DNA, 22 bp, Homo sapiens
atctgtcttccaccacacatcc

SEQ ID NO: 9366019 - DNA, 22 bp, Homo sapiens
atctgtctgagtgcttaggacc

SEQ ID NO: 9366020 - DNA, 22 bp, Homo sapiens
atctgtctatgatatagtctgt

SEQ ID NO: 9366021 - DNA, 22 bp, Homo sapiens
atctgtcctccagcatctccat

SEQ ID NO: 9366022 - DNA, 22 bp, Homo sapiens
atctgtccctggtccaagattt

SEQ ID NO: 9366023 - DNA, 18 bp, Homo sapiens
atctgtcctttctctgcc

SEQ ID NO: 9366024 - DNA, 22 bp, Homo sapiens
atctccccgagcttacctcctg

SEQ ID NO: 9366025 - DNA, 22 bp, Homo sapiens
atctcctcccgcgccgagctcg

SEQ ID NO: 9366026 - DNA, 20 bp, Homo sapiens
atctcctgctaccacccatt

SEQ ID NO: 9366027 - DNA, 20 bp, Homo sapiens
atctcctgctaccacccatt

SEQ ID NO: 9366028 - DNA, 22 bp, Homo sapiens
atctccccgagcttacctcctg

SEQ ID NO: 9366029 - DNA, 18 bp, Homo sapiens
atctcccattggccaagg

SEQ ID NO: 9366030 - DNA, 22 bp, Homo sapiens
atctccccgagcttacctcctg

SEQ ID NO: 9366031 - DNA, 22 bp, Homo sapiens
atctccgaaagtcttgtcaccc

SEQ ID NO: 9366032 - DNA, 21 bp, Homo sapiens
atctccccttccttgtaggtg

SEQ ID NO: 9366033 - DNA, 22 bp, Homo sapiens
cttcctttcagaggaaggcctg

SEQ ID NO: 9366034 - DNA, 22 bp, Homo sapiens
cttccttgtggtccttctcatt

SEQ ID NO: 9366035 - DNA, 22 bp, Homo sapiens
atctctgaaggctccaggagag

SEQ ID NO: 9366036 - DNA, 23 bp, Homo sapiens
atctctctttattcttggggata

SEQ ID NO: 9366037 - DNA, 22 bp, Homo sapiens
cttctccttatatgtcccgttc

SEQ ID NO: 9366038 - DNA, 22 bp, Homo sapiens
cttctccttatatgtcccgttc

SEQ ID NO: 9366039 - DNA, 22 bp, Homo sapiens
cttctgagatgttgttttacag

SEQ ID NO: 9366040 - DNA, 22 bp, Homo sapiens
cttctgagatgttgttttacag

SEQ ID NO: 9366041 - DNA, 22 bp, Homo sapiens
cttctgagatgttgttttacag

SEQ ID NO: 9366042 - DNA, 17 bp, Homo sapiens
atctctctaaggcaggc

SEQ ID NO: 9366043 - DNA, 22 bp, Homo sapiens
atctctccttatgaagcattat

SEQ ID NO: 9366044 - DNA, 22 bp, Homo sapiens
atctctccttatgaagcattat

SEQ ID NO: 9366045 - DNA, 22 bp, Homo sapiens
atctctatctttattgaaatct

SEQ ID NO: 9366046 - DNA, 22 bp, Homo sapiens
atctctagctaaccctctggca

SEQ ID NO: 9366047 - DNA, 23 bp, Homo sapiens
atctctctggtggtcacagtcag

SEQ ID NO: 9366048 - DNA, 23 bp, Homo sapiens
atctctctggtggtcacagtcag

SEQ ID NO: 9366049 - DNA, 15 bp, Homo sapiens
atctctctagctgct

SEQ ID NO: 9366050 - DNA, 22 bp, Homo sapiens
atctctctatgcactgaggact

SEQ ID NO: 9366051 - DNA, 22 bp, Homo sapiens
atctctctgcccaggggctgtg

SEQ ID NO: 9366052 - DNA, 22 bp, Homo sapiens
cttctgaggactctaaagagga

SEQ ID NO: 9366053 - DNA, 22 bp, Homo sapiens
cttctgagatgttgttttacag

SEQ ID NO: 9366054 - DNA, 22 bp, Homo sapiens
cttctgagatgttgttttacag

SEQ ID NO: 9366055 - DNA, 22 bp, Homo sapiens
cttctgagcagacctcctgggg

SEQ ID NO: 9366056 - DNA, 22 bp, Homo sapiens
cttctgagatgttgttttacag

SEQ ID NO: 9366057 - DNA, 22 bp, Homo sapiens
cttctgattagcaagtttgtat

SEQ ID NO: 9366058 - DNA, 19 bp, Homo sapiens
cttctgatggaaagccaac

SEQ ID NO: 9366059 - DNA, 22 bp, Homo sapiens
cttctgattagcaagtttgtat

SEQ ID NO: 9366060 - DNA, 19 bp, Homo sapiens
cttctgcagggtgacagtg

SEQ ID NO: 9366061 - DNA, 22 bp, Homo sapiens
cttctgcaggccctgtctgacc

SEQ ID NO: 9366062 - DNA, 19 bp, Homo sapiens
cttctgtgatacatcagtc

SEQ ID NO: 9366063 - DNA, 19 bp, Homo sapiens
cttctgtgatacatcagtc

SEQ ID NO: 9366064 - DNA, 22 bp, Homo sapiens
cttctgtgatttggttaggata

SEQ ID NO: 9366065 - DNA, 22 bp, Homo sapiens
cttctgtgatttggttaggata

SEQ ID NO: 9366066 - DNA, 22 bp, Homo sapiens
cttctgtgcaattgtggaggag

SEQ ID NO: 9366067 - DNA, 22 bp, Homo sapiens
cttctgtgttaaatgagtcttt

SEQ ID NO: 9366068 - DNA, 22 bp, Homo sapiens
cttctgtgtagaaaggtagccc

SEQ ID NO: 9366069 - DNA, 22 bp, Homo sapiens
cttctgtgttttactatatgta

SEQ ID NO: 9366070 - DNA, 22 bp, Homo sapiens
cttctgtgcttcacagttgcca

SEQ ID NO: 9366071 - DNA, 22 bp, Homo sapiens
cttctgtggtaaactttgttgt

SEQ ID NO: 9366072 - DNA, 22 bp, Homo sapiens
cttctgtggatgttggatgcat

SEQ ID NO: 9366073 - DNA, 22 bp, Homo sapiens
atccatgattgcccagaggtgt

SEQ ID NO: 9366074 - DNA, 22 bp, Homo sapiens
atccatttctatcttgctgagg

SEQ ID NO: 9366075 - DNA, 22 bp, Homo sapiens
atccatttctatcttgctgagg

SEQ ID NO: 9366076 - DNA, 22 bp, Homo sapiens
atccatctttcctgctgaactg

SEQ ID NO: 9366077 - DNA, 22 bp, Homo sapiens
atccatgaccctctcaacaacc

SEQ ID NO: 9366078 - DNA, 22 bp, Homo sapiens
cttaatctcacctgcaaagtcc

SEQ ID NO: 9366079 - DNA, 22 bp, Homo sapiens
cttaatctcacctgcaaagtcc

SEQ ID NO: 9366080 - DNA, 22 bp, Homo sapiens
cttaagatttgcgatacctaat

SEQ ID NO: 9366081 - DNA, 22 bp, Homo sapiens
cttaagatttgagatacctaat

SEQ ID NO: 9366082 - DNA, 22 bp, Homo sapiens
cttaagatgaggtcatgctata

SEQ ID NO: 9366083 - DNA, 22 bp, Homo sapiens
cttaacatggggggtaagtctg

SEQ ID NO: 9366084 - DNA, 22 bp, Homo sapiens
cttaacagagagaagtgttgct

SEQ ID NO: 9366085 - DNA, 21 bp, Homo sapiens
cttaacattttaaatgaaagg

SEQ ID NO: 9366086 - DNA, 22 bp, Homo sapiens
ctgtttctcccatgtccaagtg

SEQ ID NO: 9366087 - DNA, 22 bp, Homo sapiens
ctgtttctcccaacgccctagt

SEQ ID NO: 9366088 - DNA, 22 bp, Homo sapiens
ctgtttctcccatgtccaagtg

SEQ ID NO: 9366089 - DNA, 22 bp, Homo sapiens
ctgtttctccacactcttccca

SEQ ID NO: 9366090 - DNA, 22 bp, Homo sapiens
atcatcagggacatttctgtgc

SEQ ID NO: 9366091 - DNA, 22 bp, Homo sapiens
atcatcatcaacaagaaacatt

SEQ ID NO: 9366092 - DNA, 22 bp, Homo sapiens
atcatacatgtaactaagtaaa

SEQ ID NO: 9366093 - DNA, 19 bp, Homo sapiens
atcatacatgttacactct

SEQ ID NO: 9366094 - DNA, 22 bp, Homo sapiens
atcatacagaacctgagcactt

SEQ ID NO: 9366095 - DNA, 22 bp, Homo sapiens
atcatacagcctttgttagtgt

SEQ ID NO: 9366096 - DNA, 22 bp, Homo sapiens
cttcaaggtggctaaatggggc

SEQ ID NO: 9366097 - DNA, 22 bp, Homo sapiens
cttcaagtcgccaaatgctgaa

SEQ ID NO: 9366098 - DNA, 22 bp, Homo sapiens
cttccttctgaagcatagaagc

SEQ ID NO: 9366099 - DNA, 22 bp, Homo sapiens
cttccttctcactagcagcgcc

SEQ ID NO: 9366100 - DNA, 22 bp, Homo sapiens
cttccttccttccccgaaatgc

SEQ ID NO: 9366101 - DNA, 22 bp, Homo sapiens
cttccttccttccccgaaatgc

SEQ ID NO: 9366102 - DNA, 22 bp, Homo sapiens
cttcctctcttgcccataagag

SEQ ID NO: 9366103 - DNA, 22 bp, Homo sapiens
cttccttccacaccttcagaat

SEQ ID NO: 9366104 - DNA, 22 bp, Homo sapiens
cttccttccacaccttcagaat

SEQ ID NO: 9366105 - DNA, 22 bp, Homo sapiens
cttcctctatgttcaggtagaa

SEQ ID NO: 9366106 - DNA, 22 bp, Homo sapiens
cttccttctgaagcatagaagc

SEQ ID NO: 9366107 - DNA, 22 bp, Homo sapiens
cttccttctgtaagaccagttg

SEQ ID NO: 9366108 - DNA, 22 bp, Homo sapiens
cttatgtacacacatatattgt

SEQ ID NO: 9366109 - DNA, 22 bp, Homo sapiens
cttcaacagttttagaacactg

SEQ ID NO: 9366110 - DNA, 22 bp, Homo sapiens
cttcaagaagacagcagagcat

SEQ ID NO: 9366111 - DNA, 22 bp, Homo sapiens
cttcaactttgtaagtagaatt

SEQ ID NO: 9366112 - DNA, 22 bp, Homo sapiens
cttcaaattcgaggagtagatg

SEQ ID NO: 9366113 - DNA, 21 bp, Homo sapiens
ctgtcgcaggtcgccccaccc

SEQ ID NO: 9366114 - DNA, 22 bp, Homo sapiens
ctgtcgctgccaacagggctgg

SEQ ID NO: 9366115 - DNA, 22 bp, Homo sapiens
ctgtctatcccttccttccttt

SEQ ID NO: 9366116 - DNA, 20 bp, Homo sapiens
atcagctggagaacattatg

SEQ ID NO: 9366117 - DNA, 22 bp, Homo sapiens
atcaggaaaaattgtgaaaggg

SEQ ID NO: 9366118 - DNA, 22 bp, Homo sapiens
atcaggaaagaaaagcttggcg

SEQ ID NO: 9366119 - DNA, 22 bp, Homo sapiens
ctgtctctgataagctcgaggg

SEQ ID NO: 9366120 - DNA, 22 bp, Homo sapiens
ctgtctctgataagctcgaggg

SEQ ID NO: 9366121 - DNA, 22 bp, Homo sapiens
atcaggtgatgctctggttccc

SEQ ID NO: 9366122 - DNA, 22 bp, Homo sapiens
atcaggtgcattagattaatta

SEQ ID NO: 9366123 - DNA, 22 bp, Homo sapiens
ctgtctccgccctcttggtagg

SEQ ID NO: 9366124 - DNA, 22 bp, Homo sapiens
ctgtctccgccctcttggtagg

SEQ ID NO: 9366125 - DNA, 22 bp, Homo sapiens
ctgtctcctccactgcatggga

SEQ ID NO: 9366126 - DNA, 22 bp, Homo sapiens
ctgtctcctccactgcatggga

SEQ ID NO: 9366127 - DNA, 22 bp, Homo sapiens
atcataaagtgctatctgattg

SEQ ID NO: 9366128 - DNA, 22 bp, Homo sapiens
atcataaagtgctatctgattg

SEQ ID NO: 9366129 - DNA, 22 bp, Homo sapiens
atcataattgctccagtgatat

SEQ ID NO: 9366130 - DNA, 22 bp, Homo sapiens
atcataattgctccagtgatat

SEQ ID NO: 9366131 - DNA, 22 bp, Homo sapiens
atcataaaccactttgtaatct

SEQ ID NO: 9366132 - DNA, 22 bp, Homo sapiens
atcataaagtgctatctgattg

SEQ ID NO: 9366133 - DNA, 22 bp, Homo sapiens
atcagtttgtatatgaaacact

SEQ ID NO: 9366134 - DNA, 22 bp, Homo sapiens
atcagtttgtatatgaaacact

SEQ ID NO: 9366135 - DNA, 22 bp, Homo sapiens
atcagttttgggggacatactg

SEQ ID NO: 9366136 - DNA, 22 bp, Homo sapiens
atcagttttgggggacatactg

SEQ ID NO: 9366137 - DNA, 22 bp, Homo sapiens
atcagtttctgtgaagaacaca

SEQ ID NO: 9366138 - DNA, 22 bp, Homo sapiens
atcagtttggaacattcaggcc

SEQ ID NO: 9366139 - DNA, 22 bp, Homo sapiens
atcagtttaactgtcaagagcc

SEQ ID NO: 9366140 - DNA, 22 bp, Homo sapiens
atcagtttctaccatgtggaat

SEQ ID NO: 9366141 - DNA, 22 bp, Homo sapiens
atcagtttcacttgcttgcaaa

SEQ ID NO: 9366142 - DNA, 22 bp, Homo sapiens
atcagtttctgtgaagaacaca

SEQ ID NO: 9366143 - DNA, 22 bp, Homo sapiens
ctgtaatcccagctactcggga

SEQ ID NO: 9366144 - DNA, 22 bp, Homo sapiens
ctgtaatcccagctactcggga

SEQ ID NO: 9366145 - DNA, 22 bp, Homo sapiens
atcagagctagtacttgcaggt

SEQ ID NO: 9366146 - DNA, 22 bp, Homo sapiens
atcagagccttatgcttctcat

SEQ ID NO: 9366147 - DNA, 22 bp, Homo sapiens
atcagagcccggcaatttattt

SEQ ID NO: 9366148 - DNA, 22 bp, Homo sapiens
atcagagccctgatgacagact

SEQ ID NO: 9366149 - DNA, 22 bp, Homo sapiens
ctgtaatcccagctacctggga

SEQ ID NO: 9366150 - DNA, 22 bp, Homo sapiens
ctgtaatcccagctacctggga

SEQ ID NO: 9366151 - DNA, 22 bp, Homo sapiens
ctgtaaatggaactatgtagta

SEQ ID NO: 9366152 - DNA, 19 bp, Homo sapiens
atcagctgaagccttcaga

SEQ ID NO: 9366153 - DNA, 22 bp, Homo sapiens
atcagcccaccatcttcataac

SEQ ID NO: 9366154 - DNA, 22 bp, Homo sapiens
atcagcatctttaacaattacc

SEQ ID NO: 9366155 - DNA, 22 bp, Homo sapiens
atcagagctgcattttagagcc

SEQ ID NO: 9366156 - DNA, 22 bp, Homo sapiens
atcagcagatgctcaatgaaca

SEQ ID NO: 9366157 - DNA, 22 bp, Homo sapiens
atcagcaggtgctggtggagac

SEQ ID NO: 9366158 - DNA, 22 bp, Homo sapiens
atcagcagtgagtggctttcat

SEQ ID NO: 9366159 - DNA, 22 bp, Homo sapiens
atcagcaggtgctggtggagac

SEQ ID NO: 9366160 - DNA, 22 bp, Homo sapiens
atcacaaaggtctcagagcaca

SEQ ID NO: 9366161 - DNA, 22 bp, Homo sapiens
atcacaaaggtctcagagcaca

SEQ ID NO: 9366162 - DNA, 20 bp, Homo sapiens
ctgtaaactgcgtctgtaat

SEQ ID NO: 9366163 - DNA, 22 bp, Homo sapiens
atcacagcacacctgacatgta

SEQ ID NO: 9366164 - DNA, 22 bp, Homo sapiens
ctgtaaataatgacagttgact

SEQ ID NO: 9366165 - DNA, 22 bp, Homo sapiens
ctgtaaatggaactatgtagta

SEQ ID NO: 9366166 - DNA, 22 bp, Homo sapiens
ctgtaaatggaactatgtagta

SEQ ID NO: 9366167 - DNA, 22 bp, Homo sapiens
ctggtccctggacctccctgga

SEQ ID NO: 9366168 - DNA, 22 bp, Homo sapiens
ctggtccctgcagtgtgctggg

SEQ ID NO: 9366169 - DNA, 22 bp, Homo sapiens
ctggtccctgcagtgtgctggg

SEQ ID NO: 9366170 - DNA, 22 bp, Homo sapiens
ctggtccctgcagtgtgctggg

SEQ ID NO: 9366171 - DNA, 22 bp, Homo sapiens
ctggtcctccttgccttcagat

SEQ ID NO: 9366172 - DNA, 22 bp, Homo sapiens
ctggtccctggacctccctgga

SEQ ID NO: 9366173 - DNA, 22 bp, Homo sapiens
ctggtcctccttgccttcagat

SEQ ID NO: 9366174 - DNA, 22 bp, Homo sapiens
ctggtcccagctctgccaccaa

SEQ ID NO: 9366175 - DNA, 22 bp, Homo sapiens
ctggtcccagctctgccaccaa

SEQ ID NO: 9366176 - DNA, 22 bp, Homo sapiens
ctggtccagtggatgctgaggg

SEQ ID NO: 9366177 - DNA, 22 bp, Homo sapiens
ctgggtggctgtccagccagcc

SEQ ID NO: 9366178 - DNA, 22 bp, Homo sapiens
ctgggtggctgtccagccagcc

SEQ ID NO: 9366179 - DNA, 22 bp, Homo sapiens
ctgggtggctgtccagccagcc

SEQ ID NO: 9366180 - DNA, 22 bp, Homo sapiens
ctgggtggctgtccagccagcc

SEQ ID NO: 9366181 - DNA, 22 bp, Homo sapiens
ctgggtggcgtctggggccagt

SEQ ID NO: 9366182 - DNA, 22 bp, Homo sapiens
ctggtcatgccaggtttgctgc

SEQ ID NO: 9366183 - DNA, 22 bp, Homo sapiens
ctggtcatcactctaacagact

SEQ ID NO: 9366184 - DNA, 22 bp, Homo sapiens
ctggtcagggtagtgttgcaga

SEQ ID NO: 9366185 - DNA, 18 bp, Homo sapiens
ctggtcagggcaatgggc

SEQ ID NO: 9366186 - DNA, 20 bp, Homo sapiens
ctgggtggcaagcaaggggg

SEQ ID NO: 9366187 - DNA, 22 bp, Homo sapiens
ctgggtggcagagcctgcagtg

SEQ ID NO: 9366188 - DNA, 22 bp, Homo sapiens
ctgggtggcagagcctgcagtg

SEQ ID NO: 9366189 - DNA, 22 bp, Homo sapiens
ctgggtggcagagcctgcagtg

SEQ ID NO: 9366190 - DNA, 22 bp, Homo sapiens
ctgggtggcgtctggggccagt

SEQ ID NO: 9366191 - DNA, 22 bp, Homo sapiens
ctgggtggcagagcctgcagtg

SEQ ID NO: 9366192 - DNA, 22 bp, Homo sapiens
ctgggtggatcgcagccccagg

SEQ ID NO: 9366193 - DNA, 20 bp, Homo sapiens
ctgggtggcaagcaaggggg

SEQ ID NO: 9366194 - DNA, 22 bp, Homo sapiens
ctgggtggatcgcagccccagg

SEQ ID NO: 9366195 - DNA, 20 bp, Homo sapiens
ctgggtggcaagcaaggggg

SEQ ID NO: 9366196 - DNA, 18 bp, Homo sapiens
ctgggtctccaggctgcc

SEQ ID NO: 9366197 - DNA, 18 bp, Homo sapiens
ctgggtctccaggctgcc

SEQ ID NO: 9366198 - DNA, 22 bp, Homo sapiens
ctgggtggatcgcagccccagg

SEQ ID NO: 9366199 - DNA, 22 bp, Homo sapiens
atattattctagtaacagtgat

SEQ ID NO: 9366200 - DNA, 22 bp, Homo sapiens
atattattttccctggagttgt

SEQ ID NO: 9366201 - DNA, 22 bp, Homo sapiens
ctgggaggtgaacagaaaaact

SEQ ID NO: 9366202 - DNA, 22 bp, Homo sapiens
ctgggaggtgcagcaaaaatca

SEQ ID NO: 9366203 - DNA, 22 bp, Homo sapiens
ctgggaggtgcagcaaaaatca

SEQ ID NO: 9366204 - DNA, 22 bp, Homo sapiens
ctgggaggtgaacagaaaaact

SEQ ID NO: 9366205 - DNA, 22 bp, Homo sapiens
ctgggaggtggaggttgcattg

SEQ ID NO: 9366206 - DNA, 22 bp, Homo sapiens
ctgggaggtggaggttgcattg

SEQ ID NO: 9366207 - DNA, 19 bp, Homo sapiens
ctgggaggtgttcagagaa

SEQ ID NO: 9366208 - DNA, 22 bp, Homo sapiens
ctgggaggcggaggttgtagtg

SEQ ID NO: 9366209 - DNA, 22 bp, Homo sapiens
ctgggaggcggaggttgtagtg

SEQ ID NO: 9366210 - DNA, 22 bp, Homo sapiens
ctgggaggggtagccaatccta

SEQ ID NO: 9366211 - DNA, 20 bp, Homo sapiens
ctgggaggtcttccaaatca

SEQ ID NO: 9366212 - DNA, 20 bp, Homo sapiens
ctgggaggtcttccaaatca

SEQ ID NO: 9366213 - DNA, 22 bp, Homo sapiens
ctgggaggatacacaagatcag

SEQ ID NO: 9366214 - DNA, 22 bp, Homo sapiens
ctgggaggattcattgaggtga

SEQ ID NO: 9366215 - DNA, 22 bp, Homo sapiens
ctgggaggatacacaagatcag

SEQ ID NO: 9366216 - DNA, 22 bp, Homo sapiens
ctgggaggacaacttggagctc

SEQ ID NO: 9366217 - DNA, 22 bp, Homo sapiens
ctgggaggacaacttggagctc

SEQ ID NO: 9366218 - DNA, 22 bp, Homo sapiens
ctgggaggacaacttggagctc

SEQ ID NO: 9366219 - DNA, 22 bp, Homo sapiens
ctggggctgtaggaggacttat

SEQ ID NO: 9366220 - DNA, 22 bp, Homo sapiens
ctggggctgtaggaggacttat

SEQ ID NO: 9366221 - DNA, 22 bp, Homo sapiens
ctggggcatgggcccctagagg

SEQ ID NO: 9366222 - DNA, 22 bp, Homo sapiens
ctggggcatctgacagataaat

SEQ ID NO: 9366223 - DNA, 23 bp, Homo sapiens
ctggggctttcaaatctgggcag

SEQ ID NO: 9366224 - DNA, 23 bp, Homo sapiens
ctggggctttcaaatctgggcag

SEQ ID NO: 9366225 - DNA, 22 bp, Homo sapiens
ctggggctgtgggagacaaggc

SEQ ID NO: 9366226 - DNA, 22 bp, Homo sapiens
ctggggctgtgggagacaaggc

SEQ ID NO: 9366227 - DNA, 19 bp, Homo sapiens
ctggggctttggtactgcc

SEQ ID NO: 9366228 - DNA, 22 bp, Homo sapiens
ctgggggcaagcagacagctgt

SEQ ID NO: 9366229 - DNA, 19 bp, Homo sapiens
ctggggctttggtactgcc

SEQ ID NO: 9366230 - DNA, 19 bp, Homo sapiens
ctggggctttggtactgcc

SEQ ID NO: 9366231 - DNA, 22 bp, Homo sapiens
atattattctagtaacagtgat

SEQ ID NO: 9366232 - DNA, 22 bp, Homo sapiens
atattattctagctcttgtgtg

SEQ ID NO: 9366233 - DNA, 22 bp, Homo sapiens
ctggctgaagctgggctctcct

SEQ ID NO: 9366234 - DNA, 22 bp, Homo sapiens
ctggctctttcctagctaggct

SEQ ID NO: 9366235 - DNA, 22 bp, Homo sapiens
ctggctgacaccttgatagcag

SEQ ID NO: 9366236 - DNA, 22 bp, Homo sapiens
ctggctgacacaaaggtatcga

SEQ ID NO: 9366237 - DNA, 22 bp, Homo sapiens
ctggctgacacaaaggtatcga

SEQ ID NO: 9366238 - DNA, 22 bp, Homo sapiens
atataaagtgtttagaaagctg

SEQ ID NO: 9366239 - DNA, 22 bp, Homo sapiens
atataaagtgtttagaaagctg

SEQ ID NO: 9366240 - DNA, 22 bp, Homo sapiens
ctggctcttgcgactcagcttg

SEQ ID NO: 9366241 - DNA, 22 bp, Homo sapiens
atataaagaagtggaaaatgag

SEQ ID NO: 9366242 - DNA, 22 bp, Homo sapiens
atataaagaagtggaaaatgag

SEQ ID NO: 9366243 - DNA, 22 bp, Homo sapiens
atataaagagcttagtatagtg

SEQ ID NO: 9366244 - DNA, 22 bp, Homo sapiens
atataaagagcttagtatagtg

SEQ ID NO: 9366245 - DNA, 22 bp, Homo sapiens
atagttttatagatattgtgta

SEQ ID NO: 9366246 - DNA, 22 bp, Homo sapiens
atagttttaaaacctcaggaag

SEQ ID NO: 9366247 - DNA, 23 bp, Homo sapiens
atataaacaccagatagattgta

SEQ ID NO: 9366248 - DNA, 23 bp, Homo sapiens
atataaacaccagatagattgta

SEQ ID NO: 9366249 - DNA, 22 bp, Homo sapiens
ctggcgtgaaggtggccatgag

SEQ ID NO: 9366250 - DNA, 22 bp, Homo sapiens
ctggcgtgaaggtggccatgag

SEQ ID NO: 9366251 - DNA, 22 bp, Homo sapiens
ctggctcacaggtgagatgcat

SEQ ID NO: 9366252 - DNA, 22 bp, Homo sapiens
ctggctcacaggtgagatgcat

SEQ ID NO: 9366253 - DNA, 22 bp, Homo sapiens
atagtgcagccccttttctatt

SEQ ID NO: 9366254 - DNA, 22 bp, Homo sapiens
atagtgggtacaggggcagaga

SEQ ID NO: 9366255 - DNA, 21 bp, Homo sapiens
atagtgctagaatcagaggct

SEQ ID NO: 9366256 - DNA, 22 bp, Homo sapiens
atagtttgggcaaagaggacct

SEQ ID NO: 9366257 - DNA, 22 bp, Homo sapiens
atagtttaccttccagatggct

SEQ ID NO: 9366258 - DNA, 22 bp, Homo sapiens
ctggcctctctgagcagggagc

SEQ ID NO: 9366259 - DNA, 22 bp, Homo sapiens
ctggcctctctgagcagggagc

SEQ ID NO: 9366260 - DNA, 22 bp, Homo sapiens
ctggcctgtgggctgtctccgg

SEQ ID NO: 9366261 - DNA, 19 bp, Homo sapiens
ctggcctgtgtcctgtgct

SEQ ID NO: 9366262 - DNA, 22 bp, Homo sapiens
ctggcctttagccccagtgtct

SEQ ID NO: 9366263 - DNA, 22 bp, Homo sapiens
ctggcctttcgtgagagctggg

SEQ ID NO: 9366264 - DNA, 22 bp, Homo sapiens
ctggcctttcgtgagagctggg

SEQ ID NO: 9366265 - DNA, 22 bp, Homo sapiens
ctggcctttttagaaaacagct

SEQ ID NO: 9366266 - DNA, 22 bp, Homo sapiens
ctggccttttgtttctggagaa

SEQ ID NO: 9366267 - DNA, 22 bp, Homo sapiens
ctgggagctggatgccctgccc

SEQ ID NO: 9366268 - DNA, 22 bp, Homo sapiens
ctgggagctggaatgggagaag

SEQ ID NO: 9366269 - DNA, 22 bp, Homo sapiens
ctgggagctgtcaggagcgtgt

SEQ ID NO: 9366270 - DNA, 22 bp, Homo sapiens
ctgggagcttgttaggaatgca

SEQ ID NO: 9366271 - DNA, 22 bp, Homo sapiens
ctgggagcttggagcctttggt

SEQ ID NO: 9366272 - DNA, 22 bp, Homo sapiens
ctgggagctgtcaggagcgtgt

SEQ ID NO: 9366273 - DNA, 22 bp, Homo sapiens
atatacttggagactatcattg

SEQ ID NO: 9366274 - DNA, 22 bp, Homo sapiens
atatacttggagactatcattg

SEQ ID NO: 9366275 - DNA, 22 bp, Homo sapiens
atatacttggagactatcattg

SEQ ID NO: 9366276 - DNA, 20 bp, Homo sapiens
atataccatcccacaacagg

SEQ ID NO: 9366277 - DNA, 22 bp, Homo sapiens
atatacatgggaatatgtggag

SEQ ID NO: 9366278 - DNA, 22 bp, Homo sapiens
atatacatgggaatatgtggag

SEQ ID NO: 9366279 - DNA, 19 bp, Homo sapiens
atatacatactgtgtgcat

SEQ ID NO: 9366280 - DNA, 22 bp, Homo sapiens
atatacagttttacagggtttc

SEQ ID NO: 9366281 - DNA, 19 bp, Homo sapiens
atatacatactgtgtgcat

SEQ ID NO: 9366282 - DNA, 22 bp, Homo sapiens
atatacttccccattatggggg

SEQ ID NO: 9366283 - DNA, 22 bp, Homo sapiens
atatacctcattctttgagtgc

SEQ ID NO: 9366284 - DNA, 22 bp, Homo sapiens
atatacaggtggtatgtgtaaa

SEQ ID NO: 9366285 - DNA, 22 bp, Homo sapiens
atatacaggtggtatgtgtaaa

SEQ ID NO: 9366286 - DNA, 22 bp, Homo sapiens
atatacaggtggtatgtgtaaa

SEQ ID NO: 9366287 - DNA, 22 bp, Homo sapiens
atatacaggtggtatgtgtaaa

SEQ ID NO: 9366288 - DNA, 22 bp, Homo sapiens
atatacaggtggtatgtgtaaa

SEQ ID NO: 9366289 - DNA, 22 bp, Homo sapiens
atatacaggtggtatgtgtaaa

SEQ ID NO: 9366290 - DNA, 22 bp, Homo sapiens
atatacactccactgatacagg

SEQ ID NO: 9366291 - DNA, 22 bp, Homo sapiens
atatacactcaccatggtattt

SEQ ID NO: 9366292 - DNA, 22 bp, Homo sapiens
atatacactccactgatacagg

SEQ ID NO: 9366293 - DNA, 22 bp, Homo sapiens
atatacactgtttcagttgaag

SEQ ID NO: 9366294 - DNA, 22 bp, Homo sapiens
atatacagggagaaacagctta

SEQ ID NO: 9366295 - DNA, 22 bp, Homo sapiens
atatacacatgtgtatacattt

SEQ ID NO: 9366296 - DNA, 22 bp, Homo sapiens
atatacacatgtgtatacattt

SEQ ID NO: 9366297 - DNA, 22 bp, Homo sapiens
atatacacatttgcttatgtgt

SEQ ID NO: 9366298 - DNA, 22 bp, Homo sapiens
atatacacatttgcttatgtgt

SEQ ID NO: 9366299 - DNA, 22 bp, Homo sapiens
atatacacatgtgtatacattt

SEQ ID NO: 9366300 - DNA, 22 bp, Homo sapiens
atataatacaacctgctaagtg

SEQ ID NO: 9366301 - DNA, 19 bp, Homo sapiens
ctggctgcaatgccagggt

SEQ ID NO: 9366302 - DNA, 22 bp, Homo sapiens
ctggctgaggcagagcctgggg

SEQ ID NO: 9366303 - DNA, 22 bp, Homo sapiens
ctggctgagctagagtccatgg

SEQ ID NO: 9366304 - DNA, 22 bp, Homo sapiens
ctggctgagttactccactgag

SEQ ID NO: 9366305 - DNA, 22 bp, Homo sapiens
ctggctgcaaaatctattcact

SEQ ID NO: 9366306 - DNA, 22 bp, Homo sapiens
ctggctgattttctcacttctc

SEQ ID NO: 9366307 - DNA, 19 bp, Homo sapiens
ctggctgcaatgccagggt

SEQ ID NO: 9366308 - DNA, 22 bp, Homo sapiens
ctggctgcaaaatctattcact

SEQ ID NO: 9366309 - DNA, 22 bp, Homo sapiens
ctggcctcacctcagacttact

SEQ ID NO: 9366310 - DNA, 22 bp, Homo sapiens
ctggcctaggaatggttttccg

SEQ ID NO: 9366311 - DNA, 22 bp, Homo sapiens
ctggcctaaaattgcttctgca

SEQ ID NO: 9366312 - DNA, 22 bp, Homo sapiens
ctggcccttctcttgcttcctg

SEQ ID NO: 9366313 - DNA, 22 bp, Homo sapiens
ctggcccttgacttacagcagg

SEQ ID NO: 9366314 - DNA, 22 bp, Homo sapiens
ctggccagaggttcctctgccc

SEQ ID NO: 9366315 - DNA, 22 bp, Homo sapiens
ctggccagactacacatgtgtg

SEQ ID NO: 9366316 - DNA, 22 bp, Homo sapiens
ctggccctatgagcctcctgat

SEQ ID NO: 9366317 - DNA, 22 bp, Homo sapiens
ctggccctaggcaaacacagat

SEQ ID NO: 9366318 - DNA, 20 bp, Homo sapiens
ctggccagaacgcctacaca

SEQ ID NO: 9366319 - DNA, 22 bp, Homo sapiens
ctggccagaagcacctttggcg

SEQ ID NO: 9366320 - DNA, 20 bp, Homo sapiens
ctggccagaacgcctacaca

SEQ ID NO: 9366321 - DNA, 20 bp, Homo sapiens
ctggccagaacgcctacaca

SEQ ID NO: 9366322 - DNA, 20 bp, Homo sapiens
ctggccagaacgcctacaca

SEQ ID NO: 9366323 - DNA, 22 bp, Homo sapiens
ctggccagactacacatgtgtg

SEQ ID NO: 9366324 - DNA, 22 bp, Homo sapiens
ctggcaggttatagagctgccc

SEQ ID NO: 9366325 - DNA, 22 bp, Homo sapiens
ctggcaggtttggtgtctggtg

SEQ ID NO: 9366326 - DNA, 22 bp, Homo sapiens
ctggcagtattaagagaagtga

SEQ ID NO: 9366327 - DNA, 22 bp, Homo sapiens
ctggccactgcgggcctctgcc

SEQ ID NO: 9366328 - DNA, 22 bp, Homo sapiens
ctggcaggtttggtgtctggtg

SEQ ID NO: 9366329 - DNA, 22 bp, Homo sapiens
ctggcaggtttggtgtctggtg

SEQ ID NO: 9366330 - DNA, 22 bp, Homo sapiens
ctggcaggtttggtgtctggtg

SEQ ID NO: 9366331 - DNA, 22 bp, Homo sapiens
ctggccactgcgggcctctgcc

SEQ ID NO: 9366332 - DNA, 22 bp, Homo sapiens
ctggccactggaggtggcaccc

SEQ ID NO: 9366333 - DNA, 22 bp, Homo sapiens
ctggccactgcgggcctctgcc

SEQ ID NO: 9366334 - DNA, 22 bp, Homo sapiens
ctggccactgcgggcctctgcc

SEQ ID NO: 9366335 - DNA, 22 bp, Homo sapiens
ctggccactgcgggcctctgcc

SEQ ID NO: 9366336 - DNA, 22 bp, Homo sapiens
ctggccactggaggtggcaccc

SEQ ID NO: 9366337 - DNA, 22 bp, Homo sapiens
ctggccactggaggtggcaccc

SEQ ID NO: 9366338 - DNA, 20 bp, Homo sapiens
ctggccagaacgcctacaca

SEQ ID NO: 9366339 - DNA, 22 bp, Homo sapiens
ctggcaggttatagagctgccc

SEQ ID NO: 9366340 - DNA, 22 bp, Homo sapiens
ctggcaggttatagagctgccc

SEQ ID NO: 9366341 - DNA, 22 bp, Homo sapiens
ctggcaggttatagagctgccc

SEQ ID NO: 9366342 - DNA, 22 bp, Homo sapiens
ctggcaggttatagagctgccc

SEQ ID NO: 9366343 - DNA, 22 bp, Homo sapiens
ctggcaggtggaggttgcagtg

SEQ ID NO: 9366344 - DNA, 22 bp, Homo sapiens
ctggcaggtggatggggactcc

SEQ ID NO: 9366345 - DNA, 22 bp, Homo sapiens
ctggcaggtggatggggactcc

SEQ ID NO: 9366346 - DNA, 22 bp, Homo sapiens
ctggcaggtggatggggactcc

SEQ ID NO: 9366347 - DNA, 22 bp, Homo sapiens
ctggcaggtggaggttgcagtg

SEQ ID NO: 9366348 - DNA, 22 bp, Homo sapiens
ctggcaggtctcgctgacgtgt

SEQ ID NO: 9366349 - DNA, 22 bp, Homo sapiens
ctggcaggtccagctggactca

SEQ ID NO: 9366350 - DNA, 22 bp, Homo sapiens
ctggcaggtccagctggactca

SEQ ID NO: 9366351 - DNA, 22 bp, Homo sapiens
ctggcagcttattagaaatgca

SEQ ID NO: 9366352 - DNA, 22 bp, Homo sapiens
ctggcaggtctcgctgacgtgt

SEQ ID NO: 9366353 - DNA, 22 bp, Homo sapiens
ctggcaggtggaggttgcagtg

SEQ ID NO: 9366354 - DNA, 22 bp, Homo sapiens
ctggcaggtggaggttgcagtg

SEQ ID NO: 9366355 - DNA, 22 bp, Homo sapiens
ctggcacacgtggcagggtagg

SEQ ID NO: 9366356 - DNA, 22 bp, Homo sapiens
ctggcacagagacagaaggatt

SEQ ID NO: 9366357 - DNA, 22 bp, Homo sapiens
ctggcacagagacagaaggatt

SEQ ID NO: 9366358 - DNA, 22 bp, Homo sapiens
ctggcacacgtggcagggtagg

SEQ ID NO: 9366359 - DNA, 22 bp, Homo sapiens
ctggcacacagtaggcaccaat

SEQ ID NO: 9366360 - DNA, 22 bp, Homo sapiens
ctggcacacgtggcagggtagg

SEQ ID NO: 9366361 - DNA, 22 bp, Homo sapiens
ctggcacacagcaggctctcag

SEQ ID NO: 9366362 - DNA, 22 bp, Homo sapiens
ctggcacacagtaggcaccaat

SEQ ID NO: 9366363 - DNA, 22 bp, Homo sapiens
ctggcacacagtaggcaccaat

SEQ ID NO: 9366364 - DNA, 22 bp, Homo sapiens
ctggcacagagtgagcattcaa

SEQ ID NO: 9366365 - DNA, 22 bp, Homo sapiens
ctggcacagagtgagcattcaa

SEQ ID NO: 9366366 - DNA, 22 bp, Homo sapiens
ctggcacagagtgagcattcaa

SEQ ID NO: 9366367 - DNA, 22 bp, Homo sapiens
ctggcacagagtgagcattcaa

SEQ ID NO: 9366368 - DNA, 22 bp, Homo sapiens
ctggcacagccactgcaggcag

SEQ ID NO: 9366369 - DNA, 22 bp, Homo sapiens
ctggcacaactccacctcagcg

SEQ ID NO: 9366370 - DNA, 22 bp, Homo sapiens
ctggcacaactccacctcagcg

SEQ ID NO: 9366371 - DNA, 22 bp, Homo sapiens
ctggcacaaatggaaaccaagc

SEQ ID NO: 9366372 - DNA, 22 bp, Homo sapiens
ctggcaagtggttgggatggat

SEQ ID NO: 9366373 - DNA, 22 bp, Homo sapiens
ctggcaagtggttgggatggat

SEQ ID NO: 9366374 - DNA, 22 bp, Homo sapiens
ctggcacaaaagaaaactgcca

SEQ ID NO: 9366375 - DNA, 22 bp, Homo sapiens
ctggcacacagaggccctcggg

SEQ ID NO: 9366376 - DNA, 22 bp, Homo sapiens
ctggcacacagcaggctctcag

SEQ ID NO: 9366377 - DNA, 22 bp, Homo sapiens
ctggcacacagcaggctctcag

SEQ ID NO: 9366378 - DNA, 22 bp, Homo sapiens
ctggcacacaagtatttccttt

SEQ ID NO: 9366379 - DNA, 22 bp, Homo sapiens
ctggcacaatgtcacttttgct

SEQ ID NO: 9366380 - DNA, 22 bp, Homo sapiens
ctggcacacaagtatttccttt

SEQ ID NO: 9366381 - DNA, 20 bp, Homo sapiens
atacacatgcagacagatgc

SEQ ID NO: 9366382 - DNA, 22 bp, Homo sapiens
atacacatgtgtatgtgcatgc

SEQ ID NO: 9366383 - DNA, 22 bp, Homo sapiens
ctggagtgcagtggcatgatca

SEQ ID NO: 9366384 - DNA, 22 bp, Homo sapiens
ctggagtgcagtggcatgatca

SEQ ID NO: 9366385 - DNA, 22 bp, Homo sapiens
ctggagtggccggtgctgtggc

SEQ ID NO: 9366386 - DNA, 22 bp, Homo sapiens
ctggagtgcagtggcatgatca

SEQ ID NO: 9366387 - DNA, 22 bp, Homo sapiens
ctggcaagtactgggccagctc

SEQ ID NO: 9366388 - DNA, 22 bp, Homo sapiens
ctggcaagtactgggccagctc

SEQ ID NO: 9366389 - DNA, 22 bp, Homo sapiens
ctggcagcttagcactctggtt

SEQ ID NO: 9366390 - DNA, 22 bp, Homo sapiens
atacatgtgggtctaaacatat

SEQ ID NO: 9366391 - DNA, 22 bp, Homo sapiens
atacatgtgggtctaaacatat

SEQ ID NO: 9366392 - DNA, 22 bp, Homo sapiens
atacatgtacataaatgtagca

SEQ ID NO: 9366393 - DNA, 22 bp, Homo sapiens
atacatgtgggtctaaacatat

SEQ ID NO: 9366394 - DNA, 22 bp, Homo sapiens
atacatgtcatcatatgtttgt

SEQ ID NO: 9366395 - DNA, 22 bp, Homo sapiens
ctggcacatagcaaatctcaac

SEQ ID NO: 9366396 - DNA, 22 bp, Homo sapiens
ctggcacataattagtgatcct

SEQ ID NO: 9366397 - DNA, 22 bp, Homo sapiens
ctggcacagttaacatatgcta

SEQ ID NO: 9366398 - DNA, 20 bp, Homo sapiens
ctggcacagggtccgtcctt

SEQ ID NO: 9366399 - DNA, 22 bp, Homo sapiens
ctggcacagttaacatatgcta

SEQ ID NO: 9366400 - DNA, 20 bp, Homo sapiens
ctggcacagggtccgtcctt

SEQ ID NO: 9366401 - DNA, 22 bp, Homo sapiens
ctggcacaggatccgagacctt

SEQ ID NO: 9366402 - DNA, 22 bp, Homo sapiens
ctggcacagccactgcaggcag

SEQ ID NO: 9366403 - DNA, 22 bp, Homo sapiens
ctggcacagcttgggccccatc

SEQ ID NO: 9366404 - DNA, 22 bp, Homo sapiens
ctggcacagcttgggccccatc

SEQ ID NO: 9366405 - DNA, 22 bp, Homo sapiens
ctggcacaggatccgagacctt

SEQ ID NO: 9366406 - DNA, 22 bp, Homo sapiens
ctggcacagcttgggccccatc

SEQ ID NO: 9366407 - DNA, 22 bp, Homo sapiens
ctggcacatagcaaatctcaac

SEQ ID NO: 9366408 - DNA, 19 bp, Homo sapiens
atacatgcatttacatgct

SEQ ID NO: 9366409 - DNA, 19 bp, Homo sapiens
atacatgcatttacatgct

SEQ ID NO: 9366410 - DNA, 22 bp, Homo sapiens
atacatgcgccatgttggtgtg

SEQ ID NO: 9366411 - DNA, 22 bp, Homo sapiens
agttctctttagctcatatggt

SEQ ID NO: 9366412 - DNA, 20 bp, Homo sapiens
agttctcttccttgggcctg

SEQ ID NO: 9366413 - DNA, 22 bp, Homo sapiens
agttctctcccctgctgttcag

SEQ ID NO: 9366414 - DNA, 22 bp, Homo sapiens
agttctctggctcctttccaga

SEQ ID NO: 9366415 - DNA, 22 bp, Homo sapiens
agttctgtctgattctaatgca

SEQ ID NO: 9366416 - DNA, 22 bp, Homo sapiens
agttctgtctgattctaatgca

SEQ ID NO: 9366417 - DNA, 22 bp, Homo sapiens
agttctgtctgattctaatgca

SEQ ID NO: 9366418 - DNA, 22 bp, Homo sapiens
agttctgtcctccccactcttt

SEQ ID NO: 9366419 - DNA, 22 bp, Homo sapiens
agttctgtctgacaccgaagtt

SEQ ID NO: 9366420 - DNA, 22 bp, Homo sapiens
agttctggttgcccatgacatc

SEQ ID NO: 9366421 - DNA, 22 bp, Homo sapiens
agttctggcgcccatgagcaga

SEQ ID NO: 9366422 - DNA, 22 bp, Homo sapiens
agttctggtggtttggagatct

SEQ ID NO: 9366423 - DNA, 22 bp, Homo sapiens
agttctatttctaacatgttat

SEQ ID NO: 9366424 - DNA, 22 bp, Homo sapiens
agttctattgggtaggttctgt

SEQ ID NO: 9366425 - DNA, 22 bp, Homo sapiens
agttctcatttcacaggcagtg

SEQ ID NO: 9366426 - DNA, 23 bp, Homo sapiens
agttctcattcatcacggcctat

SEQ ID NO: 9366427 - DNA, 22 bp, Homo sapiens
ataaaaatgagggcggtagcta

SEQ ID NO: 9366428 - DNA, 22 bp, Homo sapiens
ataaaaatgagggcggtagcta

SEQ ID NO: 9366429 - DNA, 22 bp, Homo sapiens
ataaaaatgagggcggtagcta

SEQ ID NO: 9366430 - DNA, 22 bp, Homo sapiens
agttttgtaattctcaaaaata

SEQ ID NO: 9366431 - DNA, 17 bp, Homo sapiens
agttttgatataatggc

SEQ ID NO: 9366432 - DNA, 22 bp, Homo sapiens
agttctgtgacaatatcattac

SEQ ID NO: 9366433 - DNA, 22 bp, Homo sapiens
agttctgtgctcactctacccc

SEQ ID NO: 9366434 - DNA, 22 bp, Homo sapiens
agttctgttgtctagggaagcc

SEQ ID NO: 9366435 - DNA, 21 bp, Homo sapiens
agttctgttatgctggactca

SEQ ID NO: 9366436 - DNA, 22 bp, Homo sapiens
agttctgtggctgtgccctgta

SEQ ID NO: 9366437 - DNA, 22 bp, Homo sapiens
ctgcaggctcgaagacacggat

SEQ ID NO: 9366438 - DNA, 22 bp, Homo sapiens
ctgcaggctgagcgcctgccgg

SEQ ID NO: 9366439 - DNA, 22 bp, Homo sapiens
ctgcaggctcgaagacacggat

SEQ ID NO: 9366440 - DNA, 22 bp, Homo sapiens
ataaaacttattagaattgtgt

SEQ ID NO: 9366441 - DNA, 22 bp, Homo sapiens
ctgcagggaccacaagcaggtt

SEQ ID NO: 9366442 - DNA, 22 bp, Homo sapiens
ctgcagggaccacaagcaggtt

SEQ ID NO: 9366443 - DNA, 22 bp, Homo sapiens
ctgcagggaccacaagcaggtt

SEQ ID NO: 9366444 - DNA, 22 bp, Homo sapiens
ctgcagggacccaagtctttgg

SEQ ID NO: 9366445 - DNA, 22 bp, Homo sapiens
ctgcagggacccaagtctttgg

SEQ ID NO: 9366446 - DNA, 22 bp, Homo sapiens
ctgcagggagaggggacagcct

SEQ ID NO: 9366447 - DNA, 22 bp, Homo sapiens
ctgcagggagaggggacagcct

SEQ ID NO: 9366448 - DNA, 22 bp, Homo sapiens
ctgcagggaactgaggcccaga

SEQ ID NO: 9366449 - DNA, 22 bp, Homo sapiens
ctgcagggaactgaggcccaga

SEQ ID NO: 9366450 - DNA, 22 bp, Homo sapiens
ctgcagggaactgaggcccaga

SEQ ID NO: 9366451 - DNA, 22 bp, Homo sapiens
ctgcagggaccacaagcaggtt

SEQ ID NO: 9366452 - DNA, 22 bp, Homo sapiens
ctgcaggctgagcgcctgccgg

SEQ ID NO: 9366453 - DNA, 22 bp, Homo sapiens
ctgcagggaactgaggcccaga

SEQ ID NO: 9366454 - DNA, 22 bp, Homo sapiens
ctgcaggcttccagggctgtgg

SEQ ID NO: 9366455 - DNA, 22 bp, Homo sapiens
ataaaatctttatgtgctctgc

SEQ ID NO: 9366456 - DNA, 22 bp, Homo sapiens
ataaacatctgtttctcttctg

SEQ ID NO: 9366457 - DNA, 22 bp, Homo sapiens
ataaaatcagagttggattgga

SEQ ID NO: 9366458 - DNA, 22 bp, Homo sapiens
ataaaatcaactggctccagtt

SEQ ID NO: 9366459 - DNA, 22 bp, Homo sapiens
ctgcagggagaggggacagcct

SEQ ID NO: 9366460 - DNA, 22 bp, Homo sapiens
ataaaccagaagtaaaagctac

SEQ ID NO: 9366461 - DNA, 22 bp, Homo sapiens
ataaagatttttaggcatttct

SEQ ID NO: 9366462 - DNA, 22 bp, Homo sapiens
ataaagaggatgtatttacagc

SEQ ID NO: 9366463 - DNA, 22 bp, Homo sapiens
ataaacttgagtctcagagtat

SEQ ID NO: 9366464 - DNA, 22 bp, Homo sapiens
ataaactttagcggaaggagga

SEQ ID NO: 9366465 - DNA, 22 bp, Homo sapiens
ataaagcaagcataccattaag

SEQ ID NO: 9366466 - DNA, 22 bp, Homo sapiens
ataaagcatactttgtatgact

SEQ ID NO: 9366467 - DNA, 22 bp, Homo sapiens
ataaagctaagacttacatgaa

SEQ ID NO: 9366468 - DNA, 22 bp, Homo sapiens
ctgctgggggacacaggtccgg

SEQ ID NO: 9366469 - DNA, 22 bp, Homo sapiens
ctgctggggaggcgcctcgacg

SEQ ID NO: 9366470 - DNA, 22 bp, Homo sapiens
ctgctgggctcctcatgtgact

SEQ ID NO: 9366471 - DNA, 22 bp, Homo sapiens
ctgctgggctcctcatgtgact

SEQ ID NO: 9366472 - DNA, 22 bp, Homo sapiens
ctgctgggctcctcatgtgact

SEQ ID NO: 9366473 - DNA, 22 bp, Homo sapiens
ctgctgggcctggtctctgagg

SEQ ID NO: 9366474 - DNA, 22 bp, Homo sapiens
ctgctgggcctggtctctgagg

SEQ ID NO: 9366475 - DNA, 22 bp, Homo sapiens
ctgctgggcagaggctgcatga

SEQ ID NO: 9366476 - DNA, 22 bp, Homo sapiens
ctgctgcccagtgtgcattggg

SEQ ID NO: 9366477 - DNA, 22 bp, Homo sapiens
ctgctgcccagtgtgcattggg

SEQ ID NO: 9366478 - DNA, 19 bp, Homo sapiens
ctgctcaggtcagtctgtc

SEQ ID NO: 9366479 - DNA, 19 bp, Homo sapiens
ctgctcagagcagctccag

SEQ ID NO: 9366480 - DNA, 19 bp, Homo sapiens
ctgctcagagcagctccag

SEQ ID NO: 9366481 - DNA, 19 bp, Homo sapiens
ctgctcagagcagctccag

SEQ ID NO: 9366482 - DNA, 20 bp, Homo sapiens
ctgctcagaccaactcttct

SEQ ID NO: 9366483 - DNA, 20 bp, Homo sapiens
ctgctcagaccaactcttct

SEQ ID NO: 9366484 - DNA, 19 bp, Homo sapiens
ctgctcagagcagctccag

SEQ ID NO: 9366485 - DNA, 22 bp, Homo sapiens
ctgcctgtgatttttctctagt

SEQ ID NO: 9366486 - DNA, 22 bp, Homo sapiens
ctgcctgtattgtctgcttggg

SEQ ID NO: 9366487 - DNA, 22 bp, Homo sapiens
ctgcctggtgcggtgcccaccc

SEQ ID NO: 9366488 - DNA, 22 bp, Homo sapiens
ctgcctgtaactttctgaagca

SEQ ID NO: 9366489 - DNA, 22 bp, Homo sapiens
ctgcctgtgccaatgctccttt

SEQ ID NO: 9366490 - DNA, 22 bp, Homo sapiens
ctgcctgtgccaatgctccttt

SEQ ID NO: 9366491 - DNA, 22 bp, Homo sapiens
ctgcctgtgccaccgcctcatt

SEQ ID NO: 9366492 - DNA, 22 bp, Homo sapiens
ctgcctgtgccaccgcctcatt

SEQ ID NO: 9366493 - DNA, 22 bp, Homo sapiens
ctgctaccctagagctcactct

SEQ ID NO: 9366494 - DNA, 22 bp, Homo sapiens
ctgctaaacctctctgagagct

SEQ ID NO: 9366495 - DNA, 22 bp, Homo sapiens
ctgcctggtctcaggcatgggg

SEQ ID NO: 9366496 - DNA, 22 bp, Homo sapiens
ctgcctggtctcaggcatgggg

SEQ ID NO: 9366497 - DNA, 22 bp, Homo sapiens
ctgcctggtactttaggcactt

SEQ ID NO: 9366498 - DNA, 22 bp, Homo sapiens
ctgcctgggttcaagtcctgtt

SEQ ID NO: 9366499 - DNA, 22 bp, Homo sapiens
ctgcctgggttcaagtcctgtt

SEQ ID NO: 9366500 - DNA, 22 bp, Homo sapiens
ataaagctttgaaatggagata

SEQ ID NO: 9366501 - DNA, 22 bp, Homo sapiens
ctgcctggaaggagcaagggga

SEQ ID NO: 9366502 - DNA, 22 bp, Homo sapiens
ctgcctgggttcaagtcctgtt

SEQ ID NO: 9366503 - DNA, 21 bp, Homo sapiens
ctgctgtggcccccgacatgc

SEQ ID NO: 9366504 - DNA, 22 bp, Homo sapiens
ctgctgtgggcagggtagctgg

SEQ ID NO: 9366505 - DNA, 22 bp, Homo sapiens
ctgctgtggatgcaggacctca

SEQ ID NO: 9366506 - DNA, 22 bp, Homo sapiens
ctgctgtggccagccaggtcaa

SEQ ID NO: 9366507 - DNA, 22 bp, Homo sapiens
ctgctgtgggcagggtagctgg

SEQ ID NO: 9366508 - DNA, 22 bp, Homo sapiens
ctgctgtgggttaagacactgt

SEQ ID NO: 9366509 - DNA, 22 bp, Homo sapiens
ctgctgtgggttaagacactgt

SEQ ID NO: 9366510 - DNA, 20 bp, Homo sapiens
ctgctgtggtcctttatttt

SEQ ID NO: 9366511 - DNA, 22 bp, Homo sapiens
ctgctgtggtgtcaagcatctc

SEQ ID NO: 9366512 - DNA, 22 bp, Homo sapiens
ctgctgtgtatcattttagatg

SEQ ID NO: 9366513 - DNA, 22 bp, Homo sapiens
ctgctgtgtcagagtccagggg

SEQ ID NO: 9366514 - DNA, 22 bp, Homo sapiens
atacaagttaatgagaatgaca

SEQ ID NO: 9366515 - DNA, 22 bp, Homo sapiens
ctgctgtgtcagagtccagggg

SEQ ID NO: 9366516 - DNA, 22 bp, Homo sapiens
ctgctgtgcaggtgcctatgat

SEQ ID NO: 9366517 - DNA, 22 bp, Homo sapiens
ctgctgtgcctcttttcacgtg

SEQ ID NO: 9366518 - DNA, 22 bp, Homo sapiens
ctgctgtgcatatttatctagg

SEQ ID NO: 9366519 - DNA, 22 bp, Homo sapiens
ctgctgtgcttgtggccacccg

SEQ ID NO: 9366520 - DNA, 22 bp, Homo sapiens
ctgctgtgcttgtggccacccg

SEQ ID NO: 9366521 - DNA, 22 bp, Homo sapiens
ctgctgtgccttaaaatgcaag

SEQ ID NO: 9366522 - DNA, 22 bp, Homo sapiens
ctgctgggggacacaggtccgg

SEQ ID NO: 9366523 - DNA, 22 bp, Homo sapiens
ctgctggggtcagagcactggg

SEQ ID NO: 9366524 - DNA, 22 bp, Homo sapiens
ctgctggggtcagagcactggg

SEQ ID NO: 9366525 - DNA, 22 bp, Homo sapiens
ctgctgtgcagacagactctct

SEQ ID NO: 9366526 - DNA, 22 bp, Homo sapiens
ctgctggggtcagagcactggg

SEQ ID NO: 9366527 - DNA, 22 bp, Homo sapiens
ctgctggggtcagagcactggg

SEQ ID NO: 9366528 - DNA, 22 bp, Homo sapiens
atacacatctatttaagagaca

SEQ ID NO: 9366529 - DNA, 22 bp, Homo sapiens
atacacatgcacacatgtgtgt

SEQ ID NO: 9366530 - DNA, 22 bp, Homo sapiens
atacacatatgtgtgtatatgt

SEQ ID NO: 9366531 - DNA, 22 bp, Homo sapiens
atacacatatcaggtgtataca

SEQ ID NO: 9366532 - DNA, 20 bp, Homo sapiens
atacacatattcttgcaact

SEQ ID NO: 9366533 - DNA, 20 bp, Homo sapiens
atacacatattcttgcaact

SEQ ID NO: 9366534 - DNA, 22 bp, Homo sapiens
atacacatatgtgtgtatatgt

SEQ ID NO: 9366535 - DNA, 21 bp, Homo sapiens
atacacatacacataaatgtg

SEQ ID NO: 9366536 - DNA, 22 bp, Homo sapiens
atacacaggtgctaggtcaata

SEQ ID NO: 9366537 - DNA, 22 bp, Homo sapiens
atacacaggcatgcttctgatt

SEQ ID NO: 9366538 - DNA, 22 bp, Homo sapiens
atacaagttgcccaaatgatta

SEQ ID NO: 9366539 - DNA, 22 bp, Homo sapiens
atacaagttctcatgtgtatct

SEQ ID NO: 9366540 - DNA, 19 bp, Homo sapiens
atacacatacgtaaactga

SEQ ID NO: 9366541 - DNA, 19 bp, Homo sapiens
atacacatacgtaaactga

SEQ ID NO: 9366542 - DNA, 19 bp, Homo sapiens
atacacatacgtaaactga

SEQ ID NO: 9366543 - DNA, 21 bp, Homo sapiens
atacacatacacataaatgtg

SEQ ID NO: 9366544 - DNA, 22 bp, Homo sapiens
ccagaacagacctgcctgacct

SEQ ID NO: 9366545 - DNA, 22 bp, Homo sapiens
ccagaaatcctctctttcttgc

SEQ ID NO: 9366546 - DNA, 22 bp, Homo sapiens
ccagaaagttcagctgtgaatg

SEQ ID NO: 9366547 - DNA, 22 bp, Homo sapiens
ccagaactgagaaaataaattt

SEQ ID NO: 9366548 - DNA, 22 bp, Homo sapiens
ccagaaaaggagctgcaggatg

SEQ ID NO: 9366549 - DNA, 22 bp, Homo sapiens
aggcaggctgctatggagtaga

SEQ ID NO: 9366550 - DNA, 18 bp, Homo sapiens
aggcaggctggagtgact

SEQ ID NO: 9366551 - DNA, 18 bp, Homo sapiens
aggcaggctggagtgact

SEQ ID NO: 9366552 - DNA, 22 bp, Homo sapiens
ccagaaacagatgacaagccct

SEQ ID NO: 9366553 - DNA, 22 bp, Homo sapiens
ccagaaacagatgacaagccct

SEQ ID NO: 9366554 - DNA, 22 bp, Homo sapiens
ccagaaaatgcagaacatagaa

SEQ ID NO: 9366555 - DNA, 22 bp, Homo sapiens
ccagaaaatatggctaaggtga

SEQ ID NO: 9366556 - DNA, 22 bp, Homo sapiens
ccagaaagactttttaggtacg

SEQ ID NO: 9366557 - DNA, 22 bp, Homo sapiens
ccagaaagataggaaatcaagt

SEQ ID NO: 9366558 - DNA, 22 bp, Homo sapiens
ccagaaagataggaaatcaagt

SEQ ID NO: 9366559 - DNA, 22 bp, Homo sapiens
ccagaaagactttttaggtacg

SEQ ID NO: 9366560 - DNA, 22 bp, Homo sapiens
ccagaaagactttttaggtacg

SEQ ID NO: 9366561 - DNA, 22 bp, Homo sapiens
ccagacctgcaaggctgagagg

SEQ ID NO: 9366562 - DNA, 22 bp, Homo sapiens
ccagacctaagcatcagtgcat

SEQ ID NO: 9366563 - DNA, 22 bp, Homo sapiens
ccagacctaagcatcagtgcat

SEQ ID NO: 9366564 - DNA, 22 bp, Homo sapiens
ccagaccctgctctggggctct

SEQ ID NO: 9366565 - DNA, 22 bp, Homo sapiens
ccagaccctttcttggcatgtg

SEQ ID NO: 9366566 - DNA, 22 bp, Homo sapiens
ccagactgcttgcttcccagcc

SEQ ID NO: 9366567 - DNA, 22 bp, Homo sapiens
ccagacagttccttgaggttca

SEQ ID NO: 9366568 - DNA, 22 bp, Homo sapiens
ccagacatgtgcccttgaggaa

SEQ ID NO: 9366569 - DNA, 22 bp, Homo sapiens
ccagaccagactgacttgagcc

SEQ ID NO: 9366570 - DNA, 22 bp, Homo sapiens
ccagaccctgctctggggctct

SEQ ID NO: 9366571 - DNA, 22 bp, Homo sapiens
ccagaccctccattcaagctcc

SEQ ID NO: 9366572 - DNA, 22 bp, Homo sapiens
aggccacagttgaggccagcaa

SEQ ID NO: 9366573 - DNA, 22 bp, Homo sapiens
aggccacagtcagtgggtgctg

SEQ ID NO: 9366574 - DNA, 22 bp, Homo sapiens
aggccacagttgaggccagcaa

SEQ ID NO: 9366575 - DNA, 22 bp, Homo sapiens
aggccacagtcagtgggtgctg

SEQ ID NO: 9366576 - DNA, 22 bp, Homo sapiens
aggccacagtcagtgggtgctg

SEQ ID NO: 9366577 - DNA, 22 bp, Homo sapiens
aggccacagtactttgcagacc

SEQ ID NO: 9366578 - DNA, 22 bp, Homo sapiens
aggccacagtactttgcagacc

SEQ ID NO: 9366579 - DNA, 22 bp, Homo sapiens
aggccacaagaactaccccatc

SEQ ID NO: 9366580 - DNA, 22 bp, Homo sapiens
ccagagaaaaatgtgtccctgt

SEQ ID NO: 9366581 - DNA, 22 bp, Homo sapiens
ccagacttttagtagtgagtta

SEQ ID NO: 9366582 - DNA, 22 bp, Homo sapiens
ccagagaaaaatgtgtccctgt

SEQ ID NO: 9366583 - DNA, 22 bp, Homo sapiens
aggccacaagaaaatgcttcat

SEQ ID NO: 9366584 - DNA, 22 bp, Homo sapiens
aggccagaaatgtcagggagtg

SEQ ID NO: 9366585 - DNA, 22 bp, Homo sapiens
aggccagaaaaagacagctcca

SEQ ID NO: 9366586 - DNA, 22 bp, Homo sapiens
aggccagaaatgtcagggagtg

SEQ ID NO: 9366587 - DNA, 22 bp, Homo sapiens
aggccagaaatgtcagggagtg

SEQ ID NO: 9366588 - DNA, 21 bp, Homo sapiens
ccagagcctgctgagccccct

SEQ ID NO: 9366589 - DNA, 21 bp, Homo sapiens
ccagagcctgctgagccccct

SEQ ID NO: 9366590 - DNA, 22 bp, Homo sapiens
ccagagcctggcatctgcataa

SEQ ID NO: 9366591 - DNA, 22 bp, Homo sapiens
ccagagcctggcatctgcataa

SEQ ID NO: 9366592 - DNA, 22 bp, Homo sapiens
aggccacatagcttgcatgtag

SEQ ID NO: 9366593 - DNA, 22 bp, Homo sapiens
aggccacatagcttgcatgtag

SEQ ID NO: 9366594 - DNA, 22 bp, Homo sapiens
aggccacagttgaggccagcaa

SEQ ID NO: 9366595 - DNA, 22 bp, Homo sapiens
aggccaccaccctatctcctgg

SEQ ID NO: 9366596 - DNA, 22 bp, Homo sapiens
aggccacattgtgattcccgca

SEQ ID NO: 9366597 - DNA, 22 bp, Homo sapiens
aggccagaaaaagacagctcca

SEQ ID NO: 9366598 - DNA, 22 bp, Homo sapiens
aggccacggcgggtggattact

SEQ ID NO: 9366599 - DNA, 23 bp, Homo sapiens
ccagagctctttcatgcttccat

SEQ ID NO: 9366600 - DNA, 22 bp, Homo sapiens
ccagagctccagggctacagaa

SEQ ID NO: 9366601 - DNA, 22 bp, Homo sapiens
ccagagctgaggagatgggctt

SEQ ID NO: 9366602 - DNA, 22 bp, Homo sapiens
ccagagctgagggagcctgagc

SEQ ID NO: 9366603 - DNA, 22 bp, Homo sapiens
ccagagctgagggagcctgagc

SEQ ID NO: 9366604 - DNA, 22 bp, Homo sapiens
ccagagctccagggctacagaa

SEQ ID NO: 9366605 - DNA, 22 bp, Homo sapiens
ccagagctccagggctacagaa

SEQ ID NO: 9366606 - DNA, 22 bp, Homo sapiens
ccagagctccagggctacagaa

SEQ ID NO: 9366607 - DNA, 22 bp, Homo sapiens
ccagagctccagggctacagaa

SEQ ID NO: 9366608 - DNA, 22 bp, Homo sapiens
ccagagctaaacacacaggctg

SEQ ID NO: 9366609 - DNA, 22 bp, Homo sapiens
aggccatattaattacacagga

SEQ ID NO: 9366610 - DNA, 22 bp, Homo sapiens
aggccagttgttcagtgggccg

SEQ ID NO: 9366611 - DNA, 23 bp, Homo sapiens
aggccagtttttcctgcttgctg

SEQ ID NO: 9366612 - DNA, 22 bp, Homo sapiens
aggccagtgtggctggagcaca

SEQ ID NO: 9366613 - DNA, 22 bp, Homo sapiens
aggccagttgttcagtgggccg

SEQ ID NO: 9366614 - DNA, 22 bp, Homo sapiens
aggccagtgcctttccagggct

SEQ ID NO: 9366615 - DNA, 22 bp, Homo sapiens
aggccagtggttctctgtgtcc

SEQ ID NO: 9366616 - DNA, 22 bp, Homo sapiens
aggccagtgtggctggagcaca

SEQ ID NO: 9366617 - DNA, 22 bp, Homo sapiens
aggccagtgcagctggaacaga

SEQ ID NO: 9366618 - DNA, 22 bp, Homo sapiens
aggccagtgccatcagggtttt

SEQ ID NO: 9366619 - DNA, 22 bp, Homo sapiens
aggccagtgcctttccagggct

SEQ ID NO: 9366620 - DNA, 22 bp, Homo sapiens
aggccaggatagcatggatcag

SEQ ID NO: 9366621 - DNA, 22 bp, Homo sapiens
aggccaggcaacattctgaagt

SEQ ID NO: 9366622 - DNA, 22 bp, Homo sapiens
aggccaggtggtcatgcttgct

SEQ ID NO: 9366623 - DNA, 22 bp, Homo sapiens
aggccaggttcctcaatcttga

SEQ ID NO: 9366624 - DNA, 22 bp, Homo sapiens
ccagcaggaaagtgacgtttga

SEQ ID NO: 9366625 - DNA, 19 bp, Homo sapiens
ccagcagctttgattctct

SEQ ID NO: 9366626 - DNA, 22 bp, Homo sapiens
ccagcaggactttggaaatatg

SEQ ID NO: 9366627 - DNA, 22 bp, Homo sapiens
ccagcaggactttggaaatatg

SEQ ID NO: 9366628 - DNA, 22 bp, Homo sapiens
ccagcaggactttggaaatatg

SEQ ID NO: 9366629 - DNA, 22 bp, Homo sapiens
ccagcaggaaagtgacgtttga

SEQ ID NO: 9366630 - DNA, 19 bp, Homo sapiens
ccagcagctttgattctct

SEQ ID NO: 9366631 - DNA, 22 bp, Homo sapiens
aggccatgaggtcatgggagat

SEQ ID NO: 9366632 - DNA, 22 bp, Homo sapiens
aggccatgtggccccagagtct

SEQ ID NO: 9366633 - DNA, 22 bp, Homo sapiens
aggccatgtggccccagagtct

SEQ ID NO: 9366634 - DNA, 23 bp, Homo sapiens
aggcccaactctgtgagggctgc

SEQ ID NO: 9366635 - DNA, 22 bp, Homo sapiens
aggcccaaaagaaaccactggg

SEQ ID NO: 9366636 - DNA, 22 bp, Homo sapiens
aggcctggctttggtttgctga

SEQ ID NO: 9366637 - DNA, 22 bp, Homo sapiens
aggcctggcctttatgttcaag

SEQ ID NO: 9366638 - DNA, 22 bp, Homo sapiens
aggcctggcctgggcggcattg

SEQ ID NO: 9366639 - DNA, 22 bp, Homo sapiens
aggcctggcctgggcggcattg

SEQ ID NO: 9366640 - DNA, 22 bp, Homo sapiens
aggcctggcctgggcggcattg

SEQ ID NO: 9366641 - DNA, 22 bp, Homo sapiens
aggcctgctgtgtagcctgttg

SEQ ID NO: 9366642 - DNA, 22 bp, Homo sapiens
aggcctgctgtcttgaggccaa

SEQ ID NO: 9366643 - DNA, 22 bp, Homo sapiens
aggcctggcatgagacctgaga

SEQ ID NO: 9366644 - DNA, 22 bp, Homo sapiens
aggcctggcatgagacctgaga

SEQ ID NO: 9366645 - DNA, 22 bp, Homo sapiens
aggcctggcatgagacctgaga

SEQ ID NO: 9366646 - DNA, 22 bp, Homo sapiens
aggcctggccccagttgctagg

SEQ ID NO: 9366647 - DNA, 22 bp, Homo sapiens
aggcctggccccagttgctagg

SEQ ID NO: 9366648 - DNA, 22 bp, Homo sapiens
aggcctgggacgggagccgtga

SEQ ID NO: 9366649 - DNA, 18 bp, Homo sapiens
aggcctgggaagctgagg

SEQ ID NO: 9366650 - DNA, 22 bp, Homo sapiens
ccaggaaggatcgtttgggagt

SEQ ID NO: 9366651 - DNA, 22 bp, Homo sapiens
aggcctgggacgggagccgtga

SEQ ID NO: 9366652 - DNA, 22 bp, Homo sapiens
aggcctgggacgggagccgtga

SEQ ID NO: 9366653 - DNA, 22 bp, Homo sapiens
ccaggaaggcaggcctccccgc

SEQ ID NO: 9366654 - DNA, 22 bp, Homo sapiens
ccaggaaggcaggcctccccgc

SEQ ID NO: 9366655 - DNA, 22 bp, Homo sapiens
ccaggaaggcctggatgccccc

SEQ ID NO: 9366656 - DNA, 22 bp, Homo sapiens
ccaggaaggcgttgttcctctc

SEQ ID NO: 9366657 - DNA, 22 bp, Homo sapiens
ccaggaaggcctggatgccccc

SEQ ID NO: 9366658 - DNA, 22 bp, Homo sapiens
ccaggaaggcctggatgccccc

SEQ ID NO: 9366659 - DNA, 22 bp, Homo sapiens
ccaggaaggcgttgttcctctc

SEQ ID NO: 9366660 - DNA, 22 bp, Homo sapiens
ccaggaagggctctttaaagac

SEQ ID NO: 9366661 - DNA, 22 bp, Homo sapiens
ccaggaagggctctttaaagac

SEQ ID NO: 9366662 - DNA, 22 bp, Homo sapiens
ccaggaaggtatgggaagaaaa

SEQ ID NO: 9366663 - DNA, 22 bp, Homo sapiens
ccaggaaggtatgggaagaaaa

SEQ ID NO: 9366664 - DNA, 22 bp, Homo sapiens
aggcgtgggaggatctgaggcc

SEQ ID NO: 9366665 - DNA, 22 bp, Homo sapiens
aggcgtgggaggatctgaggcc

SEQ ID NO: 9366666 - DNA, 22 bp, Homo sapiens
aggcgctgtgcttggggctgga

SEQ ID NO: 9366667 - DNA, 22 bp, Homo sapiens
aggcgctgcgctggggccagaa

SEQ ID NO: 9366668 - DNA, 22 bp, Homo sapiens
aggcgctgcgctggggccagaa

SEQ ID NO: 9366669 - DNA, 22 bp, Homo sapiens
aggcgctgcatgtgaaggagtt

SEQ ID NO: 9366670 - DNA, 22 bp, Homo sapiens
aggcgctgcatgtgaaggagtt

SEQ ID NO: 9366671 - DNA, 22 bp, Homo sapiens
ccaggacaagccagagggacag

SEQ ID NO: 9366672 - DNA, 22 bp, Homo sapiens
ccaggaagtatgacccaacaga

SEQ ID NO: 9366673 - DNA, 22 bp, Homo sapiens
ccaggaagtatgacccaacaga

SEQ ID NO: 9366674 - DNA, 22 bp, Homo sapiens
ccaggaaggtgtttaactagag

SEQ ID NO: 9366675 - DNA, 22 bp, Homo sapiens
ccaggaaggtgtttaactagag

SEQ ID NO: 9366676 - DNA, 22 bp, Homo sapiens
ccaggaaggtatgggaagaaaa

SEQ ID NO: 9366677 - DNA, 22 bp, Homo sapiens
ccagcaggagactagcaacata

SEQ ID NO: 9366678 - DNA, 22 bp, Homo sapiens
ccagcaggagactagcaacata

SEQ ID NO: 9366679 - DNA, 22 bp, Homo sapiens
ccagcaggagatgcctgtgtct

SEQ ID NO: 9366680 - DNA, 22 bp, Homo sapiens
ccagcaggagagaacatttccc

SEQ ID NO: 9366681 - DNA, 22 bp, Homo sapiens
ccagcaggagagaacatttccc

SEQ ID NO: 9366682 - DNA, 22 bp, Homo sapiens
ccagcaggagatgcctgtgtct

SEQ ID NO: 9366683 - DNA, 22 bp, Homo sapiens
ccagcaggcagtcatatccttt

SEQ ID NO: 9366684 - DNA, 22 bp, Homo sapiens
ccagcaggagatgcctgtgtct

SEQ ID NO: 9366685 - DNA, 22 bp, Homo sapiens
ccagcaggcagtcatatccttt

SEQ ID NO: 9366686 - DNA, 21 bp, Homo sapiens
ccagctctgcctccagttggt

SEQ ID NO: 9366687 - DNA, 23 bp, Homo sapiens
ccagctccgtgagcctcgggctc

SEQ ID NO: 9366688 - DNA, 23 bp, Homo sapiens
ccagctccgtgagcctcgggctc

SEQ ID NO: 9366689 - DNA, 22 bp, Homo sapiens
ccagctcttttggctgagtgag

SEQ ID NO: 9366690 - DNA, 22 bp, Homo sapiens
ccagctctgcttgcccagtcag

SEQ ID NO: 9366691 - DNA, 22 bp, Homo sapiens
ccagctctgcttgcccagtcag

SEQ ID NO: 9366692 - DNA, 22 bp, Homo sapiens
ccagctggaacggcagcccagc

SEQ ID NO: 9366693 - DNA, 22 bp, Homo sapiens
ccagctggaaacaaatagagtg

SEQ ID NO: 9366694 - DNA, 22 bp, Homo sapiens
ccagctggaagagtgcagaact

SEQ ID NO: 9366695 - DNA, 22 bp, Homo sapiens
ccagctggaagagtgcagaact

SEQ ID NO: 9366696 - DNA, 22 bp, Homo sapiens
ccagctggagctcgcagatagg

SEQ ID NO: 9366697 - DNA, 22 bp, Homo sapiens
ccagctggagccaaggtggact

SEQ ID NO: 9366698 - DNA, 22 bp, Homo sapiens
ccagctggcaggagagtcaggg

SEQ ID NO: 9366699 - DNA, 22 bp, Homo sapiens
ccagctggcaggagagtcaggg

SEQ ID NO: 9366700 - DNA, 22 bp, Homo sapiens
ccagctggcactgtggctgccc

SEQ ID NO: 9366701 - DNA, 22 bp, Homo sapiens
ccagctggcactgtggctgccc

SEQ ID NO: 9366702 - DNA, 22 bp, Homo sapiens
ccagctggagctcgcagatagg

SEQ ID NO: 9366703 - DNA, 22 bp, Homo sapiens
ccagctggcactgtggctgccc

SEQ ID NO: 9366704 - DNA, 22 bp, Homo sapiens
aggcctgctgtcttgaggccaa

SEQ ID NO: 9366705 - DNA, 22 bp, Homo sapiens
aggcctctggaggtggcagtgt

SEQ ID NO: 9366706 - DNA, 22 bp, Homo sapiens
aggcctctgggcctgcgggttt

SEQ ID NO: 9366707 - DNA, 17 bp, Homo sapiens
aggcctctgccggtgcc

SEQ ID NO: 9366708 - DNA, 22 bp, Homo sapiens
aggcctctgctggaaagagttg

SEQ ID NO: 9366709 - DNA, 22 bp, Homo sapiens
ccagctggcccagctgtgctcc

SEQ ID NO: 9366710 - DNA, 22 bp, Homo sapiens
ccagctggcccagctgtgctcc

SEQ ID NO: 9366711 - DNA, 22 bp, Homo sapiens
ccagggctcaggctcccagtgg

SEQ ID NO: 9366712 - DNA, 22 bp, Homo sapiens
ccagggctcaggctcccagtgg

SEQ ID NO: 9366713 - DNA, 22 bp, Homo sapiens
ccagggctcaggctcccagtgg

SEQ ID NO: 9366714 - DNA, 19 bp, Homo sapiens
ccagggctccaagctgagt

SEQ ID NO: 9366715 - DNA, 19 bp, Homo sapiens
ccagggctccaagctgagt

SEQ ID NO: 9366716 - DNA, 19 bp, Homo sapiens
ccagggctccaagctgagt

SEQ ID NO: 9366717 - DNA, 22 bp, Homo sapiens
ccagggctccattgctcatcct

SEQ ID NO: 9366718 - DNA, 22 bp, Homo sapiens
ccagggctccattgctcatcct

SEQ ID NO: 9366719 - DNA, 22 bp, Homo sapiens
ccagggctccattgctcatcct

SEQ ID NO: 9366720 - DNA, 19 bp, Homo sapiens
ccagggctccaagctgagt

SEQ ID NO: 9366721 - DNA, 20 bp, Homo sapiens
ccagggctggctcctgggat

SEQ ID NO: 9366722 - DNA, 20 bp, Homo sapiens
ccagggctggctcctgggat

SEQ ID NO: 9366723 - DNA, 22 bp, Homo sapiens
ccagggctggaccagtgcttgg

SEQ ID NO: 9366724 - DNA, 20 bp, Homo sapiens
ccagggctggctcctgggat

SEQ ID NO: 9366725 - DNA, 20 bp, Homo sapiens
ccagggctggctcctgggat

SEQ ID NO: 9366726 - DNA, 23 bp, Homo sapiens
ccagggctacgggcaccgtcctg

SEQ ID NO: 9366727 - DNA, 23 bp, Homo sapiens
ccagggctacgggcaccgtcctg

SEQ ID NO: 9366728 - DNA, 22 bp, Homo sapiens
ccagggcctgccacttagcaag

SEQ ID NO: 9366729 - DNA, 22 bp, Homo sapiens
ccagggcaggagaaagactcac

SEQ ID NO: 9366730 - DNA, 22 bp, Homo sapiens
ccagggcctcgtgttctgagtg

SEQ ID NO: 9366731 - DNA, 22 bp, Homo sapiens
ccagggcctcgtgttctgagtg

SEQ ID NO: 9366732 - DNA, 22 bp, Homo sapiens
ccagggcctgagggcgacgccc

SEQ ID NO: 9366733 - DNA, 22 bp, Homo sapiens
ccagggcagcgcccctccacgc

SEQ ID NO: 9366734 - DNA, 22 bp, Homo sapiens
ccagggcagcgcccctccacgc

SEQ ID NO: 9366735 - DNA, 22 bp, Homo sapiens
ccaggctgtaaacaccttcaaa

SEQ ID NO: 9366736 - DNA, 22 bp, Homo sapiens
ccaggctgtaaacaccttcaaa

SEQ ID NO: 9366737 - DNA, 22 bp, Homo sapiens
aggctgaggcaagaggatcact

SEQ ID NO: 9366738 - DNA, 22 bp, Homo sapiens
aggctgaggcaagaggatcact

SEQ ID NO: 9366739 - DNA, 22 bp, Homo sapiens
aggctgaggcaggtggatcacc

SEQ ID NO: 9366740 - DNA, 22 bp, Homo sapiens
aggctgaggcaagaggatcact

SEQ ID NO: 9366741 - DNA, 22 bp, Homo sapiens
aggctgaggcaagaggatcact

SEQ ID NO: 9366742 - DNA, 22 bp, Homo sapiens
aggctgaggatccctgtgttct

SEQ ID NO: 9366743 - DNA, 22 bp, Homo sapiens
aggctgaggatcgtactttcca

SEQ ID NO: 9366744 - DNA, 22 bp, Homo sapiens
aggctgaggcaagaggatcact

SEQ ID NO: 9366745 - DNA, 22 bp, Homo sapiens
aggctgaggcaggtggatcacc

SEQ ID NO: 9366746 - DNA, 22 bp, Homo sapiens
aggctgaggcaggtggatcacc

SEQ ID NO: 9366747 - DNA, 22 bp, Homo sapiens
ccaggtctgcgggcggcaggca

SEQ ID NO: 9366748 - DNA, 22 bp, Homo sapiens
ccagggctggtggctgcagagg

SEQ ID NO: 9366749 - DNA, 22 bp, Homo sapiens
ccagggctggtgggagatgctg

SEQ ID NO: 9366750 - DNA, 22 bp, Homo sapiens
ccagggctggtgggagatgctg

SEQ ID NO: 9366751 - DNA, 22 bp, Homo sapiens
ccagggctggtggctgcagagg

SEQ ID NO: 9366752 - DNA, 22 bp, Homo sapiens
ccagggctggtggctgcagagg

SEQ ID NO: 9366753 - DNA, 22 bp, Homo sapiens
ccagggctggtggctgcagagg

SEQ ID NO: 9366754 - DNA, 22 bp, Homo sapiens
ccagggctgggtttgtcggtgt

SEQ ID NO: 9366755 - DNA, 22 bp, Homo sapiens
ccagggctgggtttgtcggtgt

SEQ ID NO: 9366756 - DNA, 22 bp, Homo sapiens
aggctgagctgacctggtttgg

SEQ ID NO: 9366757 - DNA, 22 bp, Homo sapiens
aggctgaggatcgtactttcca

SEQ ID NO: 9366758 - DNA, 22 bp, Homo sapiens
aggctgaggatcgtactttcca

SEQ ID NO: 9366759 - DNA, 22 bp, Homo sapiens
aggctgagctgacctggtttgg

SEQ ID NO: 9366760 - DNA, 22 bp, Homo sapiens
aggctgaggatccctgtgttct

SEQ ID NO: 9366761 - DNA, 22 bp, Homo sapiens
ccaggctctgcgctggacatgg

SEQ ID NO: 9366762 - DNA, 22 bp, Homo sapiens
aggctagaggcttctggcttca

SEQ ID NO: 9366763 - DNA, 22 bp, Homo sapiens
ccaggctctgcgctggacatgg

SEQ ID NO: 9366764 - DNA, 22 bp, Homo sapiens
ccaggctgctgttggtgtccgc

SEQ ID NO: 9366765 - DNA, 22 bp, Homo sapiens
ccaggctgctgttggtgtccgc

SEQ ID NO: 9366766 - DNA, 22 bp, Homo sapiens
aggctagaggcttctggcttca

SEQ ID NO: 9366767 - DNA, 22 bp, Homo sapiens
aggctacaggagacgccaggag

SEQ ID NO: 9366768 - DNA, 22 bp, Homo sapiens
aggctacaataattcccatgca

SEQ ID NO: 9366769 - DNA, 22 bp, Homo sapiens
aggctaaaagagaatcatttag

SEQ ID NO: 9366770 - DNA, 22 bp, Homo sapiens
aggcgtggttgaggcgagcata

SEQ ID NO: 9366771 - DNA, 19 bp, Homo sapiens
aggctaaagagtcttgcgt

SEQ ID NO: 9366772 - DNA, 22 bp, Homo sapiens
aggctaaaagagaatcatttag

SEQ ID NO: 9366773 - DNA, 22 bp, Homo sapiens
aggctaagatgtggtctgagca

SEQ ID NO: 9366774 - DNA, 22 bp, Homo sapiens
aggctacaataattcccatgca

SEQ ID NO: 9366775 - DNA, 21 bp, Homo sapiens
ccaggctgggagggcagttcc

SEQ ID NO: 9366776 - DNA, 22 bp, Homo sapiens
ccaggctgggcggggaacctgg

SEQ ID NO: 9366777 - DNA, 22 bp, Homo sapiens
ccaggctgggcggggaacctgg

SEQ ID NO: 9366778 - DNA, 22 bp, Homo sapiens
ccaggctgggctacaagttgag

SEQ ID NO: 9366779 - DNA, 22 bp, Homo sapiens
ccaggctgggcggggaacctgg

SEQ ID NO: 9366780 - DNA, 22 bp, Homo sapiens
ccaggctgggctacaagttgag

SEQ ID NO: 9366781 - DNA, 15 bp, Homo sapiens
ccaggctgggtgagc

SEQ ID NO: 9366782 - DNA, 15 bp, Homo sapiens
ccaggctgggtgagc

SEQ ID NO: 9366783 - DNA, 22 bp, Homo sapiens
ccaggctggtctgaatttctag

SEQ ID NO: 9366784 - DNA, 22 bp, Homo sapiens
ccaggctggagtgcaatggcat

SEQ ID NO: 9366785 - DNA, 22 bp, Homo sapiens
ccaggctggagtatagtggcgc

SEQ ID NO: 9366786 - DNA, 22 bp, Homo sapiens
ccaggctggagtatagtggcgc

SEQ ID NO: 9366787 - DNA, 22 bp, Homo sapiens
ccaggctggagtatagtggcgc

SEQ ID NO: 9366788 - DNA, 22 bp, Homo sapiens
ccaggctggagtatagtggcgc

SEQ ID NO: 9366789 - DNA, 22 bp, Homo sapiens
ccaggctgctttattactctgt

SEQ ID NO: 9366790 - DNA, 22 bp, Homo sapiens
ccaggctggaatcaatattctg

SEQ ID NO: 9366791 - DNA, 22 bp, Homo sapiens
ccaggctgcttagccttatctt

SEQ ID NO: 9366792 - DNA, 22 bp, Homo sapiens
ccaggctgcttagccttatctt

SEQ ID NO: 9366793 - DNA, 22 bp, Homo sapiens
ccaggctgcttagccttatctt

SEQ ID NO: 9366794 - DNA, 22 bp, Homo sapiens
ccaggctgctttattactctgt

SEQ ID NO: 9366795 - DNA, 22 bp, Homo sapiens
ccatttcactcttcctgaagga

SEQ ID NO: 9366796 - DNA, 22 bp, Homo sapiens
aggctggcggtgactgctctga

SEQ ID NO: 9366797 - DNA, 22 bp, Homo sapiens
aggctggcgtcaggggctgtac

SEQ ID NO: 9366798 - DNA, 22 bp, Homo sapiens
aggctggcgtcaggggctgtac

SEQ ID NO: 9366799 - DNA, 22 bp, Homo sapiens
ccatttatagatgtatttggct

SEQ ID NO: 9366800 - DNA, 22 bp, Homo sapiens
ccatttatagatgtatttggct

SEQ ID NO: 9366801 - DNA, 22 bp, Homo sapiens
ccatttatagatgtatttggct

SEQ ID NO: 9366802 - DNA, 22 bp, Homo sapiens
aggctggcgacatctggcgggc

SEQ ID NO: 9366803 - DNA, 22 bp, Homo sapiens
aggctggcgacatctggcgggc

SEQ ID NO: 9366804 - DNA, 22 bp, Homo sapiens
aggctggcgacatctggcgggc

SEQ ID NO: 9366805 - DNA, 17 bp, Homo sapiens
aggctggccttcacagt

SEQ ID NO: 9366806 - DNA, 17 bp, Homo sapiens
aggctggccttcacagt

SEQ ID NO: 9366807 - DNA, 22 bp, Homo sapiens
aggctggcgacatctggcgggc

SEQ ID NO: 9366808 - DNA, 22 bp, Homo sapiens
aggctggcggtgactgctctga

SEQ ID NO: 9366809 - DNA, 22 bp, Homo sapiens
aggctggcggtgactgctctga

SEQ ID NO: 9366810 - DNA, 22 bp, Homo sapiens
aggctggcggtgactgctctga

SEQ ID NO: 9366811 - DNA, 22 bp, Homo sapiens
aggctggcgacatctggcgggc

SEQ ID NO: 9366812 - DNA, 17 bp, Homo sapiens
aggctggccttcacagt

SEQ ID NO: 9366813 - DNA, 17 bp, Homo sapiens
aggctggccttcacagt

SEQ ID NO: 9366814 - DNA, 17 bp, Homo sapiens
aggctggccttcacagt

SEQ ID NO: 9366815 - DNA, 22 bp, Homo sapiens
aggctggcctatttctttatcg

SEQ ID NO: 9366816 - DNA, 22 bp, Homo sapiens
aggctggcctatttctttatcg

SEQ ID NO: 9366817 - DNA, 22 bp, Homo sapiens
aggctggccctactggctgcct

SEQ ID NO: 9366818 - DNA, 22 bp, Homo sapiens
aggctggccctactggctgcct

SEQ ID NO: 9366819 - DNA, 22 bp, Homo sapiens
aggctggccctactggctgcct

SEQ ID NO: 9366820 - DNA, 22 bp, Homo sapiens
aggctggccctactggctgcct

SEQ ID NO: 9366821 - DNA, 22 bp, Homo sapiens
aggctgggaaggtaaagttgta

SEQ ID NO: 9366822 - DNA, 22 bp, Homo sapiens
aggctgggctccgcccaactcc

SEQ ID NO: 9366823 - DNA, 22 bp, Homo sapiens
aggctgggtacctgtcatatgc

SEQ ID NO: 9366824 - DNA, 22 bp, Homo sapiens
aggctgggtacctgtcatatgc

SEQ ID NO: 9366825 - DNA, 22 bp, Homo sapiens
ccatttgttgtgtattaatatt

SEQ ID NO: 9366826 - DNA, 22 bp, Homo sapiens
aggctggctggggatgcgtctt

SEQ ID NO: 9366827 - DNA, 22 bp, Homo sapiens
aggctggctggggatgcgtctt

SEQ ID NO: 9366828 - DNA, 22 bp, Homo sapiens
ccatttgtggtttatttgctct

SEQ ID NO: 9366829 - DNA, 22 bp, Homo sapiens
aggctggagagtgcagtggcgt

SEQ ID NO: 9366830 - DNA, 22 bp, Homo sapiens
aggctggagagtgcagtggcgt

SEQ ID NO: 9366831 - DNA, 22 bp, Homo sapiens
aggctggagagtgcagtggcgt

SEQ ID NO: 9366832 - DNA, 22 bp, Homo sapiens
aggctggagagtgcagtggcgt

SEQ ID NO: 9366833 - DNA, 22 bp, Homo sapiens
aggctggagacccgccaagaaa

SEQ ID NO: 9366834 - DNA, 22 bp, Homo sapiens
aggctggagacccgccaagaaa

SEQ ID NO: 9366835 - DNA, 22 bp, Homo sapiens
aggctggagacccgccaagaaa

SEQ ID NO: 9366836 - DNA, 19 bp, Homo sapiens
aggctggagacaccaggcc

SEQ ID NO: 9366837 - DNA, 22 bp, Homo sapiens
aggctggagcaagggggcatat

SEQ ID NO: 9366838 - DNA, 22 bp, Homo sapiens
aggctggagcaagggggcatat

SEQ ID NO: 9366839 - DNA, 22 bp, Homo sapiens
aggctggagcaagggggcatat

SEQ ID NO: 9366840 - DNA, 22 bp, Homo sapiens
aggctggagagtgcagtggcgt

SEQ ID NO: 9366841 - DNA, 22 bp, Homo sapiens
aggctggagagtgcagtggcgt

SEQ ID NO: 9366842 - DNA, 22 bp, Homo sapiens
aggctggagcaagggggcatat

SEQ ID NO: 9366843 - DNA, 22 bp, Homo sapiens
aggctggagtacagtggctatt

SEQ ID NO: 9366844 - DNA, 22 bp, Homo sapiens
aggctggagtacagtggctatt

SEQ ID NO: 9366845 - DNA, 22 bp, Homo sapiens
aggctggagggcaatggcaaga

SEQ ID NO: 9366846 - DNA, 22 bp, Homo sapiens
aggctggaggtttgttgcggct

SEQ ID NO: 9366847 - DNA, 22 bp, Homo sapiens
aggctggcccacctcttgtctt

SEQ ID NO: 9366848 - DNA, 22 bp, Homo sapiens
aggctggcccacctcttgtctt

SEQ ID NO: 9366849 - DNA, 22 bp, Homo sapiens
aggctggcccacctcttgtctt

SEQ ID NO: 9366850 - DNA, 22 bp, Homo sapiens
aggctggcccacctcttgtctt

SEQ ID NO: 9366851 - DNA, 22 bp, Homo sapiens
aggctggccagtgctgcagtgg

SEQ ID NO: 9366852 - DNA, 22 bp, Homo sapiens
aggctggagtgtagcagtgcag

SEQ ID NO: 9366853 - DNA, 22 bp, Homo sapiens
aggctggagtgtagcagtgcag

SEQ ID NO: 9366854 - DNA, 22 bp, Homo sapiens
aggctggagtgtagcagtgcag

SEQ ID NO: 9366855 - DNA, 22 bp, Homo sapiens
aggctggagtgtagcagtgcag

SEQ ID NO: 9366856 - DNA, 22 bp, Homo sapiens
aggctggagtgcagttgcatga

SEQ ID NO: 9366857 - DNA, 22 bp, Homo sapiens
aggctggagtgtagcagtgcag

SEQ ID NO: 9366858 - DNA, 22 bp, Homo sapiens
aggctggagtgctggagtgctg

SEQ ID NO: 9366859 - DNA, 22 bp, Homo sapiens
aggctggagtgctggagtgctg

SEQ ID NO: 9366860 - DNA, 22 bp, Homo sapiens
aggctggagtgctggagtgctg

SEQ ID NO: 9366861 - DNA, 22 bp, Homo sapiens
aggctggagtgcaatggcgtga

SEQ ID NO: 9366862 - DNA, 22 bp, Homo sapiens
aggctggagtgcagtggtgtga

SEQ ID NO: 9366863 - DNA, 22 bp, Homo sapiens
aggctggagtgcagtggcgtga

SEQ ID NO: 9366864 - DNA, 22 bp, Homo sapiens
aggctgctcagtagatggagct

SEQ ID NO: 9366865 - DNA, 22 bp, Homo sapiens
ccaggtgaggtaggtatggtag

SEQ ID NO: 9366866 - DNA, 21 bp, Homo sapiens
ccaggtcttggtccttggact

SEQ ID NO: 9366867 - DNA, 22 bp, Homo sapiens
ccaggtcttgtttgacatcaat

SEQ ID NO: 9366868 - DNA, 22 bp, Homo sapiens
ccaggtcttggcccccggacct

SEQ ID NO: 9366869 - DNA, 19 bp, Homo sapiens
ccaggtctggggccagatt

SEQ ID NO: 9366870 - DNA, 22 bp, Homo sapiens
ccaggtctggcactggccagtc

SEQ ID NO: 9366871 - DNA, 19 bp, Homo sapiens
ccaggtctggggccagatt

SEQ ID NO: 9366872 - DNA, 22 bp, Homo sapiens
ccaggtctggcactggccagtc

SEQ ID NO: 9366873 - DNA, 22 bp, Homo sapiens
ccaggtctggcactggccagtc

SEQ ID NO: 9366874 - DNA, 22 bp, Homo sapiens
ccaggtctggaaccaccagggc

SEQ ID NO: 9366875 - DNA, 22 bp, Homo sapiens
ccaggtctggaaccaccagggc

SEQ ID NO: 9366876 - DNA, 19 bp, Homo sapiens
ccaggtctggggccagatt

SEQ ID NO: 9366877 - DNA, 22 bp, Homo sapiens
ccaggtctgtcttcttagctca

SEQ ID NO: 9366878 - DNA, 22 bp, Homo sapiens
ccaggtcttcactttactgaag

SEQ ID NO: 9366879 - DNA, 22 bp, Homo sapiens
aggctgctttcatggccgcccc

SEQ ID NO: 9366880 - DNA, 22 bp, Homo sapiens
aggctgctttttatttacaggt

SEQ ID NO: 9366881 - DNA, 22 bp, Homo sapiens
aggctgctttattcacaatagc

SEQ ID NO: 9366882 - DNA, 22 bp, Homo sapiens
aggctgcttcttgtccttggca

SEQ ID NO: 9366883 - DNA, 22 bp, Homo sapiens
aggctgcttcttgtccttggca

SEQ ID NO: 9366884 - DNA, 22 bp, Homo sapiens
aggctgcttcttgtccttggca

SEQ ID NO: 9366885 - DNA, 22 bp, Homo sapiens
aggctgcttccttacgtggctg

SEQ ID NO: 9366886 - DNA, 22 bp, Homo sapiens
aggctgcttccttacgtggctg

SEQ ID NO: 9366887 - DNA, 22 bp, Homo sapiens
aggctgcttccttacgtggctg

SEQ ID NO: 9366888 - DNA, 22 bp, Homo sapiens
aggctgcttcagctgcagggag

SEQ ID NO: 9366889 - DNA, 22 bp, Homo sapiens
aggctgctcagtagatggagct

SEQ ID NO: 9366890 - DNA, 19 bp, Homo sapiens
aggctggagacaccaggcc

SEQ ID NO: 9366891 - DNA, 22 bp, Homo sapiens
aggctggacccgacacctgccc

SEQ ID NO: 9366892 - DNA, 19 bp, Homo sapiens
aggctggagacaccaggcc

SEQ ID NO: 9366893 - DNA, 19 bp, Homo sapiens
aggctggagacaccaggcc

SEQ ID NO: 9366894 - DNA, 22 bp, Homo sapiens
aggctggaaagggaccagagtg

SEQ ID NO: 9366895 - DNA, 22 bp, Homo sapiens
aggctggaaatcactagattcc

SEQ ID NO: 9366896 - DNA, 22 bp, Homo sapiens
aggctggaaagggaccagagtg

SEQ ID NO: 9366897 - DNA, 22 bp, Homo sapiens
aggctggaaagggaccagagtg

SEQ ID NO: 9366898 - DNA, 22 bp, Homo sapiens
aggctggaaagggaccagagtg

SEQ ID NO: 9366899 - DNA, 22 bp, Homo sapiens
aggctgctttcatggccgcccc

SEQ ID NO: 9366900 - DNA, 22 bp, Homo sapiens
agggcgacaatggagagcgttt

SEQ ID NO: 9366901 - DNA, 22 bp, Homo sapiens
agggccttgctgtctgaagctg

SEQ ID NO: 9366902 - DNA, 22 bp, Homo sapiens
agggcgacaatggagagcgttt

SEQ ID NO: 9366903 - DNA, 22 bp, Homo sapiens
agggcgaggagacggaggcaca

SEQ ID NO: 9366904 - DNA, 22 bp, Homo sapiens
agggcgacaatggagagcgttt

SEQ ID NO: 9366905 - DNA, 22 bp, Homo sapiens
agggcgaggagacggaggcaca

SEQ ID NO: 9366906 - DNA, 22 bp, Homo sapiens
agggcgcctgctgtggccaccg

SEQ ID NO: 9366907 - DNA, 19 bp, Homo sapiens
agggcggggcccaggcaca

SEQ ID NO: 9366908 - DNA, 22 bp, Homo sapiens
agggcgctgtctggccagcggt

SEQ ID NO: 9366909 - DNA, 22 bp, Homo sapiens
agggcgctgaaatactaacatg

SEQ ID NO: 9366910 - DNA, 22 bp, Homo sapiens
agggcgtggtggtgctggagca

SEQ ID NO: 9366911 - DNA, 22 bp, Homo sapiens
agggcgtggtggtgctggagca

SEQ ID NO: 9366912 - DNA, 22 bp, Homo sapiens
agggcgtggtggtgctggagca

SEQ ID NO: 9366913 - DNA, 22 bp, Homo sapiens
agggcgtggtggtgctggagca

SEQ ID NO: 9366914 - DNA, 22 bp, Homo sapiens
cctcaggcaagtcacttaacat

SEQ ID NO: 9366915 - DNA, 22 bp, Homo sapiens
cctcaggcaggaaactgtcccg

SEQ ID NO: 9366916 - DNA, 22 bp, Homo sapiens
cctcaggcaggaaactgtcccg

SEQ ID NO: 9366917 - DNA, 22 bp, Homo sapiens
cctcaggccctgtccctgcgcc

SEQ ID NO: 9366918 - DNA, 22 bp, Homo sapiens
cctcaggccctgtccctgcgcc

SEQ ID NO: 9366919 - DNA, 22 bp, Homo sapiens
cctcaggcagtggtatggatgg

SEQ ID NO: 9366920 - DNA, 22 bp, Homo sapiens
cctcaggccagggggcggccag

SEQ ID NO: 9366921 - DNA, 22 bp, Homo sapiens
cctcaggccagggggcggccag

SEQ ID NO: 9366922 - DNA, 20 bp, Homo sapiens
cctcaggccagttttaaagt

SEQ ID NO: 9366923 - DNA, 22 bp, Homo sapiens
agggctggagccacagctggga

SEQ ID NO: 9366924 - DNA, 22 bp, Homo sapiens
agggctggagccacagctggga

SEQ ID NO: 9366925 - DNA, 22 bp, Homo sapiens
agggctggagccacagctggga

SEQ ID NO: 9366926 - DNA, 22 bp, Homo sapiens
agggctggagccacagctggga

SEQ ID NO: 9366927 - DNA, 22 bp, Homo sapiens
agggctggagccacagctggga

SEQ ID NO: 9366928 - DNA, 22 bp, Homo sapiens
agggctgcttacctggaatggc

SEQ ID NO: 9366929 - DNA, 22 bp, Homo sapiens
agggctgctttgctaaatatgg

SEQ ID NO: 9366930 - DNA, 22 bp, Homo sapiens
agggctaggaatggaactggag

SEQ ID NO: 9366931 - DNA, 22 bp, Homo sapiens
agggctagagttgagatgggga

SEQ ID NO: 9366932 - DNA, 22 bp, Homo sapiens
agggctgcatctgcctggtgaa

SEQ ID NO: 9366933 - DNA, 22 bp, Homo sapiens
agggctgcatctgcctggtgaa

SEQ ID NO: 9366934 - DNA, 22 bp, Homo sapiens
agggctgctgctccgggcccag

SEQ ID NO: 9366935 - DNA, 22 bp, Homo sapiens
agggctggcatctctaatgctg

SEQ ID NO: 9366936 - DNA, 22 bp, Homo sapiens
agggctggcatctctaatgctg

SEQ ID NO: 9366937 - DNA, 22 bp, Homo sapiens
agggctggcaagggattgaaat

SEQ ID NO: 9366938 - DNA, 22 bp, Homo sapiens
agggctggcaagggattgaaat

SEQ ID NO: 9366939 - DNA, 22 bp, Homo sapiens
agggctggcaagggattgaaat

SEQ ID NO: 9366940 - DNA, 22 bp, Homo sapiens
agggctggcaagggattgaaat

SEQ ID NO: 9366941 - DNA, 22 bp, Homo sapiens
agggctggagccacagctggga

SEQ ID NO: 9366942 - DNA, 22 bp, Homo sapiens
agggctggagccacagctggga

SEQ ID NO: 9366943 - DNA, 22 bp, Homo sapiens
agggctggagggtactagttta

SEQ ID NO: 9366944 - DNA, 22 bp, Homo sapiens
agggctggagggtactagttta

SEQ ID NO: 9366945 - DNA, 22 bp, Homo sapiens
agggctggagccacagctggga

SEQ ID NO: 9366946 - DNA, 22 bp, Homo sapiens
agggcctgcatcaggagcttgg

SEQ ID NO: 9366947 - DNA, 22 bp, Homo sapiens
agggcctgcatcaggagcttgg

SEQ ID NO: 9366948 - DNA, 22 bp, Homo sapiens
agggcctgcatcaggagcttgg

SEQ ID NO: 9366949 - DNA, 22 bp, Homo sapiens
agggcctgcatcaggagcttgg

SEQ ID NO: 9366950 - DNA, 19 bp, Homo sapiens
agggcctgcagctcaagct

SEQ ID NO: 9366951 - DNA, 19 bp, Homo sapiens
agggcctgcagctcaagct

SEQ ID NO: 9366952 - DNA, 19 bp, Homo sapiens
agggcctgcagctcaagct

SEQ ID NO: 9366953 - DNA, 22 bp, Homo sapiens
agggcctgaggctgacggggag

SEQ ID NO: 9366954 - DNA, 22 bp, Homo sapiens
agggcctgaggctgacggggag

SEQ ID NO: 9366955 - DNA, 22 bp, Homo sapiens
agggcctgagctggctgacctc

SEQ ID NO: 9366956 - DNA, 22 bp, Homo sapiens
agggcctgagctggctgacctc

SEQ ID NO: 9366957 - DNA, 19 bp, Homo sapiens
agggcctgcagctcaagct

SEQ ID NO: 9366958 - DNA, 22 bp, Homo sapiens
agggcctccagggcagcagtgg

SEQ ID NO: 9366959 - DNA, 22 bp, Homo sapiens
agggcctgagctggctgacctc

SEQ ID NO: 9366960 - DNA, 22 bp, Homo sapiens
agggcctgagctctcctccagt

SEQ ID NO: 9366961 - DNA, 22 bp, Homo sapiens
ccctggaactgccaagcctcag

SEQ ID NO: 9366962 - DNA, 22 bp, Homo sapiens
agggcctcagtgttctcatctg

SEQ ID NO: 9366963 - DNA, 22 bp, Homo sapiens
ccctggaaggagatgggacatg

SEQ ID NO: 9366964 - DNA, 22 bp, Homo sapiens
ccctgcttagcacccttgcacc

SEQ ID NO: 9366965 - DNA, 22 bp, Homo sapiens
ccctgcttgtcacccctgggtc

SEQ ID NO: 9366966 - DNA, 22 bp, Homo sapiens
ccctgctttcaaccttctagct

SEQ ID NO: 9366967 - DNA, 22 bp, Homo sapiens
ccctgctttcaaccttctagct

SEQ ID NO: 9366968 - DNA, 22 bp, Homo sapiens
ccctgctttcaaccttctagct

SEQ ID NO: 9366969 - DNA, 22 bp, Homo sapiens
ccctgctttgcacccaggctgg

SEQ ID NO: 9366970 - DNA, 22 bp, Homo sapiens
ccctggaaatgaggcatgtgcg

SEQ ID NO: 9366971 - DNA, 22 bp, Homo sapiens
ccctgctttgcacccaggctgg

SEQ ID NO: 9366972 - DNA, 22 bp, Homo sapiens
ccctggaacccatggccagtgt

SEQ ID NO: 9366973 - DNA, 22 bp, Homo sapiens
agggcctggactaattggatcc

SEQ ID NO: 9366974 - DNA, 20 bp, Homo sapiens
agggcctggagtacagcagg

SEQ ID NO: 9366975 - DNA, 20 bp, Homo sapiens
agggcctggagtacagcagg

SEQ ID NO: 9366976 - DNA, 22 bp, Homo sapiens
agggcctggcgcgtggccgccg

SEQ ID NO: 9366977 - DNA, 23 bp, Homo sapiens
agggcctggcgtggagtgtgtgc

SEQ ID NO: 9366978 - DNA, 22 bp, Homo sapiens
agggcctggcgcgtggccgccg

SEQ ID NO: 9366979 - DNA, 22 bp, Homo sapiens
agggcctggcgcgtggccgccg

SEQ ID NO: 9366980 - DNA, 18 bp, Homo sapiens
cctcagaggcaaattgtt

SEQ ID NO: 9366981 - DNA, 19 bp, Homo sapiens
cctcagagctagtgaacat

SEQ ID NO: 9366982 - DNA, 20 bp, Homo sapiens
cctcagagcgcaggccccct

SEQ ID NO: 9366983 - DNA, 22 bp, Homo sapiens
cctcagagcgcgtggcattatt

SEQ ID NO: 9366984 - DNA, 22 bp, Homo sapiens
cctcagcttgatttctgcagag

SEQ ID NO: 9366985 - DNA, 22 bp, Homo sapiens
agggcctggaactggagaccac

SEQ ID NO: 9366986 - DNA, 22 bp, Homo sapiens
agggcctggaactggagaccac

SEQ ID NO: 9366987 - DNA, 20 bp, Homo sapiens
agggcctgctctgtggtgtc

SEQ ID NO: 9366988 - DNA, 20 bp, Homo sapiens
agggcctgctctgtggtgtc

SEQ ID NO: 9366989 - DNA, 22 bp, Homo sapiens
agggcctgctctatcactctca

SEQ ID NO: 9366990 - DNA, 22 bp, Homo sapiens
agggcctggaactggagaccac

SEQ ID NO: 9366991 - DNA, 22 bp, Homo sapiens
agggcctggaactgtgggcagg

SEQ ID NO: 9366992 - DNA, 22 bp, Homo sapiens
agggcctggaactggagaccac

SEQ ID NO: 9366993 - DNA, 22 bp, Homo sapiens
agggcctggaactgtgggcagg

SEQ ID NO: 9366994 - DNA, 22 bp, Homo sapiens
aggggaggagcttttcttgcct

SEQ ID NO: 9366995 - DNA, 22 bp, Homo sapiens
aggggaggcagcgataaacctg

SEQ ID NO: 9366996 - DNA, 22 bp, Homo sapiens
aggggatgcctagtggagtctc

SEQ ID NO: 9366997 - DNA, 22 bp, Homo sapiens
aggggatgcctagtggagtctc

SEQ ID NO: 9366998 - DNA, 22 bp, Homo sapiens
aggggatgatcctcccgcagcg

SEQ ID NO: 9366999 - DNA, 22 bp, Homo sapiens
aggggaggtgtccccaaatctc

SEQ ID NO: 9367000 - DNA, 22 bp, Homo sapiens
aggggagagttaatgtgaatgt

SEQ ID NO: 9367001 - DNA, 22 bp, Homo sapiens
aggggagagttaatgtgaatgt

SEQ ID NO: 9367002 - DNA, 22 bp, Homo sapiens
agggctggctccgttaccttga

SEQ ID NO: 9367003 - DNA, 22 bp, Homo sapiens
agggctggctaggtgcgttccc

SEQ ID NO: 9367004 - DNA, 22 bp, Homo sapiens
agggctggctaggtgcgttccc

SEQ ID NO: 9367005 - DNA, 22 bp, Homo sapiens
agggctggccacatgatttggt

SEQ ID NO: 9367006 - DNA, 22 bp, Homo sapiens
agggctggccacatgatttggt

SEQ ID NO: 9367007 - DNA, 22 bp, Homo sapiens
cctcttcatcctggaagctgct

SEQ ID NO: 9367008 - DNA, 22 bp, Homo sapiens
cctcttccactgggccccatcc

SEQ ID NO: 9367009 - DNA, 22 bp, Homo sapiens
cctgaaaatcaaggtagtttgg

SEQ ID NO: 9367010 - DNA, 22 bp, Homo sapiens
aggggcagcctcacaatcctct

SEQ ID NO: 9367011 - DNA, 18 bp, Homo sapiens
aggggcagcttgtgtgga

SEQ ID NO: 9367012 - DNA, 22 bp, Homo sapiens
aggggcagcctcacaatcctct

SEQ ID NO: 9367013 - DNA, 23 bp, Homo sapiens
aggggcagcaagttttggtgtta

SEQ ID NO: 9367014 - DNA, 23 bp, Homo sapiens
aggggcagcaagttttggtgtta

SEQ ID NO: 9367015 - DNA, 22 bp, Homo sapiens
aggggcacttctcaggctgtgg

SEQ ID NO: 9367016 - DNA, 22 bp, Homo sapiens
aggggatgcctgaggatctgta

SEQ ID NO: 9367017 - DNA, 22 bp, Homo sapiens
aggggatggagctggaaggcag

SEQ ID NO: 9367018 - DNA, 22 bp, Homo sapiens
aggggatgcctgaggatctgta

SEQ ID NO: 9367019 - DNA, 22 bp, Homo sapiens
aggggatggagctggaaggcag

SEQ ID NO: 9367020 - DNA, 20 bp, Homo sapiens
aggggcacctgcgacggggc

SEQ ID NO: 9367021 - DNA, 22 bp, Homo sapiens
aggggcacgagtagagctctag

SEQ ID NO: 9367022 - DNA, 22 bp, Homo sapiens
cctgagagccagtgcctgccca

SEQ ID NO: 9367023 - DNA, 22 bp, Homo sapiens
cctgagagccctagccaggcgc

SEQ ID NO: 9367024 - DNA, 22 bp, Homo sapiens
cctgaagatgctgtggcctggt

SEQ ID NO: 9367025 - DNA, 22 bp, Homo sapiens
cctgagaggccctctcactgtc

SEQ ID NO: 9367026 - DNA, 22 bp, Homo sapiens
cctgagagtaggtgtctcttta

SEQ ID NO: 9367027 - DNA, 22 bp, Homo sapiens
cctgagagggggccctagaaat

SEQ ID NO: 9367028 - DNA, 22 bp, Homo sapiens
cctgaagacaacttttatcacc

SEQ ID NO: 9367029 - DNA, 22 bp, Homo sapiens
cctgaagaattcaaatccagat

SEQ ID NO: 9367030 - DNA, 22 bp, Homo sapiens
cctgaagatccattatagacac

SEQ ID NO: 9367031 - DNA, 20 bp, Homo sapiens
cctgaagagtttctctttct

SEQ ID NO: 9367032 - DNA, 22 bp, Homo sapiens
cctgaaatttgaagacctgaat

SEQ ID NO: 9367033 - DNA, 22 bp, Homo sapiens
cctgaacaaatggcatagccaa

SEQ ID NO: 9367034 - DNA, 22 bp, Homo sapiens
cctgaagaagttgttatggtct

SEQ ID NO: 9367035 - DNA, 22 bp, Homo sapiens
cctgaaatccatagtttacact

SEQ ID NO: 9367036 - DNA, 22 bp, Homo sapiens
cctgaaatgactccagctgagt

SEQ ID NO: 9367037 - DNA, 21 bp, Homo sapiens
cctgaaattctcactagctta

SEQ ID NO: 9367038 - DNA, 22 bp, Homo sapiens
cctgaaatgagttctgctcact

SEQ ID NO: 9367039 - DNA, 22 bp, Homo sapiens
aggggtgaaggcccgataggag

SEQ ID NO: 9367040 - DNA, 22 bp, Homo sapiens
agggtaggaactgagtggaagg

SEQ ID NO: 9367041 - DNA, 22 bp, Homo sapiens
agggtaggaactgagtggaagg

SEQ ID NO: 9367042 - DNA, 22 bp, Homo sapiens
agggtaggaactgagtggaagg

SEQ ID NO: 9367043 - DNA, 22 bp, Homo sapiens
agggtagggcccggagacagac

SEQ ID NO: 9367044 - DNA, 22 bp, Homo sapiens
agggtagggcccggagacagac

SEQ ID NO: 9367045 - DNA, 22 bp, Homo sapiens
agggtagggccgtagggccatg

SEQ ID NO: 9367046 - DNA, 22 bp, Homo sapiens
agggtagggccgtagggccatg

SEQ ID NO: 9367047 - DNA, 22 bp, Homo sapiens
agggtaggtgtaagatagccct

SEQ ID NO: 9367048 - DNA, 22 bp, Homo sapiens
agggtagggtaaatgatgcatc

SEQ ID NO: 9367049 - DNA, 22 bp, Homo sapiens
agggtagggtaaatgatgcatc

SEQ ID NO: 9367050 - DNA, 22 bp, Homo sapiens
agggtagggccgtagggccatg

SEQ ID NO: 9367051 - DNA, 22 bp, Homo sapiens
agggtatgttttaggctgagtt

SEQ ID NO: 9367052 - DNA, 22 bp, Homo sapiens
agggtcaaatgggcaggaagag

SEQ ID NO: 9367053 - DNA, 22 bp, Homo sapiens
agggtcaacatttcattgattc

SEQ ID NO: 9367054 - DNA, 22 bp, Homo sapiens
agggtcaacattctaaaatctg

SEQ ID NO: 9367055 - DNA, 22 bp, Homo sapiens
agggtcaacactttaaacatat

SEQ ID NO: 9367056 - DNA, 22 bp, Homo sapiens
cctgaggtctagagtcagggtg

SEQ ID NO: 9367057 - DNA, 22 bp, Homo sapiens
cctgaggtggctgcagcactgc

SEQ ID NO: 9367058 - DNA, 22 bp, Homo sapiens
cccatcacagacactgggttat

SEQ ID NO: 9367059 - DNA, 22 bp, Homo sapiens
cccatcaggaacccaggagccc

SEQ ID NO: 9367060 - DNA, 22 bp, Homo sapiens
cccatctcagtcgtgctaaggg

SEQ ID NO: 9367061 - DNA, 22 bp, Homo sapiens
cccatccctgattttcactcgt

SEQ ID NO: 9367062 - DNA, 22 bp, Homo sapiens
cccagtacctctgttccctgct

SEQ ID NO: 9367063 - DNA, 22 bp, Homo sapiens
cccaggcttttctcttgcccca

SEQ ID NO: 9367064 - DNA, 22 bp, Homo sapiens
cccaggcttttctcttgcccca

SEQ ID NO: 9367065 - DNA, 22 bp, Homo sapiens
cccaggcttttctcttgcccca

SEQ ID NO: 9367066 - DNA, 22 bp, Homo sapiens
cccaggcttttaagttagacag

SEQ ID NO: 9367067 - DNA, 22 bp, Homo sapiens
cccaggcttcccaatcagaagg

SEQ ID NO: 9367068 - DNA, 18 bp, Homo sapiens
cccaggctttgtgggtct

SEQ ID NO: 9367069 - DNA, 22 bp, Homo sapiens
cccaggctggaattccaggcct

SEQ ID NO: 9367070 - DNA, 22 bp, Homo sapiens
cccaggctggaattccaggcct

SEQ ID NO: 9367071 - DNA, 22 bp, Homo sapiens
cccaggctgtctgtcctttgct

SEQ ID NO: 9367072 - DNA, 22 bp, Homo sapiens
cccaggctggaattccaggcct

SEQ ID NO: 9367073 - DNA, 22 bp, Homo sapiens
cccaggctgtgcaaacttcaaa

SEQ ID NO: 9367074 - DNA, 22 bp, Homo sapiens
cccaggctgtctgtcctttgct

SEQ ID NO: 9367075 - DNA, 22 bp, Homo sapiens
cccaggctgatgttcagcgggt

SEQ ID NO: 9367076 - DNA, 22 bp, Homo sapiens
cccaggctgatgttcagcgggt

SEQ ID NO: 9367077 - DNA, 22 bp, Homo sapiens
cccaggctgatgggatgggcca

SEQ ID NO: 9367078 - DNA, 22 bp, Homo sapiens
cccaggctgatgggatgggcca

SEQ ID NO: 9367079 - DNA, 22 bp, Homo sapiens
cccaggctgcatgagtccatgg

SEQ ID NO: 9367080 - DNA, 22 bp, Homo sapiens
cccaggctgcatgagtccatgg

SEQ ID NO: 9367081 - DNA, 22 bp, Homo sapiens
cccaggctgcatgagtccatgg

SEQ ID NO: 9367082 - DNA, 22 bp, Homo sapiens
cccaggctgcgtatccacaata

SEQ ID NO: 9367083 - DNA, 22 bp, Homo sapiens
cccaggctgcgtatccacaata

SEQ ID NO: 9367084 - DNA, 22 bp, Homo sapiens
cccaggctgccacgattactgc

SEQ ID NO: 9367085 - DNA, 22 bp, Homo sapiens
cccaggaggtcaaggctgcagt

SEQ ID NO: 9367086 - DNA, 22 bp, Homo sapiens
cccaggaggtcgaagctgcagt

SEQ ID NO: 9367087 - DNA, 22 bp, Homo sapiens
cccaggaggtcgaagctgcagt

SEQ ID NO: 9367088 - DNA, 22 bp, Homo sapiens
cccaggaggtggagcttgcagt

SEQ ID NO: 9367089 - DNA, 22 bp, Homo sapiens
cccaggaggtcgaagctgcagt

SEQ ID NO: 9367090 - DNA, 23 bp, Homo sapiens
cccaggctacaaattatgctctg

SEQ ID NO: 9367091 - DNA, 23 bp, Homo sapiens
cccaggctacaaattatgctctg

SEQ ID NO: 9367092 - DNA, 22 bp, Homo sapiens
cccaggagatctggatctcgtc

SEQ ID NO: 9367093 - DNA, 22 bp, Homo sapiens
cccaggagatgcactccattgg

SEQ ID NO: 9367094 - DNA, 22 bp, Homo sapiens
cccaggagatggtgcgtggtct

SEQ ID NO: 9367095 - DNA, 23 bp, Homo sapiens
cccaggagcctgagtcctctctg

SEQ ID NO: 9367096 - DNA, 22 bp, Homo sapiens
cccaggagccatctgtcttggc

SEQ ID NO: 9367097 - DNA, 22 bp, Homo sapiens
cccaggaggtcaaggctgcagt

SEQ ID NO: 9367098 - DNA, 22 bp, Homo sapiens
cccaggaggtcaaggctgcagt

SEQ ID NO: 9367099 - DNA, 22 bp, Homo sapiens
cccaggagggtggcctctgccc

SEQ ID NO: 9367100 - DNA, 20 bp, Homo sapiens
cccaggagctgtgccccatc

SEQ ID NO: 9367101 - DNA, 22 bp, Homo sapiens
cccaggagcttctctctgcctc

SEQ ID NO: 9367102 - DNA, 20 bp, Homo sapiens
cccaggagctgtgccccatc

SEQ ID NO: 9367103 - DNA, 20 bp, Homo sapiens
cccaggagctgtgccccatc

SEQ ID NO: 9367104 - DNA, 22 bp, Homo sapiens
aggctgtctcagcctgcttgca

SEQ ID NO: 9367105 - DNA, 20 bp, Homo sapiens
aggctgtcatttctggcagg

SEQ ID NO: 9367106 - DNA, 22 bp, Homo sapiens
aggctgtcctctcttgctcagt

SEQ ID NO: 9367107 - DNA, 22 bp, Homo sapiens
aggctgtccaaggtggcgaagt

SEQ ID NO: 9367108 - DNA, 21 bp, Homo sapiens
aggctgtcctttgccagccct

SEQ ID NO: 9367109 - DNA, 22 bp, Homo sapiens
aggctgtgaaatgtggcaagga

SEQ ID NO: 9367110 - DNA, 22 bp, Homo sapiens
aggctgtgaaatgtggcaagga

SEQ ID NO: 9367111 - DNA, 22 bp, Homo sapiens
cccaggaatgaggggcggaggc

SEQ ID NO: 9367112 - DNA, 22 bp, Homo sapiens
aggctgtgacagggtcatggag

SEQ ID NO: 9367113 - DNA, 22 bp, Homo sapiens
aggctgtgacagggtcatggag

SEQ ID NO: 9367114 - DNA, 22 bp, Homo sapiens
aggctggtgattagaagcagcc

SEQ ID NO: 9367115 - DNA, 22 bp, Homo sapiens
aggctggtgtctctgtcctgtc

SEQ ID NO: 9367116 - DNA, 22 bp, Homo sapiens
aggctggtgcctgcagtgaatc

SEQ ID NO: 9367117 - DNA, 22 bp, Homo sapiens
aggctggtgcttcctagggcag

SEQ ID NO: 9367118 - DNA, 22 bp, Homo sapiens
aggctggtgtgtcctgaagcct

SEQ ID NO: 9367119 - DNA, 22 bp, Homo sapiens
ccctcaccaggctccaggcatg

SEQ ID NO: 9367120 - DNA, 22 bp, Homo sapiens
ccctcacagtctaggagcagct

SEQ ID NO: 9367121 - DNA, 22 bp, Homo sapiens
ccctcacttcacgctctgcaga

SEQ ID NO: 9367122 - DNA, 22 bp, Homo sapiens
ccctagggtttggccagagccc

SEQ ID NO: 9367123 - DNA, 22 bp, Homo sapiens
ccctagggtttggccagagccc

SEQ ID NO: 9367124 - DNA, 22 bp, Homo sapiens
ccctaggggcaatgatggtgct

SEQ ID NO: 9367125 - DNA, 19 bp, Homo sapiens
ccctaggggctcctgaggg

SEQ ID NO: 9367126 - DNA, 22 bp, Homo sapiens
ccctaggggcaatgatggtgct

SEQ ID NO: 9367127 - DNA, 22 bp, Homo sapiens
ccctagggctaagcaggactgc

SEQ ID NO: 9367128 - DNA, 22 bp, Homo sapiens
ccctaggcccaaagggtgacat

SEQ ID NO: 9367129 - DNA, 22 bp, Homo sapiens
ccctaggctgggctcttggctt

SEQ ID NO: 9367130 - DNA, 22 bp, Homo sapiens
ccctaggctgggctcttggctt

SEQ ID NO: 9367131 - DNA, 22 bp, Homo sapiens
ccctaggctgaggccagggtgc

SEQ ID NO: 9367132 - DNA, 22 bp, Homo sapiens
ccccagcacttggagtggggag

SEQ ID NO: 9367133 - DNA, 22 bp, Homo sapiens
ccccagcacaggctcctcagat

SEQ ID NO: 9367134 - DNA, 22 bp, Homo sapiens
ccccagataggttcatgcccta

SEQ ID NO: 9367135 - DNA, 22 bp, Homo sapiens
ccccagcactctgactcttacc

SEQ ID NO: 9367136 - DNA, 21 bp, Homo sapiens
ccccagcaccttgccagcctg

SEQ ID NO: 9367137 - DNA, 22 bp, Homo sapiens
ccccagcactaccagaagccag

SEQ ID NO: 9367138 - DNA, 22 bp, Homo sapiens
cccatgtggtaccttctgtgga

SEQ ID NO: 9367139 - DNA, 22 bp, Homo sapiens
ccccagagaaagtcagcagcat

SEQ ID NO: 9367140 - DNA, 22 bp, Homo sapiens
ccccagaagtttgcacaagaga

SEQ ID NO: 9367141 - DNA, 22 bp, Homo sapiens
cccatggggacaccatgaagga

SEQ ID NO: 9367142 - DNA, 22 bp, Homo sapiens
ccctgccccaggcggcttcact

SEQ ID NO: 9367143 - DNA, 22 bp, Homo sapiens
ccctgccccaggcggcttcact

SEQ ID NO: 9367144 - DNA, 22 bp, Homo sapiens
ccctgccctggagacacttaaa

SEQ ID NO: 9367145 - DNA, 22 bp, Homo sapiens
ccctgccccaggcggcttcact

SEQ ID NO: 9367146 - DNA, 21 bp, Homo sapiens
ccctgccctcaaggacagtgc

SEQ ID NO: 9367147 - DNA, 22 bp, Homo sapiens
ccctgcccaccacatgctggga

SEQ ID NO: 9367148 - DNA, 22 bp, Homo sapiens
ccctgcccatcggggcggcctg

SEQ ID NO: 9367149 - DNA, 22 bp, Homo sapiens
ccctgctgtccctcagtcctgc

SEQ ID NO: 9367150 - DNA, 19 bp, Homo sapiens
ccctgccctggtgactggg

SEQ ID NO: 9367151 - DNA, 22 bp, Homo sapiens
ccctgctgccttcacccaggac

SEQ ID NO: 9367152 - DNA, 22 bp, Homo sapiens
ccctccatgagtgtgctgctgg

SEQ ID NO: 9367153 - DNA, 22 bp, Homo sapiens
ccctccatgagtgtgctgctgg

SEQ ID NO: 9367154 - DNA, 22 bp, Homo sapiens
ccctccatgagtgtgctgctgg

SEQ ID NO: 9367155 - DNA, 22 bp, Homo sapiens
ccctccattaaaacagacctat

SEQ ID NO: 9367156 - DNA, 22 bp, Homo sapiens
ccctcagctccaccctcagcag

SEQ ID NO: 9367157 - DNA, 22 bp, Homo sapiens
ccctcagctccaccctcagcag

SEQ ID NO: 9367158 - DNA, 22 bp, Homo sapiens
ccctcagagcctgaagcaagca

SEQ ID NO: 9367159 - DNA, 22 bp, Homo sapiens
ccctcagctcaagcccctgtgc

SEQ ID NO: 9367160 - DNA, 22 bp, Homo sapiens
ccctcagctcaagcccctgtgc

SEQ ID NO: 9367161 - DNA, 20 bp, Homo sapiens
ccctcccagatgcttcccaa

SEQ ID NO: 9367162 - DNA, 20 bp, Homo sapiens
ccctcccagatgcttcccaa

SEQ ID NO: 9367163 - DNA, 20 bp, Homo sapiens
ccctcccagatgcttcccaa

SEQ ID NO: 9367164 - DNA, 22 bp, Homo sapiens
ccctccattaaaacagacctat

SEQ ID NO: 9367165 - DNA, 22 bp, Homo sapiens
ccctcccaagcactctgacata

SEQ ID NO: 9367166 - DNA, 22 bp, Homo sapiens
ccctcccaagcactctgacata

SEQ ID NO: 9367167 - DNA, 22 bp, Homo sapiens
ccctgcagtgtgacctcaccta

SEQ ID NO: 9367168 - DNA, 22 bp, Homo sapiens
ccctgccaatcccgtctctctg

SEQ ID NO: 9367169 - DNA, 18 bp, Homo sapiens
ccctgccagctcccagca

SEQ ID NO: 9367170 - DNA, 22 bp, Homo sapiens
ccctgccagatgtgcttcagtt

SEQ ID NO: 9367171 - DNA, 22 bp, Homo sapiens
ccctcccaggagtggccagaga

SEQ ID NO: 9367172 - DNA, 22 bp, Homo sapiens
ccctgatggcacagtggcaggc

SEQ ID NO: 9367173 - DNA, 22 bp, Homo sapiens
aggatcagtgaatactcagggt

SEQ ID NO: 9367174 - DNA, 22 bp, Homo sapiens
aggatctgtgagtgctgcagac

SEQ ID NO: 9367175 - DNA, 22 bp, Homo sapiens
aggatctcgcctcctgagctat

SEQ ID NO: 9367176 - DNA, 22 bp, Homo sapiens
aggatcctttggccacttctta

SEQ ID NO: 9367177 - DNA, 22 bp, Homo sapiens
aggatcagggtggtggaagtca

SEQ ID NO: 9367178 - DNA, 22 bp, Homo sapiens
aggataaatgatctagattttc

SEQ ID NO: 9367179 - DNA, 22 bp, Homo sapiens
aggataaatgatctagattttc

SEQ ID NO: 9367180 - DNA, 22 bp, Homo sapiens
aggagtttcaaagcttccatgt

SEQ ID NO: 9367181 - DNA, 22 bp, Homo sapiens
aggagtttatccgagggcataa

SEQ ID NO: 9367182 - DNA, 22 bp, Homo sapiens
aggagtttcaaagcttccatgt

SEQ ID NO: 9367183 - DNA, 22 bp, Homo sapiens
aggagtttggcacatgtatgca

SEQ ID NO: 9367184 - DNA, 23 bp, Homo sapiens
aggataaactaaactcattttgg

SEQ ID NO: 9367185 - DNA, 22 bp, Homo sapiens
aggagttgattacgtttatttt

SEQ ID NO: 9367186 - DNA, 21 bp, Homo sapiens
aggagttgctgtggcctggtt

SEQ ID NO: 9367187 - DNA, 23 bp, Homo sapiens
aggagttgcatgatttttagagc

SEQ ID NO: 9367188 - DNA, 22 bp, Homo sapiens
aggagttggtcaccgtggccca

SEQ ID NO: 9367189 - DNA, 22 bp, Homo sapiens
aggagttgtatgtccaagggac

SEQ ID NO: 9367190 - DNA, 22 bp, Homo sapiens
aggagttggtgctctccaaata

SEQ ID NO: 9367191 - DNA, 21 bp, Homo sapiens
aggagttgagtgcacagttgg

SEQ ID NO: 9367192 - DNA, 23 bp, Homo sapiens
aggagttgagggttgggttggca

SEQ ID NO: 9367193 - DNA, 16 bp, Homo sapiens
aggagttgaggctatt

SEQ ID NO: 9367194 - DNA, 22 bp, Homo sapiens
aggcacaggtggacttcacagt

SEQ ID NO: 9367195 - DNA, 22 bp, Homo sapiens
aggcacaggtggacttcacagt

SEQ ID NO: 9367196 - DNA, 22 bp, Homo sapiens
aggcacagggatgcggagccag

SEQ ID NO: 9367197 - DNA, 22 bp, Homo sapiens
catgtgtgggacccttaggttg

SEQ ID NO: 9367198 - DNA, 22 bp, Homo sapiens
catgtgtggtctgtggctatct

SEQ ID NO: 9367199 - DNA, 22 bp, Homo sapiens
catgtgtgacaaactgcctgca

SEQ ID NO: 9367200 - DNA, 22 bp, Homo sapiens
catgtgtgagtatatcttatcc

SEQ ID NO: 9367201 - DNA, 23 bp, Homo sapiens
catgtgtgacagtatcactgttt

SEQ ID NO: 9367202 - DNA, 22 bp, Homo sapiens
catgtgtgggacccttaggttg

SEQ ID NO: 9367203 - DNA, 22 bp, Homo sapiens
catgtgtggagggcatgcatgg

SEQ ID NO: 9367204 - DNA, 22 bp, Homo sapiens
catgtgtgcaccaaccctatgt

SEQ ID NO: 9367205 - DNA, 22 bp, Homo sapiens
catgtgtggagggcatgcatgg

SEQ ID NO: 9367206 - DNA, 22 bp, Homo sapiens
catgtgtggagggcatgcatgg

SEQ ID NO: 9367207 - DNA, 22 bp, Homo sapiens
catgtgtgagtatatcttatcc

SEQ ID NO: 9367208 - DNA, 22 bp, Homo sapiens
catgtgtgagtatatcttatcc

SEQ ID NO: 9367209 - DNA, 22 bp, Homo sapiens
catgtgtgcaccaaccctatgt

SEQ ID NO: 9367210 - DNA, 22 bp, Homo sapiens
catgtgtgagtgagcagtcttc

SEQ ID NO: 9367211 - DNA, 22 bp, Homo sapiens
catgtgtgagtgagcagtcttc

SEQ ID NO: 9367212 - DNA, 22 bp, Homo sapiens
catgtgtcctagctattctcct

SEQ ID NO: 9367213 - DNA, 22 bp, Homo sapiens
catgtgtccacccttgaacaca

SEQ ID NO: 9367214 - DNA, 22 bp, Homo sapiens
catgtccttctcattgcctcat

SEQ ID NO: 9367215 - DNA, 22 bp, Homo sapiens
aggatgagaagattggaatctt

SEQ ID NO: 9367216 - DNA, 21 bp, Homo sapiens
catgtgtcttgtgttactgct

SEQ ID NO: 9367217 - DNA, 22 bp, Homo sapiens
catgtgtctttatggagccaca

SEQ ID NO: 9367218 - DNA, 22 bp, Homo sapiens
catgtgtcttgctgccctccat

SEQ ID NO: 9367219 - DNA, 22 bp, Homo sapiens
catgtgtctaatctactaatat

SEQ ID NO: 9367220 - DNA, 22 bp, Homo sapiens
catgtgtctaatctactaatat

SEQ ID NO: 9367221 - DNA, 22 bp, Homo sapiens
catgtgtcctagctattctcct

SEQ ID NO: 9367222 - DNA, 22 bp, Homo sapiens
catgtgtgaagactgcgggcca

SEQ ID NO: 9367223 - DNA, 22 bp, Homo sapiens
catgtgtgaatcttgtgatcat

SEQ ID NO: 9367224 - DNA, 22 bp, Homo sapiens
aggcactttaggatcaggttga

SEQ ID NO: 9367225 - DNA, 22 bp, Homo sapiens
aggcactttctgtatgctagtt

SEQ ID NO: 9367226 - DNA, 22 bp, Homo sapiens
aggcactttccttgaggagttt

SEQ ID NO: 9367227 - DNA, 22 bp, Homo sapiens
aggcagagagcagtggccgtct

SEQ ID NO: 9367228 - DNA, 22 bp, Homo sapiens
aggcagagaaaaaccagatatg

SEQ ID NO: 9367229 - DNA, 22 bp, Homo sapiens
aggcactttctgtatgctagtt

SEQ ID NO: 9367230 - DNA, 22 bp, Homo sapiens
aggcactttgaaatttggagct

SEQ ID NO: 9367231 - DNA, 22 bp, Homo sapiens
aggcactgcagattacaggcgc

SEQ ID NO: 9367232 - DNA, 22 bp, Homo sapiens
aggcactgattctgttttccat

SEQ ID NO: 9367233 - DNA, 22 bp, Homo sapiens
aggcactgattctcagagttac

SEQ ID NO: 9367234 - DNA, 16 bp, Homo sapiens
aggcagagatttaccc

SEQ ID NO: 9367235 - DNA, 22 bp, Homo sapiens
aggcagagagcagtggccgtct

SEQ ID NO: 9367236 - DNA, 22 bp, Homo sapiens
aggcagagagcagtggccgtct

SEQ ID NO: 9367237 - DNA, 22 bp, Homo sapiens
aggcagagagcagtggccgtct

SEQ ID NO: 9367238 - DNA, 22 bp, Homo sapiens
aggcagagagcagtggccgtct

SEQ ID NO: 9367239 - DNA, 22 bp, Homo sapiens
aggcactgacaattctggactg

SEQ ID NO: 9367240 - DNA, 22 bp, Homo sapiens
aggcactgacctgcttccttga

SEQ ID NO: 9367241 - DNA, 22 bp, Homo sapiens
aggcactgacagattctgtgtc

SEQ ID NO: 9367242 - DNA, 22 bp, Homo sapiens
aggcactgactcaagggagcca

SEQ ID NO: 9367243 - DNA, 22 bp, Homo sapiens
aggcactgactcaagggagcca

SEQ ID NO: 9367244 - DNA, 22 bp, Homo sapiens
aggcactgactcaagggagcca

SEQ ID NO: 9367245 - DNA, 22 bp, Homo sapiens
aggcactgattctcagagttac

SEQ ID NO: 9367246 - DNA, 22 bp, Homo sapiens
aggcactgagaggctgtgttgc

SEQ ID NO: 9367247 - DNA, 22 bp, Homo sapiens
aggcactgactcaagggagcca

SEQ ID NO: 9367248 - DNA, 22 bp, Homo sapiens
aggcactgaagaactctttttg

SEQ ID NO: 9367249 - DNA, 22 bp, Homo sapiens
aggcacagtttcatccccgggc

SEQ ID NO: 9367250 - DNA, 22 bp, Homo sapiens
aggcactgaaaggtggccagag

SEQ ID NO: 9367251 - DNA, 22 bp, Homo sapiens
aggcactgaagtggtaaatgta

SEQ ID NO: 9367252 - DNA, 22 bp, Homo sapiens
aggcactgaaggaagcttgcgc

SEQ ID NO: 9367253 - DNA, 22 bp, Homo sapiens
aggcactgaaggaagcttgcgc

SEQ ID NO: 9367254 - DNA, 23 bp, Homo sapiens
aggcactgaatgtgtcagtgagt

SEQ ID NO: 9367255 - DNA, 22 bp, Homo sapiens
aggcactgaatatccagtaaaa

SEQ ID NO: 9367256 - DNA, 19 bp, Homo sapiens
aggcacaggttgtctggac

SEQ ID NO: 9367257 - DNA, 19 bp, Homo sapiens
aggcacaggttgtctggac

SEQ ID NO: 9367258 - DNA, 19 bp, Homo sapiens
aggcacaggttgtctggac

SEQ ID NO: 9367259 - DNA, 19 bp, Homo sapiens
aggcacaggttgtctggac

SEQ ID NO: 9367260 - DNA, 22 bp, Homo sapiens
aggcacagtgcctggaatcaaa

SEQ ID NO: 9367261 - DNA, 22 bp, Homo sapiens
aggcacagtgcctggaatcaaa

SEQ ID NO: 9367262 - DNA, 22 bp, Homo sapiens
aggcacagtggctcacacctgt

SEQ ID NO: 9367263 - DNA, 22 bp, Homo sapiens
aggcacagtggctcacacctgt

SEQ ID NO: 9367264 - DNA, 22 bp, Homo sapiens
aggcacagtggccctgtttggg

SEQ ID NO: 9367265 - DNA, 20 bp, Homo sapiens
aggcacagttcctagttggg

SEQ ID NO: 9367266 - DNA, 22 bp, Homo sapiens
ccaaagaaacccaagctcaggg

SEQ ID NO: 9367267 - DNA, 22 bp, Homo sapiens
aggcaggcccctgagaatagac

SEQ ID NO: 9367268 - DNA, 22 bp, Homo sapiens
aggcaggccctctggaaaggta

SEQ ID NO: 9367269 - DNA, 22 bp, Homo sapiens
aggcaggcccctgagaatagac

SEQ ID NO: 9367270 - DNA, 23 bp, Homo sapiens
aggcaggcagttcagctgttgtt

SEQ ID NO: 9367271 - DNA, 21 bp, Homo sapiens
aggcaggattcaaacacagag

SEQ ID NO: 9367272 - DNA, 21 bp, Homo sapiens
aggcaggattcaaacacagag

SEQ ID NO: 9367273 - DNA, 23 bp, Homo sapiens
aggcaggcagttcagctgttgtt

SEQ ID NO: 9367274 - DNA, 22 bp, Homo sapiens
ccaaactgtgtcgtctgcatag

SEQ ID NO: 9367275 - DNA, 22 bp, Homo sapiens
ccaaaatattagtgcttaagta

SEQ ID NO: 9367276 - DNA, 22 bp, Homo sapiens
aggcaggctctgggtatgtgca

SEQ ID NO: 9367277 - DNA, 22 bp, Homo sapiens
aggcaggctctgggtatgtgca

SEQ ID NO: 9367278 - DNA, 22 bp, Homo sapiens
aggcaggctgctatggagtaga

SEQ ID NO: 9367279 - DNA, 22 bp, Homo sapiens
aggcaggctgctatggagtaga

SEQ ID NO: 9367280 - DNA, 22 bp, Homo sapiens
aggcaggctctgggtatgtgca

SEQ ID NO: 9367281 - DNA, 22 bp, Homo sapiens
aggcaggctctgggtatgtgca

SEQ ID NO: 9367282 - DNA, 22 bp, Homo sapiens
aggcaggctgctatggagtaga

SEQ ID NO: 9367283 - DNA, 22 bp, Homo sapiens
aggcaggctgctatggagtaga

SEQ ID NO: 9367284 - DNA, 22 bp, Homo sapiens
aggcaggctagtcgcttgagcc

SEQ ID NO: 9367285 - DNA, 22 bp, Homo sapiens
aggcaggctagtcgcttgagcc

SEQ ID NO: 9367286 - DNA, 22 bp, Homo sapiens
aggcaggctagtcgcttgagcc

SEQ ID NO: 9367287 - DNA, 22 bp, Homo sapiens
aggcaggctagtcgcttgagcc

SEQ ID NO: 9367288 - DNA, 22 bp, Homo sapiens
aggcaggctcaatgcccagtct

SEQ ID NO: 9367289 - DNA, 22 bp, Homo sapiens
aggcaggctcaggcccatgctt

SEQ ID NO: 9367290 - DNA, 22 bp, Homo sapiens
aggcaggctcaatgcccagtct

SEQ ID NO: 9367291 - DNA, 22 bp, Homo sapiens
aggcaggccctctggaaaggta

SEQ ID NO: 9367292 - DNA, 22 bp, Homo sapiens
aggcaggccctctggaaaggta

SEQ ID NO: 9367293 - DNA, 22 bp, Homo sapiens
aggcaggccctctggaaaggta

SEQ ID NO: 9367294 - DNA, 22 bp, Homo sapiens
aggcaggccctctggaaaggta

SEQ ID NO: 9367295 - DNA, 22 bp, Homo sapiens
aggcaggccctgggccatcccg

SEQ ID NO: 9367296 - DNA, 22 bp, Homo sapiens
aggcaggccctgggccatcccg

SEQ ID NO: 9367297 - DNA, 22 bp, Homo sapiens
aggcaggcctacacaatgggag

SEQ ID NO: 9367298 - DNA, 22 bp, Homo sapiens
aggcaggccgtgtccctcctca

SEQ ID NO: 9367299 - DNA, 22 bp, Homo sapiens
aggcaggcctacacaatgggag

SEQ ID NO: 9367300 - DNA, 18 bp, Homo sapiens
aggcaggcggatcacaag

SEQ ID NO: 9367301 - DNA, 18 bp, Homo sapiens
aggcaggcggatcacaag

SEQ ID NO: 9367302 - DNA, 18 bp, Homo sapiens
aggcaggcggatcacaag

SEQ ID NO: 9367303 - DNA, 22 bp, Homo sapiens
aggcaggcctacacaatgggag

SEQ ID NO: 9367304 - DNA, 18 bp, Homo sapiens
aggcaggcggatcacaag

SEQ ID NO: 9367305 - DNA, 22 bp, Homo sapiens
aggcagaggagaatgatcttcc

SEQ ID NO: 9367306 - DNA, 19 bp, Homo sapiens
aggcagaggcttggctagc

SEQ ID NO: 9367307 - DNA, 22 bp, Homo sapiens
aggcagaggagaatgatcttcc

SEQ ID NO: 9367308 - DNA, 22 bp, Homo sapiens
aggcagaggaagggtggatttg

SEQ ID NO: 9367309 - DNA, 22 bp, Homo sapiens
aggcagaggaagggtggatttg

SEQ ID NO: 9367310 - DNA, 22 bp, Homo sapiens
aggcagagctgggttttgaaat

SEQ ID NO: 9367311 - DNA, 22 bp, Homo sapiens
aggcagaggaagggtggatttg

SEQ ID NO: 9367312 - DNA, 22 bp, Homo sapiens
aggcagagctgggttttgaaat

SEQ ID NO: 9367313 - DNA, 22 bp, Homo sapiens
aggcagagctaggaagaattgt

SEQ ID NO: 9367314 - DNA, 22 bp, Homo sapiens
aggcagagctgatgttctgtga

SEQ ID NO: 9367315 - DNA, 23 bp, Homo sapiens
aggcagagccaaggtcaaaaccc

SEQ ID NO: 9367316 - DNA, 22 bp, Homo sapiens
aggcagagctaggaagaattgt

SEQ ID NO: 9367317 - DNA, 20 bp, Homo sapiens
aggcagagcgcacttttaga

SEQ ID NO: 9367318 - DNA, 22 bp, Homo sapiens
aggcagcgtagcaaggctagta

SEQ ID NO: 9367319 - DNA, 22 bp, Homo sapiens
aggcagcgtagcaaggctagta

SEQ ID NO: 9367320 - DNA, 21 bp, Homo sapiens
aggcagcgtgagggccactca

SEQ ID NO: 9367321 - DNA, 21 bp, Homo sapiens
aggcagcgtgagggccactca

SEQ ID NO: 9367322 - DNA, 22 bp, Homo sapiens
aggcagctgtgaggactggatt

SEQ ID NO: 9367323 - DNA, 23 bp, Homo sapiens
aggcagctgggtagcatctttct

SEQ ID NO: 9367324 - DNA, 22 bp, Homo sapiens
aggcagcttaagccctggccca

SEQ ID NO: 9367325 - DNA, 22 bp, Homo sapiens
aggcagctttcagtgtctctca

SEQ ID NO: 9367326 - DNA, 22 bp, Homo sapiens
aggcagctttctgtaggggtgt

SEQ ID NO: 9367327 - DNA, 22 bp, Homo sapiens
aggcagctttgtagtaaagcta

SEQ ID NO: 9367328 - DNA, 22 bp, Homo sapiens
aggcagctttcagtgtctctca

SEQ ID NO: 9367329 - DNA, 22 bp, Homo sapiens
aggcagctttctggtgcaccat

SEQ ID NO: 9367330 - DNA, 22 bp, Homo sapiens
cagtgaggagtccagggcagag

SEQ ID NO: 9367331 - DNA, 22 bp, Homo sapiens
cagtgaggagtccagggcagag

SEQ ID NO: 9367332 - DNA, 22 bp, Homo sapiens
cagtgaggagtccagggcagag

SEQ ID NO: 9367333 - DNA, 22 bp, Homo sapiens
cagtgaggagtccagggcagag

SEQ ID NO: 9367334 - DNA, 22 bp, Homo sapiens
cagtgaggatgataattaaggt

SEQ ID NO: 9367335 - DNA, 22 bp, Homo sapiens
cagtgaggagtccagggcagag

SEQ ID NO: 9367336 - DNA, 22 bp, Homo sapiens
aggacaaaggaccagatctgga

SEQ ID NO: 9367337 - DNA, 22 bp, Homo sapiens
aggacaagacaaggaccagaga

SEQ ID NO: 9367338 - DNA, 22 bp, Homo sapiens
aggacaaaggaccagatctgga

SEQ ID NO: 9367339 - DNA, 22 bp, Homo sapiens
aggacaaaggaccagatctgga

SEQ ID NO: 9367340 - DNA, 22 bp, Homo sapiens
aggacaaaggaccagatctgga

SEQ ID NO: 9367341 - DNA, 22 bp, Homo sapiens
aggaatttttctagccggagtt

SEQ ID NO: 9367342 - DNA, 22 bp, Homo sapiens
cagtctcttttcagctccatcc

SEQ ID NO: 9367343 - DNA, 22 bp, Homo sapiens
cagtctgatgttcgcaggtgaa

SEQ ID NO: 9367344 - DNA, 22 bp, Homo sapiens
aggaattttcacagttgggtat

SEQ ID NO: 9367345 - DNA, 22 bp, Homo sapiens
aggaattttacatctcagagag

SEQ ID NO: 9367346 - DNA, 22 bp, Homo sapiens
aggaattttacaagctggttgc

SEQ ID NO: 9367347 - DNA, 19 bp, Homo sapiens
aggaatttctcagggaggc

SEQ ID NO: 9367348 - DNA, 22 bp, Homo sapiens
aggaatttgagtgctgtaggaa

SEQ ID NO: 9367349 - DNA, 22 bp, Homo sapiens
aggaattgtgttgtagtggaga

SEQ ID NO: 9367350 - DNA, 22 bp, Homo sapiens
aggaattgtgttgtagtggaga

SEQ ID NO: 9367351 - DNA, 22 bp, Homo sapiens
aggaatttaagggctcagagag

SEQ ID NO: 9367352 - DNA, 22 bp, Homo sapiens
aggaattggttcaaggtttatc

SEQ ID NO: 9367353 - DNA, 22 bp, Homo sapiens
aggaattggcacggccttctca

SEQ ID NO: 9367354 - DNA, 22 bp, Homo sapiens
aggaattgcctggggcctggga

SEQ ID NO: 9367355 - DNA, 22 bp, Homo sapiens
aggaattgagatcctaggtttt

SEQ ID NO: 9367356 - DNA, 22 bp, Homo sapiens
aggaattgcctggggcctggga

SEQ ID NO: 9367357 - DNA, 22 bp, Homo sapiens
aggaattcaagaccagctgggc

SEQ ID NO: 9367358 - DNA, 22 bp, Homo sapiens
aggaattgagatcctaggtttt

SEQ ID NO: 9367359 - DNA, 22 bp, Homo sapiens
aggaattcaagaccagctgggc

SEQ ID NO: 9367360 - DNA, 22 bp, Homo sapiens
aggaattcaagaccagctgggc

SEQ ID NO: 9367361 - DNA, 22 bp, Homo sapiens
aggaattatagtagtatttgtc

SEQ ID NO: 9367362 - DNA, 22 bp, Homo sapiens
aggaattaacaatatatttagg

SEQ ID NO: 9367363 - DNA, 22 bp, Homo sapiens
aggaatgtttagaatgtcagaa

SEQ ID NO: 9367364 - DNA, 22 bp, Homo sapiens
aggaattactcatctgtggtat

SEQ ID NO: 9367365 - DNA, 22 bp, Homo sapiens
cagtgaggctctgctgagcggt

SEQ ID NO: 9367366 - DNA, 22 bp, Homo sapiens
cagtgaggctctgctgagcggt

SEQ ID NO: 9367367 - DNA, 22 bp, Homo sapiens
cagtgaggctctgctgagcggt

SEQ ID NO: 9367368 - DNA, 22 bp, Homo sapiens
cagtgaggctctgctgagcggt

SEQ ID NO: 9367369 - DNA, 22 bp, Homo sapiens
cagtgagggaagatctcagcac

SEQ ID NO: 9367370 - DNA, 22 bp, Homo sapiens
cagtgagggaagatctcagcac

SEQ ID NO: 9367371 - DNA, 22 bp, Homo sapiens
cagtgcagccaaggacaggcac

SEQ ID NO: 9367372 - DNA, 22 bp, Homo sapiens
cagtgcagccaaggacaggcac

SEQ ID NO: 9367373 - DNA, 22 bp, Homo sapiens
cagtgagggcattcagtgctgg

SEQ ID NO: 9367374 - DNA, 22 bp, Homo sapiens
cagtgagggcattcagtgctgg

SEQ ID NO: 9367375 - DNA, 22 bp, Homo sapiens
cagtgagggcattcagtgctgg

SEQ ID NO: 9367376 - DNA, 22 bp, Homo sapiens
cagtgcaggctgggggccctgc

SEQ ID NO: 9367377 - DNA, 22 bp, Homo sapiens
cagtgcaggaagtgagatgcct

SEQ ID NO: 9367378 - DNA, 22 bp, Homo sapiens
cagtgcaggaagtgagatgcct

SEQ ID NO: 9367379 - DNA, 22 bp, Homo sapiens
cagtgcaggaagtgagatgcct

SEQ ID NO: 9367380 - DNA, 22 bp, Homo sapiens
cagtgcagctgccccgctggta

SEQ ID NO: 9367381 - DNA, 22 bp, Homo sapiens
cagtgcagccaaggacaggcac

SEQ ID NO: 9367382 - DNA, 22 bp, Homo sapiens
cagtgcagccaaggacaggcac

SEQ ID NO: 9367383 - DNA, 22 bp, Homo sapiens
cagtgcagccaaggacaggcac

SEQ ID NO: 9367384 - DNA, 23 bp, Homo sapiens
cagtgcagggcaactcagactcc

SEQ ID NO: 9367385 - DNA, 22 bp, Homo sapiens
cagtgcaggaagtgagatgcct

SEQ ID NO: 9367386 - DNA, 22 bp, Homo sapiens
cagtgcaggctgggggccctgc

SEQ ID NO: 9367387 - DNA, 22 bp, Homo sapiens
cagtgcaggcttgtggccgcag

SEQ ID NO: 9367388 - DNA, 23 bp, Homo sapiens
cagtgcagggcaactcagactcc

SEQ ID NO: 9367389 - DNA, 20 bp, Homo sapiens
aggagatgatccagagtcag

SEQ ID NO: 9367390 - DNA, 20 bp, Homo sapiens
aggagatgatccagagtcag

SEQ ID NO: 9367391 - DNA, 22 bp, Homo sapiens
aggagcagcttctgaaccatgt

SEQ ID NO: 9367392 - DNA, 22 bp, Homo sapiens
aggagccaaaagctgaacaaga

SEQ ID NO: 9367393 - DNA, 22 bp, Homo sapiens
aggagcagcccactcctgtcct

SEQ ID NO: 9367394 - DNA, 22 bp, Homo sapiens
aggagcagcccactcctgtcct

SEQ ID NO: 9367395 - DNA, 22 bp, Homo sapiens
aggagcagcccactcctgtcct

SEQ ID NO: 9367396 - DNA, 22 bp, Homo sapiens
aggagcagattggtaagatcat

SEQ ID NO: 9367397 - DNA, 22 bp, Homo sapiens
aggagcagattggtaagatcat

SEQ ID NO: 9367398 - DNA, 22 bp, Homo sapiens
aggagatggagctcagtgggca

SEQ ID NO: 9367399 - DNA, 22 bp, Homo sapiens
aggagatggagctcagtgggca

SEQ ID NO: 9367400 - DNA, 22 bp, Homo sapiens
aggagatggagctcagtgggca

SEQ ID NO: 9367401 - DNA, 22 bp, Homo sapiens
aggagccaagcagaactaagga

SEQ ID NO: 9367402 - DNA, 22 bp, Homo sapiens
aggagccaaggaaaacagtatt

SEQ ID NO: 9367403 - DNA, 22 bp, Homo sapiens
aggagccaaattttagactctg

SEQ ID NO: 9367404 - DNA, 22 bp, Homo sapiens
aggagccaagatgctgtctggc

SEQ ID NO: 9367405 - DNA, 22 bp, Homo sapiens
aggagccaagatgctgtctggc

SEQ ID NO: 9367406 - DNA, 22 bp, Homo sapiens
cagtgcttggggagcggagaga

SEQ ID NO: 9367407 - DNA, 22 bp, Homo sapiens
cagtgctttgggaggctgagga

SEQ ID NO: 9367408 - DNA, 22 bp, Homo sapiens
cagtgcttttttaccttccaac

SEQ ID NO: 9367409 - DNA, 22 bp, Homo sapiens
cagtggaaactatgctgctgga

SEQ ID NO: 9367410 - DNA, 22 bp, Homo sapiens
cagtggaaatcagagtgagagt

SEQ ID NO: 9367411 - DNA, 22 bp, Homo sapiens
cagtggaaactatgctgctgga

SEQ ID NO: 9367412 - DNA, 22 bp, Homo sapiens
aggagctggccactaggatgca

SEQ ID NO: 9367413 - DNA, 22 bp, Homo sapiens
aggagctggcctagaaaggaga

SEQ ID NO: 9367414 - DNA, 22 bp, Homo sapiens
aggagctgatagtctatggaga

SEQ ID NO: 9367415 - DNA, 22 bp, Homo sapiens
aggagctggccactaggatgca

SEQ ID NO: 9367416 - DNA, 22 bp, Homo sapiens
aggagctggccactaggatgca

SEQ ID NO: 9367417 - DNA, 22 bp, Homo sapiens
aggagctggccactaggatgca

SEQ ID NO: 9367418 - DNA, 23 bp, Homo sapiens
cagtggagactcatgcttcctta

SEQ ID NO: 9367419 - DNA, 23 bp, Homo sapiens
cagtggagactcatgcttcctta

SEQ ID NO: 9367420 - DNA, 22 bp, Homo sapiens
cagtggaagctggctgtgaaga

SEQ ID NO: 9367421 - DNA, 22 bp, Homo sapiens
cagtggaatacgagcagatgtc

SEQ ID NO: 9367422 - DNA, 22 bp, Homo sapiens
cagtggaatatataggggattt

SEQ ID NO: 9367423 - DNA, 22 bp, Homo sapiens
aggagctgggctgctgctggga

SEQ ID NO: 9367424 - DNA, 22 bp, Homo sapiens
aggagctgggctgctgctggga

SEQ ID NO: 9367425 - DNA, 22 bp, Homo sapiens
aggagctgggcccaaggatgct

SEQ ID NO: 9367426 - DNA, 22 bp, Homo sapiens
aggagctgggctgctgctggga

SEQ ID NO: 9367427 - DNA, 22 bp, Homo sapiens
aggagctgggctgctgctggga

SEQ ID NO: 9367428 - DNA, 22 bp, Homo sapiens
aggagctgggctgctgctggga

SEQ ID NO: 9367429 - DNA, 22 bp, Homo sapiens
aggagctgggcccaaggatgct

SEQ ID NO: 9367430 - DNA, 22 bp, Homo sapiens
aggagctgggcccaaggatgct

SEQ ID NO: 9367431 - DNA, 22 bp, Homo sapiens
aggagctgggcccaaggatgct

SEQ ID NO: 9367432 - DNA, 22 bp, Homo sapiens
aggagctgggcccaaggatgct

SEQ ID NO: 9367433 - DNA, 22 bp, Homo sapiens
aggagctgggcccaaggatgct

SEQ ID NO: 9367434 - DNA, 22 bp, Homo sapiens
aggagctgggagaaggactaaa

SEQ ID NO: 9367435 - DNA, 22 bp, Homo sapiens
aggagctgggagaaggactaaa

SEQ ID NO: 9367436 - DNA, 22 bp, Homo sapiens
aggagctggcctagaaaggaga

SEQ ID NO: 9367437 - DNA, 22 bp, Homo sapiens
aggagctgggagaaggactaaa

SEQ ID NO: 9367438 - DNA, 22 bp, Homo sapiens
aggagggttctctggacagagg

SEQ ID NO: 9367439 - DNA, 22 bp, Homo sapiens
aggagggttctctggacagagg

SEQ ID NO: 9367440 - DNA, 22 bp, Homo sapiens
aggagggttctctggacagagg

SEQ ID NO: 9367441 - DNA, 22 bp, Homo sapiens
aggagggtttcaatgggatgag

SEQ ID NO: 9367442 - DNA, 22 bp, Homo sapiens
aggagggttgaggaggatactt

SEQ ID NO: 9367443 - DNA, 22 bp, Homo sapiens
aggagggttgaggaggatactt

SEQ ID NO: 9367444 - DNA, 20 bp, Homo sapiens
aggaggtcaaatggaatctg

SEQ ID NO: 9367445 - DNA, 22 bp, Homo sapiens
aggaggtagtcttataaatgtt

SEQ ID NO: 9367446 - DNA, 20 bp, Homo sapiens
aggagggtttctctgacaca

SEQ ID NO: 9367447 - DNA, 22 bp, Homo sapiens
aggagggtttcaatgggatgag

SEQ ID NO: 9367448 - DNA, 22 bp, Homo sapiens
aggaggtgagcggtcatgtggt

SEQ ID NO: 9367449 - DNA, 22 bp, Homo sapiens
aggaggtgagcggtcatgtggt

SEQ ID NO: 9367450 - DNA, 22 bp, Homo sapiens
aggaggtgagcggtcatgtggt

SEQ ID NO: 9367451 - DNA, 22 bp, Homo sapiens
aggaggtgacagcctgcatctg

SEQ ID NO: 9367452 - DNA, 22 bp, Homo sapiens
aggaggtgacagcctgcatctg

SEQ ID NO: 9367453 - DNA, 22 bp, Homo sapiens
aggaggtgacagcctgcatctg

SEQ ID NO: 9367454 - DNA, 22 bp, Homo sapiens
aggaggtcagagccccatgctg

SEQ ID NO: 9367455 - DNA, 22 bp, Homo sapiens
aggagggtggggtctgcctgtc

SEQ ID NO: 9367456 - DNA, 22 bp, Homo sapiens
aggagggtggggtctgcctgtc

SEQ ID NO: 9367457 - DNA, 22 bp, Homo sapiens
aggagggtggggtctgcctgtc

SEQ ID NO: 9367458 - DNA, 22 bp, Homo sapiens
aggagggtggcctcatgtgagt

SEQ ID NO: 9367459 - DNA, 22 bp, Homo sapiens
aggagggtggcctcatgtgagt

SEQ ID NO: 9367460 - DNA, 22 bp, Homo sapiens
aggagggtggcctcatgtgagt

SEQ ID NO: 9367461 - DNA, 22 bp, Homo sapiens
aggagggtggcctcatgtgagt

SEQ ID NO: 9367462 - DNA, 22 bp, Homo sapiens
aggaggggcatagaaatgtaat

SEQ ID NO: 9367463 - DNA, 22 bp, Homo sapiens
aggaggctggttcaggccatat

SEQ ID NO: 9367464 - DNA, 22 bp, Homo sapiens
aggaggctggttcaggccatat

SEQ ID NO: 9367465 - DNA, 22 bp, Homo sapiens
catcatttgttcacttgattcc

SEQ ID NO: 9367466 - DNA, 22 bp, Homo sapiens
catcatttgttcacttgattcc

SEQ ID NO: 9367467 - DNA, 22 bp, Homo sapiens
catcatttgtttgcatgcagga

SEQ ID NO: 9367468 - DNA, 20 bp, Homo sapiens
catcattttaaaatctctcc

SEQ ID NO: 9367469 - DNA, 20 bp, Homo sapiens
catcattttaaaatctctcc

SEQ ID NO: 9367470 - DNA, 22 bp, Homo sapiens
catcattcctaggtgcagagct

SEQ ID NO: 9367471 - DNA, 22 bp, Homo sapiens
catcattgaacacttcttcctg

SEQ ID NO: 9367472 - DNA, 22 bp, Homo sapiens
catcattgcctgtttcccttgg

SEQ ID NO: 9367473 - DNA, 22 bp, Homo sapiens
catcatttaattataggggctg

SEQ ID NO: 9367474 - DNA, 22 bp, Homo sapiens
catcatttcacttagatgaagt

SEQ ID NO: 9367475 - DNA, 22 bp, Homo sapiens
catcatttcacttagatgaagt

SEQ ID NO: 9367476 - DNA, 22 bp, Homo sapiens
aggaggtgttgatagaaggttt

SEQ ID NO: 9367477 - DNA, 22 bp, Homo sapiens
aggaggtgttgatagaaggttt

SEQ ID NO: 9367478 - DNA, 22 bp, Homo sapiens
aggagtatctaataatctgaga

SEQ ID NO: 9367479 - DNA, 22 bp, Homo sapiens
aggaggttgccagtctgggggt

SEQ ID NO: 9367480 - DNA, 22 bp, Homo sapiens
aggagtgggggcgagaagttaa

SEQ ID NO: 9367481 - DNA, 22 bp, Homo sapiens
catcatttttgtaagctggtag

SEQ ID NO: 9367482 - DNA, 22 bp, Homo sapiens
catcattttgtatccaagggga

SEQ ID NO: 9367483 - DNA, 22 bp, Homo sapiens
catcattttattaaccaagaaa

SEQ ID NO: 9367484 - DNA, 22 bp, Homo sapiens
catcattttgtatccaagggga

SEQ ID NO: 9367485 - DNA, 22 bp, Homo sapiens
aggagtggtgcaggacctgcca

SEQ ID NO: 9367486 - DNA, 22 bp, Homo sapiens
aggagtggtgcaggacctgcca

SEQ ID NO: 9367487 - DNA, 22 bp, Homo sapiens
aggagtgtgaagagcctagatc

SEQ ID NO: 9367488 - DNA, 22 bp, Homo sapiens
aggagtgtgaagagcctagatc

SEQ ID NO: 9367489 - DNA, 22 bp, Homo sapiens
aggagtgtggccagggctctgg

SEQ ID NO: 9367490 - DNA, 22 bp, Homo sapiens
aggagtgttagagtagagctgg

SEQ ID NO: 9367491 - DNA, 22 bp, Homo sapiens
catcactgacgctgagattcca

SEQ ID NO: 9367492 - DNA, 22 bp, Homo sapiens
catcagaaccagctgggtgagg

SEQ ID NO: 9367493 - DNA, 22 bp, Homo sapiens
catcagaacgtgagctccttgt

SEQ ID NO: 9367494 - DNA, 22 bp, Homo sapiens
aggaggctgcaaccctgaggcc

SEQ ID NO: 9367495 - DNA, 23 bp, Homo sapiens
catcagaggttgccactccctgg

SEQ ID NO: 9367496 - DNA, 22 bp, Homo sapiens
catcagaattacttggggagct

SEQ ID NO: 9367497 - DNA, 22 bp, Homo sapiens
aggaggctgggcacagtggcct

SEQ ID NO: 9367498 - DNA, 22 bp, Homo sapiens
aggaggctgggcacagtggcct

SEQ ID NO: 9367499 - DNA, 22 bp, Homo sapiens
aggaggctgggcacagtggcct

SEQ ID NO: 9367500 - DNA, 22 bp, Homo sapiens
aggaggctgcaaccctgaggcc

SEQ ID NO: 9367501 - DNA, 22 bp, Homo sapiens
aggaggctgggcacagtggcct

SEQ ID NO: 9367502 - DNA, 22 bp, Homo sapiens
cagttcatagtcttcatgtctc

SEQ ID NO: 9367503 - DNA, 22 bp, Homo sapiens
cagttcaaagttaagcagcagt

SEQ ID NO: 9367504 - DNA, 17 bp, Homo sapiens
aggagctgggggtggtg

SEQ ID NO: 9367505 - DNA, 17 bp, Homo sapiens
aggagctgggggtggtg

SEQ ID NO: 9367506 - DNA, 22 bp, Homo sapiens
cagttattatcttagagagaca

SEQ ID NO: 9367507 - DNA, 22 bp, Homo sapiens
cagttatttcaacagagaggat

SEQ ID NO: 9367508 - DNA, 22 bp, Homo sapiens
catcacccggaactgtgtctgc

SEQ ID NO: 9367509 - DNA, 22 bp, Homo sapiens
catcacatttaattaaaatgtc

SEQ ID NO: 9367510 - DNA, 22 bp, Homo sapiens
catcacatttaaggggaaggac

SEQ ID NO: 9367511 - DNA, 23 bp, Homo sapiens
cagttcccactgtctgtcacaag

SEQ ID NO: 9367512 - DNA, 22 bp, Homo sapiens
cagttccctaatgtgtagaaga

SEQ ID NO: 9367513 - DNA, 22 bp, Homo sapiens
cagttctcttgatcgtctcttg

SEQ ID NO: 9367514 - DNA, 22 bp, Homo sapiens
aggaaacatgaatctgccttga

SEQ ID NO: 9367515 - DNA, 22 bp, Homo sapiens
aggaaacattgatattgggaaa

SEQ ID NO: 9367516 - DNA, 17 bp, Homo sapiens
aggaaacattttctttc

SEQ ID NO: 9367517 - DNA, 22 bp, Homo sapiens
aggaaacagagtgaagcttggg

SEQ ID NO: 9367518 - DNA, 22 bp, Homo sapiens
cagggtgcttagaaatggacct

SEQ ID NO: 9367519 - DNA, 22 bp, Homo sapiens
cagggtgctgcaccatccctca

SEQ ID NO: 9367520 - DNA, 22 bp, Homo sapiens
cagggtggggctggctatcaaa

SEQ ID NO: 9367521 - DNA, 22 bp, Homo sapiens
cagggtggtaccagcatctagt

SEQ ID NO: 9367522 - DNA, 22 bp, Homo sapiens
cagggtggtaccagcatctagt

SEQ ID NO: 9367523 - DNA, 22 bp, Homo sapiens
cagggtggtaccagcatctagt

SEQ ID NO: 9367524 - DNA, 22 bp, Homo sapiens
cagggtggggctggctatcaaa

SEQ ID NO: 9367525 - DNA, 22 bp, Homo sapiens
cagggtggtgaatagctatagt

SEQ ID NO: 9367526 - DNA, 22 bp, Homo sapiens
cagggttcagtgggccctcttg

SEQ ID NO: 9367527 - DNA, 22 bp, Homo sapiens
cagggtgtgaacagtgtaaaac

SEQ ID NO: 9367528 - DNA, 22 bp, Homo sapiens
aggaagagggtggcagataatc

SEQ ID NO: 9367529 - DNA, 22 bp, Homo sapiens
aggaagagggtggcagataatc

SEQ ID NO: 9367530 - DNA, 22 bp, Homo sapiens
aggaagagggtggcagataatc

SEQ ID NO: 9367531 - DNA, 22 bp, Homo sapiens
aggaagaggtagctgtcaaggg

SEQ ID NO: 9367532 - DNA, 22 bp, Homo sapiens
aggaagaggtagctgtcaaggg

SEQ ID NO: 9367533 - DNA, 22 bp, Homo sapiens
cagggttggtttctcctcaggc

SEQ ID NO: 9367534 - DNA, 22 bp, Homo sapiens
cagggttgattccttctgaggg

SEQ ID NO: 9367535 - DNA, 22 bp, Homo sapiens
cagggtttcaccatgttagcag

SEQ ID NO: 9367536 - DNA, 22 bp, Homo sapiens
cagggtttcaccatgttagcag

SEQ ID NO: 9367537 - DNA, 22 bp, Homo sapiens
aggaagagtgttacctatgggt

SEQ ID NO: 9367538 - DNA, 22 bp, Homo sapiens
aggaagagtgttacctatgggt

SEQ ID NO: 9367539 - DNA, 22 bp, Homo sapiens
aggaagaggtgtgcaatggtgt

SEQ ID NO: 9367540 - DNA, 22 bp, Homo sapiens
aggaagaggtgtgcaatggtgt

SEQ ID NO: 9367541 - DNA, 22 bp, Homo sapiens
aggaagaggtgtgcaatggtgt

SEQ ID NO: 9367542 - DNA, 22 bp, Homo sapiens
aggaagatgtgcaaagttggaa

SEQ ID NO: 9367543 - DNA, 22 bp, Homo sapiens
aggaagatgtgtttagcaggtt

SEQ ID NO: 9367544 - DNA, 22 bp, Homo sapiens
aggaagcaaaaggcagggtcta

SEQ ID NO: 9367545 - DNA, 22 bp, Homo sapiens
aggaagatgtgtttagcaggtt

SEQ ID NO: 9367546 - DNA, 22 bp, Homo sapiens
aggaaggactgcagcatttggt

SEQ ID NO: 9367547 - DNA, 22 bp, Homo sapiens
aggaagcaccggaatgatgact

SEQ ID NO: 9367548 - DNA, 22 bp, Homo sapiens
aggaagcaccggaatgatgact

SEQ ID NO: 9367549 - DNA, 22 bp, Homo sapiens
aggaagggttctttctgtttat

SEQ ID NO: 9367550 - DNA, 22 bp, Homo sapiens
aggaagggttctttgtgaaaga

SEQ ID NO: 9367551 - DNA, 22 bp, Homo sapiens
aggaagggtgtcatgagccctt

SEQ ID NO: 9367552 - DNA, 22 bp, Homo sapiens
aggaagggtgtcatgagccctt

SEQ ID NO: 9367553 - DNA, 22 bp, Homo sapiens
aggaagggtgtcatgagccctt

SEQ ID NO: 9367554 - DNA, 22 bp, Homo sapiens
aggaagggtgtcatgagccctt

SEQ ID NO: 9367555 - DNA, 22 bp, Homo sapiens
aggaaggggagaagttaaagct

SEQ ID NO: 9367556 - DNA, 22 bp, Homo sapiens
aggaagggtggatagtaacgtg

SEQ ID NO: 9367557 - DNA, 22 bp, Homo sapiens
aggaaggggagaagttaaagct

SEQ ID NO: 9367558 - DNA, 22 bp, Homo sapiens
caggtccagtcactggtctgca

SEQ ID NO: 9367559 - DNA, 17 bp, Homo sapiens
caggtcccagggtctct

SEQ ID NO: 9367560 - DNA, 20 bp, Homo sapiens
caggtccagcacgtgcacgg

SEQ ID NO: 9367561 - DNA, 22 bp, Homo sapiens
caggtccagtaaaaagagtcct

SEQ ID NO: 9367562 - DNA, 22 bp, Homo sapiens
caggtcccctcccctaccaggc

SEQ ID NO: 9367563 - DNA, 22 bp, Homo sapiens
caggtcccgccccgggctgacc

SEQ ID NO: 9367564 - DNA, 22 bp, Homo sapiens
caggtcccgccccgggctgacc

SEQ ID NO: 9367565 - DNA, 22 bp, Homo sapiens
caggtcccgttccccagagatt

SEQ ID NO: 9367566 - DNA, 21 bp, Homo sapiens
aggaagtcctgctgtgctgtc

SEQ ID NO: 9367567 - DNA, 22 bp, Homo sapiens
aggaagtcagaatgctggggag

SEQ ID NO: 9367568 - DNA, 22 bp, Homo sapiens
aggaagtcagctgccatgctgt

SEQ ID NO: 9367569 - DNA, 22 bp, Homo sapiens
aggaaggtaatgaactgaggag

SEQ ID NO: 9367570 - DNA, 22 bp, Homo sapiens
aggaaggtgcagtagggtgtgc

SEQ ID NO: 9367571 - DNA, 22 bp, Homo sapiens
aggaaggtaatgaactgaggag

SEQ ID NO: 9367572 - DNA, 22 bp, Homo sapiens
aggaagggttctttgtgaaaga

SEQ ID NO: 9367573 - DNA, 22 bp, Homo sapiens
aggaagggttctttgtgaaaga

SEQ ID NO: 9367574 - DNA, 22 bp, Homo sapiens
aggaagggttctttgtgaaaga

SEQ ID NO: 9367575 - DNA, 22 bp, Homo sapiens
aggaatgtgtgtccaccgggga

SEQ ID NO: 9367576 - DNA, 22 bp, Homo sapiens
aggaatgtgtgtccaccgggga

SEQ ID NO: 9367577 - DNA, 16 bp, Homo sapiens
aggaatgtggcggaac

SEQ ID NO: 9367578 - DNA, 21 bp, Homo sapiens
aggaatgtgtatatatacaat

SEQ ID NO: 9367579 - DNA, 21 bp, Homo sapiens
aggaatgtgtatatatacaat

SEQ ID NO: 9367580 - DNA, 16 bp, Homo sapiens
aggaatgtggcggaac

SEQ ID NO: 9367581 - DNA, 22 bp, Homo sapiens
aggaatgttaaagattaagagc

SEQ ID NO: 9367582 - DNA, 22 bp, Homo sapiens
aggaatgttaaagattaagagc

SEQ ID NO: 9367583 - DNA, 22 bp, Homo sapiens
aggaatgtgtttctaggctgtt

SEQ ID NO: 9367584 - DNA, 22 bp, Homo sapiens
aggaatgtgtttctaggctgtt

SEQ ID NO: 9367585 - DNA, 22 bp, Homo sapiens
aggaatgttaagaaggtctacc

SEQ ID NO: 9367586 - DNA, 22 bp, Homo sapiens
aggaatgttaagaaggtctacc

SEQ ID NO: 9367587 - DNA, 22 bp, Homo sapiens
aggaatgttaggagatgagtct

SEQ ID NO: 9367588 - DNA, 22 bp, Homo sapiens
aggaatgttaggagatgagtct

SEQ ID NO: 9367589 - DNA, 22 bp, Homo sapiens
aggaatgttagttctgtataca

SEQ ID NO: 9367590 - DNA, 22 bp, Homo sapiens
aggaatgtttagaatgtcagaa

SEQ ID NO: 9367591 - DNA, 22 bp, Homo sapiens
aggaatgtttagaatgtcagaa

SEQ ID NO: 9367592 - DNA, 22 bp, Homo sapiens
aggaatgtttagaatgtcagaa

SEQ ID NO: 9367593 - DNA, 22 bp, Homo sapiens
aggaatgtttacacgacagaaa

SEQ ID NO: 9367594 - DNA, 22 bp, Homo sapiens
aggaatgtttacacgacagaaa

SEQ ID NO: 9367595 - DNA, 22 bp, Homo sapiens
aggaatgttagttctgtataca

SEQ ID NO: 9367596 - DNA, 22 bp, Homo sapiens
aggaatgtctgagaaagaggca

SEQ ID NO: 9367597 - DNA, 22 bp, Homo sapiens
aggaatgtctgagaaagaggca

SEQ ID NO: 9367598 - DNA, 22 bp, Homo sapiens
aggaatgtgaaacaggtggctg

SEQ ID NO: 9367599 - DNA, 22 bp, Homo sapiens
aggaatgtgaccactagactct

SEQ ID NO: 9367600 - DNA, 22 bp, Homo sapiens
aggaatgtgaaacaggtggctg

SEQ ID NO: 9367601 - DNA, 22 bp, Homo sapiens
aggaatgtgactattttttcag

SEQ ID NO: 9367602 - DNA, 22 bp, Homo sapiens
aggaatgtgactattttttcag

SEQ ID NO: 9367603 - DNA, 22 bp, Homo sapiens
aggaatgtgaccactagactct

SEQ ID NO: 9367604 - DNA, 22 bp, Homo sapiens
aggaatgtgaggcaagttgtga

SEQ ID NO: 9367605 - DNA, 22 bp, Homo sapiens
aggaatgtgaggcaagttgtga

SEQ ID NO: 9367606 - DNA, 22 bp, Homo sapiens
aggaatgtggcctagggaggag

SEQ ID NO: 9367607 - DNA, 22 bp, Homo sapiens
aggaatgtggcctagggaggag

SEQ ID NO: 9367608 - DNA, 22 bp, Homo sapiens
aggaatgtggcaatcttcaagt

SEQ ID NO: 9367609 - DNA, 22 bp, Homo sapiens
aggaatgtggcaatcttcaagt

SEQ ID NO: 9367610 - DNA, 22 bp, Homo sapiens
aggaatgtggaaggtggcggcg

SEQ ID NO: 9367611 - DNA, 22 bp, Homo sapiens
aggaatgtgcctagcctccctg

SEQ ID NO: 9367612 - DNA, 22 bp, Homo sapiens
aggaatgtgcctagcctccctg

SEQ ID NO: 9367613 - DNA, 22 bp, Homo sapiens
aggaatgtggaaggtggcggcg

SEQ ID NO: 9367614 - DNA, 23 bp, Homo sapiens
aggaatgtgcccacccatctcct

SEQ ID NO: 9367615 - DNA, 23 bp, Homo sapiens
aggaatgtgcccacccatctcct

SEQ ID NO: 9367616 - DNA, 22 bp, Homo sapiens
caggtcctggcatcaggcaggt

SEQ ID NO: 9367617 - DNA, 22 bp, Homo sapiens
caggtcctggcatcaggcaggt

SEQ ID NO: 9367618 - DNA, 22 bp, Homo sapiens
caggtcctggcatcaggcaggt

SEQ ID NO: 9367619 - DNA, 22 bp, Homo sapiens
caggtcctggcagctgactcag

SEQ ID NO: 9367620 - DNA, 22 bp, Homo sapiens
aggaatgacagatgtccgcacc

SEQ ID NO: 9367621 - DNA, 22 bp, Homo sapiens
aggaatgtcgtcataaacatga

SEQ ID NO: 9367622 - DNA, 22 bp, Homo sapiens
aggaatgtcgtcataaacatga

SEQ ID NO: 9367623 - DNA, 14 bp, Homo sapiens
aggaatgtcctagg

SEQ ID NO: 9367624 - DNA, 14 bp, Homo sapiens
aggaatgtcctagg

SEQ ID NO: 9367625 - DNA, 22 bp, Homo sapiens
caggtcctggcagctgactcag

SEQ ID NO: 9367626 - DNA, 22 bp, Homo sapiens
caggtcctcgggggaggccggc

SEQ ID NO: 9367627 - DNA, 22 bp, Homo sapiens
caggtcctcacgcctcaccctt

SEQ ID NO: 9367628 - DNA, 22 bp, Homo sapiens
caggtcccgttccccagagatt

SEQ ID NO: 9367629 - DNA, 22 bp, Homo sapiens
cagggacattggtggccaggtt

SEQ ID NO: 9367630 - DNA, 22 bp, Homo sapiens
cagggacattggtggccaggtt

SEQ ID NO: 9367631 - DNA, 22 bp, Homo sapiens
cagggacattggtggccaggtt

SEQ ID NO: 9367632 - DNA, 22 bp, Homo sapiens
cagggacattggtggccaggtt

SEQ ID NO: 9367633 - DNA, 22 bp, Homo sapiens
cagggacccgcacaggtagcat

SEQ ID NO: 9367634 - DNA, 22 bp, Homo sapiens
cagggacccgcacaggtagcat

SEQ ID NO: 9367635 - DNA, 22 bp, Homo sapiens
cagggacatttccaagagaatt

SEQ ID NO: 9367636 - DNA, 22 bp, Homo sapiens
cagggacatttccaagagaatt

SEQ ID NO: 9367637 - DNA, 22 bp, Homo sapiens
cagggactcgctggacataccg

SEQ ID NO: 9367638 - DNA, 22 bp, Homo sapiens
cagggaccctactagctcacac

SEQ ID NO: 9367639 - DNA, 22 bp, Homo sapiens
agctttctggttacagtcttca

SEQ ID NO: 9367640 - DNA, 22 bp, Homo sapiens
agctttctctcagccaggctgc

SEQ ID NO: 9367641 - DNA, 22 bp, Homo sapiens
agctttctcttctttagaaagt

SEQ ID NO: 9367642 - DNA, 22 bp, Homo sapiens
agctttctagtttagccatctt

SEQ ID NO: 9367643 - DNA, 22 bp, Homo sapiens
agctttctccctgacgctttgg

SEQ ID NO: 9367644 - DNA, 22 bp, Homo sapiens
agctttctccctgacgctttgg

SEQ ID NO: 9367645 - DNA, 20 bp, Homo sapiens
cagggacagtggcagattca

SEQ ID NO: 9367646 - DNA, 20 bp, Homo sapiens
cagggacagtggcagattca

SEQ ID NO: 9367647 - DNA, 22 bp, Homo sapiens
cagggacataagaggaacatgg

SEQ ID NO: 9367648 - DNA, 22 bp, Homo sapiens
cagggacatgactggtctctgt

SEQ ID NO: 9367649 - DNA, 22 bp, Homo sapiens
cagggacataagaggaacatgg

SEQ ID NO: 9367650 - DNA, 22 bp, Homo sapiens
cagggacaggggagaaaagatg

SEQ ID NO: 9367651 - DNA, 22 bp, Homo sapiens
cagggacagggatcatttgctt

SEQ ID NO: 9367652 - DNA, 22 bp, Homo sapiens
cagggacaggggagaaaagatg

SEQ ID NO: 9367653 - DNA, 22 bp, Homo sapiens
cagggacaggggagaaaagatg

SEQ ID NO: 9367654 - DNA, 22 bp, Homo sapiens
cagggacagcgggactctgaca

SEQ ID NO: 9367655 - DNA, 22 bp, Homo sapiens
cagggacagcgggactctgaca

SEQ ID NO: 9367656 - DNA, 22 bp, Homo sapiens
aggaaaaataaggcagcagggc

SEQ ID NO: 9367657 - DNA, 20 bp, Homo sapiens
aggaaaagggtggtggtaga

SEQ ID NO: 9367658 - DNA, 20 bp, Homo sapiens
aggaaaagggtggtggtaga

SEQ ID NO: 9367659 - DNA, 20 bp, Homo sapiens
aggaaaagggtggtggtaga

SEQ ID NO: 9367660 - DNA, 20 bp, Homo sapiens
aggaaaagggtggtggtaga

SEQ ID NO: 9367661 - DNA, 22 bp, Homo sapiens
aggaaaagtgtgaagtatggag

SEQ ID NO: 9367662 - DNA, 22 bp, Homo sapiens
aggaaaatggaccagagttgtt

SEQ ID NO: 9367663 - DNA, 22 bp, Homo sapiens
aggaaaatggaccagagttgtt

SEQ ID NO: 9367664 - DNA, 22 bp, Homo sapiens
aggaaaagtgtgaagtatggag

SEQ ID NO: 9367665 - DNA, 22 bp, Homo sapiens
aggaaaagtgtgaagtatggag

SEQ ID NO: 9367666 - DNA, 22 bp, Homo sapiens
aggaaaagtgtgaagtatggag

SEQ ID NO: 9367667 - DNA, 22 bp, Homo sapiens
aggaaaagtgtgaagtatggag

SEQ ID NO: 9367668 - DNA, 22 bp, Homo sapiens
aggaaaatggaccagagttgtt

SEQ ID NO: 9367669 - DNA, 22 bp, Homo sapiens
aggaaaattatcatgagagcca

SEQ ID NO: 9367670 - DNA, 22 bp, Homo sapiens
aggaaacaacttggcatgagcc

SEQ ID NO: 9367671 - DNA, 22 bp, Homo sapiens
caggctggagttacctttaggg

SEQ ID NO: 9367672 - DNA, 22 bp, Homo sapiens
agctggtgctgaagctcttgag

SEQ ID NO: 9367673 - DNA, 22 bp, Homo sapiens
agctggtgctcggggagctggc

SEQ ID NO: 9367674 - DNA, 22 bp, Homo sapiens
caggctgtgggagtcaggaccc

SEQ ID NO: 9367675 - DNA, 22 bp, Homo sapiens
caggcttaggagtcagcctgct

SEQ ID NO: 9367676 - DNA, 22 bp, Homo sapiens
caggctgtgaaactgagatgcg

SEQ ID NO: 9367677 - DNA, 22 bp, Homo sapiens
caggctgtggatcaggagcctt

SEQ ID NO: 9367678 - DNA, 22 bp, Homo sapiens
caggcttcttttctttccagac

SEQ ID NO: 9367679 - DNA, 22 bp, Homo sapiens
caggcttcttttctttccagac

SEQ ID NO: 9367680 - DNA, 22 bp, Homo sapiens
caggcttcagcatccacttagt

SEQ ID NO: 9367681 - DNA, 22 bp, Homo sapiens
caggcttccgccaggtttccag

SEQ ID NO: 9367682 - DNA, 21 bp, Homo sapiens
caggcttgaggaatgtgcctg

SEQ ID NO: 9367683 - DNA, 22 bp, Homo sapiens
caggcttgagggcaggcccagt

SEQ ID NO: 9367684 - DNA, 22 bp, Homo sapiens
caggcttgaagcttcagagtat

SEQ ID NO: 9367685 - DNA, 21 bp, Homo sapiens
caggcttgaccctagtgggaa

SEQ ID NO: 9367686 - DNA, 22 bp, Homo sapiens
caggcttgctgctagagcactt

SEQ ID NO: 9367687 - DNA, 22 bp, Homo sapiens
caggcttgctagaggagccaaa

SEQ ID NO: 9367688 - DNA, 22 bp, Homo sapiens
caggcttgctagaggagccaaa

SEQ ID NO: 9367689 - DNA, 22 bp, Homo sapiens
caggcttgattattcagacaat

SEQ ID NO: 9367690 - DNA, 22 bp, Homo sapiens
agctttatatttaatgaattct

SEQ ID NO: 9367691 - DNA, 22 bp, Homo sapiens
agctttattaactctccaggtg

SEQ ID NO: 9367692 - DNA, 22 bp, Homo sapiens
agctttatatttaatgaattct

SEQ ID NO: 9367693 - DNA, 22 bp, Homo sapiens
agctttattaactctccaggtg

SEQ ID NO: 9367694 - DNA, 22 bp, Homo sapiens
agctttatttgtcattcacggc

SEQ ID NO: 9367695 - DNA, 22 bp, Homo sapiens
agctttatttgtcattcacggc

SEQ ID NO: 9367696 - DNA, 22 bp, Homo sapiens
agctttattcatgatttcaggg

SEQ ID NO: 9367697 - DNA, 22 bp, Homo sapiens
agctttattcatgatttcaggg

SEQ ID NO: 9367698 - DNA, 22 bp, Homo sapiens
agctttctagatttggaattgt

SEQ ID NO: 9367699 - DNA, 22 bp, Homo sapiens
agctttcagttactaatgaagg

SEQ ID NO: 9367700 - DNA, 23 bp, Homo sapiens
agcttctggttcaggtcaagcag

SEQ ID NO: 9367701 - DNA, 23 bp, Homo sapiens
agcttctggttcaggtcaagcag

SEQ ID NO: 9367702 - DNA, 22 bp, Homo sapiens
agcttctggaagcctggcagca

SEQ ID NO: 9367703 - DNA, 22 bp, Homo sapiens
agcttctggaaggcaaggcttg

SEQ ID NO: 9367704 - DNA, 22 bp, Homo sapiens
agcttctgagaatagtaaatgc

SEQ ID NO: 9367705 - DNA, 22 bp, Homo sapiens
agcttctcctggtacagaactg

SEQ ID NO: 9367706 - DNA, 22 bp, Homo sapiens
agcttctctctttgcactcaca

SEQ ID NO: 9367707 - DNA, 22 bp, Homo sapiens
agctgggcaccccgctgcgtct

SEQ ID NO: 9367708 - DNA, 22 bp, Homo sapiens
agctgggcagactgcagtggtt

SEQ ID NO: 9367709 - DNA, 22 bp, Homo sapiens
agctgggactcaactgtctggg

SEQ ID NO: 9367710 - DNA, 22 bp, Homo sapiens
agctgggcaccccgctgcgtct

SEQ ID NO: 9367711 - DNA, 22 bp, Homo sapiens
agctgggcaccccgctgcgtct

SEQ ID NO: 9367712 - DNA, 22 bp, Homo sapiens
agctgggactcaactgtctggg

SEQ ID NO: 9367713 - DNA, 22 bp, Homo sapiens
agctggaggagtttctcctagc

SEQ ID NO: 9367714 - DNA, 22 bp, Homo sapiens
agctggaggagtttctcctagc

SEQ ID NO: 9367715 - DNA, 23 bp, Homo sapiens
agctgggccaggtggtcagacct

SEQ ID NO: 9367716 - DNA, 21 bp, Homo sapiens
agctgggcctcagcctgcagt

SEQ ID NO: 9367717 - DNA, 21 bp, Homo sapiens
agctgggcctcagcctgcagt

SEQ ID NO: 9367718 - DNA, 22 bp, Homo sapiens
agctgggcagactgcagtggtt

SEQ ID NO: 9367719 - DNA, 22 bp, Homo sapiens
agctgggcagactgcagtggtt

SEQ ID NO: 9367720 - DNA, 23 bp, Homo sapiens
agctgggccaggtggtcagacct

SEQ ID NO: 9367721 - DNA, 22 bp, Homo sapiens
agctgggcagtgcttggattca

SEQ ID NO: 9367722 - DNA, 22 bp, Homo sapiens
agctgggcagactgcagtggtt

SEQ ID NO: 9367723 - DNA, 22 bp, Homo sapiens
agctgggcctgagctggaagct

SEQ ID NO: 9367724 - DNA, 22 bp, Homo sapiens
agctgggcctgatttgcagggg

SEQ ID NO: 9367725 - DNA, 22 bp, Homo sapiens
agctgggcgcagtggctggtga

SEQ ID NO: 9367726 - DNA, 22 bp, Homo sapiens
agctgggcgcagtggctggtga

SEQ ID NO: 9367727 - DNA, 22 bp, Homo sapiens
agctgggctgatgactcatgtt

SEQ ID NO: 9367728 - DNA, 22 bp, Homo sapiens
agctgggctgatgactcatgtt

SEQ ID NO: 9367729 - DNA, 22 bp, Homo sapiens
caggcagagctgaagatagatg

SEQ ID NO: 9367730 - DNA, 22 bp, Homo sapiens
agctgggctggagctccaagcg

SEQ ID NO: 9367731 - DNA, 22 bp, Homo sapiens
agctgggctgatgactcatgtt

SEQ ID NO: 9367732 - DNA, 22 bp, Homo sapiens
agctggagaatgtggatgatcc

SEQ ID NO: 9367733 - DNA, 22 bp, Homo sapiens
agctggagagtttccaggaagg

SEQ ID NO: 9367734 - DNA, 22 bp, Homo sapiens
agctggagagtttccaggaagg

SEQ ID NO: 9367735 - DNA, 22 bp, Homo sapiens
agctggagatgagtgacgtgcc

SEQ ID NO: 9367736 - DNA, 22 bp, Homo sapiens
agctggagatgcccagcaccgg

SEQ ID NO: 9367737 - DNA, 22 bp, Homo sapiens
agctggagatcatgctgatact

SEQ ID NO: 9367738 - DNA, 22 bp, Homo sapiens
agctggagaaacctgggagggt

SEQ ID NO: 9367739 - DNA, 22 bp, Homo sapiens
agctggagaaacctgggagggt

SEQ ID NO: 9367740 - DNA, 20 bp, Homo sapiens
agctggagaagggcccttcc

SEQ ID NO: 9367741 - DNA, 22 bp, Homo sapiens
agctggagaaacctgggagggt

SEQ ID NO: 9367742 - DNA, 22 bp, Homo sapiens
agctggagaataggaattagtg

SEQ ID NO: 9367743 - DNA, 22 bp, Homo sapiens
agctggagaatgtggatgatcc

SEQ ID NO: 9367744 - DNA, 22 bp, Homo sapiens
agctggagaataggaattagtg

SEQ ID NO: 9367745 - DNA, 22 bp, Homo sapiens
agctggagccagtgtgaggctt

SEQ ID NO: 9367746 - DNA, 22 bp, Homo sapiens
agctggagccagtgtgaggctt

SEQ ID NO: 9367747 - DNA, 22 bp, Homo sapiens
agctggagcttcaagcaggtaa

SEQ ID NO: 9367748 - DNA, 22 bp, Homo sapiens
agctggagcttcaagcaggtaa

SEQ ID NO: 9367749 - DNA, 19 bp, Homo sapiens
agctggagattggagggca

SEQ ID NO: 9367750 - DNA, 19 bp, Homo sapiens
agctggagattggagggca

SEQ ID NO: 9367751 - DNA, 22 bp, Homo sapiens
agctggagccagtgtgaggctt

SEQ ID NO: 9367752 - DNA, 22 bp, Homo sapiens
agctggagattctggggacagt

SEQ ID NO: 9367753 - DNA, 22 bp, Homo sapiens
agctggagattctggggacagt

SEQ ID NO: 9367754 - DNA, 19 bp, Homo sapiens
agctggagattggagggca

SEQ ID NO: 9367755 - DNA, 22 bp, Homo sapiens
agctggagattctggggacagt

SEQ ID NO: 9367756 - DNA, 22 bp, Homo sapiens
caggcagaggcttttcatggct

SEQ ID NO: 9367757 - DNA, 20 bp, Homo sapiens
caggcagaggatgctgacca

SEQ ID NO: 9367758 - DNA, 22 bp, Homo sapiens
caggcagagtgagaagcccttg

SEQ ID NO: 9367759 - DNA, 22 bp, Homo sapiens
caggcagagtcagattagactt

SEQ ID NO: 9367760 - DNA, 22 bp, Homo sapiens
caggcagaggaagtctgggtct

SEQ ID NO: 9367761 - DNA, 20 bp, Homo sapiens
caggcagaggatgctgacca

SEQ ID NO: 9367762 - DNA, 22 bp, Homo sapiens
agctgggtggtgctgagccttg

SEQ ID NO: 9367763 - DNA, 22 bp, Homo sapiens
agctgggtgtagggctggacaa

SEQ ID NO: 9367764 - DNA, 21 bp, Homo sapiens
agctgggtgctaatgacaact

SEQ ID NO: 9367765 - DNA, 23 bp, Homo sapiens
agctgggtggcctgcgtgaagct

SEQ ID NO: 9367766 - DNA, 19 bp, Homo sapiens
agctggggcggtgtgtgtt

SEQ ID NO: 9367767 - DNA, 22 bp, Homo sapiens
agctgggtgcccgaagccacgt

SEQ ID NO: 9367768 - DNA, 22 bp, Homo sapiens
caggcagagtgagaagcccttg

SEQ ID NO: 9367769 - DNA, 22 bp, Homo sapiens
caggcagagtgagaagcccttg

SEQ ID NO: 9367770 - DNA, 19 bp, Homo sapiens
agctggggcggtgtgtgtt

SEQ ID NO: 9367771 - DNA, 19 bp, Homo sapiens
agctggggcggtgtgtgtt

SEQ ID NO: 9367772 - DNA, 22 bp, Homo sapiens
caggcagagtgaggtggtctaa

SEQ ID NO: 9367773 - DNA, 22 bp, Homo sapiens
agctgggttgacaagatggaaa

SEQ ID NO: 9367774 - DNA, 17 bp, Homo sapiens
agctgggttctcaggaa

SEQ ID NO: 9367775 - DNA, 17 bp, Homo sapiens
agctgggttctcaggaa

SEQ ID NO: 9367776 - DNA, 19 bp, Homo sapiens
agctgggtgttagtggaga

SEQ ID NO: 9367777 - DNA, 19 bp, Homo sapiens
agctgggtgttagtggaga

SEQ ID NO: 9367778 - DNA, 22 bp, Homo sapiens
agctggtatttgttagggagtt

SEQ ID NO: 9367779 - DNA, 20 bp, Homo sapiens
agctggtccccaagcctctc

SEQ ID NO: 9367780 - DNA, 22 bp, Homo sapiens
agctgggtttctggcaggctta

SEQ ID NO: 9367781 - DNA, 22 bp, Homo sapiens
agctgggtttctggcaggctta

SEQ ID NO: 9367782 - DNA, 22 bp, Homo sapiens
agctggtaaaggggaaagcaga

SEQ ID NO: 9367783 - DNA, 22 bp, Homo sapiens
agctggtgaacctgaggcacag

SEQ ID NO: 9367784 - DNA, 22 bp, Homo sapiens
agctggtgaacctgaggcacag

SEQ ID NO: 9367785 - DNA, 22 bp, Homo sapiens
agctggtgaacctgaggcacag

SEQ ID NO: 9367786 - DNA, 22 bp, Homo sapiens
agctggtccttggcagttctca

SEQ ID NO: 9367787 - DNA, 22 bp, Homo sapiens
agctggtctgctgcatggagtg

SEQ ID NO: 9367788 - DNA, 22 bp, Homo sapiens
agctggtccttccctgccctgt

SEQ ID NO: 9367789 - DNA, 22 bp, Homo sapiens
agctggtcctaattgagccatt

SEQ ID NO: 9367790 - DNA, 22 bp, Homo sapiens
agctggtccttccctgccctgt

SEQ ID NO: 9367791 - DNA, 20 bp, Homo sapiens
agctggtgaattaaagactg

SEQ ID NO: 9367792 - DNA, 20 bp, Homo sapiens
agctggtgaattaaagactg

SEQ ID NO: 9367793 - DNA, 22 bp, Homo sapiens
agctggtgagggttgaggggta

SEQ ID NO: 9367794 - DNA, 22 bp, Homo sapiens
agctggtgctcaggggcatgga

SEQ ID NO: 9367795 - DNA, 22 bp, Homo sapiens
agctggtgcctgcttttgtgtg

SEQ ID NO: 9367796 - DNA, 22 bp, Homo sapiens
caggaaccagaaccttcccccg

SEQ ID NO: 9367797 - DNA, 22 bp, Homo sapiens
caggaaatgcgtagttgaactt

SEQ ID NO: 9367798 - DNA, 22 bp, Homo sapiens
caggaactcaaggtttgtaaca

SEQ ID NO: 9367799 - DNA, 22 bp, Homo sapiens
caggaagaaagaggtgaggtgt

SEQ ID NO: 9367800 - DNA, 22 bp, Homo sapiens
caggaagaagggtggtgagtcc

SEQ ID NO: 9367801 - DNA, 22 bp, Homo sapiens
caggaagaaagaggtgaggtgt

SEQ ID NO: 9367802 - DNA, 22 bp, Homo sapiens
caggaagaaagaggtgaggtgt

SEQ ID NO: 9367803 - DNA, 22 bp, Homo sapiens
caggaagaccagggctgtggct

SEQ ID NO: 9367804 - DNA, 22 bp, Homo sapiens
caggaagaccagggctgtggct

SEQ ID NO: 9367805 - DNA, 22 bp, Homo sapiens
caggaagaccagggctgtggct

SEQ ID NO: 9367806 - DNA, 22 bp, Homo sapiens
caggaagaccagggctgtggct

SEQ ID NO: 9367807 - DNA, 22 bp, Homo sapiens
caggaagaagggtggtgagtcc

SEQ ID NO: 9367808 - DNA, 22 bp, Homo sapiens
caggaagaagggtggtgagtcc

SEQ ID NO: 9367809 - DNA, 22 bp, Homo sapiens
caggaaatagttcagtcaaact

SEQ ID NO: 9367810 - DNA, 22 bp, Homo sapiens
caggaaatataggaaaaggaac

SEQ ID NO: 9367811 - DNA, 22 bp, Homo sapiens
caggaaaaggagactttagcac

SEQ ID NO: 9367812 - DNA, 22 bp, Homo sapiens
agctgaagaaatgggaagcatt

SEQ ID NO: 9367813 - DNA, 22 bp, Homo sapiens
agctctttggcactgagcagca

SEQ ID NO: 9367814 - DNA, 22 bp, Homo sapiens
agctcttttatcatgaggagag

SEQ ID NO: 9367815 - DNA, 22 bp, Homo sapiens
agctcttttgattctccctgtc

SEQ ID NO: 9367816 - DNA, 22 bp, Homo sapiens
agctcttttgtgagcatttggc

SEQ ID NO: 9367817 - DNA, 22 bp, Homo sapiens
agctcttttgctctccaagttt

SEQ ID NO: 9367818 - DNA, 20 bp, Homo sapiens
agctctttttagctaaggta

SEQ ID NO: 9367819 - DNA, 22 bp, Homo sapiens
agctgaaattcacaaggatcca

SEQ ID NO: 9367820 - DNA, 22 bp, Homo sapiens
agctgaagaaatgggaagcatt

SEQ ID NO: 9367821 - DNA, 22 bp, Homo sapiens
agctgaacgtgcttctgcagca

SEQ ID NO: 9367822 - DNA, 22 bp, Homo sapiens
agctgccctgggtcttgctgct

SEQ ID NO: 9367823 - DNA, 22 bp, Homo sapiens
agctgcccttaataggcattca

SEQ ID NO: 9367824 - DNA, 22 bp, Homo sapiens
agctgcccttctcttgcccttg

SEQ ID NO: 9367825 - DNA, 20 bp, Homo sapiens
agctgcccttttcacatgtt

SEQ ID NO: 9367826 - DNA, 20 bp, Homo sapiens
agctgcccttttcacatgtt

SEQ ID NO: 9367827 - DNA, 21 bp, Homo sapiens
agctgcctccacttctgaggc

SEQ ID NO: 9367828 - DNA, 22 bp, Homo sapiens
agctgcctcagtcactcatggc

SEQ ID NO: 9367829 - DNA, 22 bp, Homo sapiens
agctgcccccagggctgtgctt

SEQ ID NO: 9367830 - DNA, 22 bp, Homo sapiens
agctgccagatgacagtgctat

SEQ ID NO: 9367831 - DNA, 22 bp, Homo sapiens
agctgccagatgacagtgctat

SEQ ID NO: 9367832 - DNA, 22 bp, Homo sapiens
agctgccagatgacagtgctat

SEQ ID NO: 9367833 - DNA, 22 bp, Homo sapiens
agctgctgggaccccagatcca

SEQ ID NO: 9367834 - DNA, 22 bp, Homo sapiens
agctgctgggagaagtgagcca

SEQ ID NO: 9367835 - DNA, 22 bp, Homo sapiens
agctgcctggagccagagttga

SEQ ID NO: 9367836 - DNA, 22 bp, Homo sapiens
agctgcttttattaggacaatg

SEQ ID NO: 9367837 - DNA, 22 bp, Homo sapiens
agctgcctgcttatgagctcca

SEQ ID NO: 9367838 - DNA, 21 bp, Homo sapiens
agctgcctgctctggacctgg

SEQ ID NO: 9367839 - DNA, 22 bp, Homo sapiens
agctgcctctcttgaggttacg

SEQ ID NO: 9367840 - DNA, 22 bp, Homo sapiens
agctgcctgccatgccgctggt

SEQ ID NO: 9367841 - DNA, 22 bp, Homo sapiens
agctgcctgcatttatatcctg

SEQ ID NO: 9367842 - DNA, 22 bp, Homo sapiens
agctgcctcctggtgccccatc

SEQ ID NO: 9367843 - DNA, 22 bp, Homo sapiens
agctgcctccctgtgcttgtcc

SEQ ID NO: 9367844 - DNA, 17 bp, Homo sapiens
agctgcctctcccacca

SEQ ID NO: 9367845 - DNA, 22 bp, Homo sapiens
agctgcctctcttgaggttacg

SEQ ID NO: 9367846 - DNA, 22 bp, Homo sapiens
accagttttttatacatcttct

SEQ ID NO: 9367847 - DNA, 20 bp, Homo sapiens
accataatgttaattacaaa

SEQ ID NO: 9367848 - DNA, 20 bp, Homo sapiens
accataatgttaattacaaa

SEQ ID NO: 9367849 - DNA, 22 bp, Homo sapiens
accataattacttggctttttc

SEQ ID NO: 9367850 - DNA, 22 bp, Homo sapiens
agggcctcctaatttcctcata

SEQ ID NO: 9367851 - DNA, 23 bp, Homo sapiens
agggcccaagcctggacagcagg

SEQ ID NO: 9367852 - DNA, 21 bp, Homo sapiens
agggcctctcatttgtgccag

SEQ ID NO: 9367853 - DNA, 22 bp, Homo sapiens
agggcctctaccatccaaggtt

SEQ ID NO: 9367854 - DNA, 22 bp, Homo sapiens
agggcctcgaaggcagagggat

SEQ ID NO: 9367855 - DNA, 22 bp, Homo sapiens
accagtgggaagtggaaaatga

SEQ ID NO: 9367856 - DNA, 22 bp, Homo sapiens
accagtggatgaatgctggacc

SEQ ID NO: 9367857 - DNA, 22 bp, Homo sapiens
accagtgggtgtcattccctta

SEQ ID NO: 9367858 - DNA, 22 bp, Homo sapiens
accagtggatactgcttgcttt

SEQ ID NO: 9367859 - DNA, 22 bp, Homo sapiens
accagtggaattattctgtggt

SEQ ID NO: 9367860 - DNA, 22 bp, Homo sapiens
accagtgcttcctgctggagct

SEQ ID NO: 9367861 - DNA, 22 bp, Homo sapiens
accagtgagtatttgtaacaga

SEQ ID NO: 9367862 - DNA, 22 bp, Homo sapiens
accagtcttgttgccatgtctg

SEQ ID NO: 9367863 - DNA, 22 bp, Homo sapiens
accagtcatagaaagcagtggt

SEQ ID NO: 9367864 - DNA, 20 bp, Homo sapiens
accaggtggctgatgacacc

SEQ ID NO: 9367865 - DNA, 22 bp, Homo sapiens
accaggttggtgtccttctggc

SEQ ID NO: 9367866 - DNA, 22 bp, Homo sapiens
accaggtggccccagcgtggtt

SEQ ID NO: 9367867 - DNA, 22 bp, Homo sapiens
accaggagtaacagtgagtggt

SEQ ID NO: 9367868 - DNA, 22 bp, Homo sapiens
accaggagggaccctggtggcc

SEQ ID NO: 9367869 - DNA, 19 bp, Homo sapiens
accaggagtatcagagctg

SEQ ID NO: 9367870 - DNA, 22 bp, Homo sapiens
accaggagttgggggtgggacc

SEQ ID NO: 9367871 - DNA, 22 bp, Homo sapiens
accaggctgttgggcccagtgt

SEQ ID NO: 9367872 - DNA, 22 bp, Homo sapiens
accagggcacattccggccaga

SEQ ID NO: 9367873 - DNA, 22 bp, Homo sapiens
accagggcacaggagtctgaag

SEQ ID NO: 9367874 - DNA, 22 bp, Homo sapiens
accagggcagccgaggtgtgtc

SEQ ID NO: 9367875 - DNA, 22 bp, Homo sapiens
accagggcttacagcagtagct

SEQ ID NO: 9367876 - DNA, 22 bp, Homo sapiens
accagggctgggataggtcagg

SEQ ID NO: 9367877 - DNA, 22 bp, Homo sapiens
accagggctgacaatctgatgg

SEQ ID NO: 9367878 - DNA, 22 bp, Homo sapiens
accagggcccgggagagctctc

SEQ ID NO: 9367879 - DNA, 22 bp, Homo sapiens
accagggcagccgaggtgtgtc

SEQ ID NO: 9367880 - DNA, 22 bp, Homo sapiens
accagggcccgggagagctctc

SEQ ID NO: 9367881 - DNA, 22 bp, Homo sapiens
accagggcggcttgaggaggca

SEQ ID NO: 9367882 - DNA, 22 bp, Homo sapiens
accagggcggcttgaggaggca

SEQ ID NO: 9367883 - DNA, 19 bp, Homo sapiens
accaggagacagtgagctt

SEQ ID NO: 9367884 - DNA, 20 bp, Homo sapiens
accaggagatggaggcaggg

SEQ ID NO: 9367885 - DNA, 22 bp, Homo sapiens
accaggagccacaggaggagcc

SEQ ID NO: 9367886 - DNA, 22 bp, Homo sapiens
accaggagccacaggaggagcc

SEQ ID NO: 9367887 - DNA, 20 bp, Homo sapiens
accaggagatggaggcaggg

SEQ ID NO: 9367888 - DNA, 22 bp, Homo sapiens
accaggagccatagagtcaggc

SEQ ID NO: 9367889 - DNA, 22 bp, Homo sapiens
accaggaggcctggagcacaaa

SEQ ID NO: 9367890 - DNA, 22 bp, Homo sapiens
accaggaggctacactgtccca

SEQ ID NO: 9367891 - DNA, 22 bp, Homo sapiens
accaggaggccttggttctgag

SEQ ID NO: 9367892 - DNA, 22 bp, Homo sapiens
accaataagacacattgagcta

SEQ ID NO: 9367893 - DNA, 22 bp, Homo sapiens
accaatgcatgattttgtctgg

SEQ ID NO: 9367894 - DNA, 22 bp, Homo sapiens
accaataagacacattgagcta

SEQ ID NO: 9367895 - DNA, 22 bp, Homo sapiens
accaagtgagtacttggcagaa

SEQ ID NO: 9367896 - DNA, 22 bp, Homo sapiens
accagctcttctgctctagttg

SEQ ID NO: 9367897 - DNA, 22 bp, Homo sapiens
accacaggaattgctctgtggt

SEQ ID NO: 9367898 - DNA, 22 bp, Homo sapiens
accacaggaattgctctgtggt

SEQ ID NO: 9367899 - DNA, 22 bp, Homo sapiens
accacaggaattgctctgtggt

SEQ ID NO: 9367900 - DNA, 22 bp, Homo sapiens
accaagagccctcatgctaaga

SEQ ID NO: 9367901 - DNA, 22 bp, Homo sapiens
accaagagtccaagtgaggttg

SEQ ID NO: 9367902 - DNA, 18 bp, Homo sapiens
accctgggcaattcactc

SEQ ID NO: 9367903 - DNA, 23 bp, Homo sapiens
accctgggcaagtcacctaacct

SEQ ID NO: 9367904 - DNA, 22 bp, Homo sapiens
accctgggcacaccatttcccc

SEQ ID NO: 9367905 - DNA, 22 bp, Homo sapiens
accctgggcacaccatttcccc

SEQ ID NO: 9367906 - DNA, 22 bp, Homo sapiens
accctgggcttggcctgctcag

SEQ ID NO: 9367907 - DNA, 22 bp, Homo sapiens
accctgggacttccgagttgag

SEQ ID NO: 9367908 - DNA, 22 bp, Homo sapiens
accctgggagggagaaatcaga

SEQ ID NO: 9367909 - DNA, 22 bp, Homo sapiens
accctgggacctggaggtggat

SEQ ID NO: 9367910 - DNA, 22 bp, Homo sapiens
accctgggaactggaaactgga

SEQ ID NO: 9367911 - DNA, 22 bp, Homo sapiens
accctggaggtctacagtgcag

SEQ ID NO: 9367912 - DNA, 22 bp, Homo sapiens
accctggggtcacccttctctg

SEQ ID NO: 9367913 - DNA, 22 bp, Homo sapiens
accctgggggtggccagtgcca

SEQ ID NO: 9367914 - DNA, 22 bp, Homo sapiens
accctgggggtggccagtgcca

SEQ ID NO: 9367915 - DNA, 22 bp, Homo sapiens
accctgggtcatatacagtgtg

SEQ ID NO: 9367916 - DNA, 22 bp, Homo sapiens
accctgggtcatatacagtgtg

SEQ ID NO: 9367917 - DNA, 22 bp, Homo sapiens
accctgggtcatatacagtgtg

SEQ ID NO: 9367918 - DNA, 22 bp, Homo sapiens
accctgggtatttcccaaactt

SEQ ID NO: 9367919 - DNA, 16 bp, Homo sapiens
accctgggtagtcctg

SEQ ID NO: 9367920 - DNA, 22 bp, Homo sapiens
accctggtttgaataatctgtg

SEQ ID NO: 9367921 - DNA, 22 bp, Homo sapiens
accctggtgatttgagagagta

SEQ ID NO: 9367922 - DNA, 22 bp, Homo sapiens
accctggtctctacttcacaga

SEQ ID NO: 9367923 - DNA, 21 bp, Homo sapiens
accctgggttctccataccct

SEQ ID NO: 9367924 - DNA, 22 bp, Homo sapiens
accctgggtgagaggcaaacag

SEQ ID NO: 9367925 - DNA, 22 bp, Homo sapiens
accctgggtctcaatcatccta

SEQ ID NO: 9367926 - DNA, 22 bp, Homo sapiens
accctgggttcccgcagcacca

SEQ ID NO: 9367927 - DNA, 22 bp, Homo sapiens
accctgggttcccgcagcacca

SEQ ID NO: 9367928 - DNA, 21 bp, Homo sapiens
accctgctttatgccgtcctc

SEQ ID NO: 9367929 - DNA, 22 bp, Homo sapiens
accctgctttatgccgtcctct

SEQ ID NO: 9367930 - DNA, 22 bp, Homo sapiens
accctgcttggccccacttcta

SEQ ID NO: 9367931 - DNA, 22 bp, Homo sapiens
accctgcttctggattaatcca

SEQ ID NO: 9367932 - DNA, 22 bp, Homo sapiens
accctgcttggccccacttcta

SEQ ID NO: 9367933 - DNA, 22 bp, Homo sapiens
accctgctgacctgaaagaggg

SEQ ID NO: 9367934 - DNA, 22 bp, Homo sapiens
accccagccctgcttctgggag

SEQ ID NO: 9367935 - DNA, 20 bp, Homo sapiens
accccagcccctctatctga

SEQ ID NO: 9367936 - DNA, 22 bp, Homo sapiens
accccagaggcggaggctgcag

SEQ ID NO: 9367937 - DNA, 22 bp, Homo sapiens
accccagcgcatatggtctgcg

SEQ ID NO: 9367938 - DNA, 22 bp, Homo sapiens
accctctgccttgagcagtgcc

SEQ ID NO: 9367939 - DNA, 22 bp, Homo sapiens
accccaagacagtagaagagaa

SEQ ID NO: 9367940 - DNA, 22 bp, Homo sapiens
accccaaaagagtaatagaatt

SEQ ID NO: 9367941 - DNA, 17 bp, Homo sapiens
acccattttgcacaggc

SEQ ID NO: 9367942 - DNA, 22 bp, Homo sapiens
accccagaagcagcagtggcag

SEQ ID NO: 9367943 - DNA, 22 bp, Homo sapiens
accccagaggcggaggctgcag

SEQ ID NO: 9367944 - DNA, 22 bp, Homo sapiens
acccatgtgctcttttgtaccc

SEQ ID NO: 9367945 - DNA, 22 bp, Homo sapiens
acccatggtctggtggggccct

SEQ ID NO: 9367946 - DNA, 22 bp, Homo sapiens
acccattcctttacttcatctg

SEQ ID NO: 9367947 - DNA, 22 bp, Homo sapiens
acccatccagtgtccctgctag

SEQ ID NO: 9367948 - DNA, 17 bp, Homo sapiens
acccatccccagggcag

SEQ ID NO: 9367949 - DNA, 23 bp, Homo sapiens
acccatctctcctgtcatgcaga

SEQ ID NO: 9367950 - DNA, 22 bp, Homo sapiens
acccagggtcaccccgtagggt

SEQ ID NO: 9367951 - DNA, 22 bp, Homo sapiens
acccagggtagagtgcagtggc

SEQ ID NO: 9367952 - DNA, 22 bp, Homo sapiens
acccagggtagagtgcagtggc

SEQ ID NO: 9367953 - DNA, 22 bp, Homo sapiens
acccagggtagagtgcagtggc

SEQ ID NO: 9367954 - DNA, 22 bp, Homo sapiens
acccagagcacagatgcaacgt

SEQ ID NO: 9367955 - DNA, 22 bp, Homo sapiens
acccagagcactgggtgtgggc

SEQ ID NO: 9367956 - DNA, 17 bp, Homo sapiens
acccagagaaggaggtc

SEQ ID NO: 9367957 - DNA, 22 bp, Homo sapiens
acccagagactagcacggtaca

SEQ ID NO: 9367958 - DNA, 22 bp, Homo sapiens
acccagagaactgtgccttgag

SEQ ID NO: 9367959 - DNA, 19 bp, Homo sapiens
acccagggttgatgtccag

SEQ ID NO: 9367960 - DNA, 22 bp, Homo sapiens
acccagggttcctgggtcccag

SEQ ID NO: 9367961 - DNA, 22 bp, Homo sapiens
acccagggtttgagctctgcag

SEQ ID NO: 9367962 - DNA, 22 bp, Homo sapiens
acccagggttcctgggtcccag

SEQ ID NO: 9367963 - DNA, 22 bp, Homo sapiens
acccagtgttgggcagaactgt

SEQ ID NO: 9367964 - DNA, 22 bp, Homo sapiens
acccagtgacatcctttacctg

SEQ ID NO: 9367965 - DNA, 22 bp, Homo sapiens
acccagggtttgagctctgcag

SEQ ID NO: 9367966 - DNA, 18 bp, Homo sapiens
acccaggttttgaagctt

SEQ ID NO: 9367967 - DNA, 22 bp, Homo sapiens
acccaggtctctcgacttctgg

SEQ ID NO: 9367968 - DNA, 19 bp, Homo sapiens
agggcctgagcagatgttg

SEQ ID NO: 9367969 - DNA, 22 bp, Homo sapiens
agggcctgagaccgtggcttga

SEQ ID NO: 9367970 - DNA, 22 bp, Homo sapiens
agggcctgacacccttgccagc

SEQ ID NO: 9367971 - DNA, 22 bp, Homo sapiens
agggcctgacacccttgccagc

SEQ ID NO: 9367972 - DNA, 21 bp, Homo sapiens
agggcctctgtgtactggggg

SEQ ID NO: 9367973 - DNA, 23 bp, Homo sapiens
agggcctctgtcccccagcactc

SEQ ID NO: 9367974 - DNA, 23 bp, Homo sapiens
agggcctctgtcccccagcactc

SEQ ID NO: 9367975 - DNA, 22 bp, Homo sapiens
agggcctctggaacactgaggg

SEQ ID NO: 9367976 - DNA, 22 bp, Homo sapiens
agggcctctgcctccccgttgt

SEQ ID NO: 9367977 - DNA, 22 bp, Homo sapiens
agggcctctgagccagttctgg

SEQ ID NO: 9367978 - DNA, 22 bp, Homo sapiens
agggcctctgagccagttctgg

SEQ ID NO: 9367979 - DNA, 22 bp, Homo sapiens
agggcctctgacgcccccagcc

SEQ ID NO: 9367980 - DNA, 22 bp, Homo sapiens
agggcctctctgggcctttcct

SEQ ID NO: 9367981 - DNA, 22 bp, Homo sapiens
acccacgaagatgagcggcatg

SEQ ID NO: 9367982 - DNA, 22 bp, Homo sapiens
acccagagaactgaggcatgaa

SEQ ID NO: 9367983 - DNA, 22 bp, Homo sapiens
agggcctgagctctcctccagt

SEQ ID NO: 9367984 - DNA, 19 bp, Homo sapiens
agggcctgagcagatgttg

SEQ ID NO: 9367985 - DNA, 22 bp, Homo sapiens
agggcctgagctctcctccagt

SEQ ID NO: 9367986 - DNA, 22 bp, Homo sapiens
agggcctgagctctcctccagt

SEQ ID NO: 9367987 - DNA, 22 bp, Homo sapiens
acccacagaacctgtgacaaca

SEQ ID NO: 9367988 - DNA, 22 bp, Homo sapiens
acccacagccgctgtgcgtccc

SEQ ID NO: 9367989 - DNA, 22 bp, Homo sapiens
acccacagccgctgtgcgtccc

SEQ ID NO: 9367990 - DNA, 22 bp, Homo sapiens
acccacagccgctgtgcgtccc

SEQ ID NO: 9367991 - DNA, 22 bp, Homo sapiens
aggccagcattctctctccagg

SEQ ID NO: 9367992 - DNA, 22 bp, Homo sapiens
aggccagccctcacctgtgttc

SEQ ID NO: 9367993 - DNA, 22 bp, Homo sapiens
aggccagccctgggctgagaga

SEQ ID NO: 9367994 - DNA, 22 bp, Homo sapiens
aggccagcagacgtgggactga

SEQ ID NO: 9367995 - DNA, 22 bp, Homo sapiens
aggccagcattctctctccagg

SEQ ID NO: 9367996 - DNA, 22 bp, Homo sapiens
aggccagcattctctctccagg

SEQ ID NO: 9367997 - DNA, 22 bp, Homo sapiens
aggccagcattctctctccagg

SEQ ID NO: 9367998 - DNA, 22 bp, Homo sapiens
aggccagcattctctctccagg

SEQ ID NO: 9367999 - DNA, 22 bp, Homo sapiens
aggccagcctcaggcagggacc

SEQ ID NO: 9368000 - DNA, 22 bp, Homo sapiens
acatgaaaagactatctgatta

SEQ ID NO: 9368001 - DNA, 22 bp, Homo sapiens
acatgaaaaatgtttgcagttt

SEQ ID NO: 9368002 - DNA, 22 bp, Homo sapiens
acatgaaaactggttccttcag

SEQ ID NO: 9368003 - DNA, 21 bp, Homo sapiens
aggcccaggaatatgcatttt

SEQ ID NO: 9368004 - DNA, 22 bp, Homo sapiens
aggcccagggctgctctctgaa

SEQ ID NO: 9368005 - DNA, 22 bp, Homo sapiens
aggcccagggctgctctctgaa

SEQ ID NO: 9368006 - DNA, 22 bp, Homo sapiens
aggcccagggctgctctctgaa

SEQ ID NO: 9368007 - DNA, 21 bp, Homo sapiens
aggcccaggaatatgcatttt

SEQ ID NO: 9368008 - DNA, 22 bp, Homo sapiens
aggccctgagcatccgagggca

SEQ ID NO: 9368009 - DNA, 22 bp, Homo sapiens
aggccctgagcatccgagggca

SEQ ID NO: 9368010 - DNA, 22 bp, Homo sapiens
aggccctgatccgaatccagat

SEQ ID NO: 9368011 - DNA, 22 bp, Homo sapiens
aggccctgagcatccgagggca

SEQ ID NO: 9368012 - DNA, 22 bp, Homo sapiens
aggccctgagaaaatccctgca

SEQ ID NO: 9368013 - DNA, 22 bp, Homo sapiens
aggccctgagaaaatccctgca

SEQ ID NO: 9368014 - DNA, 22 bp, Homo sapiens
aggcccagtagtcgacggcgct

SEQ ID NO: 9368015 - DNA, 22 bp, Homo sapiens
aggccaggtggtcatgcttgct

SEQ ID NO: 9368016 - DNA, 22 bp, Homo sapiens
acatgaaacctgagtctaactc

SEQ ID NO: 9368017 - DNA, 21 bp, Homo sapiens
aggcccagctttcctcttgct

SEQ ID NO: 9368018 - DNA, 21 bp, Homo sapiens
aggcccagctttcctcttgct

SEQ ID NO: 9368019 - DNA, 21 bp, Homo sapiens
aggcccagctttcctcttgct

SEQ ID NO: 9368020 - DNA, 22 bp, Homo sapiens
aggcccagcttgaagtgggaag

SEQ ID NO: 9368021 - DNA, 22 bp, Homo sapiens
aggcccagcttgaagtgggaag

SEQ ID NO: 9368022 - DNA, 22 bp, Homo sapiens
aggcccagcttgaagtgggaag

SEQ ID NO: 9368023 - DNA, 22 bp, Homo sapiens
aggccacaggtggaagccagag

SEQ ID NO: 9368024 - DNA, 22 bp, Homo sapiens
aggccacaggtggaagccagag

SEQ ID NO: 9368025 - DNA, 22 bp, Homo sapiens
aggccagcaagaaagagagtct

SEQ ID NO: 9368026 - DNA, 22 bp, Homo sapiens
aggccagcacgacagccgcagg

SEQ ID NO: 9368027 - DNA, 22 bp, Homo sapiens
aggccagcaccagagtcaagaa

SEQ ID NO: 9368028 - DNA, 22 bp, Homo sapiens
aggccacagcctgggaggtgac

SEQ ID NO: 9368029 - DNA, 22 bp, Homo sapiens
aggccacagcctgggaggtgac

SEQ ID NO: 9368030 - DNA, 22 bp, Homo sapiens
aggccacaggattgcacagcat

SEQ ID NO: 9368031 - DNA, 22 bp, Homo sapiens
aggccacaggattgcacagcat

SEQ ID NO: 9368032 - DNA, 22 bp, Homo sapiens
aggccacaggattgcacagcat

SEQ ID NO: 9368033 - DNA, 22 bp, Homo sapiens
aggccacaatttgatttggttt

SEQ ID NO: 9368034 - DNA, 22 bp, Homo sapiens
aggccacacaactcttagagat

SEQ ID NO: 9368035 - DNA, 18 bp, Homo sapiens
aggccacactccagaaca

SEQ ID NO: 9368036 - DNA, 22 bp, Homo sapiens
aggccacagagagtgcatgtgc

SEQ ID NO: 9368037 - DNA, 22 bp, Homo sapiens
aggccacagagagtgcatgtgc

SEQ ID NO: 9368038 - DNA, 22 bp, Homo sapiens
aggcatgggtagaagagaagcc

SEQ ID NO: 9368039 - DNA, 17 bp, Homo sapiens
aggcatggtctggggtg

SEQ ID NO: 9368040 - DNA, 17 bp, Homo sapiens
aggcatggtctggggtg

SEQ ID NO: 9368041 - DNA, 17 bp, Homo sapiens
aggcatggtctggggtg

SEQ ID NO: 9368042 - DNA, 18 bp, Homo sapiens
aggcatggtggtgcgcac

SEQ ID NO: 9368043 - DNA, 18 bp, Homo sapiens
aggcatggtggtgcgcac

SEQ ID NO: 9368044 - DNA, 18 bp, Homo sapiens
aggcatggtggtgcgcac

SEQ ID NO: 9368045 - DNA, 22 bp, Homo sapiens
aggcatgggtagaagagaagcc

SEQ ID NO: 9368046 - DNA, 22 bp, Homo sapiens
aggcatggggctgcagtcaggt

SEQ ID NO: 9368047 - DNA, 22 bp, Homo sapiens
aggcatggggctgcagtcaggt

SEQ ID NO: 9368048 - DNA, 22 bp, Homo sapiens
aggcatggggctgcagtcaggt

SEQ ID NO: 9368049 - DNA, 20 bp, Homo sapiens
aggcatgggatgcccagatt

SEQ ID NO: 9368050 - DNA, 19 bp, Homo sapiens
aggcatgggaagagaagtc

SEQ ID NO: 9368051 - DNA, 19 bp, Homo sapiens
aggcatgggaagagaagtc

SEQ ID NO: 9368052 - DNA, 22 bp, Homo sapiens
aggcatggctttaggcaggcgt

SEQ ID NO: 9368053 - DNA, 22 bp, Homo sapiens
aggcatggctttaggcaggcgt

SEQ ID NO: 9368054 - DNA, 22 bp, Homo sapiens
aggcatggctttaggcaggcgt

SEQ ID NO: 9368055 - DNA, 22 bp, Homo sapiens
aggcatggctttaggcaggcgt

SEQ ID NO: 9368056 - DNA, 22 bp, Homo sapiens
acatacatggattcatggattc

SEQ ID NO: 9368057 - DNA, 22 bp, Homo sapiens
acatacatggattcatggattc

SEQ ID NO: 9368058 - DNA, 22 bp, Homo sapiens
aggcatggcatggggcagatgt

SEQ ID NO: 9368059 - DNA, 22 bp, Homo sapiens
aggcatggctttaggcaggcgt

SEQ ID NO: 9368060 - DNA, 22 bp, Homo sapiens
aggcagtgttcttctaagggca

SEQ ID NO: 9368061 - DNA, 22 bp, Homo sapiens
aggcagtgttcttctaagggca

SEQ ID NO: 9368062 - DNA, 22 bp, Homo sapiens
acatacatggttctcagccctt

SEQ ID NO: 9368063 - DNA, 22 bp, Homo sapiens
acattgatatttcaaatacagg

SEQ ID NO: 9368064 - DNA, 22 bp, Homo sapiens
acattgagagttttgaagagta

SEQ ID NO: 9368065 - DNA, 22 bp, Homo sapiens
aggctccagcagccagaggaag

SEQ ID NO: 9368066 - DNA, 22 bp, Homo sapiens
aggctccagcagccagaggaag

SEQ ID NO: 9368067 - DNA, 22 bp, Homo sapiens
aggctccagcccaaggctgcag

SEQ ID NO: 9368068 - DNA, 22 bp, Homo sapiens
aggctccagcccaaggctgcag

SEQ ID NO: 9368069 - DNA, 22 bp, Homo sapiens
aggctccagccaatgggtctgt

SEQ ID NO: 9368070 - DNA, 22 bp, Homo sapiens
acattgaatttcacttttgtac

SEQ ID NO: 9368071 - DNA, 22 bp, Homo sapiens
acattgaatgtatgtgatgaaa

SEQ ID NO: 9368072 - DNA, 22 bp, Homo sapiens
acattgaagggaatgcaaagat

SEQ ID NO: 9368073 - DNA, 22 bp, Homo sapiens
acattgaaagcatattatctcc

SEQ ID NO: 9368074 - DNA, 22 bp, Homo sapiens
acattgaacagtacaaatgatc

SEQ ID NO: 9368075 - DNA, 22 bp, Homo sapiens
aggctccaggcctccctgcatg

SEQ ID NO: 9368076 - DNA, 22 bp, Homo sapiens
aggctgtgcaattagggtaaga

SEQ ID NO: 9368077 - DNA, 22 bp, Homo sapiens
aggctccagtctcctctggcag

SEQ ID NO: 9368078 - DNA, 22 bp, Homo sapiens
aggcttcccaagcagctgcaaa

SEQ ID NO: 9368079 - DNA, 22 bp, Homo sapiens
aggcttcccagctgagctcagc

SEQ ID NO: 9368080 - DNA, 18 bp, Homo sapiens
aggcttcccaggcaggcc

SEQ ID NO: 9368081 - DNA, 19 bp, Homo sapiens
aggcttcaggccacatgct

SEQ ID NO: 9368082 - DNA, 22 bp, Homo sapiens
acattacactgtggtcctgttc

SEQ ID NO: 9368083 - DNA, 22 bp, Homo sapiens
acattaatgaggtgatgacaca

SEQ ID NO: 9368084 - DNA, 22 bp, Homo sapiens
acattaatgaggtgatgacaca

SEQ ID NO: 9368085 - DNA, 23 bp, Homo sapiens
acattacacgcagtaattgcccc

SEQ ID NO: 9368086 - DNA, 20 bp, Homo sapiens
aggccctgccagggacggag

SEQ ID NO: 9368087 - DNA, 22 bp, Homo sapiens
aggccctgcattgtactgaggg

SEQ ID NO: 9368088 - DNA, 20 bp, Homo sapiens
aggccctgccagggacggag

SEQ ID NO: 9368089 - DNA, 22 bp, Homo sapiens
aggccctgcaggagtggggaca

SEQ ID NO: 9368090 - DNA, 22 bp, Homo sapiens
aggccctgcaggaagcaggatg

SEQ ID NO: 9368091 - DNA, 22 bp, Homo sapiens
aggccctgcaggaagcaggatg

SEQ ID NO: 9368092 - DNA, 22 bp, Homo sapiens
aggccctgcaggaagcaggatg

SEQ ID NO: 9368093 - DNA, 22 bp, Homo sapiens
aggccctgcaggagtggggaca

SEQ ID NO: 9368094 - DNA, 22 bp, Homo sapiens
aggccctgcaggagtggggaca

SEQ ID NO: 9368095 - DNA, 22 bp, Homo sapiens
aggccctgcattgtactgaggg

SEQ ID NO: 9368096 - DNA, 22 bp, Homo sapiens
acattcatgtcccacttctagc

SEQ ID NO: 9368097 - DNA, 22 bp, Homo sapiens
acattctagatatgttatattt

SEQ ID NO: 9368098 - DNA, 22 bp, Homo sapiens
acattctagaagtctttgcaat

SEQ ID NO: 9368099 - DNA, 22 bp, Homo sapiens
acattctagatatgttatattt

SEQ ID NO: 9368100 - DNA, 22 bp, Homo sapiens
acattcctcagtgccagttgag

SEQ ID NO: 9368101 - DNA, 22 bp, Homo sapiens
acattcctgaatgggcacattt

SEQ ID NO: 9368102 - DNA, 22 bp, Homo sapiens
acattcccttggcttgaagcag

SEQ ID NO: 9368103 - DNA, 22 bp, Homo sapiens
acattccaggttggtgcagggt

SEQ ID NO: 9368104 - DNA, 22 bp, Homo sapiens
acattcattgccagggtggaag

SEQ ID NO: 9368105 - DNA, 22 bp, Homo sapiens
aggaggggcatagaaatgtaat

SEQ ID NO: 9368106 - DNA, 22 bp, Homo sapiens
aggaggggcatagaaatgtaat

SEQ ID NO: 9368107 - DNA, 21 bp, Homo sapiens
aggaggggtctttcccactga

SEQ ID NO: 9368108 - DNA, 22 bp, Homo sapiens
aggagggagatgcccatcctgg

SEQ ID NO: 9368109 - DNA, 22 bp, Homo sapiens
aggagggagatgcccatcctgg

SEQ ID NO: 9368110 - DNA, 20 bp, Homo sapiens
aggagggacctggattggcg

SEQ ID NO: 9368111 - DNA, 22 bp, Homo sapiens
aggagggacctaggaatattgc

SEQ ID NO: 9368112 - DNA, 20 bp, Homo sapiens
aggagggacctggattggcg

SEQ ID NO: 9368113 - DNA, 22 bp, Homo sapiens
aggagggacaccaatatatgtt

SEQ ID NO: 9368114 - DNA, 22 bp, Homo sapiens
aggaggctgtggagcactccat

SEQ ID NO: 9368115 - DNA, 22 bp, Homo sapiens
aggaggccgatttcagaggtcg

SEQ ID NO: 9368116 - DNA, 22 bp, Homo sapiens
aggaggcttttgcaggtgccac

SEQ ID NO: 9368117 - DNA, 22 bp, Homo sapiens
aggaggcttttgcaggtgccac

SEQ ID NO: 9368118 - DNA, 22 bp, Homo sapiens
aggaggcttttgcaggtgccac

SEQ ID NO: 9368119 - DNA, 22 bp, Homo sapiens
aggaggcttttgcaggtgccac

SEQ ID NO: 9368120 - DNA, 22 bp, Homo sapiens
aggaggggttctcgggtgctga

SEQ ID NO: 9368121 - DNA, 22 bp, Homo sapiens
aggaggggttctcgggtgctga

SEQ ID NO: 9368122 - DNA, 22 bp, Homo sapiens
aggaggggttctcgggtgctga

SEQ ID NO: 9368123 - DNA, 22 bp, Homo sapiens
aggaggggttctcgggtgctga

SEQ ID NO: 9368124 - DNA, 22 bp, Homo sapiens
aggagggtacaatgggtggaaa

SEQ ID NO: 9368125 - DNA, 22 bp, Homo sapiens
aggagggtcatgttgaagtgta

SEQ ID NO: 9368126 - DNA, 20 bp, Homo sapiens
aggatggcaagcaagtgcat

SEQ ID NO: 9368127 - DNA, 20 bp, Homo sapiens
aggatggcaagcaagtgcat

SEQ ID NO: 9368128 - DNA, 22 bp, Homo sapiens
aggcaaagaagttggtcaggag

SEQ ID NO: 9368129 - DNA, 22 bp, Homo sapiens
aggcaaagaagttggtcaggag

SEQ ID NO: 9368130 - DNA, 22 bp, Homo sapiens
aggatggcttgcaggaggctgt

SEQ ID NO: 9368131 - DNA, 22 bp, Homo sapiens
aggattttgctttataaaagcc

SEQ ID NO: 9368132 - DNA, 21 bp, Homo sapiens
acatacataccttaccacctt

SEQ ID NO: 9368133 - DNA, 22 bp, Homo sapiens
acatacatatgtttaaatgcat

SEQ ID NO: 9368134 - DNA, 22 bp, Homo sapiens
acatacatcaagtatcacaaga

SEQ ID NO: 9368135 - DNA, 23 bp, Homo sapiens
acatacatggagataaagtgatg

SEQ ID NO: 9368136 - DNA, 22 bp, Homo sapiens
acatacatcaagtatcacaaga

SEQ ID NO: 9368137 - DNA, 22 bp, Homo sapiens
acatacatcaagtatcacaaga

SEQ ID NO: 9368138 - DNA, 22 bp, Homo sapiens
acatacatcaagtatcacaaga

SEQ ID NO: 9368139 - DNA, 22 bp, Homo sapiens
acatacacaagcgtacatgaac

SEQ ID NO: 9368140 - DNA, 22 bp, Homo sapiens
acatacacaagcgtacatgaac

SEQ ID NO: 9368141 - DNA, 22 bp, Homo sapiens
acatacacatgaatatattttt

SEQ ID NO: 9368142 - DNA, 22 bp, Homo sapiens
acatacacatgaatatattttt

SEQ ID NO: 9368143 - DNA, 22 bp, Homo sapiens
acatacacaagcgtacatgaac

SEQ ID NO: 9368144 - DNA, 22 bp, Homo sapiens
acataacaatcataggacatag

SEQ ID NO: 9368145 - DNA, 23 bp, Homo sapiens
acatacataagcaccacattttg

SEQ ID NO: 9368146 - DNA, 23 bp, Homo sapiens
acatacataagcaccacattttg

SEQ ID NO: 9368147 - DNA, 22 bp, Homo sapiens
acatacacatgaatatattttt

SEQ ID NO: 9368148 - DNA, 22 bp, Homo sapiens
acatacacgggaaacctctttt

SEQ ID NO: 9368149 - DNA, 22 bp, Homo sapiens
acatacagacctgcagggcagc

SEQ ID NO: 9368150 - DNA, 22 bp, Homo sapiens
aggcaacaggaaaccacatgat

SEQ ID NO: 9368151 - DNA, 22 bp, Homo sapiens
aggcaacaggaaaccacatgat

SEQ ID NO: 9368152 - DNA, 22 bp, Homo sapiens
aggcaacaggaaaccacatgat

SEQ ID NO: 9368153 - DNA, 22 bp, Homo sapiens
aggcaacatgggccaggcagaa

SEQ ID NO: 9368154 - DNA, 22 bp, Homo sapiens
aggcaacatgggccaggcagaa

SEQ ID NO: 9368155 - DNA, 19 bp, Homo sapiens
aggcaaccaatgaggcaaa

SEQ ID NO: 9368156 - DNA, 22 bp, Homo sapiens
aggcacagaatggcattcagtg

SEQ ID NO: 9368157 - DNA, 22 bp, Homo sapiens
aggcacagagaatgccctccat

SEQ ID NO: 9368158 - DNA, 18 bp, Homo sapiens
aggcacagagcatacata

SEQ ID NO: 9368159 - DNA, 18 bp, Homo sapiens
aggcacagagcatacata

SEQ ID NO: 9368160 - DNA, 22 bp, Homo sapiens
aggcacagagaatgccctccat

SEQ ID NO: 9368161 - DNA, 22 bp, Homo sapiens
aggcacagaatggcattcagtg

SEQ ID NO: 9368162 - DNA, 22 bp, Homo sapiens
acataaatttcactgttccgtg

SEQ ID NO: 9368163 - DNA, 22 bp, Homo sapiens
aggcacagatttggggaaagca

SEQ ID NO: 9368164 - DNA, 22 bp, Homo sapiens
aggcacagatttggggaaagca

SEQ ID NO: 9368165 - DNA, 18 bp, Homo sapiens
aggcacagagcatacata

SEQ ID NO: 9368166 - DNA, 18 bp, Homo sapiens
aggcacagagcatacata

SEQ ID NO: 9368167 - DNA, 23 bp, Homo sapiens
aggagacagggaagtgcctggct

SEQ ID NO: 9368168 - DNA, 22 bp, Homo sapiens
aggagacagccaggggcctgag

SEQ ID NO: 9368169 - DNA, 22 bp, Homo sapiens
aggagacagccaggggcctgag

SEQ ID NO: 9368170 - DNA, 23 bp, Homo sapiens
aggagacagggaagtgcctggct

SEQ ID NO: 9368171 - DNA, 17 bp, Homo sapiens
aggaagggcaagtttct

SEQ ID NO: 9368172 - DNA, 17 bp, Homo sapiens
aggaagggcaagtttct

SEQ ID NO: 9368173 - DNA, 22 bp, Homo sapiens
aggaagggatacataggatagt

SEQ ID NO: 9368174 - DNA, 22 bp, Homo sapiens
aggaagggatacataggatagt

SEQ ID NO: 9368175 - DNA, 22 bp, Homo sapiens
aggaagggatacataggatagt

SEQ ID NO: 9368176 - DNA, 22 bp, Homo sapiens
aggaagggatacataggatagt

SEQ ID NO: 9368177 - DNA, 22 bp, Homo sapiens
aggaagggatacataggatagt

SEQ ID NO: 9368178 - DNA, 22 bp, Homo sapiens
acaggggctccgaaggtgaggg

SEQ ID NO: 9368179 - DNA, 22 bp, Homo sapiens
aggagactcagagacctggccg

SEQ ID NO: 9368180 - DNA, 22 bp, Homo sapiens
aggagactcagagacctggccg

SEQ ID NO: 9368181 - DNA, 22 bp, Homo sapiens
aggagaccttttgagtgtgaga

SEQ ID NO: 9368182 - DNA, 21 bp, Homo sapiens
aggagaccggcttgtttgtgc

SEQ ID NO: 9368183 - DNA, 22 bp, Homo sapiens
aggagacatactataggaatat

SEQ ID NO: 9368184 - DNA, 22 bp, Homo sapiens
aggagacatctaactgtaggtt

SEQ ID NO: 9368185 - DNA, 22 bp, Homo sapiens
aggaagctaaccagggagtgag

SEQ ID NO: 9368186 - DNA, 22 bp, Homo sapiens
aggaagctaaccagggagtgag

SEQ ID NO: 9368187 - DNA, 23 bp, Homo sapiens
aggaagctaagtgtggctgcgga

SEQ ID NO: 9368188 - DNA, 23 bp, Homo sapiens
aggaagctaagtgtggctgcgga

SEQ ID NO: 9368189 - DNA, 20 bp, Homo sapiens
aggaaggagaatctgagcaa

SEQ ID NO: 9368190 - DNA, 22 bp, Homo sapiens
aggaagctagagccaccggact

SEQ ID NO: 9368191 - DNA, 22 bp, Homo sapiens
aggaagctagaaggtcttcttt

SEQ ID NO: 9368192 - DNA, 23 bp, Homo sapiens
aggaagctaccaattttgtaggc

SEQ ID NO: 9368193 - DNA, 22 bp, Homo sapiens
aggaagcccaagtctcatcttc

SEQ ID NO: 9368194 - DNA, 22 bp, Homo sapiens
aggaagccatggtggacgtcta

SEQ ID NO: 9368195 - DNA, 22 bp, Homo sapiens
aggaagcctggcattaaaaagc

SEQ ID NO: 9368196 - DNA, 22 bp, Homo sapiens
aggaagcctgcaggtgactgct

SEQ ID NO: 9368197 - DNA, 22 bp, Homo sapiens
aggaagcctggggctgccctcg

SEQ ID NO: 9368198 - DNA, 17 bp, Homo sapiens
aggaagcgagctggcct

SEQ ID NO: 9368199 - DNA, 22 bp, Homo sapiens
aggaagcgtgggtctggctgga

SEQ ID NO: 9368200 - DNA, 22 bp, Homo sapiens
aggaaggctgatcactgcttgt

SEQ ID NO: 9368201 - DNA, 19 bp, Homo sapiens
aggaaggcggcggctgccc

SEQ ID NO: 9368202 - DNA, 20 bp, Homo sapiens
aggaaggctgttggccttgc

SEQ ID NO: 9368203 - DNA, 22 bp, Homo sapiens
aggaaggagggcagatattaag

SEQ ID NO: 9368204 - DNA, 22 bp, Homo sapiens
aggaaggcacattgttggctaa

SEQ ID NO: 9368205 - DNA, 22 bp, Homo sapiens
acagggtggggatggtgagctt

SEQ ID NO: 9368206 - DNA, 22 bp, Homo sapiens
acagggtgactttgtgacagat

SEQ ID NO: 9368207 - DNA, 22 bp, Homo sapiens
acagggtgactttgtgacagat

SEQ ID NO: 9368208 - DNA, 22 bp, Homo sapiens
acagggtgaatgtgacattatc

SEQ ID NO: 9368209 - DNA, 22 bp, Homo sapiens
acagggtcttagagatcacctg

SEQ ID NO: 9368210 - DNA, 22 bp, Homo sapiens
acagggtcattttatgatctgt

SEQ ID NO: 9368211 - DNA, 22 bp, Homo sapiens
acagggtcaagggtgctacaag

SEQ ID NO: 9368212 - DNA, 22 bp, Homo sapiens
acagggggtcccatggcctgga

SEQ ID NO: 9368213 - DNA, 22 bp, Homo sapiens
aggagccattgcaggatggcag

SEQ ID NO: 9368214 - DNA, 20 bp, Homo sapiens
aggagccattgactgcagca

SEQ ID NO: 9368215 - DNA, 20 bp, Homo sapiens
aggagccattgactgcagca

SEQ ID NO: 9368216 - DNA, 22 bp, Homo sapiens
aggagcagaccgtagtcctgca

SEQ ID NO: 9368217 - DNA, 22 bp, Homo sapiens
aggagcagaccgtagtcctgca

SEQ ID NO: 9368218 - DNA, 22 bp, Homo sapiens
aggagccatggaggtgaggcgg

SEQ ID NO: 9368219 - DNA, 22 bp, Homo sapiens
aggagcctgaatcagagggtga

SEQ ID NO: 9368220 - DNA, 22 bp, Homo sapiens
aggagcctccttctcatgtgca

SEQ ID NO: 9368221 - DNA, 22 bp, Homo sapiens
aggagcctggctggcccacagg

SEQ ID NO: 9368222 - DNA, 22 bp, Homo sapiens
aggagctgcaaaaccggccgct

SEQ ID NO: 9368223 - DNA, 22 bp, Homo sapiens
aggagccctccgttgcttcatc

SEQ ID NO: 9368224 - DNA, 23 bp, Homo sapiens
aggagcccctaattctgggcagc

SEQ ID NO: 9368225 - DNA, 22 bp, Homo sapiens
aggagcccctcttcagtcctgg

SEQ ID NO: 9368226 - DNA, 22 bp, Homo sapiens
aggagcccctcttcagtcctgg

SEQ ID NO: 9368227 - DNA, 22 bp, Homo sapiens
aggagccattttccaagggcga

SEQ ID NO: 9368228 - DNA, 22 bp, Homo sapiens
aggagctgcttaaatggttggt

SEQ ID NO: 9368229 - DNA, 22 bp, Homo sapiens
aggagctgctttggtgcggttt

SEQ ID NO: 9368230 - DNA, 22 bp, Homo sapiens
aggagctgctttggtgcggttt

SEQ ID NO: 9368231 - DNA, 22 bp, Homo sapiens
aggagctgcttaaatggttggt

SEQ ID NO: 9368232 - DNA, 22 bp, Homo sapiens
aggagctgcttaaatggttggt

SEQ ID NO: 9368233 - DNA, 22 bp, Homo sapiens
aggagctggagtccaggcaagt

SEQ ID NO: 9368234 - DNA, 22 bp, Homo sapiens
aggagctggaatggtccttttg

SEQ ID NO: 9368235 - DNA, 22 bp, Homo sapiens
aggagctggaatggtccttttg

SEQ ID NO: 9368236 - DNA, 22 bp, Homo sapiens
aggagctgctttggtgcggttt

SEQ ID NO: 9368237 - DNA, 22 bp, Homo sapiens
aggagctgctttggtgcggttt

SEQ ID NO: 9368238 - DNA, 22 bp, Homo sapiens
aggagctgctttggtgcggttt

SEQ ID NO: 9368239 - DNA, 22 bp, Homo sapiens
aggagctgcactgggagttttt

SEQ ID NO: 9368240 - DNA, 22 bp, Homo sapiens
aggagctgcactgggagttttt

SEQ ID NO: 9368241 - DNA, 22 bp, Homo sapiens
aggagctgcagattctgccttg

SEQ ID NO: 9368242 - DNA, 22 bp, Homo sapiens
aggagctgcatggatacctggt

SEQ ID NO: 9368243 - DNA, 22 bp, Homo sapiens
aggagctgcatggatacctggt

SEQ ID NO: 9368244 - DNA, 22 bp, Homo sapiens
aggagctgcatggatacctggt

SEQ ID NO: 9368245 - DNA, 22 bp, Homo sapiens
aggagctgcagattctgccttg

SEQ ID NO: 9368246 - DNA, 22 bp, Homo sapiens
aggagctgcagattctgccttg

SEQ ID NO: 9368247 - DNA, 22 bp, Homo sapiens
aggaagccacgagtggcacggg

SEQ ID NO: 9368248 - DNA, 18 bp, Homo sapiens
aggaagcaggaggaaggc

SEQ ID NO: 9368249 - DNA, 22 bp, Homo sapiens
aggaagagcattcacatggtag

SEQ ID NO: 9368250 - DNA, 18 bp, Homo sapiens
aggaagcaggaggaaggc

SEQ ID NO: 9368251 - DNA, 18 bp, Homo sapiens
aggaaagaaaggcaggtg

SEQ ID NO: 9368252 - DNA, 22 bp, Homo sapiens
aggaaagaaaggaggtgcattt

SEQ ID NO: 9368253 - DNA, 22 bp, Homo sapiens
aggaaactgtcccctcatccta

SEQ ID NO: 9368254 - DNA, 22 bp, Homo sapiens
aggaaactgggtatggttatac

SEQ ID NO: 9368255 - DNA, 22 bp, Homo sapiens
aggaaactgggtatggttatac

SEQ ID NO: 9368256 - DNA, 22 bp, Homo sapiens
aggaaactgggcctcaggttag

SEQ ID NO: 9368257 - DNA, 22 bp, Homo sapiens
aggaaactgatgttttttacaa

SEQ ID NO: 9368258 - DNA, 22 bp, Homo sapiens
aggaaactgatgttttttacaa

SEQ ID NO: 9368259 - DNA, 22 bp, Homo sapiens
aggaaactttcttttgcttcat

SEQ ID NO: 9368260 - DNA, 22 bp, Homo sapiens
aggaaacttcagagttttggtc

SEQ ID NO: 9368261 - DNA, 22 bp, Homo sapiens
aggaaacttcagagttttggtc

SEQ ID NO: 9368262 - DNA, 19 bp, Homo sapiens
aggaaactgtcttttccag

SEQ ID NO: 9368263 - DNA, 22 bp, Homo sapiens
aggaaactaacttatctttata

SEQ ID NO: 9368264 - DNA, 22 bp, Homo sapiens
aggaaactaacttatctttata

SEQ ID NO: 9368265 - DNA, 22 bp, Homo sapiens
aggaaactaaggctcagtgaag

SEQ ID NO: 9368266 - DNA, 22 bp, Homo sapiens
aggaaactaattagtagaataa

SEQ ID NO: 9368267 - DNA, 22 bp, Homo sapiens
aggaaactaattagtagaataa

SEQ ID NO: 9368268 - DNA, 22 bp, Homo sapiens
aggaaactcaaagtgtcaggta

SEQ ID NO: 9368269 - DNA, 22 bp, Homo sapiens
aggaaactcccctacatctcaa

SEQ ID NO: 9368270 - DNA, 22 bp, Homo sapiens
aggaaactgaggttacgggact

SEQ ID NO: 9368271 - DNA, 23 bp, Homo sapiens
aggaaactgaaggggccctctat

SEQ ID NO: 9368272 - DNA, 22 bp, Homo sapiens
aggaaactgaagcccagagagg

SEQ ID NO: 9368273 - DNA, 22 bp, Homo sapiens
aggaaactctgagcggaccagc

SEQ ID NO: 9368274 - DNA, 22 bp, Homo sapiens
aggaaaaagagttgctgccttc

SEQ ID NO: 9368275 - DNA, 21 bp, Homo sapiens
agcttttctgttttatatcta

SEQ ID NO: 9368276 - DNA, 22 bp, Homo sapiens
agctttttcactttggatggga

SEQ ID NO: 9368277 - DNA, 19 bp, Homo sapiens
agcttttactaacagcaga

SEQ ID NO: 9368278 - DNA, 22 bp, Homo sapiens
agcttttacataatgatcttga

SEQ ID NO: 9368279 - DNA, 22 bp, Homo sapiens
agctttatggtgcctcacttga

SEQ ID NO: 9368280 - DNA, 22 bp, Homo sapiens
agcttccaatttctccaagaga

SEQ ID NO: 9368281 - DNA, 22 bp, Homo sapiens
agctttatggtgcctcacttga

SEQ ID NO: 9368282 - DNA, 22 bp, Homo sapiens
agctttggtgctgtcacacaaa

SEQ ID NO: 9368283 - DNA, 22 bp, Homo sapiens
agctttggttgaggggagtgtg

SEQ ID NO: 9368284 - DNA, 23 bp, Homo sapiens
agctttgtgaaagcagacatggg

SEQ ID NO: 9368285 - DNA, 22 bp, Homo sapiens
agctgggagctgaaggctgatt

SEQ ID NO: 9368286 - DNA, 22 bp, Homo sapiens
agctgggagctgaaggctgatt

SEQ ID NO: 9368287 - DNA, 22 bp, Homo sapiens
agctgggagcagagccacagcc

SEQ ID NO: 9368288 - DNA, 22 bp, Homo sapiens
agctgggagcagagccacagcc

SEQ ID NO: 9368289 - DNA, 22 bp, Homo sapiens
agctgggagcagagccacagcc

SEQ ID NO: 9368290 - DNA, 22 bp, Homo sapiens
agctgggaggctcctctgtgac

SEQ ID NO: 9368291 - DNA, 22 bp, Homo sapiens
agctgggatgaggagcatcctt

SEQ ID NO: 9368292 - DNA, 22 bp, Homo sapiens
agctgggatgaggagcatcctt

SEQ ID NO: 9368293 - DNA, 22 bp, Homo sapiens
agctgggaggtgggcagtgaga

SEQ ID NO: 9368294 - DNA, 22 bp, Homo sapiens
agctgggatgataacctcagtc

SEQ ID NO: 9368295 - DNA, 22 bp, Homo sapiens
agctgggcaaaatgtgaggttg

SEQ ID NO: 9368296 - DNA, 22 bp, Homo sapiens
agctggttcagaaattagatgg

SEQ ID NO: 9368297 - DNA, 21 bp, Homo sapiens
agctgtggcgaggggaacatg

SEQ ID NO: 9368298 - DNA, 22 bp, Homo sapiens
agctgtgggcctgggagagctg

SEQ ID NO: 9368299 - DNA, 22 bp, Homo sapiens
agctgtgggagaatctctgggt

SEQ ID NO: 9368300 - DNA, 22 bp, Homo sapiens
agcttattcatcttgtgaccta

SEQ ID NO: 9368301 - DNA, 22 bp, Homo sapiens
agcttattatcttatcaagctt

SEQ ID NO: 9368302 - DNA, 22 bp, Homo sapiens
agcttattatcttatcaagctt

SEQ ID NO: 9368303 - DNA, 22 bp, Homo sapiens
agcttagtggttgtatgagtta

SEQ ID NO: 9368304 - DNA, 22 bp, Homo sapiens
agcttattaatttttctgcatg

SEQ ID NO: 9368305 - DNA, 22 bp, Homo sapiens
agcttatcttgttagtttcatt

SEQ ID NO: 9368306 - DNA, 22 bp, Homo sapiens
agcttattaatttttctgcatg

SEQ ID NO: 9368307 - DNA, 22 bp, Homo sapiens
agctgtgggcctgggagagctg

SEQ ID NO: 9368308 - DNA, 22 bp, Homo sapiens
agctgtggggaggaggctagca

SEQ ID NO: 9368309 - DNA, 22 bp, Homo sapiens
agctgtggggcaggcagcgagg

SEQ ID NO: 9368310 - DNA, 22 bp, Homo sapiens
agctgtggggcaggcagcgagg

SEQ ID NO: 9368311 - DNA, 19 bp, Homo sapiens
agctgtggggcctagcacc

SEQ ID NO: 9368312 - DNA, 21 bp, Homo sapiens
agctgtggttttacatctttt

SEQ ID NO: 9368313 - DNA, 22 bp, Homo sapiens
agctgtggtcttcaagttgcct

SEQ ID NO: 9368314 - DNA, 22 bp, Homo sapiens
agctgtggtacttgattcacaa

SEQ ID NO: 9368315 - DNA, 22 bp, Homo sapiens
agctgtggtgttttcaagccct

SEQ ID NO: 9368316 - DNA, 22 bp, Homo sapiens
agctgtggttagatagagtcct

SEQ ID NO: 9368317 - DNA, 22 bp, Homo sapiens
agctgtggttagatagagtcct

SEQ ID NO: 9368318 - DNA, 22 bp, Homo sapiens
acagcctgatttatggagcagt

SEQ ID NO: 9368319 - DNA, 20 bp, Homo sapiens
agctggcctgtcctaggcct

SEQ ID NO: 9368320 - DNA, 20 bp, Homo sapiens
agctggcctgtcctaggcct

SEQ ID NO: 9368321 - DNA, 22 bp, Homo sapiens
agctggcagctctcaggggtac

SEQ ID NO: 9368322 - DNA, 22 bp, Homo sapiens
agctggcaggggttcacactgc

SEQ ID NO: 9368323 - DNA, 22 bp, Homo sapiens
agctggcaggggttcacactgc

SEQ ID NO: 9368324 - DNA, 19 bp, Homo sapiens
agctggcagcttccacttc

SEQ ID NO: 9368325 - DNA, 21 bp, Homo sapiens
agctggctctctctggagaga

SEQ ID NO: 9368326 - DNA, 21 bp, Homo sapiens
agctggctctctctggagaga

SEQ ID NO: 9368327 - DNA, 22 bp, Homo sapiens
agctggctatgccctgtgaacc

SEQ ID NO: 9368328 - DNA, 22 bp, Homo sapiens
agctggcctgttagagctgagt

SEQ ID NO: 9368329 - DNA, 22 bp, Homo sapiens
agctggcctgttagagctgagt

SEQ ID NO: 9368330 - DNA, 22 bp, Homo sapiens
agctggccttagtgagcacctg

SEQ ID NO: 9368331 - DNA, 21 bp, Homo sapiens
agctggctatagttagtgatg

SEQ ID NO: 9368332 - DNA, 22 bp, Homo sapiens
agctggctatacttgaaaagtc

SEQ ID NO: 9368333 - DNA, 22 bp, Homo sapiens
agctggctatacttgaaaagtc

SEQ ID NO: 9368334 - DNA, 22 bp, Homo sapiens
agctggccttcggtgtcactgg

SEQ ID NO: 9368335 - DNA, 22 bp, Homo sapiens
agctggctatacttgaaaagtc

SEQ ID NO: 9368336 - DNA, 22 bp, Homo sapiens
acagccccagcgcggcggggtc

SEQ ID NO: 9368337 - DNA, 23 bp, Homo sapiens
acagccccatgcaggtgtgtttg

SEQ ID NO: 9368338 - DNA, 22 bp, Homo sapiens
acagcccaggactccagtgggc

SEQ ID NO: 9368339 - DNA, 22 bp, Homo sapiens
acagccccccgctcagtttcca

SEQ ID NO: 9368340 - DNA, 22 bp, Homo sapiens
acagcccgtgtcatcagctgct

SEQ ID NO: 9368341 - DNA, 22 bp, Homo sapiens
acagcccgttctctggcacaca

SEQ ID NO: 9368342 - DNA, 22 bp, Homo sapiens
acagcccgttctctggcacaca

SEQ ID NO: 9368343 - DNA, 22 bp, Homo sapiens
acagcccagaaagcctaagggg

SEQ ID NO: 9368344 - DNA, 22 bp, Homo sapiens
agctgctgtcctaggcactgta

SEQ ID NO: 9368345 - DNA, 22 bp, Homo sapiens
agctgctgtggccacatctggc

SEQ ID NO: 9368346 - DNA, 22 bp, Homo sapiens
agctgctgtcctaggcactgta

SEQ ID NO: 9368347 - DNA, 22 bp, Homo sapiens
agctgctgtcctaggcactgta

SEQ ID NO: 9368348 - DNA, 22 bp, Homo sapiens
agctgctggtttaagggatggg

SEQ ID NO: 9368349 - DNA, 22 bp, Homo sapiens
agctgctggtttaagggatggg

SEQ ID NO: 9368350 - DNA, 22 bp, Homo sapiens
agctgctggtttaagggatggg

SEQ ID NO: 9368351 - DNA, 21 bp, Homo sapiens
agctgctgtggccagaatcca

SEQ ID NO: 9368352 - DNA, 22 bp, Homo sapiens
agctgctgtggccacatctggc

SEQ ID NO: 9368353 - DNA, 22 bp, Homo sapiens
agctgctgtggccacatctggc

SEQ ID NO: 9368354 - DNA, 22 bp, Homo sapiens
agctccaggtgcaagtcatggt

SEQ ID NO: 9368355 - DNA, 22 bp, Homo sapiens
agctccaggtgcaagtcatggt

SEQ ID NO: 9368356 - DNA, 20 bp, Homo sapiens
agctccagtgctgacgcttc

SEQ ID NO: 9368357 - DNA, 22 bp, Homo sapiens
agctcccagaagccagagtcgg

SEQ ID NO: 9368358 - DNA, 22 bp, Homo sapiens
acagccagaggtggtcctgggt

SEQ ID NO: 9368359 - DNA, 22 bp, Homo sapiens
agctccagtttcctgactgagc

SEQ ID NO: 9368360 - DNA, 22 bp, Homo sapiens
acagccagtcatctcagcaggg

SEQ ID NO: 9368361 - DNA, 22 bp, Homo sapiens
acagccagtaatctacccctgt

SEQ ID NO: 9368362 - DNA, 22 bp, Homo sapiens
acagccagtcctcccacagggt

SEQ ID NO: 9368363 - DNA, 22 bp, Homo sapiens
acagccagtgactgcagaccct

SEQ ID NO: 9368364 - DNA, 22 bp, Homo sapiens
acagccaggtaaaggcatggca

SEQ ID NO: 9368365 - DNA, 22 bp, Homo sapiens
acagccaggtaaaggcatggca

SEQ ID NO: 9368366 - DNA, 22 bp, Homo sapiens
acagccagggtctcaggaggcg

SEQ ID NO: 9368367 - DNA, 22 bp, Homo sapiens
acagccagtaaggaaagaccca

SEQ ID NO: 9368368 - DNA, 22 bp, Homo sapiens
acagccagtaaggaaagaccca

SEQ ID NO: 9368369 - DNA, 22 bp, Homo sapiens
agctgcagccgcagctgtggcc

SEQ ID NO: 9368370 - DNA, 22 bp, Homo sapiens
agctgcagcctcatgattcggt

SEQ ID NO: 9368371 - DNA, 22 bp, Homo sapiens
agctgcagccgcagctgtggcc

SEQ ID NO: 9368372 - DNA, 22 bp, Homo sapiens
agctgcagccgcagctgtggcc

SEQ ID NO: 9368373 - DNA, 22 bp, Homo sapiens
agctgcagccctcctgcatggc

SEQ ID NO: 9368374 - DNA, 22 bp, Homo sapiens
agctgcagccctcctgcatggc

SEQ ID NO: 9368375 - DNA, 22 bp, Homo sapiens
acagccagtgctccgtgaggac

SEQ ID NO: 9368376 - DNA, 22 bp, Homo sapiens
acagccagtgactggacaagct

SEQ ID NO: 9368377 - DNA, 22 bp, Homo sapiens
acagccagtgactggacaagct

SEQ ID NO: 9368378 - DNA, 23 bp, Homo sapiens
acagccagttcacctctccttgg

SEQ ID NO: 9368379 - DNA, 23 bp, Homo sapiens
acagccagttcacctctccttgg

SEQ ID NO: 9368380 - DNA, 22 bp, Homo sapiens
acagcccaagtcacctgcagga

SEQ ID NO: 9368381 - DNA, 22 bp, Homo sapiens
agctgcagcttcctagtccagc

SEQ ID NO: 9368382 - DNA, 22 bp, Homo sapiens
agctgcaggaagtagaagcgga

SEQ ID NO: 9368383 - DNA, 22 bp, Homo sapiens
agctgcaggaagtagaagcgga

SEQ ID NO: 9368384 - DNA, 22 bp, Homo sapiens
agctgcaggagtcgcctaggat

SEQ ID NO: 9368385 - DNA, 22 bp, Homo sapiens
agctgcaggagtcgcctaggat

SEQ ID NO: 9368386 - DNA, 22 bp, Homo sapiens
agctgcagctacagtgttggtt

SEQ ID NO: 9368387 - DNA, 22 bp, Homo sapiens
agctgcagctgttttctgagtg

SEQ ID NO: 9368388 - DNA, 22 bp, Homo sapiens
agctgcagcgttcatttttcca

SEQ ID NO: 9368389 - DNA, 22 bp, Homo sapiens
agctgcagctacagtgttggtt

SEQ ID NO: 9368390 - DNA, 22 bp, Homo sapiens
agctgcagctacagtgttggtt

SEQ ID NO: 9368391 - DNA, 22 bp, Homo sapiens
agctgcaggcccatgctcagtc

SEQ ID NO: 9368392 - DNA, 22 bp, Homo sapiens
agctgcaggattatggaatgga

SEQ ID NO: 9368393 - DNA, 22 bp, Homo sapiens
agctgcaggattatggaatgga

SEQ ID NO: 9368394 - DNA, 22 bp, Homo sapiens
agctgctcaggagagccaggtc

SEQ ID NO: 9368395 - DNA, 22 bp, Homo sapiens
agctgctcattactttctgttg

SEQ ID NO: 9368396 - DNA, 23 bp, Homo sapiens
actgccagttttaccacagacgg

SEQ ID NO: 9368397 - DNA, 21 bp, Homo sapiens
actgccaggagagtaggggga

SEQ ID NO: 9368398 - DNA, 22 bp, Homo sapiens
actgccaggatggcactagagg

SEQ ID NO: 9368399 - DNA, 22 bp, Homo sapiens
actgccaggtaagtgctcctgc

SEQ ID NO: 9368400 - DNA, 22 bp, Homo sapiens
actgccaatggtagtttgatgg

SEQ ID NO: 9368401 - DNA, 22 bp, Homo sapiens
actgccctccagcctgggtgac

SEQ ID NO: 9368402 - DNA, 22 bp, Homo sapiens
actgccctcccatctattgcaa

SEQ ID NO: 9368403 - DNA, 22 bp, Homo sapiens
actgcctgagctattggaaaag

SEQ ID NO: 9368404 - DNA, 22 bp, Homo sapiens
actgccctgtaactgccaggta

SEQ ID NO: 9368405 - DNA, 22 bp, Homo sapiens
actgcccttgtcctggcacacc

SEQ ID NO: 9368406 - DNA, 19 bp, Homo sapiens
actgcctgaggctcacagg

SEQ ID NO: 9368407 - DNA, 22 bp, Homo sapiens
actgcctgatgtggttctaaat

SEQ ID NO: 9368408 - DNA, 22 bp, Homo sapiens
actgcctgctcataacattgct

SEQ ID NO: 9368409 - DNA, 22 bp, Homo sapiens
actggctgcggggtggaagaag

SEQ ID NO: 9368410 - DNA, 22 bp, Homo sapiens
actggctgcgatcttggcgctt

SEQ ID NO: 9368411 - DNA, 20 bp, Homo sapiens
actggctgcctggaatgcgc

SEQ ID NO: 9368412 - DNA, 22 bp, Homo sapiens
actggctgcgttcctgtgagac

SEQ ID NO: 9368413 - DNA, 22 bp, Homo sapiens
actggctggactctgacctctt

SEQ ID NO: 9368414 - DNA, 22 bp, Homo sapiens
actggctggagttgccaaggct

SEQ ID NO: 9368415 - DNA, 22 bp, Homo sapiens
actggctgcctccaaagtgtgc

SEQ ID NO: 9368416 - DNA, 22 bp, Homo sapiens
actggctgcctccaaagtgtgc

SEQ ID NO: 9368417 - DNA, 21 bp, Homo sapiens
actggctgccatgatccaggg

SEQ ID NO: 9368418 - DNA, 22 bp, Homo sapiens
actggctgatcacctgcctcag

SEQ ID NO: 9368419 - DNA, 21 bp, Homo sapiens
actggccaccactggcagggg

SEQ ID NO: 9368420 - DNA, 22 bp, Homo sapiens
actgcctgtagctcttcatctc

SEQ ID NO: 9368421 - DNA, 22 bp, Homo sapiens
actggctgatatggctaggaag

SEQ ID NO: 9368422 - DNA, 22 bp, Homo sapiens
actgggccgcgctgcagagggc

SEQ ID NO: 9368423 - DNA, 22 bp, Homo sapiens
actgggcatgatgagtcaccta

SEQ ID NO: 9368424 - DNA, 22 bp, Homo sapiens
actgggcatcccatggcagagc

SEQ ID NO: 9368425 - DNA, 22 bp, Homo sapiens
actgggcattttgaacgttctt

SEQ ID NO: 9368426 - DNA, 18 bp, Homo sapiens
actgggccagcaggcagg

SEQ ID NO: 9368427 - DNA, 20 bp, Homo sapiens
actgggagctaacggagatt

SEQ ID NO: 9368428 - DNA, 21 bp, Homo sapiens
agtgtctctggaagcacgtgt

SEQ ID NO: 9368429 - DNA, 21 bp, Homo sapiens
agtgtccttttactgtgaata

SEQ ID NO: 9368430 - DNA, 22 bp, Homo sapiens
agtgtcctttctgttccagcca

SEQ ID NO: 9368431 - DNA, 21 bp, Homo sapiens
agtgtccttttactgtgaata

SEQ ID NO: 9368432 - DNA, 22 bp, Homo sapiens
agtgtctcagccccaactagag

SEQ ID NO: 9368433 - DNA, 20 bp, Homo sapiens
actgggcatacctgtcctgt

SEQ ID NO: 9368434 - DNA, 22 bp, Homo sapiens
actgggcagcagctcgagccgc

SEQ ID NO: 9368435 - DNA, 22 bp, Homo sapiens
actgggcagggaaggagaccga

SEQ ID NO: 9368436 - DNA, 22 bp, Homo sapiens
agtgtccttgttattactgctc

SEQ ID NO: 9368437 - DNA, 22 bp, Homo sapiens
agtgtccttgttattactgctc

SEQ ID NO: 9368438 - DNA, 22 bp, Homo sapiens
agtgtcctttctgttccagcca

SEQ ID NO: 9368439 - DNA, 22 bp, Homo sapiens
agtgtccttgttattactgctc

SEQ ID NO: 9368440 - DNA, 22 bp, Homo sapiens
agtgtccttgattcctgttgtt

SEQ ID NO: 9368441 - DNA, 21 bp, Homo sapiens
agtgtccttgatcttgccttg

SEQ ID NO: 9368442 - DNA, 22 bp, Homo sapiens
agtgtccttgaggttcctagga

SEQ ID NO: 9368443 - DNA, 21 bp, Homo sapiens
agtgtccttgatcttgccttg

SEQ ID NO: 9368444 - DNA, 22 bp, Homo sapiens
agtgtccttgattcctgttgtt

SEQ ID NO: 9368445 - DNA, 22 bp, Homo sapiens
agtgtccttgaggttcctagga

SEQ ID NO: 9368446 - DNA, 21 bp, Homo sapiens
agtgtccttgatcttgccttg

SEQ ID NO: 9368447 - DNA, 22 bp, Homo sapiens
agtgtccttagttagctttggg

SEQ ID NO: 9368448 - DNA, 22 bp, Homo sapiens
agtgtccttagttagctttggg

SEQ ID NO: 9368449 - DNA, 22 bp, Homo sapiens
agtgtccttagttagctttggg

SEQ ID NO: 9368450 - DNA, 22 bp, Homo sapiens
agtgtcctgtgtcccagactgt

SEQ ID NO: 9368451 - DNA, 22 bp, Homo sapiens
actggctggccacaccctggta

SEQ ID NO: 9368452 - DNA, 21 bp, Homo sapiens
actggctggctgagtttcctg

SEQ ID NO: 9368453 - DNA, 22 bp, Homo sapiens
actggctggccgcgctcttcgc

SEQ ID NO: 9368454 - DNA, 21 bp, Homo sapiens
actggctggtggctaagaatc

SEQ ID NO: 9368455 - DNA, 21 bp, Homo sapiens
actggctggtggctaagaatc

SEQ ID NO: 9368456 - DNA, 21 bp, Homo sapiens
actggctgtcttcctactggt

SEQ ID NO: 9368457 - DNA, 22 bp, Homo sapiens
actggctgtgcagagggcagta

SEQ ID NO: 9368458 - DNA, 22 bp, Homo sapiens
actggctgtggccacggctgct

SEQ ID NO: 9368459 - DNA, 22 bp, Homo sapiens
actggctgtgcccatagagctc

SEQ ID NO: 9368460 - DNA, 22 bp, Homo sapiens
actggctgtgtaacctcaggca

SEQ ID NO: 9368461 - DNA, 22 bp, Homo sapiens
agtgtcctggggccctaaggcc

SEQ ID NO: 9368462 - DNA, 22 bp, Homo sapiens
agtgtcctggcaagggtttcag

SEQ ID NO: 9368463 - DNA, 22 bp, Homo sapiens
agtgtcctgtgtcccagactgt

SEQ ID NO: 9368464 - DNA, 22 bp, Homo sapiens
agtgtcctggggccctaaggcc

SEQ ID NO: 9368465 - DNA, 22 bp, Homo sapiens
agtgtcctggggccctaaggcc

SEQ ID NO: 9368466 - DNA, 22 bp, Homo sapiens
agtgtcctggcaagggtttcag

SEQ ID NO: 9368467 - DNA, 22 bp, Homo sapiens
agtgtcctggcaagggtttcag

SEQ ID NO: 9368468 - DNA, 22 bp, Homo sapiens
agtgctcctttcattgctgccc

SEQ ID NO: 9368469 - DNA, 22 bp, Homo sapiens
agtgctcctgaagcttgaggca

SEQ ID NO: 9368470 - DNA, 22 bp, Homo sapiens
agtgctcctgccagctttctgg

SEQ ID NO: 9368471 - DNA, 22 bp, Homo sapiens
agtgctccctagagttgtgcaa

SEQ ID NO: 9368472 - DNA, 22 bp, Homo sapiens
agtgctcctatggatcagttgt

SEQ ID NO: 9368473 - DNA, 22 bp, Homo sapiens
agtgctcctcagaagagttgga

SEQ ID NO: 9368474 - DNA, 22 bp, Homo sapiens
agtgctcctcagaagagttgga

SEQ ID NO: 9368475 - DNA, 22 bp, Homo sapiens
actgccaatggtagtttgatgg

SEQ ID NO: 9368476 - DNA, 21 bp, Homo sapiens
agtgctgaaaaagcatgtctc

SEQ ID NO: 9368477 - DNA, 23 bp, Homo sapiens
agtgctcccaggacctggggcag

SEQ ID NO: 9368478 - DNA, 22 bp, Homo sapiens
agtgctccacattgcactattc

SEQ ID NO: 9368479 - DNA, 22 bp, Homo sapiens
agtgctccaaaggttggtcatt

SEQ ID NO: 9368480 - DNA, 22 bp, Homo sapiens
agtgctcactctccacagtgcc

SEQ ID NO: 9368481 - DNA, 23 bp, Homo sapiens
agtgctcagggcattaggctaga

SEQ ID NO: 9368482 - DNA, 23 bp, Homo sapiens
agtgctcagggcattaggctaga

SEQ ID NO: 9368483 - DNA, 22 bp, Homo sapiens
agtgctcacctgtcaggtcaag

SEQ ID NO: 9368484 - DNA, 22 bp, Homo sapiens
actgcacttcaccctgggtgac

SEQ ID NO: 9368485 - DNA, 22 bp, Homo sapiens
actgcacttcagcctgggtgac

SEQ ID NO: 9368486 - DNA, 22 bp, Homo sapiens
actgcacttcaccctgggtgac

SEQ ID NO: 9368487 - DNA, 22 bp, Homo sapiens
actgcactccagcctgggtgat

SEQ ID NO: 9368488 - DNA, 22 bp, Homo sapiens
actgcactccagcctgggtgat

SEQ ID NO: 9368489 - DNA, 22 bp, Homo sapiens
actgcactccagcctgggtgat

SEQ ID NO: 9368490 - DNA, 22 bp, Homo sapiens
actgcactcctgcctgggtaac

SEQ ID NO: 9368491 - DNA, 22 bp, Homo sapiens
actgcacttcaccctgggtgac

SEQ ID NO: 9368492 - DNA, 22 bp, Homo sapiens
actgcacttacatagaggaggc

SEQ ID NO: 9368493 - DNA, 22 bp, Homo sapiens
actgcactcctgcctgggtaac

SEQ ID NO: 9368494 - DNA, 22 bp, Homo sapiens
agtgaagaggaagtggggcaca

SEQ ID NO: 9368495 - DNA, 22 bp, Homo sapiens
agtgaagatatactgttgtcct

SEQ ID NO: 9368496 - DNA, 22 bp, Homo sapiens
agtgaatacatgtcactcagca

SEQ ID NO: 9368497 - DNA, 22 bp, Homo sapiens
actgcacatagtgggctggcct

SEQ ID NO: 9368498 - DNA, 22 bp, Homo sapiens
actctgaaccagagatcatacc

SEQ ID NO: 9368499 - DNA, 22 bp, Homo sapiens
actctgaactccaggaggctca

SEQ ID NO: 9368500 - DNA, 22 bp, Homo sapiens
actctgaagaagacttccagac

SEQ ID NO: 9368501 - DNA, 22 bp, Homo sapiens
actctgaaccagagatcatacc

SEQ ID NO: 9368502 - DNA, 22 bp, Homo sapiens
actctgaggagtgactagaggt

SEQ ID NO: 9368503 - DNA, 19 bp, Homo sapiens
actctgaggctgagacaag

SEQ ID NO: 9368504 - DNA, 22 bp, Homo sapiens
actctgagaaaacactatgctg

SEQ ID NO: 9368505 - DNA, 22 bp, Homo sapiens
actctgcctgaacctcctgcaa

SEQ ID NO: 9368506 - DNA, 21 bp, Homo sapiens
actctgccagtctcctgcact

SEQ ID NO: 9368507 - DNA, 22 bp, Homo sapiens
actctgcaatgtggcaagaaca

SEQ ID NO: 9368508 - DNA, 18 bp, Homo sapiens
actctgcggaggccccag

SEQ ID NO: 9368509 - DNA, 22 bp, Homo sapiens
actgaatttgtgtagatggtct

SEQ ID NO: 9368510 - DNA, 22 bp, Homo sapiens
actctgcctttcagcagatgaa

SEQ ID NO: 9368511 - DNA, 18 bp, Homo sapiens
actctgcggaggccccag

SEQ ID NO: 9368512 - DNA, 22 bp, Homo sapiens
actgagagcgtgtacaaactta

SEQ ID NO: 9368513 - DNA, 22 bp, Homo sapiens
actgagaggaaattgagactat

SEQ ID NO: 9368514 - DNA, 22 bp, Homo sapiens
actgagagagctgggtatctcc

SEQ ID NO: 9368515 - DNA, 22 bp, Homo sapiens
actgagagagctgggtatctcc

SEQ ID NO: 9368516 - DNA, 22 bp, Homo sapiens
actgaattttcacttattttag

SEQ ID NO: 9368517 - DNA, 22 bp, Homo sapiens
actgagagtcaagatagcatgg

SEQ ID NO: 9368518 - DNA, 22 bp, Homo sapiens
actgagaggtgatagtgacatt

SEQ ID NO: 9368519 - DNA, 22 bp, Homo sapiens
actgagaggtgatagtgacatt

SEQ ID NO: 9368520 - DNA, 22 bp, Homo sapiens
actgagagggaggctgtccggt

SEQ ID NO: 9368521 - DNA, 22 bp, Homo sapiens
actgagagttgtgcattcatgc

SEQ ID NO: 9368522 - DNA, 22 bp, Homo sapiens
actgagagtcttagaaacacat

SEQ ID NO: 9368523 - DNA, 22 bp, Homo sapiens
actgagagttgaaaagggagga

SEQ ID NO: 9368524 - DNA, 22 bp, Homo sapiens
agtgaaatttgtttagataggt

SEQ ID NO: 9368525 - DNA, 22 bp, Homo sapiens
actgagccttgaagctagatag

SEQ ID NO: 9368526 - DNA, 22 bp, Homo sapiens
actgagccttgaagctagatag

SEQ ID NO: 9368527 - DNA, 22 bp, Homo sapiens
actgagcctctcttcccacctc

SEQ ID NO: 9368528 - DNA, 22 bp, Homo sapiens
actgagcctgtgccctcatcag

SEQ ID NO: 9368529 - DNA, 22 bp, Homo sapiens
agtgaagaggaagtggggcaca

SEQ ID NO: 9368530 - DNA, 22 bp, Homo sapiens
agtgaagaggaagtggggcaca

SEQ ID NO: 9368531 - DNA, 19 bp, Homo sapiens
agtgaactccatatcaggt

SEQ ID NO: 9368532 - DNA, 22 bp, Homo sapiens
actacagtgtgataagaggggc

SEQ ID NO: 9368533 - DNA, 21 bp, Homo sapiens
actactggtgaaagcctagat

SEQ ID NO: 9368534 - DNA, 22 bp, Homo sapiens
actaaatatttgagaggtgtag

SEQ ID NO: 9368535 - DNA, 22 bp, Homo sapiens
actaaatctgcagagtttagtg

SEQ ID NO: 9368536 - DNA, 22 bp, Homo sapiens
actacagtactatatctatagg

SEQ ID NO: 9368537 - DNA, 22 bp, Homo sapiens
aggtgacttaggctgtggctcg

SEQ ID NO: 9368538 - DNA, 22 bp, Homo sapiens
aggtgactggtttatctggcag

SEQ ID NO: 9368539 - DNA, 22 bp, Homo sapiens
aggtgggcactccgctcgaggt

SEQ ID NO: 9368540 - DNA, 21 bp, Homo sapiens
aggtgggcaggtggagtggcc

SEQ ID NO: 9368541 - DNA, 22 bp, Homo sapiens
acgatcagcttagtctaccatg

SEQ ID NO: 9368542 - DNA, 22 bp, Homo sapiens
acgatgagatggggctggaagg

SEQ ID NO: 9368543 - DNA, 22 bp, Homo sapiens
acgaaggaatgtgcttgagcat

SEQ ID NO: 9368544 - DNA, 22 bp, Homo sapiens
accttttatgtaaatatatgtt

SEQ ID NO: 9368545 - DNA, 21 bp, Homo sapiens
acctttgggtgtttataatag

SEQ ID NO: 9368546 - DNA, 22 bp, Homo sapiens
acctttggataatttgagtttg

SEQ ID NO: 9368547 - DNA, 22 bp, Homo sapiens
accttttacggtgtgactagca

SEQ ID NO: 9368548 - DNA, 22 bp, Homo sapiens
aggtcttgtgaaggactgtgcc

SEQ ID NO: 9368549 - DNA, 22 bp, Homo sapiens
aggtcttggtaggccagagtct

SEQ ID NO: 9368550 - DNA, 19 bp, Homo sapiens
aggtcttgactctgttctt

SEQ ID NO: 9368551 - DNA, 20 bp, Homo sapiens
aggtcttccaatcagctcct

SEQ ID NO: 9368552 - DNA, 22 bp, Homo sapiens
aggtgaagttaaaaaccagtct

SEQ ID NO: 9368553 - DNA, 22 bp, Homo sapiens
aggtgaagttgaggaggcagaa

SEQ ID NO: 9368554 - DNA, 22 bp, Homo sapiens
aggtgacaggacaggagctggt

SEQ ID NO: 9368555 - DNA, 22 bp, Homo sapiens
aggtgaatgcctgaggcctctg

SEQ ID NO: 9368556 - DNA, 22 bp, Homo sapiens
aggtgaagttgaggaggcagaa

SEQ ID NO: 9368557 - DNA, 22 bp, Homo sapiens
aggtgaagttgaggaggcagaa

SEQ ID NO: 9368558 - DNA, 22 bp, Homo sapiens
aggtgaagttgaggaggcagaa

SEQ ID NO: 9368559 - DNA, 22 bp, Homo sapiens
aggtgacaggatgcagataaac

SEQ ID NO: 9368560 - DNA, 22 bp, Homo sapiens
aggtgacaggacaggagctggt

SEQ ID NO: 9368561 - DNA, 22 bp, Homo sapiens
aggtgacaggacaggagctggt

SEQ ID NO: 9368562 - DNA, 22 bp, Homo sapiens
aggtgacatcccggcagcagag

SEQ ID NO: 9368563 - DNA, 22 bp, Homo sapiens
aggtgacatcccggcagcagag

SEQ ID NO: 9368564 - DNA, 22 bp, Homo sapiens
aggtgacatcccggcagcagag

SEQ ID NO: 9368565 - DNA, 19 bp, Homo sapiens
aggtgacatgtgacagcct

SEQ ID NO: 9368566 - DNA, 22 bp, Homo sapiens
aggtgacatgaaaaatgttgag

SEQ ID NO: 9368567 - DNA, 22 bp, Homo sapiens
aggtccagaggttgaacggtgg

SEQ ID NO: 9368568 - DNA, 22 bp, Homo sapiens
aggtccagaggttgaacggtgg

SEQ ID NO: 9368569 - DNA, 22 bp, Homo sapiens
aggtccagagttgagatacaga

SEQ ID NO: 9368570 - DNA, 22 bp, Homo sapiens
aggtccagagttgagatacaga

SEQ ID NO: 9368571 - DNA, 22 bp, Homo sapiens
aggtccagcctgccctctctcc

SEQ ID NO: 9368572 - DNA, 22 bp, Homo sapiens
aggtccagctctattgaaaaga

SEQ ID NO: 9368573 - DNA, 22 bp, Homo sapiens
aggtccagaacgtgcctactct

SEQ ID NO: 9368574 - DNA, 22 bp, Homo sapiens
aggtccagaggctccttattac

SEQ ID NO: 9368575 - DNA, 22 bp, Homo sapiens
aggtccagactgtgtaccctag

SEQ ID NO: 9368576 - DNA, 22 bp, Homo sapiens
aggtccagctgttgcagcctcc

SEQ ID NO: 9368577 - DNA, 22 bp, Homo sapiens
aggtccagctgttgcagcctcc

SEQ ID NO: 9368578 - DNA, 22 bp, Homo sapiens
aggtccagctgttgcagcctcc

SEQ ID NO: 9368579 - DNA, 22 bp, Homo sapiens
aggtccaggagatttggcaatt

SEQ ID NO: 9368580 - DNA, 22 bp, Homo sapiens
aggtccaggagatttggcaatt

SEQ ID NO: 9368581 - DNA, 22 bp, Homo sapiens
aggtccaggatttgtggggtct

SEQ ID NO: 9368582 - DNA, 22 bp, Homo sapiens
aggtccaggcatttgggttggg

SEQ ID NO: 9368583 - DNA, 22 bp, Homo sapiens
aggtccaggcatttgggttggg

SEQ ID NO: 9368584 - DNA, 22 bp, Homo sapiens
aggtccaggcctcatgatggcc

SEQ ID NO: 9368585 - DNA, 22 bp, Homo sapiens
aggtccaggttccgtttctgcg

SEQ ID NO: 9368586 - DNA, 22 bp, Homo sapiens
aggtccagtgctcttggtggtt

SEQ ID NO: 9368587 - DNA, 22 bp, Homo sapiens
aggtccagtgctcttggtggtt

SEQ ID NO: 9368588 - DNA, 22 bp, Homo sapiens
aggtccagtgaaactttatttg

SEQ ID NO: 9368589 - DNA, 21 bp, Homo sapiens
aggtccagttctgtcttggac

SEQ ID NO: 9368590 - DNA, 22 bp, Homo sapiens
accttccaggaatctgccagat

SEQ ID NO: 9368591 - DNA, 22 bp, Homo sapiens
accttccaggaatctgccagat

SEQ ID NO: 9368592 - DNA, 19 bp, Homo sapiens
acctttcctttctcagatg

SEQ ID NO: 9368593 - DNA, 22 bp, Homo sapiens
acctttctgcaagttctgggac

SEQ ID NO: 9368594 - DNA, 22 bp, Homo sapiens
aggtcaagggcaagagtgaggt

SEQ ID NO: 9368595 - DNA, 22 bp, Homo sapiens
aggtcaagggcaagagtgaggt

SEQ ID NO: 9368596 - DNA, 22 bp, Homo sapiens
aggtcaaggctgcagtgagctg

SEQ ID NO: 9368597 - DNA, 22 bp, Homo sapiens
aggtcaagggagctgagggcca

SEQ ID NO: 9368598 - DNA, 22 bp, Homo sapiens
aggtcaaggctgcagtgagctg

SEQ ID NO: 9368599 - DNA, 22 bp, Homo sapiens
aggtcaaggttcacaggggatc

SEQ ID NO: 9368600 - DNA, 22 bp, Homo sapiens
aggtcaagtttagatagagtta

SEQ ID NO: 9368601 - DNA, 22 bp, Homo sapiens
aggtcaagagtaaatttgggta

SEQ ID NO: 9368602 - DNA, 22 bp, Homo sapiens
aggtcaaggccaaaagagtggt

SEQ ID NO: 9368603 - DNA, 22 bp, Homo sapiens
aggtcaagagtaaatttgggta

SEQ ID NO: 9368604 - DNA, 22 bp, Homo sapiens
aggtcaagaattgatgtggttt

SEQ ID NO: 9368605 - DNA, 22 bp, Homo sapiens
aggtcaaaccacagctctaggc

SEQ ID NO: 9368606 - DNA, 22 bp, Homo sapiens
acccttctgtgacctgcctgtc

SEQ ID NO: 9368607 - DNA, 22 bp, Homo sapiens
acccttccaaatgagcttatta

SEQ ID NO: 9368608 - DNA, 22 bp, Homo sapiens
aggtattttatagataagtaaa

SEQ ID NO: 9368609 - DNA, 22 bp, Homo sapiens
aggtattttatagataagtaaa

SEQ ID NO: 9368610 - DNA, 22 bp, Homo sapiens
aggtatttgttatttgagagtg

SEQ ID NO: 9368611 - DNA, 22 bp, Homo sapiens
aggtatttgttatttgagagtg

SEQ ID NO: 9368612 - DNA, 22 bp, Homo sapiens
aggtatttgtctcagattgggt

SEQ ID NO: 9368613 - DNA, 22 bp, Homo sapiens
aggtatttatgagagcacatat

SEQ ID NO: 9368614 - DNA, 22 bp, Homo sapiens
aggtatttcccaaagtggcatg

SEQ ID NO: 9368615 - DNA, 22 bp, Homo sapiens
actcctgctgtcactgcagttc

SEQ ID NO: 9368616 - DNA, 22 bp, Homo sapiens
actcctgcttcttccctgagga

SEQ ID NO: 9368617 - DNA, 22 bp, Homo sapiens
actcctgccacacagatgctgt

SEQ ID NO: 9368618 - DNA, 22 bp, Homo sapiens
actccctccaaatctgcacagt

SEQ ID NO: 9368619 - DNA, 21 bp, Homo sapiens
actccctgcataagtgattta

SEQ ID NO: 9368620 - DNA, 22 bp, Homo sapiens
actccctctctagtccttgcaa

SEQ ID NO: 9368621 - DNA, 22 bp, Homo sapiens
actccctgcaagattttccatg

SEQ ID NO: 9368622 - DNA, 22 bp, Homo sapiens
actcctgggtgctgaccagcgt

SEQ ID NO: 9368623 - DNA, 22 bp, Homo sapiens
actcctgggtgcatttctgatt

SEQ ID NO: 9368624 - DNA, 22 bp, Homo sapiens
actcctgggtgctgaccagcgt

SEQ ID NO: 9368625 - DNA, 22 bp, Homo sapiens
actcctgggtgcatttctgatt

SEQ ID NO: 9368626 - DNA, 22 bp, Homo sapiens
actcctggggctgccatcacag

SEQ ID NO: 9368627 - DNA, 22 bp, Homo sapiens
actcctggaaaagaacgcaggg

SEQ ID NO: 9368628 - DNA, 22 bp, Homo sapiens
actcctggggctgccatcacag

SEQ ID NO: 9368629 - DNA, 22 bp, Homo sapiens
actcctggggatccattccttt

SEQ ID NO: 9368630 - DNA, 22 bp, Homo sapiens
actcctgggtgctgaccagcgt

SEQ ID NO: 9368631 - DNA, 22 bp, Homo sapiens
agtcaccaggttttagagacct

SEQ ID NO: 9368632 - DNA, 22 bp, Homo sapiens
agtcaccctccaactctccact

SEQ ID NO: 9368633 - DNA, 22 bp, Homo sapiens
agtcactctgctacatgacagc

SEQ ID NO: 9368634 - DNA, 22 bp, Homo sapiens
agtcaccatctgtggcagcctg

SEQ ID NO: 9368635 - DNA, 22 bp, Homo sapiens
agtcaccattttcacctgcctc

SEQ ID NO: 9368636 - DNA, 22 bp, Homo sapiens
agtcacttaatctaagtctcag

SEQ ID NO: 9368637 - DNA, 22 bp, Homo sapiens
agtcacttaatctaagtctcag

SEQ ID NO: 9368638 - DNA, 22 bp, Homo sapiens
agtcacttcatggtttcttgga

SEQ ID NO: 9368639 - DNA, 22 bp, Homo sapiens
agtcacttaacatttgctgcag

SEQ ID NO: 9368640 - DNA, 22 bp, Homo sapiens
agtcactgtttcagaactgagt

SEQ ID NO: 9368641 - DNA, 22 bp, Homo sapiens
actctaaaccccactctgctgg

SEQ ID NO: 9368642 - DNA, 22 bp, Homo sapiens
agtcacttcatggtttcttgga

SEQ ID NO: 9368643 - DNA, 22 bp, Homo sapiens
agtcactgggctgcttcctata

SEQ ID NO: 9368644 - DNA, 22 bp, Homo sapiens
agtcactgagatggtgaggcta

SEQ ID NO: 9368645 - DNA, 22 bp, Homo sapiens
actctcttgggggagagcagag

SEQ ID NO: 9368646 - DNA, 22 bp, Homo sapiens
actctctgtgatggaggccagc

SEQ ID NO: 9368647 - DNA, 22 bp, Homo sapiens
actctctctgatggaactttag

SEQ ID NO: 9368648 - DNA, 22 bp, Homo sapiens
actctctctgatggaactttag

SEQ ID NO: 9368649 - DNA, 22 bp, Homo sapiens
actctctcacacacgcctatat

SEQ ID NO: 9368650 - DNA, 22 bp, Homo sapiens
actctctcacacacgcctatat

SEQ ID NO: 9368651 - DNA, 22 bp, Homo sapiens
actctctcacacacgcctatat

SEQ ID NO: 9368652 - DNA, 22 bp, Homo sapiens
actctctcacagcttggctgat

SEQ ID NO: 9368653 - DNA, 22 bp, Homo sapiens
actctctcacagcttggctgat

SEQ ID NO: 9368654 - DNA, 22 bp, Homo sapiens
actctctcacagcttggctgat

SEQ ID NO: 9368655 - DNA, 22 bp, Homo sapiens
actctcccttggagcctcaggc

SEQ ID NO: 9368656 - DNA, 22 bp, Homo sapiens
agtacttttttgatatctgagt

SEQ ID NO: 9368657 - DNA, 22 bp, Homo sapiens
agtagaaagaaggcactgggcc

SEQ ID NO: 9368658 - DNA, 22 bp, Homo sapiens
agtatacagtaatgacatatct

SEQ ID NO: 9368659 - DNA, 22 bp, Homo sapiens
agtatacaaataaatgtgtaat

SEQ ID NO: 9368660 - DNA, 22 bp, Homo sapiens
agtatacaaataaatgtgtaat

SEQ ID NO: 9368661 - DNA, 21 bp, Homo sapiens
agtagtttagcacagggtttg

SEQ ID NO: 9368662 - DNA, 22 bp, Homo sapiens
agtataaagtggttttcagcac

SEQ ID NO: 9368663 - DNA, 22 bp, Homo sapiens
agtataaagtggttttcagcac

SEQ ID NO: 9368664 - DNA, 22 bp, Homo sapiens
agtacccttttcactgtcacaa

SEQ ID NO: 9368665 - DNA, 22 bp, Homo sapiens
agtaccattatccagtaaagga

SEQ ID NO: 9368666 - DNA, 23 bp, Homo sapiens
agtacattcgaaaaattctgtga

SEQ ID NO: 9368667 - DNA, 22 bp, Homo sapiens
agtacatgtggtcctggccaga

SEQ ID NO: 9368668 - DNA, 22 bp, Homo sapiens
aggtggggaaaccagcgatccc

SEQ ID NO: 9368669 - DNA, 22 bp, Homo sapiens
aggtggggaaaccagcgatccc

SEQ ID NO: 9368670 - DNA, 22 bp, Homo sapiens
aggtggggaaaccagcgatccc

SEQ ID NO: 9368671 - DNA, 22 bp, Homo sapiens
aggtgggcggattcatgaggtc

SEQ ID NO: 9368672 - DNA, 22 bp, Homo sapiens
aggtgggcggattcatgaggtc

SEQ ID NO: 9368673 - DNA, 21 bp, Homo sapiens
aggtgggcaggtggagtggcc

SEQ ID NO: 9368674 - DNA, 22 bp, Homo sapiens
atccaggcattctgacttcaag

SEQ ID NO: 9368675 - DNA, 22 bp, Homo sapiens
agaaatcctgatggagtctgaa

SEQ ID NO: 9368676 - DNA, 22 bp, Homo sapiens
agaaatctgactgctgtgcaca

SEQ ID NO: 9368677 - DNA, 22 bp, Homo sapiens
atcccacacccctacaacatat

SEQ ID NO: 9368678 - DNA, 21 bp, Homo sapiens
atcccagcacccaggagtgca

SEQ ID NO: 9368679 - DNA, 22 bp, Homo sapiens
atcccaggaggctgcgcagtta

SEQ ID NO: 9368680 - DNA, 22 bp, Homo sapiens
atcccaggcggcacaggttgca

SEQ ID NO: 9368681 - DNA, 22 bp, Homo sapiens
atcccatagggttatcataggg

SEQ ID NO: 9368682 - DNA, 22 bp, Homo sapiens
agaacatttgtcaaaaagccaa

SEQ ID NO: 9368683 - DNA, 22 bp, Homo sapiens
agaacattaatgcgaggtatta

SEQ ID NO: 9368684 - DNA, 22 bp, Homo sapiens
agaacatttgtcgatcaatttg

SEQ ID NO: 9368685 - DNA, 22 bp, Homo sapiens
atctctggcaatgcagcatcgt

SEQ ID NO: 9368686 - DNA, 22 bp, Homo sapiens
atctctggcccctggggtccga

SEQ ID NO: 9368687 - DNA, 22 bp, Homo sapiens
atctcaggaggaccctgatgct

SEQ ID NO: 9368688 - DNA, 22 bp, Homo sapiens
atccccagaaaataggtgccta

SEQ ID NO: 9368689 - DNA, 22 bp, Homo sapiens
agaacagggactggaggcttca

SEQ ID NO: 9368690 - DNA, 22 bp, Homo sapiens
atccccagaaaataggtgccta

SEQ ID NO: 9368691 - DNA, 22 bp, Homo sapiens
agaacatatctgttttctaact

SEQ ID NO: 9368692 - DNA, 22 bp, Homo sapiens
agaagccacaggcctcgtctgg

SEQ ID NO: 9368693 - DNA, 22 bp, Homo sapiens
agaagccacaggcctcgtctgg

SEQ ID NO: 9368694 - DNA, 22 bp, Homo sapiens
agaaggcaccgtggccaatatt

SEQ ID NO: 9368695 - DNA, 22 bp, Homo sapiens
agaaggcaccgtggccaatatt

SEQ ID NO: 9368696 - DNA, 21 bp, Homo sapiens
agaaggcaccagcaaggactg

SEQ ID NO: 9368697 - DNA, 22 bp, Homo sapiens
agaaggcacagtgctgctaaga

SEQ ID NO: 9368698 - DNA, 22 bp, Homo sapiens
agaaggagtgtacaggtcatgc

SEQ ID NO: 9368699 - DNA, 22 bp, Homo sapiens
agaaggcagatgggacggagca

SEQ ID NO: 9368700 - DNA, 22 bp, Homo sapiens
agaaggcagatgggacggagca

SEQ ID NO: 9368701 - DNA, 22 bp, Homo sapiens
agaaggcagatgggacggagca

SEQ ID NO: 9368702 - DNA, 22 bp, Homo sapiens
agaaggcactcacactggcacg

SEQ ID NO: 9368703 - DNA, 22 bp, Homo sapiens
agaaggcagaaagtccaggtat

SEQ ID NO: 9368704 - DNA, 22 bp, Homo sapiens
agaaggcactcacactggcacg

SEQ ID NO: 9368705 - DNA, 22 bp, Homo sapiens
atctgccaatgccatgagaaga

SEQ ID NO: 9368706 - DNA, 22 bp, Homo sapiens
atctgccaatgccatgagaaga

SEQ ID NO: 9368707 - DNA, 22 bp, Homo sapiens
agaaggcaggttttaaaatgtc

SEQ ID NO: 9368708 - DNA, 22 bp, Homo sapiens
agaaggcatcagaagtgtgtag

SEQ ID NO: 9368709 - DNA, 20 bp, Homo sapiens
agaagccaagtgacatgttt

SEQ ID NO: 9368710 - DNA, 22 bp, Homo sapiens
agaagccaatcagctctctgct

SEQ ID NO: 9368711 - DNA, 22 bp, Homo sapiens
agaagccaatcagctctctgct

SEQ ID NO: 9368712 - DNA, 22 bp, Homo sapiens
agaagccaattctgtgtgagtc

SEQ ID NO: 9368713 - DNA, 22 bp, Homo sapiens
agaagccacaggcctcgtctgg

SEQ ID NO: 9368714 - DNA, 22 bp, Homo sapiens
agaagccaatccttgtctctct

SEQ ID NO: 9368715 - DNA, 22 bp, Homo sapiens
agaagccaatccttgtctctct

SEQ ID NO: 9368716 - DNA, 22 bp, Homo sapiens
agaagccaatcagctctctgct

SEQ ID NO: 9368717 - DNA, 22 bp, Homo sapiens
agaagccaatcagctctctgct

SEQ ID NO: 9368718 - DNA, 22 bp, Homo sapiens
agaagccaattctgtgtgagtc

SEQ ID NO: 9368719 - DNA, 22 bp, Homo sapiens
agaagccaatccttgtctctct

SEQ ID NO: 9368720 - DNA, 22 bp, Homo sapiens
atctcttctcccaacacctggc

SEQ ID NO: 9368721 - DNA, 22 bp, Homo sapiens
atctcttctgagcaattcctgt

SEQ ID NO: 9368722 - DNA, 22 bp, Homo sapiens
atctcttctgagcaattcctgt

SEQ ID NO: 9368723 - DNA, 22 bp, Homo sapiens
atctctgggctttgagtttgtt

SEQ ID NO: 9368724 - DNA, 22 bp, Homo sapiens
atctctggccttccttttccaa

SEQ ID NO: 9368725 - DNA, 22 bp, Homo sapiens
atctctggtccaaatgttacct

SEQ ID NO: 9368726 - DNA, 22 bp, Homo sapiens
atctctgggtccatagaagaga

SEQ ID NO: 9368727 - DNA, 22 bp, Homo sapiens
atctctgggtccatagaagaga

SEQ ID NO: 9368728 - DNA, 22 bp, Homo sapiens
atctctggttgttttgctccca

SEQ ID NO: 9368729 - DNA, 22 bp, Homo sapiens
atctctggtccaaatgttacct

SEQ ID NO: 9368730 - DNA, 22 bp, Homo sapiens
actttttgcatagtaagtgtct

SEQ ID NO: 9368731 - DNA, 22 bp, Homo sapiens
acttttttataaggaagaagat

SEQ ID NO: 9368732 - DNA, 21 bp, Homo sapiens
agaaaaacacgatataagccc

SEQ ID NO: 9368733 - DNA, 22 bp, Homo sapiens
acttttctaagcaatggtcttg

SEQ ID NO: 9368734 - DNA, 22 bp, Homo sapiens
acttttctccctcctgccttca

SEQ ID NO: 9368735 - DNA, 22 bp, Homo sapiens
acttttctccctcctgccttca

SEQ ID NO: 9368736 - DNA, 22 bp, Homo sapiens
acttttcccttggtagagttgc

SEQ ID NO: 9368737 - DNA, 22 bp, Homo sapiens
actttttacagggtgtatacca

SEQ ID NO: 9368738 - DNA, 22 bp, Homo sapiens
acttttctgcagatgatctctt

SEQ ID NO: 9368739 - DNA, 22 bp, Homo sapiens
acttttcttatcagaaaggcca

SEQ ID NO: 9368740 - DNA, 21 bp, Homo sapiens
atatttttgtttggactgtca

SEQ ID NO: 9368741 - DNA, 21 bp, Homo sapiens
atatttttgtttggactgtca

SEQ ID NO: 9368742 - DNA, 21 bp, Homo sapiens
atatttttgtttggactgtca

SEQ ID NO: 9368743 - DNA, 21 bp, Homo sapiens
atatttttgtttggactgtca

SEQ ID NO: 9368744 - DNA, 22 bp, Homo sapiens
atatttttccatgtgggactct

SEQ ID NO: 9368745 - DNA, 22 bp, Homo sapiens
atatttttccatgtgggactct

SEQ ID NO: 9368746 - DNA, 22 bp, Homo sapiens
atatttttccatgtgggactct

SEQ ID NO: 9368747 - DNA, 22 bp, Homo sapiens
atattttggtagctctcaatga

SEQ ID NO: 9368748 - DNA, 22 bp, Homo sapiens
atattttgtaacttggaatagg

SEQ ID NO: 9368749 - DNA, 22 bp, Homo sapiens
atattttgtaacttggaatagg

SEQ ID NO: 9368750 - DNA, 21 bp, Homo sapiens
atatttctcataaggttatgg

SEQ ID NO: 9368751 - DNA, 22 bp, Homo sapiens
atattttggggtgatgtgcatc

SEQ ID NO: 9368752 - DNA, 22 bp, Homo sapiens
atatttctccaaatgttttcaa

SEQ ID NO: 9368753 - DNA, 22 bp, Homo sapiens
atattttggtagctctcaatga

SEQ ID NO: 9368754 - DNA, 22 bp, Homo sapiens
agaaaaactaagagtgggtggt

SEQ ID NO: 9368755 - DNA, 22 bp, Homo sapiens
agaaatcatgtcttatttctat

SEQ ID NO: 9368756 - DNA, 22 bp, Homo sapiens
agaaatcatgactaagagcagt

SEQ ID NO: 9368757 - DNA, 22 bp, Homo sapiens
atcagtgctgggagatgtcaga

SEQ ID NO: 9368758 - DNA, 22 bp, Homo sapiens
atcagtgcttcatagccctggt

SEQ ID NO: 9368759 - DNA, 19 bp, Homo sapiens
atcagtgcatgagtgctgt

SEQ ID NO: 9368760 - DNA, 22 bp, Homo sapiens
atcagtgcatcctgccacaaag

SEQ ID NO: 9368761 - DNA, 22 bp, Homo sapiens
atcagtgctaaagcaaatgccc

SEQ ID NO: 9368762 - DNA, 22 bp, Homo sapiens
atcagtgccccatggctaatgc

SEQ ID NO: 9368763 - DNA, 22 bp, Homo sapiens
atcagtgctgagagactatcaa

SEQ ID NO: 9368764 - DNA, 22 bp, Homo sapiens
atcagtgctaagagagggcctg

SEQ ID NO: 9368765 - DNA, 22 bp, Homo sapiens
atcagtctgttggaatatcgct

SEQ ID NO: 9368766 - DNA, 22 bp, Homo sapiens
agaaagcactctgtcttttacc

SEQ ID NO: 9368767 - DNA, 22 bp, Homo sapiens
atcaaaatgctccagtgatggt

SEQ ID NO: 9368768 - DNA, 22 bp, Homo sapiens
agaaagaggatgcagatctcat

SEQ ID NO: 9368769 - DNA, 20 bp, Homo sapiens
atcaaaatcctattgaggtt

SEQ ID NO: 9368770 - DNA, 20 bp, Homo sapiens
atcaaaatcctattgaggtt

SEQ ID NO: 9368771 - DNA, 22 bp, Homo sapiens
atcaaaacttctttagagttta

SEQ ID NO: 9368772 - DNA, 22 bp, Homo sapiens
atcaaaacttctttagagttta

SEQ ID NO: 9368773 - DNA, 22 bp, Homo sapiens
agaaagcagcatttatgatctc

SEQ ID NO: 9368774 - DNA, 22 bp, Homo sapiens
agaaagcagcatttatgatctc

SEQ ID NO: 9368775 - DNA, 22 bp, Homo sapiens
agaaagcatctccattgtaggt

SEQ ID NO: 9368776 - DNA, 20 bp, Homo sapiens
atcaggtgtattccttatct

SEQ ID NO: 9368777 - DNA, 22 bp, Homo sapiens
atcaggtgtggtccaatcagca

SEQ ID NO: 9368778 - DNA, 22 bp, Homo sapiens
acttccttttgggaaactgttt

SEQ ID NO: 9368779 - DNA, 22 bp, Homo sapiens
acttccttgtcaggtgcatcat

SEQ ID NO: 9368780 - DNA, 22 bp, Homo sapiens
acttccttgtactgactccatt

SEQ ID NO: 9368781 - DNA, 19 bp, Homo sapiens
ataaataaaaagtgggaga

SEQ ID NO: 9368782 - DNA, 22 bp, Homo sapiens
ataaagttctgctggcatatat

SEQ ID NO: 9368783 - DNA, 19 bp, Homo sapiens
ataaataaaaagtgggaga

SEQ ID NO: 9368784 - DNA, 22 bp, Homo sapiens
acttcctggctgggtgacctgg

SEQ ID NO: 9368785 - DNA, 22 bp, Homo sapiens
actgtttatagttttgagctga

SEQ ID NO: 9368786 - DNA, 22 bp, Homo sapiens
ataaagtcatttcaaaagttga

SEQ ID NO: 9368787 - DNA, 22 bp, Homo sapiens
ataaagtcattatgaagatcta

SEQ ID NO: 9368788 - DNA, 22 bp, Homo sapiens
ataaagtcatggcagctagaat

SEQ ID NO: 9368789 - DNA, 22 bp, Homo sapiens
ataaagtcaaggcattttatga

SEQ ID NO: 9368790 - DNA, 22 bp, Homo sapiens
ataaagtcatggcagctagaat

SEQ ID NO: 9368791 - DNA, 22 bp, Homo sapiens
ataaagtcaaggcattttatga

SEQ ID NO: 9368792 - DNA, 22 bp, Homo sapiens
ataaagtctgggccaggcatgg

SEQ ID NO: 9368793 - DNA, 22 bp, Homo sapiens
ataaagtctaccgtattaaaga

SEQ ID NO: 9368794 - DNA, 22 bp, Homo sapiens
ataaagtctcatgggtaaatgt

SEQ ID NO: 9368795 - DNA, 22 bp, Homo sapiens
actgttatttgtaatccattat

SEQ ID NO: 9368796 - DNA, 22 bp, Homo sapiens
actgttgtcaggctgctttgga

SEQ ID NO: 9368797 - DNA, 22 bp, Homo sapiens
actgttgtcaggctgctttgga

SEQ ID NO: 9368798 - DNA, 18 bp, Homo sapiens
agtttttaggaagaaatg

SEQ ID NO: 9368799 - DNA, 22 bp, Homo sapiens
agttttatgtagacaattcatt

SEQ ID NO: 9368800 - DNA, 23 bp, Homo sapiens
agtttttaatggtcatagctgag

SEQ ID NO: 9368801 - DNA, 23 bp, Homo sapiens
agtttttaatggtcatagctgag

SEQ ID NO: 9368802 - DNA, 23 bp, Homo sapiens
agtttttaatggtcatagctgag

SEQ ID NO: 9368803 - DNA, 22 bp, Homo sapiens
actgggctaccccaccattacc

SEQ ID NO: 9368804 - DNA, 22 bp, Homo sapiens
actgggctaccccaccattacc

SEQ ID NO: 9368805 - DNA, 21 bp, Homo sapiens
actgggctagcctgacttctg

SEQ ID NO: 9368806 - DNA, 22 bp, Homo sapiens
actgggctagagtggaagctgg

SEQ ID NO: 9368807 - DNA, 22 bp, Homo sapiens
actgggctagagtggaagctgg

SEQ ID NO: 9368808 - DNA, 22 bp, Homo sapiens
actgggctagagtggaagctgg

SEQ ID NO: 9368809 - DNA, 22 bp, Homo sapiens
actgggctagagtggaagctgg

SEQ ID NO: 9368810 - DNA, 22 bp, Homo sapiens
actgggctccagatgtgatacg

SEQ ID NO: 9368811 - DNA, 22 bp, Homo sapiens
actgggctccaaggacctggag

SEQ ID NO: 9368812 - DNA, 22 bp, Homo sapiens
actgggctccaaggacctggag

SEQ ID NO: 9368813 - DNA, 22 bp, Homo sapiens
actgggctcaagtgattgtcct

SEQ ID NO: 9368814 - DNA, 22 bp, Homo sapiens
actgggctcataatgtcataga

SEQ ID NO: 9368815 - DNA, 22 bp, Homo sapiens
agttttatgcagtgttctgata

SEQ ID NO: 9368816 - DNA, 22 bp, Homo sapiens
agttttatggctcaacctaata

SEQ ID NO: 9368817 - DNA, 22 bp, Homo sapiens
agttttatggctcaacctaata

SEQ ID NO: 9368818 - DNA, 22 bp, Homo sapiens
agttttatctgtaagctgttca

SEQ ID NO: 9368819 - DNA, 22 bp, Homo sapiens
agttttatgcagtgttctgata

SEQ ID NO: 9368820 - DNA, 22 bp, Homo sapiens
agttttatctgtaagctgttca

SEQ ID NO: 9368821 - DNA, 21 bp, Homo sapiens
agttttatattataagctaaa

SEQ ID NO: 9368822 - DNA, 22 bp, Homo sapiens
agttttatatcttccattggtt

SEQ ID NO: 9368823 - DNA, 22 bp, Homo sapiens
agttttataaaggcacctcagt

SEQ ID NO: 9368824 - DNA, 21 bp, Homo sapiens
actttacaatttacatagtga

SEQ ID NO: 9368825 - DNA, 21 bp, Homo sapiens
actttacaatttacatagtga

SEQ ID NO: 9368826 - DNA, 21 bp, Homo sapiens
actttacaatttacatagtga

SEQ ID NO: 9368827 - DNA, 21 bp, Homo sapiens
actttacaatttacatagtga

SEQ ID NO: 9368828 - DNA, 22 bp, Homo sapiens
actttacacatcttttctcatt

SEQ ID NO: 9368829 - DNA, 22 bp, Homo sapiens
atacatatccacaggagataaa

SEQ ID NO: 9368830 - DNA, 22 bp, Homo sapiens
actttacacatcttttctcatt

SEQ ID NO: 9368831 - DNA, 22 bp, Homo sapiens
actttacacatcttttctcatt

SEQ ID NO: 9368832 - DNA, 20 bp, Homo sapiens
actttacagagaagactgac

SEQ ID NO: 9368833 - DNA, 22 bp, Homo sapiens
atacatcaaggatgatggtgta

SEQ ID NO: 9368834 - DNA, 22 bp, Homo sapiens
atacatatgaatgatttggctc

SEQ ID NO: 9368835 - DNA, 22 bp, Homo sapiens
atacatatgaatgatttggctc

SEQ ID NO: 9368836 - DNA, 22 bp, Homo sapiens
atacatcacctatatattcaca

SEQ ID NO: 9368837 - DNA, 22 bp, Homo sapiens
atacatcacctatatattcaca

SEQ ID NO: 9368838 - DNA, 21 bp, Homo sapiens
actttaatatacatgaggagg

SEQ ID NO: 9368839 - DNA, 22 bp, Homo sapiens
actttaaagcagaatggctatg

SEQ ID NO: 9368840 - DNA, 21 bp, Homo sapiens
actttacaatttacatagtga

SEQ ID NO: 9368841 - DNA, 21 bp, Homo sapiens
actttacaatttacatagtga

SEQ ID NO: 9368842 - DNA, 22 bp, Homo sapiens
actttacaatatcctgtgactt

SEQ ID NO: 9368843 - DNA, 22 bp, Homo sapiens
actttacaatatcctgtgactt

SEQ ID NO: 9368844 - DNA, 22 bp, Homo sapiens
actttacaagcttatagcctag

SEQ ID NO: 9368845 - DNA, 22 bp, Homo sapiens
actttacaaactcctcactgtt

SEQ ID NO: 9368846 - DNA, 22 bp, Homo sapiens
actttacaaactcctcactgtt

SEQ ID NO: 9368847 - DNA, 22 bp, Homo sapiens
atacaaaaattagccgggagta

SEQ ID NO: 9368848 - DNA, 22 bp, Homo sapiens
atacaaaatatatactggagac

SEQ ID NO: 9368849 - DNA, 22 bp, Homo sapiens
atacaaaaattagccgggagta

SEQ ID NO: 9368850 - DNA, 22 bp, Homo sapiens
atacaaaaattagccgggagta

SEQ ID NO: 9368851 - DNA, 22 bp, Homo sapiens
atacaaaaattagccgggagta

SEQ ID NO: 9368852 - DNA, 22 bp, Homo sapiens
atacaaaaattagccgggagta

SEQ ID NO: 9368853 - DNA, 22 bp, Homo sapiens
acttctcttcataggtggcaat

SEQ ID NO: 9368854 - DNA, 22 bp, Homo sapiens
ataatttttgtttgatgtccaa

SEQ ID NO: 9368855 - DNA, 22 bp, Homo sapiens
acttctctcattcagacatagc

SEQ ID NO: 9368856 - DNA, 22 bp, Homo sapiens
atacaaaatatatactggagac

SEQ ID NO: 9368857 - DNA, 22 bp, Homo sapiens
atacaaaatatatactggagac

SEQ ID NO: 9368858 - DNA, 22 bp, Homo sapiens
atacaaaatatatactggagac

SEQ ID NO: 9368859 - DNA, 22 bp, Homo sapiens
atacaaaatatatactggagac

SEQ ID NO: 9368860 - DNA, 22 bp, Homo sapiens
atacaaaatatatactggagac

SEQ ID NO: 9368861 - DNA, 22 bp, Homo sapiens
atacaaaatatatactggagac

SEQ ID NO: 9368862 - DNA, 22 bp, Homo sapiens
acttggttgatgtcataaggtt

SEQ ID NO: 9368863 - DNA, 22 bp, Homo sapiens
atagatcatgttaaaagctcca

SEQ ID NO: 9368864 - DNA, 22 bp, Homo sapiens
actttgttcctttcacaaagaa

SEQ ID NO: 9368865 - DNA, 22 bp, Homo sapiens
atagatatttgagttgtttcca

SEQ ID NO: 9368866 - DNA, 22 bp, Homo sapiens
atagatattagcaaaattttat

SEQ ID NO: 9368867 - DNA, 22 bp, Homo sapiens
atagatattagcaaaattttat

SEQ ID NO: 9368868 - DNA, 20 bp, Homo sapiens
atagatatcatctttagaag

SEQ ID NO: 9368869 - DNA, 22 bp, Homo sapiens
atagatacttataacaattgtg

SEQ ID NO: 9368870 - DNA, 22 bp, Homo sapiens
atagatacttaactgaaatctt

SEQ ID NO: 9368871 - DNA, 22 bp, Homo sapiens
atagatacttataacaattgtg

SEQ ID NO: 9368872 - DNA, 22 bp, Homo sapiens
actttggacaatttattactgt

SEQ ID NO: 9368873 - DNA, 22 bp, Homo sapiens
atagagtgatgtaaggtatgtg

SEQ ID NO: 9368874 - DNA, 22 bp, Homo sapiens
atagagtgatgtaaggtatgtg

SEQ ID NO: 9368875 - DNA, 22 bp, Homo sapiens
atagatacattgttatatttgt

SEQ ID NO: 9368876 - DNA, 22 bp, Homo sapiens
atacatcatgctccatatattt

SEQ ID NO: 9368877 - DNA, 22 bp, Homo sapiens
atacatcatttatgatgtgtgt

SEQ ID NO: 9368878 - DNA, 22 bp, Homo sapiens
atacatcatttcccatcaatcg

SEQ ID NO: 9368879 - DNA, 22 bp, Homo sapiens
atacatcatttcccatcaatcg

SEQ ID NO: 9368880 - DNA, 22 bp, Homo sapiens
atacatcatttcccatcaatcg

SEQ ID NO: 9368881 - DNA, 22 bp, Homo sapiens
actttggaagatggctgtattt

SEQ ID NO: 9368882 - DNA, 22 bp, Homo sapiens
actttgctgcaggtttaaagag

SEQ ID NO: 9368883 - DNA, 22 bp, Homo sapiens
actttgctcatattgagtttct

SEQ ID NO: 9368884 - DNA, 22 bp, Homo sapiens
actttgcaggccttttcttgtg

SEQ ID NO: 9368885 - DNA, 22 bp, Homo sapiens
actttgcagggcttgatatcca

SEQ ID NO: 9368886 - DNA, 20 bp, Homo sapiens
actttgcatttcctgatttt

SEQ ID NO: 9368887 - DNA, 19 bp, Homo sapiens
actttgcatgtgtgtctaa

SEQ ID NO: 9368888 - DNA, 22 bp, Homo sapiens
agacaagaaactgggagtctct

SEQ ID NO: 9368889 - DNA, 22 bp, Homo sapiens
agacaagagctgaggacatatt

SEQ ID NO: 9368890 - DNA, 22 bp, Homo sapiens
agacaaggcaaggcggccagat

SEQ ID NO: 9368891 - DNA, 22 bp, Homo sapiens
agacaaggcccccttgggctct

SEQ ID NO: 9368892 - DNA, 22 bp, Homo sapiens
agacacttatttagtgggagtt

SEQ ID NO: 9368893 - DNA, 22 bp, Homo sapiens
agacagaaataggagaaaccag

SEQ ID NO: 9368894 - DNA, 22 bp, Homo sapiens
agacactttcagaagtgtttgc

SEQ ID NO: 9368895 - DNA, 22 bp, Homo sapiens
agacaaggcccccttgggctct

SEQ ID NO: 9368896 - DNA, 22 bp, Homo sapiens
agacaccagaatctgttgagca

SEQ ID NO: 9368897 - DNA, 22 bp, Homo sapiens
agacacattttacattaactgt

SEQ ID NO: 9368898 - DNA, 22 bp, Homo sapiens
atgaggcctttcttcacccttt

SEQ ID NO: 9368899 - DNA, 22 bp, Homo sapiens
atgaggcctatcttggcagagg

SEQ ID NO: 9368900 - DNA, 22 bp, Homo sapiens
atgaggcctatcttggcagagg

SEQ ID NO: 9368901 - DNA, 22 bp, Homo sapiens
atgaggccatggctgtcactaa

SEQ ID NO: 9368902 - DNA, 22 bp, Homo sapiens
atgaggccatggctgtcactaa

SEQ ID NO: 9368903 - DNA, 22 bp, Homo sapiens
atgaggcccaaacattacaaat

SEQ ID NO: 9368904 - DNA, 22 bp, Homo sapiens
atgaggcccaggaatctgtatt

SEQ ID NO: 9368905 - DNA, 22 bp, Homo sapiens
atgaggcctatcttggcagagg

SEQ ID NO: 9368906 - DNA, 22 bp, Homo sapiens
atgaggcccaaacattacaaat

SEQ ID NO: 9368907 - DNA, 22 bp, Homo sapiens
atgagggaggcaaggagatgct

SEQ ID NO: 9368908 - DNA, 22 bp, Homo sapiens
atgagggaggcaaggagatgct

SEQ ID NO: 9368909 - DNA, 22 bp, Homo sapiens
atgaggcttaaactgctgcaac

SEQ ID NO: 9368910 - DNA, 22 bp, Homo sapiens
atgaggctgaaacacagaggct

SEQ ID NO: 9368911 - DNA, 20 bp, Homo sapiens
atgaggccagcagggctcag

SEQ ID NO: 9368912 - DNA, 22 bp, Homo sapiens
atgaggccagaccactctgcat

SEQ ID NO: 9368913 - DNA, 20 bp, Homo sapiens
atgaggccagcagggctcag

SEQ ID NO: 9368914 - DNA, 22 bp, Homo sapiens
atgaggccagggtgccatgaaa

SEQ ID NO: 9368915 - DNA, 22 bp, Homo sapiens
atgaggccagggtgccatgaaa

SEQ ID NO: 9368916 - DNA, 22 bp, Homo sapiens
agaatattgaaagttcttgaca

SEQ ID NO: 9368917 - DNA, 22 bp, Homo sapiens
agaatcaaagagaaatactttg

SEQ ID NO: 9368918 - DNA, 22 bp, Homo sapiens
agaatcaattagattctatgag

SEQ ID NO: 9368919 - DNA, 22 bp, Homo sapiens
atgaagctctaaatgtacttag

SEQ ID NO: 9368920 - DNA, 22 bp, Homo sapiens
atgaagctgaaaaaggcatata

SEQ ID NO: 9368921 - DNA, 22 bp, Homo sapiens
atgaagctactgaatatttggt

SEQ ID NO: 9368922 - DNA, 22 bp, Homo sapiens
atgaagctaaaccctgcagcca

SEQ ID NO: 9368923 - DNA, 22 bp, Homo sapiens
atgaagctgaccttgtcttgct

SEQ ID NO: 9368924 - DNA, 22 bp, Homo sapiens
atgaagctgtttattttagcag

SEQ ID NO: 9368925 - DNA, 22 bp, Homo sapiens
atgaagcttgaggtgagagctg

SEQ ID NO: 9368926 - DNA, 22 bp, Homo sapiens
atgaaggatagggcaaaatttt

SEQ ID NO: 9368927 - DNA, 22 bp, Homo sapiens
atgaagggtgtccctgtgagca

SEQ ID NO: 9368928 - DNA, 22 bp, Homo sapiens
agaatatgatcggaatacagat

SEQ ID NO: 9368929 - DNA, 22 bp, Homo sapiens
agaatattcatctgtattctta

SEQ ID NO: 9368930 - DNA, 22 bp, Homo sapiens
atgaagtggttctattggtttt

SEQ ID NO: 9368931 - DNA, 22 bp, Homo sapiens
agaatatagttaccaaattctg

SEQ ID NO: 9368932 - DNA, 22 bp, Homo sapiens
atgaagttctcaataatcatgt

SEQ ID NO: 9368933 - DNA, 22 bp, Homo sapiens
atctgcccttgattgccctagg

SEQ ID NO: 9368934 - DNA, 22 bp, Homo sapiens
atctgcccatctgtcctgcttc

SEQ ID NO: 9368935 - DNA, 22 bp, Homo sapiens
atctgcctgtatttaccatcat

SEQ ID NO: 9368936 - DNA, 22 bp, Homo sapiens
atctgctgtgtgtaatggaatg

SEQ ID NO: 9368937 - DNA, 22 bp, Homo sapiens
atgaacaatgactacatattga

SEQ ID NO: 9368938 - DNA, 22 bp, Homo sapiens
atgaacaatgactacatattga

SEQ ID NO: 9368939 - DNA, 22 bp, Homo sapiens
atgaacaatgactacatattga

SEQ ID NO: 9368940 - DNA, 22 bp, Homo sapiens
atgatatagagagtagattaaa

SEQ ID NO: 9368941 - DNA, 22 bp, Homo sapiens
atgcagggttctgggctagaga

SEQ ID NO: 9368942 - DNA, 22 bp, Homo sapiens
atgatatacttcctagaacagt

SEQ ID NO: 9368943 - DNA, 22 bp, Homo sapiens
atgatatacttcctagaacagt

SEQ ID NO: 9368944 - DNA, 22 bp, Homo sapiens
atgatatacttcctagaacagt

SEQ ID NO: 9368945 - DNA, 22 bp, Homo sapiens
atgatactctaggtgatttaca

SEQ ID NO: 9368946 - DNA, 22 bp, Homo sapiens
atgatactctaggtgatttaca

SEQ ID NO: 9368947 - DNA, 21 bp, Homo sapiens
atgatactgaagcacaactat

SEQ ID NO: 9368948 - DNA, 22 bp, Homo sapiens
atgatagaaaggacacttggtg

SEQ ID NO: 9368949 - DNA, 22 bp, Homo sapiens
agacagacagagaatttaaata

SEQ ID NO: 9368950 - DNA, 22 bp, Homo sapiens
agacagacacatggtaacagat

SEQ ID NO: 9368951 - DNA, 22 bp, Homo sapiens
agacagacaaaattcctgcctg

SEQ ID NO: 9368952 - DNA, 15 bp, Homo sapiens
agacagacagtggga

SEQ ID NO: 9368953 - DNA, 18 bp, Homo sapiens
agacagacaggtttgtgc

SEQ ID NO: 9368954 - DNA, 22 bp, Homo sapiens
agacagacatagaaattagtaa

SEQ ID NO: 9368955 - DNA, 22 bp, Homo sapiens
atgatacatcttcatgtcagtg

SEQ ID NO: 9368956 - DNA, 22 bp, Homo sapiens
atgatacatcttcatgtcagtg

SEQ ID NO: 9368957 - DNA, 22 bp, Homo sapiens
atgatacattgcaaaattttaa

SEQ ID NO: 9368958 - DNA, 22 bp, Homo sapiens
atgcatttttgagtatgaatga

SEQ ID NO: 9368959 - DNA, 22 bp, Homo sapiens
atgcatttttgagtatgaatga

SEQ ID NO: 9368960 - DNA, 22 bp, Homo sapiens
atgcatttttgagtatgaatga

SEQ ID NO: 9368961 - DNA, 22 bp, Homo sapiens
atgccaaagcccaagttcatca

SEQ ID NO: 9368962 - DNA, 22 bp, Homo sapiens
atgcatttgtaaaatataatcg

SEQ ID NO: 9368963 - DNA, 22 bp, Homo sapiens
atgcatttgtaaaatataatcg

SEQ ID NO: 9368964 - DNA, 22 bp, Homo sapiens
atgcatattttctactatatcg

SEQ ID NO: 9368965 - DNA, 22 bp, Homo sapiens
atgcatttgtaaaatataatcg

SEQ ID NO: 9368966 - DNA, 22 bp, Homo sapiens
atgcatattgattatagattca

SEQ ID NO: 9368967 - DNA, 22 bp, Homo sapiens
atgcatattttctactatatcg

SEQ ID NO: 9368968 - DNA, 22 bp, Homo sapiens
atgcctggtcccacctctaggt

SEQ ID NO: 9368969 - DNA, 22 bp, Homo sapiens
atgcctggtatgaagcaaggaa

SEQ ID NO: 9368970 - DNA, 22 bp, Homo sapiens
agacgagggcccccaggacagc

SEQ ID NO: 9368971 - DNA, 22 bp, Homo sapiens
atgcctggtatgaagcaaggaa

SEQ ID NO: 9368972 - DNA, 22 bp, Homo sapiens
atgcctggtatgaagcaaggaa

SEQ ID NO: 9368973 - DNA, 22 bp, Homo sapiens
agactgggtttgagacttagca

SEQ ID NO: 9368974 - DNA, 22 bp, Homo sapiens
agactggggttctggcaaggag

SEQ ID NO: 9368975 - DNA, 22 bp, Homo sapiens
atgcgctttgtgtgaagcagtg

SEQ ID NO: 9368976 - DNA, 22 bp, Homo sapiens
atgcctttgccacagattagga

SEQ ID NO: 9368977 - DNA, 22 bp, Homo sapiens
agacccagagggctgctgggag

SEQ ID NO: 9368978 - DNA, 22 bp, Homo sapiens
atgccaagttgacaaggggtgg

SEQ ID NO: 9368979 - DNA, 20 bp, Homo sapiens
atgccaagctatctagaatc

SEQ ID NO: 9368980 - DNA, 22 bp, Homo sapiens
atgccaagctctatccctgacc

SEQ ID NO: 9368981 - DNA, 22 bp, Homo sapiens
agacctggagtggggcctcagg

SEQ ID NO: 9368982 - DNA, 22 bp, Homo sapiens
agacctggagtgaagagttccc

SEQ ID NO: 9368983 - DNA, 22 bp, Homo sapiens
agacctgggtgccctgtgcttt

SEQ ID NO: 9368984 - DNA, 22 bp, Homo sapiens
agacctgggttcgagtcctaac

SEQ ID NO: 9368985 - DNA, 22 bp, Homo sapiens
agacctggatgtgagggaagta

SEQ ID NO: 9368986 - DNA, 22 bp, Homo sapiens
agacctggtgatagctgtccta

SEQ ID NO: 9368987 - DNA, 22 bp, Homo sapiens
agacctggtgatagctgtccta

SEQ ID NO: 9368988 - DNA, 22 bp, Homo sapiens
agacctttatttcatgatagga

SEQ ID NO: 9368989 - DNA, 21 bp, Homo sapiens
agaccttttctcagataactt

SEQ ID NO: 9368990 - DNA, 22 bp, Homo sapiens
agaccttagtagcttttaatgg

SEQ ID NO: 9368991 - DNA, 22 bp, Homo sapiens
agacttctttgtgagcattttc

SEQ ID NO: 9368992 - DNA, 22 bp, Homo sapiens
agacttctcttggctatattat

SEQ ID NO: 9368993 - DNA, 22 bp, Homo sapiens
agactttagaatcagatagcct

SEQ ID NO: 9368994 - DNA, 22 bp, Homo sapiens
agactttataaatcttaatttc

SEQ ID NO: 9368995 - DNA, 21 bp, Homo sapiens
agacttccatcctgagagagg

SEQ ID NO: 9368996 - DNA, 22 bp, Homo sapiens
agacttctaaatagcagcttct

SEQ ID NO: 9368997 - DNA, 21 bp, Homo sapiens
agacttctagaagtgagatag

SEQ ID NO: 9368998 - DNA, 22 bp, Homo sapiens
agacttcaaagcctttgttcat

SEQ ID NO: 9368999 - DNA, 22 bp, Homo sapiens
agacttctcagttttattagta

SEQ ID NO: 9369000 - DNA, 22 bp, Homo sapiens
agactgtgagaagatggctgcg

SEQ ID NO: 9369001 - DNA, 22 bp, Homo sapiens
agacttaatagaagcatgacat

SEQ ID NO: 9369002 - DNA, 22 bp, Homo sapiens
agagaaaactcattgaggtgtc

SEQ ID NO: 9369003 - DNA, 19 bp, Homo sapiens
agagaaggatcctatggtt

SEQ ID NO: 9369004 - DNA, 22 bp, Homo sapiens
agagaagggtgtagcctgggcc

SEQ ID NO: 9369005 - DNA, 22 bp, Homo sapiens
agagaagggtgtagcctgggcc

SEQ ID NO: 9369006 - DNA, 22 bp, Homo sapiens
agagaaggtcactaaggaccca

SEQ ID NO: 9369007 - DNA, 22 bp, Homo sapiens
agagaagggtgtagcctgggcc

SEQ ID NO: 9369008 - DNA, 22 bp, Homo sapiens
agagaaggtcactaaggaccca

SEQ ID NO: 9369009 - DNA, 22 bp, Homo sapiens
agagaatacaaagaagatatgt

SEQ ID NO: 9369010 - DNA, 22 bp, Homo sapiens
agagaagtgagcttgttcactc

SEQ ID NO: 9369011 - DNA, 22 bp, Homo sapiens
agagagcccgggccagggcaca

SEQ ID NO: 9369012 - DNA, 22 bp, Homo sapiens
agagagcattgaggaaatcttc

SEQ ID NO: 9369013 - DNA, 22 bp, Homo sapiens
agagagcatggcacagaggggt

SEQ ID NO: 9369014 - DNA, 22 bp, Homo sapiens
agagagcatggcacagaggggt

SEQ ID NO: 9369015 - DNA, 22 bp, Homo sapiens
agagagcatggcacagaggggt

SEQ ID NO: 9369016 - DNA, 21 bp, Homo sapiens
agagacagagaaagtaacatt

SEQ ID NO: 9369017 - DNA, 21 bp, Homo sapiens
agagacagagaaagtaacatt

SEQ ID NO: 9369018 - DNA, 22 bp, Homo sapiens
agagagaagcaatcagtggcca

SEQ ID NO: 9369019 - DNA, 22 bp, Homo sapiens
agagacagacacatcgggctgc

SEQ ID NO: 9369020 - DNA, 22 bp, Homo sapiens
agagaattttaaaagccttgaa

SEQ ID NO: 9369021 - DNA, 21 bp, Homo sapiens
agagaattgccttagatgttc

SEQ ID NO: 9369022 - DNA, 22 bp, Homo sapiens
agagacaagggacctctggaga

SEQ ID NO: 9369023 - DNA, 22 bp, Homo sapiens
agagacaagggacctctggaga

SEQ ID NO: 9369024 - DNA, 22 bp, Homo sapiens
agagacaaacactgcaacttct

SEQ ID NO: 9369025 - DNA, 22 bp, Homo sapiens
agagacaccgcgcatcatggct

SEQ ID NO: 9369026 - DNA, 22 bp, Homo sapiens
agagacaatgccaatgcacacg

SEQ ID NO: 9369027 - DNA, 22 bp, Homo sapiens
agagagctctggctgggtgacc

SEQ ID NO: 9369028 - DNA, 22 bp, Homo sapiens
agagagctctgatgggaggtga

SEQ ID NO: 9369029 - DNA, 22 bp, Homo sapiens
agagagctgactttggagtcag

SEQ ID NO: 9369030 - DNA, 22 bp, Homo sapiens
agagaggcattcggtgatccca

SEQ ID NO: 9369031 - DNA, 22 bp, Homo sapiens
agagaggcattcggtgatccca

SEQ ID NO: 9369032 - DNA, 22 bp, Homo sapiens
agagagctgtcctgggacaccc

SEQ ID NO: 9369033 - DNA, 22 bp, Homo sapiens
agagaggatttgtttttctcct

SEQ ID NO: 9369034 - DNA, 22 bp, Homo sapiens
agagaggctgctggactatatg

SEQ ID NO: 9369035 - DNA, 19 bp, Homo sapiens
agagaggctgtgtgaggga

SEQ ID NO: 9369036 - DNA, 19 bp, Homo sapiens
agagaggctgtgtgaggga

SEQ ID NO: 9369037 - DNA, 22 bp, Homo sapiens
agagagggaatatttggggtat

SEQ ID NO: 9369038 - DNA, 22 bp, Homo sapiens
agagagggaatatttggggtat

SEQ ID NO: 9369039 - DNA, 22 bp, Homo sapiens
agagaggttggctaggatgttt

SEQ ID NO: 9369040 - DNA, 22 bp, Homo sapiens
agagagggcatagaaaaaggga

SEQ ID NO: 9369041 - DNA, 21 bp, Homo sapiens
agagagggagatgaaacatcc

SEQ ID NO: 9369042 - DNA, 22 bp, Homo sapiens
agagctggatggtcaagatggc

SEQ ID NO: 9369043 - DNA, 22 bp, Homo sapiens
agagctggatggtcaagatggc

SEQ ID NO: 9369044 - DNA, 22 bp, Homo sapiens
agagctggcagcagcttctcct

SEQ ID NO: 9369045 - DNA, 22 bp, Homo sapiens
agagctggcagcagcttctcct

SEQ ID NO: 9369046 - DNA, 22 bp, Homo sapiens
agagctggaatcagacctcagg

SEQ ID NO: 9369047 - DNA, 22 bp, Homo sapiens
agagctggaatcagacctcagg

SEQ ID NO: 9369048 - DNA, 22 bp, Homo sapiens
agagctgaaaaagctgacccgg

SEQ ID NO: 9369049 - DNA, 22 bp, Homo sapiens
agagctggctgctgcggtgctt

SEQ ID NO: 9369050 - DNA, 22 bp, Homo sapiens
agagctggctgctgcggtgctt

SEQ ID NO: 9369051 - DNA, 22 bp, Homo sapiens
agagctggctggtagccctgat

SEQ ID NO: 9369052 - DNA, 22 bp, Homo sapiens
agagctggctggtagccctgat

SEQ ID NO: 9369053 - DNA, 22 bp, Homo sapiens
agagctggctggtagccctgat

SEQ ID NO: 9369054 - DNA, 22 bp, Homo sapiens
agagctggctgtgggtgacttt

SEQ ID NO: 9369055 - DNA, 22 bp, Homo sapiens
agagctggctgtgggtgacttt

SEQ ID NO: 9369056 - DNA, 22 bp, Homo sapiens
agagctggccagggatcactct

SEQ ID NO: 9369057 - DNA, 22 bp, Homo sapiens
agagccctgacggggacagatg

SEQ ID NO: 9369058 - DNA, 22 bp, Homo sapiens
agagccctgaagcagagctaaa

SEQ ID NO: 9369059 - DNA, 22 bp, Homo sapiens
agagccctctcattggcttatt

SEQ ID NO: 9369060 - DNA, 22 bp, Homo sapiens
agagccctctcattggcttatt

SEQ ID NO: 9369061 - DNA, 22 bp, Homo sapiens
agagccctaaaccctgccttgg

SEQ ID NO: 9369062 - DNA, 22 bp, Homo sapiens
agagccctcttcactgcccctt

SEQ ID NO: 9369063 - DNA, 23 bp, Homo sapiens
agagcctgaaagacttctggcac

SEQ ID NO: 9369064 - DNA, 22 bp, Homo sapiens
agagccctggagggcagtcccg

SEQ ID NO: 9369065 - DNA, 22 bp, Homo sapiens
agagccctgccaatggatgagg

SEQ ID NO: 9369066 - DNA, 22 bp, Homo sapiens
agagcctgaggccctgagaggg

SEQ ID NO: 9369067 - DNA, 22 bp, Homo sapiens
agagcctgaggccctgagaggg

SEQ ID NO: 9369068 - DNA, 22 bp, Homo sapiens
agagctgaaaaagctgacccgg

SEQ ID NO: 9369069 - DNA, 22 bp, Homo sapiens
agagcctgaggtctaacagggg

SEQ ID NO: 9369070 - DNA, 22 bp, Homo sapiens
agagcctgcagctgtgaagaaa

SEQ ID NO: 9369071 - DNA, 21 bp, Homo sapiens
agagcctgagatcttccagca

SEQ ID NO: 9369072 - DNA, 22 bp, Homo sapiens
agagcctgagcctgaaagccct

SEQ ID NO: 9369073 - DNA, 21 bp, Homo sapiens
agagcctgagatcttccagca

SEQ ID NO: 9369074 - DNA, 22 bp, Homo sapiens
agagcctgagaggataatgggg

SEQ ID NO: 9369075 - DNA, 22 bp, Homo sapiens
agagcctgagaggataatgggg

SEQ ID NO: 9369076 - DNA, 22 bp, Homo sapiens
agagcctgaggatgtcccagct

SEQ ID NO: 9369077 - DNA, 22 bp, Homo sapiens
agagcctgaggccaggaaaatg

SEQ ID NO: 9369078 - DNA, 22 bp, Homo sapiens
agagcctgagcctgatcttgaa

SEQ ID NO: 9369079 - DNA, 22 bp, Homo sapiens
agagcccatcagtggcagtgga

SEQ ID NO: 9369080 - DNA, 22 bp, Homo sapiens
agagcccatcagtggcagtgga

SEQ ID NO: 9369081 - DNA, 22 bp, Homo sapiens
agagcccatcagtggcagtgga

SEQ ID NO: 9369082 - DNA, 22 bp, Homo sapiens
agagcccagtgacatcagcaca

SEQ ID NO: 9369083 - DNA, 22 bp, Homo sapiens
agagcccagtgacatcagcaca

SEQ ID NO: 9369084 - DNA, 22 bp, Homo sapiens
agagcccctggtggagtgagaa

SEQ ID NO: 9369085 - DNA, 22 bp, Homo sapiens
agagccaggccaggccggggca

SEQ ID NO: 9369086 - DNA, 22 bp, Homo sapiens
agagcccaggcaggcatccagg

SEQ ID NO: 9369087 - DNA, 22 bp, Homo sapiens
agagcccaggtcctggagaggg

SEQ ID NO: 9369088 - DNA, 22 bp, Homo sapiens
agagcccaggtcctggagaggg

SEQ ID NO: 9369089 - DNA, 20 bp, Homo sapiens
agagcccagatgtctgtatt

SEQ ID NO: 9369090 - DNA, 22 bp, Homo sapiens
agagcccagaaagtatgtcata

SEQ ID NO: 9369091 - DNA, 22 bp, Homo sapiens
agagcccagaaagtatgtcata

SEQ ID NO: 9369092 - DNA, 20 bp, Homo sapiens
agagcagcagttggtgaggt

SEQ ID NO: 9369093 - DNA, 20 bp, Homo sapiens
agagcagcagttggtgaggt

SEQ ID NO: 9369094 - DNA, 22 bp, Homo sapiens
agagcagcctcagctccctgtg

SEQ ID NO: 9369095 - DNA, 22 bp, Homo sapiens
agagcagatggccagggggcct

SEQ ID NO: 9369096 - DNA, 22 bp, Homo sapiens
agagcagatggccagggggcct

SEQ ID NO: 9369097 - DNA, 22 bp, Homo sapiens
agagcagatggagctggaagag

SEQ ID NO: 9369098 - DNA, 22 bp, Homo sapiens
agagcagatggagctggaagag

SEQ ID NO: 9369099 - DNA, 22 bp, Homo sapiens
agagcagatggagctggaagag

SEQ ID NO: 9369100 - DNA, 22 bp, Homo sapiens
agagcagatggagctggaagag

SEQ ID NO: 9369101 - DNA, 22 bp, Homo sapiens
agagcagatggccagggggcct

SEQ ID NO: 9369102 - DNA, 22 bp, Homo sapiens
agagcacagtatctgcacatca

SEQ ID NO: 9369103 - DNA, 22 bp, Homo sapiens
agagaggtttgctggaagattc

SEQ ID NO: 9369104 - DNA, 22 bp, Homo sapiens
agagcacagccaccatttacaa

SEQ ID NO: 9369105 - DNA, 22 bp, Homo sapiens
agagatttacacatgccttttc

SEQ ID NO: 9369106 - DNA, 22 bp, Homo sapiens
agagcacaggctcaccattgtt

SEQ ID NO: 9369107 - DNA, 22 bp, Homo sapiens
agagcacaggctcaccattgtt

SEQ ID NO: 9369108 - DNA, 22 bp, Homo sapiens
agagcagagtggctgtagcttg

SEQ ID NO: 9369109 - DNA, 22 bp, Homo sapiens
agagcagatggagctggaagag

SEQ ID NO: 9369110 - DNA, 22 bp, Homo sapiens
agagcagagggctctgggacaa

SEQ ID NO: 9369111 - DNA, 22 bp, Homo sapiens
agagcagagggctctgggacaa

SEQ ID NO: 9369112 - DNA, 22 bp, Homo sapiens
agagcagagggctctgggacaa

SEQ ID NO: 9369113 - DNA, 22 bp, Homo sapiens
agagcagaggcatggccgtggg

SEQ ID NO: 9369114 - DNA, 22 bp, Homo sapiens
agagcagagggctctgggacaa

SEQ ID NO: 9369115 - DNA, 22 bp, Homo sapiens
agagcacagtgcaggatccccg

SEQ ID NO: 9369116 - DNA, 22 bp, Homo sapiens
agagcactgcgccggctcggaa

SEQ ID NO: 9369117 - DNA, 22 bp, Homo sapiens
attggtagttttgtatttctct

SEQ ID NO: 9369118 - DNA, 22 bp, Homo sapiens
attggtagttttgtatttctct

SEQ ID NO: 9369119 - DNA, 22 bp, Homo sapiens
attgggctttatgtaggggaag

SEQ ID NO: 9369120 - DNA, 22 bp, Homo sapiens
attgggctggattaggactgtt

SEQ ID NO: 9369121 - DNA, 22 bp, Homo sapiens
attgggctggccttctggagag

SEQ ID NO: 9369122 - DNA, 22 bp, Homo sapiens
attggtcagagtaaatttattt

SEQ ID NO: 9369123 - DNA, 21 bp, Homo sapiens
agatagttgggcatgcagctg

SEQ ID NO: 9369124 - DNA, 21 bp, Homo sapiens
agatagttgggcatgcagctg

SEQ ID NO: 9369125 - DNA, 22 bp, Homo sapiens
attggcatttctcacagtcccc

SEQ ID NO: 9369126 - DNA, 21 bp, Homo sapiens
attggcctgtttacagagtga

SEQ ID NO: 9369127 - DNA, 22 bp, Homo sapiens
attgggaagatttagatccact

SEQ ID NO: 9369128 - DNA, 20 bp, Homo sapiens
attggctggggttctgatgc

SEQ ID NO: 9369129 - DNA, 22 bp, Homo sapiens
agagtggcagcaagtcaggtag

SEQ ID NO: 9369130 - DNA, 22 bp, Homo sapiens
agagtggcagcaaaaagtgtgc

SEQ ID NO: 9369131 - DNA, 22 bp, Homo sapiens
agagtggagagaaacaactctg

SEQ ID NO: 9369132 - DNA, 21 bp, Homo sapiens
agagtggcaaagtgtccaaga

SEQ ID NO: 9369133 - DNA, 22 bp, Homo sapiens
attggcatactttctatattca

SEQ ID NO: 9369134 - DNA, 22 bp, Homo sapiens
agagtggcagcaagtcaggtag

SEQ ID NO: 9369135 - DNA, 22 bp, Homo sapiens
agagtggcagcaagtcaggtag

SEQ ID NO: 9369136 - DNA, 22 bp, Homo sapiens
agatatttgtatcttgctattg

SEQ ID NO: 9369137 - DNA, 22 bp, Homo sapiens
agatatttgtatcttgctattg

SEQ ID NO: 9369138 - DNA, 22 bp, Homo sapiens
agatatttgtatcttgctattg

SEQ ID NO: 9369139 - DNA, 22 bp, Homo sapiens
agatattttgtgtgatgtttca

SEQ ID NO: 9369140 - DNA, 22 bp, Homo sapiens
agatatttaaatcagacaaaga

SEQ ID NO: 9369141 - DNA, 22 bp, Homo sapiens
agatattaccagcagtctatgc

SEQ ID NO: 9369142 - DNA, 22 bp, Homo sapiens
agatattaatcgtacataaggt

SEQ ID NO: 9369143 - DNA, 22 bp, Homo sapiens
agatcactggttacttaatgaa

SEQ ID NO: 9369144 - DNA, 23 bp, Homo sapiens
agatcacatagttatcagatgac

SEQ ID NO: 9369145 - DNA, 22 bp, Homo sapiens
agatcacagttctctattcgta

SEQ ID NO: 9369146 - DNA, 22 bp, Homo sapiens
agatcacagtcaattgcaagtt

SEQ ID NO: 9369147 - DNA, 22 bp, Homo sapiens
agatcacagtggcaactccctt

SEQ ID NO: 9369148 - DNA, 22 bp, Homo sapiens
agatcacagtggcaactccctt

SEQ ID NO: 9369149 - DNA, 22 bp, Homo sapiens
agatcacagcccccagatgcca

SEQ ID NO: 9369150 - DNA, 22 bp, Homo sapiens
agatcacagagccaagattcca

SEQ ID NO: 9369151 - DNA, 22 bp, Homo sapiens
agatcacagcccccagatgcca

SEQ ID NO: 9369152 - DNA, 22 bp, Homo sapiens
agatcaaagccatgagagattt

SEQ ID NO: 9369153 - DNA, 22 bp, Homo sapiens
agatcaaagccatgagagattt

SEQ ID NO: 9369154 - DNA, 22 bp, Homo sapiens
agatattttgtgtgatgtttca

SEQ ID NO: 9369155 - DNA, 22 bp, Homo sapiens
agatcagtaagaggaagaatgg

SEQ ID NO: 9369156 - DNA, 22 bp, Homo sapiens
agatcatattgtaactttattg

SEQ ID NO: 9369157 - DNA, 22 bp, Homo sapiens
agatccactcgaatccaggaat

SEQ ID NO: 9369158 - DNA, 21 bp, Homo sapiens
agatgctgtgctccaggagca

SEQ ID NO: 9369159 - DNA, 22 bp, Homo sapiens
agatgctgtcacacacactgtt

SEQ ID NO: 9369160 - DNA, 22 bp, Homo sapiens
agatgcagaaaaactaagtgat

SEQ ID NO: 9369161 - DNA, 17 bp, Homo sapiens
agatgctggccacatgt

SEQ ID NO: 9369162 - DNA, 22 bp, Homo sapiens
agatggaggaaggctgaactca

SEQ ID NO: 9369163 - DNA, 22 bp, Homo sapiens
agatggagttagtaccagagtc

SEQ ID NO: 9369164 - DNA, 22 bp, Homo sapiens
agatggagttgtagcagtgact

SEQ ID NO: 9369165 - DNA, 17 bp, Homo sapiens
agatggcaggaggcaga

SEQ ID NO: 9369166 - DNA, 17 bp, Homo sapiens
agatggcaggaggcaga

SEQ ID NO: 9369167 - DNA, 19 bp, Homo sapiens
agatggctaggatcaccct

SEQ ID NO: 9369168 - DNA, 22 bp, Homo sapiens
agatggctagattgcaagaact

SEQ ID NO: 9369169 - DNA, 22 bp, Homo sapiens
agatggctccagtgtccagagg

SEQ ID NO: 9369170 - DNA, 22 bp, Homo sapiens
agatggctatagatagcctttc

SEQ ID NO: 9369171 - DNA, 22 bp, Homo sapiens
agatggctatagatagcctttc

SEQ ID NO: 9369172 - DNA, 22 bp, Homo sapiens
agatggcaggggtacctggaag

SEQ ID NO: 9369173 - DNA, 22 bp, Homo sapiens
agatggcaggccctgtgggggt

SEQ ID NO: 9369174 - DNA, 22 bp, Homo sapiens
agatggctgatataaagataag

SEQ ID NO: 9369175 - DNA, 22 bp, Homo sapiens
agatggctgatggcaggagcca

SEQ ID NO: 9369176 - DNA, 22 bp, Homo sapiens
agatggctgatggcaggagcca

SEQ ID NO: 9369177 - DNA, 22 bp, Homo sapiens
agatggctctttgaaggggaat

SEQ ID NO: 9369178 - DNA, 22 bp, Homo sapiens
agatggctctcaagtctgatta

SEQ ID NO: 9369179 - DNA, 22 bp, Homo sapiens
agatggctctcaagtctgatta

SEQ ID NO: 9369180 - DNA, 21 bp, Homo sapiens
agatggctcccaggtctctgg

SEQ ID NO: 9369181 - DNA, 21 bp, Homo sapiens
agatggctcccaggtctctgg

SEQ ID NO: 9369182 - DNA, 22 bp, Homo sapiens
agatggctccagtgtccagagg

SEQ ID NO: 9369183 - DNA, 22 bp, Homo sapiens
agatggctgggagctctgtttg

SEQ ID NO: 9369184 - DNA, 22 bp, Homo sapiens
agatggctgggccccaccccag

SEQ ID NO: 9369185 - DNA, 22 bp, Homo sapiens
agatggctggaggtagatgctc

SEQ ID NO: 9369186 - DNA, 22 bp, Homo sapiens
agatggctgattaactccatgg

SEQ ID NO: 9369187 - DNA, 22 bp, Homo sapiens
agatggctggaggtagatgctc

SEQ ID NO: 9369188 - DNA, 22 bp, Homo sapiens
agatggctgggagctctgtttg

SEQ ID NO: 9369189 - DNA, 22 bp, Homo sapiens
agatggctgggagctctgtttg

SEQ ID NO: 9369190 - DNA, 22 bp, Homo sapiens
agatggcttagcctggctccca

SEQ ID NO: 9369191 - DNA, 22 bp, Homo sapiens
agatggcttagcctggctccca

SEQ ID NO: 9369192 - DNA, 22 bp, Homo sapiens
agatggcttccttctcactgtg

SEQ ID NO: 9369193 - DNA, 20 bp, Homo sapiens
agatggctgtcatttctgtc

SEQ ID NO: 9369194 - DNA, 22 bp, Homo sapiens
agatggctgggctcgtccgcag

SEQ ID NO: 9369195 - DNA, 22 bp, Homo sapiens
attttaaccctcttatatatac

SEQ ID NO: 9369196 - DNA, 22 bp, Homo sapiens
agatggctttgcttttagaagc

SEQ ID NO: 9369197 - DNA, 22 bp, Homo sapiens
agatggctttgcttttagaagc

SEQ ID NO: 9369198 - DNA, 22 bp, Homo sapiens
agatggcttgtgagatgaacaa

SEQ ID NO: 9369199 - DNA, 19 bp, Homo sapiens
agatggcttggactgaaaa

SEQ ID NO: 9369200 - DNA, 19 bp, Homo sapiens
agatggcttggactgaaaa

SEQ ID NO: 9369201 - DNA, 22 bp, Homo sapiens
agatggcttccttctcactgtg

SEQ ID NO: 9369202 - DNA, 22 bp, Homo sapiens
agatgtggcctttgggagatta

SEQ ID NO: 9369203 - DNA, 22 bp, Homo sapiens
attttcagaacattcattcact

SEQ ID NO: 9369204 - DNA, 22 bp, Homo sapiens
attttcagaacattcattcact

SEQ ID NO: 9369205 - DNA, 22 bp, Homo sapiens
attttcagagacatctggactt

SEQ ID NO: 9369206 - DNA, 22 bp, Homo sapiens
attttcaccctgaatatattga

SEQ ID NO: 9369207 - DNA, 22 bp, Homo sapiens
attttcaccctgaatatattga

SEQ ID NO: 9369208 - DNA, 22 bp, Homo sapiens
attttatgacacgattcttcca

SEQ ID NO: 9369209 - DNA, 22 bp, Homo sapiens
attttcaaaacatctgctgtgt

SEQ ID NO: 9369210 - DNA, 22 bp, Homo sapiens
attttagttttagcatccatgc

SEQ ID NO: 9369211 - DNA, 22 bp, Homo sapiens
attttagtacctcaagtatcca

SEQ ID NO: 9369212 - DNA, 22 bp, Homo sapiens
agatgggcgccctggactgagg

SEQ ID NO: 9369213 - DNA, 22 bp, Homo sapiens
attttaaccctcttatatatac

SEQ ID NO: 9369214 - DNA, 22 bp, Homo sapiens
attttaaccctcttatatatac

SEQ ID NO: 9369215 - DNA, 22 bp, Homo sapiens
attttagatttaagaataaggt

SEQ ID NO: 9369216 - DNA, 22 bp, Homo sapiens
agatgtgggcaatggaatggag

SEQ ID NO: 9369217 - DNA, 22 bp, Homo sapiens
agatgtgggtgtcaggcagtga

SEQ ID NO: 9369218 - DNA, 22 bp, Homo sapiens
agcaaagctatctctatggaga

SEQ ID NO: 9369219 - DNA, 22 bp, Homo sapiens
agcaaagctcatgacattacag

SEQ ID NO: 9369220 - DNA, 22 bp, Homo sapiens
agcaaatattttgttgaagtgc

SEQ ID NO: 9369221 - DNA, 22 bp, Homo sapiens
agatgtgtttctagttcctgca

SEQ ID NO: 9369222 - DNA, 22 bp, Homo sapiens
agatgtgtttctagttcctgca

SEQ ID NO: 9369223 - DNA, 18 bp, Homo sapiens
agatgttcaatatttctc

SEQ ID NO: 9369224 - DNA, 19 bp, Homo sapiens
agcaacaccgtttatttcc

SEQ ID NO: 9369225 - DNA, 19 bp, Homo sapiens
agcaacctgtcagagatgc

SEQ ID NO: 9369226 - DNA, 19 bp, Homo sapiens
agcaacctgtcagagatgc

SEQ ID NO: 9369227 - DNA, 19 bp, Homo sapiens
agcaacctgggccaatgta

SEQ ID NO: 9369228 - DNA, 22 bp, Homo sapiens
agcaacctgccagtcactcagt

SEQ ID NO: 9369229 - DNA, 22 bp, Homo sapiens
agcaacctggatcatggtgaaa

SEQ ID NO: 9369230 - DNA, 22 bp, Homo sapiens
agcaacattgagactgcagttg

SEQ ID NO: 9369231 - DNA, 22 bp, Homo sapiens
agcaacatttttcaattaacat

SEQ ID NO: 9369232 - DNA, 22 bp, Homo sapiens
agcaacctcatgagagtgaaat

SEQ ID NO: 9369233 - DNA, 22 bp, Homo sapiens
agcaacctgccaccacaggcaa

SEQ ID NO: 9369234 - DNA, 17 bp, Homo sapiens
agcaacctcctcttcct

SEQ ID NO: 9369235 - DNA, 22 bp, Homo sapiens
agcaacaggaccatggagccca

SEQ ID NO: 9369236 - DNA, 22 bp, Homo sapiens
agcaagaaaatctctgtccaat

SEQ ID NO: 9369237 - DNA, 20 bp, Homo sapiens
agcaagagtaaggacagcga

SEQ ID NO: 9369238 - DNA, 21 bp, Homo sapiens
agcaagaatcaggaaggctct

SEQ ID NO: 9369239 - DNA, 20 bp, Homo sapiens
agcaagaaggttgtgggagc

SEQ ID NO: 9369240 - DNA, 22 bp, Homo sapiens
caaaggcaggtcatggccactt

SEQ ID NO: 9369241 - DNA, 22 bp, Homo sapiens
caaaggcaggtgctgaatattc

SEQ ID NO: 9369242 - DNA, 22 bp, Homo sapiens
caaagcagacgcagtaagggta

SEQ ID NO: 9369243 - DNA, 22 bp, Homo sapiens
caaagcaagggctgaagactcc

SEQ ID NO: 9369244 - DNA, 22 bp, Homo sapiens
caaagatatgacatggaaaatg

SEQ ID NO: 9369245 - DNA, 22 bp, Homo sapiens
caaagataatcacagaataccc

SEQ ID NO: 9369246 - DNA, 22 bp, Homo sapiens
agaggggaggcgaaccagagtc

SEQ ID NO: 9369247 - DNA, 23 bp, Homo sapiens
agaggggagcatctgctggctga

SEQ ID NO: 9369248 - DNA, 22 bp, Homo sapiens
agaggggaggcgaaccagagtc

SEQ ID NO: 9369249 - DNA, 22 bp, Homo sapiens
agaggggaagtaatgaatgata

SEQ ID NO: 9369250 - DNA, 22 bp, Homo sapiens
agaggggacagccacctgcccg

SEQ ID NO: 9369251 - DNA, 22 bp, Homo sapiens
agaggggagagctaagcaattc

SEQ ID NO: 9369252 - DNA, 18 bp, Homo sapiens
agaggggaggtaagtctg

SEQ ID NO: 9369253 - DNA, 22 bp, Homo sapiens
agaggggagtcctaatctgatt

SEQ ID NO: 9369254 - DNA, 22 bp, Homo sapiens
agagggcttccctaggagtgag

SEQ ID NO: 9369255 - DNA, 22 bp, Homo sapiens
agagggcttccctaggagtgag

SEQ ID NO: 9369256 - DNA, 22 bp, Homo sapiens
agaggggaaggatgtgatgtga

SEQ ID NO: 9369257 - DNA, 22 bp, Homo sapiens
agaggctgtctcatattttgta

SEQ ID NO: 9369258 - DNA, 22 bp, Homo sapiens
agagggcagggcggtaagtcct

SEQ ID NO: 9369259 - DNA, 22 bp, Homo sapiens
agagggcagtctcagattggga

SEQ ID NO: 9369260 - DNA, 22 bp, Homo sapiens
agagggcagtctcagattggga

SEQ ID NO: 9369261 - DNA, 22 bp, Homo sapiens
agagggcttccctaggagtgag

SEQ ID NO: 9369262 - DNA, 22 bp, Homo sapiens
agagggctgggatgtgctgtgt

SEQ ID NO: 9369263 - DNA, 22 bp, Homo sapiens
agagggctgggatgtgctgtgt

SEQ ID NO: 9369264 - DNA, 22 bp, Homo sapiens
agagggctgggatgtgctgtgt

SEQ ID NO: 9369265 - DNA, 22 bp, Homo sapiens
agagggctggacgcaggttgga

SEQ ID NO: 9369266 - DNA, 22 bp, Homo sapiens
agaggctgggtacgggccacct

SEQ ID NO: 9369267 - DNA, 16 bp, Homo sapiens
agaggctgtaatggaa

SEQ ID NO: 9369268 - DNA, 19 bp, Homo sapiens
agaggctgtcacctgtagc

SEQ ID NO: 9369269 - DNA, 16 bp, Homo sapiens
agaggctgtaatggaa

SEQ ID NO: 9369270 - DNA, 16 bp, Homo sapiens
agaggctgtaatggaa

SEQ ID NO: 9369271 - DNA, 22 bp, Homo sapiens
agaggctgtcccttgctattcc

SEQ ID NO: 9369272 - DNA, 22 bp, Homo sapiens
agaggctgtcccttgctattcc

SEQ ID NO: 9369273 - DNA, 22 bp, Homo sapiens
agaggctgggcaggacccacag

SEQ ID NO: 9369274 - DNA, 22 bp, Homo sapiens
agaggctgggtacgggccacct

SEQ ID NO: 9369275 - DNA, 22 bp, Homo sapiens
agaggctgggtacgggccacct

SEQ ID NO: 9369276 - DNA, 22 bp, Homo sapiens
agagtccaaatgtgcagttatg

SEQ ID NO: 9369277 - DNA, 22 bp, Homo sapiens
agagtccaccctggggtcaggc

SEQ ID NO: 9369278 - DNA, 22 bp, Homo sapiens
agagtcagttatgtcaagtgct

SEQ ID NO: 9369279 - DNA, 22 bp, Homo sapiens
agagtcagcttatgacacagtc

SEQ ID NO: 9369280 - DNA, 22 bp, Homo sapiens
agagtcagaaagcagacagggg

SEQ ID NO: 9369281 - DNA, 22 bp, Homo sapiens
agagtcagaaccaagatgaggc

SEQ ID NO: 9369282 - DNA, 22 bp, Homo sapiens
agagtcagcttatgacacagtc

SEQ ID NO: 9369283 - DNA, 22 bp, Homo sapiens
agagtcagcttatgacacagtc

SEQ ID NO: 9369284 - DNA, 22 bp, Homo sapiens
agaggtgacataggagaggctc

SEQ ID NO: 9369285 - DNA, 22 bp, Homo sapiens
agaggtgagtcattacctagtg

SEQ ID NO: 9369286 - DNA, 22 bp, Homo sapiens
agaggtggagctcttggcatca

SEQ ID NO: 9369287 - DNA, 22 bp, Homo sapiens
agagtataggcaggatgccagt

SEQ ID NO: 9369288 - DNA, 18 bp, Homo sapiens
agagtatacagacaacaa

SEQ ID NO: 9369289 - DNA, 22 bp, Homo sapiens
agagtataattagtgtcttcta

SEQ ID NO: 9369290 - DNA, 21 bp, Homo sapiens
agagtataataaaggcatgtc

SEQ ID NO: 9369291 - DNA, 22 bp, Homo sapiens
agagtagcctcatagacactca

SEQ ID NO: 9369292 - DNA, 20 bp, Homo sapiens
agagtagaggtagatttatg

SEQ ID NO: 9369293 - DNA, 22 bp, Homo sapiens
agagtattttgattatcctgga

SEQ ID NO: 9369294 - DNA, 22 bp, Homo sapiens
agagtatattgaagcagtcagg

SEQ ID NO: 9369295 - DNA, 22 bp, Homo sapiens
agagtccatgaagacagctgag

SEQ ID NO: 9369296 - DNA, 22 bp, Homo sapiens
agagtccatatgtgggaggagt

SEQ ID NO: 9369297 - DNA, 22 bp, Homo sapiens
agagtccatgaagacagctgag

SEQ ID NO: 9369298 - DNA, 18 bp, Homo sapiens
agagtccagggtgaggtg

SEQ ID NO: 9369299 - DNA, 19 bp, Homo sapiens
agagtcggggggacatagg

SEQ ID NO: 9369300 - DNA, 22 bp, Homo sapiens
agagtctgaggcagctgcagcc

SEQ ID NO: 9369301 - DNA, 22 bp, Homo sapiens
agagtctgatatttgtaccaga

SEQ ID NO: 9369302 - DNA, 22 bp, Homo sapiens
agagtctgaggcagctgcagcc

SEQ ID NO: 9369303 - DNA, 22 bp, Homo sapiens
agagtgccctgctctgagctct

SEQ ID NO: 9369304 - DNA, 22 bp, Homo sapiens
agagtgagggggcactgagacg

SEQ ID NO: 9369305 - DNA, 22 bp, Homo sapiens
agagtgagggggcactgagacg

SEQ ID NO: 9369306 - DNA, 20 bp, Homo sapiens
agagtgagactccatctcag

SEQ ID NO: 9369307 - DNA, 22 bp, Homo sapiens
agagtgcaaccgaaacaagcag

SEQ ID NO: 9369308 - DNA, 22 bp, Homo sapiens
agagtgatgggttgtgctgacc

SEQ ID NO: 9369309 - DNA, 22 bp, Homo sapiens
agagtgatcagatatcaggtgt

SEQ ID NO: 9369310 - DNA, 22 bp, Homo sapiens
agagtgattcgttcaagaacca

SEQ ID NO: 9369311 - DNA, 16 bp, Homo sapiens
agaggccacagacaga

SEQ ID NO: 9369312 - DNA, 22 bp, Homo sapiens
agaggccacaccagcctcccgt

SEQ ID NO: 9369313 - DNA, 22 bp, Homo sapiens
agaggccaccactgtcagggac

SEQ ID NO: 9369314 - DNA, 22 bp, Homo sapiens
agaggccactttgcctgtgatg

SEQ ID NO: 9369315 - DNA, 22 bp, Homo sapiens
agaggccagaaggcgcaccccg

SEQ ID NO: 9369316 - DNA, 22 bp, Homo sapiens
agaggccagaaagtatgccacc

SEQ ID NO: 9369317 - DNA, 22 bp, Homo sapiens
agaggccagaaggcgcaccccg

SEQ ID NO: 9369318 - DNA, 22 bp, Homo sapiens
agaggccagcactgcagggaag

SEQ ID NO: 9369319 - DNA, 22 bp, Homo sapiens
agaggccagcagtgcctatctg

SEQ ID NO: 9369320 - DNA, 22 bp, Homo sapiens
agaggccagcactgcagggaag

SEQ ID NO: 9369321 - DNA, 22 bp, Homo sapiens
agaggccagatcatcatagatg

SEQ ID NO: 9369322 - DNA, 22 bp, Homo sapiens
agaggccagcaaccacagtaaa

SEQ ID NO: 9369323 - DNA, 22 bp, Homo sapiens
agaggccagcccaggccaccga

SEQ ID NO: 9369324 - DNA, 22 bp, Homo sapiens
agaggccagcagtgcctatctg

SEQ ID NO: 9369325 - DNA, 23 bp, Homo sapiens
agaggccagcctttggagacacc

SEQ ID NO: 9369326 - DNA, 18 bp, Homo sapiens
agaggctggacaggggat

SEQ ID NO: 9369327 - DNA, 23 bp, Homo sapiens
agaggctgcagggtattgagaat

SEQ ID NO: 9369328 - DNA, 22 bp, Homo sapiens
agaggctgcaggctggaaatca

SEQ ID NO: 9369329 - DNA, 22 bp, Homo sapiens
agaggctgcaggctggaaatca

SEQ ID NO: 9369330 - DNA, 23 bp, Homo sapiens
agaggctgcagggtattgagaat

SEQ ID NO: 9369331 - DNA, 22 bp, Homo sapiens
agaggctgggaagggtccccgg

SEQ ID NO: 9369332 - DNA, 22 bp, Homo sapiens
agaggctggattgagcatagac

SEQ ID NO: 9369333 - DNA, 22 bp, Homo sapiens
agaggctggattgagcatagac

SEQ ID NO: 9369334 - DNA, 18 bp, Homo sapiens
agaggctggacaggggat

SEQ ID NO: 9369335 - DNA, 18 bp, Homo sapiens
agaggctggacaggggat

SEQ ID NO: 9369336 - DNA, 22 bp, Homo sapiens
agaggctggattgagcatagac

SEQ ID NO: 9369337 - DNA, 22 bp, Homo sapiens
agaggctgcacttgctcatgat

SEQ ID NO: 9369338 - DNA, 22 bp, Homo sapiens
agaggctgcacttgctcatgat

SEQ ID NO: 9369339 - DNA, 22 bp, Homo sapiens
agaggctgcacttgctcatgat

SEQ ID NO: 9369340 - DNA, 22 bp, Homo sapiens
agaggctgatggagtagtgtct

SEQ ID NO: 9369341 - DNA, 22 bp, Homo sapiens
agaggctgatggagtagtgtct

SEQ ID NO: 9369342 - DNA, 22 bp, Homo sapiens
agaggctccttcactctggcac

SEQ ID NO: 9369343 - DNA, 22 bp, Homo sapiens
agaggctccttcactctggcac

SEQ ID NO: 9369344 - DNA, 22 bp, Homo sapiens
agaggctgcacttgctcatgat

SEQ ID NO: 9369345 - DNA, 22 bp, Homo sapiens
agaggctgcacttgctcatgat

SEQ ID NO: 9369346 - DNA, 22 bp, Homo sapiens
agaggctcctcggtgcctcgtg

SEQ ID NO: 9369347 - DNA, 22 bp, Homo sapiens
agaggccaggctgcagagggat

SEQ ID NO: 9369348 - DNA, 22 bp, Homo sapiens
agaggccagctagcgggccatc

SEQ ID NO: 9369349 - DNA, 22 bp, Homo sapiens
agaggccaggcagcccaaggtg

SEQ ID NO: 9369350 - DNA, 22 bp, Homo sapiens
attacagtaacagctacaatgc

SEQ ID NO: 9369351 - DNA, 22 bp, Homo sapiens
attacagtaacagctacaatgc

SEQ ID NO: 9369352 - DNA, 22 bp, Homo sapiens
attacagcttgctcagtttgca

SEQ ID NO: 9369353 - DNA, 21 bp, Homo sapiens
attacagcagtggccaaatgc

SEQ ID NO: 9369354 - DNA, 22 bp, Homo sapiens
attacagtaaatgctacaggca

SEQ ID NO: 9369355 - DNA, 22 bp, Homo sapiens
attacagtaaatgctacaggca

SEQ ID NO: 9369356 - DNA, 22 bp, Homo sapiens
attacagaatgcagttccttat

SEQ ID NO: 9369357 - DNA, 22 bp, Homo sapiens
attacagatagactttgaagct

SEQ ID NO: 9369358 - DNA, 22 bp, Homo sapiens
attacacatagacattcgttca

SEQ ID NO: 9369359 - DNA, 22 bp, Homo sapiens
attacacaggctggctctttga

SEQ ID NO: 9369360 - DNA, 22 bp, Homo sapiens
attacacatagacattcgttca

SEQ ID NO: 9369361 - DNA, 22 bp, Homo sapiens
attacacaggctggctctttga

SEQ ID NO: 9369362 - DNA, 22 bp, Homo sapiens
attacacagcggttactactag

SEQ ID NO: 9369363 - DNA, 22 bp, Homo sapiens
attacacaggatttgccttact

SEQ ID NO: 9369364 - DNA, 22 bp, Homo sapiens
attacacagcggttactactag

SEQ ID NO: 9369365 - DNA, 22 bp, Homo sapiens
agaggcaccatctggaacagcc

SEQ ID NO: 9369366 - DNA, 22 bp, Homo sapiens
agaggcacccgcgcgcggccat

SEQ ID NO: 9369367 - DNA, 22 bp, Homo sapiens
agaggcaccgtctgcagcgtgc

SEQ ID NO: 9369368 - DNA, 22 bp, Homo sapiens
agaggcacggaggctgcatgga

SEQ ID NO: 9369369 - DNA, 22 bp, Homo sapiens
agaggcactaagggaagagcag

SEQ ID NO: 9369370 - DNA, 22 bp, Homo sapiens
agaggcaagattatcagggcat

SEQ ID NO: 9369371 - DNA, 22 bp, Homo sapiens
agaggaggctgggtccagataa

SEQ ID NO: 9369372 - DNA, 22 bp, Homo sapiens
agaggaggctgggtccagataa

SEQ ID NO: 9369373 - DNA, 21 bp, Homo sapiens
agagctgggacttgcctgaga

SEQ ID NO: 9369374 - DNA, 22 bp, Homo sapiens
agagctgggaccgtctggaagt

SEQ ID NO: 9369375 - DNA, 20 bp, Homo sapiens
agagctgggaagctccctat

SEQ ID NO: 9369376 - DNA, 22 bp, Homo sapiens
agagctggctgtgggtgacttt

SEQ ID NO: 9369377 - DNA, 22 bp, Homo sapiens
agagctggctgtgggtgacttt

SEQ ID NO: 9369378 - DNA, 20 bp, Homo sapiens
agagctgggaagctccctat

SEQ ID NO: 9369379 - DNA, 19 bp, Homo sapiens
agaggcaagggtggaagta

SEQ ID NO: 9369380 - DNA, 22 bp, Homo sapiens
agaggcaagttcagagctagga

SEQ ID NO: 9369381 - DNA, 19 bp, Homo sapiens
agaggcaagggctcatgac

SEQ ID NO: 9369382 - DNA, 22 bp, Homo sapiens
agaggcaagggacctttctggg

SEQ ID NO: 9369383 - DNA, 22 bp, Homo sapiens
agaggcaaggcaggattcttct

SEQ ID NO: 9369384 - DNA, 23 bp, Homo sapiens
agaggcacagcacttggctggcc

SEQ ID NO: 9369385 - DNA, 22 bp, Homo sapiens
agaggcaccatctggaacagcc

SEQ ID NO: 9369386 - DNA, 22 bp, Homo sapiens
agaggcaccatctggaacagcc

SEQ ID NO: 9369387 - DNA, 22 bp, Homo sapiens
agaggcacagaggcagtcccct

SEQ ID NO: 9369388 - DNA, 23 bp, Homo sapiens
agaggcacagcacttggctggcc

SEQ ID NO: 9369389 - DNA, 23 bp, Homo sapiens
agaggcacagcacttggctggcc

SEQ ID NO: 9369390 - DNA, 22 bp, Homo sapiens
agaggcaatgaaagcagtctct

SEQ ID NO: 9369391 - DNA, 22 bp, Homo sapiens
agcctgggcctggcttcccgcc

SEQ ID NO: 9369392 - DNA, 18 bp, Homo sapiens
agcctgggctctgcctgg

SEQ ID NO: 9369393 - DNA, 22 bp, Homo sapiens
agcctgggccctgcctcttctc

SEQ ID NO: 9369394 - DNA, 22 bp, Homo sapiens
agcctgggccctgcctcttctc

SEQ ID NO: 9369395 - DNA, 20 bp, Homo sapiens
agcctggggaattccacccc

SEQ ID NO: 9369396 - DNA, 18 bp, Homo sapiens
agcctgggctctgcctgg

SEQ ID NO: 9369397 - DNA, 22 bp, Homo sapiens
agcctggggcacttctccaaac

SEQ ID NO: 9369398 - DNA, 22 bp, Homo sapiens
agcctgggggcgcagaaaccgg

SEQ ID NO: 9369399 - DNA, 21 bp, Homo sapiens
agcctgggtatcctttgagga

SEQ ID NO: 9369400 - DNA, 22 bp, Homo sapiens
agcctgggtgggggttcggaga

SEQ ID NO: 9369401 - DNA, 22 bp, Homo sapiens
agcctgggttagggttcttccc

SEQ ID NO: 9369402 - DNA, 22 bp, Homo sapiens
agcctgggttagggttcttccc

SEQ ID NO: 9369403 - DNA, 22 bp, Homo sapiens
agcctggtgtggggctgcagag

SEQ ID NO: 9369404 - DNA, 22 bp, Homo sapiens
agcctgggtttttattaaggag

SEQ ID NO: 9369405 - DNA, 20 bp, Homo sapiens
agcggcagcttcctgcttcg

SEQ ID NO: 9369406 - DNA, 22 bp, Homo sapiens
agcggagctagtttttgtcctc

SEQ ID NO: 9369407 - DNA, 22 bp, Homo sapiens
agcctggtttaagcattttata

SEQ ID NO: 9369408 - DNA, 22 bp, Homo sapiens
agctaagacttagtgacttagt

SEQ ID NO: 9369409 - DNA, 22 bp, Homo sapiens
agctaagaacttgagctctgga

SEQ ID NO: 9369410 - DNA, 22 bp, Homo sapiens
agctaacatgactagaagcttc

SEQ ID NO: 9369411 - DNA, 22 bp, Homo sapiens
agctacagggaactaaaagcta

SEQ ID NO: 9369412 - DNA, 22 bp, Homo sapiens
agctacagctgtactctgcagg

SEQ ID NO: 9369413 - DNA, 22 bp, Homo sapiens
agctacagtggacaagtgaact

SEQ ID NO: 9369414 - DNA, 22 bp, Homo sapiens
agctacagttgccctcagcagg

SEQ ID NO: 9369415 - DNA, 22 bp, Homo sapiens
agctacctggcttatcactgtc

SEQ ID NO: 9369416 - DNA, 22 bp, Homo sapiens
agctactagggtgccagacatg

SEQ ID NO: 9369417 - DNA, 22 bp, Homo sapiens
agctaaggaactctgtaacacc

SEQ ID NO: 9369418 - DNA, 22 bp, Homo sapiens
agctacagatgagcccagtatc

SEQ ID NO: 9369419 - DNA, 22 bp, Homo sapiens
agctacaaatgtatgtgctgat

SEQ ID NO: 9369420 - DNA, 22 bp, Homo sapiens
agcctggccactcagggcctga

SEQ ID NO: 9369421 - DNA, 22 bp, Homo sapiens
agcctggcttaatcctcctttt

SEQ ID NO: 9369422 - DNA, 22 bp, Homo sapiens
agcctggccactcagggcctga

SEQ ID NO: 9369423 - DNA, 22 bp, Homo sapiens
cagcaagaaaattcacatgctc

SEQ ID NO: 9369424 - DNA, 22 bp, Homo sapiens
agcctggcttagctctctcact

SEQ ID NO: 9369425 - DNA, 19 bp, Homo sapiens
agcctggctttgctctgct

SEQ ID NO: 9369426 - DNA, 17 bp, Homo sapiens
agcctgggaaggagtga

SEQ ID NO: 9369427 - DNA, 17 bp, Homo sapiens
agcctgggaaggagtga

SEQ ID NO: 9369428 - DNA, 19 bp, Homo sapiens
agcctggctttgctctgct

SEQ ID NO: 9369429 - DNA, 22 bp, Homo sapiens
agcctgggaatttagagttcgg

SEQ ID NO: 9369430 - DNA, 21 bp, Homo sapiens
agcctgggaggcggaggttgc

SEQ ID NO: 9369431 - DNA, 22 bp, Homo sapiens
agcctgggagacactaagttgt

SEQ ID NO: 9369432 - DNA, 22 bp, Homo sapiens
agcctgggcaacagagcaaaac

SEQ ID NO: 9369433 - DNA, 22 bp, Homo sapiens
agcctgggcaactccattcact

SEQ ID NO: 9369434 - DNA, 22 bp, Homo sapiens
agcctgggcatgggacgggagg

SEQ ID NO: 9369435 - DNA, 22 bp, Homo sapiens
cagatgtacatgaagggcaatg

SEQ ID NO: 9369436 - DNA, 22 bp, Homo sapiens
cagatgtgcatgatgggaaggg

SEQ ID NO: 9369437 - DNA, 20 bp, Homo sapiens
cagatgggacgtggaggagt

SEQ ID NO: 9369438 - DNA, 18 bp, Homo sapiens
cagatggtggagttttta

SEQ ID NO: 9369439 - DNA, 22 bp, Homo sapiens
cagatgtacatgaagggcaatg

SEQ ID NO: 9369440 - DNA, 22 bp, Homo sapiens
cagcaacatgtggtagtgtagg

SEQ ID NO: 9369441 - DNA, 22 bp, Homo sapiens
cagcaacatatatgaaactgtg

SEQ ID NO: 9369442 - DNA, 22 bp, Homo sapiens
cagcaacttggacagcagtctt

SEQ ID NO: 9369443 - DNA, 21 bp, Homo sapiens
agctccaggctcctggggttc

SEQ ID NO: 9369444 - DNA, 21 bp, Homo sapiens
agctccaggctcctggggttc

SEQ ID NO: 9369445 - DNA, 21 bp, Homo sapiens
agctccaggctcctggggttc

SEQ ID NO: 9369446 - DNA, 19 bp, Homo sapiens
agctcctgattgtgcctcg

SEQ ID NO: 9369447 - DNA, 19 bp, Homo sapiens
agctcctgattgtgcctcg

SEQ ID NO: 9369448 - DNA, 19 bp, Homo sapiens
agctcctgattgtgcctcg

SEQ ID NO: 9369449 - DNA, 22 bp, Homo sapiens
agctcctggacgaacagggagt

SEQ ID NO: 9369450 - DNA, 22 bp, Homo sapiens
agctcctggaggtgcgcactcg

SEQ ID NO: 9369451 - DNA, 23 bp, Homo sapiens
agctccagctgacgtgggcagcc

SEQ ID NO: 9369452 - DNA, 22 bp, Homo sapiens
agctccagcctcttctggaggt

SEQ ID NO: 9369453 - DNA, 23 bp, Homo sapiens
agctccagctgacgtgggcagcc

SEQ ID NO: 9369454 - DNA, 22 bp, Homo sapiens
agctccaggataagacaggtgc

SEQ ID NO: 9369455 - DNA, 22 bp, Homo sapiens
agctccaggataagacaggtgc

SEQ ID NO: 9369456 - DNA, 22 bp, Homo sapiens
agctccaggataagacaggtgc

SEQ ID NO: 9369457 - DNA, 22 bp, Homo sapiens
agctccagaagcctgcaaggta

SEQ ID NO: 9369458 - DNA, 22 bp, Homo sapiens
agctccagcccatctgctcgtg

SEQ ID NO: 9369459 - DNA, 22 bp, Homo sapiens
agctccagcccatctgctcgtg

SEQ ID NO: 9369460 - DNA, 22 bp, Homo sapiens
agctccagccgctgatgggttt

SEQ ID NO: 9369461 - DNA, 22 bp, Homo sapiens
agctccagccctagtacagctg

SEQ ID NO: 9369462 - DNA, 22 bp, Homo sapiens
agctccagccctagtacagctg

SEQ ID NO: 9369463 - DNA, 22 bp, Homo sapiens
agctccagccctagtacagctg

SEQ ID NO: 9369464 - DNA, 22 bp, Homo sapiens
agctccagcctcttctggaggt

SEQ ID NO: 9369465 - DNA, 22 bp, Homo sapiens
agctccagccgctgatgggttt

SEQ ID NO: 9369466 - DNA, 23 bp, Homo sapiens
agctccagaacatagcacaggaa

SEQ ID NO: 9369467 - DNA, 23 bp, Homo sapiens
agctccagaacatagcacaggaa

SEQ ID NO: 9369468 - DNA, 23 bp, Homo sapiens
agctccagaacatagcacaggaa

SEQ ID NO: 9369469 - DNA, 23 bp, Homo sapiens
agctccagaacatagcacaggaa

SEQ ID NO: 9369470 - DNA, 19 bp, Homo sapiens
agctcaggcccatcgtccc

SEQ ID NO: 9369471 - DNA, 19 bp, Homo sapiens
agctcaggcccatcgtccc

SEQ ID NO: 9369472 - DNA, 19 bp, Homo sapiens
agctcaggcccatcgtccc

SEQ ID NO: 9369473 - DNA, 22 bp, Homo sapiens
agctagccatgtggctcctgtg

SEQ ID NO: 9369474 - DNA, 22 bp, Homo sapiens
agctagccatgtggctcctgtg

SEQ ID NO: 9369475 - DNA, 20 bp, Homo sapiens
agctaggagaaagcatggag

SEQ ID NO: 9369476 - DNA, 22 bp, Homo sapiens
agctaggacaggtagagatggg

SEQ ID NO: 9369477 - DNA, 22 bp, Homo sapiens
agctcctgggggttccaagcag

SEQ ID NO: 9369478 - DNA, 18 bp, Homo sapiens
agctcctggtctcaggga

SEQ ID NO: 9369479 - DNA, 22 bp, Homo sapiens
agctcctggtctttgtccagag

SEQ ID NO: 9369480 - DNA, 22 bp, Homo sapiens
agctcctggtgcctcagccgaa

SEQ ID NO: 9369481 - DNA, 22 bp, Homo sapiens
agctcctgtctcaagggagcct

SEQ ID NO: 9369482 - DNA, 19 bp, Homo sapiens
agctcctgggctctgggcc

SEQ ID NO: 9369483 - DNA, 19 bp, Homo sapiens
agctcctgggctctgggcc

SEQ ID NO: 9369484 - DNA, 22 bp, Homo sapiens
agctcctgggccatcacaacca

SEQ ID NO: 9369485 - DNA, 22 bp, Homo sapiens
agctcctgggccaagcccatgc

SEQ ID NO: 9369486 - DNA, 22 bp, Homo sapiens
agctcctggctttcctctcacc

SEQ ID NO: 9369487 - DNA, 22 bp, Homo sapiens
agctcctggcaaggtcatggtg

SEQ ID NO: 9369488 - DNA, 22 bp, Homo sapiens
agctctgggattctcaggccac

SEQ ID NO: 9369489 - DNA, 22 bp, Homo sapiens
agctctgggccaggaaccctaa

SEQ ID NO: 9369490 - DNA, 22 bp, Homo sapiens
agctcctgtggcagctcttctg

SEQ ID NO: 9369491 - DNA, 22 bp, Homo sapiens
agctcctgtggcagctcttctg

SEQ ID NO: 9369492 - DNA, 22 bp, Homo sapiens
agctctgtggccttgggtgaat

SEQ ID NO: 9369493 - DNA, 22 bp, Homo sapiens
agctctgtctttctcttagtaa

SEQ ID NO: 9369494 - DNA, 22 bp, Homo sapiens
agctctgtggccttgggtgaat

SEQ ID NO: 9369495 - DNA, 22 bp, Homo sapiens
agctctggtttagaaggggaaa

SEQ ID NO: 9369496 - DNA, 22 bp, Homo sapiens
agctctggtttagaaggggaaa

SEQ ID NO: 9369497 - DNA, 22 bp, Homo sapiens
agctctgggccaggaaccctaa

SEQ ID NO: 9369498 - DNA, 22 bp, Homo sapiens
agctctggtttagaaggggaaa

SEQ ID NO: 9369499 - DNA, 22 bp, Homo sapiens
agctcttacatttaggtctatg

SEQ ID NO: 9369500 - DNA, 22 bp, Homo sapiens
agctcttacatttaggtctatg

SEQ ID NO: 9369501 - DNA, 22 bp, Homo sapiens
agctcttcctgcacctgtggct

SEQ ID NO: 9369502 - DNA, 22 bp, Homo sapiens
agctctttatgtggaagaggca

SEQ ID NO: 9369503 - DNA, 22 bp, Homo sapiens
agctctttatgggtaaatgcca

SEQ ID NO: 9369504 - DNA, 22 bp, Homo sapiens
agctctttagagtctcccttct

SEQ ID NO: 9369505 - DNA, 22 bp, Homo sapiens
agctctttacacagagtccctc

SEQ ID NO: 9369506 - DNA, 22 bp, Homo sapiens
agctctttaatcttagccccag

SEQ ID NO: 9369507 - DNA, 22 bp, Homo sapiens
agctctttctacaagcaggcag

SEQ ID NO: 9369508 - DNA, 15 bp, Homo sapiens
agctctttcagctac

SEQ ID NO: 9369509 - DNA, 22 bp, Homo sapiens
agctctttcccctccctatggc

SEQ ID NO: 9369510 - DNA, 22 bp, Homo sapiens
agctctttgagaaggcagtgtg

SEQ ID NO: 9369511 - DNA, 22 bp, Homo sapiens
agctctttgactaatcttgctt

SEQ ID NO: 9369512 - DNA, 22 bp, Homo sapiens
agctctttgctggcagtaggct

SEQ ID NO: 9369513 - DNA, 22 bp, Homo sapiens
agctctttggaaggtgtgcact

SEQ ID NO: 9369514 - DNA, 22 bp, Homo sapiens
agctctttgagcaaggcagctc

SEQ ID NO: 9369515 - DNA, 19 bp, Homo sapiens
agctctttgctgcattcca

SEQ ID NO: 9369516 - DNA, 19 bp, Homo sapiens
agctctttgctgcattcca

SEQ ID NO: 9369517 - DNA, 22 bp, Homo sapiens
cagagacatccattttatatgc

SEQ ID NO: 9369518 - DNA, 21 bp, Homo sapiens
agccagctatcacacagcatt

SEQ ID NO: 9369519 - DNA, 22 bp, Homo sapiens
cagagaactccagtggctggcg

SEQ ID NO: 9369520 - DNA, 17 bp, Homo sapiens
agccaggcatatgaagt

SEQ ID NO: 9369521 - DNA, 17 bp, Homo sapiens
agccaggcatatgaagt

SEQ ID NO: 9369522 - DNA, 22 bp, Homo sapiens
agccaggccagactcacaccct

SEQ ID NO: 9369523 - DNA, 22 bp, Homo sapiens
agccaggccagactcacaccct

SEQ ID NO: 9369524 - DNA, 22 bp, Homo sapiens
cagagacctcaaattatttcct

SEQ ID NO: 9369525 - DNA, 21 bp, Homo sapiens
cagagcctgtgttgacagttg

SEQ ID NO: 9369526 - DNA, 21 bp, Homo sapiens
cagagcctgtgttgacagttg

SEQ ID NO: 9369527 - DNA, 22 bp, Homo sapiens
cagagcccagggcctacgtccc

SEQ ID NO: 9369528 - DNA, 20 bp, Homo sapiens
cagagcccactttcttatca

SEQ ID NO: 9369529 - DNA, 22 bp, Homo sapiens
cagagcctggcgatgtcatgga

SEQ ID NO: 9369530 - DNA, 22 bp, Homo sapiens
agccaggccttttctcaaggtt

SEQ ID NO: 9369531 - DNA, 22 bp, Homo sapiens
agccaggccttttctcaaggtt

SEQ ID NO: 9369532 - DNA, 22 bp, Homo sapiens
agccaggccagctgtcttgagt

SEQ ID NO: 9369533 - DNA, 20 bp, Homo sapiens
agccaggcctcaagttaagt

SEQ ID NO: 9369534 - DNA, 22 bp, Homo sapiens
agccaggccagctgtcttgagt

SEQ ID NO: 9369535 - DNA, 22 bp, Homo sapiens
agccaggccttagggagaggca

SEQ ID NO: 9369536 - DNA, 22 bp, Homo sapiens
agccaggccttagggagaggca

SEQ ID NO: 9369537 - DNA, 22 bp, Homo sapiens
cagagctcagagctgccaggca

SEQ ID NO: 9369538 - DNA, 18 bp, Homo sapiens
cagagctcctggatgcag

SEQ ID NO: 9369539 - DNA, 18 bp, Homo sapiens
cagagctcctggatgcag

SEQ ID NO: 9369540 - DNA, 18 bp, Homo sapiens
cagagctcctggatgcag

SEQ ID NO: 9369541 - DNA, 22 bp, Homo sapiens
cagagctcagagcagggcactc

SEQ ID NO: 9369542 - DNA, 22 bp, Homo sapiens
cagagctcagagctgccaggca

SEQ ID NO: 9369543 - DNA, 22 bp, Homo sapiens
cagagctcagagcagggcactc

SEQ ID NO: 9369544 - DNA, 22 bp, Homo sapiens
cagagccttagttctcctagaa

SEQ ID NO: 9369545 - DNA, 22 bp, Homo sapiens
cagagccttagttctcctagaa

SEQ ID NO: 9369546 - DNA, 22 bp, Homo sapiens
cagagccttagttctcctagaa

SEQ ID NO: 9369547 - DNA, 22 bp, Homo sapiens
cagagccttcctagcagactct

SEQ ID NO: 9369548 - DNA, 19 bp, Homo sapiens
cagagccttcagtgactcc

SEQ ID NO: 9369549 - DNA, 19 bp, Homo sapiens
agccagcagcgtagcatct

SEQ ID NO: 9369550 - DNA, 22 bp, Homo sapiens
agccagcacggcgccatggagt

SEQ ID NO: 9369551 - DNA, 21 bp, Homo sapiens
agccagcaacacagcatctcc

SEQ ID NO: 9369552 - DNA, 22 bp, Homo sapiens
agccagcacggatttcccagga

SEQ ID NO: 9369553 - DNA, 22 bp, Homo sapiens
agccagagatccatccctagga

SEQ ID NO: 9369554 - DNA, 19 bp, Homo sapiens
agccagagtggcccagggg

SEQ ID NO: 9369555 - DNA, 22 bp, Homo sapiens
cactttctgtgtatcttccatt

SEQ ID NO: 9369556 - DNA, 22 bp, Homo sapiens
cactttctgtgtatcttccatt

SEQ ID NO: 9369557 - DNA, 22 bp, Homo sapiens
cactttataaaattggtgtgag

SEQ ID NO: 9369558 - DNA, 22 bp, Homo sapiens
cactttactatctataaaataa

SEQ ID NO: 9369559 - DNA, 22 bp, Homo sapiens
cactttatgggaagcaaaaatt

SEQ ID NO: 9369560 - DNA, 22 bp, Homo sapiens
cactttatattctaagacggcc

SEQ ID NO: 9369561 - DNA, 17 bp, Homo sapiens
agccagcagtagctggt

SEQ ID NO: 9369562 - DNA, 17 bp, Homo sapiens
agccagcagtagctggt

SEQ ID NO: 9369563 - DNA, 22 bp, Homo sapiens
agccagcagggcttagaggaca

SEQ ID NO: 9369564 - DNA, 22 bp, Homo sapiens
agccagcaggtgagtgcagcct

SEQ ID NO: 9369565 - DNA, 22 bp, Homo sapiens
agccagcagggcttagaggaca

SEQ ID NO: 9369566 - DNA, 22 bp, Homo sapiens
agccagcccctgactgtgtcct

SEQ ID NO: 9369567 - DNA, 22 bp, Homo sapiens
agccagcccctgactgtgtcct

SEQ ID NO: 9369568 - DNA, 22 bp, Homo sapiens
agccagcctgatctcttcttgc

SEQ ID NO: 9369569 - DNA, 22 bp, Homo sapiens
agccagccgggggaccacagtg

SEQ ID NO: 9369570 - DNA, 22 bp, Homo sapiens
agccagctaagggaagcatgat

SEQ ID NO: 9369571 - DNA, 20 bp, Homo sapiens
agccagccacttcctgctcc

SEQ ID NO: 9369572 - DNA, 20 bp, Homo sapiens
agccagccacttcctgctcc

SEQ ID NO: 9369573 - DNA, 22 bp, Homo sapiens
agccagccagttcactaggaaa

SEQ ID NO: 9369574 - DNA, 22 bp, Homo sapiens
cagatggctgccttcttgctgt

SEQ ID NO: 9369575 - DNA, 22 bp, Homo sapiens
cagatggctgccttcttgctgt

SEQ ID NO: 9369576 - DNA, 22 bp, Homo sapiens
cagatggcagggcagctctgca

SEQ ID NO: 9369577 - DNA, 20 bp, Homo sapiens
cagatggcacgtcagggcat

SEQ ID NO: 9369578 - DNA, 22 bp, Homo sapiens
cagatggcagggcagctctgca

SEQ ID NO: 9369579 - DNA, 22 bp, Homo sapiens
cagatggccagaggcagctgca

SEQ ID NO: 9369580 - DNA, 22 bp, Homo sapiens
agccctgggcagccaaggaagc

SEQ ID NO: 9369581 - DNA, 22 bp, Homo sapiens
agccctgggcgttactgggatg

SEQ ID NO: 9369582 - DNA, 22 bp, Homo sapiens
cagatgaaggcctgaatgtcta

SEQ ID NO: 9369583 - DNA, 22 bp, Homo sapiens
agccctgggaggccagcttgta

SEQ ID NO: 9369584 - DNA, 22 bp, Homo sapiens
agccctgggaggccagcttgta

SEQ ID NO: 9369585 - DNA, 22 bp, Homo sapiens
agccctggctcccagcagcgct

SEQ ID NO: 9369586 - DNA, 22 bp, Homo sapiens
agccctggcccggctgtgcttt

SEQ ID NO: 9369587 - DNA, 22 bp, Homo sapiens
agccctggctcccagcagcgct

SEQ ID NO: 9369588 - DNA, 22 bp, Homo sapiens
agccctggcccggctgtgcttt

SEQ ID NO: 9369589 - DNA, 22 bp, Homo sapiens
agccctggcccggctgtgcttt

SEQ ID NO: 9369590 - DNA, 23 bp, Homo sapiens
agccctgctgagacccagctccc

SEQ ID NO: 9369591 - DNA, 22 bp, Homo sapiens
agccctgctcatctggatcccg

SEQ ID NO: 9369592 - DNA, 22 bp, Homo sapiens
agccctgctcatctggatcccg

SEQ ID NO: 9369593 - DNA, 22 bp, Homo sapiens
agccctgcgtgccaggggactg

SEQ ID NO: 9369594 - DNA, 22 bp, Homo sapiens
agccctgattaaccttggcttt

SEQ ID NO: 9369595 - DNA, 23 bp, Homo sapiens
agccctgctgagacccagctccc

SEQ ID NO: 9369596 - DNA, 23 bp, Homo sapiens
agccctgctgagacccagctccc

SEQ ID NO: 9369597 - DNA, 22 bp, Homo sapiens
agccctgctgcctgaattagct

SEQ ID NO: 9369598 - DNA, 22 bp, Homo sapiens
agccccagttccctggaagtct

SEQ ID NO: 9369599 - DNA, 22 bp, Homo sapiens
agccctgagccagcctggtcag

SEQ ID NO: 9369600 - DNA, 22 bp, Homo sapiens
agccctgagctggcctgggctt

SEQ ID NO: 9369601 - DNA, 22 bp, Homo sapiens
agccctggagcaaaggtgtctt

SEQ ID NO: 9369602 - DNA, 22 bp, Homo sapiens
agccctggaagccacagtccta

SEQ ID NO: 9369603 - DNA, 22 bp, Homo sapiens
agccctgcttcaccatttactt

SEQ ID NO: 9369604 - DNA, 22 bp, Homo sapiens
agccctgctgcttcttgtattt

SEQ ID NO: 9369605 - DNA, 22 bp, Homo sapiens
agccctggcagagccaggtagt

SEQ ID NO: 9369606 - DNA, 22 bp, Homo sapiens
agccctggattctgaggtccaa

SEQ ID NO: 9369607 - DNA, 22 bp, Homo sapiens
agccagtgcaacagcagtgaag

SEQ ID NO: 9369608 - DNA, 22 bp, Homo sapiens
agccagtgccagtcatgcctgc

SEQ ID NO: 9369609 - DNA, 22 bp, Homo sapiens
agccagtgccagtcatgcctgc

SEQ ID NO: 9369610 - DNA, 22 bp, Homo sapiens
agccagtggaattcccaggggt

SEQ ID NO: 9369611 - DNA, 22 bp, Homo sapiens
agccagtgccagtcatgcctgc

SEQ ID NO: 9369612 - DNA, 22 bp, Homo sapiens
agccagtgcagctggaaattca

SEQ ID NO: 9369613 - DNA, 22 bp, Homo sapiens
agccagtgcaacagcagtgaag

SEQ ID NO: 9369614 - DNA, 22 bp, Homo sapiens
cagagctctatgttcatggagg

SEQ ID NO: 9369615 - DNA, 22 bp, Homo sapiens
cagagctctatgttcatggagg

SEQ ID NO: 9369616 - DNA, 22 bp, Homo sapiens
cagagctctctttgctactaca

SEQ ID NO: 9369617 - DNA, 22 bp, Homo sapiens
cagagctctgacagctacagcc

SEQ ID NO: 9369618 - DNA, 22 bp, Homo sapiens
agccagtggaattcccaggggt

SEQ ID NO: 9369619 - DNA, 22 bp, Homo sapiens
agccagtgggattagagcctct

SEQ ID NO: 9369620 - DNA, 22 bp, Homo sapiens
agccagtgggattagagcctct

SEQ ID NO: 9369621 - DNA, 22 bp, Homo sapiens
agccagtggtgtaatgccgtct

SEQ ID NO: 9369622 - DNA, 22 bp, Homo sapiens
agccagtgtcgtgtgacatgag

SEQ ID NO: 9369623 - DNA, 22 bp, Homo sapiens
agccagtgtcgtgtgacatgag

SEQ ID NO: 9369624 - DNA, 22 bp, Homo sapiens
agccagtgttaagtgactggtt

SEQ ID NO: 9369625 - DNA, 22 bp, Homo sapiens
agccagtgttaagtgactggtt

SEQ ID NO: 9369626 - DNA, 22 bp, Homo sapiens
agccagttccagcacaccactg

SEQ ID NO: 9369627 - DNA, 22 bp, Homo sapiens
agcccagggagttgattagcat

SEQ ID NO: 9369628 - DNA, 22 bp, Homo sapiens
agcccaggttgaggctgcagtg

SEQ ID NO: 9369629 - DNA, 22 bp, Homo sapiens
agcccaggttgaggctgcagtg

SEQ ID NO: 9369630 - DNA, 22 bp, Homo sapiens
agcccaggttctaaagccaaac

SEQ ID NO: 9369631 - DNA, 23 bp, Homo sapiens
agccagttgtagccacagaactc

SEQ ID NO: 9369632 - DNA, 22 bp, Homo sapiens
agccagttgtggggctagccct

SEQ ID NO: 9369633 - DNA, 22 bp, Homo sapiens
agcccagggacagggcggatgt

SEQ ID NO: 9369634 - DNA, 22 bp, Homo sapiens
agcccaggttgaggctgcagtg

SEQ ID NO: 9369635 - DNA, 22 bp, Homo sapiens
agcccaggttgaggctgcagtg

SEQ ID NO: 9369636 - DNA, 22 bp, Homo sapiens
agccccacactctctctgagaa

SEQ ID NO: 9369637 - DNA, 22 bp, Homo sapiens
agcccatggtgtactctgtggc

SEQ ID NO: 9369638 - DNA, 22 bp, Homo sapiens
agcccatggtgtactctgtggc

SEQ ID NO: 9369639 - DNA, 22 bp, Homo sapiens
agcccatgcaaatactcggtga

SEQ ID NO: 9369640 - DNA, 22 bp, Homo sapiens
agcccatgcaaatactcggtga

SEQ ID NO: 9369641 - DNA, 22 bp, Homo sapiens
agcccatgcaacaggcctagcg

SEQ ID NO: 9369642 - DNA, 22 bp, Homo sapiens
agccccaggatgggccgcagga

SEQ ID NO: 9369643 - DNA, 22 bp, Homo sapiens
agccccaggatgggccgcagga

SEQ ID NO: 9369644 - DNA, 22 bp, Homo sapiens
agccccagcccctctctcacaa

SEQ ID NO: 9369645 - DNA, 22 bp, Homo sapiens
agccccagcccctctctcacaa

SEQ ID NO: 9369646 - DNA, 22 bp, Homo sapiens
agccccacgttgtctagcacct

SEQ ID NO: 9369647 - DNA, 22 bp, Homo sapiens
agcagctcaaagcctgcaagga

SEQ ID NO: 9369648 - DNA, 22 bp, Homo sapiens
agcagctcatggagtaggcact

SEQ ID NO: 9369649 - DNA, 19 bp, Homo sapiens
agcagctcagggaggcacc

SEQ ID NO: 9369650 - DNA, 22 bp, Homo sapiens
agcagcctttgatcatctggga

SEQ ID NO: 9369651 - DNA, 21 bp, Homo sapiens
agcagccttgtgtgccaggca

SEQ ID NO: 9369652 - DNA, 22 bp, Homo sapiens
agcagcctttgatcatctggga

SEQ ID NO: 9369653 - DNA, 22 bp, Homo sapiens
agcagcctttgatcatctggga

SEQ ID NO: 9369654 - DNA, 22 bp, Homo sapiens
agcagcgagccagctctgcggg

SEQ ID NO: 9369655 - DNA, 22 bp, Homo sapiens
cacagagatcggaacagaagta

SEQ ID NO: 9369656 - DNA, 22 bp, Homo sapiens
agcagctcccctcatgctccac

SEQ ID NO: 9369657 - DNA, 22 bp, Homo sapiens
agcagctggcagcttcttctct

SEQ ID NO: 9369658 - DNA, 21 bp, Homo sapiens
agcagctgggcaacatggagg

SEQ ID NO: 9369659 - DNA, 17 bp, Homo sapiens
agcagctggcacaggag

SEQ ID NO: 9369660 - DNA, 17 bp, Homo sapiens
agcagctggcacaggag

SEQ ID NO: 9369661 - DNA, 19 bp, Homo sapiens
agcagctggaggtggagtg

SEQ ID NO: 9369662 - DNA, 19 bp, Homo sapiens
agcagctggaggtggagtg

SEQ ID NO: 9369663 - DNA, 22 bp, Homo sapiens
cacagagatggccagggcacat

SEQ ID NO: 9369664 - DNA, 22 bp, Homo sapiens
cacagagattagaattagacta

SEQ ID NO: 9369665 - DNA, 22 bp, Homo sapiens
cacagagcaactcaaatcagct

SEQ ID NO: 9369666 - DNA, 22 bp, Homo sapiens
cacagagcaggtgctgggaaga

SEQ ID NO: 9369667 - DNA, 22 bp, Homo sapiens
agcagctggaacatatgaagaa

SEQ ID NO: 9369668 - DNA, 22 bp, Homo sapiens
agcagctggaacatatgaagaa

SEQ ID NO: 9369669 - DNA, 22 bp, Homo sapiens
agcagctggaactaatagtggt

SEQ ID NO: 9369670 - DNA, 22 bp, Homo sapiens
agcagcagatcaaacaggcttg

SEQ ID NO: 9369671 - DNA, 22 bp, Homo sapiens
agcagcagatcaaacaggcttg

SEQ ID NO: 9369672 - DNA, 22 bp, Homo sapiens
agcagcagatcaaacaggcttg

SEQ ID NO: 9369673 - DNA, 22 bp, Homo sapiens
agcagcagatccaaaaaatgtg

SEQ ID NO: 9369674 - DNA, 21 bp, Homo sapiens
agcagcagatctggtgagggc

SEQ ID NO: 9369675 - DNA, 22 bp, Homo sapiens
agcagcagatccaaaaaatgtg

SEQ ID NO: 9369676 - DNA, 21 bp, Homo sapiens
agcagcagatctggtgagggc

SEQ ID NO: 9369677 - DNA, 22 bp, Homo sapiens
agcagcagaggtcagaaaggta

SEQ ID NO: 9369678 - DNA, 22 bp, Homo sapiens
agcagcagaggtcagaaaggta

SEQ ID NO: 9369679 - DNA, 22 bp, Homo sapiens
agcagcagagctctggtctgca

SEQ ID NO: 9369680 - DNA, 22 bp, Homo sapiens
agcagcagagctctggtctgca

SEQ ID NO: 9369681 - DNA, 22 bp, Homo sapiens
agcagcagaggtcagaaaggta

SEQ ID NO: 9369682 - DNA, 19 bp, Homo sapiens
agcagcagaagtgtgcctt

SEQ ID NO: 9369683 - DNA, 19 bp, Homo sapiens
agcagcagaagtgtgcctt

SEQ ID NO: 9369684 - DNA, 19 bp, Homo sapiens
agcagcagaagtgtgcctt

SEQ ID NO: 9369685 - DNA, 22 bp, Homo sapiens
agcagcagagctctggtctgca

SEQ ID NO: 9369686 - DNA, 19 bp, Homo sapiens
agcagcagaagtgtgcctt

SEQ ID NO: 9369687 - DNA, 16 bp, Homo sapiens
caatacatggcatttc

SEQ ID NO: 9369688 - DNA, 22 bp, Homo sapiens
caatacatcaggtcaaaatgtg

SEQ ID NO: 9369689 - DNA, 22 bp, Homo sapiens
caatacatcaggtcaaaatgtg

SEQ ID NO: 9369690 - DNA, 22 bp, Homo sapiens
agcagccctagggattgctgtt

SEQ ID NO: 9369691 - DNA, 22 bp, Homo sapiens
agcagccctatgtaattggact

SEQ ID NO: 9369692 - DNA, 22 bp, Homo sapiens
agcagcccgaggatcatgtgtc

SEQ ID NO: 9369693 - DNA, 22 bp, Homo sapiens
agcagcccctcggcgggtgcgc

SEQ ID NO: 9369694 - DNA, 22 bp, Homo sapiens
agcagcccctcggcgggtgcgc

SEQ ID NO: 9369695 - DNA, 23 bp, Homo sapiens
agcagcccagatgccttccatcc

SEQ ID NO: 9369696 - DNA, 22 bp, Homo sapiens
agcagcccagttgtactgagtg

SEQ ID NO: 9369697 - DNA, 22 bp, Homo sapiens
agcagcccaggcaaagataaaa

SEQ ID NO: 9369698 - DNA, 21 bp, Homo sapiens
agcagcagatctggtgagggc

SEQ ID NO: 9369699 - DNA, 20 bp, Homo sapiens
agcagcagatgttggaggtg

SEQ ID NO: 9369700 - DNA, 21 bp, Homo sapiens
agcagcagatctggtgagggc

SEQ ID NO: 9369701 - DNA, 22 bp, Homo sapiens
agcagccagagaatgatgcagt

SEQ ID NO: 9369702 - DNA, 22 bp, Homo sapiens
agcagcccagataaagctcagg

SEQ ID NO: 9369703 - DNA, 23 bp, Homo sapiens
agcagcccaatggcaagctctgg

SEQ ID NO: 9369704 - DNA, 23 bp, Homo sapiens
agcagccctgggacctggcctgc

SEQ ID NO: 9369705 - DNA, 23 bp, Homo sapiens
agcagccctgggacctggcctgc

SEQ ID NO: 9369706 - DNA, 23 bp, Homo sapiens
agcagccctgggacctggcctgc

SEQ ID NO: 9369707 - DNA, 22 bp, Homo sapiens
agcagcctattcttctcttgga

SEQ ID NO: 9369708 - DNA, 22 bp, Homo sapiens
agcagcctcccagggagcagcc

SEQ ID NO: 9369709 - DNA, 22 bp, Homo sapiens
agcagccttaggtattgtgatt

SEQ ID NO: 9369710 - DNA, 21 bp, Homo sapiens
agcagccttgtgtgccaggca

SEQ ID NO: 9369711 - DNA, 22 bp, Homo sapiens
caaagggcattttagtgaactg

SEQ ID NO: 9369712 - DNA, 22 bp, Homo sapiens
caaagggcattttagtgaactg

SEQ ID NO: 9369713 - DNA, 22 bp, Homo sapiens
caaagggcatggcctgagcact

SEQ ID NO: 9369714 - DNA, 22 bp, Homo sapiens
caaaggcctgagaactgagggg

SEQ ID NO: 9369715 - DNA, 17 bp, Homo sapiens
agcacctgtccagtccc

SEQ ID NO: 9369716 - DNA, 23 bp, Homo sapiens
agcacctgtgatttcctagctct

SEQ ID NO: 9369717 - DNA, 22 bp, Homo sapiens
agcacctgtcacaagcagaagg

SEQ ID NO: 9369718 - DNA, 22 bp, Homo sapiens
agcacctgggaagctattctca

SEQ ID NO: 9369719 - DNA, 22 bp, Homo sapiens
agcaccaggtcgctggcacgct

SEQ ID NO: 9369720 - DNA, 23 bp, Homo sapiens
agcacgggtacagcctggccagg

SEQ ID NO: 9369721 - DNA, 22 bp, Homo sapiens
agcaccttgctcttggccttcc

SEQ ID NO: 9369722 - DNA, 22 bp, Homo sapiens
agcaccttgatcttggacttcc

SEQ ID NO: 9369723 - DNA, 22 bp, Homo sapiens
agcaccttgagatcaagcagtg

SEQ ID NO: 9369724 - DNA, 22 bp, Homo sapiens
agcacctgtggctcatgctcgt

SEQ ID NO: 9369725 - DNA, 21 bp, Homo sapiens
agcaccttacagctataatgg

SEQ ID NO: 9369726 - DNA, 22 bp, Homo sapiens
agcacctgttgcacttcataat

SEQ ID NO: 9369727 - DNA, 22 bp, Homo sapiens
agcacctgtgttcatgcctcat

SEQ ID NO: 9369728 - DNA, 22 bp, Homo sapiens
agcactagctttaagcattctg

SEQ ID NO: 9369729 - DNA, 22 bp, Homo sapiens
agcactctggagtaggagtggg

SEQ ID NO: 9369730 - DNA, 22 bp, Homo sapiens
agcactctaagtgcaagacact

SEQ ID NO: 9369731 - DNA, 22 bp, Homo sapiens
agcactgatttaaactggattt

SEQ ID NO: 9369732 - DNA, 22 bp, Homo sapiens
agcactgattttgttgcactta

SEQ ID NO: 9369733 - DNA, 22 bp, Homo sapiens
agcactggagtttagtgggatt

SEQ ID NO: 9369734 - DNA, 22 bp, Homo sapiens
agcactgggaacgcatggggcc

SEQ ID NO: 9369735 - DNA, 20 bp, Homo sapiens
caataatttacttccctatt

SEQ ID NO: 9369736 - DNA, 22 bp, Homo sapiens
caataatttacattggatacca

SEQ ID NO: 9369737 - DNA, 22 bp, Homo sapiens
caataattgctttccagagtta

SEQ ID NO: 9369738 - DNA, 20 bp, Homo sapiens
caataatttacttccctatt

SEQ ID NO: 9369739 - DNA, 22 bp, Homo sapiens
caatacaattaccagttaatca

SEQ ID NO: 9369740 - DNA, 22 bp, Homo sapiens
caagtgacagtttgaaagccag

SEQ ID NO: 9369741 - DNA, 22 bp, Homo sapiens
caagtgacattcaatactagag

SEQ ID NO: 9369742 - DNA, 22 bp, Homo sapiens
caagtgagtgaccagagttggt

SEQ ID NO: 9369743 - DNA, 22 bp, Homo sapiens
agcagaggtttgttggaaacct

SEQ ID NO: 9369744 - DNA, 22 bp, Homo sapiens
agcagaggtttgttggaaacct

SEQ ID NO: 9369745 - DNA, 16 bp, Homo sapiens
agcagaggtgagtgaa

SEQ ID NO: 9369746 - DNA, 22 bp, Homo sapiens
agcagaggtgtttattatggga

SEQ ID NO: 9369747 - DNA, 22 bp, Homo sapiens
agcagaggtgtttattatggga

SEQ ID NO: 9369748 - DNA, 21 bp, Homo sapiens
agcagaggggacatgtttgat

SEQ ID NO: 9369749 - DNA, 21 bp, Homo sapiens
agcagaggggacatgtttgat

SEQ ID NO: 9369750 - DNA, 22 bp, Homo sapiens
agcagagctgcagtggcctgct

SEQ ID NO: 9369751 - DNA, 22 bp, Homo sapiens
agcagagctgcagtggcctgct

SEQ ID NO: 9369752 - DNA, 22 bp, Homo sapiens
agcactgtggggaactcacaga

SEQ ID NO: 9369753 - DNA, 22 bp, Homo sapiens
agcagagaccatatagcccaga

SEQ ID NO: 9369754 - DNA, 22 bp, Homo sapiens
agcagagaggaggtggccctgt

SEQ ID NO: 9369755 - DNA, 21 bp, Homo sapiens
agcagaggctgcctggtgact

SEQ ID NO: 9369756 - DNA, 21 bp, Homo sapiens
agcagaggctgcctggtgact

SEQ ID NO: 9369757 - DNA, 21 bp, Homo sapiens
agcagaggcagaatgtatgca

SEQ ID NO: 9369758 - DNA, 21 bp, Homo sapiens
agcagaggcagaatgtatgca

SEQ ID NO: 9369759 - DNA, 22 bp, Homo sapiens
agcagaggaggatttagttagg

SEQ ID NO: 9369760 - DNA, 22 bp, Homo sapiens
agcagaggaggatttagttagg

SEQ ID NO: 9369761 - DNA, 22 bp, Homo sapiens
agcagaggacagttcttaggaa

SEQ ID NO: 9369762 - DNA, 22 bp, Homo sapiens
agcagagctttttggactcaga

SEQ ID NO: 9369763 - DNA, 22 bp, Homo sapiens
agcagagctgggatcctgggtc

SEQ ID NO: 9369764 - DNA, 20 bp, Homo sapiens
agcatgcagccagagccaac

SEQ ID NO: 9369765 - DNA, 22 bp, Homo sapiens
agcatgcaggaaccacatggca

SEQ ID NO: 9369766 - DNA, 22 bp, Homo sapiens
agcatgcgcttgatcagctcca

SEQ ID NO: 9369767 - DNA, 22 bp, Homo sapiens
agcatgcatgaagattcagcaa

SEQ ID NO: 9369768 - DNA, 22 bp, Homo sapiens
agcatgcatttttggactgtgc

SEQ ID NO: 9369769 - DNA, 23 bp, Homo sapiens
agcatggaataggaaagaggcag

SEQ ID NO: 9369770 - DNA, 18 bp, Homo sapiens
agcatggcacaggctccc

SEQ ID NO: 9369771 - DNA, 22 bp, Homo sapiens
agcatggcattattggaaggac

SEQ ID NO: 9369772 - DNA, 22 bp, Homo sapiens
agcatggcactcaaggctcctg

SEQ ID NO: 9369773 - DNA, 22 bp, Homo sapiens
agcatggggctccgcaatgaac

SEQ ID NO: 9369774 - DNA, 22 bp, Homo sapiens
agcatggtctgatcaggtggct

SEQ ID NO: 9369775 - DNA, 22 bp, Homo sapiens
agcatggcctgcagcggccacc

SEQ ID NO: 9369776 - DNA, 22 bp, Homo sapiens
agcatggcctcccgggcctggc

SEQ ID NO: 9369777 - DNA, 19 bp, Homo sapiens
agcatggcctacagtgtgc

SEQ ID NO: 9369778 - DNA, 22 bp, Homo sapiens
agcatggccatctgggccgtcc

SEQ ID NO: 9369779 - DNA, 22 bp, Homo sapiens
agcatggggcaatgcatgtgct

SEQ ID NO: 9369780 - DNA, 22 bp, Homo sapiens
agcatggctttggaggatagca

SEQ ID NO: 9369781 - DNA, 22 bp, Homo sapiens
agcatggggcaatgcatgtgct

SEQ ID NO: 9369782 - DNA, 22 bp, Homo sapiens
agcattacagtggtacccaggg

SEQ ID NO: 9369783 - DNA, 22 bp, Homo sapiens
agcattaataagaaatggctcc

SEQ ID NO: 9369784 - DNA, 22 bp, Homo sapiens
agcattactattctcaaaaaca

SEQ ID NO: 9369785 - DNA, 22 bp, Homo sapiens
cactggtgagtccagaagtcat

SEQ ID NO: 9369786 - DNA, 22 bp, Homo sapiens
cactgtgtcagagtatgatgat

SEQ ID NO: 9369787 - DNA, 19 bp, Homo sapiens
cactgtggtccttcactgc

SEQ ID NO: 9369788 - DNA, 22 bp, Homo sapiens
cactgtttggctcctgtactta

SEQ ID NO: 9369789 - DNA, 22 bp, Homo sapiens
cactgtgtctggagtgagctgg

SEQ ID NO: 9369790 - DNA, 22 bp, Homo sapiens
cactttactatctataaaataa

SEQ ID NO: 9369791 - DNA, 22 bp, Homo sapiens
cactttacccttgttactcatg

SEQ ID NO: 9369792 - DNA, 22 bp, Homo sapiens
cactttactatctataaaataa

SEQ ID NO: 9369793 - DNA, 23 bp, Homo sapiens
agcagtgagtaaacagataggat

SEQ ID NO: 9369794 - DNA, 22 bp, Homo sapiens
agcagtgagtgggaggaccatg

SEQ ID NO: 9369795 - DNA, 22 bp, Homo sapiens
agcagtggacctcagtgctatt

SEQ ID NO: 9369796 - DNA, 22 bp, Homo sapiens
agcagtggacctcagtgctatt

SEQ ID NO: 9369797 - DNA, 22 bp, Homo sapiens
agcagtgcccattctgccccct

SEQ ID NO: 9369798 - DNA, 22 bp, Homo sapiens
agcatgaagacttcagagctag

SEQ ID NO: 9369799 - DNA, 22 bp, Homo sapiens
agcatgaaaggcgtgccaactt

SEQ ID NO: 9369800 - DNA, 22 bp, Homo sapiens
agcatgaaagcataggacagtc

SEQ ID NO: 9369801 - DNA, 22 bp, Homo sapiens
agcatgaaaggcgtgccaactt

SEQ ID NO: 9369802 - DNA, 21 bp, Homo sapiens
agcatgcactacttcatctta

SEQ ID NO: 9369803 - DNA, 22 bp, Homo sapiens
agcatgaaagcataggacagtc

SEQ ID NO: 9369804 - DNA, 22 bp, Homo sapiens
agcatattgtatgtctatatgt

SEQ ID NO: 9369805 - DNA, 22 bp, Homo sapiens
agcagtggcctggggctctgtg

SEQ ID NO: 9369806 - DNA, 22 bp, Homo sapiens
agcagtccaactgaggtggcat

SEQ ID NO: 9369807 - DNA, 22 bp, Homo sapiens
agcagtccaactgaggtggcat

SEQ ID NO: 9369808 - DNA, 20 bp, Homo sapiens
agcagtccaaaagggcagac

SEQ ID NO: 9369809 - DNA, 22 bp, Homo sapiens
agcagtaagtgaagactagttt

SEQ ID NO: 9369810 - DNA, 18 bp, Homo sapiens
agcaggttctcacagcca

SEQ ID NO: 9369811 - DNA, 22 bp, Homo sapiens
agcaggtgtttgtatcataagg

SEQ ID NO: 9369812 - DNA, 22 bp, Homo sapiens
agcaggtgtcggcgagggtctt

SEQ ID NO: 9369813 - DNA, 22 bp, Homo sapiens
agcaggtgtcggcgagggtctt

SEQ ID NO: 9369814 - DNA, 22 bp, Homo sapiens
agcaggtgttagggatccaatg

SEQ ID NO: 9369815 - DNA, 18 bp, Homo sapiens
agcaggtgtgcagaatgt

SEQ ID NO: 9369816 - DNA, 18 bp, Homo sapiens
agcaggtgtgcagaatgt

SEQ ID NO: 9369817 - DNA, 18 bp, Homo sapiens
agcaggtgtgcagaatgt

SEQ ID NO: 9369818 - DNA, 22 bp, Homo sapiens
agcaggtgttggctgggccatc

SEQ ID NO: 9369819 - DNA, 22 bp, Homo sapiens
agcaggtgtttgtatcataagg

SEQ ID NO: 9369820 - DNA, 22 bp, Homo sapiens
agcaggtgttggctgggccatc

SEQ ID NO: 9369821 - DNA, 22 bp, Homo sapiens
agcaggtgttagggatccaatg

SEQ ID NO: 9369822 - DNA, 22 bp, Homo sapiens
agcaggtgttggctgggccatc

SEQ ID NO: 9369823 - DNA, 22 bp, Homo sapiens
agcagggctggggcacgagcca

SEQ ID NO: 9369824 - DNA, 22 bp, Homo sapiens
agcaggtgggcatgaaagctga

SEQ ID NO: 9369825 - DNA, 22 bp, Homo sapiens
agcaggtgggcatgaaagctga

SEQ ID NO: 9369826 - DNA, 19 bp, Homo sapiens
agcaggtgggtaagaaaat

SEQ ID NO: 9369827 - DNA, 22 bp, Homo sapiens
agcaggtgtcggcgagggtctt

SEQ ID NO: 9369828 - DNA, 22 bp, Homo sapiens
agcagggctggatttggcaaga

SEQ ID NO: 9369829 - DNA, 22 bp, Homo sapiens
agcagggctggatttggcaaga

SEQ ID NO: 9369830 - DNA, 22 bp, Homo sapiens
agcagggctggggcacgagcca

SEQ ID NO: 9369831 - DNA, 22 bp, Homo sapiens
agcagggctggggcacgagcca

SEQ ID NO: 9369832 - DNA, 22 bp, Homo sapiens
agcagggctctgtggagggtgg

SEQ ID NO: 9369833 - DNA, 22 bp, Homo sapiens
agcagggctctgccatgggccc

SEQ ID NO: 9369834 - DNA, 22 bp, Homo sapiens
agcagggctctgtggagggtgg

SEQ ID NO: 9369835 - DNA, 22 bp, Homo sapiens
agcagggctctgtggagggtgg

SEQ ID NO: 9369836 - DNA, 22 bp, Homo sapiens
agcagggctctgtggagggtgg

SEQ ID NO: 9369837 - DNA, 22 bp, Homo sapiens
agcagggctgcggccccaccac

SEQ ID NO: 9369838 - DNA, 22 bp, Homo sapiens
agcagggctgcagtgtgtcttt

SEQ ID NO: 9369839 - DNA, 22 bp, Homo sapiens
agcagggctgcagtgtgtcttt

SEQ ID NO: 9369840 - DNA, 22 bp, Homo sapiens
agcagggctctgtggagggtgg

SEQ ID NO: 9369841 - DNA, 22 bp, Homo sapiens
caccagccagagtgacagctcc

SEQ ID NO: 9369842 - DNA, 22 bp, Homo sapiens
caccagcagaagactgagggtg

SEQ ID NO: 9369843 - DNA, 23 bp, Homo sapiens
caccactttctccttctccttgg

SEQ ID NO: 9369844 - DNA, 22 bp, Homo sapiens
caccagaacaagacaggagaat

SEQ ID NO: 9369845 - DNA, 22 bp, Homo sapiens
agcagggcactggaaggcactg

SEQ ID NO: 9369846 - DNA, 22 bp, Homo sapiens
agcagggcactggaaggcactg

SEQ ID NO: 9369847 - DNA, 22 bp, Homo sapiens
agcagggcaaagtcaggctaac

SEQ ID NO: 9369848 - DNA, 22 bp, Homo sapiens
agcagggcaaagtcaggctaac

SEQ ID NO: 9369849 - DNA, 22 bp, Homo sapiens
agcagggcagctgatgcgcacg

SEQ ID NO: 9369850 - DNA, 22 bp, Homo sapiens
agcagggcagctgatgcgcacg

SEQ ID NO: 9369851 - DNA, 22 bp, Homo sapiens
agcagggcagctgatgcgcacg

SEQ ID NO: 9369852 - DNA, 17 bp, Homo sapiens
agcagggagtcaaggga

SEQ ID NO: 9369853 - DNA, 17 bp, Homo sapiens
agcagggagtcaaggga

SEQ ID NO: 9369854 - DNA, 19 bp, Homo sapiens
agcagggagtggttgtggg

SEQ ID NO: 9369855 - DNA, 22 bp, Homo sapiens
agcagggcaaagtcaggctaac

SEQ ID NO: 9369856 - DNA, 22 bp, Homo sapiens
agcagggcaaagtcaggctaac

SEQ ID NO: 9369857 - DNA, 22 bp, Homo sapiens
agcagggcaaagtcaggctaac

SEQ ID NO: 9369858 - DNA, 22 bp, Homo sapiens
agcagggcaggtaaggatcaga

SEQ ID NO: 9369859 - DNA, 22 bp, Homo sapiens
agcagggcaggtaaggatcaga

SEQ ID NO: 9369860 - DNA, 22 bp, Homo sapiens
agcagggcaggtaaggatcaga

SEQ ID NO: 9369861 - DNA, 22 bp, Homo sapiens
agcagggcaggtaaggatcaga

SEQ ID NO: 9369862 - DNA, 22 bp, Homo sapiens
agcagggcagcttttttcagaa

SEQ ID NO: 9369863 - DNA, 22 bp, Homo sapiens
agcagggcagcttttttcagaa

SEQ ID NO: 9369864 - DNA, 22 bp, Homo sapiens
agcagggcagtgatcagaaagg

SEQ ID NO: 9369865 - DNA, 22 bp, Homo sapiens
agcagggcagtgatcagaaagg

SEQ ID NO: 9369866 - DNA, 22 bp, Homo sapiens
cacatttaatcctttataagta

SEQ ID NO: 9369867 - DNA, 22 bp, Homo sapiens
cacatttaatcctttataagta

SEQ ID NO: 9369868 - DNA, 22 bp, Homo sapiens
cacatttaattggtttagggtg

SEQ ID NO: 9369869 - DNA, 22 bp, Homo sapiens
cacatttaatcctttataagta

SEQ ID NO: 9369870 - DNA, 23 bp, Homo sapiens
caccactttctccttctccttgg

SEQ ID NO: 9369871 - DNA, 22 bp, Homo sapiens
cacatttaattggtttagggtg

SEQ ID NO: 9369872 - DNA, 22 bp, Homo sapiens
agcagggagaccatctcttcct

SEQ ID NO: 9369873 - DNA, 22 bp, Homo sapiens
agcaggcttactttctgattag

SEQ ID NO: 9369874 - DNA, 22 bp, Homo sapiens
agcagggagaccatctcttcct

SEQ ID NO: 9369875 - DNA, 22 bp, Homo sapiens
agcagggaggcccagggcactg

SEQ ID NO: 9369876 - DNA, 22 bp, Homo sapiens
agcagggaggcccagggcactg

SEQ ID NO: 9369877 - DNA, 22 bp, Homo sapiens
agcagggaggcggtgtgctggc

SEQ ID NO: 9369878 - DNA, 17 bp, Homo sapiens
agcagggagtcaaggga

SEQ ID NO: 9369879 - DNA, 17 bp, Homo sapiens
agcagggagtcaaggga

SEQ ID NO: 9369880 - DNA, 22 bp, Homo sapiens
agcagggaggcggtgtgctggc

SEQ ID NO: 9369881 - DNA, 22 bp, Homo sapiens
agcagggaggcggtgtgctggc

SEQ ID NO: 9369882 - DNA, 22 bp, Homo sapiens
agcagggaggtctagcacgtgg

SEQ ID NO: 9369883 - DNA, 22 bp, Homo sapiens
agcagggaggtctagcacgtgg

SEQ ID NO: 9369884 - DNA, 22 bp, Homo sapiens
agcagggaggcggtgtgctggc

SEQ ID NO: 9369885 - DNA, 22 bp, Homo sapiens
agcagggaggcggtgtgctggc

SEQ ID NO: 9369886 - DNA, 22 bp, Homo sapiens
cacagcagaaagtgtaggagga

SEQ ID NO: 9369887 - DNA, 22 bp, Homo sapiens
cacagcagaaatatgaaggcag

SEQ ID NO: 9369888 - DNA, 22 bp, Homo sapiens
cacagcagaaagtgtaggagga

SEQ ID NO: 9369889 - DNA, 22 bp, Homo sapiens
cacagcagaaagtgtaggagga

SEQ ID NO: 9369890 - DNA, 22 bp, Homo sapiens
cacagcagaaatatgaaggcag

SEQ ID NO: 9369891 - DNA, 22 bp, Homo sapiens
agcaggctgggcaatatgggca

SEQ ID NO: 9369892 - DNA, 22 bp, Homo sapiens
cacagcagagggagccattgaa

SEQ ID NO: 9369893 - DNA, 22 bp, Homo sapiens
cacagcagacagggaggcggct

SEQ ID NO: 9369894 - DNA, 22 bp, Homo sapiens
cacagcagacagggaggcggct

SEQ ID NO: 9369895 - DNA, 22 bp, Homo sapiens
cacagcagagggagccattgaa

SEQ ID NO: 9369896 - DNA, 22 bp, Homo sapiens
cacagcagagggagccattgaa

SEQ ID NO: 9369897 - DNA, 22 bp, Homo sapiens
agcagcttctttcactcctgga

SEQ ID NO: 9369898 - DNA, 22 bp, Homo sapiens
agcagcttctttcactcctgga

SEQ ID NO: 9369899 - DNA, 22 bp, Homo sapiens
agcagcttgagctggggctggc

SEQ ID NO: 9369900 - DNA, 22 bp, Homo sapiens
agcaggaaggctttgggggttc

SEQ ID NO: 9369901 - DNA, 22 bp, Homo sapiens
agcaggaaggctttgggggttc

SEQ ID NO: 9369902 - DNA, 22 bp, Homo sapiens
agcaggaactcagggagttctc

SEQ ID NO: 9369903 - DNA, 22 bp, Homo sapiens
agcaggaactcagggagttctc

SEQ ID NO: 9369904 - DNA, 22 bp, Homo sapiens
agcaggaaggtctgtgtgagtc

SEQ ID NO: 9369905 - DNA, 22 bp, Homo sapiens
agcaggaaggggatgatgggca

SEQ ID NO: 9369906 - DNA, 22 bp, Homo sapiens
agcaggaaggctttgggggttc

SEQ ID NO: 9369907 - DNA, 22 bp, Homo sapiens
agcaggaaggtctgtgtgagtc

SEQ ID NO: 9369908 - DNA, 22 bp, Homo sapiens
agcaggaaggtctgtgtgagtc

SEQ ID NO: 9369909 - DNA, 22 bp, Homo sapiens
agcaggaatctgttctgtataa

SEQ ID NO: 9369910 - DNA, 22 bp, Homo sapiens
agcaggaagtagtctgtaagca

SEQ ID NO: 9369911 - DNA, 20 bp, Homo sapiens
agcaggaatgatgctttcat

SEQ ID NO: 9369912 - DNA, 22 bp, Homo sapiens
agcaggacaatatgggatcagg

SEQ ID NO: 9369913 - DNA, 22 bp, Homo sapiens
cacagcaagagctaaatgacca

SEQ ID NO: 9369914 - DNA, 22 bp, Homo sapiens
aactatgttaataagtttcatt

SEQ ID NO: 9369915 - DNA, 22 bp, Homo sapiens
aactcactttgtggcttctgaa

SEQ ID NO: 9369916 - DNA, 22 bp, Homo sapiens
aactcacagctgtttggattag

SEQ ID NO: 9369917 - DNA, 22 bp, Homo sapiens
aactcaaagatgcatgacgctt

SEQ ID NO: 9369918 - DNA, 22 bp, Homo sapiens
aactaatacattaatacatgtg

SEQ ID NO: 9369919 - DNA, 22 bp, Homo sapiens
aactaatacattaatacatgtg

SEQ ID NO: 9369920 - DNA, 22 bp, Homo sapiens
aacatttgtgaagtacttagat

SEQ ID NO: 9369921 - DNA, 22 bp, Homo sapiens
aacatttgcagaggaaagctat

SEQ ID NO: 9369922 - DNA, 22 bp, Homo sapiens
aacatttgagaaaaatactctt

SEQ ID NO: 9369923 - DNA, 22 bp, Homo sapiens
aacatttcttctgaaactgagt

SEQ ID NO: 9369924 - DNA, 22 bp, Homo sapiens
aacatttgaaaatcaagaatct

SEQ ID NO: 9369925 - DNA, 20 bp, Homo sapiens
aactcagagatgaaaaagac

SEQ ID NO: 9369926 - DNA, 22 bp, Homo sapiens
aactcagacatgtataaagact

SEQ ID NO: 9369927 - DNA, 22 bp, Homo sapiens
aactcagaatagggtgcagggc

SEQ ID NO: 9369928 - DNA, 22 bp, Homo sapiens
aactgaaacttaggaagtaatc

SEQ ID NO: 9369929 - DNA, 22 bp, Homo sapiens
aactcaggagaatggagggtat

SEQ ID NO: 9369930 - DNA, 22 bp, Homo sapiens
aactcagatatgatagcaggag

SEQ ID NO: 9369931 - DNA, 22 bp, Homo sapiens
aactcagatgtttggctacctt

SEQ ID NO: 9369932 - DNA, 22 bp, Homo sapiens
aactgaaatcaatcagtgattc

SEQ ID NO: 9369933 - DNA, 22 bp, Homo sapiens
aactgagacacgaactatgatt

SEQ ID NO: 9369934 - DNA, 22 bp, Homo sapiens
aacttgccaagagctttgctag

SEQ ID NO: 9369935 - DNA, 22 bp, Homo sapiens
aactgatttcaagttcagtttc

SEQ ID NO: 9369936 - DNA, 22 bp, Homo sapiens
aactgaggtctccagtgcagaa

SEQ ID NO: 9369937 - DNA, 22 bp, Homo sapiens
aactgaggtctccagtgcagaa

SEQ ID NO: 9369938 - DNA, 22 bp, Homo sapiens
aactgaggtatctgctgtgttt

SEQ ID NO: 9369939 - DNA, 22 bp, Homo sapiens
aactgataatggacacataaaa

SEQ ID NO: 9369940 - DNA, 22 bp, Homo sapiens
aactgataatggacacataaaa

SEQ ID NO: 9369941 - DNA, 22 bp, Homo sapiens
aactgagggccctgctgaagca

SEQ ID NO: 9369942 - DNA, 22 bp, Homo sapiens
aactgaggccaagtgaggaaag

SEQ ID NO: 9369943 - DNA, 22 bp, Homo sapiens
aactgaggaataactgagttgc

SEQ ID NO: 9369944 - DNA, 20 bp, Homo sapiens
aactgagagttcaggaggag

SEQ ID NO: 9369945 - DNA, 20 bp, Homo sapiens
aacagtaccatttatctcag

SEQ ID NO: 9369946 - DNA, 22 bp, Homo sapiens
aacaggaaaacagcacaatagc

SEQ ID NO: 9369947 - DNA, 22 bp, Homo sapiens
aacaggaaaacagcacaatagc

SEQ ID NO: 9369948 - DNA, 22 bp, Homo sapiens
aacagtgagaaggtggacagga

SEQ ID NO: 9369949 - DNA, 22 bp, Homo sapiens
aacagtgagaaggtggacagga

SEQ ID NO: 9369950 - DNA, 22 bp, Homo sapiens
aacagtcacattgttcaacttt

SEQ ID NO: 9369951 - DNA, 22 bp, Homo sapiens
aacagtcagcttctcgggacat

SEQ ID NO: 9369952 - DNA, 22 bp, Homo sapiens
aacattctatgtgcattcagaa

SEQ ID NO: 9369953 - DNA, 22 bp, Homo sapiens
aacattaagatggcggaacagt

SEQ ID NO: 9369954 - DNA, 22 bp, Homo sapiens
aacattaagatggcggaacagt

SEQ ID NO: 9369955 - DNA, 22 bp, Homo sapiens
aacatgcaatgtctgaaaatcc

SEQ ID NO: 9369956 - DNA, 22 bp, Homo sapiens
aacatgcaaagctatgatgtat

SEQ ID NO: 9369957 - DNA, 22 bp, Homo sapiens
aacatgcaaagctatgatgtat

SEQ ID NO: 9369958 - DNA, 22 bp, Homo sapiens
aacattaattacagtcaaacat

SEQ ID NO: 9369959 - DNA, 22 bp, Homo sapiens
aacattcaaaacccagttcagt

SEQ ID NO: 9369960 - DNA, 21 bp, Homo sapiens
aacattagtaatttgactttt

SEQ ID NO: 9369961 - DNA, 22 bp, Homo sapiens
aacattagatttgtttttctag

SEQ ID NO: 9369962 - DNA, 22 bp, Homo sapiens
aaagcaattgtggtttttgcca

SEQ ID NO: 9369963 - DNA, 22 bp, Homo sapiens
aaagcaatgggtctaaggtaaa

SEQ ID NO: 9369964 - DNA, 22 bp, Homo sapiens
aaatggtgagggaattgaacag

SEQ ID NO: 9369965 - DNA, 22 bp, Homo sapiens
aaatggtgaagtgtaatttagc

SEQ ID NO: 9369966 - DNA, 22 bp, Homo sapiens
aaagcaagtctctacaaagtac

SEQ ID NO: 9369967 - DNA, 22 bp, Homo sapiens
aaatggctgcatttgtgtaaat

SEQ ID NO: 9369968 - DNA, 22 bp, Homo sapiens
aaatgggtttgattctcagcca

SEQ ID NO: 9369969 - DNA, 22 bp, Homo sapiens
aaatggtccatcctaaagaagt

SEQ ID NO: 9369970 - DNA, 22 bp, Homo sapiens
aaatggtaccctaatggccaga

SEQ ID NO: 9369971 - DNA, 22 bp, Homo sapiens
aaagcacagagctcccacagga

SEQ ID NO: 9369972 - DNA, 22 bp, Homo sapiens
aaagcacattacaagctcagtc

SEQ ID NO: 9369973 - DNA, 22 bp, Homo sapiens
aaagcacatagtagaaggattt

SEQ ID NO: 9369974 - DNA, 22 bp, Homo sapiens
aaagcacatgagtagtgtagta

SEQ ID NO: 9369975 - DNA, 22 bp, Homo sapiens
aacaaatttagctctgagtgct

SEQ ID NO: 9369976 - DNA, 22 bp, Homo sapiens
aacaaatttagctctgagtgct

SEQ ID NO: 9369977 - DNA, 22 bp, Homo sapiens
aacaaattagttgcaagactgg

SEQ ID NO: 9369978 - DNA, 22 bp, Homo sapiens
aacaaattagttgcaagactgg

SEQ ID NO: 9369979 - DNA, 22 bp, Homo sapiens
aacaaattagttgcaagactgg

SEQ ID NO: 9369980 - DNA, 22 bp, Homo sapiens
aacaaatgtgttttgtaattaa

SEQ ID NO: 9369981 - DNA, 22 bp, Homo sapiens
aacaagaagggaaggcatgatt

SEQ ID NO: 9369982 - DNA, 22 bp, Homo sapiens
aacaatgtgaagtgctgttcag

SEQ ID NO: 9369983 - DNA, 22 bp, Homo sapiens
aacaattactaccaaggcctgt

SEQ ID NO: 9369984 - DNA, 22 bp, Homo sapiens
aacacaaagaagctgcaggatc

SEQ ID NO: 9369985 - DNA, 22 bp, Homo sapiens
aacacataggcagagcatgaca

SEQ ID NO: 9369986 - DNA, 22 bp, Homo sapiens
aacacataggcagagcatgaca

SEQ ID NO: 9369987 - DNA, 22 bp, Homo sapiens
aacacataggcagagcatgaca

SEQ ID NO: 9369988 - DNA, 22 bp, Homo sapiens
aacacaaagaagctgcaggatc

SEQ ID NO: 9369989 - DNA, 22 bp, Homo sapiens
aacacattgccagagatcagca

SEQ ID NO: 9369990 - DNA, 23 bp, Homo sapiens
aacacattgctaattacattcaa

SEQ ID NO: 9369991 - DNA, 23 bp, Homo sapiens
aacacattgctaattacattcaa

SEQ ID NO: 9369992 - DNA, 22 bp, Homo sapiens
aacacatggcaagagcaggaaa

SEQ ID NO: 9369993 - DNA, 22 bp, Homo sapiens
aacacatgccttaagaataagt

SEQ ID NO: 9369994 - DNA, 22 bp, Homo sapiens
aacacatatttttgctgagcat

SEQ ID NO: 9369995 - DNA, 22 bp, Homo sapiens
aacacatatttatatatgcaca

SEQ ID NO: 9369996 - DNA, 22 bp, Homo sapiens
aacacatgaaagttggtgagta

SEQ ID NO: 9369997 - DNA, 21 bp, Homo sapiens
aacacatccagagtatttgac

SEQ ID NO: 9369998 - DNA, 22 bp, Homo sapiens
aacacatatttatatatgcaca

SEQ ID NO: 9369999 - DNA, 22 bp, Homo sapiens
aacacatatttatatatgcaca

SEQ ID NO: 9370000 - DNA, 22 bp, Homo sapiens
aagcagcacgctttgccaacaa

SEQ ID NO: 9370001 - DNA, 22 bp, Homo sapiens
aagcagcacgctttgccaacaa

SEQ ID NO: 9370002 - DNA, 22 bp, Homo sapiens
aagcagcacagcaatgactcta

SEQ ID NO: 9370003 - DNA, 15 bp, Homo sapiens
aagcagcaatatata

SEQ ID NO: 9370004 - DNA, 22 bp, Homo sapiens
aagcagcaagtttatttctatc

SEQ ID NO: 9370005 - DNA, 22 bp, Homo sapiens
aagcagcacagtaatattggtg

SEQ ID NO: 9370006 - DNA, 22 bp, Homo sapiens
aagcagcagacctgattttgaa

SEQ ID NO: 9370007 - DNA, 22 bp, Homo sapiens
aagcagcagacctgattttgaa

SEQ ID NO: 9370008 - DNA, 22 bp, Homo sapiens
aagcagcagcaggattaaagag

SEQ ID NO: 9370009 - DNA, 22 bp, Homo sapiens
aagcagcagcctgaagtacgtc

SEQ ID NO: 9370010 - DNA, 22 bp, Homo sapiens
aagcagcagccatcccccaagg

SEQ ID NO: 9370011 - DNA, 22 bp, Homo sapiens
aagcagcataattgctatttta

SEQ ID NO: 9370012 - DNA, 22 bp, Homo sapiens
aagccaatgagagaggcctcag

SEQ ID NO: 9370013 - DNA, 22 bp, Homo sapiens
aagccaatgctagcccacatgc

SEQ ID NO: 9370014 - DNA, 22 bp, Homo sapiens
aagccaatgatacgggtgatct

SEQ ID NO: 9370015 - DNA, 22 bp, Homo sapiens
aagccactgagatttcactgca

SEQ ID NO: 9370016 - DNA, 22 bp, Homo sapiens
aagccactatggtgattctcaa

SEQ ID NO: 9370017 - DNA, 22 bp, Homo sapiens
aagccaatgttgcctgggtttc

SEQ ID NO: 9370018 - DNA, 22 bp, Homo sapiens
aagccaatggattggttgcttt

SEQ ID NO: 9370019 - DNA, 18 bp, Homo sapiens
aagccagagaccactgcc

SEQ ID NO: 9370020 - DNA, 22 bp, Homo sapiens
aagccagatagaagaactcatt

SEQ ID NO: 9370021 - DNA, 22 bp, Homo sapiens
aagccagagtttttgagaactt

SEQ ID NO: 9370022 - DNA, 22 bp, Homo sapiens
aagccagattccttaagcacag

SEQ ID NO: 9370023 - DNA, 22 bp, Homo sapiens
aagcagaaagaacaactgagtg

SEQ ID NO: 9370024 - DNA, 22 bp, Homo sapiens
aagcagaaaaactgagctccaa

SEQ ID NO: 9370025 - DNA, 22 bp, Homo sapiens
aagcagcaacaaactggataaa

SEQ ID NO: 9370026 - DNA, 22 bp, Homo sapiens
aagcagcaagtttatttctatc

SEQ ID NO: 9370027 - DNA, 22 bp, Homo sapiens
aagcactgtacaaatgtcactt

SEQ ID NO: 9370028 - DNA, 22 bp, Homo sapiens
aagcactggggccacagacacg

SEQ ID NO: 9370029 - DNA, 22 bp, Homo sapiens
aagcacttagaagagtgcctgc

SEQ ID NO: 9370030 - DNA, 22 bp, Homo sapiens
aagcacttggttttggaaagtt

SEQ ID NO: 9370031 - DNA, 22 bp, Homo sapiens
aagcactttagtgagaataagg

SEQ ID NO: 9370032 - DNA, 19 bp, Homo sapiens
aaatatcagagagatgata

SEQ ID NO: 9370033 - DNA, 19 bp, Homo sapiens
aaatatcagagagatgata

SEQ ID NO: 9370034 - DNA, 22 bp, Homo sapiens
aaatatcattctggtgcacaga

SEQ ID NO: 9370035 - DNA, 22 bp, Homo sapiens
aaatatcattctggtgcacaga

SEQ ID NO: 9370036 - DNA, 22 bp, Homo sapiens
aaatatcatttataacttttaa

SEQ ID NO: 9370037 - DNA, 22 bp, Homo sapiens
aaatatcatttataacttttaa

SEQ ID NO: 9370038 - DNA, 22 bp, Homo sapiens
aaatatcatttataacttttaa

SEQ ID NO: 9370039 - DNA, 22 bp, Homo sapiens
aaatatgaatgataagagttat

SEQ ID NO: 9370040 - DNA, 22 bp, Homo sapiens
aaatatgaatgataagagttat

SEQ ID NO: 9370041 - DNA, 22 bp, Homo sapiens
aaatatgaatgataagagttat

SEQ ID NO: 9370042 - DNA, 22 bp, Homo sapiens
aagcacagctggaacagcagga

SEQ ID NO: 9370043 - DNA, 22 bp, Homo sapiens
aagcacctctatgattgctttt

SEQ ID NO: 9370044 - DNA, 22 bp, Homo sapiens
aagcacctgcagttgacaaaaa

SEQ ID NO: 9370045 - DNA, 22 bp, Homo sapiens
aagcacctgggttatatcttag

SEQ ID NO: 9370046 - DNA, 22 bp, Homo sapiens
aagcaaatgtgggtgcagaatt

SEQ ID NO: 9370047 - DNA, 22 bp, Homo sapiens
aagcaaagtgctttgcctccag

SEQ ID NO: 9370048 - DNA, 22 bp, Homo sapiens
aagcaaagtgaattttgccaag

SEQ ID NO: 9370049 - DNA, 22 bp, Homo sapiens
aagcaaaggcaggagcttgtga

SEQ ID NO: 9370050 - DNA, 22 bp, Homo sapiens
aagcaaaggaaagctgactttt

SEQ ID NO: 9370051 - DNA, 22 bp, Homo sapiens
aagcaaagagataaccttttgg

SEQ ID NO: 9370052 - DNA, 18 bp, Homo sapiens
aagaggaggagcaggttg

SEQ ID NO: 9370053 - DNA, 18 bp, Homo sapiens
aagaggaggagcaggttg

SEQ ID NO: 9370054 - DNA, 22 bp, Homo sapiens
aagaggagacttcagcaacttg

SEQ ID NO: 9370055 - DNA, 18 bp, Homo sapiens
aagaggaggaaacccagg

SEQ ID NO: 9370056 - DNA, 22 bp, Homo sapiens
aactttgaggtcactgaattcc

SEQ ID NO: 9370057 - DNA, 22 bp, Homo sapiens
aactttgcaagggggccctgcg

SEQ ID NO: 9370058 - DNA, 20 bp, Homo sapiens
aactttgcattttattctcc

SEQ ID NO: 9370059 - DNA, 22 bp, Homo sapiens
aacttggcttgcatggctgaaa

SEQ ID NO: 9370060 - DNA, 22 bp, Homo sapiens
aactttctttgcatctaagttt

SEQ ID NO: 9370061 - DNA, 22 bp, Homo sapiens
aactttggtaatttactgggaa

SEQ ID NO: 9370062 - DNA, 21 bp, Homo sapiens
aactttgcttaactgtgtgga

SEQ ID NO: 9370063 - DNA, 19 bp, Homo sapiens
aactttgctaccctatcct

SEQ ID NO: 9370064 - DNA, 22 bp, Homo sapiens
aactttgggcctaagtactgtt

SEQ ID NO: 9370065 - DNA, 22 bp, Homo sapiens
aacttttctgtgttgtccggga

SEQ ID NO: 9370066 - DNA, 22 bp, Homo sapiens
aagaaagccaaagttcatacct

SEQ ID NO: 9370067 - DNA, 22 bp, Homo sapiens
aagaaagggagaaggatggtgt

SEQ ID NO: 9370068 - DNA, 22 bp, Homo sapiens
aacttttagacttgggtataaa

SEQ ID NO: 9370069 - DNA, 23 bp, Homo sapiens
aacttttagagtttaacagtgtt

SEQ ID NO: 9370070 - DNA, 22 bp, Homo sapiens
aacttttaaaatacacagacaa

SEQ ID NO: 9370071 - DNA, 22 bp, Homo sapiens
aacttttacaaattgtcatcat

SEQ ID NO: 9370072 - DNA, 22 bp, Homo sapiens
aacttttcacaggctagctctt

SEQ ID NO: 9370073 - DNA, 22 bp, Homo sapiens
aacttttcataagggcaaattt

SEQ ID NO: 9370074 - DNA, 22 bp, Homo sapiens
aacttttcattccaaaggtgct

SEQ ID NO: 9370075 - DNA, 22 bp, Homo sapiens
aacttttcattgaatcatgtca

SEQ ID NO: 9370076 - DNA, 22 bp, Homo sapiens
aagaatgtctctggtgaggcgc

SEQ ID NO: 9370077 - DNA, 22 bp, Homo sapiens
aagaatgattacaaagcaacga

SEQ ID NO: 9370078 - DNA, 22 bp, Homo sapiens
aagaatgagctcaaagatctta

SEQ ID NO: 9370079 - DNA, 22 bp, Homo sapiens
aagaaagtgggtaatatgattt

SEQ ID NO: 9370080 - DNA, 22 bp, Homo sapiens
aagaaagtgtggagagcctagc

SEQ ID NO: 9370081 - DNA, 22 bp, Homo sapiens
aagaaagtgtggagagcctagc

SEQ ID NO: 9370082 - DNA, 22 bp, Homo sapiens
aagaaagtgatgagctacagat

SEQ ID NO: 9370083 - DNA, 22 bp, Homo sapiens
aagaaagtgatgagctacagat

SEQ ID NO: 9370084 - DNA, 22 bp, Homo sapiens
aagaaagtgctttgtaaattat

SEQ ID NO: 9370085 - DNA, 22 bp, Homo sapiens
aagaaaggtgtgtttgcagatg

SEQ ID NO: 9370086 - DNA, 22 bp, Homo sapiens
aagaaagggctattgttctcca

SEQ ID NO: 9370087 - DNA, 22 bp, Homo sapiens
aagagccatatatgcagctaga

SEQ ID NO: 9370088 - DNA, 22 bp, Homo sapiens
aagagccctggttgaaaataac

SEQ ID NO: 9370089 - DNA, 22 bp, Homo sapiens
aagaggaagtctccatggagag

SEQ ID NO: 9370090 - DNA, 22 bp, Homo sapiens
aagaggacttgtgaagatgtac

SEQ ID NO: 9370091 - DNA, 22 bp, Homo sapiens
aagagcatgttaattctaggac

SEQ ID NO: 9370092 - DNA, 22 bp, Homo sapiens
aagagccagctagtgaagaggc

SEQ ID NO: 9370093 - DNA, 22 bp, Homo sapiens
aagagccagtgggaaagtcttg

SEQ ID NO: 9370094 - DNA, 22 bp, Homo sapiens
aagagccagtgggaaagtcttg

SEQ ID NO: 9370095 - DNA, 22 bp, Homo sapiens
aagagccaggacagatccagct

SEQ ID NO: 9370096 - DNA, 22 bp, Homo sapiens
aagagcagtgttttactcagct

SEQ ID NO: 9370097 - DNA, 20 bp, Homo sapiens
aagagaggaagttatactag

SEQ ID NO: 9370098 - DNA, 22 bp, Homo sapiens
aagagagagttcctaggcaaaa

SEQ ID NO: 9370099 - DNA, 22 bp, Homo sapiens
aagagagagttcctaggcaaaa

SEQ ID NO: 9370100 - DNA, 22 bp, Homo sapiens
aagacagagactctgcaacagg

SEQ ID NO: 9370101 - DNA, 22 bp, Homo sapiens
aagacagagggaagcaatgatg

SEQ ID NO: 9370102 - DNA, 22 bp, Homo sapiens
aagacagagactctgcaacagg

SEQ ID NO: 9370103 - DNA, 22 bp, Homo sapiens
aagacagagactctgcaacagg

SEQ ID NO: 9370104 - DNA, 17 bp, Homo sapiens
aagacagaagccatgag

SEQ ID NO: 9370105 - DNA, 22 bp, Homo sapiens
aagacagaccacgtgacagggc

SEQ ID NO: 9370106 - DNA, 17 bp, Homo sapiens
aagacagaagccatgag

SEQ ID NO: 9370107 - DNA, 22 bp, Homo sapiens
aaacaaagcatcttgctatgca

SEQ ID NO: 9370108 - DNA, 22 bp, Homo sapiens
aaacaaatagtgcatgggaatt

SEQ ID NO: 9370109 - DNA, 22 bp, Homo sapiens
aaacacacctttggaactgtga

SEQ ID NO: 9370110 - DNA, 22 bp, Homo sapiens
aaacacacctttggaactgtga

SEQ ID NO: 9370111 - DNA, 22 bp, Homo sapiens
aaacacacagaaatgaatgagg

SEQ ID NO: 9370112 - DNA, 22 bp, Homo sapiens
aaacacaatgtttctttgttct

SEQ ID NO: 9370113 - DNA, 22 bp, Homo sapiens
aaacaactcggcaactgctttt

SEQ ID NO: 9370114 - DNA, 22 bp, Homo sapiens
aaacaacctaaagttactgatc

SEQ ID NO: 9370115 - DNA, 22 bp, Homo sapiens
aaacaacatggtgggtgtgtag

SEQ ID NO: 9370116 - DNA, 22 bp, Homo sapiens
aaacaacatggtgggtgtgtag

SEQ ID NO: 9370117 - DNA, 22 bp, Homo sapiens
aaaatagctatggaatgtcact

SEQ ID NO: 9370118 - DNA, 22 bp, Homo sapiens
aaaatagctatggaatgtcact

SEQ ID NO: 9370119 - DNA, 22 bp, Homo sapiens
aaaatagctatggaatgtcact

SEQ ID NO: 9370120 - DNA, 22 bp, Homo sapiens
aaaatagctatggaatgtcact

SEQ ID NO: 9370121 - DNA, 22 bp, Homo sapiens
aaaataggtacggattagaatg

SEQ ID NO: 9370122 - DNA, 22 bp, Homo sapiens
aaaattcatggcttgggaaaag

SEQ ID NO: 9370123 - DNA, 22 bp, Homo sapiens
aaaattcattcctcagactgcc

SEQ ID NO: 9370124 - DNA, 22 bp, Homo sapiens
aaaatagcatattgctttcttt

SEQ ID NO: 9370125 - DNA, 22 bp, Homo sapiens
aaaatagcatattgctttcttt

SEQ ID NO: 9370126 - DNA, 22 bp, Homo sapiens
aaaatagcatgaaaggcctttg

SEQ ID NO: 9370127 - DNA, 20 bp, Homo sapiens
aaaatagccccaggctcatt

SEQ ID NO: 9370128 - DNA, 22 bp, Homo sapiens
aaaatagcctcacataattgct

SEQ ID NO: 9370129 - DNA, 22 bp, Homo sapiens
aaaatagatgaaaggaagtctg

SEQ ID NO: 9370130 - DNA, 22 bp, Homo sapiens
aaaatagattctaggatgtctt

SEQ ID NO: 9370131 - DNA, 22 bp, Homo sapiens
aaaagtcttgtcaaggttccca

SEQ ID NO: 9370132 - DNA, 22 bp, Homo sapiens
aaaagtcttggggaaggccagg

SEQ ID NO: 9370133 - DNA, 22 bp, Homo sapiens
aaaagtgtccagattatgaaga

SEQ ID NO: 9370134 - DNA, 22 bp, Homo sapiens
aaaaatgcttggacttaataaa

SEQ ID NO: 9370135 - DNA, 22 bp, Homo sapiens
aaaaatgtcattatggaactga

SEQ ID NO: 9370136 - DNA, 22 bp, Homo sapiens
aaaaatgcttggacttaataaa

SEQ ID NO: 9370137 - DNA, 22 bp, Homo sapiens
aaaaatgcttggacttaataaa

SEQ ID NO: 9370138 - DNA, 22 bp, Homo sapiens
aaaaatgtcattatggaactga

SEQ ID NO: 9370139 - DNA, 22 bp, Homo sapiens
aaaaggctcttcaaaatggaag

SEQ ID NO: 9370140 - DNA, 22 bp, Homo sapiens
aaaagtattttggatctcagat

SEQ ID NO: 9370141 - DNA, 22 bp, Homo sapiens
aaaagtattttggatctcagat

SEQ ID NO: 9370142 - DNA, 22 bp, Homo sapiens
aaaagtctgctctcatttcaga

SEQ ID NO: 9370143 - DNA, 22 bp, Homo sapiens
aaaagtctctctgagtaaaagt

SEQ ID NO: 9370144 - DNA, 22 bp, Homo sapiens
aaaaatgaattcttcagtggca

SEQ ID NO: 9370145 - DNA, 22 bp, Homo sapiens
aaaaatgaattcttcagtggca

SEQ ID NO: 9370146 - DNA, 21 bp, Homo sapiens
aaaaatgaagttgttcaggaa

SEQ ID NO: 9370147 - DNA, 22 bp, Homo sapiens
aaaaatgaaacggctggttggc

SEQ ID NO: 9370148 - DNA, 22 bp, Homo sapiens
aaaaatgaaacggctggttggc

SEQ ID NO: 9370149 - DNA, 22 bp, Homo sapiens
aaaaagacagaggatgaggcag

SEQ ID NO: 9370150 - DNA, 22 bp, Homo sapiens
aaaaagacagaggatgaggcag

SEQ ID NO: 9370151 - DNA, 22 bp, Homo sapiens
aaaaagactagtcgagtgcagt

SEQ ID NO: 9370152 - DNA, 22 bp, Homo sapiens
aaaaagactagtcgagtgcagt

SEQ ID NO: 9370153 - DNA, 22 bp, Homo sapiens
aaaaagacttccaactcaggag

SEQ ID NO: 9370154 - DNA, 22 bp, Homo sapiens
aaaaactgtaattacttttgca

SEQ ID NO: 9370155 - DNA, 22 bp, Homo sapiens
aaaaactgtaattacttttgca

SEQ ID NO: 9370156 - DNA, 22 bp, Homo sapiens
aaacatttttcttcatcatcct

SEQ ID NO: 9370157 - DNA, 22 bp, Homo sapiens
aaacatttttctaggtcttggt

SEQ ID NO: 9370158 - DNA, 23 bp, Homo sapiens
aaacatttctcttttcctgcctc

SEQ ID NO: 9370159 - DNA, 22 bp, Homo sapiens
aaacatttgcaactcggtttgg

SEQ ID NO: 9370160 - DNA, 22 bp, Homo sapiens
aaacatttgcaactcggtttgg

SEQ ID NO: 9370161 - DNA, 22 bp, Homo sapiens
aaacatgagcatttctgtttaa

SEQ ID NO: 9370162 - DNA, 22 bp, Homo sapiens
aaacatgagcatctcttcaagc

SEQ ID NO: 9370163 - DNA, 22 bp, Homo sapiens
aaacatgatattgaggctgggc

SEQ ID NO: 9370164 - DNA, 22 bp, Homo sapiens
aaacattgttatgataaattac

SEQ ID NO: 9370165 - DNA, 22 bp, Homo sapiens
aaaccacttatatcgtgatttg

SEQ ID NO: 9370166 - DNA, 22 bp, Homo sapiens
aaaccactcctgattcacttca

SEQ ID NO: 9370167 - DNA, 22 bp, Homo sapiens
aaaccacagttcagtgcttttg

SEQ ID NO: 9370168 - DNA, 22 bp, Homo sapiens
aaaccaaacatttgcggtggtg

SEQ ID NO: 9370169 - DNA, 22 bp, Homo sapiens
aaaccacacttagcagtttcgt

SEQ ID NO: 9370170 - DNA, 22 bp, Homo sapiens
aaacatcttctcttgattcttt

SEQ ID NO: 9370171 - DNA, 22 bp, Homo sapiens
aaacatcttctcttgattcttt

SEQ ID NO: 9370172 - DNA, 22 bp, Homo sapiens
aaacatctgacttgctttttca

SEQ ID NO: 9370173 - DNA, 22 bp, Homo sapiens
aaacatgaatagatattaaaca

SEQ ID NO: 9370174 - DNA, 22 bp, Homo sapiens
aaacatgagcacttgcttcata

SEQ ID NO: 9370175 - DNA, 22 bp, Homo sapiens
aaacatgaatagatattaaaca

SEQ ID NO: 9370176 - DNA, 22 bp, Homo sapiens
aaacatgagcacttgcttcata

SEQ ID NO: 9370177 - DNA, 22 bp, Homo sapiens
aaacatgagcatctcttcaagc

SEQ ID NO: 9370178 - DNA, 21 bp, Homo sapiens
aaacatctctgcttttgtgtc

SEQ ID NO: 9370179 - DNA, 22 bp, Homo sapiens
aaacacagggatatatattcca

SEQ ID NO: 9370180 - DNA, 22 bp, Homo sapiens
aaacttgtcattgtaatggtat

SEQ ID NO: 9370181 - DNA, 22 bp, Homo sapiens
aaacttgagtcacttctcttcc

SEQ ID NO: 9370182 - DNA, 23 bp, Homo sapiens
aaacttgctatggctgaaatcat

SEQ ID NO: 9370183 - DNA, 23 bp, Homo sapiens
aaacttgctatggctgaaatcat

SEQ ID NO: 9370184 - DNA, 23 bp, Homo sapiens
aaacttgctatggctgaaatcat

SEQ ID NO: 9370185 - DNA, 22 bp, Homo sapiens
aaacttgaaaggtactgttggt

SEQ ID NO: 9370186 - DNA, 22 bp, Homo sapiens
aaacttgacagtagacagatta

SEQ ID NO: 9370187 - DNA, 22 bp, Homo sapiens
aaacttgaacccagctcaggct

SEQ ID NO: 9370188 - DNA, 22 bp, Homo sapiens
aaacttctggctacaagcaata

SEQ ID NO: 9370189 - DNA, 18 bp, Homo sapiens
aaagaaggattggagagc

SEQ ID NO: 9370190 - DNA, 22 bp, Homo sapiens
aaagaagggacagactgcctct

SEQ ID NO: 9370191 - DNA, 17 bp, Homo sapiens
aaagagcttggagtgtt

SEQ ID NO: 9370192 - DNA, 22 bp, Homo sapiens
aaagaagacagacatttctttc

SEQ ID NO: 9370193 - DNA, 22 bp, Homo sapiens
aaagaagacagacatttctttc

SEQ ID NO: 9370194 - DNA, 22 bp, Homo sapiens
aaagaagagcaaatttgttgta

SEQ ID NO: 9370195 - DNA, 22 bp, Homo sapiens
aaagaagatggagacctgacta

SEQ ID NO: 9370196 - DNA, 22 bp, Homo sapiens
aaagaagagctggaaggagtct

SEQ ID NO: 9370197 - DNA, 22 bp, Homo sapiens
aaagatcattctctggtccaga

SEQ ID NO: 9370198 - DNA, 22 bp, Homo sapiens
aaagagctttccacactagtca

SEQ ID NO: 9370199 - DNA, 22 bp, Homo sapiens
aaagatggcccatgatctcttg

SEQ ID NO: 9370200 - DNA, 22 bp, Homo sapiens
aaagatgcataaatgccaatgg

SEQ ID NO: 9370201 - DNA, 22 bp, Homo sapiens
aaatatgttttccagttgtcat

SEQ ID NO: 9370202 - DNA, 22 bp, Homo sapiens
aaatatgtgatcagtgaataaa

SEQ ID NO: 9370203 - DNA, 22 bp, Homo sapiens
aaatatgttttccagttgtcat

SEQ ID NO: 9370204 - DNA, 22 bp, Homo sapiens
aaatattagggagaacagggac

SEQ ID NO: 9370205 - DNA, 22 bp, Homo sapiens
aaatattattgcttaaggggag

SEQ ID NO: 9370206 - DNA, 22 bp, Homo sapiens
aaatccaggaagcagtggtgta

SEQ ID NO: 9370207 - DNA, 22 bp, Homo sapiens
aaatccaggtccatgtggggta

SEQ ID NO: 9370208 - DNA, 22 bp, Homo sapiens
aaatccaagctttggtaactga

SEQ ID NO: 9370209 - DNA, 21 bp, Homo sapiens
aaatccaaacactagtccaca

SEQ ID NO: 9370210 - DNA, 21 bp, Homo sapiens
aaatccaaacactagtccaca

SEQ ID NO: 9370211 - DNA, 22 bp, Homo sapiens
aaatcatgttggcacaataaaa

SEQ ID NO: 9370212 - DNA, 22 bp, Homo sapiens
aaatcatgttggcacaataaaa

SEQ ID NO: 9370213 - DNA, 22 bp, Homo sapiens
aaatcatgtgcagagatcagga

SEQ ID NO: 9370214 - DNA, 22 bp, Homo sapiens
aaatcatggtggaagaaacaga

SEQ ID NO: 9370215 - DNA, 22 bp, Homo sapiens
aaatcatgaggacattatgcca

SEQ ID NO: 9370216 - DNA, 22 bp, Homo sapiens
aaatcatggtggaagaaacaga

SEQ ID NO: 9370217 - DNA, 22 bp, Homo sapiens
aaatcatggtggaagaaacaga

SEQ ID NO: 9370218 - DNA, 18 bp, Homo sapiens
aaatgctaggctacatga

SEQ ID NO: 9370219 - DNA, 18 bp, Homo sapiens
aaatgctaggctacatga

SEQ ID NO: 9370220 - DNA, 22 bp, Homo sapiens
aaatgctaaatgcagcaagtag

SEQ ID NO: 9370221 - DNA, 22 bp, Homo sapiens
aaatgctacacaggaattctca

SEQ ID NO: 9370222 - DNA, 22 bp, Homo sapiens
aaatgctacatacacatcaggg

SEQ ID NO: 9370223 - DNA, 22 bp, Homo sapiens
aaatgctacatacacatcaggg

SEQ ID NO: 9370224 - DNA, 22 bp, Homo sapiens
aaatgcagctgggcatgagagg

SEQ ID NO: 9370225 - DNA, 20 bp, Homo sapiens
aaatgccagtgattctgctt

SEQ ID NO: 9370226 - DNA, 23 bp, Homo sapiens
aaactacatttatagtttttctc

SEQ ID NO: 9370227 - DNA, 23 bp, Homo sapiens
aaactacatttatagtttttctc

SEQ ID NO: 9370228 - DNA, 22 bp, Homo sapiens
aaactacatctcatggatgagg

SEQ ID NO: 9370229 - DNA, 20 bp, Homo sapiens
aaactaaaggtgtttggttt

SEQ ID NO: 9370230 - DNA, 20 bp, Homo sapiens
aaactaaaggtgtttggttt

SEQ ID NO: 9370231 - DNA, 22 bp, Homo sapiens
aaactacactttgggaccagca

SEQ ID NO: 9370232 - DNA, 23 bp, Homo sapiens
aaactacaacgccaggcactgag

SEQ ID NO: 9370233 - DNA, 23 bp, Homo sapiens
aaactacaacgccaggcactgag

SEQ ID NO: 9370234 - DNA, 22 bp, Homo sapiens
aaatatgtaaccaaggtgaagt

SEQ ID NO: 9370235 - DNA, 22 bp, Homo sapiens
aaatatgtaaccaaggtgaagt

SEQ ID NO: 9370236 - DNA, 22 bp, Homo sapiens
aaatatgtatggagttcatgaa

SEQ ID NO: 9370237 - DNA, 22 bp, Homo sapiens
aaatatgtaagattagcactag

SEQ ID NO: 9370238 - DNA, 22 bp, Homo sapiens
aaatatgtgatcagtgaataaa

SEQ ID NO: 9370239 - DNA, 20 bp, Homo sapiens
aaacgagccatcattctggt

SEQ ID NO: 9370240 - DNA, 22 bp, Homo sapiens
aaatactgttgaatgaagtaag

SEQ ID NO: 9370241 - DNA, 22 bp, Homo sapiens
aaatagaaaccaacaaggtcag

SEQ ID NO: 9370242 - DNA, 22 bp, Homo sapiens
aaatagaaaccaacaaggtcag

SEQ ID NO: 9370243 - DNA, 22 bp, Homo sapiens
aaatacagattctgactcagag

SEQ ID NO: 9370244 - DNA, 22 bp, Homo sapiens
aaatacagattctgactcagag

SEQ ID NO: 9370245 - DNA, 22 bp, Homo sapiens
aaatactgtctctgagagagcc

SEQ ID NO: 9370246 - DNA, 22 bp, Homo sapiens
aaatactgtccaccatggagca

SEQ ID NO: 9370247 - DNA, 22 bp, Homo sapiens
aaacactggtatgatgtatagt

SEQ ID NO: 9370248 - DNA, 22 bp, Homo sapiens
aaacactgcagggtttacttga

SEQ ID NO: 9370249 - DNA, 22 bp, Homo sapiens
aaacactggcaatttcatgcac

SEQ ID NO: 9370250 - DNA, 22 bp, Homo sapiens
aaagtcatttagccttatctcc

SEQ ID NO: 9370251 - DNA, 22 bp, Homo sapiens
aaagtgcagtccatgaaattaa

SEQ ID NO: 9370252 - DNA, 22 bp, Homo sapiens
aaagtgcattgtttgtgttcct

SEQ ID NO: 9370253 - DNA, 22 bp, Homo sapiens
aaagtgctaaataagccctgaa

SEQ ID NO: 9370254 - DNA, 22 bp, Homo sapiens
aaagtgctgaagacctagctgt

SEQ ID NO: 9370255 - DNA, 22 bp, Homo sapiens
aaagtgctgaagacctagctgt

SEQ ID NO: 9370256 - DNA, 20 bp, Homo sapiens
aaacatagtggataccacag

SEQ ID NO: 9370257 - DNA, 22 bp, Homo sapiens
aaacatcaccattttacctaat

SEQ ID NO: 9370258 - DNA, 22 bp, Homo sapiens
aaacatcataggcatgcatgat

SEQ ID NO: 9370259 - DNA, 22 bp, Homo sapiens
aaacatcataggcatgcatgat

SEQ ID NO: 9370260 - DNA, 22 bp, Homo sapiens
aaagatgtgtaagaaataaaca

SEQ ID NO: 9370261 - DNA, 22 bp, Homo sapiens
aaagatgtcagtttgaaataac

SEQ ID NO: 9370262 - DNA, 22 bp, Homo sapiens
aaagatgtccaagtaaagttaa

SEQ ID NO: 9370263 - DNA, 22 bp, Homo sapiens
aaagatgtcatacacattaaga

SEQ ID NO: 9370264 - DNA, 22 bp, Homo sapiens
aaagcaatcagattcagatgtc

SEQ ID NO: 9370265 - DNA, 22 bp, Homo sapiens
aaaggaggaatggagagatgct

SEQ ID NO: 9370266 - DNA, 22 bp, Homo sapiens
aaaggcatggaacagattctcc

SEQ ID NO: 9370267 - DNA, 22 bp, Homo sapiens
aaaggcatggatagtgaattca

SEQ ID NO: 9370268 - DNA, 22 bp, Homo sapiens
aaaggccacactgctctttctc

SEQ ID NO: 9370269 - DNA, 22 bp, Homo sapiens
aaaggccacacagagcagggag

SEQ ID NO: 9370270 - DNA, 22 bp, Homo sapiens
aaaggccacacagagcagggag

SEQ ID NO: 9370271 - DNA, 22 bp, Homo sapiens
aaaggccaataaagacaagctg

SEQ ID NO: 9370272 - DNA, 22 bp, Homo sapiens
aaaggccaagcatgaggtggac

SEQ ID NO: 9370273 - DNA, 22 bp, Homo sapiens
aaaggccaagcatgaggtggac

SEQ ID NO: 9370274 - DNA, 22 bp, Homo sapiens
aaaggcatggatagtgaattca

SEQ ID NO: 9370275 - DNA, 22 bp, Homo sapiens
aaaggccttgagctgggtgcca

SEQ ID NO: 9370276 - DNA, 22 bp, Homo sapiens
aaaggccattacttgcttttag

SEQ ID NO: 9370277 - DNA, 22 bp, Homo sapiens
aaacactgatggatatttttcc

SEQ ID NO: 9370278 - DNA, 22 bp, Homo sapiens
aaacactgatggatatttttcc

SEQ ID NO: 9370279 - DNA, 22 bp, Homo sapiens
aaaggccaccaacatgaagcat

SEQ ID NO: 9370280 - DNA, 22 bp, Homo sapiens
aaaggccaccaacatgaagcat

SEQ ID NO: 9370281 - DNA, 22 bp, Homo sapiens
aaaggccacttgaaggattttt

SEQ ID NO: 9370282 - DNA, 22 bp, Homo sapiens
aaaggccactgcaagggaaggt

SEQ ID NO: 9370283 - DNA, 22 bp, Homo sapiens
aaaggccactgcaagggaaggt

SEQ ID NO: 9370284 - DNA, 21 bp, Homo sapiens
aaaggccataatcacggagca

SEQ ID NO: 9370285 - DNA, 21 bp, Homo sapiens
aaaggccataatcacggagca

SEQ ID NO: 9370286 - DNA, 22 bp, Homo sapiens
aaaggccatggttggagtgttt

SEQ ID NO: 9370287 - DNA, 22 bp, Homo sapiens
aaaggccatggttggagtgttt

SEQ ID NO: 9370288 - DNA, 22 bp, Homo sapiens
aaaggccaggttggctggtatt

SEQ ID NO: 9370289 - DNA, 22 bp, Homo sapiens
aaaggccaggttggctggtatt

SEQ ID NO: 9370290 - DNA, 22 bp, Homo sapiens
aaaggccacttgaaggattttt

SEQ ID NO: 9370291 - DNA, 22 bp, Homo sapiens
aaccaggtgactcatggtgagc

SEQ ID NO: 9370292 - DNA, 22 bp, Homo sapiens
aactataatggggttaggaaat

SEQ ID NO: 9370293 - DNA, 22 bp, Homo sapiens
aactcagttacatattagaata

SEQ ID NO: 9370294 - DNA, 22 bp, Homo sapiens
aactatacatatttacatagac

SEQ ID NO: 9370295 - DNA, 22 bp, Homo sapiens
aactatacatatttacatagac

SEQ ID NO: 9370296 - DNA, 22 bp, Homo sapiens
aactccaggcagggaggccact

SEQ ID NO: 9370297 - DNA, 22 bp, Homo sapiens
aactccagctcacacagtgacc

SEQ ID NO: 9370298 - DNA, 22 bp, Homo sapiens
aactccagactactaatttagt

SEQ ID NO: 9370299 - DNA, 22 bp, Homo sapiens
aactcatttgcatttttcctgt

SEQ ID NO: 9370300 - DNA, 22 bp, Homo sapiens
aactcattctaagtataccaaa

SEQ ID NO: 9370301 - DNA, 22 bp, Homo sapiens
aactccaggtcctttgaatctg

SEQ ID NO: 9370302 - DNA, 22 bp, Homo sapiens
aactccagggggtcaatattta

SEQ ID NO: 9370303 - DNA, 22 bp, Homo sapiens
aactcccactcagcttcttaat

SEQ ID NO: 9370304 - DNA, 22 bp, Homo sapiens
aatcacttgtaaggaattcaat

SEQ ID NO: 9370305 - DNA, 22 bp, Homo sapiens
aatcacttgtgccatgggtacc

SEQ ID NO: 9370306 - DNA, 22 bp, Homo sapiens
aatcacttcagtttttggacag

SEQ ID NO: 9370307 - DNA, 22 bp, Homo sapiens
aatcacattagtgaaacactga

SEQ ID NO: 9370308 - DNA, 22 bp, Homo sapiens
aatcacatttacattgctaatt

SEQ ID NO: 9370309 - DNA, 22 bp, Homo sapiens
aatcacattacagcatatctgt

SEQ ID NO: 9370310 - DNA, 19 bp, Homo sapiens
aaccaggacaaggggctgg

SEQ ID NO: 9370311 - DNA, 22 bp, Homo sapiens
aaccaggaattgcagggctgca

SEQ ID NO: 9370312 - DNA, 22 bp, Homo sapiens
aatcactttgcactcttatttg

SEQ ID NO: 9370313 - DNA, 22 bp, Homo sapiens
aacatttattgagcacctactg

SEQ ID NO: 9370314 - DNA, 22 bp, Homo sapiens
aacatttcagcacctgattcct

SEQ ID NO: 9370315 - DNA, 22 bp, Homo sapiens
aatcacatgtgggtcttgtagc

SEQ ID NO: 9370316 - DNA, 22 bp, Homo sapiens
aatatttgaacagtcactgagt

SEQ ID NO: 9370317 - DNA, 22 bp, Homo sapiens
aatatttgaacagtcactgagt

SEQ ID NO: 9370318 - DNA, 22 bp, Homo sapiens
aatcacatgcagggcctccacc

SEQ ID NO: 9370319 - DNA, 22 bp, Homo sapiens
aacatttatatgggttcatgaa

SEQ ID NO: 9370320 - DNA, 22 bp, Homo sapiens
aacatttaggaaggacctcctc

SEQ ID NO: 9370321 - DNA, 22 bp, Homo sapiens
aacatttatgattgaggtaaat

SEQ ID NO: 9370322 - DNA, 22 bp, Homo sapiens
aacatttatgattgaggtaaat

SEQ ID NO: 9370323 - DNA, 22 bp, Homo sapiens
aacatttatgattgaggtaaat

SEQ ID NO: 9370324 - DNA, 22 bp, Homo sapiens
aacatttattgagcacctactg

SEQ ID NO: 9370325 - DNA, 22 bp, Homo sapiens
aacatttattctaattctggga

SEQ ID NO: 9370326 - DNA, 22 bp, Homo sapiens
aacatttattctaattctggga

SEQ ID NO: 9370327 - DNA, 22 bp, Homo sapiens
aacatttatggtagtcattgca

SEQ ID NO: 9370328 - DNA, 22 bp, Homo sapiens
aacattggatatttattaaaag

SEQ ID NO: 9370329 - DNA, 22 bp, Homo sapiens
aacatttacaaatccttctgca

SEQ ID NO: 9370330 - DNA, 22 bp, Homo sapiens
aacataaatttgaagtggcaaa

SEQ ID NO: 9370331 - DNA, 22 bp, Homo sapiens
aagtatttggaatggcattttt

SEQ ID NO: 9370332 - DNA, 22 bp, Homo sapiens
aagtatttctggcctgtgaaag

SEQ ID NO: 9370333 - DNA, 22 bp, Homo sapiens
aagtatttcgttctgaaaaagt

SEQ ID NO: 9370334 - DNA, 22 bp, Homo sapiens
aagtatttcgttctgaaaaagt

SEQ ID NO: 9370335 - DNA, 22 bp, Homo sapiens
aagtatttcgttctgaaaaagt

SEQ ID NO: 9370336 - DNA, 22 bp, Homo sapiens
aacactggaagggacatcaagt

SEQ ID NO: 9370337 - DNA, 22 bp, Homo sapiens
aagtcaagtactacaggaaaca

SEQ ID NO: 9370338 - DNA, 22 bp, Homo sapiens
aagttctatatctgcctcacca

SEQ ID NO: 9370339 - DNA, 20 bp, Homo sapiens
aagttacattgtattgtacc

SEQ ID NO: 9370340 - DNA, 22 bp, Homo sapiens
aacactgtaacagcatcatttt

SEQ ID NO: 9370341 - DNA, 22 bp, Homo sapiens
aacactgtaacagcatcatttt

SEQ ID NO: 9370342 - DNA, 22 bp, Homo sapiens
aacactgtaacagcatcatttt

SEQ ID NO: 9370343 - DNA, 22 bp, Homo sapiens
aagttgatagcatgttaagctc

SEQ ID NO: 9370344 - DNA, 22 bp, Homo sapiens
aagttgatcaagtagcgagttc

SEQ ID NO: 9370345 - DNA, 19 bp, Homo sapiens
aagttgatcattttgacag

SEQ ID NO: 9370346 - DNA, 19 bp, Homo sapiens
aagttgatcattttgacag

SEQ ID NO: 9370347 - DNA, 22 bp, Homo sapiens
aagttgattaatctttcgagaa

SEQ ID NO: 9370348 - DNA, 22 bp, Homo sapiens
aagttgatttaaactactagtc

SEQ ID NO: 9370349 - DNA, 22 bp, Homo sapiens
aagttgattgcttcaaatttct

SEQ ID NO: 9370350 - DNA, 22 bp, Homo sapiens
aagttgattaatctttcgagaa

SEQ ID NO: 9370351 - DNA, 22 bp, Homo sapiens
aagttgatttaaactactagtc

SEQ ID NO: 9370352 - DNA, 22 bp, Homo sapiens
aagttgaatcagtaacacagtt

SEQ ID NO: 9370353 - DNA, 22 bp, Homo sapiens
aataaacaaaggacaaggaggt

SEQ ID NO: 9370354 - DNA, 22 bp, Homo sapiens
aataaaatggtcagttttctca

SEQ ID NO: 9370355 - DNA, 22 bp, Homo sapiens
aataaaatggtcagttttctca

SEQ ID NO: 9370356 - DNA, 22 bp, Homo sapiens
aataaaatggtcagttttctca

SEQ ID NO: 9370357 - DNA, 22 bp, Homo sapiens
aataaaatggtcagttttctca

SEQ ID NO: 9370358 - DNA, 20 bp, Homo sapiens
aagtttggagtcaggagacc

SEQ ID NO: 9370359 - DNA, 22 bp, Homo sapiens
aagtttggaatgatagagacct

SEQ ID NO: 9370360 - DNA, 20 bp, Homo sapiens
aagttgcagagagttgtctt

SEQ ID NO: 9370361 - DNA, 22 bp, Homo sapiens
aagtttctgatattgttaaagc

SEQ ID NO: 9370362 - DNA, 22 bp, Homo sapiens
aagtttctttattagcttgtcc

SEQ ID NO: 9370363 - DNA, 22 bp, Homo sapiens
aagtttgacagaagtttctaat

SEQ ID NO: 9370364 - DNA, 22 bp, Homo sapiens
aacagtttgcctgaaatgtatt

SEQ ID NO: 9370365 - DNA, 22 bp, Homo sapiens
aataaacttccactgtgttttt

SEQ ID NO: 9370366 - DNA, 22 bp, Homo sapiens
aataaacaaatctttcctgtgg

SEQ ID NO: 9370367 - DNA, 22 bp, Homo sapiens
aataaacaaatctttcctgtgg

SEQ ID NO: 9370368 - DNA, 20 bp, Homo sapiens
aataaactactgagagatgt

SEQ ID NO: 9370369 - DNA, 20 bp, Homo sapiens
aataaactactgagagatgt

SEQ ID NO: 9370370 - DNA, 22 bp, Homo sapiens
aataaactgctcaattgcatca

SEQ ID NO: 9370371 - DNA, 22 bp, Homo sapiens
aataaactgctcaattgcatca

SEQ ID NO: 9370372 - DNA, 22 bp, Homo sapiens
aagccagatttcactcttaatt

SEQ ID NO: 9370373 - DNA, 22 bp, Homo sapiens
aagccagtgtccagaatgggca

SEQ ID NO: 9370374 - DNA, 22 bp, Homo sapiens
aagccagtcctctactgggcac

SEQ ID NO: 9370375 - DNA, 22 bp, Homo sapiens
aagccagtcctctactgggcac

SEQ ID NO: 9370376 - DNA, 22 bp, Homo sapiens
aagccagtggcttctccctgct

SEQ ID NO: 9370377 - DNA, 22 bp, Homo sapiens
aagccagtgtttttgagagttg

SEQ ID NO: 9370378 - DNA, 22 bp, Homo sapiens
aagctggcatgtcacctgagaa

SEQ ID NO: 9370379 - DNA, 22 bp, Homo sapiens
aagctggcctgtacctgctgag

SEQ ID NO: 9370380 - DNA, 22 bp, Homo sapiens
aagctggcctcaaactcctagc

SEQ ID NO: 9370381 - DNA, 19 bp, Homo sapiens
aagctggcagaatattgcc

SEQ ID NO: 9370382 - DNA, 22 bp, Homo sapiens
aagctggcaattatcaaaactg

SEQ ID NO: 9370383 - DNA, 20 bp, Homo sapiens
aagctggcaggtcatagctt

SEQ ID NO: 9370384 - DNA, 20 bp, Homo sapiens
aagctggcaggtcatagctt

SEQ ID NO: 9370385 - DNA, 22 bp, Homo sapiens
aagctggcatgtcacctgagaa

SEQ ID NO: 9370386 - DNA, 18 bp, Homo sapiens
aagctgggaaggagacag

SEQ ID NO: 9370387 - DNA, 18 bp, Homo sapiens
aagctgggaaggagacag

SEQ ID NO: 9370388 - DNA, 18 bp, Homo sapiens
aagctgggaaggagacag

SEQ ID NO: 9370389 - DNA, 18 bp, Homo sapiens
aagctgggaaggagacag

SEQ ID NO: 9370390 - DNA, 23 bp, Homo sapiens
aagctggctgggagcagaaggga

SEQ ID NO: 9370391 - DNA, 22 bp, Homo sapiens
aagctggcctgtacctgctgag

SEQ ID NO: 9370392 - DNA, 22 bp, Homo sapiens
aagctggctaaataaaaggtcc

SEQ ID NO: 9370393 - DNA, 22 bp, Homo sapiens
aagctggctctgatgtcagaat

SEQ ID NO: 9370394 - DNA, 22 bp, Homo sapiens
aagctggcaaacaagcatcatt

SEQ ID NO: 9370395 - DNA, 22 bp, Homo sapiens
aagctggcaaacaagcatcatt

SEQ ID NO: 9370396 - DNA, 22 bp, Homo sapiens
aagctgcaaaaaatttctgtct

SEQ ID NO: 9370397 - DNA, 22 bp, Homo sapiens
aagctgcaaaaaatttctgtct

SEQ ID NO: 9370398 - DNA, 22 bp, Homo sapiens
aagctgattctaaaatttatta

SEQ ID NO: 9370399 - DNA, 22 bp, Homo sapiens
aagctgatgtcccagtttgaag

SEQ ID NO: 9370400 - DNA, 22 bp, Homo sapiens
aagctgatgtcccagtttgaag

SEQ ID NO: 9370401 - DNA, 22 bp, Homo sapiens
aagctgatcatccttccaggtt

SEQ ID NO: 9370402 - DNA, 22 bp, Homo sapiens
aagcttttattaaaatcttgcc

SEQ ID NO: 9370403 - DNA, 22 bp, Homo sapiens
aagctttgttcttcacagagtg

SEQ ID NO: 9370404 - DNA, 21 bp, Homo sapiens
aagcttttcctgagagttgtc

SEQ ID NO: 9370405 - DNA, 22 bp, Homo sapiens
aagcttttattaaaatcttgcc

SEQ ID NO: 9370406 - DNA, 22 bp, Homo sapiens
aagctttgactactgcctcttg

SEQ ID NO: 9370407 - DNA, 22 bp, Homo sapiens
aagctttcagagcagaatgtga

SEQ ID NO: 9370408 - DNA, 22 bp, Homo sapiens
aagctttatgatctctcagcta

SEQ ID NO: 9370409 - DNA, 22 bp, Homo sapiens
aagctttgcaccggtggctgga

SEQ ID NO: 9370410 - DNA, 22 bp, Homo sapiens
aagctttgataattggattact

SEQ ID NO: 9370411 - DNA, 22 bp, Homo sapiens
aagctttgggcagaagaggatt

SEQ ID NO: 9370412 - DNA, 20 bp, Homo sapiens
aagctgtcagaggtggacag

SEQ ID NO: 9370413 - DNA, 19 bp, Homo sapiens
aagctgtcctgttggccct

SEQ ID NO: 9370414 - DNA, 22 bp, Homo sapiens
aagctttatgacttggagacag

SEQ ID NO: 9370415 - DNA, 22 bp, Homo sapiens
aagctttagagatgagttcctt

SEQ ID NO: 9370416 - DNA, 20 bp, Homo sapiens
aagctgggtaggagaggagc

SEQ ID NO: 9370417 - DNA, 20 bp, Homo sapiens
aagctgggtaggagaggagc

SEQ ID NO: 9370418 - DNA, 22 bp, Homo sapiens
aagctggggactcagaccccat

SEQ ID NO: 9370419 - DNA, 20 bp, Homo sapiens
aagctgggtaggagaggagc

SEQ ID NO: 9370420 - DNA, 22 bp, Homo sapiens
aagctgggagggagcccagagt

SEQ ID NO: 9370421 - DNA, 22 bp, Homo sapiens
aagctgggagggagcccagagt

SEQ ID NO: 9370422 - DNA, 22 bp, Homo sapiens
aagctgggacttagcgcagata

SEQ ID NO: 9370423 - DNA, 22 bp, Homo sapiens
aagctgggacttagcgcagata

SEQ ID NO: 9370424 - DNA, 22 bp, Homo sapiens
aagctgggacttagcgcagata

SEQ ID NO: 9370425 - DNA, 22 bp, Homo sapiens
aagctgggacttagcgcagata

SEQ ID NO: 9370426 - DNA, 22 bp, Homo sapiens
aagctgggacttagcgcagata

SEQ ID NO: 9370427 - DNA, 21 bp, Homo sapiens
aaattagcttcaagttctgca

SEQ ID NO: 9370428 - DNA, 18 bp, Homo sapiens
aaattagatggacctgtg

SEQ ID NO: 9370429 - DNA, 22 bp, Homo sapiens
aaattagatcagtggattttct

SEQ ID NO: 9370430 - DNA, 22 bp, Homo sapiens
aaattagtgttttcttactggt

SEQ ID NO: 9370431 - DNA, 22 bp, Homo sapiens
aaattagtcggtttaggaattt

SEQ ID NO: 9370432 - DNA, 22 bp, Homo sapiens
aaattagtcatgttgtattact

SEQ ID NO: 9370433 - DNA, 22 bp, Homo sapiens
aaattagtacattgcaaagtcc

SEQ ID NO: 9370434 - DNA, 22 bp, Homo sapiens
aaggacatttctgactaatgca

SEQ ID NO: 9370435 - DNA, 22 bp, Homo sapiens
aaattattataggcagagctga

SEQ ID NO: 9370436 - DNA, 22 bp, Homo sapiens
aaattattaaacagtgggatgc

SEQ ID NO: 9370437 - DNA, 22 bp, Homo sapiens
aaattattacaagctagttggc

SEQ ID NO: 9370438 - DNA, 22 bp, Homo sapiens
aaattattagttaagttgggca

SEQ ID NO: 9370439 - DNA, 22 bp, Homo sapiens
aaattattataggcagagctga

SEQ ID NO: 9370440 - DNA, 22 bp, Homo sapiens
aaattattacaagctagttggc

SEQ ID NO: 9370441 - DNA, 22 bp, Homo sapiens
aaatttaagaagtgtgtgcgtg

SEQ ID NO: 9370442 - DNA, 22 bp, Homo sapiens
aaatttaaggaggtgctcactt

SEQ ID NO: 9370443 - DNA, 22 bp, Homo sapiens
aaatttaaggaggtgctcactt

SEQ ID NO: 9370444 - DNA, 22 bp, Homo sapiens
aaatttaaaaagcagcattgca

SEQ ID NO: 9370445 - DNA, 22 bp, Homo sapiens
aaatttaaaaagcagcattgca

SEQ ID NO: 9370446 - DNA, 18 bp, Homo sapiens
aaattgtgtaggagtcca

SEQ ID NO: 9370447 - DNA, 22 bp, Homo sapiens
aaattgcattttaaaggtagat

SEQ ID NO: 9370448 - DNA, 22 bp, Homo sapiens
aaattgttgatctacagtaagg

SEQ ID NO: 9370449 - DNA, 22 bp, Homo sapiens
aaattgtggcgtctgtaagagt

SEQ ID NO: 9370450 - DNA, 22 bp, Homo sapiens
aaattgtgtctcaggcagtggt

SEQ ID NO: 9370451 - DNA, 20 bp, Homo sapiens
aaattgtgtttgtgagctcc

SEQ ID NO: 9370452 - DNA, 22 bp, Homo sapiens
aaggactgtctaaggcctccaa

SEQ ID NO: 9370453 - DNA, 22 bp, Homo sapiens
aaggagaaatggtagatgtgca

SEQ ID NO: 9370454 - DNA, 22 bp, Homo sapiens
aaggacctgattttgagcatct

SEQ ID NO: 9370455 - DNA, 21 bp, Homo sapiens
aaggacgaggttttgattaca

SEQ ID NO: 9370456 - DNA, 22 bp, Homo sapiens
aaggacctatattgtcagagga

SEQ ID NO: 9370457 - DNA, 22 bp, Homo sapiens
aaggactagattatacaatagg

SEQ ID NO: 9370458 - DNA, 22 bp, Homo sapiens
aaggactagatattcatacatg

SEQ ID NO: 9370459 - DNA, 22 bp, Homo sapiens
aaggccaccaccagcgaggggg

SEQ ID NO: 9370460 - DNA, 22 bp, Homo sapiens
aaggccaaggctgcagtgagcc

SEQ ID NO: 9370461 - DNA, 22 bp, Homo sapiens
aaggccacagagcctcagagag

SEQ ID NO: 9370462 - DNA, 22 bp, Homo sapiens
aaggccacagagcctcagagag

SEQ ID NO: 9370463 - DNA, 23 bp, Homo sapiens
aaggccagaatttcaatggtgcc

SEQ ID NO: 9370464 - DNA, 22 bp, Homo sapiens
aaggccagacaggaccacatct

SEQ ID NO: 9370465 - DNA, 22 bp, Homo sapiens
aaggccagacaggaccacatct

SEQ ID NO: 9370466 - DNA, 23 bp, Homo sapiens
aaggccagaatttcaatggtgcc

SEQ ID NO: 9370467 - DNA, 23 bp, Homo sapiens
aaggccagaatttcaatggtgcc

SEQ ID NO: 9370468 - DNA, 22 bp, Homo sapiens
aaggccagacaggaccacatct

SEQ ID NO: 9370469 - DNA, 22 bp, Homo sapiens
aaggccagactctggaatgaca

SEQ ID NO: 9370470 - DNA, 22 bp, Homo sapiens
aaggccagactctggaatgaca

SEQ ID NO: 9370471 - DNA, 22 bp, Homo sapiens
aaatttcaagcaaagtagctat

SEQ ID NO: 9370472 - DNA, 22 bp, Homo sapiens
aaatttcaagcaaagtagctat

SEQ ID NO: 9370473 - DNA, 20 bp, Homo sapiens
aaatttaggaaattttacgc

SEQ ID NO: 9370474 - DNA, 22 bp, Homo sapiens
aaatttctaagcagccacttcc

SEQ ID NO: 9370475 - DNA, 22 bp, Homo sapiens
aaatttctaagcagccacttcc

SEQ ID NO: 9370476 - DNA, 22 bp, Homo sapiens
aaggccaactaggatgagctag

SEQ ID NO: 9370477 - DNA, 22 bp, Homo sapiens
aacaataactagacatgccatg

SEQ ID NO: 9370478 - DNA, 22 bp, Homo sapiens
aacaataactagacatgccatg

SEQ ID NO: 9370479 - DNA, 22 bp, Homo sapiens
aagggagacagttgtgtgagga

SEQ ID NO: 9370480 - DNA, 22 bp, Homo sapiens
aagggagacccaccgtcctgga

SEQ ID NO: 9370481 - DNA, 22 bp, Homo sapiens
aagggagacagttgtgtgagga

SEQ ID NO: 9370482 - DNA, 22 bp, Homo sapiens
aagggagacagttgtgtgagga

SEQ ID NO: 9370483 - DNA, 22 bp, Homo sapiens
aacaataattgcggttctctat

SEQ ID NO: 9370484 - DNA, 22 bp, Homo sapiens
aacaataactagacatgccatg

SEQ ID NO: 9370485 - DNA, 22 bp, Homo sapiens
aacaataactagacatgccatg

SEQ ID NO: 9370486 - DNA, 22 bp, Homo sapiens
aacaagtgtattaatggaaata

SEQ ID NO: 9370487 - DNA, 22 bp, Homo sapiens
aacaagtgatgctcatgattca

SEQ ID NO: 9370488 - DNA, 22 bp, Homo sapiens
aacaagtgatatataatggaag

SEQ ID NO: 9370489 - DNA, 22 bp, Homo sapiens
aacaagtgagtcatttaaactc

SEQ ID NO: 9370490 - DNA, 22 bp, Homo sapiens
aacaagtgaaagtccttttcga

SEQ ID NO: 9370491 - DNA, 18 bp, Homo sapiens
aagtatgcctatgttatt

SEQ ID NO: 9370492 - DNA, 22 bp, Homo sapiens
aagtatgtgtgggatgctggga

SEQ ID NO: 9370493 - DNA, 22 bp, Homo sapiens
aagtatgtctttgggtattatt

SEQ ID NO: 9370494 - DNA, 22 bp, Homo sapiens
aagtacaatctttctgtaaagg

SEQ ID NO: 9370495 - DNA, 22 bp, Homo sapiens
aacaatgccacattaagtgtat

SEQ ID NO: 9370496 - DNA, 23 bp, Homo sapiens
aacaatagagataaagtgagatc

SEQ ID NO: 9370497 - DNA, 22 bp, Homo sapiens
aacaataattgcggttctctat

SEQ ID NO: 9370498 - DNA, 22 bp, Homo sapiens
aacaataattgcggttctctat

SEQ ID NO: 9370499 - DNA, 22 bp, Homo sapiens
aacaataggctatatgctaggc

SEQ ID NO: 9370500 - DNA, 22 bp, Homo sapiens
aaggggaagtagcaccagaggt

SEQ ID NO: 9370501 - DNA, 22 bp, Homo sapiens
aagggctggagactgggtcttc

SEQ ID NO: 9370502 - DNA, 22 bp, Homo sapiens
aagggctggagactgggtcttc

SEQ ID NO: 9370503 - DNA, 21 bp, Homo sapiens
aagggagataggaatcaggcc

SEQ ID NO: 9370504 - DNA, 21 bp, Homo sapiens
aagggagataggaatcaggcc

SEQ ID NO: 9370505 - DNA, 22 bp, Homo sapiens
aaggggctcttgtcaggcgcag

SEQ ID NO: 9370506 - DNA, 22 bp, Homo sapiens
aaggggcctcacagatgggctt

SEQ ID NO: 9370507 - DNA, 22 bp, Homo sapiens
aaggggcatgcttttgccagga

SEQ ID NO: 9370508 - DNA, 21 bp, Homo sapiens
aaggggcaaacccaggacacc

SEQ ID NO: 9370509 - DNA, 21 bp, Homo sapiens
aaggggcaaacccaggacacc

SEQ ID NO: 9370510 - DNA, 22 bp, Homo sapiens
aaggggatttaaggtaagaaga

SEQ ID NO: 9370511 - DNA, 22 bp, Homo sapiens
aaggggaatagagtgggttgtg

SEQ ID NO: 9370512 - DNA, 22 bp, Homo sapiens
aaggggaagtagcaccagaggt

SEQ ID NO: 9370513 - DNA, 22 bp, Homo sapiens
aaggggagatgtcatgggccct

SEQ ID NO: 9370514 - DNA, 22 bp, Homo sapiens
aatgtgtttatttagtgattta

SEQ ID NO: 9370515 - DNA, 22 bp, Homo sapiens
aatgtgttttcactgaagattc

SEQ ID NO: 9370516 - DNA, 22 bp, Homo sapiens
aatgtgttttatgagagaatat

SEQ ID NO: 9370517 - DNA, 22 bp, Homo sapiens
aatgttacgatcaacaacacat

SEQ ID NO: 9370518 - DNA, 22 bp, Homo sapiens
aatgttacgatcaacaacacat

SEQ ID NO: 9370519 - DNA, 22 bp, Homo sapiens
aatgttatgtggttcaacttaa

SEQ ID NO: 9370520 - DNA, 22 bp, Homo sapiens
aatgttatgtggttcaacttaa

SEQ ID NO: 9370521 - DNA, 22 bp, Homo sapiens
aattacttaagagaaactttga

SEQ ID NO: 9370522 - DNA, 22 bp, Homo sapiens
aactttctctggatggcttcct

SEQ ID NO: 9370523 - DNA, 22 bp, Homo sapiens
aactttctgaaaagcttgatca

SEQ ID NO: 9370524 - DNA, 22 bp, Homo sapiens
aactttcaggcaatgaatattt

SEQ ID NO: 9370525 - DNA, 22 bp, Homo sapiens
aactttctataggttgggattt

SEQ ID NO: 9370526 - DNA, 22 bp, Homo sapiens
aactttcagaatcctatgcatt

SEQ ID NO: 9370527 - DNA, 22 bp, Homo sapiens
aactttcagcaagtaattctgg

SEQ ID NO: 9370528 - DNA, 22 bp, Homo sapiens
aactttcagaatcctatgcatt

SEQ ID NO: 9370529 - DNA, 22 bp, Homo sapiens
aactttacttgaaagaacatgt

SEQ ID NO: 9370530 - DNA, 22 bp, Homo sapiens
aatgttatgtggttcaacttaa

SEQ ID NO: 9370531 - DNA, 22 bp, Homo sapiens
aatgtcttggatacagaggttg

SEQ ID NO: 9370532 - DNA, 22 bp, Homo sapiens
aatgtcttgagaagagaaatct

SEQ ID NO: 9370533 - DNA, 20 bp, Homo sapiens
aatgtattgttttgtttcag

SEQ ID NO: 9370534 - DNA, 22 bp, Homo sapiens
aatgtattttgggagtttcttt

SEQ ID NO: 9370535 - DNA, 22 bp, Homo sapiens
aatgtcaaaatggaatgagact

SEQ ID NO: 9370536 - DNA, 22 bp, Homo sapiens
aatgtcaacacaagagaaatgc

SEQ ID NO: 9370537 - DNA, 22 bp, Homo sapiens
aatgtacaataagacaaagagg

SEQ ID NO: 9370538 - DNA, 22 bp, Homo sapiens
aatgtacaataagacaaagagg

SEQ ID NO: 9370539 - DNA, 22 bp, Homo sapiens
aatgtattctgggaaaatgtta

SEQ ID NO: 9370540 - DNA, 22 bp, Homo sapiens
aatgtattctgggaaaatgtta

SEQ ID NO: 9370541 - DNA, 20 bp, Homo sapiens
aactcctagcctcaagtgat

SEQ ID NO: 9370542 - DNA, 22 bp, Homo sapiens
aactctacttgggactcctctg

SEQ ID NO: 9370543 - DNA, 22 bp, Homo sapiens
aactctatttaccctactaaac

SEQ ID NO: 9370544 - DNA, 22 bp, Homo sapiens
aactctatttaccctactaaac

SEQ ID NO: 9370545 - DNA, 22 bp, Homo sapiens
aactctggaaatctacatggcc

SEQ ID NO: 9370546 - DNA, 22 bp, Homo sapiens
aagaattggtcacatgctacaa

SEQ ID NO: 9370547 - DNA, 22 bp, Homo sapiens
aagaattcactggtagagtcaa

SEQ ID NO: 9370548 - DNA, 22 bp, Homo sapiens
aagaattgatgtgaattgcagc

SEQ ID NO: 9370549 - DNA, 22 bp, Homo sapiens
aagaattattgcaatactagat

SEQ ID NO: 9370550 - DNA, 22 bp, Homo sapiens
aagaattattgcaatactagat

SEQ ID NO: 9370551 - DNA, 22 bp, Homo sapiens
aagaatttaaactaaccatatg

SEQ ID NO: 9370552 - DNA, 22 bp, Homo sapiens
aattagctaattaattgtagcc

SEQ ID NO: 9370553 - DNA, 22 bp, Homo sapiens
aattagctaattaattgtagcc

SEQ ID NO: 9370554 - DNA, 22 bp, Homo sapiens
aattagagtggcgagtgattta

SEQ ID NO: 9370555 - DNA, 20 bp, Homo sapiens
aattagatgtttaatcaata

SEQ ID NO: 9370556 - DNA, 20 bp, Homo sapiens
aattagatgtttaatcaata

SEQ ID NO: 9370557 - DNA, 22 bp, Homo sapiens
aattagcatttcccatataaat

SEQ ID NO: 9370558 - DNA, 22 bp, Homo sapiens
aattagaagctgttagcaaaat

SEQ ID NO: 9370559 - DNA, 23 bp, Homo sapiens
aattcaaattcagtgtgactagg

SEQ ID NO: 9370560 - DNA, 22 bp, Homo sapiens
aattatttaactcctttggaga

SEQ ID NO: 9370561 - DNA, 22 bp, Homo sapiens
aattcaaattacaatagttgtt

SEQ ID NO: 9370562 - DNA, 22 bp, Homo sapiens
aattcaaattacaatagttgtt

SEQ ID NO: 9370563 - DNA, 22 bp, Homo sapiens
aattcaaattacaatagttgtt

SEQ ID NO: 9370564 - DNA, 22 bp, Homo sapiens
aagacacaaagcttcccttttc

SEQ ID NO: 9370565 - DNA, 22 bp, Homo sapiens
acaactgtcagtaaagaatatt

SEQ ID NO: 9370566 - DNA, 22 bp, Homo sapiens
acaactgatgggtcatgtggga

SEQ ID NO: 9370567 - DNA, 22 bp, Homo sapiens
acaactccttcttgggtcctgg

SEQ ID NO: 9370568 - DNA, 22 bp, Homo sapiens
acaactccttcttgggtcctgg

SEQ ID NO: 9370569 - DNA, 22 bp, Homo sapiens
aagacacagcgaaatgttcctg

SEQ ID NO: 9370570 - DNA, 22 bp, Homo sapiens
acaactttctgggttatctgat

SEQ ID NO: 9370571 - DNA, 22 bp, Homo sapiens
acaactttctgggttatctgat

SEQ ID NO: 9370572 - DNA, 22 bp, Homo sapiens
acaactttaatgggtttcagct

SEQ ID NO: 9370573 - DNA, 22 bp, Homo sapiens
acaagaagtaaaggtcggatgc

SEQ ID NO: 9370574 - DNA, 22 bp, Homo sapiens
aagacattgtcattttataatt

SEQ ID NO: 9370575 - DNA, 22 bp, Homo sapiens
aagacattgtcattttataatt

SEQ ID NO: 9370576 - DNA, 22 bp, Homo sapiens
aagacattgctgcttttaattg

SEQ ID NO: 9370577 - DNA, 22 bp, Homo sapiens
aagacattggacaatccagagg

SEQ ID NO: 9370578 - DNA, 22 bp, Homo sapiens
aagacattggacaatccagagg

SEQ ID NO: 9370579 - DNA, 22 bp, Homo sapiens
aagacattggcattgactgtaa

SEQ ID NO: 9370580 - DNA, 22 bp, Homo sapiens
aagacattgcatgataatgctg

SEQ ID NO: 9370581 - DNA, 22 bp, Homo sapiens
aagacattgcatgataatgctg

SEQ ID NO: 9370582 - DNA, 22 bp, Homo sapiens
aagacattgcatgataatgctg

SEQ ID NO: 9370583 - DNA, 22 bp, Homo sapiens
aagacattccaaagtggctaat

SEQ ID NO: 9370584 - DNA, 22 bp, Homo sapiens
aagacattcatgaagaagggat

SEQ ID NO: 9370585 - DNA, 22 bp, Homo sapiens
aagacattcacaaatgttcact

SEQ ID NO: 9370586 - DNA, 22 bp, Homo sapiens
aagacattcacaaatgttcact

SEQ ID NO: 9370587 - DNA, 22 bp, Homo sapiens
aagacattagaatcagcctgtt

SEQ ID NO: 9370588 - DNA, 22 bp, Homo sapiens
aagatacatcaaagcaaattgg

SEQ ID NO: 9370589 - DNA, 23 bp, Homo sapiens
acacgtgtgtgtacatagatagt

SEQ ID NO: 9370590 - DNA, 22 bp, Homo sapiens
acacctggtctttgcatgagca

SEQ ID NO: 9370591 - DNA, 22 bp, Homo sapiens
acacctggtctttgcatgagca

SEQ ID NO: 9370592 - DNA, 22 bp, Homo sapiens
acaccccaccagtaactgaggg

SEQ ID NO: 9370593 - DNA, 22 bp, Homo sapiens
acacctggtctttgcatgagca

SEQ ID NO: 9370594 - DNA, 22 bp, Homo sapiens
acacctttgccccaagtcatag

SEQ ID NO: 9370595 - DNA, 22 bp, Homo sapiens
acacctttgtgaagtgatgatg

SEQ ID NO: 9370596 - DNA, 22 bp, Homo sapiens
acacgcataaatacacagtcta

SEQ ID NO: 9370597 - DNA, 22 bp, Homo sapiens
acacgcatgatgatgcacgtac

SEQ ID NO: 9370598 - DNA, 22 bp, Homo sapiens
acacatttctctttttgtaagt

SEQ ID NO: 9370599 - DNA, 22 bp, Homo sapiens
acacatttctaaatttttaccg

SEQ ID NO: 9370600 - DNA, 22 bp, Homo sapiens
aagagtcgtttcaggacagagg

SEQ ID NO: 9370601 - DNA, 22 bp, Homo sapiens
aagaggtttcatgattttctta

SEQ ID NO: 9370602 - DNA, 22 bp, Homo sapiens
aagaggtttaactgactcacag

SEQ ID NO: 9370603 - DNA, 22 bp, Homo sapiens
aagagttagctcaataacttga

SEQ ID NO: 9370604 - DNA, 22 bp, Homo sapiens
aagagtggagctggaaagtggg

SEQ ID NO: 9370605 - DNA, 22 bp, Homo sapiens
aagaccataatgtaagatgaat

SEQ ID NO: 9370606 - DNA, 22 bp, Homo sapiens
aagaggaggattgatgtgggag

SEQ ID NO: 9370607 - DNA, 22 bp, Homo sapiens
aagaggaactgggggctgagtc

SEQ ID NO: 9370608 - DNA, 22 bp, Homo sapiens
aagacattttgaaattggaagc

SEQ ID NO: 9370609 - DNA, 22 bp, Homo sapiens
aagacattttagagatagggaa

SEQ ID NO: 9370610 - DNA, 22 bp, Homo sapiens
aagacattgtggagatgttgct

SEQ ID NO: 9370611 - DNA, 22 bp, Homo sapiens
aagacatttatgaaaagtgctg

SEQ ID NO: 9370612 - DNA, 22 bp, Homo sapiens
aagacatttatttgaatcaatt

SEQ ID NO: 9370613 - DNA, 22 bp, Homo sapiens
aagaggcagtggtgatgaatgg

SEQ ID NO: 9370614 - DNA, 22 bp, Homo sapiens
aagaggcataaaatttatatgg

SEQ ID NO: 9370615 - DNA, 21 bp, Homo sapiens
aagaggcatcactatttgtgt

SEQ ID NO: 9370616 - DNA, 22 bp, Homo sapiens
aagaggcagaaatatcgctgaa

SEQ ID NO: 9370617 - DNA, 22 bp, Homo sapiens
aagaggcagcccgctgaggctg

SEQ ID NO: 9370618 - DNA, 22 bp, Homo sapiens
aagaggcagcccgctgaggctg

SEQ ID NO: 9370619 - DNA, 22 bp, Homo sapiens
aagaggagtagatgtggttggt

SEQ ID NO: 9370620 - DNA, 19 bp, Homo sapiens
aagaggcaaccctcgagcc

SEQ ID NO: 9370621 - DNA, 20 bp, Homo sapiens
aagaggtgataacaggtgag

SEQ ID NO: 9370622 - DNA, 22 bp, Homo sapiens
aagaggtgagaagctacactta

SEQ ID NO: 9370623 - DNA, 22 bp, Homo sapiens
aagaggtcacactaggtcctag

SEQ ID NO: 9370624 - DNA, 22 bp, Homo sapiens
aagaggtgggttggacagatac

SEQ ID NO: 9370625 - DNA, 22 bp, Homo sapiens
aagaggttattgttcccagctt

SEQ ID NO: 9370626 - DNA, 22 bp, Homo sapiens
aagaggttctaatttaactatc

SEQ ID NO: 9370627 - DNA, 22 bp, Homo sapiens
aagaggtggaacagcaattcgt

SEQ ID NO: 9370628 - DNA, 22 bp, Homo sapiens
aagaggtggaacagcaattcgt

SEQ ID NO: 9370629 - DNA, 22 bp, Homo sapiens
acacacatgcatgcttgccatt

SEQ ID NO: 9370630 - DNA, 22 bp, Homo sapiens
acacacatgcatgcttgccatt

SEQ ID NO: 9370631 - DNA, 22 bp, Homo sapiens
acacacatgcatgcttgccatt

SEQ ID NO: 9370632 - DNA, 22 bp, Homo sapiens
aagaggctttcagtgaacttgt

SEQ ID NO: 9370633 - DNA, 22 bp, Homo sapiens
acacacatgcatgcttgccatt

SEQ ID NO: 9370634 - DNA, 22 bp, Homo sapiens
acacacaggtaaaggagcctgg

SEQ ID NO: 9370635 - DNA, 22 bp, Homo sapiens
acacacaggtaaaggagcctgg

SEQ ID NO: 9370636 - DNA, 22 bp, Homo sapiens
acacacagcgcctaccatgtgc

SEQ ID NO: 9370637 - DNA, 22 bp, Homo sapiens
acacacagagtttatacaggca

SEQ ID NO: 9370638 - DNA, 22 bp, Homo sapiens
acacacagagtttatacaggca

SEQ ID NO: 9370639 - DNA, 20 bp, Homo sapiens
acacacagagacatgcgcat

SEQ ID NO: 9370640 - DNA, 21 bp, Homo sapiens
aagaggcatcactatttgtgt

SEQ ID NO: 9370641 - DNA, 22 bp, Homo sapiens
aagaggcatctcagcttcctct

SEQ ID NO: 9370642 - DNA, 22 bp, Homo sapiens
acagaagcaaagactcaggcaa

SEQ ID NO: 9370643 - DNA, 22 bp, Homo sapiens
acagaagcaaaagcaggatctt

SEQ ID NO: 9370644 - DNA, 22 bp, Homo sapiens
acagaagcaaaagcaggatctt

SEQ ID NO: 9370645 - DNA, 22 bp, Homo sapiens
acagaagataatgctgccttgg

SEQ ID NO: 9370646 - DNA, 22 bp, Homo sapiens
aagatttcttacttattgatgc

SEQ ID NO: 9370647 - DNA, 22 bp, Homo sapiens
acagaagcagcgcggctcttct

SEQ ID NO: 9370648 - DNA, 22 bp, Homo sapiens
acagaagcagccgtcacagata

SEQ ID NO: 9370649 - DNA, 22 bp, Homo sapiens
acagaagagcacatttagtatg

SEQ ID NO: 9370650 - DNA, 22 bp, Homo sapiens
acagaagaccagagagctaact

SEQ ID NO: 9370651 - DNA, 22 bp, Homo sapiens
aagattttcagtgcctaaaaca

SEQ ID NO: 9370652 - DNA, 22 bp, Homo sapiens
aagattttcagctaatggtgca

SEQ ID NO: 9370653 - DNA, 22 bp, Homo sapiens
aagcaaaaggttacacttctgg

SEQ ID NO: 9370654 - DNA, 22 bp, Homo sapiens
aagcaaaaggttacacttctgg

SEQ ID NO: 9370655 - DNA, 22 bp, Homo sapiens
aagatttttttccacagactca

SEQ ID NO: 9370656 - DNA, 22 bp, Homo sapiens
aagattttctcaactgtatttg

SEQ ID NO: 9370657 - DNA, 22 bp, Homo sapiens
acagaagaccaagaaagcttcc

SEQ ID NO: 9370658 - DNA, 22 bp, Homo sapiens
acagaagaccaagaaagcttcc

SEQ ID NO: 9370659 - DNA, 22 bp, Homo sapiens
acagaagaagttcaaggtgaag

SEQ ID NO: 9370660 - DNA, 22 bp, Homo sapiens
aagatatactattaagtaccat

SEQ ID NO: 9370661 - DNA, 22 bp, Homo sapiens
aagatatactattaagtaccat

SEQ ID NO: 9370662 - DNA, 22 bp, Homo sapiens
aagatactgatgatgtaggcta

SEQ ID NO: 9370663 - DNA, 20 bp, Homo sapiens
aagatactccagaaattaaa

SEQ ID NO: 9370664 - DNA, 22 bp, Homo sapiens
aagatacattttcttcagagaa

SEQ ID NO: 9370665 - DNA, 22 bp, Homo sapiens
aagatacattatgtctctctga

SEQ ID NO: 9370666 - DNA, 22 bp, Homo sapiens
aagatacatcattcaggagtga

SEQ ID NO: 9370667 - DNA, 22 bp, Homo sapiens
acagaggaagcatatagcacaa

SEQ ID NO: 9370668 - DNA, 22 bp, Homo sapiens
acagagcttcccagcctgagca

SEQ ID NO: 9370669 - DNA, 22 bp, Homo sapiens
acagagcttaggatgactccca

SEQ ID NO: 9370670 - DNA, 22 bp, Homo sapiens
acagagcttaattcaggagctt

SEQ ID NO: 9370671 - DNA, 22 bp, Homo sapiens
aagcaaagacagtttgagtgga

SEQ ID NO: 9370672 - DNA, 17 bp, Homo sapiens
acagagcacatcaagat

SEQ ID NO: 9370673 - DNA, 22 bp, Homo sapiens
acagagcacatagattggagtt

SEQ ID NO: 9370674 - DNA, 17 bp, Homo sapiens
acagagcacatcaagat

SEQ ID NO: 9370675 - DNA, 18 bp, Homo sapiens
acagaggcagacatgtat

SEQ ID NO: 9370676 - DNA, 22 bp, Homo sapiens
acagaggaaggctgagctgccc

SEQ ID NO: 9370677 - DNA, 22 bp, Homo sapiens
acagaggaaggctgagctgccc

SEQ ID NO: 9370678 - DNA, 22 bp, Homo sapiens
acagaggacaactaggcgctca

SEQ ID NO: 9370679 - DNA, 22 bp, Homo sapiens
acagaggacaactaggcgctca

SEQ ID NO: 9370680 - DNA, 22 bp, Homo sapiens
aagcacattaaggaacattgaa

SEQ ID NO: 9370681 - DNA, 22 bp, Homo sapiens
aagcacatgagctattcatgct

SEQ ID NO: 9370682 - DNA, 22 bp, Homo sapiens
aagcacatctcctgtgcagaac

SEQ ID NO: 9370683 - DNA, 22 bp, Homo sapiens
aagcacattgcctggcacatag

SEQ ID NO: 9370684 - DNA, 22 bp, Homo sapiens
aagcacattgtacatttgtgct

SEQ ID NO: 9370685 - DNA, 22 bp, Homo sapiens
aagcacatttggaaaacatgga

SEQ ID NO: 9370686 - DNA, 20 bp, Homo sapiens
aagcacatttctacaataat

SEQ ID NO: 9370687 - DNA, 22 bp, Homo sapiens
acagatgaaacccagctagttg

SEQ ID NO: 9370688 - DNA, 22 bp, Homo sapiens
acagatgaaaaagcttgtggat

SEQ ID NO: 9370689 - DNA, 22 bp, Homo sapiens
acagatctcaaagcctggaccc

SEQ ID NO: 9370690 - DNA, 22 bp, Homo sapiens
acagatctacattgtctgaccc

SEQ ID NO: 9370691 - DNA, 22 bp, Homo sapiens
acagagtcattcactgatgaag

SEQ ID NO: 9370692 - DNA, 22 bp, Homo sapiens
acagatatttggggaaagacgt

SEQ ID NO: 9370693 - DNA, 22 bp, Homo sapiens
acagatgagactccaggacctt

SEQ ID NO: 9370694 - DNA, 22 bp, Homo sapiens
acagatgaaacccagctagttg

SEQ ID NO: 9370695 - DNA, 23 bp, Homo sapiens
acagatgaaagtgtggctcagag

SEQ ID NO: 9370696 - DNA, 22 bp, Homo sapiens
aatgtagatgagatattttttg

SEQ ID NO: 9370697 - DNA, 22 bp, Homo sapiens
aatgtagaatgatccttaggat

SEQ ID NO: 9370698 - DNA, 22 bp, Homo sapiens
aatgtataaagtgttaataact

SEQ ID NO: 9370699 - DNA, 22 bp, Homo sapiens
aatgtataaagtgttaataact

SEQ ID NO: 9370700 - DNA, 22 bp, Homo sapiens
aatgtataaagtgttaataact

SEQ ID NO: 9370701 - DNA, 22 bp, Homo sapiens
aatgtacaggctggctatgggg

SEQ ID NO: 9370702 - DNA, 22 bp, Homo sapiens
aatgtacagctgtctttcctcc

SEQ ID NO: 9370703 - DNA, 22 bp, Homo sapiens
aatgtacatctcagtgtagtac

SEQ ID NO: 9370704 - DNA, 22 bp, Homo sapiens
aatgtacactgaaagcctatca

SEQ ID NO: 9370705 - DNA, 22 bp, Homo sapiens
aatgtacagctgctgctgaagg

SEQ ID NO: 9370706 - DNA, 22 bp, Homo sapiens
aatgtacaccgtgggtttttta

SEQ ID NO: 9370707 - DNA, 22 bp, Homo sapiens
aatgtacactgaaagcctatca

SEQ ID NO: 9370708 - DNA, 22 bp, Homo sapiens
agaatcctggccaggtcagagc

SEQ ID NO: 9370709 - DNA, 22 bp, Homo sapiens
agaatccttgactcaggctgag

SEQ ID NO: 9370710 - DNA, 19 bp, Homo sapiens
agaatctaaattatttctg

SEQ ID NO: 9370711 - DNA, 22 bp, Homo sapiens
agaattgtaagcaatttgatta

SEQ ID NO: 9370712 - DNA, 22 bp, Homo sapiens
agaatttagctccttggtcata

SEQ ID NO: 9370713 - DNA, 23 bp, Homo sapiens
aatgctggaaattcaggcatgat

SEQ ID NO: 9370714 - DNA, 22 bp, Homo sapiens
aatgaaaattggaccctagaac

SEQ ID NO: 9370715 - DNA, 22 bp, Homo sapiens
aatgcttttgctgtcattgctt

SEQ ID NO: 9370716 - DNA, 22 bp, Homo sapiens
aatgctttttgcgaaatgtgca

SEQ ID NO: 9370717 - DNA, 22 bp, Homo sapiens
aatggaatacctaggtggccca

SEQ ID NO: 9370718 - DNA, 22 bp, Homo sapiens
aatggagaccctaaggaagagg

SEQ ID NO: 9370719 - DNA, 22 bp, Homo sapiens
agaataaaatagtctgaagatg

SEQ ID NO: 9370720 - DNA, 22 bp, Homo sapiens
agaataaaatagtctgaagatg

SEQ ID NO: 9370721 - DNA, 22 bp, Homo sapiens
agaataaaatagtctgaagatg

SEQ ID NO: 9370722 - DNA, 22 bp, Homo sapiens
agaataaaatagtctgaagatg

SEQ ID NO: 9370723 - DNA, 22 bp, Homo sapiens
agaataaatgctacctatcaca

SEQ ID NO: 9370724 - DNA, 22 bp, Homo sapiens
agaataaatcaaatgtcctgag

SEQ ID NO: 9370725 - DNA, 22 bp, Homo sapiens
agaatcattagagagaaaactt

SEQ ID NO: 9370726 - DNA, 22 bp, Homo sapiens
agaataaatgttggacttagga

SEQ ID NO: 9370727 - DNA, 22 bp, Homo sapiens
agaataaatgttggacttagga

SEQ ID NO: 9370728 - DNA, 22 bp, Homo sapiens
agaataatcactgaagttcaaa

SEQ ID NO: 9370729 - DNA, 22 bp, Homo sapiens
agaataatactgaaatgctgaa

SEQ ID NO: 9370730 - DNA, 22 bp, Homo sapiens
agaataatactgaaatgctgaa

SEQ ID NO: 9370731 - DNA, 19 bp, Homo sapiens
agactctgtgtgagacttt

SEQ ID NO: 9370732 - DNA, 23 bp, Homo sapiens
agactggggcataagaagatggc

SEQ ID NO: 9370733 - DNA, 22 bp, Homo sapiens
agagaaacaggtcagctgggag

SEQ ID NO: 9370734 - DNA, 18 bp, Homo sapiens
agagaaagaccaaagcat

SEQ ID NO: 9370735 - DNA, 23 bp, Homo sapiens
agagaaagggataacacgttgaa

SEQ ID NO: 9370736 - DNA, 19 bp, Homo sapiens
agagaaagaattgagtcta

SEQ ID NO: 9370737 - DNA, 22 bp, Homo sapiens
aatgtataaccataggaaattt

SEQ ID NO: 9370738 - DNA, 22 bp, Homo sapiens
aatgtataaccataggaaattt

SEQ ID NO: 9370739 - DNA, 22 bp, Homo sapiens
aatgtataaccataggaaattt

SEQ ID NO: 9370740 - DNA, 22 bp, Homo sapiens
agacacctaatagatgaattca

SEQ ID NO: 9370741 - DNA, 22 bp, Homo sapiens
agacctctgctcccttcatggt

SEQ ID NO: 9370742 - DNA, 22 bp, Homo sapiens
agactctggagtcagctaggat

SEQ ID NO: 9370743 - DNA, 21 bp, Homo sapiens
agactctggggatctctgtcc

SEQ ID NO: 9370744 - DNA, 22 bp, Homo sapiens
agagagaattggataaattggt

SEQ ID NO: 9370745 - DNA, 20 bp, Homo sapiens
agagagacctaggcctagtc

SEQ ID NO: 9370746 - DNA, 18 bp, Homo sapiens
agagagaattccagtagg

SEQ ID NO: 9370747 - DNA, 18 bp, Homo sapiens
agagagaattccagtagg

SEQ ID NO: 9370748 - DNA, 22 bp, Homo sapiens
agagacagggttttgccatgtt

SEQ ID NO: 9370749 - DNA, 21 bp, Homo sapiens
agagaaagtcatggctgtggc

SEQ ID NO: 9370750 - DNA, 21 bp, Homo sapiens
agagaaagtcatggctgtggc

SEQ ID NO: 9370751 - DNA, 21 bp, Homo sapiens
agagaaagtcatggctgtggc

SEQ ID NO: 9370752 - DNA, 21 bp, Homo sapiens
agagaaagtcatggctgtggc

SEQ ID NO: 9370753 - DNA, 22 bp, Homo sapiens
agagaaagtcctgatctctcta

SEQ ID NO: 9370754 - DNA, 22 bp, Homo sapiens
agagaaagtcctgatctctcta

SEQ ID NO: 9370755 - DNA, 22 bp, Homo sapiens
agagagagaaatgaaatgtgct

SEQ ID NO: 9370756 - DNA, 22 bp, Homo sapiens
agagagagaaatgaaatgtgct

SEQ ID NO: 9370757 - DNA, 22 bp, Homo sapiens
agagagacgggggctgctgctt

SEQ ID NO: 9370758 - DNA, 22 bp, Homo sapiens
agagagagaaatgaaatgtgct

SEQ ID NO: 9370759 - DNA, 17 bp, Homo sapiens
agagagagcatgccacc

SEQ ID NO: 9370760 - DNA, 17 bp, Homo sapiens
agagagagcatgccacc

SEQ ID NO: 9370761 - DNA, 20 bp, Homo sapiens
agagagaggtaaattgagca

SEQ ID NO: 9370762 - DNA, 20 bp, Homo sapiens
agagagaggtaaattgagca

SEQ ID NO: 9370763 - DNA, 20 bp, Homo sapiens
agagagaggtaaattgagca

SEQ ID NO: 9370764 - DNA, 22 bp, Homo sapiens
agagagaggggcgagcaaacac

SEQ ID NO: 9370765 - DNA, 22 bp, Homo sapiens
agagagaggggcgagcaaacac

SEQ ID NO: 9370766 - DNA, 22 bp, Homo sapiens
agagagagggaaactgctaaac

SEQ ID NO: 9370767 - DNA, 22 bp, Homo sapiens
aattatgtttgctttagatgga

SEQ ID NO: 9370768 - DNA, 22 bp, Homo sapiens
aattatgtgcttgcttgtttcc

SEQ ID NO: 9370769 - DNA, 22 bp, Homo sapiens
aattatgtagccatatgaaaca

SEQ ID NO: 9370770 - DNA, 19 bp, Homo sapiens
agagatccagcttctagct

SEQ ID NO: 9370771 - DNA, 22 bp, Homo sapiens
agagatcccttctgcctgggga

SEQ ID NO: 9370772 - DNA, 22 bp, Homo sapiens
agagatctagcacctgctggtc

SEQ ID NO: 9370773 - DNA, 22 bp, Homo sapiens
agagatccttcaatctagtttt

SEQ ID NO: 9370774 - DNA, 22 bp, Homo sapiens
agagatctctgaagctgctgct

SEQ ID NO: 9370775 - DNA, 22 bp, Homo sapiens
agagatctgaaacaaattagga

SEQ ID NO: 9370776 - DNA, 22 bp, Homo sapiens
agagatatgctgcctaaattta

SEQ ID NO: 9370777 - DNA, 22 bp, Homo sapiens
agagatatgctgcctaaattta

SEQ ID NO: 9370778 - DNA, 22 bp, Homo sapiens
agagatataagtataaataggg

SEQ ID NO: 9370779 - DNA, 22 bp, Homo sapiens
agagatatatatttgtttacca

SEQ ID NO: 9370780 - DNA, 23 bp, Homo sapiens
agagagagtttgtgtcaggtacc

SEQ ID NO: 9370781 - DNA, 22 bp, Homo sapiens
agagagcagtctggaagaaaca

SEQ ID NO: 9370782 - DNA, 22 bp, Homo sapiens
aattttgtgtgggatcaaagga

SEQ ID NO: 9370783 - DNA, 22 bp, Homo sapiens
aattttgtgtgggatcaaagga

SEQ ID NO: 9370784 - DNA, 22 bp, Homo sapiens
aattttgtgtgggatcaaagga

SEQ ID NO: 9370785 - DNA, 22 bp, Homo sapiens
agagggctgcctcagtcagcta

SEQ ID NO: 9370786 - DNA, 22 bp, Homo sapiens
agagggctgctgcacagtgctc

SEQ ID NO: 9370787 - DNA, 22 bp, Homo sapiens
agagggctggacgcaggttgga

SEQ ID NO: 9370788 - DNA, 22 bp, Homo sapiens
aattttctggtgtgtaatgaag

SEQ ID NO: 9370789 - DNA, 17 bp, Homo sapiens
agagggctcaaggcatc

SEQ ID NO: 9370790 - DNA, 17 bp, Homo sapiens
agagggctcaaggcatc

SEQ ID NO: 9370791 - DNA, 22 bp, Homo sapiens
agagggctaactgggaagcagg

SEQ ID NO: 9370792 - DNA, 22 bp, Homo sapiens
agagggctaaggtttgggagat

SEQ ID NO: 9370793 - DNA, 22 bp, Homo sapiens
agagggctaactgggaagcagg

SEQ ID NO: 9370794 - DNA, 22 bp, Homo sapiens
agagggcccatgttgggctgct

SEQ ID NO: 9370795 - DNA, 22 bp, Homo sapiens
agagggcataaaatagagcacg

SEQ ID NO: 9370796 - DNA, 22 bp, Homo sapiens
agagggcatgcttggtggcctg

SEQ ID NO: 9370797 - DNA, 22 bp, Homo sapiens
agagggcataaaatagagcacg

SEQ ID NO: 9370798 - DNA, 22 bp, Homo sapiens
agagggccataggtgcatagtt

SEQ ID NO: 9370799 - DNA, 22 bp, Homo sapiens
agagggcccatgttgggctgct

SEQ ID NO: 9370800 - DNA, 22 bp, Homo sapiens
agagggcattaactctgtcttg

SEQ ID NO: 9370801 - DNA, 22 bp, Homo sapiens
agaggcttggcctcagttctgt

SEQ ID NO: 9370802 - DNA, 22 bp, Homo sapiens
agagggcataaaatagagcacg

SEQ ID NO: 9370803 - DNA, 22 bp, Homo sapiens
aatttcaagtggcatctttgat

SEQ ID NO: 9370804 - DNA, 22 bp, Homo sapiens
aatttcaaagctcactggcata

SEQ ID NO: 9370805 - DNA, 22 bp, Homo sapiens
aatttcaagtcttgaagaagta

SEQ ID NO: 9370806 - DNA, 22 bp, Homo sapiens
aatttcaaactcttgccctcag

SEQ ID NO: 9370807 - DNA, 22 bp, Homo sapiens
aatttatttcctgccagtacac

SEQ ID NO: 9370808 - DNA, 22 bp, Homo sapiens
aatttatttcctgccagtacac

SEQ ID NO: 9370809 - DNA, 22 bp, Homo sapiens
aatttattcccgtctctgggct

SEQ ID NO: 9370810 - DNA, 22 bp, Homo sapiens
aatttatttcctgccagtacac

SEQ ID NO: 9370811 - DNA, 22 bp, Homo sapiens
aatttatttcctgccagtacac

SEQ ID NO: 9370812 - DNA, 22 bp, Homo sapiens
aatttatttcctgccagtacac

SEQ ID NO: 9370813 - DNA, 22 bp, Homo sapiens
aatttatttcctgccagtacac

SEQ ID NO: 9370814 - DNA, 22 bp, Homo sapiens
aatttattatatcctaggggaa

SEQ ID NO: 9370815 - DNA, 22 bp, Homo sapiens
aatttattatatcctaggggaa

SEQ ID NO: 9370816 - DNA, 22 bp, Homo sapiens
aatttattatatcctaggggaa

SEQ ID NO: 9370817 - DNA, 22 bp, Homo sapiens
aatttattatatcctaggggaa

SEQ ID NO: 9370818 - DNA, 22 bp, Homo sapiens
aatttattcccgtctctgggct

SEQ ID NO: 9370819 - DNA, 22 bp, Homo sapiens
aatttattcccgtctctgggct

SEQ ID NO: 9370820 - DNA, 22 bp, Homo sapiens
aatttattcccgtctctgggct

SEQ ID NO: 9370821 - DNA, 22 bp, Homo sapiens
aatttattcccgtctctgggct

SEQ ID NO: 9370822 - DNA, 22 bp, Homo sapiens
agaggccacaccagcctcccgt

SEQ ID NO: 9370823 - DNA, 22 bp, Homo sapiens
agaggccaatagtaggtggcat

SEQ ID NO: 9370824 - DNA, 22 bp, Homo sapiens
agaggccaatagtaggtggcat

SEQ ID NO: 9370825 - DNA, 22 bp, Homo sapiens
agaggccaatagtaggtggcat

SEQ ID NO: 9370826 - DNA, 22 bp, Homo sapiens
agagcagctgtgacatggacag

SEQ ID NO: 9370827 - DNA, 22 bp, Homo sapiens
agagcagctgtgacatggacag

SEQ ID NO: 9370828 - DNA, 22 bp, Homo sapiens
agagcagctggggcagagacca

SEQ ID NO: 9370829 - DNA, 22 bp, Homo sapiens
agagcagcttttcggaaccact

SEQ ID NO: 9370830 - DNA, 22 bp, Homo sapiens
agagcagctgtgacatggacag

SEQ ID NO: 9370831 - DNA, 22 bp, Homo sapiens
agagcagctgtgacatggacag

SEQ ID NO: 9370832 - DNA, 22 bp, Homo sapiens
agagcagctggggcagagacca

SEQ ID NO: 9370833 - DNA, 22 bp, Homo sapiens
agagcagctggggcagagacca

SEQ ID NO: 9370834 - DNA, 22 bp, Homo sapiens
agagcagctggggcagagacca

SEQ ID NO: 9370835 - DNA, 22 bp, Homo sapiens
agaggcaactgatttctgccag

SEQ ID NO: 9370836 - DNA, 23 bp, Homo sapiens
agaggcaggagtggcttgcccgg

SEQ ID NO: 9370837 - DNA, 22 bp, Homo sapiens
agaggcaacatggggaacagat

SEQ ID NO: 9370838 - DNA, 22 bp, Homo sapiens
agaggcaacatggggaacagat

SEQ ID NO: 9370839 - DNA, 22 bp, Homo sapiens
agagcaggcataaagctttgaa

SEQ ID NO: 9370840 - DNA, 22 bp, Homo sapiens
agagcaggggcaatgtgttgca

SEQ ID NO: 9370841 - DNA, 21 bp, Homo sapiens
agaggcaggcattaagtacac

SEQ ID NO: 9370842 - DNA, 22 bp, Homo sapiens
agaggcatgcacagatgtgctg

SEQ ID NO: 9370843 - DNA, 22 bp, Homo sapiens
agaggcatgcacagatgtgctg

SEQ ID NO: 9370844 - DNA, 22 bp, Homo sapiens
agaggccaaagaatctacaaga

SEQ ID NO: 9370845 - DNA, 23 bp, Homo sapiens
agaggccaacttcttgcccctcc

SEQ ID NO: 9370846 - DNA, 22 bp, Homo sapiens
agaggccaagccagactgtgca

SEQ ID NO: 9370847 - DNA, 22 bp, Homo sapiens
agaggccaagccagactgtgca

SEQ ID NO: 9370848 - DNA, 22 bp, Homo sapiens
agagcagctgcattcagcacct

SEQ ID NO: 9370849 - DNA, 22 bp, Homo sapiens
agagcagctgacagcctgccat

SEQ ID NO: 9370850 - DNA, 22 bp, Homo sapiens
agagcagctgacagcctgccat

SEQ ID NO: 9370851 - DNA, 22 bp, Homo sapiens
agagcagctgacagcctgccat

SEQ ID NO: 9370852 - DNA, 22 bp, Homo sapiens
agagcagctgacagcctgccat

SEQ ID NO: 9370853 - DNA, 22 bp, Homo sapiens
agagcagcgtttgtggaacact

SEQ ID NO: 9370854 - DNA, 22 bp, Homo sapiens
agagcagctcgctacctctcta

SEQ ID NO: 9370855 - DNA, 23 bp, Homo sapiens
agatctgatgttaccaagaattg

SEQ ID NO: 9370856 - DNA, 20 bp, Homo sapiens
agatctgcctgcaccctctc

SEQ ID NO: 9370857 - DNA, 22 bp, Homo sapiens
agatcttatttagctttaatca

SEQ ID NO: 9370858 - DNA, 16 bp, Homo sapiens
agatgggtgggtcact

SEQ ID NO: 9370859 - DNA, 20 bp, Homo sapiens
agatgggttaaagctatggg

SEQ ID NO: 9370860 - DNA, 22 bp, Homo sapiens
agatgtttgtgttatctccatt

SEQ ID NO: 9370861 - DNA, 22 bp, Homo sapiens
agatggtaatcacatttatctg

SEQ ID NO: 9370862 - DNA, 20 bp, Homo sapiens
agattattcctaagatttct

SEQ ID NO: 9370863 - DNA, 22 bp, Homo sapiens
agattatgctggctgctacaag

SEQ ID NO: 9370864 - DNA, 20 bp, Homo sapiens
agattattcctaagatttct

SEQ ID NO: 9370865 - DNA, 22 bp, Homo sapiens
agattatctcctgattttaagg

SEQ ID NO: 9370866 - DNA, 22 bp, Homo sapiens
agattacagaagaataagtaga

SEQ ID NO: 9370867 - DNA, 22 bp, Homo sapiens
agattacagcatgggaatggga

SEQ ID NO: 9370868 - DNA, 22 bp, Homo sapiens
agattacagaagaataagtaga

SEQ ID NO: 9370869 - DNA, 22 bp, Homo sapiens
agatatacagagaattattcac

SEQ ID NO: 9370870 - DNA, 22 bp, Homo sapiens
agatatatttaaggtaataagt

SEQ ID NO: 9370871 - DNA, 22 bp, Homo sapiens
agatatatttaaggtaataagt

SEQ ID NO: 9370872 - DNA, 22 bp, Homo sapiens
agatatatttaaggtaataagt

SEQ ID NO: 9370873 - DNA, 22 bp, Homo sapiens
agatatgtccctgtctaatatt

SEQ ID NO: 9370874 - DNA, 18 bp, Homo sapiens
agatatggagggggtggg

SEQ ID NO: 9370875 - DNA, 22 bp, Homo sapiens
agatatcttacactttgaagtt

SEQ ID NO: 9370876 - DNA, 22 bp, Homo sapiens
agatatctgatgaaaatactct

SEQ ID NO: 9370877 - DNA, 22 bp, Homo sapiens
agatatgtttgtatatatttgt

SEQ ID NO: 9370878 - DNA, 22 bp, Homo sapiens
agatccagttaatagcttcatt

SEQ ID NO: 9370879 - DNA, 22 bp, Homo sapiens
agatccatgtgatttggagttc

SEQ ID NO: 9370880 - DNA, 23 bp, Homo sapiens
agatccatgtgggctggaaactg

SEQ ID NO: 9370881 - DNA, 22 bp, Homo sapiens
agatctgagtggctgcatgtaa

SEQ ID NO: 9370882 - DNA, 22 bp, Homo sapiens
agatctgagtatgatttgcctg

SEQ ID NO: 9370883 - DNA, 21 bp, Homo sapiens
agatcctggggtctggggagg

SEQ ID NO: 9370884 - DNA, 22 bp, Homo sapiens
agatcctgccaatggaagcagg

SEQ ID NO: 9370885 - DNA, 22 bp, Homo sapiens
agagggtaacaagaggcctgga

SEQ ID NO: 9370886 - DNA, 22 bp, Homo sapiens
agagggtaacaagaggcctgga

SEQ ID NO: 9370887 - DNA, 22 bp, Homo sapiens
agaggggttaagtgctagtccg

SEQ ID NO: 9370888 - DNA, 22 bp, Homo sapiens
acaaaaaccgtggattcagcat

SEQ ID NO: 9370889 - DNA, 22 bp, Homo sapiens
acaaaaaccgtggattcagcat

SEQ ID NO: 9370890 - DNA, 22 bp, Homo sapiens
acaaaaaccgtggattcagcat

SEQ ID NO: 9370891 - DNA, 22 bp, Homo sapiens
aattttgttttagtggaggctg

SEQ ID NO: 9370892 - DNA, 22 bp, Homo sapiens
aattttgtttaagtgatctgct

SEQ ID NO: 9370893 - DNA, 22 bp, Homo sapiens
aattttgttcttggaaatcagg

SEQ ID NO: 9370894 - DNA, 22 bp, Homo sapiens
aattttgttcttggaaatcagg

SEQ ID NO: 9370895 - DNA, 22 bp, Homo sapiens
agaggtgggagcctggtcacat

SEQ ID NO: 9370896 - DNA, 23 bp, Homo sapiens
agaggtgtagtgtctcatctact

SEQ ID NO: 9370897 - DNA, 22 bp, Homo sapiens
agaggtgtggccaggactcaag

SEQ ID NO: 9370898 - DNA, 22 bp, Homo sapiens
agaggtgtggccaggactcaag

SEQ ID NO: 9370899 - DNA, 22 bp, Homo sapiens
agaggtggccatgggcgctgga

SEQ ID NO: 9370900 - DNA, 22 bp, Homo sapiens
agaggtggccatgggcgctgga

SEQ ID NO: 9370901 - DNA, 22 bp, Homo sapiens
agaggtgggagcctggtcacat

SEQ ID NO: 9370902 - DNA, 22 bp, Homo sapiens
agaggtggccatgggcgctgga

SEQ ID NO: 9370903 - DNA, 22 bp, Homo sapiens
agaggtggccatgggcgctgga

SEQ ID NO: 9370904 - DNA, 22 bp, Homo sapiens
agaggttgggtctgaggtgaga

SEQ ID NO: 9370905 - DNA, 22 bp, Homo sapiens
agaggttgggtctgaggtgaga

SEQ ID NO: 9370906 - DNA, 22 bp, Homo sapiens
agaggtttcttaggggcttcct

SEQ ID NO: 9370907 - DNA, 22 bp, Homo sapiens
agaggttgttagaatagtggag

SEQ ID NO: 9370908 - DNA, 22 bp, Homo sapiens
agaggttgttagaatagtggag

SEQ ID NO: 9370909 - DNA, 22 bp, Homo sapiens
agagtctgttacttgtccccta

SEQ ID NO: 9370910 - DNA, 22 bp, Homo sapiens
agagtctgtgctttcatcagga

SEQ ID NO: 9370911 - DNA, 22 bp, Homo sapiens
agagtgaaaagctagagcagta

SEQ ID NO: 9370912 - DNA, 22 bp, Homo sapiens
agatataataatttacaagtgt

SEQ ID NO: 9370913 - DNA, 22 bp, Homo sapiens
agatataataatttacaagtgt

SEQ ID NO: 9370914 - DNA, 22 bp, Homo sapiens
agatataataatttacaagtgt

SEQ ID NO: 9370915 - DNA, 22 bp, Homo sapiens
agatatacacccatatcacata

SEQ ID NO: 9370916 - DNA, 22 bp, Homo sapiens
agagtctgggcactgggaatgc

SEQ ID NO: 9370917 - DNA, 22 bp, Homo sapiens
agagtctgtgagtccctgagca

SEQ ID NO: 9370918 - DNA, 19 bp, Homo sapiens
agagtctgtgctcttccta

SEQ ID NO: 9370919 - DNA, 22 bp, Homo sapiens
agagtctggaagcgcttctaaa

SEQ ID NO: 9370920 - DNA, 21 bp, Homo sapiens
agagtctgcatttctgacaag

SEQ ID NO: 9370921 - DNA, 22 bp, Homo sapiens
agagtctgcctttttctcctgc

SEQ ID NO: 9370922 - DNA, 22 bp, Homo sapiens
agagtactgcctcagttatgaa

SEQ ID NO: 9370923 - DNA, 22 bp, Homo sapiens
agcaggagggttttgtagagtc

SEQ ID NO: 9370924 - DNA, 22 bp, Homo sapiens
agcaggagggttttgtagagtc

SEQ ID NO: 9370925 - DNA, 22 bp, Homo sapiens
agcaggagggttttgtagagtc

SEQ ID NO: 9370926 - DNA, 22 bp, Homo sapiens
agcaggcaggctgccagtgaat

SEQ ID NO: 9370927 - DNA, 22 bp, Homo sapiens
agcaggcaggctgccagtgaat

SEQ ID NO: 9370928 - DNA, 19 bp, Homo sapiens
agcaggcaggtggcccagg

SEQ ID NO: 9370929 - DNA, 22 bp, Homo sapiens
agcaggcaggctgccagtgaat

SEQ ID NO: 9370930 - DNA, 22 bp, Homo sapiens
agcaggagggttttgtagagtc

SEQ ID NO: 9370931 - DNA, 22 bp, Homo sapiens
agcaggagtgtcccctggctgt

SEQ ID NO: 9370932 - DNA, 22 bp, Homo sapiens
agcaggagggttttgtagagtc

SEQ ID NO: 9370933 - DNA, 22 bp, Homo sapiens
agcaggaacgagttcatgggga

SEQ ID NO: 9370934 - DNA, 22 bp, Homo sapiens
agcaggaacgagttcatgggga

SEQ ID NO: 9370935 - DNA, 22 bp, Homo sapiens
agcagctgagccccagctgtga

SEQ ID NO: 9370936 - DNA, 22 bp, Homo sapiens
agcagctgagatggtaagattc

SEQ ID NO: 9370937 - DNA, 22 bp, Homo sapiens
agcaggagctgtgggaagatgg

SEQ ID NO: 9370938 - DNA, 22 bp, Homo sapiens
agcaggagctgtgggaagatgg

SEQ ID NO: 9370939 - DNA, 22 bp, Homo sapiens
agcaggaggagagcctggcggt

SEQ ID NO: 9370940 - DNA, 21 bp, Homo sapiens
agcaggaggcagtcacagctc

SEQ ID NO: 9370941 - DNA, 22 bp, Homo sapiens
agcagccatagatagcatgcaa

SEQ ID NO: 9370942 - DNA, 22 bp, Homo sapiens
agcagccagttctctgtggtag

SEQ ID NO: 9370943 - DNA, 22 bp, Homo sapiens
agcagctcctgccatgagtgct

SEQ ID NO: 9370944 - DNA, 22 bp, Homo sapiens
agcagctcctctaggaacggat

SEQ ID NO: 9370945 - DNA, 22 bp, Homo sapiens
agcagcccaaacagactaagac

SEQ ID NO: 9370946 - DNA, 21 bp, Homo sapiens
agcagccatttcacagagact

SEQ ID NO: 9370947 - DNA, 21 bp, Homo sapiens
agcagccatttcacagagact

SEQ ID NO: 9370948 - DNA, 21 bp, Homo sapiens
agcagccatggatggtatgta

SEQ ID NO: 9370949 - DNA, 19 bp, Homo sapiens
agcagccatcgaccatgga

SEQ ID NO: 9370950 - DNA, 22 bp, Homo sapiens
agcagctgaccagtgagtcctg

SEQ ID NO: 9370951 - DNA, 22 bp, Homo sapiens
agcagctgaccagtgagtcctg

SEQ ID NO: 9370952 - DNA, 22 bp, Homo sapiens
agcagctctgtttacctggagg

SEQ ID NO: 9370953 - DNA, 22 bp, Homo sapiens
agcagctctggcactgtagcat

SEQ ID NO: 9370954 - DNA, 22 bp, Homo sapiens
agcagctcgggctacagagggg

SEQ ID NO: 9370955 - DNA, 22 bp, Homo sapiens
agcagctcggccagtcaccagg

SEQ ID NO: 9370956 - DNA, 19 bp, Homo sapiens
agcaggcaggtggcccagg

SEQ ID NO: 9370957 - DNA, 19 bp, Homo sapiens
agcaggcaggtggcccagg

SEQ ID NO: 9370958 - DNA, 22 bp, Homo sapiens
agcaggcagtgtagagccttca

SEQ ID NO: 9370959 - DNA, 21 bp, Homo sapiens
agcaggcagtgggctggattt

SEQ ID NO: 9370960 - DNA, 21 bp, Homo sapiens
agcaggcagtgggctggattt

SEQ ID NO: 9370961 - DNA, 22 bp, Homo sapiens
agcaggcatagagtagcactca

SEQ ID NO: 9370962 - DNA, 22 bp, Homo sapiens
agcaggcagtgtagagccttca

SEQ ID NO: 9370963 - DNA, 22 bp, Homo sapiens
agcaggcatagagtagcactca

SEQ ID NO: 9370964 - DNA, 22 bp, Homo sapiens
agcaggcatagagtagcactca

SEQ ID NO: 9370965 - DNA, 23 bp, Homo sapiens
agcaggcatctgtggcacaaggc

SEQ ID NO: 9370966 - DNA, 23 bp, Homo sapiens
agcaggcatctgtggcacaaggc

SEQ ID NO: 9370967 - DNA, 19 bp, Homo sapiens
agcaggccacagggccagc

SEQ ID NO: 9370968 - DNA, 19 bp, Homo sapiens
agcaggccacagggccagc

SEQ ID NO: 9370969 - DNA, 22 bp, Homo sapiens
agcagggcctctggcactggtc

SEQ ID NO: 9370970 - DNA, 19 bp, Homo sapiens
agcaggccacagggccagc

SEQ ID NO: 9370971 - DNA, 22 bp, Homo sapiens
agcagggcccactaggggagat

SEQ ID NO: 9370972 - DNA, 22 bp, Homo sapiens
agcagggcttgccgcttgtcct

SEQ ID NO: 9370973 - DNA, 22 bp, Homo sapiens
agcagggcttgccgcttgtcct

SEQ ID NO: 9370974 - DNA, 22 bp, Homo sapiens
agcagggcttgccgcttgtcct

SEQ ID NO: 9370975 - DNA, 22 bp, Homo sapiens
agcagggctttggctggctttc

SEQ ID NO: 9370976 - DNA, 22 bp, Homo sapiens
agcagggctttgcagacttggg

SEQ ID NO: 9370977 - DNA, 22 bp, Homo sapiens
agcagggctgtgtaggtaatga

SEQ ID NO: 9370978 - DNA, 22 bp, Homo sapiens
agcagggcttctgtgcctgtgc

SEQ ID NO: 9370979 - DNA, 22 bp, Homo sapiens
agcagggcttctgtgcctgtgc

SEQ ID NO: 9370980 - DNA, 22 bp, Homo sapiens
agcagggcttctgtgcctgtgc

SEQ ID NO: 9370981 - DNA, 22 bp, Homo sapiens
agcagggctgtgtaggtaatga

SEQ ID NO: 9370982 - DNA, 22 bp, Homo sapiens
agcagggctgtgctccttccga

SEQ ID NO: 9370983 - DNA, 22 bp, Homo sapiens
agcagggctgtgtaggtaatga

SEQ ID NO: 9370984 - DNA, 22 bp, Homo sapiens
agcagggcctctggcactggtc

SEQ ID NO: 9370985 - DNA, 22 bp, Homo sapiens
agcaggtgacccaagcaggctg

SEQ ID NO: 9370986 - DNA, 22 bp, Homo sapiens
agcaggtgacagggctgtggtg

SEQ ID NO: 9370987 - DNA, 22 bp, Homo sapiens
agcaggtgaattcctggatgtg

SEQ ID NO: 9370988 - DNA, 22 bp, Homo sapiens
agcaggtgacagggctgtggtg

SEQ ID NO: 9370989 - DNA, 22 bp, Homo sapiens
agcaggtgacagggctgtggtg

SEQ ID NO: 9370990 - DNA, 20 bp, Homo sapiens
agcaggtgacggggcctgct

SEQ ID NO: 9370991 - DNA, 22 bp, Homo sapiens
agcaggtgacccaagcaggctg

SEQ ID NO: 9370992 - DNA, 22 bp, Homo sapiens
agcaggtgacccaagcaggctg

SEQ ID NO: 9370993 - DNA, 22 bp, Homo sapiens
agcaggtcttgctctcaacagg

SEQ ID NO: 9370994 - DNA, 21 bp, Homo sapiens
agcaggtgaacctccagtaca

SEQ ID NO: 9370995 - DNA, 21 bp, Homo sapiens
agcaggtgaacctccagtaca

SEQ ID NO: 9370996 - DNA, 22 bp, Homo sapiens
agcaggtcttgctctcaacagg

SEQ ID NO: 9370997 - DNA, 22 bp, Homo sapiens
agcaggtgaattcctggatgtg

SEQ ID NO: 9370998 - DNA, 22 bp, Homo sapiens
agcaggtgaattcctggatgtg

SEQ ID NO: 9370999 - DNA, 21 bp, Homo sapiens
agcaggtgaacctccagtaca

SEQ ID NO: 9371000 - DNA, 22 bp, Homo sapiens
agcagggctttgtctctgtgaa

SEQ ID NO: 9371001 - DNA, 22 bp, Homo sapiens
agcagggctttgtctctgtgaa

SEQ ID NO: 9371002 - DNA, 22 bp, Homo sapiens
agcagggctttgtctctgtgaa

SEQ ID NO: 9371003 - DNA, 22 bp, Homo sapiens
agcatcagcagactctcagcta

SEQ ID NO: 9371004 - DNA, 22 bp, Homo sapiens
agcaggtgagcacagccaggct

SEQ ID NO: 9371005 - DNA, 22 bp, Homo sapiens
agcaggtgagcacagccaggct

SEQ ID NO: 9371006 - DNA, 22 bp, Homo sapiens
agcaggtgagcacagccaggct

SEQ ID NO: 9371007 - DNA, 20 bp, Homo sapiens
agcaggtgacggggcctgct

SEQ ID NO: 9371008 - DNA, 22 bp, Homo sapiens
agcatccagcatcctatagaaa

SEQ ID NO: 9371009 - DNA, 22 bp, Homo sapiens
agcatccagatgcctgatgtca

SEQ ID NO: 9371010 - DNA, 19 bp, Homo sapiens
agcatccagtcatgggatc

SEQ ID NO: 9371011 - DNA, 22 bp, Homo sapiens
agcatcagcctctgtcctggag

SEQ ID NO: 9371012 - DNA, 22 bp, Homo sapiens
agcatccaacaggagggaaggg

SEQ ID NO: 9371013 - DNA, 22 bp, Homo sapiens
agcatccactcactgggagagg

SEQ ID NO: 9371014 - DNA, 22 bp, Homo sapiens
agcagcagattatggtctacat

SEQ ID NO: 9371015 - DNA, 22 bp, Homo sapiens
agcagcagattcagcaggaatg

SEQ ID NO: 9371016 - DNA, 22 bp, Homo sapiens
agcagcagattatggtctacat

SEQ ID NO: 9371017 - DNA, 22 bp, Homo sapiens
agcagcagattatggtctacat

SEQ ID NO: 9371018 - DNA, 22 bp, Homo sapiens
agcagcagattcagcaggaatg

SEQ ID NO: 9371019 - DNA, 22 bp, Homo sapiens
agcagcagattcagcaggaatg

SEQ ID NO: 9371020 - DNA, 19 bp, Homo sapiens
agcagcagcaccagggatt

SEQ ID NO: 9371021 - DNA, 19 bp, Homo sapiens
agcagcagcaccagggatt

SEQ ID NO: 9371022 - DNA, 21 bp, Homo sapiens
agcagcagcagtggggcttct

SEQ ID NO: 9371023 - DNA, 23 bp, Homo sapiens
agcagcagcaattaagtggatat

SEQ ID NO: 9371024 - DNA, 23 bp, Homo sapiens
agcagcagcaattaagtggatat

SEQ ID NO: 9371025 - DNA, 19 bp, Homo sapiens
agcagcagcaccagggatt

SEQ ID NO: 9371026 - DNA, 19 bp, Homo sapiens
agcagcagcaccagggatt

SEQ ID NO: 9371027 - DNA, 23 bp, Homo sapiens
agcagcagcaattaagtggatat

SEQ ID NO: 9371028 - DNA, 22 bp, Homo sapiens
agcagcagcattgagcgcttgt

SEQ ID NO: 9371029 - DNA, 22 bp, Homo sapiens
agcagcagccgtagccttatta

SEQ ID NO: 9371030 - DNA, 21 bp, Homo sapiens
agcagcagcagtggggcttct

SEQ ID NO: 9371031 - DNA, 22 bp, Homo sapiens
agcagcagcattgagcgcttgt

SEQ ID NO: 9371032 - DNA, 22 bp, Homo sapiens
agcagcagctcagttctcagct

SEQ ID NO: 9371033 - DNA, 22 bp, Homo sapiens
agcagcagctcagttctcagct

SEQ ID NO: 9371034 - DNA, 22 bp, Homo sapiens
agcagcagccgtagccttatta

SEQ ID NO: 9371035 - DNA, 19 bp, Homo sapiens
agcagcagctaccacttgt

SEQ ID NO: 9371036 - DNA, 22 bp, Homo sapiens
acacagaacctcatagcctctc

SEQ ID NO: 9371037 - DNA, 23 bp, Homo sapiens
acacagaagaagacccaaggaag

SEQ ID NO: 9371038 - DNA, 23 bp, Homo sapiens
acacagaagaagacccaaggaag

SEQ ID NO: 9371039 - DNA, 22 bp, Homo sapiens
agcagcagttgctgacgttcta

SEQ ID NO: 9371040 - DNA, 22 bp, Homo sapiens
agcagcatagaagctgggagga

SEQ ID NO: 9371041 - DNA, 22 bp, Homo sapiens
agcagccagtgggagtgataca

SEQ ID NO: 9371042 - DNA, 22 bp, Homo sapiens
agcagccaggaatctgcagagc

SEQ ID NO: 9371043 - DNA, 22 bp, Homo sapiens
agcagccaggaatctgcagagc

SEQ ID NO: 9371044 - DNA, 22 bp, Homo sapiens
agcagccagagtctgaacatta

SEQ ID NO: 9371045 - DNA, 22 bp, Homo sapiens
acacacttttgctaaaaattgt

SEQ ID NO: 9371046 - DNA, 22 bp, Homo sapiens
acacactgtaaggactatcact

SEQ ID NO: 9371047 - DNA, 22 bp, Homo sapiens
acacactggcccccagtactga

SEQ ID NO: 9371048 - DNA, 22 bp, Homo sapiens
acacactgtaaggactatcact

SEQ ID NO: 9371049 - DNA, 22 bp, Homo sapiens
acacactgtaaggactatcact

SEQ ID NO: 9371050 - DNA, 22 bp, Homo sapiens
agcagcagctcattcttcctgt

SEQ ID NO: 9371051 - DNA, 22 bp, Homo sapiens
agcagcagctcattcttcctgt

SEQ ID NO: 9371052 - DNA, 22 bp, Homo sapiens
agcagcagctcagttctcagct

SEQ ID NO: 9371053 - DNA, 22 bp, Homo sapiens
agcagcagctcattcttcctgt

SEQ ID NO: 9371054 - DNA, 22 bp, Homo sapiens
agcactttgtgcatttctgaag

SEQ ID NO: 9371055 - DNA, 22 bp, Homo sapiens
agcactttgagcagatgaagga

SEQ ID NO: 9371056 - DNA, 22 bp, Homo sapiens
agcactttcctggcaaatgtgg

SEQ ID NO: 9371057 - DNA, 22 bp, Homo sapiens
agcactttgggagataaagctg

SEQ ID NO: 9371058 - DNA, 22 bp, Homo sapiens
agcactttagaatttagagttg

SEQ ID NO: 9371059 - DNA, 22 bp, Homo sapiens
agcacttgtagactagaatttt

SEQ ID NO: 9371060 - DNA, 22 bp, Homo sapiens
agcactttattcaggaactcca

SEQ ID NO: 9371061 - DNA, 22 bp, Homo sapiens
agcagaaaattggaaatgacaa

SEQ ID NO: 9371062 - DNA, 22 bp, Homo sapiens
agcagaaaattggaaatgacaa

SEQ ID NO: 9371063 - DNA, 22 bp, Homo sapiens
acacactgctcatgaggagcat

SEQ ID NO: 9371064 - DNA, 21 bp, Homo sapiens
acacactgagttttccactgt

SEQ ID NO: 9371065 - DNA, 22 bp, Homo sapiens
acacactggcaggagctataaa

SEQ ID NO: 9371066 - DNA, 22 bp, Homo sapiens
acacaccatgatttatttaccc

SEQ ID NO: 9371067 - DNA, 19 bp, Homo sapiens
acacaccagtgcctgtgac

SEQ ID NO: 9371068 - DNA, 22 bp, Homo sapiens
acacaccatgatttatttaccc

SEQ ID NO: 9371069 - DNA, 22 bp, Homo sapiens
acacactcaattgcataagcac

SEQ ID NO: 9371070 - DNA, 22 bp, Homo sapiens
acacacgtgctcaacacgctcc

SEQ ID NO: 9371071 - DNA, 22 bp, Homo sapiens
acacacgtatatatacgtatgt

SEQ ID NO: 9371072 - DNA, 22 bp, Homo sapiens
acacacgtgctcaacacgctcc

SEQ ID NO: 9371073 - DNA, 22 bp, Homo sapiens
acacactcaattgcataagcac

SEQ ID NO: 9371074 - DNA, 22 bp, Homo sapiens
acacactgaattttgtggaaac

SEQ ID NO: 9371075 - DNA, 22 bp, Homo sapiens
acacactgagtgccataggacc

SEQ ID NO: 9371076 - DNA, 22 bp, Homo sapiens
agatttctctttccctggctga

SEQ ID NO: 9371077 - DNA, 22 bp, Homo sapiens
agatttctgggcttcaccacct

SEQ ID NO: 9371078 - DNA, 22 bp, Homo sapiens
agatttctgtcaccttctatgc

SEQ ID NO: 9371079 - DNA, 22 bp, Homo sapiens
agatttgagttttctatccttg

SEQ ID NO: 9371080 - DNA, 22 bp, Homo sapiens
agatttctgtggtcatgtaatg

SEQ ID NO: 9371081 - DNA, 22 bp, Homo sapiens
acacacatgcctttcctaagta

SEQ ID NO: 9371082 - DNA, 22 bp, Homo sapiens
acacacagaaggaagccccact

SEQ ID NO: 9371083 - DNA, 22 bp, Homo sapiens
acacacatggtattgttcagaa

SEQ ID NO: 9371084 - DNA, 22 bp, Homo sapiens
acacacatggtattgttcagaa

SEQ ID NO: 9371085 - DNA, 22 bp, Homo sapiens
acacacatggtattgttcagaa

SEQ ID NO: 9371086 - DNA, 22 bp, Homo sapiens
acacacatggtattgttcagaa

SEQ ID NO: 9371087 - DNA, 22 bp, Homo sapiens
acacacatgcctttcctaagta

SEQ ID NO: 9371088 - DNA, 22 bp, Homo sapiens
acacacatggtattgttcagaa

SEQ ID NO: 9371089 - DNA, 22 bp, Homo sapiens
acacacagaaggaagccccact

SEQ ID NO: 9371090 - DNA, 18 bp, Homo sapiens
agattttgagaaatacaa

SEQ ID NO: 9371091 - DNA, 22 bp, Homo sapiens
agattttagtttggggaggtgc

SEQ ID NO: 9371092 - DNA, 22 bp, Homo sapiens
agattttatagataatttccca

SEQ ID NO: 9371093 - DNA, 22 bp, Homo sapiens
agattttagtgtagaggacttg

SEQ ID NO: 9371094 - DNA, 22 bp, Homo sapiens
agatttgttgtgagcaggaata

SEQ ID NO: 9371095 - DNA, 21 bp, Homo sapiens
agatttgtcccttcccattta

SEQ ID NO: 9371096 - DNA, 22 bp, Homo sapiens
agctccaggtagtgccttatcg

SEQ ID NO: 9371097 - DNA, 22 bp, Homo sapiens
agctccaggtcagtgcacccct

SEQ ID NO: 9371098 - DNA, 22 bp, Homo sapiens
agctccaggtcagtgcacccct

SEQ ID NO: 9371099 - DNA, 22 bp, Homo sapiens
agctccaggtcagtgcacccct

SEQ ID NO: 9371100 - DNA, 23 bp, Homo sapiens
agctccagggaacaggcagtagg

SEQ ID NO: 9371101 - DNA, 22 bp, Homo sapiens
agctccagaaaggtacacacag

SEQ ID NO: 9371102 - DNA, 22 bp, Homo sapiens
agctcaggtctcaggaggtgtc

SEQ ID NO: 9371103 - DNA, 22 bp, Homo sapiens
agctcaggtctcaggaggtgtc

SEQ ID NO: 9371104 - DNA, 22 bp, Homo sapiens
agctcaggtctcaggaggtgtc

SEQ ID NO: 9371105 - DNA, 22 bp, Homo sapiens
agctcaggtcattccagggatg

SEQ ID NO: 9371106 - DNA, 22 bp, Homo sapiens
agctcaggtcattccagggatg

SEQ ID NO: 9371107 - DNA, 22 bp, Homo sapiens
agctcagggctccaggaccgct

SEQ ID NO: 9371108 - DNA, 22 bp, Homo sapiens
agctcaggtagactcagcatct

SEQ ID NO: 9371109 - DNA, 22 bp, Homo sapiens
agctcaggtagactcagcatct

SEQ ID NO: 9371110 - DNA, 22 bp, Homo sapiens
agctcaggctctgcagggacta

SEQ ID NO: 9371111 - DNA, 22 bp, Homo sapiens
agctcagggcaaagactcaaat

SEQ ID NO: 9371112 - DNA, 22 bp, Homo sapiens
agctcagggccaggcgcgtttc

SEQ ID NO: 9371113 - DNA, 22 bp, Homo sapiens
agctcagggcaaagactcaaat

SEQ ID NO: 9371114 - DNA, 22 bp, Homo sapiens
agctcagggcaaagactcaaat

SEQ ID NO: 9371115 - DNA, 22 bp, Homo sapiens
agctcagggctccaggaccgct

SEQ ID NO: 9371116 - DNA, 22 bp, Homo sapiens
agctcagggcgatctgtctcgg

SEQ ID NO: 9371117 - DNA, 22 bp, Homo sapiens
agctcagggcgatctgtctcgg

SEQ ID NO: 9371118 - DNA, 22 bp, Homo sapiens
agctcagggcgatctgtctcgg

SEQ ID NO: 9371119 - DNA, 22 bp, Homo sapiens
agctcagggccatcggcccttt

SEQ ID NO: 9371120 - DNA, 22 bp, Homo sapiens
agctcagggccatcggcccttt

SEQ ID NO: 9371121 - DNA, 22 bp, Homo sapiens
agctcaggctctgcagggacta

SEQ ID NO: 9371122 - DNA, 22 bp, Homo sapiens
agctcaggccggagctacaggc

SEQ ID NO: 9371123 - DNA, 22 bp, Homo sapiens
agctcaggccggagctacaggc

SEQ ID NO: 9371124 - DNA, 22 bp, Homo sapiens
agctcaggccggagctacaggc

SEQ ID NO: 9371125 - DNA, 22 bp, Homo sapiens
agcctggcttaatcctcctttt

SEQ ID NO: 9371126 - DNA, 22 bp, Homo sapiens
agcctgtgaaatctctgccact

SEQ ID NO: 9371127 - DNA, 22 bp, Homo sapiens
agcctgtgacattgactatgaa

SEQ ID NO: 9371128 - DNA, 22 bp, Homo sapiens
agcctggctgggaagagcctct

SEQ ID NO: 9371129 - DNA, 22 bp, Homo sapiens
agcctggctaaattctcccatg

SEQ ID NO: 9371130 - DNA, 22 bp, Homo sapiens
agcctggctgggaagagcctct

SEQ ID NO: 9371131 - DNA, 22 bp, Homo sapiens
agcctggctgggaagagcctct

SEQ ID NO: 9371132 - DNA, 22 bp, Homo sapiens
agcctggctgtaacctcatggt

SEQ ID NO: 9371133 - DNA, 21 bp, Homo sapiens
agcctgttggtttactgctca

SEQ ID NO: 9371134 - DNA, 22 bp, Homo sapiens
agccttacataaacagccttat

SEQ ID NO: 9371135 - DNA, 22 bp, Homo sapiens
agcctgttctccctccagacac

SEQ ID NO: 9371136 - DNA, 22 bp, Homo sapiens
agcctgtgtgctttggacaggg

SEQ ID NO: 9371137 - DNA, 22 bp, Homo sapiens
agcctgtgtgctttggacaggg

SEQ ID NO: 9371138 - DNA, 22 bp, Homo sapiens
agcctgtgtgctttggacaggg

SEQ ID NO: 9371139 - DNA, 22 bp, Homo sapiens
agcctgtgtcctcatctgcagc

SEQ ID NO: 9371140 - DNA, 22 bp, Homo sapiens
agcctgtgtcctcatctgcagc

SEQ ID NO: 9371141 - DNA, 22 bp, Homo sapiens
agccctggtttgcagcatttgc

SEQ ID NO: 9371142 - DNA, 22 bp, Homo sapiens
agccctggtagcctgctgccat

SEQ ID NO: 9371143 - DNA, 22 bp, Homo sapiens
agccctggtttgcagcatttgc

SEQ ID NO: 9371144 - DNA, 22 bp, Homo sapiens
agccctggggtgcagaaccatg

SEQ ID NO: 9371145 - DNA, 22 bp, Homo sapiens
agccctgggtcccagtcctggc

SEQ ID NO: 9371146 - DNA, 22 bp, Homo sapiens
agccctgggtcccagtcctggc

SEQ ID NO: 9371147 - DNA, 22 bp, Homo sapiens
agccctgggttagggtgggagc

SEQ ID NO: 9371148 - DNA, 22 bp, Homo sapiens
agcctggcctgggcaggcacat

SEQ ID NO: 9371149 - DNA, 22 bp, Homo sapiens
agcctggcctgggcaggcacat

SEQ ID NO: 9371150 - DNA, 22 bp, Homo sapiens
agcctggcctgggcaggcacat

SEQ ID NO: 9371151 - DNA, 22 bp, Homo sapiens
agcctggccctgctgaactctg

SEQ ID NO: 9371152 - DNA, 21 bp, Homo sapiens
agcctggcccagggggaggct

SEQ ID NO: 9371153 - DNA, 22 bp, Homo sapiens
agcctggccctgctgaactctg

SEQ ID NO: 9371154 - DNA, 22 bp, Homo sapiens
agcctggccaggcctgcccagg

SEQ ID NO: 9371155 - DNA, 22 bp, Homo sapiens
agcctggccaggcctgcccagg

SEQ ID NO: 9371156 - DNA, 22 bp, Homo sapiens
agcctgctgggaagggaggctt

SEQ ID NO: 9371157 - DNA, 22 bp, Homo sapiens
agcccctgtcctctctgatgac

SEQ ID NO: 9371158 - DNA, 22 bp, Homo sapiens
agccctgcacaggtctgtggct

SEQ ID NO: 9371159 - DNA, 22 bp, Homo sapiens
agccctgcacaggtctgtggct

SEQ ID NO: 9371160 - DNA, 22 bp, Homo sapiens
agcccctgtttttccagtcaga

SEQ ID NO: 9371161 - DNA, 22 bp, Homo sapiens
agccctgcaggatgagggaggt

SEQ ID NO: 9371162 - DNA, 22 bp, Homo sapiens
agccctgcataaatcagttggt

SEQ ID NO: 9371163 - DNA, 22 bp, Homo sapiens
agccctgcacagttcgggagga

SEQ ID NO: 9371164 - DNA, 22 bp, Homo sapiens
agccctgcaggaggtgggagag

SEQ ID NO: 9371165 - DNA, 22 bp, Homo sapiens
agccctgccattctctggagct

SEQ ID NO: 9371166 - DNA, 22 bp, Homo sapiens
agccctgcatagaagggaacac

SEQ ID NO: 9371167 - DNA, 22 bp, Homo sapiens
agccctgccctgccatgtggca

SEQ ID NO: 9371168 - DNA, 22 bp, Homo sapiens
agccctgccctgccatgtggca

SEQ ID NO: 9371169 - DNA, 22 bp, Homo sapiens
agccctgcctctccaatgccca

SEQ ID NO: 9371170 - DNA, 16 bp, Homo sapiens
agccctgccgtgtact

SEQ ID NO: 9371171 - DNA, 22 bp, Homo sapiens
agccctggggctggtcttggaa

SEQ ID NO: 9371172 - DNA, 22 bp, Homo sapiens
agccctggggctggtcttggaa

SEQ ID NO: 9371173 - DNA, 22 bp, Homo sapiens
agccctggggctggtgcttacc

SEQ ID NO: 9371174 - DNA, 22 bp, Homo sapiens
agccctgcgtgccaggggactg

SEQ ID NO: 9371175 - DNA, 22 bp, Homo sapiens
agccctggggctggtcttggaa

SEQ ID NO: 9371176 - DNA, 22 bp, Homo sapiens
agccctgcgctcacgttctgca

SEQ ID NO: 9371177 - DNA, 22 bp, Homo sapiens
agccctgcgatcgtgatttctt

SEQ ID NO: 9371178 - DNA, 22 bp, Homo sapiens
agcatctggtgagggcctagtt

SEQ ID NO: 9371179 - DNA, 22 bp, Homo sapiens
agcatcttcaacaggcatttta

SEQ ID NO: 9371180 - DNA, 22 bp, Homo sapiens
agcattcatgatgacaacagga

SEQ ID NO: 9371181 - DNA, 22 bp, Homo sapiens
agcattccacactgaagtctgc

SEQ ID NO: 9371182 - DNA, 22 bp, Homo sapiens
agcattccacactgaagtctgc

SEQ ID NO: 9371183 - DNA, 18 bp, Homo sapiens
agcattcggtagtggtag

SEQ ID NO: 9371184 - DNA, 20 bp, Homo sapiens
agcattctactagacttttc

SEQ ID NO: 9371185 - DNA, 22 bp, Homo sapiens
agcattctgtggtcttctatgg

SEQ ID NO: 9371186 - DNA, 22 bp, Homo sapiens
agcattgaggtgggtttctctt

SEQ ID NO: 9371187 - DNA, 23 bp, Homo sapiens
agcattctctccaacatttaaca

SEQ ID NO: 9371188 - DNA, 22 bp, Homo sapiens
agcattctcagaatgtcatttt

SEQ ID NO: 9371189 - DNA, 22 bp, Homo sapiens
agccaggctcaaggcctgctcc

SEQ ID NO: 9371190 - DNA, 20 bp, Homo sapiens
agccaggctcaagctccccc

SEQ ID NO: 9371191 - DNA, 20 bp, Homo sapiens
agccaggctcaagctccccc

SEQ ID NO: 9371192 - DNA, 22 bp, Homo sapiens
agccaggctactccttgctgac

SEQ ID NO: 9371193 - DNA, 22 bp, Homo sapiens
agccaggctactccttgctgac

SEQ ID NO: 9371194 - DNA, 22 bp, Homo sapiens
agccaggctactccttgctgac

SEQ ID NO: 9371195 - DNA, 22 bp, Homo sapiens
agccaggctactccttgctgac

SEQ ID NO: 9371196 - DNA, 22 bp, Homo sapiens
agccaggctaaatgagccatga

SEQ ID NO: 9371197 - DNA, 22 bp, Homo sapiens
agccaggcgggtctttgctcct

SEQ ID NO: 9371198 - DNA, 22 bp, Homo sapiens
agccaggctaaatgagccatga

SEQ ID NO: 9371199 - DNA, 22 bp, Homo sapiens
agccaggctaaatgagccatga

SEQ ID NO: 9371200 - DNA, 22 bp, Homo sapiens
agcatttaatcctacatagatc

SEQ ID NO: 9371201 - DNA, 22 bp, Homo sapiens
agcatttaatcctacatagatc

SEQ ID NO: 9371202 - DNA, 22 bp, Homo sapiens
agcatttaagggtggatacagg

SEQ ID NO: 9371203 - DNA, 22 bp, Homo sapiens
agcatttaagcttctgcaaagc

SEQ ID NO: 9371204 - DNA, 22 bp, Homo sapiens
agcatttaagggtggatacagg

SEQ ID NO: 9371205 - DNA, 22 bp, Homo sapiens
agcatttaagcttctgcaaagc

SEQ ID NO: 9371206 - DNA, 22 bp, Homo sapiens
agcattgcctgcctattgctaa

SEQ ID NO: 9371207 - DNA, 22 bp, Homo sapiens
agcattgctaaagctaattttt

SEQ ID NO: 9371208 - DNA, 22 bp, Homo sapiens
agccaggcgcagtggcttatgc

SEQ ID NO: 9371209 - DNA, 22 bp, Homo sapiens
agccaggcgcagtggcttatgc

SEQ ID NO: 9371210 - DNA, 22 bp, Homo sapiens
agccaggcggggcaggtttcct

SEQ ID NO: 9371211 - DNA, 22 bp, Homo sapiens
agccaggcggggcaggtttcct

SEQ ID NO: 9371212 - DNA, 22 bp, Homo sapiens
agccaggaatgcatgctctgct

SEQ ID NO: 9371213 - DNA, 22 bp, Homo sapiens
agcatttaattacagtttaatt

SEQ ID NO: 9371214 - DNA, 22 bp, Homo sapiens
agcccaggtccagttcactgca

SEQ ID NO: 9371215 - DNA, 22 bp, Homo sapiens
agcccaggtctcaaagtacagg

SEQ ID NO: 9371216 - DNA, 22 bp, Homo sapiens
agcccaggtccagttcactgca

SEQ ID NO: 9371217 - DNA, 22 bp, Homo sapiens
agcccaggtccagttcactgca

SEQ ID NO: 9371218 - DNA, 22 bp, Homo sapiens
agcccaggtccagttcactgca

SEQ ID NO: 9371219 - DNA, 22 bp, Homo sapiens
agcccagggctaataggaacca

SEQ ID NO: 9371220 - DNA, 22 bp, Homo sapiens
agcccagggctaataggaacca

SEQ ID NO: 9371221 - DNA, 22 bp, Homo sapiens
agcccagggctaataggaacca

SEQ ID NO: 9371222 - DNA, 22 bp, Homo sapiens
agcccagggctaataggaacca

SEQ ID NO: 9371223 - DNA, 22 bp, Homo sapiens
agcccagggagttgattagcat

SEQ ID NO: 9371224 - DNA, 22 bp, Homo sapiens
agcccagggagttgattagcat

SEQ ID NO: 9371225 - DNA, 22 bp, Homo sapiens
agcccagctttcacccctctgg

SEQ ID NO: 9371226 - DNA, 22 bp, Homo sapiens
acagaacatggatttttgaagt

SEQ ID NO: 9371227 - DNA, 18 bp, Homo sapiens
acagaactcaggggcacc

SEQ ID NO: 9371228 - DNA, 22 bp, Homo sapiens
agcccaggtctcaaagtacagg

SEQ ID NO: 9371229 - DNA, 22 bp, Homo sapiens
agcccaggtctcaaagtacagg

SEQ ID NO: 9371230 - DNA, 22 bp, Homo sapiens
agcccaggtctggcccagcctg

SEQ ID NO: 9371231 - DNA, 22 bp, Homo sapiens
agcccaggtggagtgtgtgggg

SEQ ID NO: 9371232 - DNA, 21 bp, Homo sapiens
acagacagggccagtgtcccc

SEQ ID NO: 9371233 - DNA, 22 bp, Homo sapiens
agcccaggtggagtgtgtgggg

SEQ ID NO: 9371234 - DNA, 22 bp, Homo sapiens
agcccaggtgaggggttcgaaa

SEQ ID NO: 9371235 - DNA, 22 bp, Homo sapiens
agcccaggtgaggggttcgaaa

SEQ ID NO: 9371236 - DNA, 22 bp, Homo sapiens
agcccaggtgactcatacaccc

SEQ ID NO: 9371237 - DNA, 22 bp, Homo sapiens
agcccaggtgactcatacaccc

SEQ ID NO: 9371238 - DNA, 22 bp, Homo sapiens
acagacagtaaatagtgtggct

SEQ ID NO: 9371239 - DNA, 21 bp, Homo sapiens
acagacagggccagtgtcccc

SEQ ID NO: 9371240 - DNA, 22 bp, Homo sapiens
acagacagtatggtggggctga

SEQ ID NO: 9371241 - DNA, 22 bp, Homo sapiens
acagacagtaaatagtgtggct

SEQ ID NO: 9371242 - DNA, 22 bp, Homo sapiens
acagacagtaaatagtgtggct

SEQ ID NO: 9371243 - DNA, 21 bp, Homo sapiens
acagacagtccagagaaaaga

SEQ ID NO: 9371244 - DNA, 22 bp, Homo sapiens
acagacagtatggtggggctga

SEQ ID NO: 9371245 - DNA, 22 bp, Homo sapiens
acagacatatttggcccatagc

SEQ ID NO: 9371246 - DNA, 22 bp, Homo sapiens
acagacatcatcaacatcttcc

SEQ ID NO: 9371247 - DNA, 22 bp, Homo sapiens
acagacatcatcaacatcttcc

SEQ ID NO: 9371248 - DNA, 22 bp, Homo sapiens
accacaggggaggaatgatgcc

SEQ ID NO: 9371249 - DNA, 22 bp, Homo sapiens
accaccctcagcagagctgaaa

SEQ ID NO: 9371250 - DNA, 22 bp, Homo sapiens
acattttgcccttatttgctga

SEQ ID NO: 9371251 - DNA, 22 bp, Homo sapiens
acattttgcccttatttgctga

SEQ ID NO: 9371252 - DNA, 22 bp, Homo sapiens
accacaggaggatggctgctgg

SEQ ID NO: 9371253 - DNA, 22 bp, Homo sapiens
accacaggaggatggctgctgg

SEQ ID NO: 9371254 - DNA, 22 bp, Homo sapiens
acattctgtttccccaaagaga

SEQ ID NO: 9371255 - DNA, 22 bp, Homo sapiens
acattctgtgagtcatgtttta

SEQ ID NO: 9371256 - DNA, 22 bp, Homo sapiens
acattctgttgaggctgggtca

SEQ ID NO: 9371257 - DNA, 22 bp, Homo sapiens
acattctgtatcatctgtctca

SEQ ID NO: 9371258 - DNA, 22 bp, Homo sapiens
accagctgagtaggggagggcc

SEQ ID NO: 9371259 - DNA, 22 bp, Homo sapiens
accagctgagttctcggatggt

SEQ ID NO: 9371260 - DNA, 22 bp, Homo sapiens
accagctgagttctcggatggt

SEQ ID NO: 9371261 - DNA, 22 bp, Homo sapiens
aagggcagcttaaattggtagc

SEQ ID NO: 9371262 - DNA, 22 bp, Homo sapiens
aagggcagcttaaattggtagc

SEQ ID NO: 9371263 - DNA, 22 bp, Homo sapiens
aagggcagctgacagatgctta

SEQ ID NO: 9371264 - DNA, 22 bp, Homo sapiens
accagcacttccagaggtcagg

SEQ ID NO: 9371265 - DNA, 22 bp, Homo sapiens
accagcacggattagaatgctt

SEQ ID NO: 9371266 - DNA, 22 bp, Homo sapiens
aagggcagcctgactcacggtc

SEQ ID NO: 9371267 - DNA, 22 bp, Homo sapiens
aagggcagcctgactcacggtc

SEQ ID NO: 9371268 - DNA, 22 bp, Homo sapiens
aagggcagagggaatcccacat

SEQ ID NO: 9371269 - DNA, 17 bp, Homo sapiens
accacctctcaccagca

SEQ ID NO: 9371270 - DNA, 22 bp, Homo sapiens
accactgagtgtccttcagggt

SEQ ID NO: 9371271 - DNA, 22 bp, Homo sapiens
accacctcatcaagctggattg

SEQ ID NO: 9371272 - DNA, 21 bp, Homo sapiens
accaccctgtttatccagagg

SEQ ID NO: 9371273 - DNA, 22 bp, Homo sapiens
accacctcatcaagctggattg

SEQ ID NO: 9371274 - DNA, 22 bp, Homo sapiens
aagggcagctgacagatgctta

SEQ ID NO: 9371275 - DNA, 22 bp, Homo sapiens
aagggcagctgacagatgctta

SEQ ID NO: 9371276 - DNA, 22 bp, Homo sapiens
aagggcagctattatcgtcatc

SEQ ID NO: 9371277 - DNA, 22 bp, Homo sapiens
aagggcagcctgactcacggtc

SEQ ID NO: 9371278 - DNA, 22 bp, Homo sapiens
aagtaaaatgtttcctttatta

SEQ ID NO: 9371279 - DNA, 22 bp, Homo sapiens
aagtaaaatgtttcctttatta

SEQ ID NO: 9371280 - DNA, 22 bp, Homo sapiens
aagtaaaattcaatcttcactg

SEQ ID NO: 9371281 - DNA, 22 bp, Homo sapiens
aagtaaaagcaggtgtgctggg

SEQ ID NO: 9371282 - DNA, 22 bp, Homo sapiens
aagtaaaacacacagtccaccg

SEQ ID NO: 9371283 - DNA, 22 bp, Homo sapiens
aaggtttttttccagtatctct

SEQ ID NO: 9371284 - DNA, 22 bp, Homo sapiens
accaggccaaaatcatatttac

SEQ ID NO: 9371285 - DNA, 22 bp, Homo sapiens
accaggccaaaatcatatttac

SEQ ID NO: 9371286 - DNA, 22 bp, Homo sapiens
accaggcatgatgtggagcaca

SEQ ID NO: 9371287 - DNA, 21 bp, Homo sapiens
accaggccaggaggctggcac

SEQ ID NO: 9371288 - DNA, 22 bp, Homo sapiens
accaggccaacagctaagttaa

SEQ ID NO: 9371289 - DNA, 22 bp, Homo sapiens
accaggccaacagctaagttaa

SEQ ID NO: 9371290 - DNA, 22 bp, Homo sapiens
aaggtgtcactgggacaggaaa

SEQ ID NO: 9371291 - DNA, 21 bp, Homo sapiens
accaggccaggaggctggcac

SEQ ID NO: 9371292 - DNA, 22 bp, Homo sapiens
aaggtgtcactgggacaggaaa

SEQ ID NO: 9371293 - DNA, 22 bp, Homo sapiens
aaggtttaaggtctataaatgt

SEQ ID NO: 9371294 - DNA, 22 bp, Homo sapiens
aaggtgtcactgggacaggaaa

SEQ ID NO: 9371295 - DNA, 22 bp, Homo sapiens
accaggcaaaaccacaggagca

SEQ ID NO: 9371296 - DNA, 22 bp, Homo sapiens
accaggcaaaaccacaggagca

SEQ ID NO: 9371297 - DNA, 17 bp, Homo sapiens
accaggcaacacgccca

SEQ ID NO: 9371298 - DNA, 17 bp, Homo sapiens
accaggcaacacgccca

SEQ ID NO: 9371299 - DNA, 22 bp, Homo sapiens
accaggcactcctgaggtctga

SEQ ID NO: 9371300 - DNA, 22 bp, Homo sapiens
accaggcactcttgtggcagtg

SEQ ID NO: 9371301 - DNA, 22 bp, Homo sapiens
accaggcactcttgtggcagtg

SEQ ID NO: 9371302 - DNA, 22 bp, Homo sapiens
accaggcagtatggtgctgcaa

SEQ ID NO: 9371303 - DNA, 22 bp, Homo sapiens
accaggcagtcaccgtccagga

SEQ ID NO: 9371304 - DNA, 22 bp, Homo sapiens
accaggcatgatgtggagcaca

SEQ ID NO: 9371305 - DNA, 22 bp, Homo sapiens
accaggaaatttggcaacaaag

SEQ ID NO: 9371306 - DNA, 22 bp, Homo sapiens
accagctgttaggcttggtgct

SEQ ID NO: 9371307 - DNA, 22 bp, Homo sapiens
accagctgtgtgacctgaggca

SEQ ID NO: 9371308 - DNA, 22 bp, Homo sapiens
accagctggtcacctgggcact

SEQ ID NO: 9371309 - DNA, 22 bp, Homo sapiens
accagctggtcacctgggcact

SEQ ID NO: 9371310 - DNA, 22 bp, Homo sapiens
accagctggcccatgagcacgt

SEQ ID NO: 9371311 - DNA, 22 bp, Homo sapiens
accagctggtcacctgggcact

SEQ ID NO: 9371312 - DNA, 22 bp, Homo sapiens
accagctggtcagttgaagatt

SEQ ID NO: 9371313 - DNA, 22 bp, Homo sapiens
accagctgtgtcctggctgcag

SEQ ID NO: 9371314 - DNA, 22 bp, Homo sapiens
accagctgtgtcctggctgcag

SEQ ID NO: 9371315 - DNA, 22 bp, Homo sapiens
accagctggtcagttgaagatt

SEQ ID NO: 9371316 - DNA, 22 bp, Homo sapiens
acataataaaaataacagctca

SEQ ID NO: 9371317 - DNA, 22 bp, Homo sapiens
acataagttatggataaaatgt

SEQ ID NO: 9371318 - DNA, 22 bp, Homo sapiens
acataagcttctgaagggatgg

SEQ ID NO: 9371319 - DNA, 22 bp, Homo sapiens
acataacatagttgacattttt

SEQ ID NO: 9371320 - DNA, 22 bp, Homo sapiens
acatacattgcctcattggtaa

SEQ ID NO: 9371321 - DNA, 22 bp, Homo sapiens
acataccatacatggtgagatg

SEQ ID NO: 9371322 - DNA, 22 bp, Homo sapiens
acatactatgaatacatgtgtc

SEQ ID NO: 9371323 - DNA, 18 bp, Homo sapiens
acatacattctgtctgca

SEQ ID NO: 9371324 - DNA, 22 bp, Homo sapiens
acatgggacagagaaagaggcc

SEQ ID NO: 9371325 - DNA, 21 bp, Homo sapiens
acatgggacctgcgaaaggaa

SEQ ID NO: 9371326 - DNA, 22 bp, Homo sapiens
acatgggagagaaataaatgta

SEQ ID NO: 9371327 - DNA, 23 bp, Homo sapiens
acatgggagggacatggaggctg

SEQ ID NO: 9371328 - DNA, 23 bp, Homo sapiens
acatgggagggacatggaggctg

SEQ ID NO: 9371329 - DNA, 22 bp, Homo sapiens
acatgggagagaaataaatgta

SEQ ID NO: 9371330 - DNA, 19 bp, Homo sapiens
acatggctctccagtctgg

SEQ ID NO: 9371331 - DNA, 22 bp, Homo sapiens
acatggctcagtctcatgacag

SEQ ID NO: 9371332 - DNA, 22 bp, Homo sapiens
acatggctcagtctcatgacag

SEQ ID NO: 9371333 - DNA, 23 bp, Homo sapiens
acatgggaaatgcaaagagaagt

SEQ ID NO: 9371334 - DNA, 22 bp, Homo sapiens
acatggctggcaccttaaattt

SEQ ID NO: 9371335 - DNA, 22 bp, Homo sapiens
acatgggatcaatgaggcaggc

SEQ ID NO: 9371336 - DNA, 22 bp, Homo sapiens
acatgggatcaatgaggcaggc

SEQ ID NO: 9371337 - DNA, 17 bp, Homo sapiens
acatgggctgagactcc

SEQ ID NO: 9371338 - DNA, 22 bp, Homo sapiens
acatgggatgacctccgatggt

SEQ ID NO: 9371339 - DNA, 22 bp, Homo sapiens
acatgggatcaatgaggcaggc

SEQ ID NO: 9371340 - DNA, 22 bp, Homo sapiens
acatgggttattgtgaggttaa

SEQ ID NO: 9371341 - DNA, 22 bp, Homo sapiens
acatgcattctctaaaagcaaa

SEQ ID NO: 9371342 - DNA, 22 bp, Homo sapiens
acatgcattaaaaatacttgtg

SEQ ID NO: 9371343 - DNA, 22 bp, Homo sapiens
acatacttatgctaaaaatata

SEQ ID NO: 9371344 - DNA, 22 bp, Homo sapiens
acatacttatgtgtatatgtgt

SEQ ID NO: 9371345 - DNA, 22 bp, Homo sapiens
aaggccaggaaattatccctat

SEQ ID NO: 9371346 - DNA, 22 bp, Homo sapiens
aaggccaggacaccaggggact

SEQ ID NO: 9371347 - DNA, 22 bp, Homo sapiens
aaggccaggacaccaggggact

SEQ ID NO: 9371348 - DNA, 22 bp, Homo sapiens
aaggccaggaaattatccctat

SEQ ID NO: 9371349 - DNA, 22 bp, Homo sapiens
aaggccaggacaccaggggact

SEQ ID NO: 9371350 - DNA, 22 bp, Homo sapiens
aaggccagctggagggatgagg

SEQ ID NO: 9371351 - DNA, 22 bp, Homo sapiens
aaggccagcttgtagggctggt

SEQ ID NO: 9371352 - DNA, 22 bp, Homo sapiens
aaggccagcttgtagggctggt

SEQ ID NO: 9371353 - DNA, 22 bp, Homo sapiens
aaggccagcttgtagggctggt

SEQ ID NO: 9371354 - DNA, 22 bp, Homo sapiens
aaggccagcttgtagggctggt

SEQ ID NO: 9371355 - DNA, 22 bp, Homo sapiens
aaggccagctggagggatgagg

SEQ ID NO: 9371356 - DNA, 22 bp, Homo sapiens
aaggccagctggagggatgagg

SEQ ID NO: 9371357 - DNA, 22 bp, Homo sapiens
aaggccagcgcagaccattgtc

SEQ ID NO: 9371358 - DNA, 22 bp, Homo sapiens
acatgtaaaagataaattaaca

SEQ ID NO: 9371359 - DNA, 22 bp, Homo sapiens
acatggtatttctattataatt

SEQ ID NO: 9371360 - DNA, 22 bp, Homo sapiens
aaggccaggagacttggagtca

SEQ ID NO: 9371361 - DNA, 22 bp, Homo sapiens
aaggccaggagacttggagtca

SEQ ID NO: 9371362 - DNA, 22 bp, Homo sapiens
aaggccaggagacttggagtca

SEQ ID NO: 9371363 - DNA, 22 bp, Homo sapiens
aaggccaggcagggagctgtga

SEQ ID NO: 9371364 - DNA, 22 bp, Homo sapiens
aaggccaggcagggagctgtga

SEQ ID NO: 9371365 - DNA, 22 bp, Homo sapiens
aaggccaggcagggagctgtga

SEQ ID NO: 9371366 - DNA, 22 bp, Homo sapiens
aaggccaggccagatgacagtc

SEQ ID NO: 9371367 - DNA, 22 bp, Homo sapiens
aaggccaggccagatgacagtc

SEQ ID NO: 9371368 - DNA, 22 bp, Homo sapiens
aaggccaggccagatgacagtc

SEQ ID NO: 9371369 - DNA, 22 bp, Homo sapiens
aaggccaggcctagcacggagg

SEQ ID NO: 9371370 - DNA, 22 bp, Homo sapiens
aaggccaggcctagcacggagg

SEQ ID NO: 9371371 - DNA, 22 bp, Homo sapiens
aaggccaggcctagcacggagg

SEQ ID NO: 9371372 - DNA, 22 bp, Homo sapiens
acatgtgttaaaattctcacca

SEQ ID NO: 9371373 - DNA, 22 bp, Homo sapiens
aaggccagggatgccagctcgg

SEQ ID NO: 9371374 - DNA, 22 bp, Homo sapiens
aaggccagggatgccagctcgg

SEQ ID NO: 9371375 - DNA, 22 bp, Homo sapiens
acatgtgttttcctacttatga

SEQ ID NO: 9371376 - DNA, 22 bp, Homo sapiens
acatgtgttaaaattctcacca

SEQ ID NO: 9371377 - DNA, 22 bp, Homo sapiens
aaggccaggcctagcacggagg

SEQ ID NO: 9371378 - DNA, 22 bp, Homo sapiens
aaggccaggcctagcacggagg

SEQ ID NO: 9371379 - DNA, 22 bp, Homo sapiens
acatgtgttaaaattctcacca

SEQ ID NO: 9371380 - DNA, 21 bp, Homo sapiens
acattacagggtgatgtgtct

SEQ ID NO: 9371381 - DNA, 22 bp, Homo sapiens
acattctatttcatcatgtcta

SEQ ID NO: 9371382 - DNA, 22 bp, Homo sapiens
acattcaaaatatttctgatgt

SEQ ID NO: 9371383 - DNA, 22 bp, Homo sapiens
acattctgaaaaacagtgtttt

SEQ ID NO: 9371384 - DNA, 22 bp, Homo sapiens
acattctgggtgatgttcttca

SEQ ID NO: 9371385 - DNA, 22 bp, Homo sapiens
acattctggatgtctgatgaga

SEQ ID NO: 9371386 - DNA, 22 bp, Homo sapiens
acattctgaataggcattttat

SEQ ID NO: 9371387 - DNA, 22 bp, Homo sapiens
acattatagttgctacagagta

SEQ ID NO: 9371388 - DNA, 22 bp, Homo sapiens
acattatagctttgagtttgga

SEQ ID NO: 9371389 - DNA, 21 bp, Homo sapiens
acattataattcatattccac

SEQ ID NO: 9371390 - DNA, 21 bp, Homo sapiens
acattataattcatattccac

SEQ ID NO: 9371391 - DNA, 21 bp, Homo sapiens
acattataattcatattccac

SEQ ID NO: 9371392 - DNA, 22 bp, Homo sapiens
acattagatgactctttctttc

SEQ ID NO: 9371393 - DNA, 22 bp, Homo sapiens
acattagagaagcttggagatg

SEQ ID NO: 9371394 - DNA, 22 bp, Homo sapiens
acattagataactcagaaagga

SEQ ID NO: 9371395 - DNA, 22 bp, Homo sapiens
acattagaacattaatattggg

SEQ ID NO: 9371396 - DNA, 22 bp, Homo sapiens
acagatttgactggtacctggc

SEQ ID NO: 9371397 - DNA, 22 bp, Homo sapiens
acagatttattgaagctgctgc

SEQ ID NO: 9371398 - DNA, 22 bp, Homo sapiens
acagatttggaggcctcacccc

SEQ ID NO: 9371399 - DNA, 22 bp, Homo sapiens
acagatttgatctgagaacaaa

SEQ ID NO: 9371400 - DNA, 22 bp, Homo sapiens
acagatttgatctgagaacaaa

SEQ ID NO: 9371401 - DNA, 22 bp, Homo sapiens
acagatttgatctgagaacaaa

SEQ ID NO: 9371402 - DNA, 22 bp, Homo sapiens
acagatttgactggtacctggc

SEQ ID NO: 9371403 - DNA, 22 bp, Homo sapiens
acagatttggcccagccaatgc

SEQ ID NO: 9371404 - DNA, 22 bp, Homo sapiens
acagatttgttcttttgggcta

SEQ ID NO: 9371405 - DNA, 22 bp, Homo sapiens
acagatttggcccagccaatgc

SEQ ID NO: 9371406 - DNA, 22 bp, Homo sapiens
acagattttaaatgacactccc

SEQ ID NO: 9371407 - DNA, 22 bp, Homo sapiens
acagattttaaatgacactccc

SEQ ID NO: 9371408 - DNA, 22 bp, Homo sapiens
acagattttaaatttgtagttg

SEQ ID NO: 9371409 - DNA, 22 bp, Homo sapiens
acagatgaggaagagtcagcca

SEQ ID NO: 9371410 - DNA, 22 bp, Homo sapiens
acagatgaggaagagtcagcca

SEQ ID NO: 9371411 - DNA, 22 bp, Homo sapiens
acagatgaggaaacagggtcag

SEQ ID NO: 9371412 - DNA, 22 bp, Homo sapiens
acagatttaggactgtagcgat

SEQ ID NO: 9371413 - DNA, 22 bp, Homo sapiens
acagctggagtgttggtgaggt

SEQ ID NO: 9371414 - DNA, 22 bp, Homo sapiens
acagatttttggtaaataattt

SEQ ID NO: 9371415 - DNA, 22 bp, Homo sapiens
acagatttttggtaaataattt

SEQ ID NO: 9371416 - DNA, 22 bp, Homo sapiens
acagctggcaggggggcatgaa

SEQ ID NO: 9371417 - DNA, 22 bp, Homo sapiens
acagcttcttgtttcccaggag

SEQ ID NO: 9371418 - DNA, 22 bp, Homo sapiens
acagctggagtgttggtgaggt

SEQ ID NO: 9371419 - DNA, 22 bp, Homo sapiens
acagattttggtatttgcaatg

SEQ ID NO: 9371420 - DNA, 22 bp, Homo sapiens
acagattttattattcaggtat

SEQ ID NO: 9371421 - DNA, 22 bp, Homo sapiens
acagattttattattcaggtat

SEQ ID NO: 9371422 - DNA, 22 bp, Homo sapiens
acagattttggtatttgcaatg

SEQ ID NO: 9371423 - DNA, 22 bp, Homo sapiens
acagatttttggtaaataattt

SEQ ID NO: 9371424 - DNA, 22 bp, Homo sapiens
acagatttttcagctcctgtgt

SEQ ID NO: 9371425 - DNA, 22 bp, Homo sapiens
acagattttggtatttgcaatg

SEQ ID NO: 9371426 - DNA, 22 bp, Homo sapiens
acagattttggtatttgcaatg

SEQ ID NO: 9371427 - DNA, 22 bp, Homo sapiens
acagattttaaatttgtagttg

SEQ ID NO: 9371428 - DNA, 22 bp, Homo sapiens
acagattttaaatttgtagttg

SEQ ID NO: 9371429 - DNA, 21 bp, Homo sapiens
acagattttatatctctgctg

SEQ ID NO: 9371430 - DNA, 22 bp, Homo sapiens
acagattttattattcaggtat

SEQ ID NO: 9371431 - DNA, 22 bp, Homo sapiens
acagcttttcaattctgctgag

SEQ ID NO: 9371432 - DNA, 22 bp, Homo sapiens
acaggaaagagctaggcatagg

SEQ ID NO: 9371433 - DNA, 22 bp, Homo sapiens
acagcttttatgggaccagcca

SEQ ID NO: 9371434 - DNA, 22 bp, Homo sapiens
acagctttgtgttaatgggaag

SEQ ID NO: 9371435 - DNA, 22 bp, Homo sapiens
acagcttgctgtgccccctgcc

SEQ ID NO: 9371436 - DNA, 22 bp, Homo sapiens
acagcttgggatgctttatttc

SEQ ID NO: 9371437 - DNA, 22 bp, Homo sapiens
acagctttagtgtgggtggtgc

SEQ ID NO: 9371438 - DNA, 22 bp, Homo sapiens
acaggaaattggcatatcagtt

SEQ ID NO: 9371439 - DNA, 22 bp, Homo sapiens
acaggaaattggcatatcagtt

SEQ ID NO: 9371440 - DNA, 22 bp, Homo sapiens
acaggaaattggcatatcagtt

SEQ ID NO: 9371441 - DNA, 22 bp, Homo sapiens
acaggaaagagctaggcatagg

SEQ ID NO: 9371442 - DNA, 21 bp, Homo sapiens
acaggagaccgcctggcagtc

SEQ ID NO: 9371443 - DNA, 21 bp, Homo sapiens
acaggagaccgcctggcagtc

SEQ ID NO: 9371444 - DNA, 21 bp, Homo sapiens
acaggagaccgcctggcagtc

SEQ ID NO: 9371445 - DNA, 21 bp, Homo sapiens
acaggagaccgcctggcagtc

SEQ ID NO: 9371446 - DNA, 21 bp, Homo sapiens
acaggagaccgcctggcagtc

SEQ ID NO: 9371447 - DNA, 21 bp, Homo sapiens
acaggagaccgcctggcagtc

SEQ ID NO: 9371448 - DNA, 21 bp, Homo sapiens
acaggagaccgcctggcagtc

SEQ ID NO: 9371449 - DNA, 21 bp, Homo sapiens
acaggagaccgcctggcagtc

SEQ ID NO: 9371450 - DNA, 22 bp, Homo sapiens
acaggagaccctgctggttctg

SEQ ID NO: 9371451 - DNA, 22 bp, Homo sapiens
acaggagaattatctggaacaa

SEQ ID NO: 9371452 - DNA, 22 bp, Homo sapiens
aagccctggacggcccttcccc

SEQ ID NO: 9371453 - DNA, 22 bp, Homo sapiens
acaggctctggggcaggatggc

SEQ ID NO: 9371454 - DNA, 22 bp, Homo sapiens
acaggccagcctggggtaaggt

SEQ ID NO: 9371455 - DNA, 22 bp, Homo sapiens
acaggccagcctggggtaaggt

SEQ ID NO: 9371456 - DNA, 22 bp, Homo sapiens
acaggccagaggtggggcagcc

SEQ ID NO: 9371457 - DNA, 22 bp, Homo sapiens
acaggcagagagtggcggactc

SEQ ID NO: 9371458 - DNA, 22 bp, Homo sapiens
acaggcagagtcaggttgggtt

SEQ ID NO: 9371459 - DNA, 22 bp, Homo sapiens
acaggcagagaactcagccaga

SEQ ID NO: 9371460 - DNA, 22 bp, Homo sapiens
acaggcagagaactcagccaga

SEQ ID NO: 9371461 - DNA, 22 bp, Homo sapiens
acaggcactttgacatgccatc

SEQ ID NO: 9371462 - DNA, 22 bp, Homo sapiens
acaggcactgtcaagtcatgaa

SEQ ID NO: 9371463 - DNA, 19 bp, Homo sapiens
acaggcagaattgggtgtg

SEQ ID NO: 9371464 - DNA, 19 bp, Homo sapiens
acaggcagaattgggtgtg

SEQ ID NO: 9371465 - DNA, 22 bp, Homo sapiens
acaggcagagaactcagccaga

SEQ ID NO: 9371466 - DNA, 22 bp, Homo sapiens
acaggcagagaactcagccaga

SEQ ID NO: 9371467 - DNA, 22 bp, Homo sapiens
acaggcagagaactcagccaga

SEQ ID NO: 9371468 - DNA, 22 bp, Homo sapiens
acaggcagagaactcagccaga

SEQ ID NO: 9371469 - DNA, 22 bp, Homo sapiens
acaggagctctagggacagcac

SEQ ID NO: 9371470 - DNA, 22 bp, Homo sapiens
acaggaggagcagctgtgtgcc

SEQ ID NO: 9371471 - DNA, 22 bp, Homo sapiens
acaggaggagcagctgtgtgcc

SEQ ID NO: 9371472 - DNA, 22 bp, Homo sapiens
acaggaggagctgtttcaggga

SEQ ID NO: 9371473 - DNA, 22 bp, Homo sapiens
acaggaggagcagctgtgtgcc

SEQ ID NO: 9371474 - DNA, 20 bp, Homo sapiens
acaggagatctgaggaaagg

SEQ ID NO: 9371475 - DNA, 22 bp, Homo sapiens
acaggagcccaggatgggcgga

SEQ ID NO: 9371476 - DNA, 22 bp, Homo sapiens
acaggctgaggatgattgcatc

SEQ ID NO: 9371477 - DNA, 22 bp, Homo sapiens
acaggctgagcgtccatcttca

SEQ ID NO: 9371478 - DNA, 23 bp, Homo sapiens
acaggctcttaatcagtgctcct

SEQ ID NO: 9371479 - DNA, 22 bp, Homo sapiens
acaggctctggggcaggatggc

SEQ ID NO: 9371480 - DNA, 23 bp, Homo sapiens
acaggctcttaatcagtgctcct

SEQ ID NO: 9371481 - DNA, 22 bp, Homo sapiens
acaggctgaaagttaagttctg

SEQ ID NO: 9371482 - DNA, 22 bp, Homo sapiens
acaggctgacttcctgccatgt

SEQ ID NO: 9371483 - DNA, 22 bp, Homo sapiens
acaggctgacttcctgccatgt

SEQ ID NO: 9371484 - DNA, 22 bp, Homo sapiens
acaggcttacaggctgcaagta

SEQ ID NO: 9371485 - DNA, 22 bp, Homo sapiens
acaggctgccacttgcatccaa

SEQ ID NO: 9371486 - DNA, 22 bp, Homo sapiens
acaggctgccacttgcatccaa

SEQ ID NO: 9371487 - DNA, 22 bp, Homo sapiens
acaggctgatagaccataaata

SEQ ID NO: 9371488 - DNA, 22 bp, Homo sapiens
acaggcttagggcttgggcccg

SEQ ID NO: 9371489 - DNA, 22 bp, Homo sapiens
acaggcttcagatgtattaact

SEQ ID NO: 9371490 - DNA, 22 bp, Homo sapiens
acaggcttctcacagaaaaggg

SEQ ID NO: 9371491 - DNA, 18 bp, Homo sapiens
acaggcttaggaaatgtg

SEQ ID NO: 9371492 - DNA, 22 bp, Homo sapiens
acaggcttagggcaggctgacc

SEQ ID NO: 9371493 - DNA, 22 bp, Homo sapiens
acaggcttgcactagggtggca

SEQ ID NO: 9371494 - DNA, 20 bp, Homo sapiens
acaggctttggagtctgaat

SEQ ID NO: 9371495 - DNA, 20 bp, Homo sapiens
acaggctttctgaggctggc

SEQ ID NO: 9371496 - DNA, 22 bp, Homo sapiens
acaggctttatgtagtgactta

SEQ ID NO: 9371497 - DNA, 22 bp, Homo sapiens
acaggcttttttagaatgacat

SEQ ID NO: 9371498 - DNA, 23 bp, Homo sapiens
acagggaaaagtcatcagtgtga

SEQ ID NO: 9371499 - DNA, 22 bp, Homo sapiens
acaggcttttttgctctcgaat

SEQ ID NO: 9371500 - DNA, 22 bp, Homo sapiens
acaggctttggcgaggcccatc

SEQ ID NO: 9371501 - DNA, 23 bp, Homo sapiens
acagggcttatctgtcactcatc

SEQ ID NO: 9371502 - DNA, 23 bp, Homo sapiens
acagggcttatctgtcactcatc

SEQ ID NO: 9371503 - DNA, 23 bp, Homo sapiens
acagggcttatctgtcactcatc

SEQ ID NO: 9371504 - DNA, 22 bp, Homo sapiens
acaggtagaaattcatctatat

SEQ ID NO: 9371505 - DNA, 22 bp, Homo sapiens
acaggtctgtgtgcacagtgct

SEQ ID NO: 9371506 - DNA, 22 bp, Homo sapiens
acaggtctgtgtgcacagtgct

SEQ ID NO: 9371507 - DNA, 22 bp, Homo sapiens
acaggtctggtctgggtgggac

SEQ ID NO: 9371508 - DNA, 22 bp, Homo sapiens
acaggtgaagtattacactaag

SEQ ID NO: 9371509 - DNA, 22 bp, Homo sapiens
acaggtgaggatctgagcctca

SEQ ID NO: 9371510 - DNA, 22 bp, Homo sapiens
acaggtgacttgcattttcaca

SEQ ID NO: 9371511 - DNA, 22 bp, Homo sapiens
acaggtgaggggttctaggctg

SEQ ID NO: 9371512 - DNA, 22 bp, Homo sapiens
acaggtgagggagctttgtgcc

SEQ ID NO: 9371513 - DNA, 22 bp, Homo sapiens
acaggtctgcagtaactgggaa

SEQ ID NO: 9371514 - DNA, 22 bp, Homo sapiens
acaggtctccagagtgagagga

SEQ ID NO: 9371515 - DNA, 22 bp, Homo sapiens
acaggtctactggcaagcagtg

SEQ ID NO: 9371516 - DNA, 22 bp, Homo sapiens
acaggtcagataaaggctggtg

SEQ ID NO: 9371517 - DNA, 22 bp, Homo sapiens
acaggtcaacgagagcaggcaa

SEQ ID NO: 9371518 - DNA, 22 bp, Homo sapiens
acagtctttgcaaagtcctggt

SEQ ID NO: 9371519 - DNA, 22 bp, Homo sapiens
acagtgcaggtctcaacaatta

SEQ ID NO: 9371520 - DNA, 22 bp, Homo sapiens
acagtgctaaacacttcttgaa

SEQ ID NO: 9371521 - DNA, 22 bp, Homo sapiens
acagtgctaaacacttcttgaa

SEQ ID NO: 9371522 - DNA, 22 bp, Homo sapiens
acagtgctaaacacttcttgaa

SEQ ID NO: 9371523 - DNA, 19 bp, Homo sapiens
acagtgcatgggacctggt

SEQ ID NO: 9371524 - DNA, 20 bp, Homo sapiens
acagtgcatggggggacagc

SEQ ID NO: 9371525 - DNA, 22 bp, Homo sapiens
acaggtgatgacatttgaacca

SEQ ID NO: 9371526 - DNA, 22 bp, Homo sapiens
acaggtgtagaaaacagattat

SEQ ID NO: 9371527 - DNA, 22 bp, Homo sapiens
acaggtgattcaggctctggga

SEQ ID NO: 9371528 - DNA, 22 bp, Homo sapiens
acaggtgattcaggctctggga

SEQ ID NO: 9371529 - DNA, 22 bp, Homo sapiens
acaggtgtagaaaacagattat

SEQ ID NO: 9371530 - DNA, 22 bp, Homo sapiens
acaggtgtagcaggagcatcaa

SEQ ID NO: 9371531 - DNA, 22 bp, Homo sapiens
acaggtgtagcaggagcatcaa

SEQ ID NO: 9371532 - DNA, 22 bp, Homo sapiens
acaggtgtagcaggagcatcaa

SEQ ID NO: 9371533 - DNA, 22 bp, Homo sapiens
acaggtgtatgaatatgttcca

SEQ ID NO: 9371534 - DNA, 22 bp, Homo sapiens
acaggtgtatgaatatgttcca

SEQ ID NO: 9371535 - DNA, 22 bp, Homo sapiens
acaggtgtaggtacatttgcat

SEQ ID NO: 9371536 - DNA, 22 bp, Homo sapiens
acaggtgtaggtacatttgcat

SEQ ID NO: 9371537 - DNA, 22 bp, Homo sapiens
acaggtgtaggtacatttgcat

SEQ ID NO: 9371538 - DNA, 22 bp, Homo sapiens
acaggtgtcctcacagggggtg

SEQ ID NO: 9371539 - DNA, 22 bp, Homo sapiens
acaggtgtctaaggcagacagc

SEQ ID NO: 9371540 - DNA, 22 bp, Homo sapiens
acaggtgtccaacatttacctt

SEQ ID NO: 9371541 - DNA, 22 bp, Homo sapiens
acaggtgtccaacatttacctt

SEQ ID NO: 9371542 - DNA, 22 bp, Homo sapiens
acaggtgtctgcaagttactgg

SEQ ID NO: 9371543 - DNA, 22 bp, Homo sapiens
acaggtgtcctcacagggggtg

SEQ ID NO: 9371544 - DNA, 22 bp, Homo sapiens
acaggtgtctaaggcagacagc

SEQ ID NO: 9371545 - DNA, 22 bp, Homo sapiens
acaggtgtgggctgggctctga

SEQ ID NO: 9371546 - DNA, 22 bp, Homo sapiens
acaggtgtgggctgggctctga

SEQ ID NO: 9371547 - DNA, 22 bp, Homo sapiens
acaggtgtgcggaaagctgtga

SEQ ID NO: 9371548 - DNA, 22 bp, Homo sapiens
acagtctttctacattctgtgc

SEQ ID NO: 9371549 - DNA, 22 bp, Homo sapiens
acaggtgtgagaacatgccttg

SEQ ID NO: 9371550 - DNA, 22 bp, Homo sapiens
acaggtgtctgcaagttactgg

SEQ ID NO: 9371551 - DNA, 22 bp, Homo sapiens
acaggtgtgagaacatgccttg

SEQ ID NO: 9371552 - DNA, 22 bp, Homo sapiens
acaggtgtgcggaaagctgtga

SEQ ID NO: 9371553 - DNA, 22 bp, Homo sapiens
acaggtgtgagaacatgccttg

SEQ ID NO: 9371554 - DNA, 22 bp, Homo sapiens
acagtgctgaacgacatggaag

SEQ ID NO: 9371555 - DNA, 22 bp, Homo sapiens
acagtgctggctacaaccctgg

SEQ ID NO: 9371556 - DNA, 20 bp, Homo sapiens
acagtgggtggggagcactg

SEQ ID NO: 9371557 - DNA, 22 bp, Homo sapiens
acagtgctgtctatctcactaa

SEQ ID NO: 9371558 - DNA, 18 bp, Homo sapiens
acagtgctgtcactgctt

SEQ ID NO: 9371559 - DNA, 22 bp, Homo sapiens
acagtgtaatatgggagtcagt

SEQ ID NO: 9371560 - DNA, 22 bp, Homo sapiens
acagtgtagtgtgatgtcaaaa

SEQ ID NO: 9371561 - DNA, 22 bp, Homo sapiens
acagtgtagcatggtagcaatg

SEQ ID NO: 9371562 - DNA, 22 bp, Homo sapiens
acagtgtactaggtacatgttc

SEQ ID NO: 9371563 - DNA, 22 bp, Homo sapiens
acagtgtaattcatggctgaaa

SEQ ID NO: 9371564 - DNA, 22 bp, Homo sapiens
acagtgtatgatatttcacagt

SEQ ID NO: 9371565 - DNA, 22 bp, Homo sapiens
acagtttacagggatttgagct

SEQ ID NO: 9371566 - DNA, 22 bp, Homo sapiens
acagtttacagggatttgagct

SEQ ID NO: 9371567 - DNA, 18 bp, Homo sapiens
aagtaacagaagagcaca

SEQ ID NO: 9371568 - DNA, 18 bp, Homo sapiens
aagtaacagaagagcaca

SEQ ID NO: 9371569 - DNA, 20 bp, Homo sapiens
acctggcttcctcttggcat

SEQ ID NO: 9371570 - DNA, 21 bp, Homo sapiens
aagtaaatcagagaaataacc

SEQ ID NO: 9371571 - DNA, 22 bp, Homo sapiens
aagtaaaccacagagaagccac

SEQ ID NO: 9371572 - DNA, 22 bp, Homo sapiens
acctgggagtatgcagtggtga

SEQ ID NO: 9371573 - DNA, 22 bp, Homo sapiens
acctgggagtcacacctgagaa

SEQ ID NO: 9371574 - DNA, 22 bp, Homo sapiens
acctgggaggcggaggttgcag

SEQ ID NO: 9371575 - DNA, 22 bp, Homo sapiens
acctgggaggcagaggttgcag

SEQ ID NO: 9371576 - DNA, 22 bp, Homo sapiens
acctgggaaagccgtggaaagg

SEQ ID NO: 9371577 - DNA, 22 bp, Homo sapiens
acctgggaaagccgtggaaagg

SEQ ID NO: 9371578 - DNA, 22 bp, Homo sapiens
acctgggaacgctttgtggagg

SEQ ID NO: 9371579 - DNA, 22 bp, Homo sapiens
accttctgaccagttatcttga

SEQ ID NO: 9371580 - DNA, 22 bp, Homo sapiens
accttctgaccagttatcttga

SEQ ID NO: 9371581 - DNA, 22 bp, Homo sapiens
acctgggcattttggatgatta

SEQ ID NO: 9371582 - DNA, 22 bp, Homo sapiens
acctgggtctggtgttgggacg

SEQ ID NO: 9371583 - DNA, 22 bp, Homo sapiens
accttgggcaacctgctcctgc

SEQ ID NO: 9371584 - DNA, 22 bp, Homo sapiens
accttgggcaagttggaaactg

SEQ ID NO: 9371585 - DNA, 23 bp, Homo sapiens
accttggacttcccagcttccag

SEQ ID NO: 9371586 - DNA, 22 bp, Homo sapiens
accttggaactgaagtgttttt

SEQ ID NO: 9371587 - DNA, 22 bp, Homo sapiens
accttgatggggctgttggagt

SEQ ID NO: 9371588 - DNA, 22 bp, Homo sapiens
accttggaaatgcccattgcct

SEQ ID NO: 9371589 - DNA, 22 bp, Homo sapiens
aagtgatttctgcctgcatgtt

SEQ ID NO: 9371590 - DNA, 22 bp, Homo sapiens
aagtgatttgcatgcttaattc

SEQ ID NO: 9371591 - DNA, 22 bp, Homo sapiens
aagtgatttagtcttataaagg

SEQ ID NO: 9371592 - DNA, 22 bp, Homo sapiens
aagtgattctagtcatgattct

SEQ ID NO: 9371593 - DNA, 22 bp, Homo sapiens
aagtgattctccctacgcggga

SEQ ID NO: 9371594 - DNA, 22 bp, Homo sapiens
aagtgattctgatgtgtttctt

SEQ ID NO: 9371595 - DNA, 22 bp, Homo sapiens
aagtgattgttccgttgagtgt

SEQ ID NO: 9371596 - DNA, 22 bp, Homo sapiens
aagtgattgctggttttgccat

SEQ ID NO: 9371597 - DNA, 22 bp, Homo sapiens
aagtgattttcttcttagttat

SEQ ID NO: 9371598 - DNA, 22 bp, Homo sapiens
aagtgattttcctacttgctaa

SEQ ID NO: 9371599 - DNA, 22 bp, Homo sapiens
aagtgatttgtacaaaatgtcg

SEQ ID NO: 9371600 - DNA, 22 bp, Homo sapiens
aagtgatttgtacaaaatgtcg

SEQ ID NO: 9371601 - DNA, 22 bp, Homo sapiens
aagtgattttcccaccatctac

SEQ ID NO: 9371602 - DNA, 18 bp, Homo sapiens
aagtgactggcaggccaa

SEQ ID NO: 9371603 - DNA, 22 bp, Homo sapiens
aagtgatacatctagtctataa

SEQ ID NO: 9371604 - DNA, 22 bp, Homo sapiens
aagtgagtgaaaatgcagaata

SEQ ID NO: 9371605 - DNA, 22 bp, Homo sapiens
aagtgagtcacaagtttgcttt

SEQ ID NO: 9371606 - DNA, 22 bp, Homo sapiens
aagtgatacctaggaaatcaag

SEQ ID NO: 9371607 - DNA, 22 bp, Homo sapiens
aagtgatgctacgactttgaca

SEQ ID NO: 9371608 - DNA, 22 bp, Homo sapiens
aagtgatgctacgactttgaca

SEQ ID NO: 9371609 - DNA, 18 bp, Homo sapiens
aagtgattcctttccctt

SEQ ID NO: 9371610 - DNA, 22 bp, Homo sapiens
aagtgattccttgcagacacac

SEQ ID NO: 9371611 - DNA, 22 bp, Homo sapiens
aagtgattcattgatgatgagg

SEQ ID NO: 9371612 - DNA, 17 bp, Homo sapiens
aagtgattcagccctca

SEQ ID NO: 9371613 - DNA, 22 bp, Homo sapiens
aagtgattaaccatgctctgct

SEQ ID NO: 9371614 - DNA, 22 bp, Homo sapiens
aagtgattaagtaacctaatat

SEQ ID NO: 9371615 - DNA, 22 bp, Homo sapiens
aagtgattaacatggagctttt

SEQ ID NO: 9371616 - DNA, 22 bp, Homo sapiens
aagtgattatttaatgcggttt

SEQ ID NO: 9371617 - DNA, 22 bp, Homo sapiens
aagtgattattgttttcaggtt

SEQ ID NO: 9371618 - DNA, 22 bp, Homo sapiens
aagtgattatgtccaggagaac

SEQ ID NO: 9371619 - DNA, 22 bp, Homo sapiens
aagtctctttgggtactttatt

SEQ ID NO: 9371620 - DNA, 22 bp, Homo sapiens
aagtctcttttcttcctgtatt

SEQ ID NO: 9371621 - DNA, 21 bp, Homo sapiens
acctttaattcaagcatcagg

SEQ ID NO: 9371622 - DNA, 22 bp, Homo sapiens
accttgttgtaggtacaaaaga

SEQ ID NO: 9371623 - DNA, 20 bp, Homo sapiens
accttgggtgagtgacggtc

SEQ ID NO: 9371624 - DNA, 22 bp, Homo sapiens
accttgtcttttatagaacaag

SEQ ID NO: 9371625 - DNA, 22 bp, Homo sapiens
accttgtctgtgcacctgggct

SEQ ID NO: 9371626 - DNA, 22 bp, Homo sapiens
aagtgaatgtttggtagcagtg

SEQ ID NO: 9371627 - DNA, 22 bp, Homo sapiens
aagtgaataccatcaagagctt

SEQ ID NO: 9371628 - DNA, 22 bp, Homo sapiens
aagtggcagttcaggaagcaga

SEQ ID NO: 9371629 - DNA, 22 bp, Homo sapiens
aagtggcagttcaggaagcaga

SEQ ID NO: 9371630 - DNA, 22 bp, Homo sapiens
aagtggcagaatagtggcagga

SEQ ID NO: 9371631 - DNA, 22 bp, Homo sapiens
aagtgggtacatgatgcacttt

SEQ ID NO: 9371632 - DNA, 22 bp, Homo sapiens
aagtgggtaactggcctttgtt

SEQ ID NO: 9371633 - DNA, 22 bp, Homo sapiens
aagtttggtccttctaagaaga

SEQ ID NO: 9371634 - DNA, 22 bp, Homo sapiens
aagtttgtggtcatttattata

SEQ ID NO: 9371635 - DNA, 22 bp, Homo sapiens
aagttttaacaagtacttacta

SEQ ID NO: 9371636 - DNA, 22 bp, Homo sapiens
aagtttgttgtacatgttagta

SEQ ID NO: 9371637 - DNA, 22 bp, Homo sapiens
aagttttactgaggacacatgt

SEQ ID NO: 9371638 - DNA, 22 bp, Homo sapiens
actcagttatcatgtgtccaca

SEQ ID NO: 9371639 - DNA, 22 bp, Homo sapiens
actcagtggcactttggaattt

SEQ ID NO: 9371640 - DNA, 22 bp, Homo sapiens
actcagtgaattttcatcaaat

SEQ ID NO: 9371641 - DNA, 23 bp, Homo sapiens
actcagtgagggccttgggctgc

SEQ ID NO: 9371642 - DNA, 22 bp, Homo sapiens
actcagtacatctggagttggc

SEQ ID NO: 9371643 - DNA, 22 bp, Homo sapiens
actcagagcagagcagcctgag

SEQ ID NO: 9371644 - DNA, 22 bp, Homo sapiens
actcagagatatggtggttgat

SEQ ID NO: 9371645 - DNA, 22 bp, Homo sapiens
actcatgtcctaggagtaaagc

SEQ ID NO: 9371646 - DNA, 22 bp, Homo sapiens
actcatgtaagcggaatgtagt

SEQ ID NO: 9371647 - DNA, 22 bp, Homo sapiens
actcatggtagcacaggctgtg

SEQ ID NO: 9371648 - DNA, 22 bp, Homo sapiens
actcatctttgaattttcagta

SEQ ID NO: 9371649 - DNA, 19 bp, Homo sapiens
actcatctttccagaatat

SEQ ID NO: 9371650 - DNA, 22 bp, Homo sapiens
aagtggaggccgagttcacgca

SEQ ID NO: 9371651 - DNA, 22 bp, Homo sapiens
aagtggagtccctacaaccagc

SEQ ID NO: 9371652 - DNA, 22 bp, Homo sapiens
aagtggagctataggctcagat

SEQ ID NO: 9371653 - DNA, 22 bp, Homo sapiens
aagtggcacgctttttggagtt

SEQ ID NO: 9371654 - DNA, 22 bp, Homo sapiens
aagtggcacgctttttggagtt

SEQ ID NO: 9371655 - DNA, 18 bp, Homo sapiens
aagtggcacaggagtgca

SEQ ID NO: 9371656 - DNA, 20 bp, Homo sapiens
aagtggatccctaagaacag

SEQ ID NO: 9371657 - DNA, 22 bp, Homo sapiens
aataaagcctgtctctttagag

SEQ ID NO: 9371658 - DNA, 22 bp, Homo sapiens
aataaagccttattgattttac

SEQ ID NO: 9371659 - DNA, 22 bp, Homo sapiens
aataaaggcaccataaggcaaa

SEQ ID NO: 9371660 - DNA, 22 bp, Homo sapiens
aataaaggcaccataaggcaaa

SEQ ID NO: 9371661 - DNA, 22 bp, Homo sapiens
aataaagtagcgtttaaggtgc

SEQ ID NO: 9371662 - DNA, 22 bp, Homo sapiens
aataaagacaaacaggggagcc

SEQ ID NO: 9371663 - DNA, 22 bp, Homo sapiens
aataaatgtttgttggatgttt

SEQ ID NO: 9371664 - DNA, 22 bp, Homo sapiens
aataaatgaacaaagcaggttg

SEQ ID NO: 9371665 - DNA, 22 bp, Homo sapiens
aataacagagtcttcaagatag

SEQ ID NO: 9371666 - DNA, 22 bp, Homo sapiens
aataaatgtttgttggatgttt

SEQ ID NO: 9371667 - DNA, 22 bp, Homo sapiens
aataacagaaacttgagcatca

SEQ ID NO: 9371668 - DNA, 22 bp, Homo sapiens
aagttttattggctatagcact

SEQ ID NO: 9371669 - DNA, 22 bp, Homo sapiens
aagttttattggaacatagcca

SEQ ID NO: 9371670 - DNA, 22 bp, Homo sapiens
actgagaaatttccagacttgc

SEQ ID NO: 9371671 - DNA, 22 bp, Homo sapiens
actgagaaatttccagacttgc

SEQ ID NO: 9371672 - DNA, 22 bp, Homo sapiens
actgactcttgttaacttcagc

SEQ ID NO: 9371673 - DNA, 22 bp, Homo sapiens
aataaacttccactgtgttttt

SEQ ID NO: 9371674 - DNA, 22 bp, Homo sapiens
aataaacttccactgtgttttt

SEQ ID NO: 9371675 - DNA, 22 bp, Homo sapiens
aataaaatggtcagttttctca

SEQ ID NO: 9371676 - DNA, 22 bp, Homo sapiens
actgagactgagaatgtttctt

SEQ ID NO: 9371677 - DNA, 20 bp, Homo sapiens
actgagaccaataagtagaa

SEQ ID NO: 9371678 - DNA, 22 bp, Homo sapiens
actgagacaactgtgtttctaa

SEQ ID NO: 9371679 - DNA, 22 bp, Homo sapiens
actgagaagattctcactctta

SEQ ID NO: 9371680 - DNA, 22 bp, Homo sapiens
actgagaacttggggacagagg

SEQ ID NO: 9371681 - DNA, 22 bp, Homo sapiens
actgagaagattctcactctta

SEQ ID NO: 9371682 - DNA, 22 bp, Homo sapiens
actgagaagctcgcagtgatgc

SEQ ID NO: 9371683 - DNA, 22 bp, Homo sapiens
aatatcttctaaggatagaact

SEQ ID NO: 9371684 - DNA, 22 bp, Homo sapiens
aatatcaggatgcaaagctgtg

SEQ ID NO: 9371685 - DNA, 22 bp, Homo sapiens
aatatgaattattgttacaagt

SEQ ID NO: 9371686 - DNA, 22 bp, Homo sapiens
aatatgaattattgttacaagt

SEQ ID NO: 9371687 - DNA, 23 bp, Homo sapiens
acttccagttataggaactcttc

SEQ ID NO: 9371688 - DNA, 22 bp, Homo sapiens
acttagcagagttgaatgtact

SEQ ID NO: 9371689 - DNA, 22 bp, Homo sapiens
actgttgaagtgccagcttgat

SEQ ID NO: 9371690 - DNA, 22 bp, Homo sapiens
actgttggcttctggtagtgac

SEQ ID NO: 9371691 - DNA, 22 bp, Homo sapiens
actgttgaagtgccagcttgat

SEQ ID NO: 9371692 - DNA, 22 bp, Homo sapiens
acttagcaggtactttcatatt

SEQ ID NO: 9371693 - DNA, 22 bp, Homo sapiens
acttagcagtttagaatatgtc

SEQ ID NO: 9371694 - DNA, 22 bp, Homo sapiens
acttagtgccctggcccttaca

SEQ ID NO: 9371695 - DNA, 22 bp, Homo sapiens
acttatactaaagtattatttg

SEQ ID NO: 9371696 - DNA, 22 bp, Homo sapiens
acttatactaaagtattatttg

SEQ ID NO: 9371697 - DNA, 22 bp, Homo sapiens
acttatcgtagggaatttacta

SEQ ID NO: 9371698 - DNA, 22 bp, Homo sapiens
acttatcagttgtctctaatgt

SEQ ID NO: 9371699 - DNA, 22 bp, Homo sapiens
acttatcacacactaaattagg

SEQ ID NO: 9371700 - DNA, 22 bp, Homo sapiens
acttattctgagattatgatca

SEQ ID NO: 9371701 - DNA, 22 bp, Homo sapiens
acttatcttagttcatttgtat

SEQ ID NO: 9371702 - DNA, 22 bp, Homo sapiens
acttatttcatggatcataatg

SEQ ID NO: 9371703 - DNA, 22 bp, Homo sapiens
aataacaggctcatcagatgct

SEQ ID NO: 9371704 - DNA, 22 bp, Homo sapiens
aataacagattttcaagctgtg

SEQ ID NO: 9371705 - DNA, 23 bp, Homo sapiens
actgtctgatatgttttccatca

SEQ ID NO: 9371706 - DNA, 22 bp, Homo sapiens
actgtggccttgtgggttcagg

SEQ ID NO: 9371707 - DNA, 22 bp, Homo sapiens
actgtggccaaagcctctggga

SEQ ID NO: 9371708 - DNA, 22 bp, Homo sapiens
actgtggctcatcaggctggtg

SEQ ID NO: 9371709 - DNA, 22 bp, Homo sapiens
actgtgggacatccctccctat

SEQ ID NO: 9371710 - DNA, 22 bp, Homo sapiens
actgtgggagcgcagtggcagc

SEQ ID NO: 9371711 - DNA, 22 bp, Homo sapiens
actgtggcaaaagaacattgga

SEQ ID NO: 9371712 - DNA, 21 bp, Homo sapiens
actgtggggttcaactggcag

SEQ ID NO: 9371713 - DNA, 22 bp, Homo sapiens
actgtggggtgcgaggcagtga

SEQ ID NO: 9371714 - DNA, 22 bp, Homo sapiens
actgtgggagcttatcatttca

SEQ ID NO: 9371715 - DNA, 23 bp, Homo sapiens
actgtgggcaccacagagagtgt

SEQ ID NO: 9371716 - DNA, 23 bp, Homo sapiens
actgtgggcaccacagagagtgt

SEQ ID NO: 9371717 - DNA, 22 bp, Homo sapiens
actgtgggggagccagtcccat

SEQ ID NO: 9371718 - DNA, 22 bp, Homo sapiens
actgtggggtgaggcccaagaa

SEQ ID NO: 9371719 - DNA, 22 bp, Homo sapiens
actgtggggggctttgctcagt

SEQ ID NO: 9371720 - DNA, 22 bp, Homo sapiens
aatctttcaaatttctttgggt

SEQ ID NO: 9371721 - DNA, 19 bp, Homo sapiens
aatctttccacaatgaggc

SEQ ID NO: 9371722 - DNA, 22 bp, Homo sapiens
aatctttcgtttctcctgtctg

SEQ ID NO: 9371723 - DNA, 21 bp, Homo sapiens
aatctttctaaccctggtggc

SEQ ID NO: 9371724 - DNA, 22 bp, Homo sapiens
aatcttcaacagaatggtagga

SEQ ID NO: 9371725 - DNA, 22 bp, Homo sapiens
aatcttcaaaatgttctgcttg

SEQ ID NO: 9371726 - DNA, 22 bp, Homo sapiens
aatcttaagctgaattctctcc

SEQ ID NO: 9371727 - DNA, 22 bp, Homo sapiens
aatctgtattgttaacaagtaa

SEQ ID NO: 9371728 - DNA, 22 bp, Homo sapiens
aatctgtcgtagtaaaaagcag

SEQ ID NO: 9371729 - DNA, 22 bp, Homo sapiens
aatctgtcccttaactagtcat

SEQ ID NO: 9371730 - DNA, 22 bp, Homo sapiens
aatcttaaagaatattctacca

SEQ ID NO: 9371731 - DNA, 22 bp, Homo sapiens
agaaactattatggtaaacaaa

SEQ ID NO: 9371732 - DNA, 22 bp, Homo sapiens
agaaactgaacacaagagtcgg

SEQ ID NO: 9371733 - DNA, 22 bp, Homo sapiens
agaaacgcctgtgaaattatct

SEQ ID NO: 9371734 - DNA, 22 bp, Homo sapiens
agaaacctgtgtgctgtgatga

SEQ ID NO: 9371735 - DNA, 22 bp, Homo sapiens
agaaacgcctgtgaaattatct

SEQ ID NO: 9371736 - DNA, 22 bp, Homo sapiens
agaaactatcctgagtagcaaa

SEQ ID NO: 9371737 - DNA, 22 bp, Homo sapiens
agaaaattactccagagacaag

SEQ ID NO: 9371738 - DNA, 22 bp, Homo sapiens
agaaaattactccagagacaag

SEQ ID NO: 9371739 - DNA, 22 bp, Homo sapiens
agaaacctccatttattcactc

SEQ ID NO: 9371740 - DNA, 22 bp, Homo sapiens
agaaaccagggcttaccagtgc

SEQ ID NO: 9371741 - DNA, 22 bp, Homo sapiens
agaaaataatttcttggctggt

SEQ ID NO: 9371742 - DNA, 22 bp, Homo sapiens
aatattcatttgcagaagaagt

SEQ ID NO: 9371743 - DNA, 22 bp, Homo sapiens
agaaaatattcattgagaggct

SEQ ID NO: 9371744 - DNA, 22 bp, Homo sapiens
agaaaatattcattgagaggct

SEQ ID NO: 9371745 - DNA, 22 bp, Homo sapiens
agaaaatattcattgagaggct

SEQ ID NO: 9371746 - DNA, 22 bp, Homo sapiens
agaaaatattcattgagaggct

SEQ ID NO: 9371747 - DNA, 22 bp, Homo sapiens
aatattagtttctcaagagaga

SEQ ID NO: 9371748 - DNA, 22 bp, Homo sapiens
aatattaatagaaggggttcta

SEQ ID NO: 9371749 - DNA, 22 bp, Homo sapiens
aatattagtttctcaagagaga

SEQ ID NO: 9371750 - DNA, 22 bp, Homo sapiens
aatatgtttataagatatcttc

SEQ ID NO: 9371751 - DNA, 22 bp, Homo sapiens
aatatgttgagtctatctttat

SEQ ID NO: 9371752 - DNA, 22 bp, Homo sapiens
aatatgttccacttaaagctgg

SEQ ID NO: 9371753 - DNA, 22 bp, Homo sapiens
aatatgttcaaaatagatcact

SEQ ID NO: 9371754 - DNA, 22 bp, Homo sapiens
aatatgtgggtgctaatcaaaa

SEQ ID NO: 9371755 - DNA, 22 bp, Homo sapiens
aatatgttcaaaatagatcact

SEQ ID NO: 9371756 - DNA, 22 bp, Homo sapiens
aatatgttcaaaatagatcact

SEQ ID NO: 9371757 - DNA, 22 bp, Homo sapiens
aatatgatccttaaccttcatg

SEQ ID NO: 9371758 - DNA, 22 bp, Homo sapiens
aatatgcactctgatttagcag

SEQ ID NO: 9371759 - DNA, 22 bp, Homo sapiens
aatatgcagcatgatgaagtaa

SEQ ID NO: 9371760 - DNA, 22 bp, Homo sapiens
aatatgcagcatgatgaagtaa

SEQ ID NO: 9371761 - DNA, 22 bp, Homo sapiens
aatatgcatgtatacatgtgta

SEQ ID NO: 9371762 - DNA, 16 bp, Homo sapiens
gctgggagggagaggt

SEQ ID NO: 9371763 - DNA, 16 bp, Homo sapiens
gctgggagggagaggt

SEQ ID NO: 9371764 - DNA, 22 bp, Homo sapiens
gctgggagtcgcgtctgtggcc

SEQ ID NO: 9371765 - DNA, 16 bp, Homo sapiens
gctgggagggagaggt

SEQ ID NO: 9371766 - DNA, 16 bp, Homo sapiens
gctgggagggagaggt

SEQ ID NO: 9371767 - DNA, 20 bp, Homo sapiens
gctgggggtgtgctgagtga

SEQ ID NO: 9371768 - DNA, 20 bp, Homo sapiens
gctgggggtgtgctgagtga

SEQ ID NO: 9371769 - DNA, 22 bp, Homo sapiens
gctgggagtcgcgtctgtggcc

SEQ ID NO: 9371770 - DNA, 22 bp, Homo sapiens
gctgggagtcgcgtctgtggcc

SEQ ID NO: 9371771 - DNA, 22 bp, Homo sapiens
gctgggagtcgcgtctgtggcc

SEQ ID NO: 9371772 - DNA, 18 bp, Homo sapiens
gctggggttgagctctcc

SEQ ID NO: 9371773 - DNA, 22 bp, Homo sapiens
gctggggtgtggtggataagct

SEQ ID NO: 9371774 - DNA, 22 bp, Homo sapiens
gctggggtgtggtggataagct

SEQ ID NO: 9371775 - DNA, 22 bp, Homo sapiens
gctggggtgtggtggataagct

SEQ ID NO: 9371776 - DNA, 22 bp, Homo sapiens
gctggggtctgtgaggagggct

SEQ ID NO: 9371777 - DNA, 22 bp, Homo sapiens
gctggggtctgtgaggagggct

SEQ ID NO: 9371778 - DNA, 22 bp, Homo sapiens
gctgggtcctatgctggtagag

SEQ ID NO: 9371779 - DNA, 22 bp, Homo sapiens
gctgggtccatggtcctcgggt

SEQ ID NO: 9371780 - DNA, 19 bp, Homo sapiens
gctgggtggggtccacagc

SEQ ID NO: 9371781 - DNA, 22 bp, Homo sapiens
gctgggtgtcacggggctcgtg

SEQ ID NO: 9371782 - DNA, 22 bp, Homo sapiens
gctgggtgtcacggggctcgtg

SEQ ID NO: 9371783 - DNA, 22 bp, Homo sapiens
gctgggtggatcggaggctctg

SEQ ID NO: 9371784 - DNA, 22 bp, Homo sapiens
gctgggtggatcggaggctctg

SEQ ID NO: 9371785 - DNA, 22 bp, Homo sapiens
gctgggtgattcatttccataa

SEQ ID NO: 9371786 - DNA, 22 bp, Homo sapiens
gctgggtggatcggaggctctg

SEQ ID NO: 9371787 - DNA, 19 bp, Homo sapiens
gctgggtgaggtcgttgga

SEQ ID NO: 9371788 - DNA, 19 bp, Homo sapiens
gctgggtgaggtcgttgga

SEQ ID NO: 9371789 - DNA, 22 bp, Homo sapiens
gctgggtgattcatttccataa

SEQ ID NO: 9371790 - DNA, 22 bp, Homo sapiens
gctgggtcctatgctggtagag

SEQ ID NO: 9371791 - DNA, 22 bp, Homo sapiens
gctgggtctctccctggtcctg

SEQ ID NO: 9371792 - DNA, 22 bp, Homo sapiens
gctgggtttccagcaggcagga

SEQ ID NO: 9371793 - DNA, 22 bp, Homo sapiens
gctgggttttcttccgggccta

SEQ ID NO: 9371794 - DNA, 22 bp, Homo sapiens
gctggtagacctcactgcactc

SEQ ID NO: 9371795 - DNA, 22 bp, Homo sapiens
gctgtgagcactgctgggtgga

SEQ ID NO: 9371796 - DNA, 22 bp, Homo sapiens
gctgtgagcactgctgggtgga

SEQ ID NO: 9371797 - DNA, 22 bp, Homo sapiens
gctgtgagaaacagggagtgtc

SEQ ID NO: 9371798 - DNA, 22 bp, Homo sapiens
gctgtgagccgctgctgagcat

SEQ ID NO: 9371799 - DNA, 22 bp, Homo sapiens
gctgtgagccgctgctgagcat

SEQ ID NO: 9371800 - DNA, 22 bp, Homo sapiens
gctgtgagctgcctgtgtcaca

SEQ ID NO: 9371801 - DNA, 22 bp, Homo sapiens
gctgtcttgctcactcttgcag

SEQ ID NO: 9371802 - DNA, 22 bp, Homo sapiens
gctgtcttgggtagaaagaggt

SEQ ID NO: 9371803 - DNA, 22 bp, Homo sapiens
gctgtgagggcttctgaggcat

SEQ ID NO: 9371804 - DNA, 22 bp, Homo sapiens
gctgtgagggtctagtgaggtg

SEQ ID NO: 9371805 - DNA, 22 bp, Homo sapiens
gctgtgagtggaggaggctgag

SEQ ID NO: 9371806 - DNA, 22 bp, Homo sapiens
gctgtgagtgagctgcctaggc

SEQ ID NO: 9371807 - DNA, 22 bp, Homo sapiens
gctgtgcagagcacagggtccc

SEQ ID NO: 9371808 - DNA, 22 bp, Homo sapiens
gctgtgcagtctttggtgtgcc

SEQ ID NO: 9371809 - DNA, 22 bp, Homo sapiens
gctgtgcccagctccagctctg

SEQ ID NO: 9371810 - DNA, 22 bp, Homo sapiens
gctgtgcccatattctgctgac

SEQ ID NO: 9371811 - DNA, 22 bp, Homo sapiens
gctgtgcccagctccagctctg

SEQ ID NO: 9371812 - DNA, 22 bp, Homo sapiens
gctgtgcccagccattctagat

SEQ ID NO: 9371813 - DNA, 20 bp, Homo sapiens
gctgtgccatgaccctcgag

SEQ ID NO: 9371814 - DNA, 22 bp, Homo sapiens
gctgtgcagccaagtgcctctg

SEQ ID NO: 9371815 - DNA, 22 bp, Homo sapiens
gctgtgcagatgtagggagtgg

SEQ ID NO: 9371816 - DNA, 22 bp, Homo sapiens
gctgtgcagccaagtgcctctg

SEQ ID NO: 9371817 - DNA, 21 bp, Homo sapiens
gctgtgcaggattgaaagcag

SEQ ID NO: 9371818 - DNA, 22 bp, Homo sapiens
gctgtgcagccaagtgcctctg

SEQ ID NO: 9371819 - DNA, 22 bp, Homo sapiens
gctgtgcagtagtaggtacagt

SEQ ID NO: 9371820 - DNA, 22 bp, Homo sapiens
gctgtgcagtagtaggtacagt

SEQ ID NO: 9371821 - DNA, 22 bp, Homo sapiens
gcttccatgttgctgctggtca

SEQ ID NO: 9371822 - DNA, 22 bp, Homo sapiens
gcttccatgttgctgctggtca

SEQ ID NO: 9371823 - DNA, 22 bp, Homo sapiens
gcttccatgtatgctcttgaca

SEQ ID NO: 9371824 - DNA, 22 bp, Homo sapiens
gcttccatgtatgctcttgaca

SEQ ID NO: 9371825 - DNA, 22 bp, Homo sapiens
gcttccatttgctaggggattt

SEQ ID NO: 9371826 - DNA, 23 bp, Homo sapiens
gcttccattctagtttgctgtgc

SEQ ID NO: 9371827 - DNA, 22 bp, Homo sapiens
gctgtgcccatattctgctgac

SEQ ID NO: 9371828 - DNA, 22 bp, Homo sapiens
gcttccaagcggtagatagcat

SEQ ID NO: 9371829 - DNA, 21 bp, Homo sapiens
gcttccaagatggcaccttga

SEQ ID NO: 9371830 - DNA, 22 bp, Homo sapiens
gcttccagtaactcttgaaagg

SEQ ID NO: 9371831 - DNA, 22 bp, Homo sapiens
gcttccagtaagttgctgccat

SEQ ID NO: 9371832 - DNA, 22 bp, Homo sapiens
gctggctgcctggttatgcctt

SEQ ID NO: 9371833 - DNA, 22 bp, Homo sapiens
gctggctgccaatttcagagct

SEQ ID NO: 9371834 - DNA, 22 bp, Homo sapiens
gctggctgccaatttcagagct

SEQ ID NO: 9371835 - DNA, 22 bp, Homo sapiens
gctggctgcagattttagaggt

SEQ ID NO: 9371836 - DNA, 18 bp, Homo sapiens
gctggctgcacttctgct

SEQ ID NO: 9371837 - DNA, 22 bp, Homo sapiens
gctggctgcagattttagaggt

SEQ ID NO: 9371838 - DNA, 22 bp, Homo sapiens
gctggctgcacaggggctcact

SEQ ID NO: 9371839 - DNA, 22 bp, Homo sapiens
gctggctgcacaggggctcact

SEQ ID NO: 9371840 - DNA, 22 bp, Homo sapiens
gctggctcttcagtggagatag

SEQ ID NO: 9371841 - DNA, 22 bp, Homo sapiens
gctggctgagttctgtcgtctg

SEQ ID NO: 9371842 - DNA, 22 bp, Homo sapiens
gctggctgcacaggggctcact

SEQ ID NO: 9371843 - DNA, 22 bp, Homo sapiens
gctggctgagttctgtcgtctg

SEQ ID NO: 9371844 - DNA, 22 bp, Homo sapiens
gctggctgagttctgtcgtctg

SEQ ID NO: 9371845 - DNA, 21 bp, Homo sapiens
gctggctctctgacgtgcttt

SEQ ID NO: 9371846 - DNA, 22 bp, Homo sapiens
gctggctcgggaagcaggggat

SEQ ID NO: 9371847 - DNA, 22 bp, Homo sapiens
gctggctcctctgtcctcacgg

SEQ ID NO: 9371848 - DNA, 22 bp, Homo sapiens
gctggctcccattggtccttcc

SEQ ID NO: 9371849 - DNA, 22 bp, Homo sapiens
gctggctcgggaagcaggggat

SEQ ID NO: 9371850 - DNA, 22 bp, Homo sapiens
gctggctcggatttgaacagga

SEQ ID NO: 9371851 - DNA, 22 bp, Homo sapiens
gctggctctgccccacctgttc

SEQ ID NO: 9371852 - DNA, 22 bp, Homo sapiens
gctggctctgtggtagttggca

SEQ ID NO: 9371853 - DNA, 22 bp, Homo sapiens
gctggctctgcacccaggcctc

SEQ ID NO: 9371854 - DNA, 22 bp, Homo sapiens
gctggctctgcacccaggcctc

SEQ ID NO: 9371855 - DNA, 22 bp, Homo sapiens
gctgggaagtggcagagctgga

SEQ ID NO: 9371856 - DNA, 22 bp, Homo sapiens
gctgggaagtggcagagctgga

SEQ ID NO: 9371857 - DNA, 22 bp, Homo sapiens
gctgggacaggcttggccctgt

SEQ ID NO: 9371858 - DNA, 22 bp, Homo sapiens
gctgggagcaaagccatgcata

SEQ ID NO: 9371859 - DNA, 22 bp, Homo sapiens
gctgggaggaatttggggaata

SEQ ID NO: 9371860 - DNA, 22 bp, Homo sapiens
gctgggaggatctctccctgtc

SEQ ID NO: 9371861 - DNA, 22 bp, Homo sapiens
gctgggaggatctctccctgtc

SEQ ID NO: 9371862 - DNA, 22 bp, Homo sapiens
gctgggagacagacttggaacc

SEQ ID NO: 9371863 - DNA, 22 bp, Homo sapiens
gctgggagacagacttggaacc

SEQ ID NO: 9371864 - DNA, 22 bp, Homo sapiens
gctgggagacagacttggaacc

SEQ ID NO: 9371865 - DNA, 22 bp, Homo sapiens
gctgggactgagacagtgacct

SEQ ID NO: 9371866 - DNA, 22 bp, Homo sapiens
gctgggactgagacagtgacct

SEQ ID NO: 9371867 - DNA, 22 bp, Homo sapiens
gctgggactgagacagtgacct

SEQ ID NO: 9371868 - DNA, 22 bp, Homo sapiens
gctgggagaggccctgaagtga

SEQ ID NO: 9371869 - DNA, 22 bp, Homo sapiens
gctgggagaggcagctttcgga

SEQ ID NO: 9371870 - DNA, 22 bp, Homo sapiens
gctgggagaggccctgaagtga

SEQ ID NO: 9371871 - DNA, 22 bp, Homo sapiens
gctgggagaggcagctttcgga

SEQ ID NO: 9371872 - DNA, 22 bp, Homo sapiens
gctggcagaatttcttcttgct

SEQ ID NO: 9371873 - DNA, 22 bp, Homo sapiens
gctggcagaatttcttcttgct

SEQ ID NO: 9371874 - DNA, 19 bp, Homo sapiens
gctggcagaattttgaacc

SEQ ID NO: 9371875 - DNA, 19 bp, Homo sapiens
gctggcagaattttgaacc

SEQ ID NO: 9371876 - DNA, 22 bp, Homo sapiens
gctggcagactgggggcagaac

SEQ ID NO: 9371877 - DNA, 22 bp, Homo sapiens
gctggcagaatttcttcttgct

SEQ ID NO: 9371878 - DNA, 22 bp, Homo sapiens
gctggcagaagagctggttcaa

SEQ ID NO: 9371879 - DNA, 22 bp, Homo sapiens
gctggcagaagagctggttcaa

SEQ ID NO: 9371880 - DNA, 22 bp, Homo sapiens
gctggcagaagagctggttcaa

SEQ ID NO: 9371881 - DNA, 22 bp, Homo sapiens
gctggcagacttcctctggaac

SEQ ID NO: 9371882 - DNA, 22 bp, Homo sapiens
gctggcagacttcctctggaac

SEQ ID NO: 9371883 - DNA, 22 bp, Homo sapiens
gctggcagacttcctctggaac

SEQ ID NO: 9371884 - DNA, 22 bp, Homo sapiens
gctggcagactgggggcagaac

SEQ ID NO: 9371885 - DNA, 22 bp, Homo sapiens
gctggcagactgggggcagaac

SEQ ID NO: 9371886 - DNA, 22 bp, Homo sapiens
gctggcagactgggggcagaac

SEQ ID NO: 9371887 - DNA, 22 bp, Homo sapiens
gctggcagacttcctctggaac

SEQ ID NO: 9371888 - DNA, 22 bp, Homo sapiens
gctggcacctgcaccaagcagg

SEQ ID NO: 9371889 - DNA, 22 bp, Homo sapiens
gctggcacctatttggacctgg

SEQ ID NO: 9371890 - DNA, 22 bp, Homo sapiens
gctggcacctgcaccaagcagg

SEQ ID NO: 9371891 - DNA, 19 bp, Homo sapiens
gctggcacttcaagggagc

SEQ ID NO: 9371892 - DNA, 22 bp, Homo sapiens
gctggcactgggaaggactgag

SEQ ID NO: 9371893 - DNA, 22 bp, Homo sapiens
gctggcactgggaaggactgag

SEQ ID NO: 9371894 - DNA, 22 bp, Homo sapiens
gctggcacctatttggacctgg

SEQ ID NO: 9371895 - DNA, 22 bp, Homo sapiens
gctggcacatggctcagggcct

SEQ ID NO: 9371896 - DNA, 22 bp, Homo sapiens
gctggcacacagtacacgcctt

SEQ ID NO: 9371897 - DNA, 22 bp, Homo sapiens
gctggcacagaataagcaggca

SEQ ID NO: 9371898 - DNA, 22 bp, Homo sapiens
gctggcacatggctcagggcct

SEQ ID NO: 9371899 - DNA, 22 bp, Homo sapiens
gctggcacaggtggatgctggc

SEQ ID NO: 9371900 - DNA, 19 bp, Homo sapiens
gctggatggatcctggagt

SEQ ID NO: 9371901 - DNA, 22 bp, Homo sapiens
gctggcaatggtgtggtctggt

SEQ ID NO: 9371902 - DNA, 22 bp, Homo sapiens
gctggcaagtaggttttggctg

SEQ ID NO: 9371903 - DNA, 22 bp, Homo sapiens
gctggcagagacaagaagacta

SEQ ID NO: 9371904 - DNA, 22 bp, Homo sapiens
gctggcagagacaagaagacta

SEQ ID NO: 9371905 - DNA, 22 bp, Homo sapiens
gctggcagagagctggtgagga

SEQ ID NO: 9371906 - DNA, 22 bp, Homo sapiens
gctggcagctggaagttgggct

SEQ ID NO: 9371907 - DNA, 22 bp, Homo sapiens
gctggcaggagaaacggggtgc

SEQ ID NO: 9371908 - DNA, 22 bp, Homo sapiens
gctggcagctggaagttgggct

SEQ ID NO: 9371909 - DNA, 22 bp, Homo sapiens
gctggcagctggaagttgggct

SEQ ID NO: 9371910 - DNA, 22 bp, Homo sapiens
gctggcaggataacttctaagc

SEQ ID NO: 9371911 - DNA, 22 bp, Homo sapiens
gctggcaggagcctttcccttt

SEQ ID NO: 9371912 - DNA, 22 bp, Homo sapiens
gctggcaggataacttctaagc

SEQ ID NO: 9371913 - DNA, 22 bp, Homo sapiens
gctggcaggatagaagtctaat

SEQ ID NO: 9371914 - DNA, 22 bp, Homo sapiens
gctggcaggatagaagtctaat

SEQ ID NO: 9371915 - DNA, 22 bp, Homo sapiens
gctggcaggagaccatacccta

SEQ ID NO: 9371916 - DNA, 22 bp, Homo sapiens
gctggcaggagaccatacccta

SEQ ID NO: 9371917 - DNA, 22 bp, Homo sapiens
gctggcaggagcctttcccttt

SEQ ID NO: 9371918 - DNA, 22 bp, Homo sapiens
gctggcaggagcctttcccttt

SEQ ID NO: 9371919 - DNA, 22 bp, Homo sapiens
gctggcaggagaccatacccta

SEQ ID NO: 9371920 - DNA, 22 bp, Homo sapiens
gctggcaggagaaacggggtgc

SEQ ID NO: 9371921 - DNA, 22 bp, Homo sapiens
gctggcaggagaaacggggtgc

SEQ ID NO: 9371922 - DNA, 22 bp, Homo sapiens
gctggcagggacagctgcgtgt

SEQ ID NO: 9371923 - DNA, 22 bp, Homo sapiens
gctggcagggacagctgcgtgt

SEQ ID NO: 9371924 - DNA, 22 bp, Homo sapiens
gctggcagggacagctgcgtgt

SEQ ID NO: 9371925 - DNA, 22 bp, Homo sapiens
gctggcagggacagctgcgtgt

SEQ ID NO: 9371926 - DNA, 22 bp, Homo sapiens
gctggctcaagtgtgcttccca

SEQ ID NO: 9371927 - DNA, 22 bp, Homo sapiens
gctggctcaagtgtgcttccca

SEQ ID NO: 9371928 - DNA, 22 bp, Homo sapiens
gctggctcaagtgtgcttccca

SEQ ID NO: 9371929 - DNA, 22 bp, Homo sapiens
gctggcagggacagctgcgtgt

SEQ ID NO: 9371930 - DNA, 21 bp, Homo sapiens
gctggctcaaatgcttgtgtc

SEQ ID NO: 9371931 - DNA, 21 bp, Homo sapiens
gctggctcaaatgcttgtgtc

SEQ ID NO: 9371932 - DNA, 22 bp, Homo sapiens
gctggctcagggggattagcaa

SEQ ID NO: 9371933 - DNA, 22 bp, Homo sapiens
gctggctcagggactagagttt

SEQ ID NO: 9371934 - DNA, 22 bp, Homo sapiens
gctggctcccagaggccccagc

SEQ ID NO: 9371935 - DNA, 22 bp, Homo sapiens
gctggctcccagaggccccagc

SEQ ID NO: 9371936 - DNA, 22 bp, Homo sapiens
gctggctccaaaagcaggggct

SEQ ID NO: 9371937 - DNA, 22 bp, Homo sapiens
gctggctccaaaagcaggggct

SEQ ID NO: 9371938 - DNA, 22 bp, Homo sapiens
gcttccgcgatgtcctaggtgg

SEQ ID NO: 9371939 - DNA, 17 bp, Homo sapiens
gcttcccctgccctctc

SEQ ID NO: 9371940 - DNA, 22 bp, Homo sapiens
gcttcccaggcgcctgaccttt

SEQ ID NO: 9371941 - DNA, 23 bp, Homo sapiens
gcttcccagacaatactgcttcc

SEQ ID NO: 9371942 - DNA, 22 bp, Homo sapiens
gcttcctgagtacaccctcatc

SEQ ID NO: 9371943 - DNA, 18 bp, Homo sapiens
gcttcctgaaagctgccc

SEQ ID NO: 9371944 - DNA, 22 bp, Homo sapiens
gcttcctgagaaacaatctgat

SEQ ID NO: 9371945 - DNA, 18 bp, Homo sapiens
gcttcctgaaagctgccc

SEQ ID NO: 9371946 - DNA, 22 bp, Homo sapiens
ggaaagctttgtacttgaaaac

SEQ ID NO: 9371947 - DNA, 22 bp, Homo sapiens
ggaaagctcagatcttgttgga

SEQ ID NO: 9371948 - DNA, 22 bp, Homo sapiens
ggaaaggctaacagtcatggaa

SEQ ID NO: 9371949 - DNA, 22 bp, Homo sapiens
ggaaaggctaacagtcatggaa

SEQ ID NO: 9371950 - DNA, 22 bp, Homo sapiens
ggaaagggagttttgcttatga

SEQ ID NO: 9371951 - DNA, 22 bp, Homo sapiens
ggaaagggcagaggccttggag

SEQ ID NO: 9371952 - DNA, 22 bp, Homo sapiens
ggaaaggagatgaataggatta

SEQ ID NO: 9371953 - DNA, 22 bp, Homo sapiens
ggaaaggagatattggagagtg

SEQ ID NO: 9371954 - DNA, 22 bp, Homo sapiens
ggaaatccttctaaaaagtcag

SEQ ID NO: 9371955 - DNA, 22 bp, Homo sapiens
ggaaagggcatggccttttcac

SEQ ID NO: 9371956 - DNA, 22 bp, Homo sapiens
ggaaagggcagaggccttggag

SEQ ID NO: 9371957 - DNA, 22 bp, Homo sapiens
ggaaagggcagaggccttggag

SEQ ID NO: 9371958 - DNA, 22 bp, Homo sapiens
ggaaaggggcctggatcttttg

SEQ ID NO: 9371959 - DNA, 22 bp, Homo sapiens
ggaaagggcagaggccttggag

SEQ ID NO: 9371960 - DNA, 17 bp, Homo sapiens
ggaaaggtagagtaatc

SEQ ID NO: 9371961 - DNA, 22 bp, Homo sapiens
ggaaaggggcctggatcttttg

SEQ ID NO: 9371962 - DNA, 22 bp, Homo sapiens
ggaaaggggcctggatcttttg

SEQ ID NO: 9371963 - DNA, 17 bp, Homo sapiens
ggaaaggtagagtaatc

SEQ ID NO: 9371964 - DNA, 22 bp, Homo sapiens
ggaagctgttgtgagtgcagca

SEQ ID NO: 9371965 - DNA, 22 bp, Homo sapiens
ggaagcttaatgcctaatttcc

SEQ ID NO: 9371966 - DNA, 22 bp, Homo sapiens
ggaagctgttgtgagtgcagca

SEQ ID NO: 9371967 - DNA, 22 bp, Homo sapiens
ggaagctgttgtgagtgcagca

SEQ ID NO: 9371968 - DNA, 22 bp, Homo sapiens
ggaagcttaatgcctaatttcc

SEQ ID NO: 9371969 - DNA, 22 bp, Homo sapiens
ggaagcttcatacctttattta

SEQ ID NO: 9371970 - DNA, 21 bp, Homo sapiens
ggaagcttccttggtgatcac

SEQ ID NO: 9371971 - DNA, 22 bp, Homo sapiens
ggaagcttcatacctttattta

SEQ ID NO: 9371972 - DNA, 22 bp, Homo sapiens
ggaagctgttcctgtgtggcca

SEQ ID NO: 9371973 - DNA, 22 bp, Homo sapiens
ggaagctgttatcatctgtatc

SEQ ID NO: 9371974 - DNA, 22 bp, Homo sapiens
ggaagctgttatcatctgtatc

SEQ ID NO: 9371975 - DNA, 22 bp, Homo sapiens
ggaagctgttcctgtgtggcca

SEQ ID NO: 9371976 - DNA, 20 bp, Homo sapiens
ggaagctgtgggtccccagg

SEQ ID NO: 9371977 - DNA, 21 bp, Homo sapiens
ggaagctgtgtccatgctcct

SEQ ID NO: 9371978 - DNA, 22 bp, Homo sapiens
ggaagccagttgcttggtgtgg

SEQ ID NO: 9371979 - DNA, 22 bp, Homo sapiens
ggaagccaggttactgttcaga

SEQ ID NO: 9371980 - DNA, 19 bp, Homo sapiens
ggaagccaggtcagcccac

SEQ ID NO: 9371981 - DNA, 19 bp, Homo sapiens
ggaagccaggtcagcccac

SEQ ID NO: 9371982 - DNA, 22 bp, Homo sapiens
ggaagccatgagggacagttct

SEQ ID NO: 9371983 - DNA, 22 bp, Homo sapiens
ggaagccatgagggacagttct

SEQ ID NO: 9371984 - DNA, 22 bp, Homo sapiens
ggaaggaagtgaccaggatatc

SEQ ID NO: 9371985 - DNA, 21 bp, Homo sapiens
ggacaccagtcacactggatt

SEQ ID NO: 9371986 - DNA, 21 bp, Homo sapiens
ggacaccagtcacactggatt

SEQ ID NO: 9371987 - DNA, 22 bp, Homo sapiens
ggaaggaaattggggcagttgt

SEQ ID NO: 9371988 - DNA, 22 bp, Homo sapiens
ggaagctttctctgtttcctta

SEQ ID NO: 9371989 - DNA, 20 bp, Homo sapiens
ggaagccagcatccttgagg

SEQ ID NO: 9371990 - DNA, 22 bp, Homo sapiens
ggaagccaggccaatgagaaca

SEQ ID NO: 9371991 - DNA, 22 bp, Homo sapiens
ggaagccaggccaatgagaaca

SEQ ID NO: 9371992 - DNA, 22 bp, Homo sapiens
ggaagccaggccaatgagaaca

SEQ ID NO: 9371993 - DNA, 20 bp, Homo sapiens
ggaagccagggtgcagggga

SEQ ID NO: 9371994 - DNA, 22 bp, Homo sapiens
ggaagccaggctgggggatctg

SEQ ID NO: 9371995 - DNA, 22 bp, Homo sapiens
ggaagccaggctgggggatctg

SEQ ID NO: 9371996 - DNA, 22 bp, Homo sapiens
ggaagccaggcccagagatgct

SEQ ID NO: 9371997 - DNA, 22 bp, Homo sapiens
ggaagcaggaggctggggtaaa

SEQ ID NO: 9371998 - DNA, 21 bp, Homo sapiens
ggaagcagtggcggcaactcc

SEQ ID NO: 9371999 - DNA, 22 bp, Homo sapiens
ggaagccagagtgctgggcagg

SEQ ID NO: 9372000 - DNA, 22 bp, Homo sapiens
ggaagccacccagctttgatag

SEQ ID NO: 9372001 - DNA, 22 bp, Homo sapiens
ggaagccagaaagtgagaatat

SEQ ID NO: 9372002 - DNA, 22 bp, Homo sapiens
ggaagccacccagctttgatag

SEQ ID NO: 9372003 - DNA, 22 bp, Homo sapiens
ggaagccagaaagtgagaatat

SEQ ID NO: 9372004 - DNA, 22 bp, Homo sapiens
ggaagccaaggtggcctctatt

SEQ ID NO: 9372005 - DNA, 21 bp, Homo sapiens
ggaacattgttaatagtctct

SEQ ID NO: 9372006 - DNA, 22 bp, Homo sapiens
ggaacattggcattttaaggct

SEQ ID NO: 9372007 - DNA, 22 bp, Homo sapiens
ggaacattctagagtgttgtga

SEQ ID NO: 9372008 - DNA, 20 bp, Homo sapiens
ggaacatgaatgtgagtggc

SEQ ID NO: 9372009 - DNA, 22 bp, Homo sapiens
ggaacagggatttggcctggtt

SEQ ID NO: 9372010 - DNA, 22 bp, Homo sapiens
ggaacagttgcgtcatgggcct

SEQ ID NO: 9372011 - DNA, 22 bp, Homo sapiens
ggaacagttgagatgatgtacc

SEQ ID NO: 9372012 - DNA, 22 bp, Homo sapiens
ggaacagggatttggcctggtt

SEQ ID NO: 9372013 - DNA, 22 bp, Homo sapiens
ggaacagggatttggcctggtt

SEQ ID NO: 9372014 - DNA, 22 bp, Homo sapiens
ggaacattttttaaggcagaaa

SEQ ID NO: 9372015 - DNA, 22 bp, Homo sapiens
ggaacatttaaattcttatttg

SEQ ID NO: 9372016 - DNA, 21 bp, Homo sapiens
ggaacattgttaatagtctct

SEQ ID NO: 9372017 - DNA, 22 bp, Homo sapiens
ggaacatttcctggcagagagg

SEQ ID NO: 9372018 - DNA, 15 bp, Homo sapiens
ggaacatttctgttt

SEQ ID NO: 9372019 - DNA, 22 bp, Homo sapiens
ggacctggaagtttggtgatcc

SEQ ID NO: 9372020 - DNA, 22 bp, Homo sapiens
ggacctgctctcccagttctct

SEQ ID NO: 9372021 - DNA, 21 bp, Homo sapiens
ggactctacacaggccatctt

SEQ ID NO: 9372022 - DNA, 22 bp, Homo sapiens
ggactctggctcagtgttgctt

SEQ ID NO: 9372023 - DNA, 22 bp, Homo sapiens
ggactctgtagaggttctcatt

SEQ ID NO: 9372024 - DNA, 22 bp, Homo sapiens
ggactctggctcagtgttgctt

SEQ ID NO: 9372025 - DNA, 22 bp, Homo sapiens
ggactcagcagccaggagtggc

SEQ ID NO: 9372026 - DNA, 22 bp, Homo sapiens
ggacggggagctggaaagggga

SEQ ID NO: 9372027 - DNA, 22 bp, Homo sapiens
ggacggggagctggaaagggga

SEQ ID NO: 9372028 - DNA, 20 bp, Homo sapiens
ggactacaatttgcagtgtg

SEQ ID NO: 9372029 - DNA, 22 bp, Homo sapiens
ggagagagatgccgccttgctc

SEQ ID NO: 9372030 - DNA, 22 bp, Homo sapiens
ggagagagatgccgccttgctc

SEQ ID NO: 9372031 - DNA, 22 bp, Homo sapiens
ggagagagagctcattagctgc

SEQ ID NO: 9372032 - DNA, 22 bp, Homo sapiens
ggagagctggtagctggctcca

SEQ ID NO: 9372033 - DNA, 22 bp, Homo sapiens
ggagagaggagcccactgctgt

SEQ ID NO: 9372034 - DNA, 22 bp, Homo sapiens
ggactgaggacatgtgaggcat

SEQ ID NO: 9372035 - DNA, 22 bp, Homo sapiens
ggactgaggacatgtgaggcat

SEQ ID NO: 9372036 - DNA, 19 bp, Homo sapiens
ggagaggctggagggatgc

SEQ ID NO: 9372037 - DNA, 19 bp, Homo sapiens
ggagaggctggagggatgc

SEQ ID NO: 9372038 - DNA, 19 bp, Homo sapiens
ggagaggctggagggatgc

SEQ ID NO: 9372039 - DNA, 19 bp, Homo sapiens
ggagaggctggagggatgc

SEQ ID NO: 9372040 - DNA, 19 bp, Homo sapiens
ggagaggctggagggatgc

SEQ ID NO: 9372041 - DNA, 22 bp, Homo sapiens
ggagaggcttccagagtcgtgc

SEQ ID NO: 9372042 - DNA, 22 bp, Homo sapiens
ggagaggcttccagagtcgtgc

SEQ ID NO: 9372043 - DNA, 22 bp, Homo sapiens
ggagaggcttccagagtcgtgc

SEQ ID NO: 9372044 - DNA, 22 bp, Homo sapiens
ggagaggcgatgagtcacagcc

SEQ ID NO: 9372045 - DNA, 22 bp, Homo sapiens
ggagaggcgatgagtcacagcc

SEQ ID NO: 9372046 - DNA, 22 bp, Homo sapiens
ggagaggcgatgagtcacagcc

SEQ ID NO: 9372047 - DNA, 22 bp, Homo sapiens
ggagaggagctattgggggctc

SEQ ID NO: 9372048 - DNA, 22 bp, Homo sapiens
ggagaggatgttttagtaactt

SEQ ID NO: 9372049 - DNA, 22 bp, Homo sapiens
ggagaggaaatgccagcacttc

SEQ ID NO: 9372050 - DNA, 22 bp, Homo sapiens
ggagaggaaatgccagcacttc

SEQ ID NO: 9372051 - DNA, 22 bp, Homo sapiens
ggagaggaaatgccagcacttc

SEQ ID NO: 9372052 - DNA, 22 bp, Homo sapiens
ggagaggaaatgccagcacttc

SEQ ID NO: 9372053 - DNA, 22 bp, Homo sapiens
ggagaggaaatgccagcacttc

SEQ ID NO: 9372054 - DNA, 22 bp, Homo sapiens
ggagagcttggagtgcgatttt

SEQ ID NO: 9372055 - DNA, 22 bp, Homo sapiens
ggagaggaaatgccagcacttc

SEQ ID NO: 9372056 - DNA, 22 bp, Homo sapiens
ggagaggaaatgccagcacttc

SEQ ID NO: 9372057 - DNA, 22 bp, Homo sapiens
ggagaggaaatgccagcacttc

SEQ ID NO: 9372058 - DNA, 22 bp, Homo sapiens
ggagaggacatggctcccacag

SEQ ID NO: 9372059 - DNA, 22 bp, Homo sapiens
ggagaggacatggctcccacag

SEQ ID NO: 9372060 - DNA, 22 bp, Homo sapiens
ggagaggagattgtggcatttt

SEQ ID NO: 9372061 - DNA, 22 bp, Homo sapiens
ggagaggagattgtggcatttt

SEQ ID NO: 9372062 - DNA, 22 bp, Homo sapiens
ggagaggagattgtggcatttt

SEQ ID NO: 9372063 - DNA, 22 bp, Homo sapiens
ggacagagccctggtggcctaa

SEQ ID NO: 9372064 - DNA, 22 bp, Homo sapiens
ggacagagccctggtggcctaa

SEQ ID NO: 9372065 - DNA, 22 bp, Homo sapiens
ggacagagccctggtggcctaa

SEQ ID NO: 9372066 - DNA, 22 bp, Homo sapiens
ggacagactttacagccccggg

SEQ ID NO: 9372067 - DNA, 22 bp, Homo sapiens
ggacagacaaaaatagtaagca

SEQ ID NO: 9372068 - DNA, 22 bp, Homo sapiens
ggacagacagtgtgagtgaggc

SEQ ID NO: 9372069 - DNA, 19 bp, Homo sapiens
ggacagacgcagagatctg

SEQ ID NO: 9372070 - DNA, 22 bp, Homo sapiens
ggacagagcagacgagcagcgg

SEQ ID NO: 9372071 - DNA, 22 bp, Homo sapiens
ggacagaaaccatatgagtgta

SEQ ID NO: 9372072 - DNA, 22 bp, Homo sapiens
ggacactgttcatggggagggg

SEQ ID NO: 9372073 - DNA, 22 bp, Homo sapiens
ggacactgttcatggggagggg

SEQ ID NO: 9372074 - DNA, 21 bp, Homo sapiens
ggacactgataatcttgttgc

SEQ ID NO: 9372075 - DNA, 17 bp, Homo sapiens
ggacacctggagtctcc

SEQ ID NO: 9372076 - DNA, 18 bp, Homo sapiens
ggacccagggcctcaccc

SEQ ID NO: 9372077 - DNA, 18 bp, Homo sapiens
ggacccagggcctcaccc

SEQ ID NO: 9372078 - DNA, 22 bp, Homo sapiens
ggacccagctctgagaccctgc

SEQ ID NO: 9372079 - DNA, 22 bp, Homo sapiens
ggacccagaggggagtctggca

SEQ ID NO: 9372080 - DNA, 22 bp, Homo sapiens
ggacccagctctgagaccctgc

SEQ ID NO: 9372081 - DNA, 22 bp, Homo sapiens
ggacagagggcaggagcccaga

SEQ ID NO: 9372082 - DNA, 21 bp, Homo sapiens
ggacagaggagaaggcaccct

SEQ ID NO: 9372083 - DNA, 22 bp, Homo sapiens
ggacccagaggggagtctggca

SEQ ID NO: 9372084 - DNA, 22 bp, Homo sapiens
ggacctgaacataaaacgaggc

SEQ ID NO: 9372085 - DNA, 22 bp, Homo sapiens
ggacctgaacataaaacgaggc

SEQ ID NO: 9372086 - DNA, 22 bp, Homo sapiens
ggacctgagaacgccttggctt

SEQ ID NO: 9372087 - DNA, 23 bp, Homo sapiens
ggaccctgtggagggtgagagtc

SEQ ID NO: 9372088 - DNA, 22 bp, Homo sapiens
ggaccctgggctctgggcctat

SEQ ID NO: 9372089 - DNA, 22 bp, Homo sapiens
ggaccctgggcagctggctgct

SEQ ID NO: 9372090 - DNA, 22 bp, Homo sapiens
ggaccctgggcagctggctgct

SEQ ID NO: 9372091 - DNA, 22 bp, Homo sapiens
gctgcacttgagcctgggagaa

SEQ ID NO: 9372092 - DNA, 22 bp, Homo sapiens
gctgcaccagctccaccagggc

SEQ ID NO: 9372093 - DNA, 22 bp, Homo sapiens
gctgcacatggcagaggccttt

SEQ ID NO: 9372094 - DNA, 22 bp, Homo sapiens
gctgcaagttagtatacattct

SEQ ID NO: 9372095 - DNA, 22 bp, Homo sapiens
gctgcaagatcttaaaagggag

SEQ ID NO: 9372096 - DNA, 22 bp, Homo sapiens
gctgcaagtcatggcttttgca

SEQ ID NO: 9372097 - DNA, 22 bp, Homo sapiens
gctgcaagtgcatgttgcaact

SEQ ID NO: 9372098 - DNA, 22 bp, Homo sapiens
gctgcaagtccttccctctctt

SEQ ID NO: 9372099 - DNA, 22 bp, Homo sapiens
gctgcaagcatgtcatcctcac

SEQ ID NO: 9372100 - DNA, 21 bp, Homo sapiens
gctgcaaggaagttttggtct

SEQ ID NO: 9372101 - DNA, 22 bp, Homo sapiens
gctgcaagtcacagaaacagtg

SEQ ID NO: 9372102 - DNA, 22 bp, Homo sapiens
gctgatggcttgctggctgaca

SEQ ID NO: 9372103 - DNA, 22 bp, Homo sapiens
gctgatggcttgctggctgaca

SEQ ID NO: 9372104 - DNA, 23 bp, Homo sapiens
gctgatggagacttgtggcctcc

SEQ ID NO: 9372105 - DNA, 23 bp, Homo sapiens
gctgatggagacttgtggcctcc

SEQ ID NO: 9372106 - DNA, 22 bp, Homo sapiens
gctgatggaattgtaaaatagt

SEQ ID NO: 9372107 - DNA, 22 bp, Homo sapiens
gctgatgtttagttgatgttac

SEQ ID NO: 9372108 - DNA, 22 bp, Homo sapiens
gctgatgggagctggctcaccc

SEQ ID NO: 9372109 - DNA, 22 bp, Homo sapiens
gctgatgggagctggctcaccc

SEQ ID NO: 9372110 - DNA, 22 bp, Homo sapiens
gctgatgtaagacttttggttt

SEQ ID NO: 9372111 - DNA, 22 bp, Homo sapiens
gctgatcacatttccaaaaccc

SEQ ID NO: 9372112 - DNA, 22 bp, Homo sapiens
gctgatagactgaatgttggga

SEQ ID NO: 9372113 - DNA, 22 bp, Homo sapiens
gctgaataggactgtcatctct

SEQ ID NO: 9372114 - DNA, 22 bp, Homo sapiens
gctgaataatgtgtaatgtctc

SEQ ID NO: 9372115 - DNA, 22 bp, Homo sapiens
gctgaataattctttgttgtgg

SEQ ID NO: 9372116 - DNA, 22 bp, Homo sapiens
gctgaatacagcatgccttatg

SEQ ID NO: 9372117 - DNA, 22 bp, Homo sapiens
gctgaatagaagtcttcaaagg

SEQ ID NO: 9372118 - DNA, 22 bp, Homo sapiens
gctgaaggtctctggagaggtc

SEQ ID NO: 9372119 - DNA, 22 bp, Homo sapiens
gctgaagtaactcacatcgtta

SEQ ID NO: 9372120 - DNA, 22 bp, Homo sapiens
gctgaagtaactcacatcgtta

SEQ ID NO: 9372121 - DNA, 22 bp, Homo sapiens
gctgaagtttatgtcttctttt

SEQ ID NO: 9372122 - DNA, 22 bp, Homo sapiens
gctgaagttttgcagagagtaa

SEQ ID NO: 9372123 - DNA, 22 bp, Homo sapiens
gctgaagttgaatattctggga

SEQ ID NO: 9372124 - DNA, 22 bp, Homo sapiens
gctgaagttgcctattttaata

SEQ ID NO: 9372125 - DNA, 22 bp, Homo sapiens
gctgaagttttgcagagagtaa

SEQ ID NO: 9372126 - DNA, 22 bp, Homo sapiens
gctgaataagagtctactttgc

SEQ ID NO: 9372127 - DNA, 22 bp, Homo sapiens
gctgaagtgtggagtgacagtt

SEQ ID NO: 9372128 - DNA, 22 bp, Homo sapiens
gctgaagtggcgtgatcagaat

SEQ ID NO: 9372129 - DNA, 22 bp, Homo sapiens
gctgaagtgtggagtgacagtt

SEQ ID NO: 9372130 - DNA, 16 bp, Homo sapiens
gctgaagtgagtatag

SEQ ID NO: 9372131 - DNA, 22 bp, Homo sapiens
gctgaagtgcttttgaatttgg

SEQ ID NO: 9372132 - DNA, 22 bp, Homo sapiens
gctgaagtcctaatcccaagta

SEQ ID NO: 9372133 - DNA, 22 bp, Homo sapiens
gctgaagtctgagaatttgcaa

SEQ ID NO: 9372134 - DNA, 22 bp, Homo sapiens
gctgaagcccacgtggcttgta

SEQ ID NO: 9372135 - DNA, 22 bp, Homo sapiens
gctgaagatttttgctagcccc

SEQ ID NO: 9372136 - DNA, 22 bp, Homo sapiens
gctgaagatttttgctagcccc

SEQ ID NO: 9372137 - DNA, 20 bp, Homo sapiens
gctgaagattcccatgcaag

SEQ ID NO: 9372138 - DNA, 19 bp, Homo sapiens
gctgaaggaggtgcctgca

SEQ ID NO: 9372139 - DNA, 19 bp, Homo sapiens
gctgaaggaggtgcctgca

SEQ ID NO: 9372140 - DNA, 22 bp, Homo sapiens
gctgaagggagtgctgagtctg

SEQ ID NO: 9372141 - DNA, 22 bp, Homo sapiens
gctgaagggagtgctgagtctg

SEQ ID NO: 9372142 - DNA, 22 bp, Homo sapiens
gctgaaggcccggaggacaggg

SEQ ID NO: 9372143 - DNA, 22 bp, Homo sapiens
gctgaaggcccggaggacaggg

SEQ ID NO: 9372144 - DNA, 22 bp, Homo sapiens
gctgccagccaacttgctgtgc

SEQ ID NO: 9372145 - DNA, 22 bp, Homo sapiens
gctgccagaatgggaaatctga

SEQ ID NO: 9372146 - DNA, 22 bp, Homo sapiens
gctgcaggtttgtctagtctgg

SEQ ID NO: 9372147 - DNA, 22 bp, Homo sapiens
gctgcaggttgggcaacagagt

SEQ ID NO: 9372148 - DNA, 22 bp, Homo sapiens
gctgcaggttgggcaacagagt

SEQ ID NO: 9372149 - DNA, 22 bp, Homo sapiens
gctgcaggatgaggctctgctc

SEQ ID NO: 9372150 - DNA, 22 bp, Homo sapiens
gctgcaggatgaggctctgctc

SEQ ID NO: 9372151 - DNA, 22 bp, Homo sapiens
gctgcaggatgaggctctgctc

SEQ ID NO: 9372152 - DNA, 22 bp, Homo sapiens
gctgcagggggtgggcgtctcc

SEQ ID NO: 9372153 - DNA, 22 bp, Homo sapiens
gctgcagggggtgggcgtctcc

SEQ ID NO: 9372154 - DNA, 22 bp, Homo sapiens
gctgcaggagctggagctgtgg

SEQ ID NO: 9372155 - DNA, 22 bp, Homo sapiens
gctgcaggagctggagctgtgg

SEQ ID NO: 9372156 - DNA, 22 bp, Homo sapiens
gctgcaggagattttgagagtc

SEQ ID NO: 9372157 - DNA, 22 bp, Homo sapiens
gctgcagctttaggatccagtg

SEQ ID NO: 9372158 - DNA, 22 bp, Homo sapiens
gctgcaggagattttgagagtc

SEQ ID NO: 9372159 - DNA, 22 bp, Homo sapiens
gctgcaggagctggagctgtgg

SEQ ID NO: 9372160 - DNA, 22 bp, Homo sapiens
gctgcagacctcatgcaggtgg

SEQ ID NO: 9372161 - DNA, 22 bp, Homo sapiens
gctgcagactgggaggcaggtg

SEQ ID NO: 9372162 - DNA, 22 bp, Homo sapiens
gctgcagactgggaggcaggtg

SEQ ID NO: 9372163 - DNA, 22 bp, Homo sapiens
gctgcagctcgccttccggcct

SEQ ID NO: 9372164 - DNA, 22 bp, Homo sapiens
gctgcagctcgccttccggcct

SEQ ID NO: 9372165 - DNA, 23 bp, Homo sapiens
gctgcagctgtggatgttctcag

SEQ ID NO: 9372166 - DNA, 22 bp, Homo sapiens
gctgcagctgtaggacacaatt

SEQ ID NO: 9372167 - DNA, 23 bp, Homo sapiens
gctgcagctgtggatgttctcag

SEQ ID NO: 9372168 - DNA, 22 bp, Homo sapiens
gctgccagttccttcttactcc

SEQ ID NO: 9372169 - DNA, 22 bp, Homo sapiens
gctgccagtgtggcatgatgca

SEQ ID NO: 9372170 - DNA, 20 bp, Homo sapiens
gctgccagtgcctgatgctt

SEQ ID NO: 9372171 - DNA, 22 bp, Homo sapiens
gctgccagtagttggagctcca

SEQ ID NO: 9372172 - DNA, 22 bp, Homo sapiens
gctgccagtagttggagctcca

SEQ ID NO: 9372173 - DNA, 22 bp, Homo sapiens
gctgccagtagttggagctcca

SEQ ID NO: 9372174 - DNA, 20 bp, Homo sapiens
gctgccagggcggagacatc

SEQ ID NO: 9372175 - DNA, 22 bp, Homo sapiens
gctgccagggaggtggtggagg

SEQ ID NO: 9372176 - DNA, 22 bp, Homo sapiens
gctgccaggggcagctgtctca

SEQ ID NO: 9372177 - DNA, 22 bp, Homo sapiens
gctgccaggggcagctgtctca

SEQ ID NO: 9372178 - DNA, 22 bp, Homo sapiens
gctgccagctttccttggctga

SEQ ID NO: 9372179 - DNA, 22 bp, Homo sapiens
gctgccagctttccttggctga

SEQ ID NO: 9372180 - DNA, 22 bp, Homo sapiens
gctgccaggacggagaggagcg

SEQ ID NO: 9372181 - DNA, 22 bp, Homo sapiens
gctgccaggacggagaggagcg

SEQ ID NO: 9372182 - DNA, 21 bp, Homo sapiens
gctgccaggattttgcaggaa

SEQ ID NO: 9372183 - DNA, 22 bp, Homo sapiens
gctgccaggccctggggctatg

SEQ ID NO: 9372184 - DNA, 22 bp, Homo sapiens
gctgccagggaggtggtggagg

SEQ ID NO: 9372185 - DNA, 22 bp, Homo sapiens
gctgccagggaggtggtggagg

SEQ ID NO: 9372186 - DNA, 22 bp, Homo sapiens
gctgccagccctcggggtctga

SEQ ID NO: 9372187 - DNA, 22 bp, Homo sapiens
gctgccagccctcggggtctga

SEQ ID NO: 9372188 - DNA, 22 bp, Homo sapiens
gctgccagcgtcagacctgggg

SEQ ID NO: 9372189 - DNA, 22 bp, Homo sapiens
gctgccagccctcggggtctga

SEQ ID NO: 9372190 - DNA, 22 bp, Homo sapiens
gctgccagctgcggcccacgcg

SEQ ID NO: 9372191 - DNA, 22 bp, Homo sapiens
gctctccagattcaggagggat

SEQ ID NO: 9372192 - DNA, 21 bp, Homo sapiens
gctctccagggccagcccagg

SEQ ID NO: 9372193 - DNA, 21 bp, Homo sapiens
gctctccagggccagcccagg

SEQ ID NO: 9372194 - DNA, 22 bp, Homo sapiens
gctctcagggtgatggcatact

SEQ ID NO: 9372195 - DNA, 18 bp, Homo sapiens
gctctgcccaggctgccc

SEQ ID NO: 9372196 - DNA, 18 bp, Homo sapiens
gctctgcccaggctgccc

SEQ ID NO: 9372197 - DNA, 17 bp, Homo sapiens
gctctgccccagcctct

SEQ ID NO: 9372198 - DNA, 17 bp, Homo sapiens
gctctgccccagcctct

SEQ ID NO: 9372199 - DNA, 17 bp, Homo sapiens
gctctgccccagcctct

SEQ ID NO: 9372200 - DNA, 17 bp, Homo sapiens
gctctgcctctcccacc

SEQ ID NO: 9372201 - DNA, 17 bp, Homo sapiens
gctctgcctctcccacc

SEQ ID NO: 9372202 - DNA, 22 bp, Homo sapiens
gctctgccccaggaactcagcc

SEQ ID NO: 9372203 - DNA, 22 bp, Homo sapiens
gctctgccccaggaactcagcc

SEQ ID NO: 9372204 - DNA, 17 bp, Homo sapiens
gctctgccccagcctct

SEQ ID NO: 9372205 - DNA, 22 bp, Homo sapiens
gctctgctaatattgtagtacc

SEQ ID NO: 9372206 - DNA, 22 bp, Homo sapiens
gctctgctctaacattcctgac

SEQ ID NO: 9372207 - DNA, 23 bp, Homo sapiens
gctctgctctgtttcatagacag

SEQ ID NO: 9372208 - DNA, 22 bp, Homo sapiens
gctctggctactccaccctgtt

SEQ ID NO: 9372209 - DNA, 22 bp, Homo sapiens
gctctggctactccaccctgtt

SEQ ID NO: 9372210 - DNA, 22 bp, Homo sapiens
gctctggctactccaccctgtt

SEQ ID NO: 9372211 - DNA, 22 bp, Homo sapiens
gctctggccagaccctcagtgg

SEQ ID NO: 9372212 - DNA, 22 bp, Homo sapiens
gctctggccagaccctcagtgg

SEQ ID NO: 9372213 - DNA, 21 bp, Homo sapiens
gctctggcctactgttccctc

SEQ ID NO: 9372214 - DNA, 22 bp, Homo sapiens
gctctggctactgtggctaccg

SEQ ID NO: 9372215 - DNA, 22 bp, Homo sapiens
gctctggctactgtggctaccg

SEQ ID NO: 9372216 - DNA, 22 bp, Homo sapiens
gctctggctactccaccctgtt

SEQ ID NO: 9372217 - DNA, 22 bp, Homo sapiens
gctctgctggaagttctctgga

SEQ ID NO: 9372218 - DNA, 22 bp, Homo sapiens
gctctggcactggcgcgggatg

SEQ ID NO: 9372219 - DNA, 23 bp, Homo sapiens
gctctggcagcttgtgtcagcac

SEQ ID NO: 9372220 - DNA, 23 bp, Homo sapiens
gctctggcagcttgtgtcagcac

SEQ ID NO: 9372221 - DNA, 22 bp, Homo sapiens
gctctggccagaccctcagtgg

SEQ ID NO: 9372222 - DNA, 23 bp, Homo sapiens
gctctggcagcttgtgtcagcac

SEQ ID NO: 9372223 - DNA, 22 bp, Homo sapiens
gctctgctgacagctgggacag

SEQ ID NO: 9372224 - DNA, 22 bp, Homo sapiens
gctctgctgaagccccttgcat

SEQ ID NO: 9372225 - DNA, 22 bp, Homo sapiens
gctctgctcttgacttaccagg

SEQ ID NO: 9372226 - DNA, 21 bp, Homo sapiens
gctctcagctgcctgctggtt

SEQ ID NO: 9372227 - DNA, 21 bp, Homo sapiens
gctctcagctgcctgctggtt

SEQ ID NO: 9372228 - DNA, 22 bp, Homo sapiens
gctctcagatgctccagcagcc

SEQ ID NO: 9372229 - DNA, 22 bp, Homo sapiens
gctctcagatgctccagcagcc

SEQ ID NO: 9372230 - DNA, 22 bp, Homo sapiens
gctctcagaagagccaggctac

SEQ ID NO: 9372231 - DNA, 22 bp, Homo sapiens
gctctcagaagagccaggctac

SEQ ID NO: 9372232 - DNA, 22 bp, Homo sapiens
gctctcagaagagccaggctac

SEQ ID NO: 9372233 - DNA, 22 bp, Homo sapiens
gctctatgtcgaaagccagtta

SEQ ID NO: 9372234 - DNA, 22 bp, Homo sapiens
gctctatgttgaccttcagtgg

SEQ ID NO: 9372235 - DNA, 22 bp, Homo sapiens
gctctatggctgctgggagtcc

SEQ ID NO: 9372236 - DNA, 22 bp, Homo sapiens
gctctatgggcacagccagtgt

SEQ ID NO: 9372237 - DNA, 17 bp, Homo sapiens
gctccttctaacttcca

SEQ ID NO: 9372238 - DNA, 22 bp, Homo sapiens
gctctatgagtttctcagttta

SEQ ID NO: 9372239 - DNA, 22 bp, Homo sapiens
gctccttcaggtggtagctgtt

SEQ ID NO: 9372240 - DNA, 22 bp, Homo sapiens
gctcctgttttcttccagaaat

SEQ ID NO: 9372241 - DNA, 22 bp, Homo sapiens
gctcctgtttgtttgttcctga

SEQ ID NO: 9372242 - DNA, 22 bp, Homo sapiens
gctcctgtgcaggtctcggttg

SEQ ID NO: 9372243 - DNA, 22 bp, Homo sapiens
gctcctgtgcaggtctcggttg

SEQ ID NO: 9372244 - DNA, 22 bp, Homo sapiens
gctcctgtttgtttgttcctga

SEQ ID NO: 9372245 - DNA, 22 bp, Homo sapiens
gctcctgtttgtttgttcctga

SEQ ID NO: 9372246 - DNA, 22 bp, Homo sapiens
gctcctgtaatttttaaaagtc

SEQ ID NO: 9372247 - DNA, 20 bp, Homo sapiens
gctcctgtcctggtggaggg

SEQ ID NO: 9372248 - DNA, 22 bp, Homo sapiens
gctcctgtcagtcatcaggtgc

SEQ ID NO: 9372249 - DNA, 22 bp, Homo sapiens
gctcctgtcatcaaacaatcct

SEQ ID NO: 9372250 - DNA, 22 bp, Homo sapiens
gctcctgtcttggggcactggc

SEQ ID NO: 9372251 - DNA, 22 bp, Homo sapiens
gctcctgtgaggacacagccgc

SEQ ID NO: 9372252 - DNA, 22 bp, Homo sapiens
gctcctgtgaaggcattaggtg

SEQ ID NO: 9372253 - DNA, 22 bp, Homo sapiens
gctcctgtccttagccccagag

SEQ ID NO: 9372254 - DNA, 22 bp, Homo sapiens
gctcctgtcttggggcactggc

SEQ ID NO: 9372255 - DNA, 22 bp, Homo sapiens
gctcctgtccttagccccagag

SEQ ID NO: 9372256 - DNA, 20 bp, Homo sapiens
gctcctgtcctggtggaggg

SEQ ID NO: 9372257 - DNA, 21 bp, Homo sapiens
gctcctggtgctgcgtggcgc

SEQ ID NO: 9372258 - DNA, 22 bp, Homo sapiens
gctcctggtgctgtagagattt

SEQ ID NO: 9372259 - DNA, 18 bp, Homo sapiens
gctcctggttggaaagaa

SEQ ID NO: 9372260 - DNA, 22 bp, Homo sapiens
gctcctggtgctgtagagattt

SEQ ID NO: 9372261 - DNA, 22 bp, Homo sapiens
gctcaggctctcccaggggaat

SEQ ID NO: 9372262 - DNA, 22 bp, Homo sapiens
gctcaggctctcccaggggaat

SEQ ID NO: 9372263 - DNA, 21 bp, Homo sapiens
gctcaggctcttgacagagca

SEQ ID NO: 9372264 - DNA, 21 bp, Homo sapiens
gctcaggctcttgacagagca

SEQ ID NO: 9372265 - DNA, 21 bp, Homo sapiens
gctcaggctcaggttcaggtt

SEQ ID NO: 9372266 - DNA, 22 bp, Homo sapiens
gctcaggcctggctatccattg

SEQ ID NO: 9372267 - DNA, 22 bp, Homo sapiens
gctcaggcctggctatccattg

SEQ ID NO: 9372268 - DNA, 22 bp, Homo sapiens
gctcaggctctcccaggggaat

SEQ ID NO: 9372269 - DNA, 21 bp, Homo sapiens
gctcaggctcaggttcaggtt

SEQ ID NO: 9372270 - DNA, 18 bp, Homo sapiens
gctcaggccctagtcagt

SEQ ID NO: 9372271 - DNA, 22 bp, Homo sapiens
gctcaggcctcactccatttgg

SEQ ID NO: 9372272 - DNA, 22 bp, Homo sapiens
gctcaggcctccagaggggcaa

SEQ ID NO: 9372273 - DNA, 22 bp, Homo sapiens
gctcaggcctccagaggggcaa

SEQ ID NO: 9372274 - DNA, 22 bp, Homo sapiens
gctcaggcctccagaggggcaa

SEQ ID NO: 9372275 - DNA, 22 bp, Homo sapiens
gctcaggcctggcccatgggac

SEQ ID NO: 9372276 - DNA, 22 bp, Homo sapiens
gctcaggcctggcccatgggac

SEQ ID NO: 9372277 - DNA, 22 bp, Homo sapiens
gctcaggcctggcccatgggac

SEQ ID NO: 9372278 - DNA, 22 bp, Homo sapiens
gctcaggcctcggacacacaat

SEQ ID NO: 9372279 - DNA, 22 bp, Homo sapiens
gctcagggaaagagctcctgtc

SEQ ID NO: 9372280 - DNA, 22 bp, Homo sapiens
gctcaggcttcttctataaaga

SEQ ID NO: 9372281 - DNA, 19 bp, Homo sapiens
gctcaggctgtgtgtgggg

SEQ ID NO: 9372282 - DNA, 19 bp, Homo sapiens
gctcaggctgtgtgtgggg

SEQ ID NO: 9372283 - DNA, 22 bp, Homo sapiens
gctcaggctggattgcagtggc

SEQ ID NO: 9372284 - DNA, 19 bp, Homo sapiens
gctcaggctgtgtgtgggg

SEQ ID NO: 9372285 - DNA, 22 bp, Homo sapiens
gctcaggctggattgcagtggc

SEQ ID NO: 9372286 - DNA, 22 bp, Homo sapiens
gctcaggctggattgcagtggc

SEQ ID NO: 9372287 - DNA, 21 bp, Homo sapiens
gctcaggctcttgacagagca

SEQ ID NO: 9372288 - DNA, 22 bp, Homo sapiens
gctcctggtctggagcttcaag

SEQ ID NO: 9372289 - DNA, 22 bp, Homo sapiens
gctcagggaactttttgcaggc

SEQ ID NO: 9372290 - DNA, 22 bp, Homo sapiens
gctcagggaaagagctcctgtc

SEQ ID NO: 9372291 - DNA, 22 bp, Homo sapiens
gctcctggtctggagcttcaag

SEQ ID NO: 9372292 - DNA, 22 bp, Homo sapiens
gctcctggtgcaaagtttcttc

SEQ ID NO: 9372293 - DNA, 21 bp, Homo sapiens
gctcctggtgctgcgtggcgc

SEQ ID NO: 9372294 - DNA, 22 bp, Homo sapiens
gctcctggtgcaaagtttcttc

SEQ ID NO: 9372295 - DNA, 22 bp, Homo sapiens
gcgactgtacagaattgcccct

SEQ ID NO: 9372296 - DNA, 22 bp, Homo sapiens
gcgagaaactaagtgccctttg

SEQ ID NO: 9372297 - DNA, 22 bp, Homo sapiens
gcgagaaactaagtgccctttg

SEQ ID NO: 9372298 - DNA, 22 bp, Homo sapiens
gcgcgctgagtgtccgttgggg

SEQ ID NO: 9372299 - DNA, 16 bp, Homo sapiens
gcgcctcctcggcctc

SEQ ID NO: 9372300 - DNA, 16 bp, Homo sapiens
gcgcctcctcggcctc

SEQ ID NO: 9372301 - DNA, 22 bp, Homo sapiens
gcgcctggcacacagcaagggc

SEQ ID NO: 9372302 - DNA, 22 bp, Homo sapiens
gcgcctggcacacagcaagggc

SEQ ID NO: 9372303 - DNA, 22 bp, Homo sapiens
gcgacctcctgcctgagagtct

SEQ ID NO: 9372304 - DNA, 22 bp, Homo sapiens
gccttgagaagtcctgcagtga

SEQ ID NO: 9372305 - DNA, 22 bp, Homo sapiens
gccttctgatatctcttggcat

SEQ ID NO: 9372306 - DNA, 22 bp, Homo sapiens
gccttgaactcatgtatattga

SEQ ID NO: 9372307 - DNA, 22 bp, Homo sapiens
gccttctgtgctcctggccttt

SEQ ID NO: 9372308 - DNA, 22 bp, Homo sapiens
gcggaaggctgcctggcttgag

SEQ ID NO: 9372309 - DNA, 22 bp, Homo sapiens
gcgctaggcaagtcctttcaac

SEQ ID NO: 9372310 - DNA, 22 bp, Homo sapiens
gcgcgtgggccgcggctggtta

SEQ ID NO: 9372311 - DNA, 22 bp, Homo sapiens
gcgctaggcaagtcctttcaac

SEQ ID NO: 9372312 - DNA, 22 bp, Homo sapiens
gcgctgcgcctcctcttccgca

SEQ ID NO: 9372313 - DNA, 18 bp, Homo sapiens
gcgctggctgtcctgtcc

SEQ ID NO: 9372314 - DNA, 22 bp, Homo sapiens
gcgctggggctcaaacctcaca

SEQ ID NO: 9372315 - DNA, 22 bp, Homo sapiens
gcgggccaccttggagagcgct

SEQ ID NO: 9372316 - DNA, 22 bp, Homo sapiens
gcgggccaccttggagagcgct

SEQ ID NO: 9372317 - DNA, 22 bp, Homo sapiens
gcggggcacagtgatggagcac

SEQ ID NO: 9372318 - DNA, 22 bp, Homo sapiens
gcggcaggagtaaaggaggaag

SEQ ID NO: 9372319 - DNA, 22 bp, Homo sapiens
gcggcccgggtccccagcagca

SEQ ID NO: 9372320 - DNA, 22 bp, Homo sapiens
gcggcccgagcaggacgggtgg

SEQ ID NO: 9372321 - DNA, 22 bp, Homo sapiens
gctcacagaacttctcttccca

SEQ ID NO: 9372322 - DNA, 22 bp, Homo sapiens
gctcaagccttctgcccacctc

SEQ ID NO: 9372323 - DNA, 22 bp, Homo sapiens
gctcaagatgtggcctctgaag

SEQ ID NO: 9372324 - DNA, 22 bp, Homo sapiens
gctcaagactgttagcctggca

SEQ ID NO: 9372325 - DNA, 22 bp, Homo sapiens
gctcaaatttcagactcatgaa

SEQ ID NO: 9372326 - DNA, 22 bp, Homo sapiens
gctcaagacccctctgtgactg

SEQ ID NO: 9372327 - DNA, 22 bp, Homo sapiens
gcggggggaggaacatcttgca

SEQ ID NO: 9372328 - DNA, 22 bp, Homo sapiens
gctatattttgaaggagagcca

SEQ ID NO: 9372329 - DNA, 22 bp, Homo sapiens
gctatagaatttcatagagacc

SEQ ID NO: 9372330 - DNA, 22 bp, Homo sapiens
gctatagaaagtaatcactatc

SEQ ID NO: 9372331 - DNA, 22 bp, Homo sapiens
gctcacagtctggcatagtctc

SEQ ID NO: 9372332 - DNA, 22 bp, Homo sapiens
gctcacagtctgctgagtgcag

SEQ ID NO: 9372333 - DNA, 22 bp, Homo sapiens
gctcacagccggctggcagggg

SEQ ID NO: 9372334 - DNA, 22 bp, Homo sapiens
gctcacagcccaggccagcgtg

SEQ ID NO: 9372335 - DNA, 22 bp, Homo sapiens
gctcacagccggctggcagggg

SEQ ID NO: 9372336 - DNA, 22 bp, Homo sapiens
gctcagctggagagggacgggt

SEQ ID NO: 9372337 - DNA, 22 bp, Homo sapiens
gctcagctggaccatcgtgttt

SEQ ID NO: 9372338 - DNA, 22 bp, Homo sapiens
gctcagcttgggagcgcccggt

SEQ ID NO: 9372339 - DNA, 18 bp, Homo sapiens
gctcaggccctagtcagt

SEQ ID NO: 9372340 - DNA, 18 bp, Homo sapiens
gctcaggccctagtcagt

SEQ ID NO: 9372341 - DNA, 22 bp, Homo sapiens
gctcaggcccagcggctggtgt

SEQ ID NO: 9372342 - DNA, 22 bp, Homo sapiens
gctcaggcatgtatgtggttgc

SEQ ID NO: 9372343 - DNA, 22 bp, Homo sapiens
gctcaggcccagcggctggtgt

SEQ ID NO: 9372344 - DNA, 22 bp, Homo sapiens
gctcaggcccagcggctggtgt

SEQ ID NO: 9372345 - DNA, 22 bp, Homo sapiens
gctcagctgcacctggagagcc

SEQ ID NO: 9372346 - DNA, 21 bp, Homo sapiens
gctcagctgcttggttcctgt

SEQ ID NO: 9372347 - DNA, 22 bp, Homo sapiens
gctcagctgcacctggagagcc

SEQ ID NO: 9372348 - DNA, 22 bp, Homo sapiens
gctcactgcaacctccacctcc

SEQ ID NO: 9372349 - DNA, 22 bp, Homo sapiens
gctcaccttcgtccagcagccg

SEQ ID NO: 9372350 - DNA, 22 bp, Homo sapiens
gctcaccttcgtccagcagccg

SEQ ID NO: 9372351 - DNA, 22 bp, Homo sapiens
gctcaccaagcagagactctgg

SEQ ID NO: 9372352 - DNA, 22 bp, Homo sapiens
gctcaccaagcagagactctgg

SEQ ID NO: 9372353 - DNA, 22 bp, Homo sapiens
gctcacagttctatttttcatg

SEQ ID NO: 9372354 - DNA, 22 bp, Homo sapiens
gcctgggtaggagacaaaaggt

SEQ ID NO: 9372355 - DNA, 22 bp, Homo sapiens
gcctggggggcatgtcataata

SEQ ID NO: 9372356 - DNA, 22 bp, Homo sapiens
gcctggtgataagcagtgacct

SEQ ID NO: 9372357 - DNA, 22 bp, Homo sapiens
gcctggtgaaaggcagagagcg

SEQ ID NO: 9372358 - DNA, 23 bp, Homo sapiens
gcctgggttgtaactagtgcatc

SEQ ID NO: 9372359 - DNA, 22 bp, Homo sapiens
gcctgggttcctgcttttgtga

SEQ ID NO: 9372360 - DNA, 23 bp, Homo sapiens
gcctgggttgtaactagtgcatc

SEQ ID NO: 9372361 - DNA, 22 bp, Homo sapiens
gcctggtgaaaggcagagagcg

SEQ ID NO: 9372362 - DNA, 22 bp, Homo sapiens
gcctggtgaaaggcagagagcg

SEQ ID NO: 9372363 - DNA, 22 bp, Homo sapiens
gcctgggtgagggtctccttca

SEQ ID NO: 9372364 - DNA, 22 bp, Homo sapiens
gcctgggtctcctccgcttccc

SEQ ID NO: 9372365 - DNA, 22 bp, Homo sapiens
gcctgggtgaatttgatcctaa

SEQ ID NO: 9372366 - DNA, 22 bp, Homo sapiens
gcctgggtccactgatcatgct

SEQ ID NO: 9372367 - DNA, 22 bp, Homo sapiens
gcctgggtccaccgctcgcgct

SEQ ID NO: 9372368 - DNA, 22 bp, Homo sapiens
gcctgggtccactgatcatgct

SEQ ID NO: 9372369 - DNA, 23 bp, Homo sapiens
gcctgggtctagagataagagcc

SEQ ID NO: 9372370 - DNA, 22 bp, Homo sapiens
gcctgggttccatgatctccag

SEQ ID NO: 9372371 - DNA, 22 bp, Homo sapiens
gcctgggttccatgatctccag

SEQ ID NO: 9372372 - DNA, 22 bp, Homo sapiens
gcctgggtgagggtctccttca

SEQ ID NO: 9372373 - DNA, 22 bp, Homo sapiens
gcctgggtgcccaatgatgaga

SEQ ID NO: 9372374 - DNA, 22 bp, Homo sapiens
gcctgggtgtcgatcactagtg

SEQ ID NO: 9372375 - DNA, 22 bp, Homo sapiens
gcctgggtgctctgtgtaaggg

SEQ ID NO: 9372376 - DNA, 22 bp, Homo sapiens
gcctgggtggagaggggtgaca

SEQ ID NO: 9372377 - DNA, 22 bp, Homo sapiens
gccttcaggtgctgccaggcta

SEQ ID NO: 9372378 - DNA, 22 bp, Homo sapiens
gccttcagcggccgctcgctgc

SEQ ID NO: 9372379 - DNA, 23 bp, Homo sapiens
gccttcagctcgggaaggctccc

SEQ ID NO: 9372380 - DNA, 23 bp, Homo sapiens
gccttcagctcgggaaggctccc

SEQ ID NO: 9372381 - DNA, 22 bp, Homo sapiens
gccttcaggaaatcagtccttg

SEQ ID NO: 9372382 - DNA, 22 bp, Homo sapiens
gccttcagtagtgtcagctgta

SEQ ID NO: 9372383 - DNA, 22 bp, Homo sapiens
gccttcagtagtgtcagctgta

SEQ ID NO: 9372384 - DNA, 22 bp, Homo sapiens
gccttcagtagtgtcagctgta

SEQ ID NO: 9372385 - DNA, 22 bp, Homo sapiens
gccttccacctaggcctctgct

SEQ ID NO: 9372386 - DNA, 22 bp, Homo sapiens
gccttcagtagtatcctcatga

SEQ ID NO: 9372387 - DNA, 22 bp, Homo sapiens
gccttcaggtgtccctgtgggc

SEQ ID NO: 9372388 - DNA, 22 bp, Homo sapiens
gccttcagagtaccatgtcctc

SEQ ID NO: 9372389 - DNA, 18 bp, Homo sapiens
gccttcagactgcatgct

SEQ ID NO: 9372390 - DNA, 18 bp, Homo sapiens
gccttcagactgcatgct

SEQ ID NO: 9372391 - DNA, 22 bp, Homo sapiens
gccttcagcggccgctcgctgc

SEQ ID NO: 9372392 - DNA, 18 bp, Homo sapiens
gccttcagactgcatgct

SEQ ID NO: 9372393 - DNA, 22 bp, Homo sapiens
gccttaggggtcagacagagct

SEQ ID NO: 9372394 - DNA, 22 bp, Homo sapiens
gcctggtggtatcctggcaaga

SEQ ID NO: 9372395 - DNA, 22 bp, Homo sapiens
gcctggtgctatgagggccagc

SEQ ID NO: 9372396 - DNA, 22 bp, Homo sapiens
gcctggtggacactgggcatca

SEQ ID NO: 9372397 - DNA, 22 bp, Homo sapiens
gcctggtggtgtgctcaagtgg

SEQ ID NO: 9372398 - DNA, 22 bp, Homo sapiens
gcctggtgtccagaggcgagtg

SEQ ID NO: 9372399 - DNA, 22 bp, Homo sapiens
gcctggtgtccagaggcgagtg

SEQ ID NO: 9372400 - DNA, 19 bp, Homo sapiens
gcctggctgggatgagccc

SEQ ID NO: 9372401 - DNA, 19 bp, Homo sapiens
gcctggctgggatgagccc

SEQ ID NO: 9372402 - DNA, 22 bp, Homo sapiens
gcctggctgcttagcctacttc

SEQ ID NO: 9372403 - DNA, 22 bp, Homo sapiens
gcctggctggtagagggggctc

SEQ ID NO: 9372404 - DNA, 22 bp, Homo sapiens
gcctggctgggctgaatgctta

SEQ ID NO: 9372405 - DNA, 22 bp, Homo sapiens
gcctggctgtcaaacccagaag

SEQ ID NO: 9372406 - DNA, 22 bp, Homo sapiens
gcctggctgtctggcaaggttc

SEQ ID NO: 9372407 - DNA, 22 bp, Homo sapiens
gcctggctggtcactgcctggc

SEQ ID NO: 9372408 - DNA, 22 bp, Homo sapiens
gcctggctggtcactgcctggc

SEQ ID NO: 9372409 - DNA, 18 bp, Homo sapiens
gcctggcttcggagccgc

SEQ ID NO: 9372410 - DNA, 22 bp, Homo sapiens
gcctggcttcccttggagcatt

SEQ ID NO: 9372411 - DNA, 21 bp, Homo sapiens
gcctggcttcacaggcactga

SEQ ID NO: 9372412 - DNA, 22 bp, Homo sapiens
gcctggcttcccttggagcatt

SEQ ID NO: 9372413 - DNA, 22 bp, Homo sapiens
gcctggcttggggctcagtggt

SEQ ID NO: 9372414 - DNA, 22 bp, Homo sapiens
gcctggggaacttgatcctgtc

SEQ ID NO: 9372415 - DNA, 22 bp, Homo sapiens
gcctggcttgccagccctggcg

SEQ ID NO: 9372416 - DNA, 22 bp, Homo sapiens
gcctggcttgccagccctggcg

SEQ ID NO: 9372417 - DNA, 22 bp, Homo sapiens
gcctggcttgccagccctggcg

SEQ ID NO: 9372418 - DNA, 22 bp, Homo sapiens
gcctggcttgccagccctggcg

SEQ ID NO: 9372419 - DNA, 18 bp, Homo sapiens
gcctggcttcggagccgc

SEQ ID NO: 9372420 - DNA, 22 bp, Homo sapiens
gcctggctgccggccttggcaa

SEQ ID NO: 9372421 - DNA, 18 bp, Homo sapiens
gcctggctgccaacccag

SEQ ID NO: 9372422 - DNA, 22 bp, Homo sapiens
gcctggctgccggccttggcaa

SEQ ID NO: 9372423 - DNA, 22 bp, Homo sapiens
gcctggctgctcagccactcac

SEQ ID NO: 9372424 - DNA, 22 bp, Homo sapiens
gcctggctgctagccagaggca

SEQ ID NO: 9372425 - DNA, 22 bp, Homo sapiens
gcctggctgctagccagaggca

SEQ ID NO: 9372426 - DNA, 22 bp, Homo sapiens
gcctggctgctagccagaggca

SEQ ID NO: 9372427 - DNA, 22 bp, Homo sapiens
gcctcagggggagaggccagct

SEQ ID NO: 9372428 - DNA, 22 bp, Homo sapiens
gcctcagggataggatgagcat

SEQ ID NO: 9372429 - DNA, 22 bp, Homo sapiens
gcctggctaagcagaaggaccc

SEQ ID NO: 9372430 - DNA, 22 bp, Homo sapiens
gcctggctaagcagaaggaccc

SEQ ID NO: 9372431 - DNA, 22 bp, Homo sapiens
gcctcaggcctatagctgctgt

SEQ ID NO: 9372432 - DNA, 22 bp, Homo sapiens
gcctcagggataggatgagcat

SEQ ID NO: 9372433 - DNA, 22 bp, Homo sapiens
gcctcaggcctatagctgctgt

SEQ ID NO: 9372434 - DNA, 22 bp, Homo sapiens
gcctcaggccgccctgctgctc

SEQ ID NO: 9372435 - DNA, 22 bp, Homo sapiens
gcctcaggcctatagctgctgt

SEQ ID NO: 9372436 - DNA, 22 bp, Homo sapiens
gcctaacttggctttgttcacc

SEQ ID NO: 9372437 - DNA, 22 bp, Homo sapiens
gccctgaggggtggtgtctgta

SEQ ID NO: 9372438 - DNA, 22 bp, Homo sapiens
gcctcagaaagtggcaggtagg

SEQ ID NO: 9372439 - DNA, 22 bp, Homo sapiens
gcctcagaaagtggcaggtagg

SEQ ID NO: 9372440 - DNA, 23 bp, Homo sapiens
gcctcagagaaacagctgcacac

SEQ ID NO: 9372441 - DNA, 22 bp, Homo sapiens
gcctcagacactgcctgggtgt

SEQ ID NO: 9372442 - DNA, 22 bp, Homo sapiens
gcctcagaatcatttatcatct

SEQ ID NO: 9372443 - DNA, 22 bp, Homo sapiens
gcctcagagggcagggtggtga

SEQ ID NO: 9372444 - DNA, 22 bp, Homo sapiens
gcctcagagctacacacacgca

SEQ ID NO: 9372445 - DNA, 22 bp, Homo sapiens
gcctcagagctacacacacgca

SEQ ID NO: 9372446 - DNA, 22 bp, Homo sapiens
gcctacagttggctgagggcct

SEQ ID NO: 9372447 - DNA, 22 bp, Homo sapiens
gcctcagaaagcttttattcat

SEQ ID NO: 9372448 - DNA, 22 bp, Homo sapiens
gcctagcattgatcagcctgct

SEQ ID NO: 9372449 - DNA, 20 bp, Homo sapiens
gcctcagagggtttgagttt

SEQ ID NO: 9372450 - DNA, 22 bp, Homo sapiens
gcctcagagggccctagggaca

SEQ ID NO: 9372451 - DNA, 22 bp, Homo sapiens
gcctcagagggccctagggaca

SEQ ID NO: 9372452 - DNA, 22 bp, Homo sapiens
gcctcagagggccctagggaca

SEQ ID NO: 9372453 - DNA, 22 bp, Homo sapiens
gcctcagccggcggacgccagg

SEQ ID NO: 9372454 - DNA, 22 bp, Homo sapiens
gcctcaggccgccctgctgctc

SEQ ID NO: 9372455 - DNA, 22 bp, Homo sapiens
gcctcagctcccagcccaggct

SEQ ID NO: 9372456 - DNA, 22 bp, Homo sapiens
gccctgagcactgctgctgggg

SEQ ID NO: 9372457 - DNA, 22 bp, Homo sapiens
gccctgaggatttgcatttcct

SEQ ID NO: 9372458 - DNA, 22 bp, Homo sapiens
gccctgagcctatgagcctctc

SEQ ID NO: 9372459 - DNA, 22 bp, Homo sapiens
gccctgaaggcagaggtggagc

SEQ ID NO: 9372460 - DNA, 22 bp, Homo sapiens
gcccagggcgatggtcggggcc

SEQ ID NO: 9372461 - DNA, 22 bp, Homo sapiens
gcccagggcgatggtcggggcc

SEQ ID NO: 9372462 - DNA, 22 bp, Homo sapiens
gcccagggctgcaagtggacgc

SEQ ID NO: 9372463 - DNA, 22 bp, Homo sapiens
gcccagggcagggcaagagtga

SEQ ID NO: 9372464 - DNA, 23 bp, Homo sapiens
gcccagggactgggaatcagtgg

SEQ ID NO: 9372465 - DNA, 23 bp, Homo sapiens
gcccagggactgggaatcagtgg

SEQ ID NO: 9372466 - DNA, 22 bp, Homo sapiens
gcccaggctggagttcagtggt

SEQ ID NO: 9372467 - DNA, 22 bp, Homo sapiens
gcccaggctggagttcagtggt

SEQ ID NO: 9372468 - DNA, 22 bp, Homo sapiens
gcccaggctggagtgcagtggt

SEQ ID NO: 9372469 - DNA, 22 bp, Homo sapiens
gcccaggctggagtgcagtggt

SEQ ID NO: 9372470 - DNA, 22 bp, Homo sapiens
gcccaggctggagtgcagtggt

SEQ ID NO: 9372471 - DNA, 22 bp, Homo sapiens
gcccagcaaggaccaagggccg

SEQ ID NO: 9372472 - DNA, 22 bp, Homo sapiens
gcccagcaactgcacccttctt

SEQ ID NO: 9372473 - DNA, 22 bp, Homo sapiens
gcccagcaaggaccaagggccg

SEQ ID NO: 9372474 - DNA, 22 bp, Homo sapiens
gcccagagttcaaggctgcagt

SEQ ID NO: 9372475 - DNA, 22 bp, Homo sapiens
gcccagagttcaaggctgcagt

SEQ ID NO: 9372476 - DNA, 22 bp, Homo sapiens
gcccagagtggccacttggctc

SEQ ID NO: 9372477 - DNA, 21 bp, Homo sapiens
gcccagagttaagcccaccca

SEQ ID NO: 9372478 - DNA, 22 bp, Homo sapiens
gcccagagttcaaggctgcagt

SEQ ID NO: 9372479 - DNA, 22 bp, Homo sapiens
gcccagggcttcaaagagagaa

SEQ ID NO: 9372480 - DNA, 22 bp, Homo sapiens
gcccaggggcagcgcatagtgg

SEQ ID NO: 9372481 - DNA, 22 bp, Homo sapiens
gcccaggggcagcgcatagtgg

SEQ ID NO: 9372482 - DNA, 22 bp, Homo sapiens
gcccaggggagtagtcaattta

SEQ ID NO: 9372483 - DNA, 22 bp, Homo sapiens
gcccagtggtaaaagcaggcct

SEQ ID NO: 9372484 - DNA, 22 bp, Homo sapiens
gcccataattcaaatataacac

SEQ ID NO: 9372485 - DNA, 22 bp, Homo sapiens
gcccatcttctagcagctgtta

SEQ ID NO: 9372486 - DNA, 22 bp, Homo sapiens
gcccatccctgaaccaactggg

SEQ ID NO: 9372487 - DNA, 22 bp, Homo sapiens
gcccatctaatatgtactgtgt

SEQ ID NO: 9372488 - DNA, 22 bp, Homo sapiens
gcccatggacacccaagtgcca

SEQ ID NO: 9372489 - DNA, 22 bp, Homo sapiens
gcccatggaaaacctgtcctct

SEQ ID NO: 9372490 - DNA, 22 bp, Homo sapiens
gcccatgcccctccttctggca

SEQ ID NO: 9372491 - DNA, 22 bp, Homo sapiens
gcccatgcactttctgtgatgg

SEQ ID NO: 9372492 - DNA, 22 bp, Homo sapiens
gcccatgaggtggaggctgcag

SEQ ID NO: 9372493 - DNA, 20 bp, Homo sapiens
gcccatgaggactgcagctg

SEQ ID NO: 9372494 - DNA, 22 bp, Homo sapiens
gccctctggggcacacagagga

SEQ ID NO: 9372495 - DNA, 23 bp, Homo sapiens
gcccatggagtctggatctggcc

SEQ ID NO: 9372496 - DNA, 22 bp, Homo sapiens
gccctctggtgggtgagccccg

SEQ ID NO: 9372497 - DNA, 22 bp, Homo sapiens
gccaggagaaaaggcgaatgat

SEQ ID NO: 9372498 - DNA, 22 bp, Homo sapiens
gccaggagaaaaggcgaatgat

SEQ ID NO: 9372499 - DNA, 22 bp, Homo sapiens
gccaggagaaaaggcgaatgat

SEQ ID NO: 9372500 - DNA, 22 bp, Homo sapiens
gccaggactgagaatgggagca

SEQ ID NO: 9372501 - DNA, 22 bp, Homo sapiens
gccaggacctcagatgcagggc

SEQ ID NO: 9372502 - DNA, 21 bp, Homo sapiens
gccaggaccagcagaccactt

SEQ ID NO: 9372503 - DNA, 19 bp, Homo sapiens
gccaggacatcctcctgct

SEQ ID NO: 9372504 - DNA, 22 bp, Homo sapiens
gccaggaatggagaggtggcct

SEQ ID NO: 9372505 - DNA, 22 bp, Homo sapiens
gccaggagccctgggcaagttc

SEQ ID NO: 9372506 - DNA, 22 bp, Homo sapiens
gccaggagccctgggcaagttc

SEQ ID NO: 9372507 - DNA, 22 bp, Homo sapiens
gccaggagccctgggcaagttc

SEQ ID NO: 9372508 - DNA, 22 bp, Homo sapiens
gccaggagtgtgtggctatgtt

SEQ ID NO: 9372509 - DNA, 22 bp, Homo sapiens
gccaggaggctgctgtgtaggc

SEQ ID NO: 9372510 - DNA, 22 bp, Homo sapiens
gccaggagccctgggcaagttc

SEQ ID NO: 9372511 - DNA, 22 bp, Homo sapiens
gccaggagagctccttcaggtt

SEQ ID NO: 9372512 - DNA, 22 bp, Homo sapiens
gccaggagagctccttcaggtt

SEQ ID NO: 9372513 - DNA, 22 bp, Homo sapiens
gccaggagagctccttcaggtt

SEQ ID NO: 9372514 - DNA, 22 bp, Homo sapiens
gccaggagaatgctagcagagg

SEQ ID NO: 9372515 - DNA, 22 bp, Homo sapiens
gccaggtctcataaatgcagct

SEQ ID NO: 9372516 - DNA, 18 bp, Homo sapiens
gccaggtctctctgcttc

SEQ ID NO: 9372517 - DNA, 22 bp, Homo sapiens
gccaggtctgcaggcatcctga

SEQ ID NO: 9372518 - DNA, 22 bp, Homo sapiens
gccaggtcgtctccatgtccaa

SEQ ID NO: 9372519 - DNA, 22 bp, Homo sapiens
gccaggtctaagcatcagccac

SEQ ID NO: 9372520 - DNA, 22 bp, Homo sapiens
gccaggtggctgagtgactgag

SEQ ID NO: 9372521 - DNA, 22 bp, Homo sapiens
gccaggtctgggtagcagagga

SEQ ID NO: 9372522 - DNA, 22 bp, Homo sapiens
gccaggtctgggtagcagagga

SEQ ID NO: 9372523 - DNA, 22 bp, Homo sapiens
gccaggtgggagacagacagca

SEQ ID NO: 9372524 - DNA, 22 bp, Homo sapiens
gccaggtgggagacagacagca

SEQ ID NO: 9372525 - DNA, 22 bp, Homo sapiens
gccaggtgtcctcacagtgagg

SEQ ID NO: 9372526 - DNA, 22 bp, Homo sapiens
gccaggtggtctggctccagag

SEQ ID NO: 9372527 - DNA, 22 bp, Homo sapiens
gccaggtggtctggctccagag

SEQ ID NO: 9372528 - DNA, 22 bp, Homo sapiens
gccaggtgtagtggccacacct

SEQ ID NO: 9372529 - DNA, 22 bp, Homo sapiens
gccaggtggtctggctccagag

SEQ ID NO: 9372530 - DNA, 22 bp, Homo sapiens
gccaggagttcagatgcatgtt

SEQ ID NO: 9372531 - DNA, 22 bp, Homo sapiens
gccaggagttcagatgcatgtt

SEQ ID NO: 9372532 - DNA, 22 bp, Homo sapiens
gccaggagttcagatgcatgtt

SEQ ID NO: 9372533 - DNA, 22 bp, Homo sapiens
gccaggagttcagatgcatgtt

SEQ ID NO: 9372534 - DNA, 22 bp, Homo sapiens
gccaggcaaattaaggaatgca

SEQ ID NO: 9372535 - DNA, 22 bp, Homo sapiens
gccaggcaatgtgttagaagcg

SEQ ID NO: 9372536 - DNA, 22 bp, Homo sapiens
gccaggcaaattaaggaatgca

SEQ ID NO: 9372537 - DNA, 22 bp, Homo sapiens
gccaggcaaattaaggaatgca

SEQ ID NO: 9372538 - DNA, 22 bp, Homo sapiens
gccaggtcccctcatggctcct

SEQ ID NO: 9372539 - DNA, 22 bp, Homo sapiens
gccaggtccagggtggagcgct

SEQ ID NO: 9372540 - DNA, 23 bp, Homo sapiens
gccaggcacatggtggacacgca

SEQ ID NO: 9372541 - DNA, 23 bp, Homo sapiens
gccaggcacatggtggacacgca

SEQ ID NO: 9372542 - DNA, 23 bp, Homo sapiens
gccaggcacatggtggacacgca

SEQ ID NO: 9372543 - DNA, 22 bp, Homo sapiens
gccaggcacagttctaggtgct

SEQ ID NO: 9372544 - DNA, 22 bp, Homo sapiens
gccaggcacagttctaggtgct

SEQ ID NO: 9372545 - DNA, 22 bp, Homo sapiens
gccaggcacagttctaggtgct

SEQ ID NO: 9372546 - DNA, 22 bp, Homo sapiens
gccaggcaatgtgttagaagcg

SEQ ID NO: 9372547 - DNA, 22 bp, Homo sapiens
gcccactgagtgactccctcag

SEQ ID NO: 9372548 - DNA, 22 bp, Homo sapiens
gcccagagagatgaagtgatgg

SEQ ID NO: 9372549 - DNA, 22 bp, Homo sapiens
gcccagagggaagaggtgtcat

SEQ ID NO: 9372550 - DNA, 18 bp, Homo sapiens
gcccagaggtctgggccc

SEQ ID NO: 9372551 - DNA, 23 bp, Homo sapiens
gcccagagaggctcaccaggaat

SEQ ID NO: 9372552 - DNA, 22 bp, Homo sapiens
gcccagagggaagaggtgtcat

SEQ ID NO: 9372553 - DNA, 22 bp, Homo sapiens
gcccagagtgagtcctgggccc

SEQ ID NO: 9372554 - DNA, 22 bp, Homo sapiens
gcccagagtgagtcctgggccc

SEQ ID NO: 9372555 - DNA, 22 bp, Homo sapiens
gcccacagtacgaggctcaggc

SEQ ID NO: 9372556 - DNA, 22 bp, Homo sapiens
gcccacagtacgaggctcaggc

SEQ ID NO: 9372557 - DNA, 22 bp, Homo sapiens
gcccacagtacgaggctcaggc

SEQ ID NO: 9372558 - DNA, 22 bp, Homo sapiens
gcccacagtacgaggctcaggc

SEQ ID NO: 9372559 - DNA, 22 bp, Homo sapiens
gccagtggcttgccaggcagga

SEQ ID NO: 9372560 - DNA, 22 bp, Homo sapiens
gccagtggcttgccaggcagga

SEQ ID NO: 9372561 - DNA, 22 bp, Homo sapiens
gcccacaggggacctggtggct

SEQ ID NO: 9372562 - DNA, 22 bp, Homo sapiens
gcccacagtacgaggctcaggc

SEQ ID NO: 9372563 - DNA, 22 bp, Homo sapiens
gccagtggccctctggagaagg

SEQ ID NO: 9372564 - DNA, 22 bp, Homo sapiens
gccagtggccctctggagaagg

SEQ ID NO: 9372565 - DNA, 22 bp, Homo sapiens
gccagtggcttgccaggcagga

SEQ ID NO: 9372566 - DNA, 22 bp, Homo sapiens
gccagtggccctctggagaagg

SEQ ID NO: 9372567 - DNA, 22 bp, Homo sapiens
gccagtggatgaggacttaact

SEQ ID NO: 9372568 - DNA, 22 bp, Homo sapiens
gccagtggaggacccatggaga

SEQ ID NO: 9372569 - DNA, 22 bp, Homo sapiens
gccagtggaggacccatggaga

SEQ ID NO: 9372570 - DNA, 22 bp, Homo sapiens
gccagtggcatgcggcagggac

SEQ ID NO: 9372571 - DNA, 22 bp, Homo sapiens
gccagtggcatgcggcagggac

SEQ ID NO: 9372572 - DNA, 22 bp, Homo sapiens
gccagtggcatgcggcagggac

SEQ ID NO: 9372573 - DNA, 22 bp, Homo sapiens
gccaggttctggggaggtacaa

SEQ ID NO: 9372574 - DNA, 22 bp, Homo sapiens
gccaggttgctgacgacgatct

SEQ ID NO: 9372575 - DNA, 22 bp, Homo sapiens
gccaggttgctgacgacgatct

SEQ ID NO: 9372576 - DNA, 22 bp, Homo sapiens
gccaggttgctgacgacgatct

SEQ ID NO: 9372577 - DNA, 22 bp, Homo sapiens
gccagtctgctcccacaagttc

SEQ ID NO: 9372578 - DNA, 22 bp, Homo sapiens
gccagtcagctggccaggctgg

SEQ ID NO: 9372579 - DNA, 22 bp, Homo sapiens
gccagtcagctggccaggctgg

SEQ ID NO: 9372580 - DNA, 22 bp, Homo sapiens
gccagtctccctcagtcctctg

SEQ ID NO: 9372581 - DNA, 22 bp, Homo sapiens
gccagtggagactgaaacccat

SEQ ID NO: 9372582 - DNA, 22 bp, Homo sapiens
gccagtggagactgaaacccat

SEQ ID NO: 9372583 - DNA, 22 bp, Homo sapiens
gccagtggagcacatggtgaag

SEQ ID NO: 9372584 - DNA, 22 bp, Homo sapiens
gccagtggagcacatggtgaag

SEQ ID NO: 9372585 - DNA, 22 bp, Homo sapiens
gccagtgcttgtggagctggca

SEQ ID NO: 9372586 - DNA, 18 bp, Homo sapiens
gccagtgccctggctcac

SEQ ID NO: 9372587 - DNA, 18 bp, Homo sapiens
gccagtgccctggctcac

SEQ ID NO: 9372588 - DNA, 22 bp, Homo sapiens
gccagtgcctgctgctcagggc

SEQ ID NO: 9372589 - DNA, 22 bp, Homo sapiens
gccagtgcctgctgctcagggc

SEQ ID NO: 9372590 - DNA, 22 bp, Homo sapiens
gcagggctcagccgctcccacc

SEQ ID NO: 9372591 - DNA, 22 bp, Homo sapiens
gcagggctcagccgctcccacc

SEQ ID NO: 9372592 - DNA, 22 bp, Homo sapiens
gcagggctcattgccaggcatt

SEQ ID NO: 9372593 - DNA, 22 bp, Homo sapiens
gcagggctcattctagtacaat

SEQ ID NO: 9372594 - DNA, 22 bp, Homo sapiens
gcagggctcagccgctcccacc

SEQ ID NO: 9372595 - DNA, 22 bp, Homo sapiens
gcagggctcagccgctcccacc

SEQ ID NO: 9372596 - DNA, 22 bp, Homo sapiens
gcagggctcaacaggacacccc

SEQ ID NO: 9372597 - DNA, 22 bp, Homo sapiens
gcagggctcaacaggacacccc

SEQ ID NO: 9372598 - DNA, 22 bp, Homo sapiens
gcagggctccccaggcccgagg

SEQ ID NO: 9372599 - DNA, 22 bp, Homo sapiens
gcagggctccactgtggccaag

SEQ ID NO: 9372600 - DNA, 22 bp, Homo sapiens
gcagggctccactgtggccaag

SEQ ID NO: 9372601 - DNA, 22 bp, Homo sapiens
gcagggctccactgtggccaag

SEQ ID NO: 9372602 - DNA, 22 bp, Homo sapiens
gcagggctcattgccaggcatt

SEQ ID NO: 9372603 - DNA, 22 bp, Homo sapiens
gcagggctcattgccaggcatt

SEQ ID NO: 9372604 - DNA, 22 bp, Homo sapiens
gcagggctcattctagtacaat

SEQ ID NO: 9372605 - DNA, 22 bp, Homo sapiens
gcagggctcattgccaggcatt

SEQ ID NO: 9372606 - DNA, 22 bp, Homo sapiens
gcagggctcattgccaggcatt

SEQ ID NO: 9372607 - DNA, 19 bp, Homo sapiens
gcagggctctcccagatgc

SEQ ID NO: 9372608 - DNA, 22 bp, Homo sapiens
gcagggctccccaggcccgagg

SEQ ID NO: 9372609 - DNA, 19 bp, Homo sapiens
gcagggctctcccagatgc

SEQ ID NO: 9372610 - DNA, 22 bp, Homo sapiens
gcagggctctgctgtagtccta

SEQ ID NO: 9372611 - DNA, 22 bp, Homo sapiens
gcagggctctgctgtagtccta

SEQ ID NO: 9372612 - DNA, 22 bp, Homo sapiens
gcagggctctgctgtagtccta

SEQ ID NO: 9372613 - DNA, 22 bp, Homo sapiens
gcagtatatggattttaaacat

SEQ ID NO: 9372614 - DNA, 22 bp, Homo sapiens
gcagtatctatgtgatgggttg

SEQ ID NO: 9372615 - DNA, 22 bp, Homo sapiens
gcagtcacagggagatggtgac

SEQ ID NO: 9372616 - DNA, 22 bp, Homo sapiens
gcagtcagacaggaggagctcc

SEQ ID NO: 9372617 - DNA, 21 bp, Homo sapiens
gcagtcactcggttggctacc

SEQ ID NO: 9372618 - DNA, 22 bp, Homo sapiens
gcagtcacagggagatggtgac

SEQ ID NO: 9372619 - DNA, 22 bp, Homo sapiens
gcagtcagtaaggcagccagaa

SEQ ID NO: 9372620 - DNA, 22 bp, Homo sapiens
gcagtcagtaaggcagccagaa

SEQ ID NO: 9372621 - DNA, 22 bp, Homo sapiens
gcagtcagacaggaggagctcc

SEQ ID NO: 9372622 - DNA, 22 bp, Homo sapiens
gcagtcagtgttgactacatgc

SEQ ID NO: 9372623 - DNA, 22 bp, Homo sapiens
gcagtccattgacagaggtctt

SEQ ID NO: 9372624 - DNA, 22 bp, Homo sapiens
gcagtcctagggtgctctgcag

SEQ ID NO: 9372625 - DNA, 22 bp, Homo sapiens
gcagtccccgtcgtggcaggga

SEQ ID NO: 9372626 - DNA, 22 bp, Homo sapiens
gcagtccccgtcgtggcaggga

SEQ ID NO: 9372627 - DNA, 22 bp, Homo sapiens
gcagtccccgtcgtggcaggga

SEQ ID NO: 9372628 - DNA, 22 bp, Homo sapiens
gcagtcctctcattggcctcct

SEQ ID NO: 9372629 - DNA, 20 bp, Homo sapiens
gcagtctgtcacagagcatg

SEQ ID NO: 9372630 - DNA, 22 bp, Homo sapiens
gcagtctttgagtatcttcaaa

SEQ ID NO: 9372631 - DNA, 22 bp, Homo sapiens
gcagtgaacataacacagaagg

SEQ ID NO: 9372632 - DNA, 18 bp, Homo sapiens
gcagtgaagaaagagctt

SEQ ID NO: 9372633 - DNA, 22 bp, Homo sapiens
gcagtgaaaaagtgcaccctgt

SEQ ID NO: 9372634 - DNA, 22 bp, Homo sapiens
gcagtctttttcttctagctaa

SEQ ID NO: 9372635 - DNA, 22 bp, Homo sapiens
gcagtctttgagtatcttcaaa

SEQ ID NO: 9372636 - DNA, 22 bp, Homo sapiens
gcagtctttttcttctagctaa

SEQ ID NO: 9372637 - DNA, 20 bp, Homo sapiens
gcatccatatatgcatgtgt

SEQ ID NO: 9372638 - DNA, 22 bp, Homo sapiens
gcatccatgcatgcagggtgtg

SEQ ID NO: 9372639 - DNA, 22 bp, Homo sapiens
gcatccatcagcagattgactg

SEQ ID NO: 9372640 - DNA, 22 bp, Homo sapiens
gcatccattgtttatgtgtttc

SEQ ID NO: 9372641 - DNA, 22 bp, Homo sapiens
gcatccattcactcaacttaga

SEQ ID NO: 9372642 - DNA, 22 bp, Homo sapiens
gcatccatggagagcactctga

SEQ ID NO: 9372643 - DNA, 19 bp, Homo sapiens
gcatccatggaggccgctt

SEQ ID NO: 9372644 - DNA, 22 bp, Homo sapiens
gcatccctctgaggggccaggc

SEQ ID NO: 9372645 - DNA, 20 bp, Homo sapiens
gcatcctcccagcagagctg

SEQ ID NO: 9372646 - DNA, 22 bp, Homo sapiens
gcatccctctgaggggccaggc

SEQ ID NO: 9372647 - DNA, 22 bp, Homo sapiens
gcatctaaataaacgtgggagt

SEQ ID NO: 9372648 - DNA, 22 bp, Homo sapiens
gcatccagaggtagccactgtg

SEQ ID NO: 9372649 - DNA, 22 bp, Homo sapiens
gcatccagaggtagccactgtg

SEQ ID NO: 9372650 - DNA, 22 bp, Homo sapiens
gcatccagtcttggctcctgga

SEQ ID NO: 9372651 - DNA, 19 bp, Homo sapiens
gcataaatacactattgtc

SEQ ID NO: 9372652 - DNA, 19 bp, Homo sapiens
gcataaatacactattgtc

SEQ ID NO: 9372653 - DNA, 22 bp, Homo sapiens
gcatgaggttcttggccagcat

SEQ ID NO: 9372654 - DNA, 22 bp, Homo sapiens
gcatgaggggggttaggaagtt

SEQ ID NO: 9372655 - DNA, 22 bp, Homo sapiens
gcatgataccataggttttgcc

SEQ ID NO: 9372656 - DNA, 22 bp, Homo sapiens
gcatgaggggggttaggaagtt

SEQ ID NO: 9372657 - DNA, 22 bp, Homo sapiens
gcatgacattcctaatcacagt

SEQ ID NO: 9372658 - DNA, 22 bp, Homo sapiens
gcatctgttagagtgtgcatgc

SEQ ID NO: 9372659 - DNA, 22 bp, Homo sapiens
gcatctgatccaatagatatat

SEQ ID NO: 9372660 - DNA, 22 bp, Homo sapiens
gcatttgaaatgcaagaaagtg

SEQ ID NO: 9372661 - DNA, 22 bp, Homo sapiens
gcatttgagcacattttaaaga

SEQ ID NO: 9372662 - DNA, 22 bp, Homo sapiens
gcatttgaaatcctctgtgacg

SEQ ID NO: 9372663 - DNA, 22 bp, Homo sapiens
gcatttcttcctggtgtgagcc

SEQ ID NO: 9372664 - DNA, 22 bp, Homo sapiens
gcatttctgtgcatacacatga

SEQ ID NO: 9372665 - DNA, 22 bp, Homo sapiens
gcatttctgtgcatacacatga

SEQ ID NO: 9372666 - DNA, 19 bp, Homo sapiens
gcatttctctttacagcca

SEQ ID NO: 9372667 - DNA, 22 bp, Homo sapiens
gcatttcctgtgcttggcatat

SEQ ID NO: 9372668 - DNA, 22 bp, Homo sapiens
gcatttcatgtagattgagaac

SEQ ID NO: 9372669 - DNA, 22 bp, Homo sapiens
gcatgatagctaactcccctca

SEQ ID NO: 9372670 - DNA, 22 bp, Homo sapiens
gccagcagtatgtcctggcagt

SEQ ID NO: 9372671 - DNA, 22 bp, Homo sapiens
gccagcaggttgtcaaggagct

SEQ ID NO: 9372672 - DNA, 22 bp, Homo sapiens
gccagcaggttgtcaaggagct

SEQ ID NO: 9372673 - DNA, 22 bp, Homo sapiens
gccagcaggttgtcaaggagct

SEQ ID NO: 9372674 - DNA, 22 bp, Homo sapiens
gccagcagggcggagccatcta

SEQ ID NO: 9372675 - DNA, 22 bp, Homo sapiens
gccagcaggtggagagatcaag

SEQ ID NO: 9372676 - DNA, 22 bp, Homo sapiens
gccagcaggtggagagatcaag

SEQ ID NO: 9372677 - DNA, 22 bp, Homo sapiens
gccagcagggcggagccatcta

SEQ ID NO: 9372678 - DNA, 22 bp, Homo sapiens
gccagaggcccaaggacagctg

SEQ ID NO: 9372679 - DNA, 22 bp, Homo sapiens
gccagaggcccaaggacagctg

SEQ ID NO: 9372680 - DNA, 22 bp, Homo sapiens
gccagaggaacgctgcgcgccc

SEQ ID NO: 9372681 - DNA, 22 bp, Homo sapiens
gccagagctgagtgaggttctt

SEQ ID NO: 9372682 - DNA, 22 bp, Homo sapiens
gccagagctgagtgaggttctt

SEQ ID NO: 9372683 - DNA, 22 bp, Homo sapiens
gccagagctgagacacgagtcc

SEQ ID NO: 9372684 - DNA, 22 bp, Homo sapiens
gccagagctgagacacgagtcc

SEQ ID NO: 9372685 - DNA, 22 bp, Homo sapiens
gccagagctgagacacgagtcc

SEQ ID NO: 9372686 - DNA, 23 bp, Homo sapiens
gccagaggaacgcagagctttct

SEQ ID NO: 9372687 - DNA, 22 bp, Homo sapiens
gccagagcttggtttttattta

SEQ ID NO: 9372688 - DNA, 22 bp, Homo sapiens
gccagagcttcccccgagtgtg

SEQ ID NO: 9372689 - DNA, 23 bp, Homo sapiens
gccagagctgcctgcccttgctg

SEQ ID NO: 9372690 - DNA, 22 bp, Homo sapiens
gccagagcttcccccgagtgtg

SEQ ID NO: 9372691 - DNA, 23 bp, Homo sapiens
gccagagctgcctgcccttgctg

SEQ ID NO: 9372692 - DNA, 22 bp, Homo sapiens
gccagagcttcccccgagtgtg

SEQ ID NO: 9372693 - DNA, 22 bp, Homo sapiens
gccagcagtcctgctgtgtgcc

SEQ ID NO: 9372694 - DNA, 22 bp, Homo sapiens
gccagcagtcctgctgtgtgcc

SEQ ID NO: 9372695 - DNA, 22 bp, Homo sapiens
gccagcagtatgtcctggcagt

SEQ ID NO: 9372696 - DNA, 22 bp, Homo sapiens
gccagcagtatgtcctggcagt

SEQ ID NO: 9372697 - DNA, 22 bp, Homo sapiens
gccagcagtggccaccaccagg

SEQ ID NO: 9372698 - DNA, 22 bp, Homo sapiens
gccagcccattaacccctgtcc

SEQ ID NO: 9372699 - DNA, 22 bp, Homo sapiens
gccagcccattaacccctgtcc

SEQ ID NO: 9372700 - DNA, 22 bp, Homo sapiens
gccagcccattaacccctgtcc

SEQ ID NO: 9372701 - DNA, 22 bp, Homo sapiens
gccagcccattaacccctgtcc

SEQ ID NO: 9372702 - DNA, 22 bp, Homo sapiens
gccagcccagctccaggggaaa

SEQ ID NO: 9372703 - DNA, 21 bp, Homo sapiens
gccagccatgcttgcctaggc

SEQ ID NO: 9372704 - DNA, 22 bp, Homo sapiens
gccagcccagctccaggggaaa

SEQ ID NO: 9372705 - DNA, 21 bp, Homo sapiens
gccagccatgcttgcctaggc

SEQ ID NO: 9372706 - DNA, 22 bp, Homo sapiens
gccagcccctccatcctgttca

SEQ ID NO: 9372707 - DNA, 22 bp, Homo sapiens
gccagcccctccatcctgttca

SEQ ID NO: 9372708 - DNA, 22 bp, Homo sapiens
gccagccccagacatcctatcg

SEQ ID NO: 9372709 - DNA, 22 bp, Homo sapiens
gccagccccttagggctctccc

SEQ ID NO: 9372710 - DNA, 22 bp, Homo sapiens
gccagcccctccatcctgttca

SEQ ID NO: 9372711 - DNA, 22 bp, Homo sapiens
gccagccccttagggctctccc

SEQ ID NO: 9372712 - DNA, 22 bp, Homo sapiens
gccaaggcctctgcaggatgag

SEQ ID NO: 9372713 - DNA, 22 bp, Homo sapiens
gccaaggcctgcagcacctcat

SEQ ID NO: 9372714 - DNA, 22 bp, Homo sapiens
gccaaggcctgcagcacctcat

SEQ ID NO: 9372715 - DNA, 22 bp, Homo sapiens
gccaaggcctgcagcacctcat

SEQ ID NO: 9372716 - DNA, 22 bp, Homo sapiens
gccaaggcctctgcaggatgag

SEQ ID NO: 9372717 - DNA, 22 bp, Homo sapiens
gcatttttctctcctataggag

SEQ ID NO: 9372718 - DNA, 22 bp, Homo sapiens
gccaagctttgcaggagtgttg

SEQ ID NO: 9372719 - DNA, 18 bp, Homo sapiens
gcattttaatctgaggca

SEQ ID NO: 9372720 - DNA, 22 bp, Homo sapiens
gcatttgtgtggcggaaggatt

SEQ ID NO: 9372721 - DNA, 22 bp, Homo sapiens
gcattttagaatattggagcaa

SEQ ID NO: 9372722 - DNA, 22 bp, Homo sapiens
gcattttaatgaggtttatgag

SEQ ID NO: 9372723 - DNA, 22 bp, Homo sapiens
gcattttgaggctgggggagca

SEQ ID NO: 9372724 - DNA, 22 bp, Homo sapiens
gcattttataaagagttatttg

SEQ ID NO: 9372725 - DNA, 22 bp, Homo sapiens
gcatttttctaatcattggcat

SEQ ID NO: 9372726 - DNA, 22 bp, Homo sapiens
gcatttttcatccctcttgggt

SEQ ID NO: 9372727 - DNA, 22 bp, Homo sapiens
gccagagcagaatagagtggcc

SEQ ID NO: 9372728 - DNA, 21 bp, Homo sapiens
gccagagcagtacaatgaggt

SEQ ID NO: 9372729 - DNA, 21 bp, Homo sapiens
gccagagcagtacaatgaggt

SEQ ID NO: 9372730 - DNA, 22 bp, Homo sapiens
gccagagcagaatagagtggcc

SEQ ID NO: 9372731 - DNA, 22 bp, Homo sapiens
gccagagcagaatagagtggcc

SEQ ID NO: 9372732 - DNA, 21 bp, Homo sapiens
gccagagcagtacaatgaggt

SEQ ID NO: 9372733 - DNA, 22 bp, Homo sapiens
gccagagcatgcactgcctgca

SEQ ID NO: 9372734 - DNA, 22 bp, Homo sapiens
gccagagcatcgcaccctccat

SEQ ID NO: 9372735 - DNA, 18 bp, Homo sapiens
gccagagcatatctccag

SEQ ID NO: 9372736 - DNA, 22 bp, Homo sapiens
gccagagccggcttcacaggat

SEQ ID NO: 9372737 - DNA, 22 bp, Homo sapiens
gccagagccggcttcacaggat

SEQ ID NO: 9372738 - DNA, 22 bp, Homo sapiens
gccagagcctgtggatttaacc

SEQ ID NO: 9372739 - DNA, 22 bp, Homo sapiens
gccagagctgagacacgagtcc

SEQ ID NO: 9372740 - DNA, 22 bp, Homo sapiens
gccagagccggcttcacaggat

SEQ ID NO: 9372741 - DNA, 22 bp, Homo sapiens
gccagagccggcttcacaggat

SEQ ID NO: 9372742 - DNA, 22 bp, Homo sapiens
gccagagccacttttgggtgat

SEQ ID NO: 9372743 - DNA, 22 bp, Homo sapiens
gccagagcatgcactgcctgca

SEQ ID NO: 9372744 - DNA, 22 bp, Homo sapiens
gccagagcatgcactgcctgca

SEQ ID NO: 9372745 - DNA, 22 bp, Homo sapiens
gccagagcatgcactgcctgca

SEQ ID NO: 9372746 - DNA, 22 bp, Homo sapiens
gccaataaaatctgtgcatatt

SEQ ID NO: 9372747 - DNA, 22 bp, Homo sapiens
gccaagggaactgagccggagg

SEQ ID NO: 9372748 - DNA, 22 bp, Homo sapiens
gccagagcacaggctggtagta

SEQ ID NO: 9372749 - DNA, 22 bp, Homo sapiens
gccagagcacaggctggtagta

SEQ ID NO: 9372750 - DNA, 18 bp, Homo sapiens
gcactctgactgcagagc

SEQ ID NO: 9372751 - DNA, 22 bp, Homo sapiens
gcactgaaaatgttggattcca

SEQ ID NO: 9372752 - DNA, 17 bp, Homo sapiens
gcactcccccacctcct

SEQ ID NO: 9372753 - DNA, 17 bp, Homo sapiens
gcactcccccacctcct

SEQ ID NO: 9372754 - DNA, 22 bp, Homo sapiens
gcactctcctggctgccacagt

SEQ ID NO: 9372755 - DNA, 22 bp, Homo sapiens
gcactctcctggctgccacagt

SEQ ID NO: 9372756 - DNA, 22 bp, Homo sapiens
gcacaggcacagagggccactg

SEQ ID NO: 9372757 - DNA, 22 bp, Homo sapiens
gcacaggccatgggaggacagc

SEQ ID NO: 9372758 - DNA, 22 bp, Homo sapiens
gcacctgggacccagaggcacc

SEQ ID NO: 9372759 - DNA, 22 bp, Homo sapiens
gcacctgggcaaggattcagag

SEQ ID NO: 9372760 - DNA, 22 bp, Homo sapiens
gcacctgggcaaggattcagag

SEQ ID NO: 9372761 - DNA, 22 bp, Homo sapiens
gcactgaatgccaaagtgtagg

SEQ ID NO: 9372762 - DNA, 22 bp, Homo sapiens
gcactgagcaccagccacagat

SEQ ID NO: 9372763 - DNA, 23 bp, Homo sapiens
gcactgagctcactagtcccctg

SEQ ID NO: 9372764 - DNA, 22 bp, Homo sapiens
gcactgagtctgtcatgctgca

SEQ ID NO: 9372765 - DNA, 21 bp, Homo sapiens
gcactgagcatctcctctgcc

SEQ ID NO: 9372766 - DNA, 22 bp, Homo sapiens
gcactgagcaccagccacagat

SEQ ID NO: 9372767 - DNA, 17 bp, Homo sapiens
gcactgagccacagttt

SEQ ID NO: 9372768 - DNA, 21 bp, Homo sapiens
gcactgagcatctcctctgcc

SEQ ID NO: 9372769 - DNA, 22 bp, Homo sapiens
gcactgcctgtgttcagggtaa

SEQ ID NO: 9372770 - DNA, 22 bp, Homo sapiens
gcactgcctgtgagccctggtt

SEQ ID NO: 9372771 - DNA, 22 bp, Homo sapiens
gcactgccatcaatgcatgaca

SEQ ID NO: 9372772 - DNA, 23 bp, Homo sapiens
gcactgccatgtgctctgcaggc

SEQ ID NO: 9372773 - DNA, 23 bp, Homo sapiens
gcactgccatgtgctctgcaggc

SEQ ID NO: 9372774 - DNA, 22 bp, Homo sapiens
gcactgagtctgtcatgctgca

SEQ ID NO: 9372775 - DNA, 22 bp, Homo sapiens
gcactgagtctgtcatgctgca

SEQ ID NO: 9372776 - DNA, 22 bp, Homo sapiens
gcactgagtctgtcatgctgca

SEQ ID NO: 9372777 - DNA, 22 bp, Homo sapiens
gcactgccacataatctcagca

SEQ ID NO: 9372778 - DNA, 22 bp, Homo sapiens
gcactgggaatgagggcagctt

SEQ ID NO: 9372779 - DNA, 22 bp, Homo sapiens
gcactgggaagaatgagcctgt

SEQ ID NO: 9372780 - DNA, 22 bp, Homo sapiens
gcactggatcttgggagacgtg

SEQ ID NO: 9372781 - DNA, 22 bp, Homo sapiens
gcactggagggtgtagttgctg

SEQ ID NO: 9372782 - DNA, 22 bp, Homo sapiens
gcactggagatacagagatgaa

SEQ ID NO: 9372783 - DNA, 22 bp, Homo sapiens
gcactggagatggggttgtcgg

SEQ ID NO: 9372784 - DNA, 22 bp, Homo sapiens
gcactggagaatggctgtattc

SEQ ID NO: 9372785 - DNA, 22 bp, Homo sapiens
gcactggagatacagagatgaa

SEQ ID NO: 9372786 - DNA, 22 bp, Homo sapiens
gcactggaccccaggatatgga

SEQ ID NO: 9372787 - DNA, 22 bp, Homo sapiens
gcactggaaatacctagatgaa

SEQ ID NO: 9372788 - DNA, 22 bp, Homo sapiens
gcactggaaggagggaatctta

SEQ ID NO: 9372789 - DNA, 22 bp, Homo sapiens
gcactggacaggagtgaaatta

SEQ ID NO: 9372790 - DNA, 22 bp, Homo sapiens
gcacttctatttttttcagtgg

SEQ ID NO: 9372791 - DNA, 22 bp, Homo sapiens
gcactgtgctagaagccagggg

SEQ ID NO: 9372792 - DNA, 22 bp, Homo sapiens
gcactgtgcttagttcactatt

SEQ ID NO: 9372793 - DNA, 22 bp, Homo sapiens
gcacttcacatgccttttcctg

SEQ ID NO: 9372794 - DNA, 22 bp, Homo sapiens
gcacttatggcatcttcctgtg

SEQ ID NO: 9372795 - DNA, 22 bp, Homo sapiens
gcacttatggcatcttcctgtg

SEQ ID NO: 9372796 - DNA, 22 bp, Homo sapiens
gcacttacatactctgcataca

SEQ ID NO: 9372797 - DNA, 22 bp, Homo sapiens
gcacttatgctcaccttgttct

SEQ ID NO: 9372798 - DNA, 23 bp, Homo sapiens
gcactgggctctcagcaaggtgt

SEQ ID NO: 9372799 - DNA, 22 bp, Homo sapiens
gcactgggctccaggaaggagg

SEQ ID NO: 9372800 - DNA, 22 bp, Homo sapiens
gcactgggaatgctgatgggct

SEQ ID NO: 9372801 - DNA, 22 bp, Homo sapiens
gcactgggaatgctgatgggct

SEQ ID NO: 9372802 - DNA, 22 bp, Homo sapiens
gcactgggaatgtgagcagctg

SEQ ID NO: 9372803 - DNA, 22 bp, Homo sapiens
gcagaggacacaggagggcaag

SEQ ID NO: 9372804 - DNA, 21 bp, Homo sapiens
gcagaggaatggtatacataa

SEQ ID NO: 9372805 - DNA, 21 bp, Homo sapiens
gcagaggaatggtatacataa

SEQ ID NO: 9372806 - DNA, 22 bp, Homo sapiens
gcagaggacacaggagggcaag

SEQ ID NO: 9372807 - DNA, 22 bp, Homo sapiens
gcagaggacacaggagggcaag

SEQ ID NO: 9372808 - DNA, 22 bp, Homo sapiens
gcagagctgcagcgaggcctgg

SEQ ID NO: 9372809 - DNA, 22 bp, Homo sapiens
gcagagctgagcggctgcccgg

SEQ ID NO: 9372810 - DNA, 22 bp, Homo sapiens
gcagagctctgttcttatctcc

SEQ ID NO: 9372811 - DNA, 22 bp, Homo sapiens
gcagaggacagggatttagatt

SEQ ID NO: 9372812 - DNA, 22 bp, Homo sapiens
gcagaggacacaggagggcaag

SEQ ID NO: 9372813 - DNA, 22 bp, Homo sapiens
gcagaggagatgaagatacttt

SEQ ID NO: 9372814 - DNA, 22 bp, Homo sapiens
gcagaggactcaatcaaggtat

SEQ ID NO: 9372815 - DNA, 22 bp, Homo sapiens
gcagaggactcaatcaaggtat

SEQ ID NO: 9372816 - DNA, 22 bp, Homo sapiens
gcagaggacagggatttagatt

SEQ ID NO: 9372817 - DNA, 22 bp, Homo sapiens
gcagaggagcaagctggacacc

SEQ ID NO: 9372818 - DNA, 22 bp, Homo sapiens
gcagaggagcaagctggacacc

SEQ ID NO: 9372819 - DNA, 22 bp, Homo sapiens
gcagaggagcaagctggacacc

SEQ ID NO: 9372820 - DNA, 22 bp, Homo sapiens
gcagaggagatgaagatacttt

SEQ ID NO: 9372821 - DNA, 22 bp, Homo sapiens
gcagaggagcaagctggacacc

SEQ ID NO: 9372822 - DNA, 23 bp, Homo sapiens
gcagaggagcaagctggacacca

SEQ ID NO: 9372823 - DNA, 21 bp, Homo sapiens
gcacagcatgagtgttggcat

SEQ ID NO: 9372824 - DNA, 22 bp, Homo sapiens
gcacagccactgagtgagaacc

SEQ ID NO: 9372825 - DNA, 22 bp, Homo sapiens
gcacagccacgtaatgtggtca

SEQ ID NO: 9372826 - DNA, 22 bp, Homo sapiens
gcacagccagcatctgagggat

SEQ ID NO: 9372827 - DNA, 22 bp, Homo sapiens
gcaagctgtgccttctcaggat

SEQ ID NO: 9372828 - DNA, 22 bp, Homo sapiens
gcaagctggctgttagaggatg

SEQ ID NO: 9372829 - DNA, 22 bp, Homo sapiens
gcaagcttcatatggcattttc

SEQ ID NO: 9372830 - DNA, 22 bp, Homo sapiens
gcaagcagcccagaacagctct

SEQ ID NO: 9372831 - DNA, 22 bp, Homo sapiens
gcaagctgatgtgatagtgaaa

SEQ ID NO: 9372832 - DNA, 22 bp, Homo sapiens
gcaagctgatgtgatagtgaaa

SEQ ID NO: 9372833 - DNA, 22 bp, Homo sapiens
gcaagcagttgtggcttctgag

SEQ ID NO: 9372834 - DNA, 22 bp, Homo sapiens
gcaagctgctcttatgtggagg

SEQ ID NO: 9372835 - DNA, 22 bp, Homo sapiens
gcaagctgctcttatgtggagg

SEQ ID NO: 9372836 - DNA, 22 bp, Homo sapiens
gcacaggcacagagggccactg

SEQ ID NO: 9372837 - DNA, 22 bp, Homo sapiens
gcacaggcacagagggccactg

SEQ ID NO: 9372838 - DNA, 22 bp, Homo sapiens
gcacaggcaatagatacagcta

SEQ ID NO: 9372839 - DNA, 22 bp, Homo sapiens
gcacaggagccaggtccttcac

SEQ ID NO: 9372840 - DNA, 19 bp, Homo sapiens
gcacaggacatctgatgga

SEQ ID NO: 9372841 - DNA, 22 bp, Homo sapiens
gcacaggaggccgatgctcatg

SEQ ID NO: 9372842 - DNA, 22 bp, Homo sapiens
gcacagctggactctgcctggc

SEQ ID NO: 9372843 - DNA, 22 bp, Homo sapiens
gcacagctcagcatgggaggac

SEQ ID NO: 9372844 - DNA, 18 bp, Homo sapiens
gcacagctaggagggtcc

SEQ ID NO: 9372845 - DNA, 18 bp, Homo sapiens
gcacagctaggagggtcc

SEQ ID NO: 9372846 - DNA, 22 bp, Homo sapiens
gcacagctcgagctcaggaggg

SEQ ID NO: 9372847 - DNA, 22 bp, Homo sapiens
gcacagccctggtcggggcccc

SEQ ID NO: 9372848 - DNA, 22 bp, Homo sapiens
gcacagcctgtccctgtcctgg

SEQ ID NO: 9372849 - DNA, 22 bp, Homo sapiens
gcacagccttgccctgtgccct

SEQ ID NO: 9372850 - DNA, 22 bp, Homo sapiens
gcacagccttgccctgtgccct

SEQ ID NO: 9372851 - DNA, 22 bp, Homo sapiens
gaggggtcacatgggctggctt

SEQ ID NO: 9372852 - DNA, 22 bp, Homo sapiens
gaggggtcacatgggctggctt

SEQ ID NO: 9372853 - DNA, 22 bp, Homo sapiens
gaggggtcttttgttgtcaggg

SEQ ID NO: 9372854 - DNA, 22 bp, Homo sapiens
gaggggtcctgccttggctgga

SEQ ID NO: 9372855 - DNA, 22 bp, Homo sapiens
gaggggtgtggagccatcagtt

SEQ ID NO: 9372856 - DNA, 22 bp, Homo sapiens
gaggggtgtggagccatcagtt

SEQ ID NO: 9372857 - DNA, 22 bp, Homo sapiens
gaggggtgtggagccatcagtt

SEQ ID NO: 9372858 - DNA, 22 bp, Homo sapiens
gaggggtggccctggcgtgtac

SEQ ID NO: 9372859 - DNA, 22 bp, Homo sapiens
gagggggaaagtccctggagtc

SEQ ID NO: 9372860 - DNA, 22 bp, Homo sapiens
gaggggctgggtagggcaaccc

SEQ ID NO: 9372861 - DNA, 22 bp, Homo sapiens
gcaagacctatctagttgctgt

SEQ ID NO: 9372862 - DNA, 22 bp, Homo sapiens
gcaagacctatctagttgctgt

SEQ ID NO: 9372863 - DNA, 22 bp, Homo sapiens
gcaagagtttctggagcagagt

SEQ ID NO: 9372864 - DNA, 22 bp, Homo sapiens
gcaagagttttttctctcttga

SEQ ID NO: 9372865 - DNA, 22 bp, Homo sapiens
gcaagcagacattcaggtaggt

SEQ ID NO: 9372866 - DNA, 22 bp, Homo sapiens
gagggtcccgagccctgtcaga

SEQ ID NO: 9372867 - DNA, 22 bp, Homo sapiens
gcaggctccaactggaggagtt

SEQ ID NO: 9372868 - DNA, 22 bp, Homo sapiens
gcaggctcactctgtttggctc

SEQ ID NO: 9372869 - DNA, 22 bp, Homo sapiens
gcaggctcagagcagattagca

SEQ ID NO: 9372870 - DNA, 22 bp, Homo sapiens
gcaggctcaaaagctggtagga

SEQ ID NO: 9372871 - DNA, 22 bp, Homo sapiens
gcaggctcaaaagctggtagga

SEQ ID NO: 9372872 - DNA, 22 bp, Homo sapiens
gcaggctatgtcagggccgctc

SEQ ID NO: 9372873 - DNA, 19 bp, Homo sapiens
gcaggcctcttgggaatta

SEQ ID NO: 9372874 - DNA, 20 bp, Homo sapiens
gcaggctccgggcttgggag

SEQ ID NO: 9372875 - DNA, 22 bp, Homo sapiens
gcaggctcccttgcagagcagg

SEQ ID NO: 9372876 - DNA, 22 bp, Homo sapiens
gcaggctcccttgcagagcagg

SEQ ID NO: 9372877 - DNA, 22 bp, Homo sapiens
gcaggctccaggccggcccctt

SEQ ID NO: 9372878 - DNA, 22 bp, Homo sapiens
gcaggctccaaggcctgggaga

SEQ ID NO: 9372879 - DNA, 22 bp, Homo sapiens
gcaggctcgttggaagtcccct

SEQ ID NO: 9372880 - DNA, 22 bp, Homo sapiens
gcaggctcttctttctgcccag

SEQ ID NO: 9372881 - DNA, 22 bp, Homo sapiens
gcaggctgaaactcggggtcta

SEQ ID NO: 9372882 - DNA, 22 bp, Homo sapiens
gcaggctgaaactcggggtcta

SEQ ID NO: 9372883 - DNA, 22 bp, Homo sapiens
gcaggctgagagtccaagaagg

SEQ ID NO: 9372884 - DNA, 22 bp, Homo sapiens
gcaggctgagtattaccctagt

SEQ ID NO: 9372885 - DNA, 22 bp, Homo sapiens
gcaggctgagttgggaaaccaa

SEQ ID NO: 9372886 - DNA, 22 bp, Homo sapiens
gcaggctgagttgggaaaccaa

SEQ ID NO: 9372887 - DNA, 22 bp, Homo sapiens
gcaggctgatagaggattccat

SEQ ID NO: 9372888 - DNA, 22 bp, Homo sapiens
gcagggcgcgtttgagcgggct

SEQ ID NO: 9372889 - DNA, 22 bp, Homo sapiens
gcagggctaatggggcaagtag

SEQ ID NO: 9372890 - DNA, 22 bp, Homo sapiens
gcagggctaatggggcaagtag

SEQ ID NO: 9372891 - DNA, 22 bp, Homo sapiens
gcagggctaatggggcaagtag

SEQ ID NO: 9372892 - DNA, 22 bp, Homo sapiens
gcagggcggcccagagcaggcc

SEQ ID NO: 9372893 - DNA, 22 bp, Homo sapiens
gcagggctaatggggcaagtag

SEQ ID NO: 9372894 - DNA, 22 bp, Homo sapiens
gcagggctattggaaggagatg

SEQ ID NO: 9372895 - DNA, 22 bp, Homo sapiens
gcagggctattggaaggagatg

SEQ ID NO: 9372896 - DNA, 22 bp, Homo sapiens
gcagggctcaacaggacacccc

SEQ ID NO: 9372897 - DNA, 22 bp, Homo sapiens
gcagggctagatatttgcaagt

SEQ ID NO: 9372898 - DNA, 22 bp, Homo sapiens
gcagggctaggtcttctagggc

SEQ ID NO: 9372899 - DNA, 22 bp, Homo sapiens
gcagggctaggtcttctagggc

SEQ ID NO: 9372900 - DNA, 22 bp, Homo sapiens
gcaggctgatgactggagttgg

SEQ ID NO: 9372901 - DNA, 22 bp, Homo sapiens
gcaggctgatgactggagttgg

SEQ ID NO: 9372902 - DNA, 22 bp, Homo sapiens
gcaggctgatagaggattccat

SEQ ID NO: 9372903 - DNA, 22 bp, Homo sapiens
gcaggctgatgactggagttgg

SEQ ID NO: 9372904 - DNA, 22 bp, Homo sapiens
gcaggctgatagaggattccat

SEQ ID NO: 9372905 - DNA, 22 bp, Homo sapiens
gcaggctgccaccttctgagtt

SEQ ID NO: 9372906 - DNA, 22 bp, Homo sapiens
gcaggctgccaccttctgagtt

SEQ ID NO: 9372907 - DNA, 22 bp, Homo sapiens
gcaggctgccaccttctgagtt

SEQ ID NO: 9372908 - DNA, 22 bp, Homo sapiens
gcaggctgccaccttctgagtt

SEQ ID NO: 9372909 - DNA, 22 bp, Homo sapiens
gcagctggagccagccagacac

SEQ ID NO: 9372910 - DNA, 22 bp, Homo sapiens
gcagctggatttcaagagggag

SEQ ID NO: 9372911 - DNA, 22 bp, Homo sapiens
gcagctggagcatcttctcatc

SEQ ID NO: 9372912 - DNA, 22 bp, Homo sapiens
gcagctggagaaataccaccct

SEQ ID NO: 9372913 - DNA, 22 bp, Homo sapiens
gcagctggagaaataccaccct

SEQ ID NO: 9372914 - DNA, 22 bp, Homo sapiens
gcagctggagcatcttctcatc

SEQ ID NO: 9372915 - DNA, 22 bp, Homo sapiens
gcagctggagaaataccaccct

SEQ ID NO: 9372916 - DNA, 22 bp, Homo sapiens
gcagctggagcatcttctcatc

SEQ ID NO: 9372917 - DNA, 22 bp, Homo sapiens
gcagctggacccacacggctta

SEQ ID NO: 9372918 - DNA, 22 bp, Homo sapiens
gcagctggacccacacggctta

SEQ ID NO: 9372919 - DNA, 22 bp, Homo sapiens
gcagctgcctattcagggcttg

SEQ ID NO: 9372920 - DNA, 22 bp, Homo sapiens
gcagctgcctaaagtgctaaga

SEQ ID NO: 9372921 - DNA, 22 bp, Homo sapiens
gcaggaggatcacttgagccca

SEQ ID NO: 9372922 - DNA, 22 bp, Homo sapiens
gcaggaggccaggtatgcttta

SEQ ID NO: 9372923 - DNA, 22 bp, Homo sapiens
gcaggaggatcacttgagccca

SEQ ID NO: 9372924 - DNA, 22 bp, Homo sapiens
gcaggaggagcattaactgagc

SEQ ID NO: 9372925 - DNA, 22 bp, Homo sapiens
gcagctggccctgacacgcaga

SEQ ID NO: 9372926 - DNA, 22 bp, Homo sapiens
gcagctggcccctttccttgtt

SEQ ID NO: 9372927 - DNA, 22 bp, Homo sapiens
gcagctggatttcaagagggag

SEQ ID NO: 9372928 - DNA, 22 bp, Homo sapiens
gcagctggcccctttccttgtt

SEQ ID NO: 9372929 - DNA, 22 bp, Homo sapiens
gcaggcctctgttgagggcctt

SEQ ID NO: 9372930 - DNA, 22 bp, Homo sapiens
gcaggcctctgttgagggcctt

SEQ ID NO: 9372931 - DNA, 19 bp, Homo sapiens
gcaggcctcttgggaatta

SEQ ID NO: 9372932 - DNA, 22 bp, Homo sapiens
gcaggcctctgttgagggcctt

SEQ ID NO: 9372933 - DNA, 22 bp, Homo sapiens
gcaggcctctaattcaccgcag

SEQ ID NO: 9372934 - DNA, 22 bp, Homo sapiens
gcaggagttaggcgtcgtggat

SEQ ID NO: 9372935 - DNA, 22 bp, Homo sapiens
gcaggagttagaggtttaatct

SEQ ID NO: 9372936 - DNA, 22 bp, Homo sapiens
gcaggagttaggcgtcgtggat

SEQ ID NO: 9372937 - DNA, 22 bp, Homo sapiens
gcaggagtgtgtctaatactca

SEQ ID NO: 9372938 - DNA, 22 bp, Homo sapiens
gcaggagttaaaatatgtaatg

SEQ ID NO: 9372939 - DNA, 22 bp, Homo sapiens
gcaggagttaaaatatgtaatg

SEQ ID NO: 9372940 - DNA, 22 bp, Homo sapiens
gcaggagttagaggtttaatct

SEQ ID NO: 9372941 - DNA, 22 bp, Homo sapiens
gcaggagtgtatttgcatgtaa

SEQ ID NO: 9372942 - DNA, 22 bp, Homo sapiens
gcaggagtgtggtgggacatcc

SEQ ID NO: 9372943 - DNA, 22 bp, Homo sapiens
gcaggagtgtggtgggacatcc

SEQ ID NO: 9372944 - DNA, 22 bp, Homo sapiens
gcaggagtgtggtgggacatcc

SEQ ID NO: 9372945 - DNA, 22 bp, Homo sapiens
gcaggagtgtatttgcatgtaa

SEQ ID NO: 9372946 - DNA, 22 bp, Homo sapiens
gcaggagtggagaccatgggga

SEQ ID NO: 9372947 - DNA, 22 bp, Homo sapiens
gcaggagtggagaccatgggga

SEQ ID NO: 9372948 - DNA, 22 bp, Homo sapiens
gcaggagtggagaccatgggga

SEQ ID NO: 9372949 - DNA, 22 bp, Homo sapiens
gcaggagtgacatggatgtgga

SEQ ID NO: 9372950 - DNA, 22 bp, Homo sapiens
gcaggagtgacatggatgtgga

SEQ ID NO: 9372951 - DNA, 22 bp, Homo sapiens
gcaggagtcccagaaggttttg

SEQ ID NO: 9372952 - DNA, 22 bp, Homo sapiens
gcaggagtcactgacttggtcc

SEQ ID NO: 9372953 - DNA, 22 bp, Homo sapiens
gcaggagtcagccctaccttga

SEQ ID NO: 9372954 - DNA, 22 bp, Homo sapiens
gcaggagtgacatggatgtgga

SEQ ID NO: 9372955 - DNA, 22 bp, Homo sapiens
gcaggagtgacatggatgtgga

SEQ ID NO: 9372956 - DNA, 22 bp, Homo sapiens
gcaggagtgacatggatgtgga

SEQ ID NO: 9372957 - DNA, 22 bp, Homo sapiens
gcaggagtatctatacattaaa

SEQ ID NO: 9372958 - DNA, 22 bp, Homo sapiens
gcaggagtatgcagctatggtt

SEQ ID NO: 9372959 - DNA, 22 bp, Homo sapiens
gcaggagtatgcagctatggtt

SEQ ID NO: 9372960 - DNA, 22 bp, Homo sapiens
gcaggagtatctatacattaaa

SEQ ID NO: 9372961 - DNA, 22 bp, Homo sapiens
gcaggagtatgcagctatggtt

SEQ ID NO: 9372962 - DNA, 22 bp, Homo sapiens
gcaggagtatgcagctatggtt

SEQ ID NO: 9372963 - DNA, 22 bp, Homo sapiens
gcaggaggttgagccaggactg

SEQ ID NO: 9372964 - DNA, 22 bp, Homo sapiens
gcaggaggccaggtatgcttta

SEQ ID NO: 9372965 - DNA, 22 bp, Homo sapiens
gcaggaggccaggtatgcttta

SEQ ID NO: 9372966 - DNA, 22 bp, Homo sapiens
gcaggaggttgagccaggactg

SEQ ID NO: 9372967 - DNA, 16 bp, Homo sapiens
gcaggagtaccacttg

SEQ ID NO: 9372968 - DNA, 22 bp, Homo sapiens
gcagcattaccaagacatggca

SEQ ID NO: 9372969 - DNA, 22 bp, Homo sapiens
gcagcatgttgaaagggccaca

SEQ ID NO: 9372970 - DNA, 22 bp, Homo sapiens
gcagcatgttgaaagggccaca

SEQ ID NO: 9372971 - DNA, 22 bp, Homo sapiens
gcagcatgttgaaagggccaca

SEQ ID NO: 9372972 - DNA, 22 bp, Homo sapiens
gcagcatgtgccttaaatcatt

SEQ ID NO: 9372973 - DNA, 22 bp, Homo sapiens
gcagcatctagggcactggcct

SEQ ID NO: 9372974 - DNA, 22 bp, Homo sapiens
gcagcatgagctatacaaagta

SEQ ID NO: 9372975 - DNA, 22 bp, Homo sapiens
gcagcatggagttgtggaatga

SEQ ID NO: 9372976 - DNA, 22 bp, Homo sapiens
gcagcatggagttgtggaatga

SEQ ID NO: 9372977 - DNA, 22 bp, Homo sapiens
gcagcatggagttgtggaatga

SEQ ID NO: 9372978 - DNA, 22 bp, Homo sapiens
gcagcagtgcgggcagctacag

SEQ ID NO: 9372979 - DNA, 20 bp, Homo sapiens
gcagcagtgcaagtcctctt

SEQ ID NO: 9372980 - DNA, 22 bp, Homo sapiens
gcagcagtgcgggcagctacag

SEQ ID NO: 9372981 - DNA, 22 bp, Homo sapiens
gcagcaggtgtgcttttaatga

SEQ ID NO: 9372982 - DNA, 22 bp, Homo sapiens
gcagcaggtgtgcttttaatga

SEQ ID NO: 9372983 - DNA, 22 bp, Homo sapiens
gcagcagtggctgcaggtccca

SEQ ID NO: 9372984 - DNA, 22 bp, Homo sapiens
gcagcagtggctgcaggtccca

SEQ ID NO: 9372985 - DNA, 22 bp, Homo sapiens
gcagcagtggttttatcatttt

SEQ ID NO: 9372986 - DNA, 22 bp, Homo sapiens
gcagcagtgtctcccatcttgc

SEQ ID NO: 9372987 - DNA, 22 bp, Homo sapiens
gcagctgatggaagtcctattg

SEQ ID NO: 9372988 - DNA, 22 bp, Homo sapiens
gcagccacagaggagggatgca

SEQ ID NO: 9372989 - DNA, 22 bp, Homo sapiens
gcagctgcaagcacttctggca

SEQ ID NO: 9372990 - DNA, 22 bp, Homo sapiens
gcagctgcaagcacttctggca

SEQ ID NO: 9372991 - DNA, 23 bp, Homo sapiens
gcagccaagagaccagggcaggc

SEQ ID NO: 9372992 - DNA, 22 bp, Homo sapiens
gcagctgcagaccctcagtgct

SEQ ID NO: 9372993 - DNA, 22 bp, Homo sapiens
gcagctgcacttctacctaatt

SEQ ID NO: 9372994 - DNA, 22 bp, Homo sapiens
gcagctgcaataggcatcaagc

SEQ ID NO: 9372995 - DNA, 22 bp, Homo sapiens
gcagctgcagagaccgggtggg

SEQ ID NO: 9372996 - DNA, 22 bp, Homo sapiens
gcagctgcagaccctcagtgct

SEQ ID NO: 9372997 - DNA, 22 bp, Homo sapiens
gcagctgccccgactgtgagtc

SEQ ID NO: 9372998 - DNA, 20 bp, Homo sapiens
gcagctgcccccagtccctg

SEQ ID NO: 9372999 - DNA, 22 bp, Homo sapiens
gcagctgccgtgagctcacgcc

SEQ ID NO: 9373000 - DNA, 22 bp, Homo sapiens
gcagctgccgtgagctcacgcc

SEQ ID NO: 9373001 - DNA, 22 bp, Homo sapiens
gcagctgcaggtggtcccatgc

SEQ ID NO: 9373002 - DNA, 22 bp, Homo sapiens
gcagctgcaggcaggcttgctg

SEQ ID NO: 9373003 - DNA, 22 bp, Homo sapiens
gcagctgccagtccccttccag

SEQ ID NO: 9373004 - DNA, 22 bp, Homo sapiens
gcagcaggcacggtctcgacat

SEQ ID NO: 9373005 - DNA, 22 bp, Homo sapiens
gcagcaggcacggtctcgacat

SEQ ID NO: 9373006 - DNA, 22 bp, Homo sapiens
gcagcaggcacggtctcgacat

SEQ ID NO: 9373007 - DNA, 22 bp, Homo sapiens
gcagcaggatggccaattgcca

SEQ ID NO: 9373008 - DNA, 22 bp, Homo sapiens
gcagcaggatggccaattgcca

SEQ ID NO: 9373009 - DNA, 22 bp, Homo sapiens
gcagcaggatggccaattgcca

SEQ ID NO: 9373010 - DNA, 22 bp, Homo sapiens
gcagcaggagagtttgtcctgc

SEQ ID NO: 9373011 - DNA, 22 bp, Homo sapiens
gcagcaggtctgtcaatgtcat

SEQ ID NO: 9373012 - DNA, 22 bp, Homo sapiens
gcagcaggtctgtcaatgtcat

SEQ ID NO: 9373013 - DNA, 22 bp, Homo sapiens
gcagcaggtctgtcaatgtcat

SEQ ID NO: 9373014 - DNA, 22 bp, Homo sapiens
gcagcaggcacttaccgttgct

SEQ ID NO: 9373015 - DNA, 22 bp, Homo sapiens
gcagcaggcacggtctcgacat

SEQ ID NO: 9373016 - DNA, 22 bp, Homo sapiens
gcagcaggcacttaccgttgct

SEQ ID NO: 9373017 - DNA, 22 bp, Homo sapiens
gcagcaggactgccgttaaagt

SEQ ID NO: 9373018 - DNA, 22 bp, Homo sapiens
gcagcaggactgccgttaaagt

SEQ ID NO: 9373019 - DNA, 22 bp, Homo sapiens
gcagcaggagagtaatagcggt

SEQ ID NO: 9373020 - DNA, 22 bp, Homo sapiens
gcagcaggagagtttgtcctgc

SEQ ID NO: 9373021 - DNA, 22 bp, Homo sapiens
gcagcaggagagtttgtcctgc

SEQ ID NO: 9373022 - DNA, 22 bp, Homo sapiens
gcagcaggagagtttgtcctgc

SEQ ID NO: 9373023 - DNA, 22 bp, Homo sapiens
gcagcaggagagtaatagcggt

SEQ ID NO: 9373024 - DNA, 22 bp, Homo sapiens
gcagcaggaatttaaatttata

SEQ ID NO: 9373025 - DNA, 22 bp, Homo sapiens
gcagcaggaatttaaatttata

SEQ ID NO: 9373026 - DNA, 22 bp, Homo sapiens
gcagcaggaataggataagcaa

SEQ ID NO: 9373027 - DNA, 22 bp, Homo sapiens
gcagcaggaataggataagcaa

SEQ ID NO: 9373028 - DNA, 22 bp, Homo sapiens
gcagcaggaataggataagcaa

SEQ ID NO: 9373029 - DNA, 22 bp, Homo sapiens
gcagaggaggacccaggaatta

SEQ ID NO: 9373030 - DNA, 22 bp, Homo sapiens
gcagaggagcaagttgctacag

SEQ ID NO: 9373031 - DNA, 22 bp, Homo sapiens
gcagaggaggacccaggaatta

SEQ ID NO: 9373032 - DNA, 22 bp, Homo sapiens
gcagaggagcaagttgctacag

SEQ ID NO: 9373033 - DNA, 23 bp, Homo sapiens
gcagaggagcaagctggacacca

SEQ ID NO: 9373034 - DNA, 23 bp, Homo sapiens
gcagaggagcaagctggacacca

SEQ ID NO: 9373035 - DNA, 22 bp, Homo sapiens
gcagaggagcaagttgctacag

SEQ ID NO: 9373036 - DNA, 22 bp, Homo sapiens
gcagaggaggacccaggaatta

SEQ ID NO: 9373037 - DNA, 22 bp, Homo sapiens
gcagaggaggacccaggaatta

SEQ ID NO: 9373038 - DNA, 22 bp, Homo sapiens
gcagaggaggacccaggaatta

SEQ ID NO: 9373039 - DNA, 22 bp, Homo sapiens
gcagaggaggacccaggaatta

SEQ ID NO: 9373040 - DNA, 22 bp, Homo sapiens
gcagcagccgacatggattgca

SEQ ID NO: 9373041 - DNA, 22 bp, Homo sapiens
gcagaggaggacccaggaatta

SEQ ID NO: 9373042 - DNA, 22 bp, Homo sapiens
gcagcagcggggcccctgcgcg

SEQ ID NO: 9373043 - DNA, 22 bp, Homo sapiens
gcagcagcggggcccctgcgcg

SEQ ID NO: 9373044 - DNA, 22 bp, Homo sapiens
gcagcagcggggcccctgcgcg

SEQ ID NO: 9373045 - DNA, 22 bp, Homo sapiens
gcagcagctctgaatgggcccc

SEQ ID NO: 9373046 - DNA, 22 bp, Homo sapiens
gcagcagctctcaaagtggtct

SEQ ID NO: 9373047 - DNA, 22 bp, Homo sapiens
gcagcagctctcaaagtggtct

SEQ ID NO: 9373048 - DNA, 22 bp, Homo sapiens
gcagcagctctgaatgggcccc

SEQ ID NO: 9373049 - DNA, 22 bp, Homo sapiens
gcagcagctgacagtgggtgcc

SEQ ID NO: 9373050 - DNA, 22 bp, Homo sapiens
gcagcagctccctatccaggct

SEQ ID NO: 9373051 - DNA, 22 bp, Homo sapiens
gcagcagctccctatccaggct

SEQ ID NO: 9373052 - DNA, 22 bp, Homo sapiens
gcagcagctccctatccaggct

SEQ ID NO: 9373053 - DNA, 22 bp, Homo sapiens
gcagcagctcagccgggcactg

SEQ ID NO: 9373054 - DNA, 22 bp, Homo sapiens
gcagcagctcagttctgggagg

SEQ ID NO: 9373055 - DNA, 22 bp, Homo sapiens
gcagcagctcagccgggcactg

SEQ ID NO: 9373056 - DNA, 22 bp, Homo sapiens
gtcttattaaaaatctaatccc

SEQ ID NO: 9373057 - DNA, 22 bp, Homo sapiens
gtctggtgggattccaagtggc

SEQ ID NO: 9373058 - DNA, 22 bp, Homo sapiens
gtctgggtttcatgggcactgg

SEQ ID NO: 9373059 - DNA, 22 bp, Homo sapiens
gtctgggtctccacagtcagca

SEQ ID NO: 9373060 - DNA, 22 bp, Homo sapiens
gtcttatttaaagagatcatac

SEQ ID NO: 9373061 - DNA, 22 bp, Homo sapiens
gtcttatttaacctaaatttct

SEQ ID NO: 9373062 - DNA, 22 bp, Homo sapiens
gtcttcagtggcaaatggatct

SEQ ID NO: 9373063 - DNA, 22 bp, Homo sapiens
gtcttcaggacctggaattttg

SEQ ID NO: 9373064 - DNA, 22 bp, Homo sapiens
gtcttcaggacccggaattttg

SEQ ID NO: 9373065 - DNA, 22 bp, Homo sapiens
gtcttctgatctggttagccat

SEQ ID NO: 9373066 - DNA, 19 bp, Homo sapiens
gtcttctgaatgtggctgc

SEQ ID NO: 9373067 - DNA, 22 bp, Homo sapiens
gtctcctggaaatatgcccata

SEQ ID NO: 9373068 - DNA, 22 bp, Homo sapiens
gtctcctgcccccggtgcttgg

SEQ ID NO: 9373069 - DNA, 22 bp, Homo sapiens
gtctcctgccacactcagtccc

SEQ ID NO: 9373070 - DNA, 22 bp, Homo sapiens
gtctcctggcctccagtttctc

SEQ ID NO: 9373071 - DNA, 22 bp, Homo sapiens
gtctcctggctgcagctaagac

SEQ ID NO: 9373072 - DNA, 22 bp, Homo sapiens
gtctcctgaggcatccattgaa

SEQ ID NO: 9373073 - DNA, 22 bp, Homo sapiens
gtctcctgagccttgactgcaa

SEQ ID NO: 9373074 - DNA, 22 bp, Homo sapiens
gtctcctgagactgcagtcacc

SEQ ID NO: 9373075 - DNA, 22 bp, Homo sapiens
gtctcctgagactgcagtcacc

SEQ ID NO: 9373076 - DNA, 20 bp, Homo sapiens
gtctcctctttgcattccta

SEQ ID NO: 9373077 - DNA, 22 bp, Homo sapiens
gtctcctgagccttgactgcaa

SEQ ID NO: 9373078 - DNA, 22 bp, Homo sapiens
gtctcctgagactgcagtcacc

SEQ ID NO: 9373079 - DNA, 22 bp, Homo sapiens
gtctcctgagactgcagtcacc

SEQ ID NO: 9373080 - DNA, 22 bp, Homo sapiens
gtctcctggcttttgtcccagt

SEQ ID NO: 9373081 - DNA, 22 bp, Homo sapiens
gtctcctgtcctgcaggatgga

SEQ ID NO: 9373082 - DNA, 22 bp, Homo sapiens
gtctcctgtcctgcaggatgga

SEQ ID NO: 9373083 - DNA, 22 bp, Homo sapiens
gtctcgtcaatggcaggttccc

SEQ ID NO: 9373084 - DNA, 22 bp, Homo sapiens
gtctcgttgctttataaataga

SEQ ID NO: 9373085 - DNA, 22 bp, Homo sapiens
gtctcggttattcctcatttaa

SEQ ID NO: 9373086 - DNA, 22 bp, Homo sapiens
gtctctctcccaagattggcta

SEQ ID NO: 9373087 - DNA, 22 bp, Homo sapiens
gtctctctgactggtccacacc

SEQ ID NO: 9373088 - DNA, 22 bp, Homo sapiens
gtctctctgactggtccacacc

SEQ ID NO: 9373089 - DNA, 22 bp, Homo sapiens
gtctctctgctaggcctccagt

SEQ ID NO: 9373090 - DNA, 22 bp, Homo sapiens
gtctctctgctaggcctccagt

SEQ ID NO: 9373091 - DNA, 22 bp, Homo sapiens
gtctctgacctgcgtccctcct

SEQ ID NO: 9373092 - DNA, 22 bp, Homo sapiens
gtctctgacctgcgtccctcct

SEQ ID NO: 9373093 - DNA, 22 bp, Homo sapiens
gtctggggtactttcatctgat

SEQ ID NO: 9373094 - DNA, 22 bp, Homo sapiens
gtgaggccgcacgccccggagt

SEQ ID NO: 9373095 - DNA, 22 bp, Homo sapiens
gtgaggtggtacaatattaact

SEQ ID NO: 9373096 - DNA, 22 bp, Homo sapiens
gtgaggtgagtagtgagaagcc

SEQ ID NO: 9373097 - DNA, 22 bp, Homo sapiens
gtgaggtgggctggccagagac

SEQ ID NO: 9373098 - DNA, 22 bp, Homo sapiens
gtcttctgtctgtctggcatgt

SEQ ID NO: 9373099 - DNA, 22 bp, Homo sapiens
gtcttctgtaagatgaggtccc

SEQ ID NO: 9373100 - DNA, 22 bp, Homo sapiens
gtcttctgttctgtgaggcttc

SEQ ID NO: 9373101 - DNA, 22 bp, Homo sapiens
gtcttctgttctgtgaggcttc

SEQ ID NO: 9373102 - DNA, 22 bp, Homo sapiens
gtcttctggaagagagccagct

SEQ ID NO: 9373103 - DNA, 20 bp, Homo sapiens
gtcttgaaggggtcatggag

SEQ ID NO: 9373104 - DNA, 20 bp, Homo sapiens
gtcttgaaggggtcatggag

SEQ ID NO: 9373105 - DNA, 22 bp, Homo sapiens
gtcttctgttctgtgaggcttc

SEQ ID NO: 9373106 - DNA, 22 bp, Homo sapiens
gtgatatttttaaagattaagg

SEQ ID NO: 9373107 - DNA, 22 bp, Homo sapiens
gtgatcactgcttcttccacca

SEQ ID NO: 9373108 - DNA, 23 bp, Homo sapiens
gtgatattaaggatagagacaag

SEQ ID NO: 9373109 - DNA, 22 bp, Homo sapiens
gtgatgaagtaaatgttattta

SEQ ID NO: 9373110 - DNA, 22 bp, Homo sapiens
gtgataattgcagagaaaggag

SEQ ID NO: 9373111 - DNA, 23 bp, Homo sapiens
gtgatattaaggatagagacaag

SEQ ID NO: 9373112 - DNA, 22 bp, Homo sapiens
gtgatgggtaactgtttaggga

SEQ ID NO: 9373113 - DNA, 22 bp, Homo sapiens
gtgatgtacttggaaaagtcct

SEQ ID NO: 9373114 - DNA, 22 bp, Homo sapiens
gtgatgtcacacccttgataga

SEQ ID NO: 9373115 - DNA, 22 bp, Homo sapiens
gtgattaactgcagttagagct

SEQ ID NO: 9373116 - DNA, 22 bp, Homo sapiens
gtgatgtcttgtacatatgatt

SEQ ID NO: 9373117 - DNA, 22 bp, Homo sapiens
gtgatgtcagcaagaataggaa

SEQ ID NO: 9373118 - DNA, 22 bp, Homo sapiens
gtgatgtcagacatctggtatt

SEQ ID NO: 9373119 - DNA, 22 bp, Homo sapiens
gtgataaaatagaaacagtggt

SEQ ID NO: 9373120 - DNA, 22 bp, Homo sapiens
gtgagttattatttatgtaaac

SEQ ID NO: 9373121 - DNA, 22 bp, Homo sapiens
gtgagttgggggattagaagct

SEQ ID NO: 9373122 - DNA, 22 bp, Homo sapiens
gtgataaaggggaggaagtgtg

SEQ ID NO: 9373123 - DNA, 22 bp, Homo sapiens
gtgataaaggggaggaagtgtg

SEQ ID NO: 9373124 - DNA, 22 bp, Homo sapiens
gtgataaagacgtgtcataatt

SEQ ID NO: 9373125 - DNA, 22 bp, Homo sapiens
gtgataaaatagaaacagtggt

SEQ ID NO: 9373126 - DNA, 22 bp, Homo sapiens
gtgataaaattcaaatagctct

SEQ ID NO: 9373127 - DNA, 22 bp, Homo sapiens
gtgataaaattcaaatagctct

SEQ ID NO: 9373128 - DNA, 22 bp, Homo sapiens
gtgataaaattcaaatagctct

SEQ ID NO: 9373129 - DNA, 22 bp, Homo sapiens
gtgaggtggtacaatattaact

SEQ ID NO: 9373130 - DNA, 22 bp, Homo sapiens
gtgagtaaaggttcattgaatt

SEQ ID NO: 9373131 - DNA, 22 bp, Homo sapiens
gtgagtaaaggttcattgaatt

SEQ ID NO: 9373132 - DNA, 22 bp, Homo sapiens
gtgagtaaaggttcattgaatt

SEQ ID NO: 9373133 - DNA, 23 bp, Homo sapiens
gtgagtcttgcctttgctgtgga

SEQ ID NO: 9373134 - DNA, 22 bp, Homo sapiens
gtgctgggattacaggtgtgag

SEQ ID NO: 9373135 - DNA, 22 bp, Homo sapiens
gtgctgggattacaggtgtgag

SEQ ID NO: 9373136 - DNA, 22 bp, Homo sapiens
gtgctgggccctgagaccaggg

SEQ ID NO: 9373137 - DNA, 22 bp, Homo sapiens
gtgctgggctccaccccagagg

SEQ ID NO: 9373138 - DNA, 22 bp, Homo sapiens
gtgctggggagataggaagaga

SEQ ID NO: 9373139 - DNA, 22 bp, Homo sapiens
gtgctggggagataggaagaga

SEQ ID NO: 9373140 - DNA, 22 bp, Homo sapiens
gtgctgggggtttctgtaggtc

SEQ ID NO: 9373141 - DNA, 22 bp, Homo sapiens
gtgctgggggtttctgtaggtc

SEQ ID NO: 9373142 - DNA, 22 bp, Homo sapiens
gtgctgggtgctgcagacaggt

SEQ ID NO: 9373143 - DNA, 22 bp, Homo sapiens
gtgctgtaacaacagagtgtct

SEQ ID NO: 9373144 - DNA, 22 bp, Homo sapiens
gtgctgggtgctgcagacaggt

SEQ ID NO: 9373145 - DNA, 22 bp, Homo sapiens
gtgctgtattgagacaaggtcg

SEQ ID NO: 9373146 - DNA, 23 bp, Homo sapiens
gtgcttgaaagatgcagaattaa

SEQ ID NO: 9373147 - DNA, 23 bp, Homo sapiens
gtgctgtgagccccttggcctcc

SEQ ID NO: 9373148 - DNA, 22 bp, Homo sapiens
gtgcttgggggaagtaacagac

SEQ ID NO: 9373149 - DNA, 22 bp, Homo sapiens
gtgcttggaccaggtcatcttc

SEQ ID NO: 9373150 - DNA, 22 bp, Homo sapiens
gtgcctgaaagccatgctcact

SEQ ID NO: 9373151 - DNA, 22 bp, Homo sapiens
gtgcctcagcaccgcctgcagc

SEQ ID NO: 9373152 - DNA, 22 bp, Homo sapiens
gtgccctgtctcttgtctccag

SEQ ID NO: 9373153 - DNA, 22 bp, Homo sapiens
gtgccctgtctcttgtctccag

SEQ ID NO: 9373154 - DNA, 22 bp, Homo sapiens
gtgccctgttcatttctctccc

SEQ ID NO: 9373155 - DNA, 22 bp, Homo sapiens
gtgccctgttcatttctctccc

SEQ ID NO: 9373156 - DNA, 23 bp, Homo sapiens
gtgccgacgctccagcaccatcc

SEQ ID NO: 9373157 - DNA, 22 bp, Homo sapiens
gtgccctgttgcacacttgagg

SEQ ID NO: 9373158 - DNA, 22 bp, Homo sapiens
gtgccctggtccccagcatata

SEQ ID NO: 9373159 - DNA, 22 bp, Homo sapiens
gtgccctggtccccagcatata

SEQ ID NO: 9373160 - DNA, 22 bp, Homo sapiens
gtgccctggtccccagcatata

SEQ ID NO: 9373161 - DNA, 22 bp, Homo sapiens
gtgccctggtccccagcatata

SEQ ID NO: 9373162 - DNA, 22 bp, Homo sapiens
gtgccctggctcacagtgtctc

SEQ ID NO: 9373163 - DNA, 22 bp, Homo sapiens
gtgccctggctcacagtgtctc

SEQ ID NO: 9373164 - DNA, 22 bp, Homo sapiens
gtgccctggctcacagtgtctc

SEQ ID NO: 9373165 - DNA, 22 bp, Homo sapiens
gtgccctggctcacagtgtctc

SEQ ID NO: 9373166 - DNA, 22 bp, Homo sapiens
gtgattttgagacctatatagt

SEQ ID NO: 9373167 - DNA, 22 bp, Homo sapiens
gtgattttctcctcctagaagt

SEQ ID NO: 9373168 - DNA, 22 bp, Homo sapiens
gtgattttcatgccctgctagg

SEQ ID NO: 9373169 - DNA, 22 bp, Homo sapiens
gtgattttgagacctatatagt

SEQ ID NO: 9373170 - DNA, 22 bp, Homo sapiens
gtgcaaatgtaattgccattga

SEQ ID NO: 9373171 - DNA, 22 bp, Homo sapiens
gtgcaaatgtaattgtgatttt

SEQ ID NO: 9373172 - DNA, 22 bp, Homo sapiens
gtgatttagatgttgaaagtga

SEQ ID NO: 9373173 - DNA, 22 bp, Homo sapiens
gtgattgtgaaaacattaagaa

SEQ ID NO: 9373174 - DNA, 22 bp, Homo sapiens
gtgatttagtgagaggcagctg

SEQ ID NO: 9373175 - DNA, 22 bp, Homo sapiens
gtgatttagtgttaagtatgtt

SEQ ID NO: 9373176 - DNA, 22 bp, Homo sapiens
gtgattctttgatctatgaaag

SEQ ID NO: 9373177 - DNA, 22 bp, Homo sapiens
gtgattctgatatagctaaagt

SEQ ID NO: 9373178 - DNA, 22 bp, Homo sapiens
gtgattctgaaatattagaaaa

SEQ ID NO: 9373179 - DNA, 22 bp, Homo sapiens
gtgattaagcatttcagaattt

SEQ ID NO: 9373180 - DNA, 22 bp, Homo sapiens
gtgattatagaatgctacaaag

SEQ ID NO: 9373181 - DNA, 22 bp, Homo sapiens
gtgattatatttctatgtgaat

SEQ ID NO: 9373182 - DNA, 22 bp, Homo sapiens
gtgattcataaaacactagatg

SEQ ID NO: 9373183 - DNA, 22 bp, Homo sapiens
gtgcacacatacatgaacgctg

SEQ ID NO: 9373184 - DNA, 22 bp, Homo sapiens
gtgcacactcttggggcacttt

SEQ ID NO: 9373185 - DNA, 22 bp, Homo sapiens
gtgcacactcttggggcacttt

SEQ ID NO: 9373186 - DNA, 22 bp, Homo sapiens
gtgcaattttgcatctgtatgc

SEQ ID NO: 9373187 - DNA, 22 bp, Homo sapiens
gtgcacacaagcaatgcactta

SEQ ID NO: 9373188 - DNA, 22 bp, Homo sapiens
gtgcaatattgccatgttcttg

SEQ ID NO: 9373189 - DNA, 22 bp, Homo sapiens
gtgcaaattccactggaaagct

SEQ ID NO: 9373190 - DNA, 22 bp, Homo sapiens
gtgcaactaaaaccattgatca

SEQ ID NO: 9373191 - DNA, 17 bp, Homo sapiens
gtgcaactactggaaga

SEQ ID NO: 9373192 - DNA, 22 bp, Homo sapiens
gtgcaaattccactggaaagct

SEQ ID NO: 9373193 - DNA, 22 bp, Homo sapiens
gtgcaaatgtaattgtggtttt

SEQ ID NO: 9373194 - DNA, 22 bp, Homo sapiens
gtgcaataaataaatagattgt

SEQ ID NO: 9373195 - DNA, 22 bp, Homo sapiens
gtgcaatagactgtggtattaa

SEQ ID NO: 9373196 - DNA, 22 bp, Homo sapiens
gtgcaaggtacatccttgatgt

SEQ ID NO: 9373197 - DNA, 22 bp, Homo sapiens
gtgccctgatcgctaggctccc

SEQ ID NO: 9373198 - DNA, 22 bp, Homo sapiens
gtgccctgatcgctaggctccc

SEQ ID NO: 9373199 - DNA, 22 bp, Homo sapiens
gtgccctgatgcaattgtctca

SEQ ID NO: 9373200 - DNA, 22 bp, Homo sapiens
gtgccctgcatgccccgggtat

SEQ ID NO: 9373201 - DNA, 22 bp, Homo sapiens
gtgccctgagcttatgcattct

SEQ ID NO: 9373202 - DNA, 22 bp, Homo sapiens
gtgcccaggtgtccctgagaag

SEQ ID NO: 9373203 - DNA, 22 bp, Homo sapiens
gtgcacagaaacatacaatgtg

SEQ ID NO: 9373204 - DNA, 22 bp, Homo sapiens
gtgcccaggggccagctgccgg

SEQ ID NO: 9373205 - DNA, 22 bp, Homo sapiens
ggtgggcaggcgaggcccaggt

SEQ ID NO: 9373206 - DNA, 22 bp, Homo sapiens
ggtgggcagctcttggcaggca

SEQ ID NO: 9373207 - DNA, 22 bp, Homo sapiens
gtaaatcagtgtcattttagaa

SEQ ID NO: 9373208 - DNA, 22 bp, Homo sapiens
gtaaatattccctcggttccta

SEQ ID NO: 9373209 - DNA, 22 bp, Homo sapiens
ggtgggcagctcttggcaggca

SEQ ID NO: 9373210 - DNA, 22 bp, Homo sapiens
gtaaatcatggtcagaataaat

SEQ ID NO: 9373211 - DNA, 22 bp, Homo sapiens
gtaaatgagtcaaatgggggaa

SEQ ID NO: 9373212 - DNA, 22 bp, Homo sapiens
gtaaatcataaaatttgagctc

SEQ ID NO: 9373213 - DNA, 22 bp, Homo sapiens
gtaacaaaggataacttggttt

SEQ ID NO: 9373214 - DNA, 22 bp, Homo sapiens
gtaacactagctctgtcacttt

SEQ ID NO: 9373215 - DNA, 22 bp, Homo sapiens
gtaacaaagtttctaggtgctg

SEQ ID NO: 9373216 - DNA, 22 bp, Homo sapiens
gtaacaggcaatacaactctct

SEQ ID NO: 9373217 - DNA, 22 bp, Homo sapiens
gtaataatggtccccaaacact

SEQ ID NO: 9373218 - DNA, 22 bp, Homo sapiens
gtaatctcagctacttgggagg

SEQ ID NO: 9373219 - DNA, 22 bp, Homo sapiens
gtaatccaaagtaacattaaac

SEQ ID NO: 9373220 - DNA, 21 bp, Homo sapiens
gtagatttggcccaaagccat

SEQ ID NO: 9373221 - DNA, 22 bp, Homo sapiens
gtagcagctctccagggttcac

SEQ ID NO: 9373222 - DNA, 22 bp, Homo sapiens
gtagcagcagagcaggtcctcc

SEQ ID NO: 9373223 - DNA, 22 bp, Homo sapiens
gtagcaggtattctggtgtgag

SEQ ID NO: 9373224 - DNA, 22 bp, Homo sapiens
gtagcagctctgagcatgctgc

SEQ ID NO: 9373225 - DNA, 22 bp, Homo sapiens
gtagcccacctggggagggcga

SEQ ID NO: 9373226 - DNA, 22 bp, Homo sapiens
gtagcccacctggggagggcga

SEQ ID NO: 9373227 - DNA, 22 bp, Homo sapiens
gtagaggacatttgacatgatg

SEQ ID NO: 9373228 - DNA, 22 bp, Homo sapiens
gtagaggctgaaatctgagggc

SEQ ID NO: 9373229 - DNA, 22 bp, Homo sapiens
gtagatcatgagaatgtttttg

SEQ ID NO: 9373230 - DNA, 22 bp, Homo sapiens
gtagatggaggggctgcagggc

SEQ ID NO: 9373231 - DNA, 22 bp, Homo sapiens
gtcaataattgatagatattgg

SEQ ID NO: 9373232 - DNA, 22 bp, Homo sapiens
gtcaagcagaagataatttaaa

SEQ ID NO: 9373233 - DNA, 22 bp, Homo sapiens
gtcaagcagaagataatttaaa

SEQ ID NO: 9373234 - DNA, 22 bp, Homo sapiens
gtcaacataggcctcagtgagg

SEQ ID NO: 9373235 - DNA, 22 bp, Homo sapiens
gtaggaaatcaggggtttaagc

SEQ ID NO: 9373236 - DNA, 22 bp, Homo sapiens
gtaggaaagggagtgaagggaa

SEQ ID NO: 9373237 - DNA, 22 bp, Homo sapiens
gtagctttatagtgaataaacc

SEQ ID NO: 9373238 - DNA, 22 bp, Homo sapiens
gtaggaaagtaaatgaaataca

SEQ ID NO: 9373239 - DNA, 22 bp, Homo sapiens
gtaggaaagggagtgaagggaa

SEQ ID NO: 9373240 - DNA, 22 bp, Homo sapiens
gtaggaaagggagtgaagggaa

SEQ ID NO: 9373241 - DNA, 22 bp, Homo sapiens
gtagctgcctttctggcccagg

SEQ ID NO: 9373242 - DNA, 22 bp, Homo sapiens
gtagctctgtttaaagttcttt

SEQ ID NO: 9373243 - DNA, 23 bp, Homo sapiens
gtcagtgctttagttcaggatgg

SEQ ID NO: 9373244 - DNA, 22 bp, Homo sapiens
gtcagtaggaacctagggtcaa

SEQ ID NO: 9373245 - DNA, 22 bp, Homo sapiens
gtcagtgccaccagccactgcc

SEQ ID NO: 9373246 - DNA, 17 bp, Homo sapiens
gtcagtctcccactgcc

SEQ ID NO: 9373247 - DNA, 22 bp, Homo sapiens
gtcagtgcttgaagggcagaga

SEQ ID NO: 9373248 - DNA, 21 bp, Homo sapiens
gtcagtgctgaaacaccttcc

SEQ ID NO: 9373249 - DNA, 22 bp, Homo sapiens
gtcagtctgcctgagcttgttt

SEQ ID NO: 9373250 - DNA, 22 bp, Homo sapiens
gtcaggtggctggtgattcaac

SEQ ID NO: 9373251 - DNA, 22 bp, Homo sapiens
gtcagtaggaacctagggtcaa

SEQ ID NO: 9373252 - DNA, 22 bp, Homo sapiens
gtcaggtcttggaagataggct

SEQ ID NO: 9373253 - DNA, 22 bp, Homo sapiens
gtcaggtcttggaagataggct

SEQ ID NO: 9373254 - DNA, 19 bp, Homo sapiens
gtcaggtcgttcctgccgg

SEQ ID NO: 9373255 - DNA, 23 bp, Homo sapiens
gtcaggtcattagaggtgacttc

SEQ ID NO: 9373256 - DNA, 23 bp, Homo sapiens
gtcagggctggggtcagagtgac

SEQ ID NO: 9373257 - DNA, 22 bp, Homo sapiens
gtcattcctatccatttgatac

SEQ ID NO: 9373258 - DNA, 17 bp, Homo sapiens
gtcattctcagaaaatg

SEQ ID NO: 9373259 - DNA, 22 bp, Homo sapiens
gtcattcaaactgtatcacttg

SEQ ID NO: 9373260 - DNA, 22 bp, Homo sapiens
gtcagttcattagcacttccaa

SEQ ID NO: 9373261 - DNA, 22 bp, Homo sapiens
gtcagtttgactcagtgttata

SEQ ID NO: 9373262 - DNA, 22 bp, Homo sapiens
gtcagtttgactcagtgttata

SEQ ID NO: 9373263 - DNA, 22 bp, Homo sapiens
gtcataaaatttgtggattaga

SEQ ID NO: 9373264 - DNA, 22 bp, Homo sapiens
gtcagtgttataagtttagcca

SEQ ID NO: 9373265 - DNA, 22 bp, Homo sapiens
gtcacaggtgtggaggtgctgg

SEQ ID NO: 9373266 - DNA, 22 bp, Homo sapiens
gtcacagtgctcccaaagtttg

SEQ ID NO: 9373267 - DNA, 21 bp, Homo sapiens
gtcagggattcaagtgctcac

SEQ ID NO: 9373268 - DNA, 22 bp, Homo sapiens
gtcagggatccactgctcttct

SEQ ID NO: 9373269 - DNA, 21 bp, Homo sapiens
gtcagggattcaagtgctcac

SEQ ID NO: 9373270 - DNA, 22 bp, Homo sapiens
gtcagggcacagtgacagctcc

SEQ ID NO: 9373271 - DNA, 22 bp, Homo sapiens
gtcaccaggtctgatgcagcca

SEQ ID NO: 9373272 - DNA, 22 bp, Homo sapiens
gtcaccagtgctaagaggtgga

SEQ ID NO: 9373273 - DNA, 22 bp, Homo sapiens
gtcaccagcaccaatgccacat

SEQ ID NO: 9373274 - DNA, 22 bp, Homo sapiens
gtcacatggaattgactagagt

SEQ ID NO: 9373275 - DNA, 22 bp, Homo sapiens
gtcacagtggggtcacagtgtg

SEQ ID NO: 9373276 - DNA, 22 bp, Homo sapiens
gtcacagtggggtcacagtgtg

SEQ ID NO: 9373277 - DNA, 22 bp, Homo sapiens
gtcacatgccagtgcacacagg

SEQ ID NO: 9373278 - DNA, 22 bp, Homo sapiens
gtcacagtgtatctcttcagct

SEQ ID NO: 9373279 - DNA, 19 bp, Homo sapiens
gtcctcatgttgttctcca

SEQ ID NO: 9373280 - DNA, 22 bp, Homo sapiens
gtcctctccaggaggctctgat

SEQ ID NO: 9373281 - DNA, 22 bp, Homo sapiens
gtcctctccaggaggctctgat

SEQ ID NO: 9373282 - DNA, 22 bp, Homo sapiens
gtcctctgactcagccttggga

SEQ ID NO: 9373283 - DNA, 22 bp, Homo sapiens
gtcctctgaaagatgaaccatg

SEQ ID NO: 9373284 - DNA, 22 bp, Homo sapiens
gtcctctgcccaggtcaaggtt

SEQ ID NO: 9373285 - DNA, 22 bp, Homo sapiens
gtcctctgactcagccttggga

SEQ ID NO: 9373286 - DNA, 22 bp, Homo sapiens
gtcctctgagggggctgcacgc

SEQ ID NO: 9373287 - DNA, 22 bp, Homo sapiens
gtcctctgagggggctgcacgc

SEQ ID NO: 9373288 - DNA, 22 bp, Homo sapiens
gtctcccagcctacatctttct

SEQ ID NO: 9373289 - DNA, 22 bp, Homo sapiens
gtctcccatcgtttgtgaggaa

SEQ ID NO: 9373290 - DNA, 22 bp, Homo sapiens
gtctccccagggccctcttcat

SEQ ID NO: 9373291 - DNA, 22 bp, Homo sapiens
gtctccccagggccctcttcat

SEQ ID NO: 9373292 - DNA, 22 bp, Homo sapiens
gtctcctcttcatatacctgtt

SEQ ID NO: 9373293 - DNA, 22 bp, Homo sapiens
gtcctcaggaaagcagataaca

SEQ ID NO: 9373294 - DNA, 21 bp, Homo sapiens
gtcctcacgctccggcctccc

SEQ ID NO: 9373295 - DNA, 22 bp, Homo sapiens
gtcctcagcaccagaactaggg

SEQ ID NO: 9373296 - DNA, 22 bp, Homo sapiens
gtccctggagctgagcagtgct

SEQ ID NO: 9373297 - DNA, 22 bp, Homo sapiens
gtccctggaatggactctgcgc

SEQ ID NO: 9373298 - DNA, 22 bp, Homo sapiens
gtcattttatgggaacagattt

SEQ ID NO: 9373299 - DNA, 22 bp, Homo sapiens
gtcattttatgggaacagattt

SEQ ID NO: 9373300 - DNA, 22 bp, Homo sapiens
gtccctggatctgggacagctg

SEQ ID NO: 9373301 - DNA, 22 bp, Homo sapiens
gtccctggagctgagcagtgct

SEQ ID NO: 9373302 - DNA, 22 bp, Homo sapiens
gtcatttatcatcagaagtcat

SEQ ID NO: 9373303 - DNA, 22 bp, Homo sapiens
gtcatttatcatcagaagtcat

SEQ ID NO: 9373304 - DNA, 22 bp, Homo sapiens
gtcatttaggtctgtcagaaat

SEQ ID NO: 9373305 - DNA, 22 bp, Homo sapiens
gtcatttaggtctgtcagaaat

SEQ ID NO: 9373306 - DNA, 22 bp, Homo sapiens
gtcatttaaaagggaacacatg

SEQ ID NO: 9373307 - DNA, 22 bp, Homo sapiens
gggctctcgattagaccctggg

SEQ ID NO: 9373308 - DNA, 19 bp, Homo sapiens
gggctctactctcagtctt

SEQ ID NO: 9373309 - DNA, 22 bp, Homo sapiens
gggctctagaggacagcctgct

SEQ ID NO: 9373310 - DNA, 22 bp, Homo sapiens
gggctctaggatggctccagcc

SEQ ID NO: 9373311 - DNA, 22 bp, Homo sapiens
gggctcggcatctgtggactct

SEQ ID NO: 9373312 - DNA, 22 bp, Homo sapiens
gggctcctgcctcctggcacct

SEQ ID NO: 9373313 - DNA, 22 bp, Homo sapiens
gggctcctgcctcctggcacct

SEQ ID NO: 9373314 - DNA, 22 bp, Homo sapiens
gggctctctttttggcctgccc

SEQ ID NO: 9373315 - DNA, 22 bp, Homo sapiens
gggctctgaatcccaggtctgc

SEQ ID NO: 9373316 - DNA, 20 bp, Homo sapiens
gggctggcgcatggggaaag

SEQ ID NO: 9373317 - DNA, 22 bp, Homo sapiens
gggctctgaatcccaggtctgc

SEQ ID NO: 9373318 - DNA, 22 bp, Homo sapiens
gggctggcatcggttgctgaga

SEQ ID NO: 9373319 - DNA, 22 bp, Homo sapiens
gggctctgaatcccaggtctgc

SEQ ID NO: 9373320 - DNA, 22 bp, Homo sapiens
gggctggcgggaaaggcaattc

SEQ ID NO: 9373321 - DNA, 20 bp, Homo sapiens
gggctggcgcatggggaaag

SEQ ID NO: 9373322 - DNA, 20 bp, Homo sapiens
gggctggcgcatggggaaag

SEQ ID NO: 9373323 - DNA, 20 bp, Homo sapiens
gggctggcgcatggggaaag

SEQ ID NO: 9373324 - DNA, 22 bp, Homo sapiens
gggctggcgggaaaggcaattc

SEQ ID NO: 9373325 - DNA, 22 bp, Homo sapiens
gggctggcgggaaaggcaattc

SEQ ID NO: 9373326 - DNA, 20 bp, Homo sapiens
gggctggctcaactggatcc

SEQ ID NO: 9373327 - DNA, 22 bp, Homo sapiens
gggctggctaagacttttctgt

SEQ ID NO: 9373328 - DNA, 22 bp, Homo sapiens
gggctggctaagacttttctgt

SEQ ID NO: 9373329 - DNA, 20 bp, Homo sapiens
gggctggctcaactggatcc

SEQ ID NO: 9373330 - DNA, 20 bp, Homo sapiens
gggctggctcaactggatcc

SEQ ID NO: 9373331 - DNA, 22 bp, Homo sapiens
gggctggctcccaggtgttgaa

SEQ ID NO: 9373332 - DNA, 22 bp, Homo sapiens
gggctggctcccaggtgttgaa

SEQ ID NO: 9373333 - DNA, 22 bp, Homo sapiens
gggctggctcccaggtgttgaa

SEQ ID NO: 9373334 - DNA, 22 bp, Homo sapiens
gggctccaggcaggcaggaaat

SEQ ID NO: 9373335 - DNA, 17 bp, Homo sapiens
gggctcctcccctgggg

SEQ ID NO: 9373336 - DNA, 17 bp, Homo sapiens
gggctcctcccctgggg

SEQ ID NO: 9373337 - DNA, 22 bp, Homo sapiens
gggctccatcacaggctccatc

SEQ ID NO: 9373338 - DNA, 22 bp, Homo sapiens
gggctccagtttggccaggaag

SEQ ID NO: 9373339 - DNA, 22 bp, Homo sapiens
gggctccacagcagtgagtgga

SEQ ID NO: 9373340 - DNA, 22 bp, Homo sapiens
gggctccagcagaggcagccgg

SEQ ID NO: 9373341 - DNA, 21 bp, Homo sapiens
gggcctggctgcgcaggacgg

SEQ ID NO: 9373342 - DNA, 22 bp, Homo sapiens
gggcctggggacaccaccatga

SEQ ID NO: 9373343 - DNA, 22 bp, Homo sapiens
gggcctgggaacttgcatttag

SEQ ID NO: 9373344 - DNA, 22 bp, Homo sapiens
gggctccaaggaggccagcctg

SEQ ID NO: 9373345 - DNA, 22 bp, Homo sapiens
gggcctggtgcttctgactcct

SEQ ID NO: 9373346 - DNA, 22 bp, Homo sapiens
gggcctggtgcttctgactcct

SEQ ID NO: 9373347 - DNA, 22 bp, Homo sapiens
gggcctggtgcttctgactcct

SEQ ID NO: 9373348 - DNA, 21 bp, Homo sapiens
gggcctggctgcgcaggacgg

SEQ ID NO: 9373349 - DNA, 22 bp, Homo sapiens
gggcctgctggtgcttccattg

SEQ ID NO: 9373350 - DNA, 22 bp, Homo sapiens
gggcctggcatgcagccccgtt

SEQ ID NO: 9373351 - DNA, 22 bp, Homo sapiens
gggcctgctccccatcgctgct

SEQ ID NO: 9373352 - DNA, 22 bp, Homo sapiens
gggcctgctccccatcgctgct

SEQ ID NO: 9373353 - DNA, 22 bp, Homo sapiens
gggcctgctccccatcgctgct

SEQ ID NO: 9373354 - DNA, 22 bp, Homo sapiens
gggcctgccattgctgccccag

SEQ ID NO: 9373355 - DNA, 22 bp, Homo sapiens
gggcctgcaggttctgagaggc

SEQ ID NO: 9373356 - DNA, 22 bp, Homo sapiens
gggcctgcaggttctgagaggc

SEQ ID NO: 9373357 - DNA, 22 bp, Homo sapiens
gggcctgcaggttctgagaggc

SEQ ID NO: 9373358 - DNA, 22 bp, Homo sapiens
gggcctgcaggttctgagaggc

SEQ ID NO: 9373359 - DNA, 22 bp, Homo sapiens
gggcctgccattgctgccccag

SEQ ID NO: 9373360 - DNA, 22 bp, Homo sapiens
gggcctgccattgctgccccag

SEQ ID NO: 9373361 - DNA, 22 bp, Homo sapiens
gggcctgccaggctttcagcat

SEQ ID NO: 9373362 - DNA, 22 bp, Homo sapiens
gggcctccggggtgagctgtgg

SEQ ID NO: 9373363 - DNA, 22 bp, Homo sapiens
gggcctccggggtgagctgtgg

SEQ ID NO: 9373364 - DNA, 22 bp, Homo sapiens
gggcctccgtgtgctggtgctc

SEQ ID NO: 9373365 - DNA, 22 bp, Homo sapiens
gggcctctccggcctttgcatc

SEQ ID NO: 9373366 - DNA, 22 bp, Homo sapiens
gggcctctcccttctcacgcat

SEQ ID NO: 9373367 - DNA, 22 bp, Homo sapiens
gggcctgaaaccttcagggctt

SEQ ID NO: 9373368 - DNA, 22 bp, Homo sapiens
gggcctctgtgcagaggggcct

SEQ ID NO: 9373369 - DNA, 22 bp, Homo sapiens
gggcctcaggccttgctctgtg

SEQ ID NO: 9373370 - DNA, 22 bp, Homo sapiens
gggcctcaggccttgctctgtg

SEQ ID NO: 9373371 - DNA, 22 bp, Homo sapiens
gggcctcatgatggctcaggaa

SEQ ID NO: 9373372 - DNA, 22 bp, Homo sapiens
gggcctcatgatggctcaggaa

SEQ ID NO: 9373373 - DNA, 22 bp, Homo sapiens
gggcctcatgatggctcaggaa

SEQ ID NO: 9373374 - DNA, 22 bp, Homo sapiens
gggcctcagctggagtctgcct

SEQ ID NO: 9373375 - DNA, 22 bp, Homo sapiens
gggcctcagctctgctctgcaa

SEQ ID NO: 9373376 - DNA, 22 bp, Homo sapiens
gggcctcagctctgctctgcaa

SEQ ID NO: 9373377 - DNA, 22 bp, Homo sapiens
gggcatgagaggcaggcaagtg

SEQ ID NO: 9373378 - DNA, 22 bp, Homo sapiens
gggcatgacttttggagtggga

SEQ ID NO: 9373379 - DNA, 22 bp, Homo sapiens
gggcatgacttttggagtggga

SEQ ID NO: 9373380 - DNA, 22 bp, Homo sapiens
gggcatgagagggcagctggca

SEQ ID NO: 9373381 - DNA, 22 bp, Homo sapiens
gggcatgcctgagcctgccact

SEQ ID NO: 9373382 - DNA, 20 bp, Homo sapiens
gggcagttcaatgccactct

SEQ ID NO: 9373383 - DNA, 23 bp, Homo sapiens
gggcagttatgttgtccttggct

SEQ ID NO: 9373384 - DNA, 22 bp, Homo sapiens
gggcatcttgtagccttcactt

SEQ ID NO: 9373385 - DNA, 22 bp, Homo sapiens
gggcatctggtggagcctcagg

SEQ ID NO: 9373386 - DNA, 22 bp, Homo sapiens
ggggcactttactgcctcatct

SEQ ID NO: 9373387 - DNA, 22 bp, Homo sapiens
ggggcactttactgcctcatct

SEQ ID NO: 9373388 - DNA, 22 bp, Homo sapiens
ggggcagaaagcccacagagtg

SEQ ID NO: 9373389 - DNA, 22 bp, Homo sapiens
ggggcagctcccgagggcagga

SEQ ID NO: 9373390 - DNA, 22 bp, Homo sapiens
ggggcagctaccggaagtaggg

SEQ ID NO: 9373391 - DNA, 22 bp, Homo sapiens
ggggcagctaccggaagtaggg

SEQ ID NO: 9373392 - DNA, 22 bp, Homo sapiens
ggggatggtgggaaggcaatct

SEQ ID NO: 9373393 - DNA, 22 bp, Homo sapiens
ggggcacttggcacctctgcag

SEQ ID NO: 9373394 - DNA, 22 bp, Homo sapiens
ggggatggtagaccggtgacgt

SEQ ID NO: 9373395 - DNA, 22 bp, Homo sapiens
ggggatggaatgtagtagtgat

SEQ ID NO: 9373396 - DNA, 22 bp, Homo sapiens
ggggatggaatgtagtagtgat

SEQ ID NO: 9373397 - DNA, 22 bp, Homo sapiens
ggggatggaatgtagtagtgat

SEQ ID NO: 9373398 - DNA, 22 bp, Homo sapiens
ggggatggaatgtagtagtgat

SEQ ID NO: 9373399 - DNA, 22 bp, Homo sapiens
ggggatggaggcgtgtggtcct

SEQ ID NO: 9373400 - DNA, 22 bp, Homo sapiens
ggggatggaggcgtgtggtcct

SEQ ID NO: 9373401 - DNA, 22 bp, Homo sapiens
ggggatggaggcgtgtggtcct

SEQ ID NO: 9373402 - DNA, 22 bp, Homo sapiens
gggctgggcatggtgttccctc

SEQ ID NO: 9373403 - DNA, 22 bp, Homo sapiens
gggctgggcatggtgttccctc

SEQ ID NO: 9373404 - DNA, 16 bp, Homo sapiens
gggctgggggattctg

SEQ ID NO: 9373405 - DNA, 22 bp, Homo sapiens
gggctggggctcaataatttgt

SEQ ID NO: 9373406 - DNA, 22 bp, Homo sapiens
gggctggggctcaataatttgt

SEQ ID NO: 9373407 - DNA, 22 bp, Homo sapiens
gggctgggcatggtgttccctc

SEQ ID NO: 9373408 - DNA, 22 bp, Homo sapiens
gggctgggaatggctaagtatg

SEQ ID NO: 9373409 - DNA, 22 bp, Homo sapiens
gggctggctgattttcctctct

SEQ ID NO: 9373410 - DNA, 22 bp, Homo sapiens
gggctggctctgtctagaaagg

SEQ ID NO: 9373411 - DNA, 22 bp, Homo sapiens
gggctggctctgtctagaaagg

SEQ ID NO: 9373412 - DNA, 22 bp, Homo sapiens
gggctggctcccaggtgttgaa

SEQ ID NO: 9373413 - DNA, 22 bp, Homo sapiens
gggctgggattgcttgctgtga

SEQ ID NO: 9373414 - DNA, 22 bp, Homo sapiens
gggctgggatggcttgaagatt

SEQ ID NO: 9373415 - DNA, 20 bp, Homo sapiens
gggggccagcagcagacgcc

SEQ ID NO: 9373416 - DNA, 22 bp, Homo sapiens
gggggcagtaaggatatggaaa

SEQ ID NO: 9373417 - DNA, 22 bp, Homo sapiens
gggggccagtcatctcccaaga

SEQ ID NO: 9373418 - DNA, 22 bp, Homo sapiens
gggggccagtgtctcttccttg

SEQ ID NO: 9373419 - DNA, 22 bp, Homo sapiens
gggggccatcttcaaggatgtg

SEQ ID NO: 9373420 - DNA, 23 bp, Homo sapiens
gggggccgtcctggggattatag

SEQ ID NO: 9373421 - DNA, 22 bp, Homo sapiens
gggtcacttttgctatgttggc

SEQ ID NO: 9373422 - DNA, 22 bp, Homo sapiens
gggtcagagcaagactggggtc

SEQ ID NO: 9373423 - DNA, 22 bp, Homo sapiens
gggtcacttttgctatgttggc

SEQ ID NO: 9373424 - DNA, 22 bp, Homo sapiens
gggtattaaaatgaaggagaaa

SEQ ID NO: 9373425 - DNA, 22 bp, Homo sapiens
gggtcaaggctacatggagacc

SEQ ID NO: 9373426 - DNA, 22 bp, Homo sapiens
gggtcagagttcaggtcgaggg

SEQ ID NO: 9373427 - DNA, 22 bp, Homo sapiens
gggtagtttaattaggaagaaa

SEQ ID NO: 9373428 - DNA, 23 bp, Homo sapiens
gggggcgtgtcatggagggccac

SEQ ID NO: 9373429 - DNA, 22 bp, Homo sapiens
gggggcggagcacgtgaccacg

SEQ ID NO: 9373430 - DNA, 22 bp, Homo sapiens
gggggaagactgggctagtgat

SEQ ID NO: 9373431 - DNA, 22 bp, Homo sapiens
gggggaagactgggctagtgat

SEQ ID NO: 9373432 - DNA, 22 bp, Homo sapiens
gggggaagaaagaacatggcat

SEQ ID NO: 9373433 - DNA, 22 bp, Homo sapiens
ggggcttccagcgcccgccggt

SEQ ID NO: 9373434 - DNA, 22 bp, Homo sapiens
ggggcttccagcgcccgccggt

SEQ ID NO: 9373435 - DNA, 22 bp, Homo sapiens
ggggcttctttctgccaccgac

SEQ ID NO: 9373436 - DNA, 22 bp, Homo sapiens
ggggcttctttctgccaccgac

SEQ ID NO: 9373437 - DNA, 22 bp, Homo sapiens
ggggcttttgcacgtgggaggc

SEQ ID NO: 9373438 - DNA, 22 bp, Homo sapiens
ggggcaggaggtgttctctttt

SEQ ID NO: 9373439 - DNA, 22 bp, Homo sapiens
ggggcaggaggtgttctctttt

SEQ ID NO: 9373440 - DNA, 22 bp, Homo sapiens
ggggcaggaggtgttctctttt

SEQ ID NO: 9373441 - DNA, 22 bp, Homo sapiens
ggggcaggagcccttcttcagc

SEQ ID NO: 9373442 - DNA, 22 bp, Homo sapiens
ggggcaggagcccttcttcagc

SEQ ID NO: 9373443 - DNA, 22 bp, Homo sapiens
ggggcagctcccgagggcagga

SEQ ID NO: 9373444 - DNA, 22 bp, Homo sapiens
ggggcaggagcccttcttcagc

SEQ ID NO: 9373445 - DNA, 22 bp, Homo sapiens
ggtcagcagtttctttgaattt

SEQ ID NO: 9373446 - DNA, 22 bp, Homo sapiens
ggtagggatgggatttggaagt

SEQ ID NO: 9373447 - DNA, 22 bp, Homo sapiens
ggtcagcatctggttgagggca

SEQ ID NO: 9373448 - DNA, 21 bp, Homo sapiens
ggtagggaaggttcgctggtg

SEQ ID NO: 9373449 - DNA, 21 bp, Homo sapiens
ggtagggaaggttcgctggtg

SEQ ID NO: 9373450 - DNA, 22 bp, Homo sapiens
ggtagggaaggtctcccacatt

SEQ ID NO: 9373451 - DNA, 22 bp, Homo sapiens
ggtagggaaggctctgcgggga

SEQ ID NO: 9373452 - DNA, 22 bp, Homo sapiens
ggtagggaaggctctgcgggga

SEQ ID NO: 9373453 - DNA, 22 bp, Homo sapiens
ggtcagctctttgggctggtgg

SEQ ID NO: 9373454 - DNA, 22 bp, Homo sapiens
ggtcagccttggatttggtagc

SEQ ID NO: 9373455 - DNA, 19 bp, Homo sapiens
ggtcagctgggctagaggc

SEQ ID NO: 9373456 - DNA, 22 bp, Homo sapiens
ggtcagccttggatttggtagc

SEQ ID NO: 9373457 - DNA, 22 bp, Homo sapiens
ggtcaggatccaagtctgtgct

SEQ ID NO: 9373458 - DNA, 22 bp, Homo sapiens
ggtcaggatccaagtctgtgct

SEQ ID NO: 9373459 - DNA, 21 bp, Homo sapiens
ggtcaggcatgtgccctgagc

SEQ ID NO: 9373460 - DNA, 21 bp, Homo sapiens
ggtcaggcatgtgccctgagc

SEQ ID NO: 9373461 - DNA, 22 bp, Homo sapiens
ggtaggagtattttgcagcagt

SEQ ID NO: 9373462 - DNA, 22 bp, Homo sapiens
ggtaggagtattttgcagcagt

SEQ ID NO: 9373463 - DNA, 22 bp, Homo sapiens
ggtagctgcagcaggctggcaa

SEQ ID NO: 9373464 - DNA, 22 bp, Homo sapiens
ggtaggaagatagagcaaagtt

SEQ ID NO: 9373465 - DNA, 22 bp, Homo sapiens
ggtaggcaaactacagttagct

SEQ ID NO: 9373466 - DNA, 22 bp, Homo sapiens
ggtaggagtattttgcagcagt

SEQ ID NO: 9373467 - DNA, 22 bp, Homo sapiens
ggtaggcagatcactgtctatg

SEQ ID NO: 9373468 - DNA, 22 bp, Homo sapiens
ggtaggcagatcactgtctatg

SEQ ID NO: 9373469 - DNA, 22 bp, Homo sapiens
ggtaggcactggtgggaagaga

SEQ ID NO: 9373470 - DNA, 22 bp, Homo sapiens
ggtaggcactggtgggaagaga

SEQ ID NO: 9373471 - DNA, 22 bp, Homo sapiens
ggtagcgagaacagaccttaag

SEQ ID NO: 9373472 - DNA, 22 bp, Homo sapiens
ggtagcaagcgcttgccctgcg

SEQ ID NO: 9373473 - DNA, 20 bp, Homo sapiens
ggtagcagctgctgtcatcc

SEQ ID NO: 9373474 - DNA, 22 bp, Homo sapiens
ggtccaggatcaaggcatcacc

SEQ ID NO: 9373475 - DNA, 22 bp, Homo sapiens
ggtccaggatcaaggcatcacc

SEQ ID NO: 9373476 - DNA, 22 bp, Homo sapiens
ggtccaggtcctgtgacagcag

SEQ ID NO: 9373477 - DNA, 22 bp, Homo sapiens
ggtccaggtcctgtgacagcag

SEQ ID NO: 9373478 - DNA, 22 bp, Homo sapiens
ggtccaggtatgtggtgtgaat

SEQ ID NO: 9373479 - DNA, 23 bp, Homo sapiens
ggtccaggaaaggcagcagcacc

SEQ ID NO: 9373480 - DNA, 23 bp, Homo sapiens
ggtccaggaaaggcagcagcacc

SEQ ID NO: 9373481 - DNA, 23 bp, Homo sapiens
ggtccaggaaaggcagcagcacc

SEQ ID NO: 9373482 - DNA, 22 bp, Homo sapiens
ggtccagccaggtgctcatgcc

SEQ ID NO: 9373483 - DNA, 22 bp, Homo sapiens
ggtccagagctgatggtctttt

SEQ ID NO: 9373484 - DNA, 19 bp, Homo sapiens
ggtccagcacagttccagg

SEQ ID NO: 9373485 - DNA, 22 bp, Homo sapiens
ggtccagcacaacactggcatg

SEQ ID NO: 9373486 - DNA, 22 bp, Homo sapiens
ggtcagggttccaggtatcttc

SEQ ID NO: 9373487 - DNA, 22 bp, Homo sapiens
ggtcagggttccaggtatcttc

SEQ ID NO: 9373488 - DNA, 22 bp, Homo sapiens
ggtcaggggctgctctacagag

SEQ ID NO: 9373489 - DNA, 22 bp, Homo sapiens
ggtcaggggctgctctacagag

SEQ ID NO: 9373490 - DNA, 22 bp, Homo sapiens
ggtcaggggctgctctacagag

SEQ ID NO: 9373491 - DNA, 22 bp, Homo sapiens
ggtcagggctgggtatgaagag

SEQ ID NO: 9373492 - DNA, 22 bp, Homo sapiens
ggtcagggctgggtatgaagag

SEQ ID NO: 9373493 - DNA, 18 bp, Homo sapiens
ggtcaggggcggagagaa

SEQ ID NO: 9373494 - DNA, 22 bp, Homo sapiens
ggtcagggggatctgtgaggta

SEQ ID NO: 9373495 - DNA, 22 bp, Homo sapiens
ggtcagggggatctgtgaggta

SEQ ID NO: 9373496 - DNA, 22 bp, Homo sapiens
ggtcagggggatctgtgaggta

SEQ ID NO: 9373497 - DNA, 21 bp, Homo sapiens
ggtcagggggtgcctccaggt

SEQ ID NO: 9373498 - DNA, 22 bp, Homo sapiens
ggtcagggtataatcaagtgag

SEQ ID NO: 9373499 - DNA, 22 bp, Homo sapiens
ggtcagggtataatcaagtgag

SEQ ID NO: 9373500 - DNA, 22 bp, Homo sapiens
gggtcaggcctcaaggtgggct

SEQ ID NO: 9373501 - DNA, 22 bp, Homo sapiens
gggtcaggctagcccagacttc

SEQ ID NO: 9373502 - DNA, 22 bp, Homo sapiens
gggtcaggctagcccagacttc

SEQ ID NO: 9373503 - DNA, 22 bp, Homo sapiens
gggtcaggctagcccagacttc

SEQ ID NO: 9373504 - DNA, 22 bp, Homo sapiens
gggtcaggcctcaaggtgggct

SEQ ID NO: 9373505 - DNA, 22 bp, Homo sapiens
gggtcaggaagaattctgccaa

SEQ ID NO: 9373506 - DNA, 22 bp, Homo sapiens
gggtcagggctgcctgggctca

SEQ ID NO: 9373507 - DNA, 22 bp, Homo sapiens
gggtcagggctgcctgggctca

SEQ ID NO: 9373508 - DNA, 22 bp, Homo sapiens
gggtcagggctgcctgggctca

SEQ ID NO: 9373509 - DNA, 22 bp, Homo sapiens
gggtcagggaggccccaccatg

SEQ ID NO: 9373510 - DNA, 22 bp, Homo sapiens
gggtcaggctcagcagggcagc

SEQ ID NO: 9373511 - DNA, 22 bp, Homo sapiens
gggtcaggctcagcagggcagc

SEQ ID NO: 9373512 - DNA, 22 bp, Homo sapiens
gggtcaggctcagcagggcagc

SEQ ID NO: 9373513 - DNA, 23 bp, Homo sapiens
gggtccagagaagccattagggc

SEQ ID NO: 9373514 - DNA, 22 bp, Homo sapiens
gggtccagagttttcccgccct

SEQ ID NO: 9373515 - DNA, 22 bp, Homo sapiens
gggtccagactatgaagaactt

SEQ ID NO: 9373516 - DNA, 22 bp, Homo sapiens
gggtccagacactccagaggaa

SEQ ID NO: 9373517 - DNA, 22 bp, Homo sapiens
gggtccacctgagcagcagcct

SEQ ID NO: 9373518 - DNA, 22 bp, Homo sapiens
gggtccagatggtgagagttaa

SEQ ID NO: 9373519 - DNA, 22 bp, Homo sapiens
ggtaacttagctcatggctgtg

SEQ ID NO: 9373520 - DNA, 22 bp, Homo sapiens
ggtaaggagctccggcttctgc

SEQ ID NO: 9373521 - DNA, 22 bp, Homo sapiens
ggtacagggcttcctggacaag

SEQ ID NO: 9373522 - DNA, 22 bp, Homo sapiens
ggtacagaataaaaatcctaca

SEQ ID NO: 9373523 - DNA, 22 bp, Homo sapiens
ggtaagcacttcatgtacatga

SEQ ID NO: 9373524 - DNA, 22 bp, Homo sapiens
ggtacagggcttcctggacaag

SEQ ID NO: 9373525 - DNA, 22 bp, Homo sapiens
ggtacagacagggctgcctggg

SEQ ID NO: 9373526 - DNA, 19 bp, Homo sapiens
ggtagaagggaagtgtttt

SEQ ID NO: 9373527 - DNA, 22 bp, Homo sapiens
ggtagacaactttgtaatagcc

SEQ ID NO: 9373528 - DNA, 22 bp, Homo sapiens
ggtgcctgatggtgatgaggtc

SEQ ID NO: 9373529 - DNA, 22 bp, Homo sapiens
ggtgccgttgaggaagtaactg

SEQ ID NO: 9373530 - DNA, 22 bp, Homo sapiens
ggtgcctgtatttggggcacag

SEQ ID NO: 9373531 - DNA, 22 bp, Homo sapiens
ggtgcctgatggtgatgaggtc

SEQ ID NO: 9373532 - DNA, 22 bp, Homo sapiens
ggtgcccagcgaagtggctgtg

SEQ ID NO: 9373533 - DNA, 22 bp, Homo sapiens
ggtgccttttccgtgtggccca

SEQ ID NO: 9373534 - DNA, 22 bp, Homo sapiens
ggtgcctttggcccctggctag

SEQ ID NO: 9373535 - DNA, 22 bp, Homo sapiens
ggtgccttcctgccagccgcaa

SEQ ID NO: 9373536 - DNA, 22 bp, Homo sapiens
ggtgccttcctgccagccgcaa

SEQ ID NO: 9373537 - DNA, 22 bp, Homo sapiens
ggtggctctgttgtcaactgat

SEQ ID NO: 9373538 - DNA, 22 bp, Homo sapiens
ggtggctgaagcagtcttcggg

SEQ ID NO: 9373539 - DNA, 22 bp, Homo sapiens
ggtgccagatgaggcccgcgat

SEQ ID NO: 9373540 - DNA, 22 bp, Homo sapiens
ggtgccagatgaggcccgcgat

SEQ ID NO: 9373541 - DNA, 22 bp, Homo sapiens
ggtgccagcctagtgcagtggt

SEQ ID NO: 9373542 - DNA, 22 bp, Homo sapiens
ggtgccagcctagtgcagtggt

SEQ ID NO: 9373543 - DNA, 22 bp, Homo sapiens
ggtgccagcctagtgcagtggt

SEQ ID NO: 9373544 - DNA, 22 bp, Homo sapiens
ggtgccagagtggcccaggggc

SEQ ID NO: 9373545 - DNA, 22 bp, Homo sapiens
ggtgccagtgggtctcaggata

SEQ ID NO: 9373546 - DNA, 22 bp, Homo sapiens
ggtgccagtgggtctcaggata

SEQ ID NO: 9373547 - DNA, 22 bp, Homo sapiens
ggtgccagtgggtctcaggata

SEQ ID NO: 9373548 - DNA, 22 bp, Homo sapiens
ggtgccaggctgtagtcagggt

SEQ ID NO: 9373549 - DNA, 22 bp, Homo sapiens
ggtgccagtgggtctcaggata

SEQ ID NO: 9373550 - DNA, 22 bp, Homo sapiens
ggtgccaggctgtagtcagggt

SEQ ID NO: 9373551 - DNA, 22 bp, Homo sapiens
ggtgccaggctgtagtcagggt

SEQ ID NO: 9373552 - DNA, 22 bp, Homo sapiens
ggtgccaggctcccagctcagg

SEQ ID NO: 9373553 - DNA, 22 bp, Homo sapiens
ggtgccaggctcccagctcagg

SEQ ID NO: 9373554 - DNA, 23 bp, Homo sapiens
ggtgggagattatccagaattat

SEQ ID NO: 9373555 - DNA, 22 bp, Homo sapiens
ggtgggagagcttgctttgatg

SEQ ID NO: 9373556 - DNA, 22 bp, Homo sapiens
ggtggctgcaccctggctaact

SEQ ID NO: 9373557 - DNA, 22 bp, Homo sapiens
ggtggctgcaatggctaacttc

SEQ ID NO: 9373558 - DNA, 22 bp, Homo sapiens
ggtgggaggcaggctgctccca

SEQ ID NO: 9373559 - DNA, 22 bp, Homo sapiens
ggtgggagtggaacgtggaaga

SEQ ID NO: 9373560 - DNA, 22 bp, Homo sapiens
ggtgggagtggaacgtggaaga

SEQ ID NO: 9373561 - DNA, 16 bp, Homo sapiens
ggtgggaggtgaggtg

SEQ ID NO: 9373562 - DNA, 16 bp, Homo sapiens
ggtgggaggtgaggtg

SEQ ID NO: 9373563 - DNA, 21 bp, Homo sapiens
ggtgggcacaggagagcagag

SEQ ID NO: 9373564 - DNA, 22 bp, Homo sapiens
ggtgggcaacatttggcctgag

SEQ ID NO: 9373565 - DNA, 17 bp, Homo sapiens
ggtctggggccattggc

SEQ ID NO: 9373566 - DNA, 22 bp, Homo sapiens
ggtctgtcacttactagctgta

SEQ ID NO: 9373567 - DNA, 22 bp, Homo sapiens
ggtctgtctttatatctggttc

SEQ ID NO: 9373568 - DNA, 22 bp, Homo sapiens
ggtctggggcaggcatctgaca

SEQ ID NO: 9373569 - DNA, 22 bp, Homo sapiens
ggtctgtgtcataggctgagtt

SEQ ID NO: 9373570 - DNA, 22 bp, Homo sapiens
ggtctggcctcgggcaccccca

SEQ ID NO: 9373571 - DNA, 22 bp, Homo sapiens
ggtcccaatctaatcacatgag

SEQ ID NO: 9373572 - DNA, 22 bp, Homo sapiens
ggtcccaaggaggatgaggcta

SEQ ID NO: 9373573 - DNA, 17 bp, Homo sapiens
ggtctgtgtctagggaa

SEQ ID NO: 9373574 - DNA, 21 bp, Homo sapiens
ggtcttccaaataaggagaaa

SEQ ID NO: 9373575 - DNA, 22 bp, Homo sapiens
ggtgaaattccttgtggaaagt

SEQ ID NO: 9373576 - DNA, 22 bp, Homo sapiens
ggtgaacattgatgtggttaca

SEQ ID NO: 9373577 - DNA, 22 bp, Homo sapiens
ggtgaaatatttttgatatgtt

SEQ ID NO: 9373578 - DNA, 18 bp, Homo sapiens
ggtctttaggtcagtgtc

SEQ ID NO: 9373579 - DNA, 22 bp, Homo sapiens
ggtgaaggtcagagcaggaaaa

SEQ ID NO: 9373580 - DNA, 22 bp, Homo sapiens
ggtgaagggtgtcatggcattt

SEQ ID NO: 9373581 - DNA, 22 bp, Homo sapiens
ggtgaagggccttaggagacag

SEQ ID NO: 9373582 - DNA, 22 bp, Homo sapiens
ggtgaagggtgtcatggcattt

SEQ ID NO: 9373583 - DNA, 22 bp, Homo sapiens
ggtgaaggtggaacgcagagca

SEQ ID NO: 9373584 - DNA, 22 bp, Homo sapiens
ggtgaaggtggaacgcagagca

SEQ ID NO: 9373585 - DNA, 22 bp, Homo sapiens
ggtgaagtaataccaggtgtac

SEQ ID NO: 9373586 - DNA, 22 bp, Homo sapiens
ggtgaaggtggaacgcagagca

SEQ ID NO: 9373587 - DNA, 22 bp, Homo sapiens
ggtgaaggtctactgtgtgcca

SEQ ID NO: 9373588 - DNA, 22 bp, Homo sapiens
ggtgaaggtctactgtgtgcca

SEQ ID NO: 9373589 - DNA, 22 bp, Homo sapiens
ggtgaaggtcagagcaggaaaa

SEQ ID NO: 9373590 - DNA, 22 bp, Homo sapiens
ggtgaaggcacaagagggcaag

SEQ ID NO: 9373591 - DNA, 22 bp, Homo sapiens
ggtgaaggcacaagagggcaag

SEQ ID NO: 9373592 - DNA, 22 bp, Homo sapiens
ggtgaaggaggaagctgatgga

SEQ ID NO: 9373593 - DNA, 22 bp, Homo sapiens
ggtgaagcgtatttgtggagct

SEQ ID NO: 9373594 - DNA, 22 bp, Homo sapiens
ggtgaagcgtatttgtggagct

SEQ ID NO: 9373595 - DNA, 22 bp, Homo sapiens
ggtgaagggccttaggagacag

SEQ ID NO: 9373596 - DNA, 22 bp, Homo sapiens
ggtgaagggccttaggagacag

SEQ ID NO: 9373597 - DNA, 22 bp, Homo sapiens
ggtgaagggccttaggagacag

SEQ ID NO: 9373598 - DNA, 22 bp, Homo sapiens
ggtgaaggcacaagagggcaag

SEQ ID NO: 9373599 - DNA, 22 bp, Homo sapiens
ggtgcagggagaggcaggcccc

SEQ ID NO: 9373600 - DNA, 20 bp, Homo sapiens
ggtgcaggtaacgctgtgct

SEQ ID NO: 9373601 - DNA, 22 bp, Homo sapiens
ggtgcagggagaggcaggcccc

SEQ ID NO: 9373602 - DNA, 22 bp, Homo sapiens
ggtgcagggagaggcaggcccc

SEQ ID NO: 9373603 - DNA, 20 bp, Homo sapiens
ggtgcaggtaacgctgtgct

SEQ ID NO: 9373604 - DNA, 20 bp, Homo sapiens
ggtgcaggtaacgctgtgct

SEQ ID NO: 9373605 - DNA, 20 bp, Homo sapiens
ggtgcaggtaacgctgtgct

SEQ ID NO: 9373606 - DNA, 18 bp, Homo sapiens
ggcatctgcacagcagcc

SEQ ID NO: 9373607 - DNA, 22 bp, Homo sapiens
ggcatctgagctgtgtatggtt

SEQ ID NO: 9373608 - DNA, 22 bp, Homo sapiens
ggcatcttgttgctcaaatcta

SEQ ID NO: 9373609 - DNA, 22 bp, Homo sapiens
ggcatgagaggtcctggggatt

SEQ ID NO: 9373610 - DNA, 22 bp, Homo sapiens
ggcatgagaggtcctggggatt

SEQ ID NO: 9373611 - DNA, 22 bp, Homo sapiens
ggcatgagaggtcctggggatt

SEQ ID NO: 9373612 - DNA, 22 bp, Homo sapiens
ggcatgagaggtcctggggatt

SEQ ID NO: 9373613 - DNA, 20 bp, Homo sapiens
ggcatgagatgtgagggagg

SEQ ID NO: 9373614 - DNA, 20 bp, Homo sapiens
ggcatgagatgtgagggagg

SEQ ID NO: 9373615 - DNA, 21 bp, Homo sapiens
ggcatgagggcagtgagcaga

SEQ ID NO: 9373616 - DNA, 21 bp, Homo sapiens
ggcatgagggcagtgagcaga

SEQ ID NO: 9373617 - DNA, 22 bp, Homo sapiens
ggcatgagtaacgtgagtgagg

SEQ ID NO: 9373618 - DNA, 22 bp, Homo sapiens
ggcatcgtcctgggcataggga

SEQ ID NO: 9373619 - DNA, 22 bp, Homo sapiens
ggcatcgtcctgggcataggga

SEQ ID NO: 9373620 - DNA, 20 bp, Homo sapiens
ggcatccttctgacccagag

SEQ ID NO: 9373621 - DNA, 22 bp, Homo sapiens
ggcatcctctagaagctggaaa

SEQ ID NO: 9373622 - DNA, 22 bp, Homo sapiens
ggcatcagtatggccatagggt

SEQ ID NO: 9373623 - DNA, 22 bp, Homo sapiens
ggcatcagggtaggaaggtatc

SEQ ID NO: 9373624 - DNA, 22 bp, Homo sapiens
ggcagtggtgggaggctcgctc

SEQ ID NO: 9373625 - DNA, 22 bp, Homo sapiens
ggcatgagtggcagtgggcagt

SEQ ID NO: 9373626 - DNA, 22 bp, Homo sapiens
ggcatgagtggcagtgggcagt

SEQ ID NO: 9373627 - DNA, 22 bp, Homo sapiens
ggcatgagtggcagtgggcagt

SEQ ID NO: 9373628 - DNA, 22 bp, Homo sapiens
ggcatgcatacgtagtgatttt

SEQ ID NO: 9373629 - DNA, 22 bp, Homo sapiens
ggcatgcaaatgtgggtgacct

SEQ ID NO: 9373630 - DNA, 22 bp, Homo sapiens
ggcatgcaaatgtgggtgacct

SEQ ID NO: 9373631 - DNA, 23 bp, Homo sapiens
ggcatgcaatggacagagctgga

SEQ ID NO: 9373632 - DNA, 22 bp, Homo sapiens
ggcatgcaaatgtgggtgacct

SEQ ID NO: 9373633 - DNA, 22 bp, Homo sapiens
ggccagctgtaagctgctgaat

SEQ ID NO: 9373634 - DNA, 22 bp, Homo sapiens
ggccagctgtaagctgctgaat

SEQ ID NO: 9373635 - DNA, 22 bp, Homo sapiens
ggccagctgggccaccaggtgc

SEQ ID NO: 9373636 - DNA, 22 bp, Homo sapiens
ggcatgctctgggggtcctccg

SEQ ID NO: 9373637 - DNA, 22 bp, Homo sapiens
ggcatgctctttgtccacagta

SEQ ID NO: 9373638 - DNA, 22 bp, Homo sapiens
ggcatgcatgttgttttaggtg

SEQ ID NO: 9373639 - DNA, 22 bp, Homo sapiens
ggcatgcatgcaaggtggtgta

SEQ ID NO: 9373640 - DNA, 19 bp, Homo sapiens
ggccagctgtctcctgcta

SEQ ID NO: 9373641 - DNA, 22 bp, Homo sapiens
ggccagctgtggggccgagcct

SEQ ID NO: 9373642 - DNA, 22 bp, Homo sapiens
ggccagcttattagctcagagg

SEQ ID NO: 9373643 - DNA, 22 bp, Homo sapiens
ggccagcttctctgctgcctgt

SEQ ID NO: 9373644 - DNA, 22 bp, Homo sapiens
ggccagcttctctgctgcctgt

SEQ ID NO: 9373645 - DNA, 22 bp, Homo sapiens
ggccagcttctctgctgcctgt

SEQ ID NO: 9373646 - DNA, 22 bp, Homo sapiens
ggccaggaacttttgggatggg

SEQ ID NO: 9373647 - DNA, 22 bp, Homo sapiens
ggccaggaacttttgggatggg

SEQ ID NO: 9373648 - DNA, 22 bp, Homo sapiens
ggccaggaacgatcctaccctt

SEQ ID NO: 9373649 - DNA, 22 bp, Homo sapiens
ggccagctttgagctgcaggaa

SEQ ID NO: 9373650 - DNA, 22 bp, Homo sapiens
ggccagctttgagctgcaggaa

SEQ ID NO: 9373651 - DNA, 22 bp, Homo sapiens
ggccagctttgagctgcaggaa

SEQ ID NO: 9373652 - DNA, 22 bp, Homo sapiens
ggcagggtatgattacctctga

SEQ ID NO: 9373653 - DNA, 22 bp, Homo sapiens
ggcagggtaaaccgaggtaagt

SEQ ID NO: 9373654 - DNA, 22 bp, Homo sapiens
ggcagggtgcctggctcctgtt

SEQ ID NO: 9373655 - DNA, 22 bp, Homo sapiens
ggcagggtctggactgaaagct

SEQ ID NO: 9373656 - DNA, 22 bp, Homo sapiens
ggcagggtccacacctgggaaa

SEQ ID NO: 9373657 - DNA, 22 bp, Homo sapiens
ggcaggagataaaatattagtt

SEQ ID NO: 9373658 - DNA, 22 bp, Homo sapiens
ggcagctttggattcgcggctg

SEQ ID NO: 9373659 - DNA, 22 bp, Homo sapiens
ggcaggagaatggcgtgaactc

SEQ ID NO: 9373660 - DNA, 22 bp, Homo sapiens
ggcaggagctcaggttggttcc

SEQ ID NO: 9373661 - DNA, 18 bp, Homo sapiens
ggcaggagcaagaatagg

SEQ ID NO: 9373662 - DNA, 22 bp, Homo sapiens
ggcaggaggaagagttagcacc

SEQ ID NO: 9373663 - DNA, 22 bp, Homo sapiens
ggcaggagctctccagtttgcc

SEQ ID NO: 9373664 - DNA, 22 bp, Homo sapiens
ggcaggagctctccagtttgcc

SEQ ID NO: 9373665 - DNA, 17 bp, Homo sapiens
ggcaggtgacagacacc

SEQ ID NO: 9373666 - DNA, 17 bp, Homo sapiens
ggcaggtgacagacacc

SEQ ID NO: 9373667 - DNA, 17 bp, Homo sapiens
ggcaggtgacagacacc

SEQ ID NO: 9373668 - DNA, 17 bp, Homo sapiens
ggcaggtgacagacacc

SEQ ID NO: 9373669 - DNA, 22 bp, Homo sapiens
ggcaggtagcctagaggaggtt

SEQ ID NO: 9373670 - DNA, 22 bp, Homo sapiens
ggcaggtcatcaactgtaattt

SEQ ID NO: 9373671 - DNA, 22 bp, Homo sapiens
ggcaggtaggccccctctccag

SEQ ID NO: 9373672 - DNA, 22 bp, Homo sapiens
ggcaggtgacctggcctcccag

SEQ ID NO: 9373673 - DNA, 22 bp, Homo sapiens
ggcaggtgacctggcctcccag

SEQ ID NO: 9373674 - DNA, 22 bp, Homo sapiens
ggcaggtgacggggatgagtat

SEQ ID NO: 9373675 - DNA, 22 bp, Homo sapiens
ggcaggtgacctggcctcccag

SEQ ID NO: 9373676 - DNA, 22 bp, Homo sapiens
ggcaggtgacggggatgagtat

SEQ ID NO: 9373677 - DNA, 22 bp, Homo sapiens
ggcaggtgagagctctttgaaa

SEQ ID NO: 9373678 - DNA, 22 bp, Homo sapiens
ggcaggtgagagctctttgaaa

SEQ ID NO: 9373679 - DNA, 22 bp, Homo sapiens
ggcaggtgagagctctttgaaa

SEQ ID NO: 9373680 - DNA, 22 bp, Homo sapiens
ggcaggtgacggggatgagtat

SEQ ID NO: 9373681 - DNA, 22 bp, Homo sapiens
ggcaggtgaggcatgtgcctgg

SEQ ID NO: 9373682 - DNA, 22 bp, Homo sapiens
ggcagggtggcagaggctcaga

SEQ ID NO: 9373683 - DNA, 22 bp, Homo sapiens
ggcagggtggcagaggctcaga

SEQ ID NO: 9373684 - DNA, 22 bp, Homo sapiens
ggcagggtggccctccagtgag

SEQ ID NO: 9373685 - DNA, 22 bp, Homo sapiens
ggcagggtggccctccagtgag

SEQ ID NO: 9373686 - DNA, 17 bp, Homo sapiens
ggcagggtgctgggtat

SEQ ID NO: 9373687 - DNA, 19 bp, Homo sapiens
ggcaggtagagggccagtc

SEQ ID NO: 9373688 - DNA, 22 bp, Homo sapiens
ggcaggtactggggagtgaaga

SEQ ID NO: 9373689 - DNA, 22 bp, Homo sapiens
ggcaggtacagcaagaggacaa

SEQ ID NO: 9373690 - DNA, 22 bp, Homo sapiens
ggcagggtgtggagttgggaca

SEQ ID NO: 9373691 - DNA, 22 bp, Homo sapiens
ggccaggaggcaggggctcaat

SEQ ID NO: 9373692 - DNA, 22 bp, Homo sapiens
ggccaggagcaagccaggctct

SEQ ID NO: 9373693 - DNA, 22 bp, Homo sapiens
ggccaggagctgcacagggctc

SEQ ID NO: 9373694 - DNA, 22 bp, Homo sapiens
ggccaggagctgcacagggctc

SEQ ID NO: 9373695 - DNA, 22 bp, Homo sapiens
ggccaggagcaagccaggctct

SEQ ID NO: 9373696 - DNA, 22 bp, Homo sapiens
ggccaggagcaagccaggctct

SEQ ID NO: 9373697 - DNA, 22 bp, Homo sapiens
ggccaggagatggacaccacat

SEQ ID NO: 9373698 - DNA, 22 bp, Homo sapiens
ggccaggaagggaagatcagca

SEQ ID NO: 9373699 - DNA, 22 bp, Homo sapiens
ggccaggcactgtgtgagatat

SEQ ID NO: 9373700 - DNA, 22 bp, Homo sapiens
ggccaggcactgtgtgagatat

SEQ ID NO: 9373701 - DNA, 22 bp, Homo sapiens
ggccaggcactgtgtgagatat

SEQ ID NO: 9373702 - DNA, 22 bp, Homo sapiens
ggccaggcactgtgtgagatat

SEQ ID NO: 9373703 - DNA, 22 bp, Homo sapiens
ggccaggcactgtgtgagatat

SEQ ID NO: 9373704 - DNA, 22 bp, Homo sapiens
ggccaggccaagagggttggaa

SEQ ID NO: 9373705 - DNA, 22 bp, Homo sapiens
ggccaggcgatgacccctccac

SEQ ID NO: 9373706 - DNA, 22 bp, Homo sapiens
ggccctggcagccacgaaagcc

SEQ ID NO: 9373707 - DNA, 22 bp, Homo sapiens
ggccctgctgagtggagtggag

SEQ ID NO: 9373708 - DNA, 22 bp, Homo sapiens
ggccctggcagccacgaaagcc

SEQ ID NO: 9373709 - DNA, 22 bp, Homo sapiens
ggccctggcagccacgaaagcc

SEQ ID NO: 9373710 - DNA, 22 bp, Homo sapiens
ggccctggcagccacgaaagcc

SEQ ID NO: 9373711 - DNA, 19 bp, Homo sapiens
ggccaggctgactgtggtc

SEQ ID NO: 9373712 - DNA, 22 bp, Homo sapiens
ggccctgctcaggctgcgatga

SEQ ID NO: 9373713 - DNA, 22 bp, Homo sapiens
ggccaggcgatgacccctccac

SEQ ID NO: 9373714 - DNA, 22 bp, Homo sapiens
ggccaggccaagagggttggaa

SEQ ID NO: 9373715 - DNA, 22 bp, Homo sapiens
ggccctgctcaggctgcgatga

SEQ ID NO: 9373716 - DNA, 22 bp, Homo sapiens
ggccctgctgaagccgggtcta

SEQ ID NO: 9373717 - DNA, 22 bp, Homo sapiens
ggccctggtcctaggggtggaa

SEQ ID NO: 9373718 - DNA, 22 bp, Homo sapiens
ggccctggtcctaggggtggaa

SEQ ID NO: 9373719 - DNA, 21 bp, Homo sapiens
ggccctggttacgcctcctct

SEQ ID NO: 9373720 - DNA, 22 bp, Homo sapiens
ggccctgggcagaggagtgggc

SEQ ID NO: 9373721 - DNA, 22 bp, Homo sapiens
ggccctgggccctctagcttgt

SEQ ID NO: 9373722 - DNA, 22 bp, Homo sapiens
ggccctgggatgctcagcagtg

SEQ ID NO: 9373723 - DNA, 22 bp, Homo sapiens
ggccctgggatgctcagcagtg

SEQ ID NO: 9373724 - DNA, 22 bp, Homo sapiens
ggccctgggcagaggagtgggc

SEQ ID NO: 9373725 - DNA, 22 bp, Homo sapiens
ggccctgggcagaggagtgggc

SEQ ID NO: 9373726 - DNA, 22 bp, Homo sapiens
ggccctgggatgctcagcagtg

SEQ ID NO: 9373727 - DNA, 22 bp, Homo sapiens
ggccctgggatgctcagcagtg

SEQ ID NO: 9373728 - DNA, 22 bp, Homo sapiens
ggccctgggatgctcagcagtg

SEQ ID NO: 9373729 - DNA, 22 bp, Homo sapiens
ggccctgggacacaacaccgaa

SEQ ID NO: 9373730 - DNA, 21 bp, Homo sapiens
ggccctggttacgcctcctct

SEQ ID NO: 9373731 - DNA, 21 bp, Homo sapiens
ggccctggttacgcctcctct

SEQ ID NO: 9373732 - DNA, 21 bp, Homo sapiens
ggccctggttacgcctcctct

SEQ ID NO: 9373733 - DNA, 21 bp, Homo sapiens
ggccctggttacgcctcctct

SEQ ID NO: 9373734 - DNA, 22 bp, Homo sapiens
ggcctagggagtggccatgcct

SEQ ID NO: 9373735 - DNA, 22 bp, Homo sapiens
ggcctagcctctcctgagagag

SEQ ID NO: 9373736 - DNA, 22 bp, Homo sapiens
ggcctagttttttctggtaggt

SEQ ID NO: 9373737 - DNA, 22 bp, Homo sapiens
ggcctagggagtggccatgcct

SEQ ID NO: 9373738 - DNA, 22 bp, Homo sapiens
ggcctagggagtggccatgcct

SEQ ID NO: 9373739 - DNA, 22 bp, Homo sapiens
ggcctagggcttggtcatggca

SEQ ID NO: 9373740 - DNA, 22 bp, Homo sapiens
ggcctagggcttggtcatggca

SEQ ID NO: 9373741 - DNA, 21 bp, Homo sapiens
ggcctaggggcagatggtgct

SEQ ID NO: 9373742 - DNA, 22 bp, Homo sapiens
ggcggtggcgtgaaggtggctg

SEQ ID NO: 9373743 - DNA, 22 bp, Homo sapiens
ggcggtattttttgaggataga

SEQ ID NO: 9373744 - DNA, 18 bp, Homo sapiens
ggcgggtgttttattcac

SEQ ID NO: 9373745 - DNA, 22 bp, Homo sapiens
ggcgggtgtaagtaggacagcg

SEQ ID NO: 9373746 - DNA, 19 bp, Homo sapiens
ggcgggtggactggagccc

SEQ ID NO: 9373747 - DNA, 22 bp, Homo sapiens
ggcgggtgcacagacccttccc

SEQ ID NO: 9373748 - DNA, 22 bp, Homo sapiens
ggcctggcctcccttcctagcg

SEQ ID NO: 9373749 - DNA, 22 bp, Homo sapiens
ggcctggctggttcagtaccct

SEQ ID NO: 9373750 - DNA, 23 bp, Homo sapiens
ggcctggcccagggccctgatga

SEQ ID NO: 9373751 - DNA, 22 bp, Homo sapiens
ggcctggcctccagatgtgggc

SEQ ID NO: 9373752 - DNA, 22 bp, Homo sapiens
ggcctggcctccagatgtgggc

SEQ ID NO: 9373753 - DNA, 22 bp, Homo sapiens
ggcctggcatggggactaaggg

SEQ ID NO: 9373754 - DNA, 22 bp, Homo sapiens
ggcctggcatggggactaaggg

SEQ ID NO: 9373755 - DNA, 19 bp, Homo sapiens
ggcctggatttagggctcc

SEQ ID NO: 9373756 - DNA, 19 bp, Homo sapiens
ggcctggatttagggctcc

SEQ ID NO: 9373757 - DNA, 22 bp, Homo sapiens
ggcctggagtttggggaataga

SEQ ID NO: 9373758 - DNA, 22 bp, Homo sapiens
ggcctggagtcagggaaagcaa

SEQ ID NO: 9373759 - DNA, 22 bp, Homo sapiens
ggcctggagcagagactaggga

SEQ ID NO: 9373760 - DNA, 22 bp, Homo sapiens
ggcctggagcagagactaggga

SEQ ID NO: 9373761 - DNA, 22 bp, Homo sapiens
ggcctggagcagagactaggga

SEQ ID NO: 9373762 - DNA, 22 bp, Homo sapiens
ggcctggagaaggcccagggag

SEQ ID NO: 9373763 - DNA, 22 bp, Homo sapiens
ggcctggagaaggcccagggag

SEQ ID NO: 9373764 - DNA, 22 bp, Homo sapiens
ggcctggagaaggcccagggag

SEQ ID NO: 9373765 - DNA, 19 bp, Homo sapiens
ggcctgcccaatgtctgct

SEQ ID NO: 9373766 - DNA, 22 bp, Homo sapiens
ggcctcagaccggagctggcca

SEQ ID NO: 9373767 - DNA, 22 bp, Homo sapiens
ggcctcagaccggagctggcca

SEQ ID NO: 9373768 - DNA, 22 bp, Homo sapiens
ggcctgcttactgattgttgtt

SEQ ID NO: 9373769 - DNA, 22 bp, Homo sapiens
ggcctgcttctcagtgagcttg

SEQ ID NO: 9373770 - DNA, 22 bp, Homo sapiens
ggcctgctttccgagcctgcag

SEQ ID NO: 9373771 - DNA, 22 bp, Homo sapiens
ggcctgctggggcctcagacac

SEQ ID NO: 9373772 - DNA, 22 bp, Homo sapiens
ggcctgctgggccccacagtcc

SEQ ID NO: 9373773 - DNA, 22 bp, Homo sapiens
ggcctggaagaggacagagaaa

SEQ ID NO: 9373774 - DNA, 22 bp, Homo sapiens
ggcctggaagaggacagagaaa

SEQ ID NO: 9373775 - DNA, 22 bp, Homo sapiens
ggcctggaaggacagcgtgatg

SEQ ID NO: 9373776 - DNA, 22 bp, Homo sapiens
ggcctggaaggacagcgtgatg

SEQ ID NO: 9373777 - DNA, 22 bp, Homo sapiens
ggcctggaaggacagcgtgatg

SEQ ID NO: 9373778 - DNA, 22 bp, Homo sapiens
ggcctggaagaggacagagaaa

SEQ ID NO: 9373779 - DNA, 22 bp, Homo sapiens
ggcctggacaaatgcaccaagg

SEQ ID NO: 9373780 - DNA, 22 bp, Homo sapiens
ggcctggaatgctttcctacca

SEQ ID NO: 9373781 - DNA, 22 bp, Homo sapiens
ggcctggacacctgaggtctta

SEQ ID NO: 9373782 - DNA, 22 bp, Homo sapiens
ggcctggacacctgaggtctta

SEQ ID NO: 9373783 - DNA, 22 bp, Homo sapiens
ggcctggacaaatgcaccaagg

SEQ ID NO: 9373784 - DNA, 22 bp, Homo sapiens
ggattaagacctgtcagtacac

SEQ ID NO: 9373785 - DNA, 22 bp, Homo sapiens
ggattagcttttgttcttgact

SEQ ID NO: 9373786 - DNA, 18 bp, Homo sapiens
ggattctggggacctggg

SEQ ID NO: 9373787 - DNA, 22 bp, Homo sapiens
ggattgagagcactggtagctg

SEQ ID NO: 9373788 - DNA, 22 bp, Homo sapiens
ggattctactgatcagcaccac

SEQ ID NO: 9373789 - DNA, 22 bp, Homo sapiens
ggattccatggtcaggaaatag

SEQ ID NO: 9373790 - DNA, 22 bp, Homo sapiens
ggatgttgattgaatggccatt

SEQ ID NO: 9373791 - DNA, 22 bp, Homo sapiens
ggatgttgattgaatggccatt

SEQ ID NO: 9373792 - DNA, 22 bp, Homo sapiens
ggatgggaacttggtagggcat

SEQ ID NO: 9373793 - DNA, 22 bp, Homo sapiens
ggatggctgtaaaaggtgggaa

SEQ ID NO: 9373794 - DNA, 22 bp, Homo sapiens
ggatggcttgcatttgaggact

SEQ ID NO: 9373795 - DNA, 22 bp, Homo sapiens
ggatggctccagaaagcagggt

SEQ ID NO: 9373796 - DNA, 22 bp, Homo sapiens
ggatggctccagaaagcagggt

SEQ ID NO: 9373797 - DNA, 20 bp, Homo sapiens
ggatggctccacatcatttt

SEQ ID NO: 9373798 - DNA, 22 bp, Homo sapiens
ggatggctccacagtttctccc

SEQ ID NO: 9373799 - DNA, 20 bp, Homo sapiens
ggatggccggaccagagcct

SEQ ID NO: 9373800 - DNA, 22 bp, Homo sapiens
ggatggcagtctgcatgagaaa

SEQ ID NO: 9373801 - DNA, 22 bp, Homo sapiens
ggatggcatgttgggctctgtt

SEQ ID NO: 9373802 - DNA, 22 bp, Homo sapiens
ggatggcatgttgggctctgtt

SEQ ID NO: 9373803 - DNA, 22 bp, Homo sapiens
ggatggcatgttgggctctgtt

SEQ ID NO: 9373804 - DNA, 22 bp, Homo sapiens
ggatggaggttctcagatgctc

SEQ ID NO: 9373805 - DNA, 22 bp, Homo sapiens
ggatggagatgaccatggtgac

SEQ ID NO: 9373806 - DNA, 22 bp, Homo sapiens
ggatggagatgaccatggtgac

SEQ ID NO: 9373807 - DNA, 23 bp, Homo sapiens
ggatggacgtgatgccttagcca

SEQ ID NO: 9373808 - DNA, 22 bp, Homo sapiens
ggatggagatgaccatggtgac

SEQ ID NO: 9373809 - DNA, 22 bp, Homo sapiens
ggatggagatgaccatggtgac

SEQ ID NO: 9373810 - DNA, 22 bp, Homo sapiens
ggatgctctgtctcttgctgtt

SEQ ID NO: 9373811 - DNA, 22 bp, Homo sapiens
ggatgctgctgcacatcctgca

SEQ ID NO: 9373812 - DNA, 22 bp, Homo sapiens
ggatgctgggagacagcaggca

SEQ ID NO: 9373813 - DNA, 22 bp, Homo sapiens
ggatgctggggaccaatctctg

SEQ ID NO: 9373814 - DNA, 22 bp, Homo sapiens
ggatgctgtctaagctgaggac

SEQ ID NO: 9373815 - DNA, 22 bp, Homo sapiens
ggatggagatgaccatggtgac

SEQ ID NO: 9373816 - DNA, 22 bp, Homo sapiens
ggatggagatgaccatggtgac

SEQ ID NO: 9373817 - DNA, 23 bp, Homo sapiens
ggatggacgtgatgccttagcca

SEQ ID NO: 9373818 - DNA, 21 bp, Homo sapiens
ggatgccacgaagcaccagga

SEQ ID NO: 9373819 - DNA, 22 bp, Homo sapiens
ggatgcaggaacacagcgacct

SEQ ID NO: 9373820 - DNA, 22 bp, Homo sapiens
ggagcagagctgggcttggctg

SEQ ID NO: 9373821 - DNA, 22 bp, Homo sapiens
ggagcagagcatttcacagcct

SEQ ID NO: 9373822 - DNA, 22 bp, Homo sapiens
ggagcagatgtcttcatggcct

SEQ ID NO: 9373823 - DNA, 22 bp, Homo sapiens
ggagttgctgagacagaacaca

SEQ ID NO: 9373824 - DNA, 22 bp, Homo sapiens
ggagttgctggatgtggtttaa

SEQ ID NO: 9373825 - DNA, 22 bp, Homo sapiens
ggagttgccaaggcttgaaaat

SEQ ID NO: 9373826 - DNA, 23 bp, Homo sapiens
ggagttggattgtacttgctgct

SEQ ID NO: 9373827 - DNA, 22 bp, Homo sapiens
ggatctggggtagagcagtggg

SEQ ID NO: 9373828 - DNA, 22 bp, Homo sapiens
ggagttgttctgcaggagagaa

SEQ ID NO: 9373829 - DNA, 22 bp, Homo sapiens
ggatctggggtagagcagtggg

SEQ ID NO: 9373830 - DNA, 19 bp, Homo sapiens
ggatgagggtcaggcatag

SEQ ID NO: 9373831 - DNA, 19 bp, Homo sapiens
ggatgagggtcaggcatag

SEQ ID NO: 9373832 - DNA, 19 bp, Homo sapiens
ggatgagggtcaggcatag

SEQ ID NO: 9373833 - DNA, 22 bp, Homo sapiens
ggatgaggaagattactgagaa

SEQ ID NO: 9373834 - DNA, 22 bp, Homo sapiens
ggatgaggaaaccacagtgtcc

SEQ ID NO: 9373835 - DNA, 22 bp, Homo sapiens
ggatgaggaaaccacagtgtcc

SEQ ID NO: 9373836 - DNA, 22 bp, Homo sapiens
ggagatggtggaagctggtgca

SEQ ID NO: 9373837 - DNA, 22 bp, Homo sapiens
ggagatggtggaagctggtgca

SEQ ID NO: 9373838 - DNA, 22 bp, Homo sapiens
ggagatggtggaagctggtgca

SEQ ID NO: 9373839 - DNA, 22 bp, Homo sapiens
ggagatggtggaagctggtgca

SEQ ID NO: 9373840 - DNA, 22 bp, Homo sapiens
ggagatggtggaagctggtgca

SEQ ID NO: 9373841 - DNA, 22 bp, Homo sapiens
ggagatgtagtgtcactggact

SEQ ID NO: 9373842 - DNA, 22 bp, Homo sapiens
ggagatgtagtgtcactggact

SEQ ID NO: 9373843 - DNA, 22 bp, Homo sapiens
ggagcaaatgccaagtgggagg

SEQ ID NO: 9373844 - DNA, 22 bp, Homo sapiens
ggagcaagtcccaggcactagt

SEQ ID NO: 9373845 - DNA, 22 bp, Homo sapiens
ggagcactataatagagatttt

SEQ ID NO: 9373846 - DNA, 22 bp, Homo sapiens
ggagcaccgttgggaggtgagg

SEQ ID NO: 9373847 - DNA, 22 bp, Homo sapiens
ggagcaccctgctcagccaagc

SEQ ID NO: 9373848 - DNA, 22 bp, Homo sapiens
ggagatggctggcaggtagatg

SEQ ID NO: 9373849 - DNA, 22 bp, Homo sapiens
ggagatggctggcaggtagatg

SEQ ID NO: 9373850 - DNA, 22 bp, Homo sapiens
ggagatggctggcaggtagatg

SEQ ID NO: 9373851 - DNA, 22 bp, Homo sapiens
ggagatggtctgttctcatatt

SEQ ID NO: 9373852 - DNA, 21 bp, Homo sapiens
ggagatgggtatcgcctgggc

SEQ ID NO: 9373853 - DNA, 21 bp, Homo sapiens
ggagatgggtatcgcctgggc

SEQ ID NO: 9373854 - DNA, 22 bp, Homo sapiens
ggagaggcttggcccagcctgg

SEQ ID NO: 9373855 - DNA, 22 bp, Homo sapiens
ggagatggcaagaagttattag

SEQ ID NO: 9373856 - DNA, 22 bp, Homo sapiens
ggagatggctggcaggtagatg

SEQ ID NO: 9373857 - DNA, 22 bp, Homo sapiens
ggagatggctctgcaaggtcta

SEQ ID NO: 9373858 - DNA, 22 bp, Homo sapiens
ggcagcaggagccatctggtag

SEQ ID NO: 9373859 - DNA, 22 bp, Homo sapiens
ggcagcaggagccatctggtag

SEQ ID NO: 9373860 - DNA, 22 bp, Homo sapiens
ggcagcaggagccatctggtag

SEQ ID NO: 9373861 - DNA, 21 bp, Homo sapiens
ggcagaagtagcatggacggg

SEQ ID NO: 9373862 - DNA, 22 bp, Homo sapiens
ggcagaaggttgaagtaatttg

SEQ ID NO: 9373863 - DNA, 22 bp, Homo sapiens
ggcagcagcaaggttggagctg

SEQ ID NO: 9373864 - DNA, 22 bp, Homo sapiens
ggcagcagcaaggttggagctg

SEQ ID NO: 9373865 - DNA, 21 bp, Homo sapiens
ggcagaagtagcatggacggg

SEQ ID NO: 9373866 - DNA, 22 bp, Homo sapiens
ggcagaagtgatgggatataac

SEQ ID NO: 9373867 - DNA, 22 bp, Homo sapiens
ggcagaagaaaggctaagtctc

SEQ ID NO: 9373868 - DNA, 22 bp, Homo sapiens
ggcagaagacaggcaaatcatg

SEQ ID NO: 9373869 - DNA, 22 bp, Homo sapiens
ggcagaagataggacagggaat

SEQ ID NO: 9373870 - DNA, 22 bp, Homo sapiens
ggcagaagataggacagggaat

SEQ ID NO: 9373871 - DNA, 22 bp, Homo sapiens
ggcagaaggcaattagagactg

SEQ ID NO: 9373872 - DNA, 22 bp, Homo sapiens
ggcagaaggcctcccagctcct

SEQ ID NO: 9373873 - DNA, 22 bp, Homo sapiens
ggcagaaggcaattagagactg

SEQ ID NO: 9373874 - DNA, 19 bp, Homo sapiens
ggcagaaggtgtaggggga

SEQ ID NO: 9373875 - DNA, 19 bp, Homo sapiens
ggcagaaggtgtaggggga

SEQ ID NO: 9373876 - DNA, 18 bp, Homo sapiens
ggcactggtgatgcagag

SEQ ID NO: 9373877 - DNA, 18 bp, Homo sapiens
ggcactggtgatgcagag

SEQ ID NO: 9373878 - DNA, 22 bp, Homo sapiens
ggcactgggtgagggtcactgg

SEQ ID NO: 9373879 - DNA, 22 bp, Homo sapiens
ggcactgggtgagggtcactgg

SEQ ID NO: 9373880 - DNA, 22 bp, Homo sapiens
ggcactgggtgagggtcactgg

SEQ ID NO: 9373881 - DNA, 22 bp, Homo sapiens
ggcactgtttttgtattcagtt

SEQ ID NO: 9373882 - DNA, 22 bp, Homo sapiens
ggcacttggatcttagttgggg

SEQ ID NO: 9373883 - DNA, 20 bp, Homo sapiens
ggcacttgatcccctggttc

SEQ ID NO: 9373884 - DNA, 22 bp, Homo sapiens
ggcactttgcctttatgcactg

SEQ ID NO: 9373885 - DNA, 22 bp, Homo sapiens
ggcactttgattttgagatgca

SEQ ID NO: 9373886 - DNA, 22 bp, Homo sapiens
ggcactttccagtctatagagc

SEQ ID NO: 9373887 - DNA, 22 bp, Homo sapiens
ggatttactatcttgaaatata

SEQ ID NO: 9373888 - DNA, 22 bp, Homo sapiens
ggattgcaacaagctagtttag

SEQ ID NO: 9373889 - DNA, 22 bp, Homo sapiens
ggatttacacacctgcctgtca

SEQ ID NO: 9373890 - DNA, 20 bp, Homo sapiens
ggatttacaggggaaaagtg

SEQ ID NO: 9373891 - DNA, 22 bp, Homo sapiens
ggatttacccaatggatagatg

SEQ ID NO: 9373892 - DNA, 17 bp, Homo sapiens
ggattgcatatacagtg

SEQ ID NO: 9373893 - DNA, 22 bp, Homo sapiens
ggatttacaagtttaactctca

SEQ ID NO: 9373894 - DNA, 22 bp, Homo sapiens
ggcactgcaggtaagtgctgtc

SEQ ID NO: 9373895 - DNA, 22 bp, Homo sapiens
ggcactgcaggtaagtgctgtc

SEQ ID NO: 9373896 - DNA, 22 bp, Homo sapiens
ggcactgccccctgcccaggac

SEQ ID NO: 9373897 - DNA, 22 bp, Homo sapiens
ggcagcttcctgagccagcagc

SEQ ID NO: 9373898 - DNA, 22 bp, Homo sapiens
ggcagcttacgttttgctagtg

SEQ ID NO: 9373899 - DNA, 22 bp, Homo sapiens
ggcagcttacgttttgctagtg

SEQ ID NO: 9373900 - DNA, 22 bp, Homo sapiens
ggcagcttcggacggcttataa

SEQ ID NO: 9373901 - DNA, 22 bp, Homo sapiens
ggcagcttctcccaggctgttt

SEQ ID NO: 9373902 - DNA, 22 bp, Homo sapiens
ggcagcttgccctggtctcaac

SEQ ID NO: 9373903 - DNA, 22 bp, Homo sapiens
ggcagcttctcccaggctgttt

SEQ ID NO: 9373904 - DNA, 22 bp, Homo sapiens
ggcaggagaatggcgtgaactc

SEQ ID NO: 9373905 - DNA, 22 bp, Homo sapiens
ggcaggagaaaggtctcttctt

SEQ ID NO: 9373906 - DNA, 22 bp, Homo sapiens
ggcagctttggattcgcggctg

SEQ ID NO: 9373907 - DNA, 22 bp, Homo sapiens
ggcagctttccttatcctaggg

SEQ ID NO: 9373908 - DNA, 22 bp, Homo sapiens
ggcagctttcacctgtcttcct

SEQ ID NO: 9373909 - DNA, 23 bp, Homo sapiens
ggcagcttgttcctttgcttcca

SEQ ID NO: 9373910 - DNA, 22 bp, Homo sapiens
ggcagctttcaatagggttatg

SEQ ID NO: 9373911 - DNA, 20 bp, Homo sapiens
ggcagcttgggcagcagtta

SEQ ID NO: 9373912 - DNA, 22 bp, Homo sapiens
ggcagctgtttgtcctcctgtt

SEQ ID NO: 9373913 - DNA, 22 bp, Homo sapiens
ggcagctgtttgtcctcctgtt

SEQ ID NO: 9373914 - DNA, 22 bp, Homo sapiens
ggcagctgtttgtcctcctgtt

SEQ ID NO: 9373915 - DNA, 22 bp, Homo sapiens
ggcagccatggacactggctag

SEQ ID NO: 9373916 - DNA, 22 bp, Homo sapiens
ggcagctgtgaagtgcctcaca

SEQ ID NO: 9373917 - DNA, 17 bp, Homo sapiens
ggcagctgtgtgcatgc

SEQ ID NO: 9373918 - DNA, 17 bp, Homo sapiens
ggcagctgtgtgcatgc

SEQ ID NO: 9373919 - DNA, 17 bp, Homo sapiens
ggcagctgtgtgcatgc

SEQ ID NO: 9373920 - DNA, 22 bp, Homo sapiens
ggcagccagcgggtggacgcgc

SEQ ID NO: 9373921 - DNA, 22 bp, Homo sapiens
ggcagccagtagggccagcctg

SEQ ID NO: 9373922 - DNA, 22 bp, Homo sapiens
ggcagccagcaatgagaagttt

SEQ ID NO: 9373923 - DNA, 22 bp, Homo sapiens
ggcagccatggacactggctag

SEQ ID NO: 9373924 - DNA, 22 bp, Homo sapiens
ggcagccatggacactggctag

SEQ ID NO: 9373925 - DNA, 22 bp, Homo sapiens
ggcagccatactcagacctggg

SEQ ID NO: 9373926 - DNA, 22 bp, Homo sapiens
ggcagccatgcacgctgcctgg

SEQ ID NO: 9373927 - DNA, 22 bp, Homo sapiens
ggcagcagggtagccatttctc

SEQ ID NO: 9373928 - DNA, 22 bp, Homo sapiens
ggcagcagggctgtctccctac

SEQ ID NO: 9373929 - DNA, 22 bp, Homo sapiens
ggcagcagtccatggcccaagg

SEQ ID NO: 9373930 - DNA, 22 bp, Homo sapiens
gggcactcagctgtagagcagg

SEQ ID NO: 9373931 - DNA, 22 bp, Homo sapiens
gggcaccttgggtctcaggcaa

SEQ ID NO: 9373932 - DNA, 21 bp, Homo sapiens
gggcacccttagcctcctctg

SEQ ID NO: 9373933 - DNA, 22 bp, Homo sapiens
gggcacctggctagtgacagtg

SEQ ID NO: 9373934 - DNA, 22 bp, Homo sapiens
gggcacctggctagtgacagtg

SEQ ID NO: 9373935 - DNA, 21 bp, Homo sapiens
gggcactgaaagggaatagca

SEQ ID NO: 9373936 - DNA, 22 bp, Homo sapiens
gggcactgaacaccctcttcgc

SEQ ID NO: 9373937 - DNA, 22 bp, Homo sapiens
gggcacagtctaaagttgggcc

SEQ ID NO: 9373938 - DNA, 22 bp, Homo sapiens
gggcacatgcttagggaggaaa

SEQ ID NO: 9373939 - DNA, 22 bp, Homo sapiens
gggcacatgtaaagctggagaa

SEQ ID NO: 9373940 - DNA, 22 bp, Homo sapiens
gggcactggaaggctctcaggc

SEQ ID NO: 9373941 - DNA, 22 bp, Homo sapiens
gggcactgctttgctctgtcac

SEQ ID NO: 9373942 - DNA, 22 bp, Homo sapiens
gggcactggaaggctctcaggc

SEQ ID NO: 9373943 - DNA, 22 bp, Homo sapiens
gggcactggaaggctctcaggc

SEQ ID NO: 9373944 - DNA, 22 bp, Homo sapiens
gggcactggcagtcggggacgc

SEQ ID NO: 9373945 - DNA, 22 bp, Homo sapiens
gggcactggaggccaaggagct

SEQ ID NO: 9373946 - DNA, 22 bp, Homo sapiens
gggcactggaggccaaggagct

SEQ ID NO: 9373947 - DNA, 22 bp, Homo sapiens
gggcactgagtggatgatgcag

SEQ ID NO: 9373948 - DNA, 22 bp, Homo sapiens
gggcactgctggaggctccctg

SEQ ID NO: 9373949 - DNA, 22 bp, Homo sapiens
gggcactgagtggatgatgcag

SEQ ID NO: 9373950 - DNA, 22 bp, Homo sapiens
gggcactgacagggtcccaact

SEQ ID NO: 9373951 - DNA, 22 bp, Homo sapiens
gggcactgagggcccacaggat

SEQ ID NO: 9373952 - DNA, 22 bp, Homo sapiens
gggcactgagaattttccactt

SEQ ID NO: 9373953 - DNA, 23 bp, Homo sapiens
gggcaggtttttataggcttcag

SEQ ID NO: 9373954 - DNA, 23 bp, Homo sapiens
gggcaggtttttataggcttcag

SEQ ID NO: 9373955 - DNA, 22 bp, Homo sapiens
gggcaggttggcatcccgggca

SEQ ID NO: 9373956 - DNA, 23 bp, Homo sapiens
gggcaggtttttataggcttcag

SEQ ID NO: 9373957 - DNA, 22 bp, Homo sapiens
gggcaggttggcatcccgggca

SEQ ID NO: 9373958 - DNA, 22 bp, Homo sapiens
gggcaggttattggagtaggga

SEQ ID NO: 9373959 - DNA, 22 bp, Homo sapiens
gggcaggttattggagtaggga

SEQ ID NO: 9373960 - DNA, 22 bp, Homo sapiens
gggcactgggtcttctccacgc

SEQ ID NO: 9373961 - DNA, 22 bp, Homo sapiens
gggcaggttattggagtaggga

SEQ ID NO: 9373962 - DNA, 22 bp, Homo sapiens
gggcactggccgcccatccctg

SEQ ID NO: 9373963 - DNA, 18 bp, Homo sapiens
gggcactggggactggag

SEQ ID NO: 9373964 - DNA, 18 bp, Homo sapiens
gggcactggggactggag

SEQ ID NO: 9373965 - DNA, 22 bp, Homo sapiens
gggcagtgaatattggtgggaa

SEQ ID NO: 9373966 - DNA, 22 bp, Homo sapiens
gggcagtcacagtgctggagca

SEQ ID NO: 9373967 - DNA, 22 bp, Homo sapiens
gggcagtgacaaaggggatgaa

SEQ ID NO: 9373968 - DNA, 19 bp, Homo sapiens
gggcagtggcactagggag

SEQ ID NO: 9373969 - DNA, 22 bp, Homo sapiens
gggaggtgatggcaagcagcgg

SEQ ID NO: 9373970 - DNA, 22 bp, Homo sapiens
gggaggtgattaggaccatgta

SEQ ID NO: 9373971 - DNA, 22 bp, Homo sapiens
gggaggtgattaggaccatgta

SEQ ID NO: 9373972 - DNA, 22 bp, Homo sapiens
gggaggtgattaggaccatgta

SEQ ID NO: 9373973 - DNA, 22 bp, Homo sapiens
gggaggtgatggcaagcagcgg

SEQ ID NO: 9373974 - DNA, 22 bp, Homo sapiens
gggaggtgatggcaagcagcgg

SEQ ID NO: 9373975 - DNA, 22 bp, Homo sapiens
gggagggccaggctcacccagg

SEQ ID NO: 9373976 - DNA, 22 bp, Homo sapiens
gggaggtgaaaggttgctgcag

SEQ ID NO: 9373977 - DNA, 21 bp, Homo sapiens
gggagggatggaaatgatgtt

SEQ ID NO: 9373978 - DNA, 21 bp, Homo sapiens
gggagggatggaaatgatgtt

SEQ ID NO: 9373979 - DNA, 22 bp, Homo sapiens
gggagggattagttctgcctgg

SEQ ID NO: 9373980 - DNA, 22 bp, Homo sapiens
gggaggtgttctgccaacgcgg

SEQ ID NO: 9373981 - DNA, 22 bp, Homo sapiens
gggaggtgttccagtgttggta

SEQ ID NO: 9373982 - DNA, 22 bp, Homo sapiens
gggaggtgttccagtgttggta

SEQ ID NO: 9373983 - DNA, 22 bp, Homo sapiens
gggaggtgattaggaccatgta

SEQ ID NO: 9373984 - DNA, 22 bp, Homo sapiens
gggaggtgttccagtgttggta

SEQ ID NO: 9373985 - DNA, 22 bp, Homo sapiens
gggaggtgttccagtgttggta

SEQ ID NO: 9373986 - DNA, 22 bp, Homo sapiens
gggcacaggagaaggatctggc

SEQ ID NO: 9373987 - DNA, 22 bp, Homo sapiens
gggcacagtactccaatcaact

SEQ ID NO: 9373988 - DNA, 22 bp, Homo sapiens
gggaggttgaggctgcagtgag

SEQ ID NO: 9373989 - DNA, 22 bp, Homo sapiens
gggaggttgaggctgcagtgag

SEQ ID NO: 9373990 - DNA, 22 bp, Homo sapiens
gggagctggcctactattagat

SEQ ID NO: 9373991 - DNA, 22 bp, Homo sapiens
gggagctggatgattgaggcaa

SEQ ID NO: 9373992 - DNA, 22 bp, Homo sapiens
gggagctggatgattgaggcaa

SEQ ID NO: 9373993 - DNA, 22 bp, Homo sapiens
gggagctggagctggaagactc

SEQ ID NO: 9373994 - DNA, 22 bp, Homo sapiens
gggagctggagctggaagactc

SEQ ID NO: 9373995 - DNA, 22 bp, Homo sapiens
gggagctggagttgtgttgcct

SEQ ID NO: 9373996 - DNA, 22 bp, Homo sapiens
gggagctggatcgcgcgcccgg

SEQ ID NO: 9373997 - DNA, 22 bp, Homo sapiens
gggagggaggtgctggttcacg

SEQ ID NO: 9373998 - DNA, 22 bp, Homo sapiens
gggagggatctgctaggcaatg

SEQ ID NO: 9373999 - DNA, 22 bp, Homo sapiens
gggagggaggtgatgcttggct

SEQ ID NO: 9374000 - DNA, 22 bp, Homo sapiens
gggagggaggtgatgcttggct

SEQ ID NO: 9374001 - DNA, 22 bp, Homo sapiens
gggagggaggtgatgcttggct

SEQ ID NO: 9374002 - DNA, 22 bp, Homo sapiens
gggagggaggtgatgcttggct

SEQ ID NO: 9374003 - DNA, 23 bp, Homo sapiens
gggaagtgaggagcccctcagcc

SEQ ID NO: 9374004 - DNA, 22 bp, Homo sapiens
gggaagtgatggagccaggatt

SEQ ID NO: 9374005 - DNA, 22 bp, Homo sapiens
gggaagtgatggagccaggatt

SEQ ID NO: 9374006 - DNA, 23 bp, Homo sapiens
gggaagtgaggagcccctctgcc

SEQ ID NO: 9374007 - DNA, 22 bp, Homo sapiens
gggaagtgaggagcccctctgc

SEQ ID NO: 9374008 - DNA, 22 bp, Homo sapiens
gggaaggtatttagctgctgaa

SEQ ID NO: 9374009 - DNA, 22 bp, Homo sapiens
gggaagggtgttgtcttatctt

SEQ ID NO: 9374010 - DNA, 22 bp, Homo sapiens
gggaagggtgttgtcttatctt

SEQ ID NO: 9374011 - DNA, 22 bp, Homo sapiens
gggaagggtgttgtcttatctt

SEQ ID NO: 9374012 - DNA, 22 bp, Homo sapiens
gggaagggagggcctccagtca

SEQ ID NO: 9374013 - DNA, 22 bp, Homo sapiens
gggaagggagggcctccagtca

SEQ ID NO: 9374014 - DNA, 22 bp, Homo sapiens
gggaagggctccttttattgca

SEQ ID NO: 9374015 - DNA, 22 bp, Homo sapiens
gggaagggctccttttattgca

SEQ ID NO: 9374016 - DNA, 21 bp, Homo sapiens
gggagctgacagcagcacggc

SEQ ID NO: 9374017 - DNA, 21 bp, Homo sapiens
gggaatgagattcttggagat

SEQ ID NO: 9374018 - DNA, 22 bp, Homo sapiens
gggaatgaggcagatagataaa

SEQ ID NO: 9374019 - DNA, 19 bp, Homo sapiens
gggaatgatggaagacttc

SEQ ID NO: 9374020 - DNA, 22 bp, Homo sapiens
gggaatgagagtcagcccagga

SEQ ID NO: 9374021 - DNA, 22 bp, Homo sapiens
gggaatgaccttaataagtagg

SEQ ID NO: 9374022 - DNA, 17 bp, Homo sapiens
gggaagtggagaaagct

SEQ ID NO: 9374023 - DNA, 17 bp, Homo sapiens
gggaagtggagaaagct

SEQ ID NO: 9374024 - DNA, 17 bp, Homo sapiens
gggaagtggagaaagct

SEQ ID NO: 9374025 - DNA, 22 bp, Homo sapiens
gggaagtgtgcagagttctctt

SEQ ID NO: 9374026 - DNA, 23 bp, Homo sapiens
gggaagtggggatttgaagtcat

SEQ ID NO: 9374027 - DNA, 22 bp, Homo sapiens
gggagctgagggacctctgtgg

SEQ ID NO: 9374028 - DNA, 22 bp, Homo sapiens
gggagctgagggacctctgtgg

SEQ ID NO: 9374029 - DNA, 22 bp, Homo sapiens
gggagctgaggagccccgtcgg

SEQ ID NO: 9374030 - DNA, 22 bp, Homo sapiens
gggagctgagctggaagagaat

SEQ ID NO: 9374031 - DNA, 22 bp, Homo sapiens
gggagctgagctggaagagaat

SEQ ID NO: 9374032 - DNA, 19 bp, Homo sapiens
gggagctgaggtctttggt

SEQ ID NO: 9374033 - DNA, 22 bp, Homo sapiens
gggagctggagctggaagactc

SEQ ID NO: 9374034 - DNA, 19 bp, Homo sapiens
gggagctgaggtctttggt

SEQ ID NO: 9374035 - DNA, 22 bp, Homo sapiens
gggagctggagctggaagactc

SEQ ID NO: 9374036 - DNA, 22 bp, Homo sapiens
gggagctggagctggaagactc

SEQ ID NO: 9374037 - DNA, 22 bp, Homo sapiens
gggagctggagctggaagactc

SEQ ID NO: 9374038 - DNA, 22 bp, Homo sapiens
gggagctgagctggaagagaat

SEQ ID NO: 9374039 - DNA, 22 bp, Homo sapiens
gggagctgagctctgagccacg

SEQ ID NO: 9374040 - DNA, 22 bp, Homo sapiens
gggagctgagctggaagagaat

SEQ ID NO: 9374041 - DNA, 22 bp, Homo sapiens
gggagctgagctggaagagaat

SEQ ID NO: 9374042 - DNA, 22 bp, Homo sapiens
gggagctgagctggaagagaat

SEQ ID NO: 9374043 - DNA, 21 bp, Homo sapiens
gggagctgacagcagcacggc

SEQ ID NO: 9374044 - DNA, 22 bp, Homo sapiens
gggagctgacctgcaggttccc

SEQ ID NO: 9374045 - DNA, 22 bp, Homo sapiens
gggagctgacctgcaggttccc

SEQ ID NO: 9374046 - DNA, 22 bp, Homo sapiens
gggagctgacctgcaggttccc

SEQ ID NO: 9374047 - DNA, 22 bp, Homo sapiens
gggagctgagaaacaacattct

SEQ ID NO: 9374048 - DNA, 22 bp, Homo sapiens
gggagctgagctctgagccacg

SEQ ID NO: 9374049 - DNA, 20 bp, Homo sapiens
ggctgtgcccttccgtggcc

SEQ ID NO: 9374050 - DNA, 22 bp, Homo sapiens
ggctttatattgtttgagcaga

SEQ ID NO: 9374051 - DNA, 22 bp, Homo sapiens
ggctgtgcctctggcagcacat

SEQ ID NO: 9374052 - DNA, 22 bp, Homo sapiens
ggctttatgcacagcagatggt

SEQ ID NO: 9374053 - DNA, 22 bp, Homo sapiens
ggctttatgcagggatagaaat

SEQ ID NO: 9374054 - DNA, 22 bp, Homo sapiens
ggctttatcaaatgagaccctg

SEQ ID NO: 9374055 - DNA, 22 bp, Homo sapiens
ggctttatgcacagcagatggt

SEQ ID NO: 9374056 - DNA, 22 bp, Homo sapiens
ggctttatcaaatgagaccctg

SEQ ID NO: 9374057 - DNA, 22 bp, Homo sapiens
ggctttattttgcatgaatgct

SEQ ID NO: 9374058 - DNA, 22 bp, Homo sapiens
ggctttatttgcagccattgtt

SEQ ID NO: 9374059 - DNA, 22 bp, Homo sapiens
ggctttatttgcagccattgtt

SEQ ID NO: 9374060 - DNA, 22 bp, Homo sapiens
ggctttatttcactgtaccata

SEQ ID NO: 9374061 - DNA, 22 bp, Homo sapiens
ggctttattatgtggccatgtg

SEQ ID NO: 9374062 - DNA, 22 bp, Homo sapiens
ggctttattatgtggccatgtg

SEQ ID NO: 9374063 - DNA, 22 bp, Homo sapiens
ggctttattaagcagggtaagt

SEQ ID NO: 9374064 - DNA, 22 bp, Homo sapiens
ggctttattaactcatccgtaa

SEQ ID NO: 9374065 - DNA, 22 bp, Homo sapiens
ggctttatgtttttcatgtggt

SEQ ID NO: 9374066 - DNA, 21 bp, Homo sapiens
ggctttatgctcacccagcct

SEQ ID NO: 9374067 - DNA, 21 bp, Homo sapiens
ggctttatgctcacccagcct

SEQ ID NO: 9374068 - DNA, 22 bp, Homo sapiens
ggctttctcacagcatggcagc

SEQ ID NO: 9374069 - DNA, 22 bp, Homo sapiens
ggctttctagatctagctctgt

SEQ ID NO: 9374070 - DNA, 22 bp, Homo sapiens
ggctttcaacacaggctttcct

SEQ ID NO: 9374071 - DNA, 22 bp, Homo sapiens
ggctttattttgcatgaatgct

SEQ ID NO: 9374072 - DNA, 22 bp, Homo sapiens
ggctttgatgtggtgtcaattt

SEQ ID NO: 9374073 - DNA, 22 bp, Homo sapiens
ggctttgaggatacagaggaaa

SEQ ID NO: 9374074 - DNA, 22 bp, Homo sapiens
ggctttgacatgctgaattaaa

SEQ ID NO: 9374075 - DNA, 22 bp, Homo sapiens
ggctttgcctggaatttccttg

SEQ ID NO: 9374076 - DNA, 22 bp, Homo sapiens
gggaagggagctgggtatttag

SEQ ID NO: 9374077 - DNA, 22 bp, Homo sapiens
gggaagggagggacctcagtct

SEQ ID NO: 9374078 - DNA, 22 bp, Homo sapiens
gggaagggagggacctcagtct

SEQ ID NO: 9374079 - DNA, 22 bp, Homo sapiens
gggaagggagggacctcagtct

SEQ ID NO: 9374080 - DNA, 22 bp, Homo sapiens
gggaagggagggcctccagtca

SEQ ID NO: 9374081 - DNA, 22 bp, Homo sapiens
gggaagggagggcctccagtca

SEQ ID NO: 9374082 - DNA, 22 bp, Homo sapiens
gggaagggagggcctccagtca

SEQ ID NO: 9374083 - DNA, 22 bp, Homo sapiens
gggaagggagggcctccagtca

SEQ ID NO: 9374084 - DNA, 22 bp, Homo sapiens
gggaagggagggacctcagtct

SEQ ID NO: 9374085 - DNA, 22 bp, Homo sapiens
gggaagggagggacctcagtct

SEQ ID NO: 9374086 - DNA, 22 bp, Homo sapiens
gggaagggacttgtttaaggtc

SEQ ID NO: 9374087 - DNA, 22 bp, Homo sapiens
gggaagggacttgtttaaggtc

SEQ ID NO: 9374088 - DNA, 22 bp, Homo sapiens
gggaagggagctgggtatttag

SEQ ID NO: 9374089 - DNA, 22 bp, Homo sapiens
gggaagggacttgtttaaggtc

SEQ ID NO: 9374090 - DNA, 22 bp, Homo sapiens
gggaaggctgcctgagggatgg

SEQ ID NO: 9374091 - DNA, 22 bp, Homo sapiens
gggaaggccttgtcagcggatt

SEQ ID NO: 9374092 - DNA, 22 bp, Homo sapiens
gggaaggctgcctgagggatgg

SEQ ID NO: 9374093 - DNA, 22 bp, Homo sapiens
gggaaggctgcctgagggatgg

SEQ ID NO: 9374094 - DNA, 22 bp, Homo sapiens
ggctcccaggagggcctggagg

SEQ ID NO: 9374095 - DNA, 22 bp, Homo sapiens
ggctaggcgggcacatggtgga

SEQ ID NO: 9374096 - DNA, 22 bp, Homo sapiens
ggctaggcgggcacatggtgga

SEQ ID NO: 9374097 - DNA, 22 bp, Homo sapiens
ggctaggcctcaggcctgcctg

SEQ ID NO: 9374098 - DNA, 22 bp, Homo sapiens
ggctaggctcacctggagagtt

SEQ ID NO: 9374099 - DNA, 22 bp, Homo sapiens
ggctaggctcacctggagagtt

SEQ ID NO: 9374100 - DNA, 22 bp, Homo sapiens
ggctccctcaccaccatcacat

SEQ ID NO: 9374101 - DNA, 22 bp, Homo sapiens
ggctccccaggtccaggagctg

SEQ ID NO: 9374102 - DNA, 22 bp, Homo sapiens
ggctccctgcaacctccgcctc

SEQ ID NO: 9374103 - DNA, 22 bp, Homo sapiens
ggctccctgcaacctccgcctc

SEQ ID NO: 9374104 - DNA, 23 bp, Homo sapiens
ggctccctcctagctttcccaat

SEQ ID NO: 9374105 - DNA, 22 bp, Homo sapiens
ggctccctgcctgtcctcagtc

SEQ ID NO: 9374106 - DNA, 22 bp, Homo sapiens
ggctccctgggtgctcctgctc

SEQ ID NO: 9374107 - DNA, 22 bp, Homo sapiens
ggctacagggtacaccacatct

SEQ ID NO: 9374108 - DNA, 22 bp, Homo sapiens
ggctagagtggaactggagcgg

SEQ ID NO: 9374109 - DNA, 22 bp, Homo sapiens
ggctagagtggaactggagcgg

SEQ ID NO: 9374110 - DNA, 22 bp, Homo sapiens
ggctaggcaggctcagagccta

SEQ ID NO: 9374111 - DNA, 22 bp, Homo sapiens
ggctagcttagagtcatgctag

SEQ ID NO: 9374112 - DNA, 21 bp, Homo sapiens
ggctaggatgctggggtttcc

SEQ ID NO: 9374113 - DNA, 22 bp, Homo sapiens
ggctagagtggaactggagcgg

SEQ ID NO: 9374114 - DNA, 23 bp, Homo sapiens
ggctagagtggaggggaactgca

SEQ ID NO: 9374115 - DNA, 23 bp, Homo sapiens
ggctagagtggaggggaactgca

SEQ ID NO: 9374116 - DNA, 23 bp, Homo sapiens
ggctagagtggaggggaactgca

SEQ ID NO: 9374117 - DNA, 22 bp, Homo sapiens
ggcggtggttgagaggacggcg

SEQ ID NO: 9374118 - DNA, 22 bp, Homo sapiens
ggcgtgggaagtggggcttctg

SEQ ID NO: 9374119 - DNA, 22 bp, Homo sapiens
ggctacagaggccgtgagcctg

SEQ ID NO: 9374120 - DNA, 22 bp, Homo sapiens
ggctacagactgcataagggca

SEQ ID NO: 9374121 - DNA, 22 bp, Homo sapiens
ggctaaggaacgcaggcttctc

SEQ ID NO: 9374122 - DNA, 22 bp, Homo sapiens
ggctctggggggaagtctgttg

SEQ ID NO: 9374123 - DNA, 22 bp, Homo sapiens
ggctctggggggaagtctgttg

SEQ ID NO: 9374124 - DNA, 22 bp, Homo sapiens
ggctctggggggaagtctgttg

SEQ ID NO: 9374125 - DNA, 22 bp, Homo sapiens
ggctctggggttggcccatctc

SEQ ID NO: 9374126 - DNA, 22 bp, Homo sapiens
ggctctggggttggcccatctc

SEQ ID NO: 9374127 - DNA, 22 bp, Homo sapiens
ggctctgggtctgtggggagcg

SEQ ID NO: 9374128 - DNA, 22 bp, Homo sapiens
ggctctgggtaaggcgtttgac

SEQ ID NO: 9374129 - DNA, 22 bp, Homo sapiens
ggctctgggtaaggcgtttgac

SEQ ID NO: 9374130 - DNA, 22 bp, Homo sapiens
ggctctggggaagctctcttca

SEQ ID NO: 9374131 - DNA, 22 bp, Homo sapiens
ggctctggggaagctctcttca

SEQ ID NO: 9374132 - DNA, 22 bp, Homo sapiens
ggctctggggcctcctcccttg

SEQ ID NO: 9374133 - DNA, 22 bp, Homo sapiens
ggctctggggcctcctcccttg

SEQ ID NO: 9374134 - DNA, 22 bp, Homo sapiens
ggctctggggcctcctcccttg

SEQ ID NO: 9374135 - DNA, 22 bp, Homo sapiens
ggctctggggggaagtctgttg

SEQ ID NO: 9374136 - DNA, 22 bp, Homo sapiens
ggctctgggcctccaaggtctg

SEQ ID NO: 9374137 - DNA, 22 bp, Homo sapiens
ggctctggggaagctctcttca

SEQ ID NO: 9374138 - DNA, 22 bp, Homo sapiens
ggctctgggcctccaaggtctg

SEQ ID NO: 9374139 - DNA, 22 bp, Homo sapiens
ggctcctgagaatgggccatca

SEQ ID NO: 9374140 - DNA, 22 bp, Homo sapiens
ggctcctctctggccgctcccg

SEQ ID NO: 9374141 - DNA, 22 bp, Homo sapiens
ggctcctccaagcaactctcag

SEQ ID NO: 9374142 - DNA, 22 bp, Homo sapiens
ggctccctgggtgctcctgctc

SEQ ID NO: 9374143 - DNA, 22 bp, Homo sapiens
ggctcctgagaatgggccatca

SEQ ID NO: 9374144 - DNA, 22 bp, Homo sapiens
ggctcctgaggaccaggcacag

SEQ ID NO: 9374145 - DNA, 22 bp, Homo sapiens
ggctcctgaggaccaggcacag

SEQ ID NO: 9374146 - DNA, 22 bp, Homo sapiens
ggctcctgaggaccaggcacag

SEQ ID NO: 9374147 - DNA, 22 bp, Homo sapiens
ggctcctgataggagaatgcgg

SEQ ID NO: 9374148 - DNA, 22 bp, Homo sapiens
ggctcctgataggagaatgcgg

SEQ ID NO: 9374149 - DNA, 22 bp, Homo sapiens
ggctcttcacacagtgatgtca

SEQ ID NO: 9374150 - DNA, 22 bp, Homo sapiens
ggctcttccgccaccagccaca

SEQ ID NO: 9374151 - DNA, 22 bp, Homo sapiens
ggctcttctacttcagatgggg

SEQ ID NO: 9374152 - DNA, 22 bp, Homo sapiens
ggctgagccatgggcactgcag

SEQ ID NO: 9374153 - DNA, 22 bp, Homo sapiens
ggctgagccatgggcactgcag

SEQ ID NO: 9374154 - DNA, 22 bp, Homo sapiens
ggctgagcactttaggcaggag

SEQ ID NO: 9374155 - DNA, 22 bp, Homo sapiens
ggctgagccatgggcactgcag

SEQ ID NO: 9374156 - DNA, 22 bp, Homo sapiens
ggctgagccactgcgcctggct

SEQ ID NO: 9374157 - DNA, 23 bp, Homo sapiens
ggctctgtgctgggcctgcagga

SEQ ID NO: 9374158 - DNA, 22 bp, Homo sapiens
ggctctgtaagtgttgcaggta

SEQ ID NO: 9374159 - DNA, 22 bp, Homo sapiens
ggctctggttgaccatgatggc

SEQ ID NO: 9374160 - DNA, 22 bp, Homo sapiens
ggctctgtaaagtgacacctgc

SEQ ID NO: 9374161 - DNA, 22 bp, Homo sapiens
ggctctgggtctgtggggagcg

SEQ ID NO: 9374162 - DNA, 17 bp, Homo sapiens
ggctctgggtgtcacat

SEQ ID NO: 9374163 - DNA, 17 bp, Homo sapiens
ggctctgggtgtcacat

SEQ ID NO: 9374164 - DNA, 22 bp, Homo sapiens
ggctctgggtgtgaccttgggt

SEQ ID NO: 9374165 - DNA, 22 bp, Homo sapiens
ggctctgggtgtgaccttgggt

SEQ ID NO: 9374166 - DNA, 22 bp, Homo sapiens
ggctctgggtgtgaccttgggt

SEQ ID NO: 9374167 - DNA, 22 bp, Homo sapiens
ggctctggtgtgaagcagcctc

SEQ ID NO: 9374168 - DNA, 22 bp, Homo sapiens
ggctctgggttctgcaatgcgt

SEQ ID NO: 9374169 - DNA, 22 bp, Homo sapiens
ggctctgggttctgcaatgcgt

SEQ ID NO: 9374170 - DNA, 22 bp, Homo sapiens
ggctctgggttctgcaatgcgt

SEQ ID NO: 9374171 - DNA, 22 bp, Homo sapiens
ggctctgggttctgcaatgcgt

SEQ ID NO: 9374172 - DNA, 22 bp, Homo sapiens
ggctctggtgtgaagcagcctc

SEQ ID NO: 9374173 - DNA, 22 bp, Homo sapiens
ggctctggtgtgaagcagcctc

SEQ ID NO: 9374174 - DNA, 22 bp, Homo sapiens
ggctctggttgaccatgatggc

SEQ ID NO: 9374175 - DNA, 22 bp, Homo sapiens
ggctctggttgaccatgatggc

SEQ ID NO: 9374176 - DNA, 22 bp, Homo sapiens
ggctgtgaagtagcaggggcag

SEQ ID NO: 9374177 - DNA, 22 bp, Homo sapiens
ggctgtgacaaggctgcgggaa

SEQ ID NO: 9374178 - DNA, 22 bp, Homo sapiens
ggctgtgattggtggatgtgaa

SEQ ID NO: 9374179 - DNA, 22 bp, Homo sapiens
ggctgtgattggtggatgtgaa

SEQ ID NO: 9374180 - DNA, 22 bp, Homo sapiens
ggctgtgagcaggcagaatgct

SEQ ID NO: 9374181 - DNA, 22 bp, Homo sapiens
ggctgtgacccccacaggggtg

SEQ ID NO: 9374182 - DNA, 17 bp, Homo sapiens
ggctgtgccaggtgaga

SEQ ID NO: 9374183 - DNA, 20 bp, Homo sapiens
ggctgtgcccttccgtggcc

SEQ ID NO: 9374184 - DNA, 22 bp, Homo sapiens
ggctgtgccctcacatggggca

SEQ ID NO: 9374185 - DNA, 22 bp, Homo sapiens
ggctgggttctgagaaagagta

SEQ ID NO: 9374186 - DNA, 21 bp, Homo sapiens
ggctggtcgcgtgcatgtctc

SEQ ID NO: 9374187 - DNA, 22 bp, Homo sapiens
ggctggtgagttcagagaaccc

SEQ ID NO: 9374188 - DNA, 22 bp, Homo sapiens
ggctggtggggaaagaggacca

SEQ ID NO: 9374189 - DNA, 23 bp, Homo sapiens
ggctggtgcccttggccagtcgg

SEQ ID NO: 9374190 - DNA, 23 bp, Homo sapiens
ggctggtgcccttggccagtcgg

SEQ ID NO: 9374191 - DNA, 23 bp, Homo sapiens
ggctggtgcccttggccagtcgg

SEQ ID NO: 9374192 - DNA, 23 bp, Homo sapiens
ggctggtgcccttggccagtcgg

SEQ ID NO: 9374193 - DNA, 22 bp, Homo sapiens
ggctgggtcccagctgggagga

SEQ ID NO: 9374194 - DNA, 22 bp, Homo sapiens
ggctgggtcccagctgggagga

SEQ ID NO: 9374195 - DNA, 22 bp, Homo sapiens
ggctgggtcccagctgggagga

SEQ ID NO: 9374196 - DNA, 19 bp, Homo sapiens
ggctgggtctggcaggttc

SEQ ID NO: 9374197 - DNA, 19 bp, Homo sapiens
ggctgggtctggcaggttc

SEQ ID NO: 9374198 - DNA, 22 bp, Homo sapiens
ggctgggtacagggcagtgtgc

SEQ ID NO: 9374199 - DNA, 22 bp, Homo sapiens
ggctgggtacagggcagtgtgc

SEQ ID NO: 9374200 - DNA, 21 bp, Homo sapiens
ggctgggtcatgcagctggcc

SEQ ID NO: 9374201 - DNA, 22 bp, Homo sapiens
ggctggactgcctcccagagtc

SEQ ID NO: 9374202 - DNA, 21 bp, Homo sapiens
ggctggacatcccaggagact

SEQ ID NO: 9374203 - DNA, 22 bp, Homo sapiens
ggctggactttctgctgggctc

SEQ ID NO: 9374204 - DNA, 22 bp, Homo sapiens
ggctggactttctgctgggctc

SEQ ID NO: 9374205 - DNA, 22 bp, Homo sapiens
ggctggactttttgcaggtcat

SEQ ID NO: 9374206 - DNA, 19 bp, Homo sapiens
ggctggagaaaggaatcag

SEQ ID NO: 9374207 - DNA, 19 bp, Homo sapiens
ggctggagaaaggaatcag

SEQ ID NO: 9374208 - DNA, 19 bp, Homo sapiens
ggctggagaaaggaatcag

SEQ ID NO: 9374209 - DNA, 22 bp, Homo sapiens
ggctggagaagggtggttgaca

SEQ ID NO: 9374210 - DNA, 19 bp, Homo sapiens
ggctggagaaaggaatcag

SEQ ID NO: 9374211 - DNA, 21 bp, Homo sapiens
ggctggacatcccaggagact

SEQ ID NO: 9374212 - DNA, 21 bp, Homo sapiens
ggctggacatcccaggagact

SEQ ID NO: 9374213 - DNA, 21 bp, Homo sapiens
ggctggacatcccaggagact

SEQ ID NO: 9374214 - DNA, 22 bp, Homo sapiens
ggctggaatgtgtggatgtgat

SEQ ID NO: 9374215 - DNA, 22 bp, Homo sapiens
ggctggaatgtgtggatgtgat

SEQ ID NO: 9374216 - DNA, 20 bp, Homo sapiens
ggctggaagtgtgggtttgg

SEQ ID NO: 9374217 - DNA, 22 bp, Homo sapiens
ggctggaaactcaggtagggtt

SEQ ID NO: 9374218 - DNA, 22 bp, Homo sapiens
ggctggaaactcaggtagggtt

SEQ ID NO: 9374219 - DNA, 22 bp, Homo sapiens
ggctggaagagactgaggacac

SEQ ID NO: 9374220 - DNA, 22 bp, Homo sapiens
ggctggaagagactgaggacac

SEQ ID NO: 9374221 - DNA, 22 bp, Homo sapiens
ggctggaacttcttctggcatt

SEQ ID NO: 9374222 - DNA, 22 bp, Homo sapiens
ggctggaaccagagtgaggcag

SEQ ID NO: 9374223 - DNA, 20 bp, Homo sapiens
ggctgctgtgggcagagagg

SEQ ID NO: 9374224 - DNA, 22 bp, Homo sapiens
ggctgagttctcttgctgaatc

SEQ ID NO: 9374225 - DNA, 22 bp, Homo sapiens
ggctgagttgagaggattactt

SEQ ID NO: 9374226 - DNA, 21 bp, Homo sapiens
ggctgctgggggttggcacag

SEQ ID NO: 9374227 - DNA, 20 bp, Homo sapiens
ggctgctgtgggcagagagg

SEQ ID NO: 9374228 - DNA, 22 bp, Homo sapiens
ggctgaggtgtggggaactata

SEQ ID NO: 9374229 - DNA, 18 bp, Homo sapiens
ggctgaggttgactagaa

SEQ ID NO: 9374230 - DNA, 22 bp, Homo sapiens
ggctgagggttaagatcagaca

SEQ ID NO: 9374231 - DNA, 18 bp, Homo sapiens
ggctgaggttgactagaa

SEQ ID NO: 9374232 - DNA, 18 bp, Homo sapiens
ggctgaggttgactagaa

SEQ ID NO: 9374233 - DNA, 18 bp, Homo sapiens
ggctgaggttgactagaa

SEQ ID NO: 9374234 - DNA, 22 bp, Homo sapiens
ggctgagtgctgctgttcacga

SEQ ID NO: 9374235 - DNA, 22 bp, Homo sapiens
ggctgagtggctgggtctagtt

SEQ ID NO: 9374236 - DNA, 22 bp, Homo sapiens
ggctgagtggctgggtctagtt

SEQ ID NO: 9374237 - DNA, 22 bp, Homo sapiens
ggctgagtggaggtagccctgt

SEQ ID NO: 9374238 - DNA, 22 bp, Homo sapiens
ggctgagtctgtgacccatgcg

SEQ ID NO: 9374239 - DNA, 22 bp, Homo sapiens
ggctgagtctgtgacccatgcg

SEQ ID NO: 9374240 - DNA, 22 bp, Homo sapiens
ggctgagggtcccagaccctaa

SEQ ID NO: 9374241 - DNA, 22 bp, Homo sapiens
ggctgagggtatagctgtccca

SEQ ID NO: 9374242 - DNA, 22 bp, Homo sapiens
ggctgaggggcccagaggaaca

SEQ ID NO: 9374243 - DNA, 22 bp, Homo sapiens
ggctgaggggcccagaggaaca

SEQ ID NO: 9374244 - DNA, 22 bp, Homo sapiens
ggctgagggccagggctagtct

SEQ ID NO: 9374245 - DNA, 22 bp, Homo sapiens
ggctgagggccagggctagtct

SEQ ID NO: 9374246 - DNA, 22 bp, Homo sapiens
ggctgagggccagggctagtct

SEQ ID NO: 9374247 - DNA, 22 bp, Homo sapiens
tcacacatactcatgtgtgagt

SEQ ID NO: 9374248 - DNA, 22 bp, Homo sapiens
tcacacatctcaggtgtttaat

SEQ ID NO: 9374249 - DNA, 22 bp, Homo sapiens
tcacacatgagtaaatacaggg

SEQ ID NO: 9374250 - DNA, 22 bp, Homo sapiens
tcacacatgagtaaatacaggg

SEQ ID NO: 9374251 - DNA, 22 bp, Homo sapiens
tcacacatctcaggtgtttaat

SEQ ID NO: 9374252 - DNA, 22 bp, Homo sapiens
tcacacataaaaagaagactag

SEQ ID NO: 9374253 - DNA, 22 bp, Homo sapiens
tcacacataaaaagaagactag

SEQ ID NO: 9374254 - DNA, 20 bp, Homo sapiens
tcacacataagtgaacgcac

SEQ ID NO: 9374255 - DNA, 22 bp, Homo sapiens
tcacacagggttctggtctcat

SEQ ID NO: 9374256 - DNA, 22 bp, Homo sapiens
tcacacaggtttgcaatgattt

SEQ ID NO: 9374257 - DNA, 22 bp, Homo sapiens
tcacagaatttttgcttccagt

SEQ ID NO: 9374258 - DNA, 22 bp, Homo sapiens
tcacagaatgtctagcataatt

SEQ ID NO: 9374259 - DNA, 22 bp, Homo sapiens
tcacagaatgtcagagttgggg

SEQ ID NO: 9374260 - DNA, 22 bp, Homo sapiens
tcacagaatctctgataagtct

SEQ ID NO: 9374261 - DNA, 22 bp, Homo sapiens
tcacagaatctctgataagtct

SEQ ID NO: 9374262 - DNA, 22 bp, Homo sapiens
tcacagaatgtcagagttgggg

SEQ ID NO: 9374263 - DNA, 22 bp, Homo sapiens
tcacagaatagcactgtaagcg

SEQ ID NO: 9374264 - DNA, 18 bp, Homo sapiens
tcacagaatattgagtgg

SEQ ID NO: 9374265 - DNA, 22 bp, Homo sapiens
tcacagcaaatgctgcttctca

SEQ ID NO: 9374266 - DNA, 22 bp, Homo sapiens
tcacagcaaaagtgtgcagagc

SEQ ID NO: 9374267 - DNA, 20 bp, Homo sapiens
tcacagagtagccttgtctg

SEQ ID NO: 9374268 - DNA, 22 bp, Homo sapiens
tcacagcagtaaagaaaacact

SEQ ID NO: 9374269 - DNA, 22 bp, Homo sapiens
tcacagcattcgcaatggacag

SEQ ID NO: 9374270 - DNA, 22 bp, Homo sapiens
tcacagcagaatttaggaggca

SEQ ID NO: 9374271 - DNA, 22 bp, Homo sapiens
tcacagcagggtaacaggaaga

SEQ ID NO: 9374272 - DNA, 22 bp, Homo sapiens
tcacagcaccctgaggtgctgg

SEQ ID NO: 9374273 - DNA, 22 bp, Homo sapiens
tcacagcaccctgaggtgctgg

SEQ ID NO: 9374274 - DNA, 22 bp, Homo sapiens
tcacagcaaccctgaggcgagt

SEQ ID NO: 9374275 - DNA, 22 bp, Homo sapiens
tcacagcaccaggatctctcca

SEQ ID NO: 9374276 - DNA, 22 bp, Homo sapiens
tcacagcaccaggatctctcca

SEQ ID NO: 9374277 - DNA, 22 bp, Homo sapiens
tcacatctgaaaaaatattgag

SEQ ID NO: 9374278 - DNA, 22 bp, Homo sapiens
tcacatctgaaaaaatattgag

SEQ ID NO: 9374279 - DNA, 22 bp, Homo sapiens
tcacatctgcctccatagcacc

SEQ ID NO: 9374280 - DNA, 22 bp, Homo sapiens
tcacatctgcaaaatccctttt

SEQ ID NO: 9374281 - DNA, 22 bp, Homo sapiens
tcacatctgattagtgactgat

SEQ ID NO: 9374282 - DNA, 22 bp, Homo sapiens
tcacatctccatgtgttgttca

SEQ ID NO: 9374283 - DNA, 21 bp, Homo sapiens
tcacatctatgttaagcaaac

SEQ ID NO: 9374284 - DNA, 21 bp, Homo sapiens
tcacatctatgttaagcaaac

SEQ ID NO: 9374285 - DNA, 22 bp, Homo sapiens
tcacatctctcattgcctctgc

SEQ ID NO: 9374286 - DNA, 22 bp, Homo sapiens
tcacatctctgttttctaaatc

SEQ ID NO: 9374287 - DNA, 22 bp, Homo sapiens
tcacatctctcattgcctctgc

SEQ ID NO: 9374288 - DNA, 22 bp, Homo sapiens
tcacatctctcattgcctctgc

SEQ ID NO: 9374289 - DNA, 22 bp, Homo sapiens
tcacatctccctggaggacaca

SEQ ID NO: 9374290 - DNA, 20 bp, Homo sapiens
tcacatcctctcccaacatg

SEQ ID NO: 9374291 - DNA, 22 bp, Homo sapiens
tcacatcattaagacttctcct

SEQ ID NO: 9374292 - DNA, 22 bp, Homo sapiens
tcacatctaattccatttctgc

SEQ ID NO: 9374293 - DNA, 20 bp, Homo sapiens
tcacatcctctcccaacatg

SEQ ID NO: 9374294 - DNA, 22 bp, Homo sapiens
tcacatctaattccatttctgc

SEQ ID NO: 9374295 - DNA, 22 bp, Homo sapiens
tcacatctaattccatttctgc

SEQ ID NO: 9374296 - DNA, 22 bp, Homo sapiens
tcacatctaattcggttaggtt

SEQ ID NO: 9374297 - DNA, 22 bp, Homo sapiens
tcacatctatacccaataattt

SEQ ID NO: 9374298 - DNA, 22 bp, Homo sapiens
tcacagcatttttagaaagatt

SEQ ID NO: 9374299 - DNA, 22 bp, Homo sapiens
tcacatatttaagaaagttaaa

SEQ ID NO: 9374300 - DNA, 22 bp, Homo sapiens
tcacatcaggtgtctccccaag

SEQ ID NO: 9374301 - DNA, 23 bp, Homo sapiens
tcaaacaggtttcagagcatctt

SEQ ID NO: 9374302 - DNA, 22 bp, Homo sapiens
tcaaacaggactacattctcat

SEQ ID NO: 9374303 - DNA, 23 bp, Homo sapiens
tcaaacatattgtgagacacagg

SEQ ID NO: 9374304 - DNA, 22 bp, Homo sapiens
tcaatacatacaatgtatagtg

SEQ ID NO: 9374305 - DNA, 22 bp, Homo sapiens
tcaaaagtttcacatagagata

SEQ ID NO: 9374306 - DNA, 20 bp, Homo sapiens
tcaaaataggtgtgggcgga

SEQ ID NO: 9374307 - DNA, 22 bp, Homo sapiens
tcaaaaatgttttatattggta

SEQ ID NO: 9374308 - DNA, 22 bp, Homo sapiens
tattttcattctgtgtgactgt

SEQ ID NO: 9374309 - DNA, 22 bp, Homo sapiens
tcaaaaatggtctttgagctgc

SEQ ID NO: 9374310 - DNA, 22 bp, Homo sapiens
tcaaaaatggtctttgagctgc

SEQ ID NO: 9374311 - DNA, 22 bp, Homo sapiens
tcaaaaatggtctttgagctgc

SEQ ID NO: 9374312 - DNA, 18 bp, Homo sapiens
tcaaaatatttctgtgga

SEQ ID NO: 9374313 - DNA, 18 bp, Homo sapiens
tcaaaatatttctgtgga

SEQ ID NO: 9374314 - DNA, 18 bp, Homo sapiens
tcaaaatatttctgtgga

SEQ ID NO: 9374315 - DNA, 18 bp, Homo sapiens
tcaaaatatttctgtgga

SEQ ID NO: 9374316 - DNA, 22 bp, Homo sapiens
tcaaacagaggaacaattgttt

SEQ ID NO: 9374317 - DNA, 22 bp, Homo sapiens
tcaaaattctagggagaatggt

SEQ ID NO: 9374318 - DNA, 22 bp, Homo sapiens
tcacacacataatctaagatta

SEQ ID NO: 9374319 - DNA, 22 bp, Homo sapiens
tcacacacataatctaagatta

SEQ ID NO: 9374320 - DNA, 22 bp, Homo sapiens
tcacacacatggatagtatttt

SEQ ID NO: 9374321 - DNA, 21 bp, Homo sapiens
tcacacacgtttccaagggca

SEQ ID NO: 9374322 - DNA, 21 bp, Homo sapiens
tcacacacgtttccaagggca

SEQ ID NO: 9374323 - DNA, 22 bp, Homo sapiens
tcacacacatttgctgtctgat

SEQ ID NO: 9374324 - DNA, 22 bp, Homo sapiens
tcacacacatggatagtatttt

SEQ ID NO: 9374325 - DNA, 22 bp, Homo sapiens
tcacacacatttgctgtctgat

SEQ ID NO: 9374326 - DNA, 22 bp, Homo sapiens
tcacacagggtcggaaagagtg

SEQ ID NO: 9374327 - DNA, 22 bp, Homo sapiens
tcacacagcttggagttatggt

SEQ ID NO: 9374328 - DNA, 22 bp, Homo sapiens
tcacacagattggtagagctga

SEQ ID NO: 9374329 - DNA, 23 bp, Homo sapiens
tcacacagctggtcaggtacaga

SEQ ID NO: 9374330 - DNA, 22 bp, Homo sapiens
tcaattactaaccaaataatgt

SEQ ID NO: 9374331 - DNA, 22 bp, Homo sapiens
tcaattagggtctatttctagt

SEQ ID NO: 9374332 - DNA, 22 bp, Homo sapiens
tcaattatgccattgcaatatt

SEQ ID NO: 9374333 - DNA, 22 bp, Homo sapiens
tcaattctggtcctcaggaact

SEQ ID NO: 9374334 - DNA, 22 bp, Homo sapiens
tcaattctagagccttacattg

SEQ ID NO: 9374335 - DNA, 21 bp, Homo sapiens
tcaattatggatgtgtgcaaa

SEQ ID NO: 9374336 - DNA, 22 bp, Homo sapiens
tcaattattttggctatgctaa

SEQ ID NO: 9374337 - DNA, 22 bp, Homo sapiens
tcactaatgagctaaggaaaag

SEQ ID NO: 9374338 - DNA, 22 bp, Homo sapiens
tcacgttttactgagtgagata

SEQ ID NO: 9374339 - DNA, 21 bp, Homo sapiens
tcacgtggtcacatgagcttt

SEQ ID NO: 9374340 - DNA, 21 bp, Homo sapiens
tcacgtggtcacatgagcttt

SEQ ID NO: 9374341 - DNA, 22 bp, Homo sapiens
tcactggaaatgcacagctgta

SEQ ID NO: 9374342 - DNA, 22 bp, Homo sapiens
tcactggaaatgcacagctgta

SEQ ID NO: 9374343 - DNA, 21 bp, Homo sapiens
tcactggaatacaattgattt

SEQ ID NO: 9374344 - DNA, 21 bp, Homo sapiens
tcactggacgtgagccagggg

SEQ ID NO: 9374345 - DNA, 22 bp, Homo sapiens
tcactgcttcttggagaatgtc

SEQ ID NO: 9374346 - DNA, 22 bp, Homo sapiens
tcactgcttcttggagaatgtc

SEQ ID NO: 9374347 - DNA, 22 bp, Homo sapiens
tcactacaacctccgcctcctg

SEQ ID NO: 9374348 - DNA, 22 bp, Homo sapiens
tcactgctttgagccactgagc

SEQ ID NO: 9374349 - DNA, 17 bp, Homo sapiens
tcactgggcctgctccc

SEQ ID NO: 9374350 - DNA, 20 bp, Homo sapiens
tcactggccagagtagccct

SEQ ID NO: 9374351 - DNA, 22 bp, Homo sapiens
tcactggagaaaagtaatgtat

SEQ ID NO: 9374352 - DNA, 22 bp, Homo sapiens
tcactggattaagcattgacat

SEQ ID NO: 9374353 - DNA, 22 bp, Homo sapiens
tcactggatcctagctgagcct

SEQ ID NO: 9374354 - DNA, 20 bp, Homo sapiens
tcactggccagagtagccct

SEQ ID NO: 9374355 - DNA, 22 bp, Homo sapiens
tcactgtaatttgtatctgtgg

SEQ ID NO: 9374356 - DNA, 22 bp, Homo sapiens
tcactgtagagtctgtttccac

SEQ ID NO: 9374357 - DNA, 22 bp, Homo sapiens
tcactggggcctttggtcagga

SEQ ID NO: 9374358 - DNA, 22 bp, Homo sapiens
tcactgggtaggacatgctgat

SEQ ID NO: 9374359 - DNA, 22 bp, Homo sapiens
tcactggtgtgagaggagcaaa

SEQ ID NO: 9374360 - DNA, 22 bp, Homo sapiens
tcactgggtaggacatgctgat

SEQ ID NO: 9374361 - DNA, 22 bp, Homo sapiens
tcagaacatcctggtttaaaat

SEQ ID NO: 9374362 - DNA, 22 bp, Homo sapiens
tcagaacagtgcctggcactaa

SEQ ID NO: 9374363 - DNA, 20 bp, Homo sapiens
tcagaacagtagaggagcta

SEQ ID NO: 9374364 - DNA, 23 bp, Homo sapiens
tcagaacagttcttggtgcatag

SEQ ID NO: 9374365 - DNA, 22 bp, Homo sapiens
tcagaacagttcttaatattgc

SEQ ID NO: 9374366 - DNA, 22 bp, Homo sapiens
tcactgtccctgtcctcttatc

SEQ ID NO: 9374367 - DNA, 22 bp, Homo sapiens
tcactgtctgaaagaaatggcc

SEQ ID NO: 9374368 - DNA, 23 bp, Homo sapiens
tcactgtcctgctcctggaacgc

SEQ ID NO: 9374369 - DNA, 22 bp, Homo sapiens
tcactgtatgtctttttttgat

SEQ ID NO: 9374370 - DNA, 22 bp, Homo sapiens
tcactgtcttttaaggtggtta

SEQ ID NO: 9374371 - DNA, 22 bp, Homo sapiens
tcactgtgcacatatgataggt

SEQ ID NO: 9374372 - DNA, 21 bp, Homo sapiens
tcactgtgcaaatgttgatgg

SEQ ID NO: 9374373 - DNA, 21 bp, Homo sapiens
tcacctggcttctgacctggc

SEQ ID NO: 9374374 - DNA, 22 bp, Homo sapiens
tcacctctctggccgtctacct

SEQ ID NO: 9374375 - DNA, 22 bp, Homo sapiens
tcacctcaccacccttatggtt

SEQ ID NO: 9374376 - DNA, 22 bp, Homo sapiens
tcacctgtattaatacagaact

SEQ ID NO: 9374377 - DNA, 22 bp, Homo sapiens
tcacctgggagggctgtggtag

SEQ ID NO: 9374378 - DNA, 22 bp, Homo sapiens
tcacctgggagggctgtggtag

SEQ ID NO: 9374379 - DNA, 22 bp, Homo sapiens
tcaccttgtgatccgcccacct

SEQ ID NO: 9374380 - DNA, 22 bp, Homo sapiens
tcaccttgtgatctccctgcct

SEQ ID NO: 9374381 - DNA, 22 bp, Homo sapiens
tcaccttgtgatctccctgcct

SEQ ID NO: 9374382 - DNA, 22 bp, Homo sapiens
tcaccttgtgatctccctgcct

SEQ ID NO: 9374383 - DNA, 22 bp, Homo sapiens
tcacgcatggacggtcaacatc

SEQ ID NO: 9374384 - DNA, 22 bp, Homo sapiens
tcacggacctaagaggaagatt

SEQ ID NO: 9374385 - DNA, 21 bp, Homo sapiens
tcacgtggtcacatgagcttt

SEQ ID NO: 9374386 - DNA, 21 bp, Homo sapiens
tcacgtggtcacatgagcttt

SEQ ID NO: 9374387 - DNA, 22 bp, Homo sapiens
tcacccctaccaaggagcactg

SEQ ID NO: 9374388 - DNA, 22 bp, Homo sapiens
tcacccctaccaaggagcactg

SEQ ID NO: 9374389 - DNA, 22 bp, Homo sapiens
tcacccatcctggatgagattc

SEQ ID NO: 9374390 - DNA, 22 bp, Homo sapiens
tcaccccaaagttgagtttgat

SEQ ID NO: 9374391 - DNA, 22 bp, Homo sapiens
tcacccttgataatgttcttct

SEQ ID NO: 9374392 - DNA, 22 bp, Homo sapiens
tcacccttagtgtactatcatg

SEQ ID NO: 9374393 - DNA, 22 bp, Homo sapiens
tcaccccttgtgaatgctgctc

SEQ ID NO: 9374394 - DNA, 22 bp, Homo sapiens
tcacatgccacagatgaggcaa

SEQ ID NO: 9374395 - DNA, 22 bp, Homo sapiens
tcacatgaggttatgacaaagc

SEQ ID NO: 9374396 - DNA, 22 bp, Homo sapiens
tcacatgaggttatgacaaagc

SEQ ID NO: 9374397 - DNA, 22 bp, Homo sapiens
tcacatgaggttatgacaaagc

SEQ ID NO: 9374398 - DNA, 22 bp, Homo sapiens
tcacatcttgtgatgttttcat

SEQ ID NO: 9374399 - DNA, 22 bp, Homo sapiens
tcacatcttggattacaatttt

SEQ ID NO: 9374400 - DNA, 22 bp, Homo sapiens
tcacatcttattagagtatctc

SEQ ID NO: 9374401 - DNA, 22 bp, Homo sapiens
tcacatctgttgatacagcatc

SEQ ID NO: 9374402 - DNA, 22 bp, Homo sapiens
tcacatcttagtttgggactct

SEQ ID NO: 9374403 - DNA, 22 bp, Homo sapiens
tcacatctgtgtgattgtcatt

SEQ ID NO: 9374404 - DNA, 22 bp, Homo sapiens
tcacatctgtgtgattgtcatt

SEQ ID NO: 9374405 - DNA, 22 bp, Homo sapiens
tcacatctgttgatacagcatc

SEQ ID NO: 9374406 - DNA, 20 bp, Homo sapiens
tcacatctggcagctgatga

SEQ ID NO: 9374407 - DNA, 23 bp, Homo sapiens
tcacatctgccgtagtgtattct

SEQ ID NO: 9374408 - DNA, 22 bp, Homo sapiens
tcacatctgcctccatagcacc

SEQ ID NO: 9374409 - DNA, 22 bp, Homo sapiens
tcacatctgcctccatagcacc

SEQ ID NO: 9374410 - DNA, 22 bp, Homo sapiens
tcagagaattgtttaatggaat

SEQ ID NO: 9374411 - DNA, 22 bp, Homo sapiens
tcagagaatgtccttcttcatt

SEQ ID NO: 9374412 - DNA, 22 bp, Homo sapiens
tcagagaatgtgaatattaaac

SEQ ID NO: 9374413 - DNA, 22 bp, Homo sapiens
tcagagaattcgattaaatgca

SEQ ID NO: 9374414 - DNA, 22 bp, Homo sapiens
tcagagaatgtccttcttcatt

SEQ ID NO: 9374415 - DNA, 23 bp, Homo sapiens
tcagagaatggtatgcttttcct

SEQ ID NO: 9374416 - DNA, 21 bp, Homo sapiens
tcagagaatggcctactctca

SEQ ID NO: 9374417 - DNA, 22 bp, Homo sapiens
tcagaagccaccttttgttggg

SEQ ID NO: 9374418 - DNA, 22 bp, Homo sapiens
tcagaagcatgtggggagcctg

SEQ ID NO: 9374419 - DNA, 22 bp, Homo sapiens
tcagaagcatgtggggagcctg

SEQ ID NO: 9374420 - DNA, 22 bp, Homo sapiens
tcagaagcaggagtgtgcacaa

SEQ ID NO: 9374421 - DNA, 22 bp, Homo sapiens
tcagaagcagatatttcaaaat

SEQ ID NO: 9374422 - DNA, 22 bp, Homo sapiens
tcagaagcatccatttcaccac

SEQ ID NO: 9374423 - DNA, 22 bp, Homo sapiens
tcagaagcaggagtgtgcacaa

SEQ ID NO: 9374424 - DNA, 23 bp, Homo sapiens
tcagagaataattctgatagact

SEQ ID NO: 9374425 - DNA, 22 bp, Homo sapiens
tcagaacatttaaaaagtggtt

SEQ ID NO: 9374426 - DNA, 22 bp, Homo sapiens
tcagaactacatggacatgtta

SEQ ID NO: 9374427 - DNA, 22 bp, Homo sapiens
tcagaacattgacattcttatt

SEQ ID NO: 9374428 - DNA, 22 bp, Homo sapiens
tcagaacattctcattgactgc

SEQ ID NO: 9374429 - DNA, 22 bp, Homo sapiens
tcagaacatcctggtttaaaat

SEQ ID NO: 9374430 - DNA, 22 bp, Homo sapiens
tcagaacttaaagccgattggg

SEQ ID NO: 9374431 - DNA, 19 bp, Homo sapiens
tcagaactcagaatgtgta

SEQ ID NO: 9374432 - DNA, 22 bp, Homo sapiens
tcagaactggaagaggttctgc

SEQ ID NO: 9374433 - DNA, 22 bp, Homo sapiens
tcagaagcaaacatcactctag

SEQ ID NO: 9374434 - DNA, 22 bp, Homo sapiens
tcagaagcaagcttctacttct

SEQ ID NO: 9374435 - DNA, 22 bp, Homo sapiens
tcagaagcagaaaataggtggg

SEQ ID NO: 9374436 - DNA, 22 bp, Homo sapiens
tcagaggacaagctccctggtg

SEQ ID NO: 9374437 - DNA, 22 bp, Homo sapiens
tcagaggaatttgcttttcatg

SEQ ID NO: 9374438 - DNA, 22 bp, Homo sapiens
tcagaggacagcagctaaataa

SEQ ID NO: 9374439 - DNA, 22 bp, Homo sapiens
tcagaggacagcagctaaataa

SEQ ID NO: 9374440 - DNA, 22 bp, Homo sapiens
tcagaggaccttactgagaacc

SEQ ID NO: 9374441 - DNA, 22 bp, Homo sapiens
tcagaggaccttactgagaacc

SEQ ID NO: 9374442 - DNA, 22 bp, Homo sapiens
tcagaggaataatgctgcattt

SEQ ID NO: 9374443 - DNA, 22 bp, Homo sapiens
tcagaggaataatgctgcattt

SEQ ID NO: 9374444 - DNA, 23 bp, Homo sapiens
tcagagagctgttgagagctgcc

SEQ ID NO: 9374445 - DNA, 20 bp, Homo sapiens
tcagagagagggtgccactt

SEQ ID NO: 9374446 - DNA, 22 bp, Homo sapiens
tcagaggccaaactgagcaggg

SEQ ID NO: 9374447 - DNA, 22 bp, Homo sapiens
tcagaggctcatctgccttgca

SEQ ID NO: 9374448 - DNA, 22 bp, Homo sapiens
tcagaggagaagttgggaaaat

SEQ ID NO: 9374449 - DNA, 22 bp, Homo sapiens
tcagaggagaagttgggaaaat

SEQ ID NO: 9374450 - DNA, 22 bp, Homo sapiens
tcagaggagaccaaggggaata

SEQ ID NO: 9374451 - DNA, 22 bp, Homo sapiens
tcagaggagaccaaggggaata

SEQ ID NO: 9374452 - DNA, 22 bp, Homo sapiens
tcagaggacgcactagggttgt

SEQ ID NO: 9374453 - DNA, 22 bp, Homo sapiens
tcagaggactaccttctccagt

SEQ ID NO: 9374454 - DNA, 22 bp, Homo sapiens
tcagaggattggacttttatgt

SEQ ID NO: 9374455 - DNA, 19 bp, Homo sapiens
tcagaggatttggctatga

SEQ ID NO: 9374456 - DNA, 22 bp, Homo sapiens
tcagaggattgcctcagcgagc

SEQ ID NO: 9374457 - DNA, 22 bp, Homo sapiens
tcagaggattgcctcagcgagc

SEQ ID NO: 9374458 - DNA, 18 bp, Homo sapiens
tcagaggagatacctaaa

SEQ ID NO: 9374459 - DNA, 22 bp, Homo sapiens
tcaggagcctgaaagaggtcta

SEQ ID NO: 9374460 - DNA, 22 bp, Homo sapiens
tcaggagggtgacaggccctgg

SEQ ID NO: 9374461 - DNA, 22 bp, Homo sapiens
tcaggagggtctctattttcct

SEQ ID NO: 9374462 - DNA, 22 bp, Homo sapiens
tcaggagggctaagactgtagc

SEQ ID NO: 9374463 - DNA, 22 bp, Homo sapiens
tcaggagggagtgtggatagag

SEQ ID NO: 9374464 - DNA, 22 bp, Homo sapiens
tcaggagggattgttgcctatt

SEQ ID NO: 9374465 - DNA, 22 bp, Homo sapiens
tcaggagggctaagactgtagc

SEQ ID NO: 9374466 - DNA, 22 bp, Homo sapiens
tcaggagggattgttgcctatt

SEQ ID NO: 9374467 - DNA, 22 bp, Homo sapiens
tcaggaggacagataaggatag

SEQ ID NO: 9374468 - DNA, 22 bp, Homo sapiens
tcaggaggacagataaggatag

SEQ ID NO: 9374469 - DNA, 22 bp, Homo sapiens
tcaggaggagctcataagtttg

SEQ ID NO: 9374470 - DNA, 22 bp, Homo sapiens
tcagctttctcagaggcctaac

SEQ ID NO: 9374471 - DNA, 22 bp, Homo sapiens
tcagctttctctcgccatcagg

SEQ ID NO: 9374472 - DNA, 22 bp, Homo sapiens
tcagctttctcagaggcctaac

SEQ ID NO: 9374473 - DNA, 22 bp, Homo sapiens
tcagctttctcaaagaagctgg

SEQ ID NO: 9374474 - DNA, 22 bp, Homo sapiens
tcagctttctctcgccatcagg

SEQ ID NO: 9374475 - DNA, 22 bp, Homo sapiens
tcagctttctctcgccatcagg

SEQ ID NO: 9374476 - DNA, 22 bp, Homo sapiens
tcaggaaagcctagaagagaac

SEQ ID NO: 9374477 - DNA, 22 bp, Homo sapiens
tcaggaaatggtgatttggttg

SEQ ID NO: 9374478 - DNA, 22 bp, Homo sapiens
tcaggagagtgttcagtggagg

SEQ ID NO: 9374479 - DNA, 22 bp, Homo sapiens
tcaggagatgtaaccttagctg

SEQ ID NO: 9374480 - DNA, 22 bp, Homo sapiens
tcaggagatgtaaccttagctg

SEQ ID NO: 9374481 - DNA, 23 bp, Homo sapiens
tcaggcagctggggtagttggag

SEQ ID NO: 9374482 - DNA, 22 bp, Homo sapiens
tcaggcaggaagcccctgcaca

SEQ ID NO: 9374483 - DNA, 22 bp, Homo sapiens
tcaggcaggaagcccctgcaca

SEQ ID NO: 9374484 - DNA, 22 bp, Homo sapiens
tcaggcagctccaggaatggta

SEQ ID NO: 9374485 - DNA, 22 bp, Homo sapiens
tcaggcagcattaaacttcagc

SEQ ID NO: 9374486 - DNA, 22 bp, Homo sapiens
tcaggcagcattaaacttcagc

SEQ ID NO: 9374487 - DNA, 22 bp, Homo sapiens
tcaggcagatgcagggatggat

SEQ ID NO: 9374488 - DNA, 22 bp, Homo sapiens
tcaggcagcattaaacttcagc

SEQ ID NO: 9374489 - DNA, 22 bp, Homo sapiens
tcaggcagagttaatttgctcc

SEQ ID NO: 9374490 - DNA, 22 bp, Homo sapiens
tcaggagggtgacaggccctgg

SEQ ID NO: 9374491 - DNA, 22 bp, Homo sapiens
tcaggaggtaaggtaaaacaga

SEQ ID NO: 9374492 - DNA, 22 bp, Homo sapiens
tcaggaggtaggacatactggt

SEQ ID NO: 9374493 - DNA, 22 bp, Homo sapiens
tcaggaggtaggacatactggt

SEQ ID NO: 9374494 - DNA, 22 bp, Homo sapiens
tcaggaggtccgcccgggaggg

SEQ ID NO: 9374495 - DNA, 19 bp, Homo sapiens
tcaggaggtcgacctggca

SEQ ID NO: 9374496 - DNA, 19 bp, Homo sapiens
tcaggaggtcgacctggca

SEQ ID NO: 9374497 - DNA, 22 bp, Homo sapiens
tcaggaggtgtaacgaatacag

SEQ ID NO: 9374498 - DNA, 22 bp, Homo sapiens
tcaggcaccccttgagtagggg

SEQ ID NO: 9374499 - DNA, 22 bp, Homo sapiens
tcaggcaggctcagaggaaaac

SEQ ID NO: 9374500 - DNA, 22 bp, Homo sapiens
tcaggcaggctcagaggaaaac

SEQ ID NO: 9374501 - DNA, 21 bp, Homo sapiens
tcaggcaggtcccactgaaca

SEQ ID NO: 9374502 - DNA, 22 bp, Homo sapiens
tcaggcaggtggctggctatgg

SEQ ID NO: 9374503 - DNA, 22 bp, Homo sapiens
tcaggcaggtggctggctatgg

SEQ ID NO: 9374504 - DNA, 22 bp, Homo sapiens
tcaggcagtagaattgcttgaa

SEQ ID NO: 9374505 - DNA, 22 bp, Homo sapiens
tcaggccttgtcctgacctcct

SEQ ID NO: 9374506 - DNA, 22 bp, Homo sapiens
tcaggcaggttggctgcaggtc

SEQ ID NO: 9374507 - DNA, 22 bp, Homo sapiens
tcaggcaggttggctgcaggtc

SEQ ID NO: 9374508 - DNA, 21 bp, Homo sapiens
tcaggcaggcgcagagggaag

SEQ ID NO: 9374509 - DNA, 21 bp, Homo sapiens
tcaggcaggcgcagagggaag

SEQ ID NO: 9374510 - DNA, 22 bp, Homo sapiens
tcaggcaggcagagggcaaatg

SEQ ID NO: 9374511 - DNA, 22 bp, Homo sapiens
tcaggcaggatcccagggaagg

SEQ ID NO: 9374512 - DNA, 22 bp, Homo sapiens
tcaggcaggacaattatttagg

SEQ ID NO: 9374513 - DNA, 22 bp, Homo sapiens
tcaggcaggacaattatttagg

SEQ ID NO: 9374514 - DNA, 22 bp, Homo sapiens
tcaggcaggaagggaggacttg

SEQ ID NO: 9374515 - DNA, 22 bp, Homo sapiens
tcaggcaggaagggaggacttg

SEQ ID NO: 9374516 - DNA, 22 bp, Homo sapiens
tcaggcaggaagggaggacttg

SEQ ID NO: 9374517 - DNA, 20 bp, Homo sapiens
tcagccattccttacctttc

SEQ ID NO: 9374518 - DNA, 22 bp, Homo sapiens
tcagcccaaccctgcacaagga

SEQ ID NO: 9374519 - DNA, 22 bp, Homo sapiens
tcagccagttaagtcaagaaat

SEQ ID NO: 9374520 - DNA, 22 bp, Homo sapiens
tcagccagttaaggcttagaca

SEQ ID NO: 9374521 - DNA, 22 bp, Homo sapiens
tcagccagtgtgcacctggagt

SEQ ID NO: 9374522 - DNA, 22 bp, Homo sapiens
tcagccagtgtgcacctggagt

SEQ ID NO: 9374523 - DNA, 22 bp, Homo sapiens
tcagccagtttgattctatttg

SEQ ID NO: 9374524 - DNA, 22 bp, Homo sapiens
tcagccagttgccccagttagt

SEQ ID NO: 9374525 - DNA, 22 bp, Homo sapiens
tcagccagtttgtttattccgg

SEQ ID NO: 9374526 - DNA, 18 bp, Homo sapiens
tcagcccagagcccagtt

SEQ ID NO: 9374527 - DNA, 22 bp, Homo sapiens
tcagcccagcccagcaagtgca

SEQ ID NO: 9374528 - DNA, 22 bp, Homo sapiens
tcagcctcattttctgctctgt

SEQ ID NO: 9374529 - DNA, 22 bp, Homo sapiens
tcagcctcctaatttcctgtga

SEQ ID NO: 9374530 - DNA, 23 bp, Homo sapiens
tcagcctcttaggacttctcacc

SEQ ID NO: 9374531 - DNA, 18 bp, Homo sapiens
tcagcttccagcatgttt

SEQ ID NO: 9374532 - DNA, 23 bp, Homo sapiens
tcagcttcattgtcttctatggc

SEQ ID NO: 9374533 - DNA, 23 bp, Homo sapiens
tcagcttcattgtcttctatggc

SEQ ID NO: 9374534 - DNA, 22 bp, Homo sapiens
tcagcttcagatcagctagaga

SEQ ID NO: 9374535 - DNA, 22 bp, Homo sapiens
tcagcttcagatcagctagaga

SEQ ID NO: 9374536 - DNA, 23 bp, Homo sapiens
tcagcctcttaggacttctcacc

SEQ ID NO: 9374537 - DNA, 22 bp, Homo sapiens
tcagcttctccaagtgacatgg

SEQ ID NO: 9374538 - DNA, 19 bp, Homo sapiens
tcagcttctgtgtattgta

SEQ ID NO: 9374539 - DNA, 19 bp, Homo sapiens
tcagcttctgtgtattgta

SEQ ID NO: 9374540 - DNA, 22 bp, Homo sapiens
tcagcttgatccatccaactat

SEQ ID NO: 9374541 - DNA, 22 bp, Homo sapiens
tcagcttcctctgtggttccag

SEQ ID NO: 9374542 - DNA, 22 bp, Homo sapiens
tcagcttcctctgtggttccag

SEQ ID NO: 9374543 - DNA, 22 bp, Homo sapiens
tcagcttctcaaaatggcttag

SEQ ID NO: 9374544 - DNA, 22 bp, Homo sapiens
tcagcttctcaaaatggcttag

SEQ ID NO: 9374545 - DNA, 22 bp, Homo sapiens
tcagcttccctatctgaccata

SEQ ID NO: 9374546 - DNA, 22 bp, Homo sapiens
tcagctttctatgttgctaaac

SEQ ID NO: 9374547 - DNA, 22 bp, Homo sapiens
tcagctttcctgcagctaaggg

SEQ ID NO: 9374548 - DNA, 22 bp, Homo sapiens
tcagctttccttgctttagatt

SEQ ID NO: 9374549 - DNA, 22 bp, Homo sapiens
tcagcttgtgggtcagcctctg

SEQ ID NO: 9374550 - DNA, 22 bp, Homo sapiens
tcagaggtaagggctgagagga

SEQ ID NO: 9374551 - DNA, 18 bp, Homo sapiens
tcagaggtacagaaaagt

SEQ ID NO: 9374552 - DNA, 22 bp, Homo sapiens
tcagaggtaaaaactcactgta

SEQ ID NO: 9374553 - DNA, 22 bp, Homo sapiens
tcagaggtcagcagcttgccca

SEQ ID NO: 9374554 - DNA, 22 bp, Homo sapiens
tcagaggtagtagcagagttga

SEQ ID NO: 9374555 - DNA, 22 bp, Homo sapiens
tcagaggtcacacagcaagttt

SEQ ID NO: 9374556 - DNA, 22 bp, Homo sapiens
tcagaggtccctagcaggagtg

SEQ ID NO: 9374557 - DNA, 22 bp, Homo sapiens
tcagaggtgagcatgtgaccaa

SEQ ID NO: 9374558 - DNA, 22 bp, Homo sapiens
tcagaggtgcaagaagttctga

SEQ ID NO: 9374559 - DNA, 22 bp, Homo sapiens
tcagaggtgagcttcttgctaa

SEQ ID NO: 9374560 - DNA, 22 bp, Homo sapiens
tcagaggtgagcttcttgctaa

SEQ ID NO: 9374561 - DNA, 22 bp, Homo sapiens
tcagaggtggagatagttggga

SEQ ID NO: 9374562 - DNA, 22 bp, Homo sapiens
tcagaggtggcaggggtgtcca

SEQ ID NO: 9374563 - DNA, 22 bp, Homo sapiens
tcagaggtggcaggggtgtcca

SEQ ID NO: 9374564 - DNA, 22 bp, Homo sapiens
tcagaggtggcccctgccctca

SEQ ID NO: 9374565 - DNA, 22 bp, Homo sapiens
tcagaggtggcccctgccctca

SEQ ID NO: 9374566 - DNA, 21 bp, Homo sapiens
tcagagggccctggaggctca

SEQ ID NO: 9374567 - DNA, 22 bp, Homo sapiens
tcagagggtggctgggagcatc

SEQ ID NO: 9374568 - DNA, 22 bp, Homo sapiens
tcagagtaactacagtatagac

SEQ ID NO: 9374569 - DNA, 22 bp, Homo sapiens
tcagagtcaactgttgcctgtt

SEQ ID NO: 9374570 - DNA, 22 bp, Homo sapiens
tcagaggttccggccataacca

SEQ ID NO: 9374571 - DNA, 22 bp, Homo sapiens
tcagaggttcttctcagtggcc

SEQ ID NO: 9374572 - DNA, 22 bp, Homo sapiens
tcagaggttacccatgggacag

SEQ ID NO: 9374573 - DNA, 22 bp, Homo sapiens
tcagaggtggtaaaggacagca

SEQ ID NO: 9374574 - DNA, 22 bp, Homo sapiens
tcagagtgaggcgtcaacatga

SEQ ID NO: 9374575 - DNA, 22 bp, Homo sapiens
tcagagtcctcaccctgaggat

SEQ ID NO: 9374576 - DNA, 21 bp, Homo sapiens
tcagagtctcaggagcaaggg

SEQ ID NO: 9374577 - DNA, 21 bp, Homo sapiens
tcagagtctcaggagcaaggg

SEQ ID NO: 9374578 - DNA, 22 bp, Homo sapiens
tcagccagggctctggcctcag

SEQ ID NO: 9374579 - DNA, 22 bp, Homo sapiens
tcagccagggggagagaatgga

SEQ ID NO: 9374580 - DNA, 22 bp, Homo sapiens
tcagccaggtaatgtggagatg

SEQ ID NO: 9374581 - DNA, 22 bp, Homo sapiens
tcagccagtatttgagtgctca

SEQ ID NO: 9374582 - DNA, 22 bp, Homo sapiens
tcagccagtgccttgatcttgc

SEQ ID NO: 9374583 - DNA, 22 bp, Homo sapiens
tcagccagtgccttgatcttgc

SEQ ID NO: 9374584 - DNA, 22 bp, Homo sapiens
tcagccaggccctaagagattg

SEQ ID NO: 9374585 - DNA, 22 bp, Homo sapiens
tcagccaggccaggcattcaca

SEQ ID NO: 9374586 - DNA, 22 bp, Homo sapiens
tcagccaggccaggcattcaca

SEQ ID NO: 9374587 - DNA, 22 bp, Homo sapiens
tcagccagggctctggcctcag

SEQ ID NO: 9374588 - DNA, 22 bp, Homo sapiens
tcagccagggcagagcaggtga

SEQ ID NO: 9374589 - DNA, 22 bp, Homo sapiens
tcataaaaatagactctaaagt

SEQ ID NO: 9374590 - DNA, 22 bp, Homo sapiens
tcagtttttctatactttgtag

SEQ ID NO: 9374591 - DNA, 22 bp, Homo sapiens
tcagtttttctatactttgtag

SEQ ID NO: 9374592 - DNA, 22 bp, Homo sapiens
tcagtttgaatgttagcacagt

SEQ ID NO: 9374593 - DNA, 22 bp, Homo sapiens
tcagttttaaggtttgagaatt

SEQ ID NO: 9374594 - DNA, 22 bp, Homo sapiens
tcagttcaaacaggtgtctgga

SEQ ID NO: 9374595 - DNA, 22 bp, Homo sapiens
tcagttcctgttgcacagcatc

SEQ ID NO: 9374596 - DNA, 22 bp, Homo sapiens
tcagtttctttactcatagaat

SEQ ID NO: 9374597 - DNA, 22 bp, Homo sapiens
tcagtgcttttgtcacatggtc

SEQ ID NO: 9374598 - DNA, 22 bp, Homo sapiens
tcagtggaactgtctgggtgag

SEQ ID NO: 9374599 - DNA, 22 bp, Homo sapiens
tcagtggagagcttccaggatt

SEQ ID NO: 9374600 - DNA, 22 bp, Homo sapiens
tcagtggagagcttccaggatt

SEQ ID NO: 9374601 - DNA, 22 bp, Homo sapiens
tcagtgcttttgtcacatggtc

SEQ ID NO: 9374602 - DNA, 19 bp, Homo sapiens
tcagtggagaaaggggaag

SEQ ID NO: 9374603 - DNA, 23 bp, Homo sapiens
tcagtgcttgggggtgacgcgcc

SEQ ID NO: 9374604 - DNA, 22 bp, Homo sapiens
tcagtgcttgcctctggaggag

SEQ ID NO: 9374605 - DNA, 22 bp, Homo sapiens
tcagtgcttttgagaagctcct

SEQ ID NO: 9374606 - DNA, 22 bp, Homo sapiens
tcagtgcttttgagaagctcct

SEQ ID NO: 9374607 - DNA, 22 bp, Homo sapiens
tcagtgcttttgagaagctcct

SEQ ID NO: 9374608 - DNA, 22 bp, Homo sapiens
tcagtgcttgacagctctggga

SEQ ID NO: 9374609 - DNA, 22 bp, Homo sapiens
tcagtgcttcggcgagcaccta

SEQ ID NO: 9374610 - DNA, 22 bp, Homo sapiens
tcagtgcttcggcgagcaccta

SEQ ID NO: 9374611 - DNA, 22 bp, Homo sapiens
tcagtgcttgcctctggaggag

SEQ ID NO: 9374612 - DNA, 22 bp, Homo sapiens
tcagtgcttgcctctggaggag

SEQ ID NO: 9374613 - DNA, 22 bp, Homo sapiens
tcagtgcttcctggaggaagcc

SEQ ID NO: 9374614 - DNA, 22 bp, Homo sapiens
tcagtgcttcctggaggaagcc

SEQ ID NO: 9374615 - DNA, 22 bp, Homo sapiens
tcagtgctgtgtaaatgtatta

SEQ ID NO: 9374616 - DNA, 22 bp, Homo sapiens
tcagtgcttatattctgagcct

SEQ ID NO: 9374617 - DNA, 22 bp, Homo sapiens
tcagtgggagcaggagagtgac

SEQ ID NO: 9374618 - DNA, 22 bp, Homo sapiens
tcagtgggaggccattgaatgg

SEQ ID NO: 9374619 - DNA, 20 bp, Homo sapiens
tcagtgggaaagtgagagtg

SEQ ID NO: 9374620 - DNA, 22 bp, Homo sapiens
tcagtggattgtagaaggctta

SEQ ID NO: 9374621 - DNA, 22 bp, Homo sapiens
tcagtggattggatgagatctg

SEQ ID NO: 9374622 - DNA, 22 bp, Homo sapiens
tcagtggagtatggatgaagtc

SEQ ID NO: 9374623 - DNA, 22 bp, Homo sapiens
tcagtggagctaagcatgagat

SEQ ID NO: 9374624 - DNA, 19 bp, Homo sapiens
tcagtggatgaacatgttt

SEQ ID NO: 9374625 - DNA, 22 bp, Homo sapiens
tcagtggattgacatgaaaaag

SEQ ID NO: 9374626 - DNA, 22 bp, Homo sapiens
tcagtggatatttctgtggctg

SEQ ID NO: 9374627 - DNA, 22 bp, Homo sapiens
tcagtggggtcgatgtgaggga

SEQ ID NO: 9374628 - DNA, 22 bp, Homo sapiens
tcagtggtatgcgtgggagctg

SEQ ID NO: 9374629 - DNA, 22 bp, Homo sapiens
tcatccactggggatcccatgt

SEQ ID NO: 9374630 - DNA, 22 bp, Homo sapiens
tcatccagagcttcataagtaa

SEQ ID NO: 9374631 - DNA, 22 bp, Homo sapiens
tcatcaaaggattgcatgattt

SEQ ID NO: 9374632 - DNA, 22 bp, Homo sapiens
tcatcatctgcaagctcatgtc

SEQ ID NO: 9374633 - DNA, 22 bp, Homo sapiens
tcatcatctgggcttgggggtg

SEQ ID NO: 9374634 - DNA, 20 bp, Homo sapiens
tcataaagaggaaataaata

SEQ ID NO: 9374635 - DNA, 22 bp, Homo sapiens
tcatatttgggggtgtgtgttt

SEQ ID NO: 9374636 - DNA, 22 bp, Homo sapiens
tcataaaatgctcctgatattg

SEQ ID NO: 9374637 - DNA, 22 bp, Homo sapiens
tcatccctctgccaggcccagg

SEQ ID NO: 9374638 - DNA, 22 bp, Homo sapiens
tcatccctaaggacagctctgc

SEQ ID NO: 9374639 - DNA, 22 bp, Homo sapiens
tcatcccagaccacttattttc

SEQ ID NO: 9374640 - DNA, 22 bp, Homo sapiens
tcatcccagtgtccatgctcag

SEQ ID NO: 9374641 - DNA, 22 bp, Homo sapiens
tcatccattgtcctcacattag

SEQ ID NO: 9374642 - DNA, 22 bp, Homo sapiens
tcatccattgtcctcacattag

SEQ ID NO: 9374643 - DNA, 22 bp, Homo sapiens
tcatccatgtcagagcatgtat

SEQ ID NO: 9374644 - DNA, 22 bp, Homo sapiens
tcatccatgtgcaaactttggt

SEQ ID NO: 9374645 - DNA, 21 bp, Homo sapiens
tcatccatggcttttgtgctt

SEQ ID NO: 9374646 - DNA, 16 bp, Homo sapiens
tcatccatgacagctc

SEQ ID NO: 9374647 - DNA, 22 bp, Homo sapiens
tcatccagtatgactggtgtct

SEQ ID NO: 9374648 - DNA, 22 bp, Homo sapiens
tcatccatctttgatttcatag

SEQ ID NO: 9374649 - DNA, 22 bp, Homo sapiens
tcatccatgaagagtgacagaa

SEQ ID NO: 9374650 - DNA, 22 bp, Homo sapiens
tcatccatctttgatttcatag

SEQ ID NO: 9374651 - DNA, 22 bp, Homo sapiens
tcatccatcctcgcctttgctt

SEQ ID NO: 9374652 - DNA, 22 bp, Homo sapiens
tcatccatagtttggttggact

SEQ ID NO: 9374653 - DNA, 22 bp, Homo sapiens
tcatccatactattgagaggca

SEQ ID NO: 9374654 - DNA, 22 bp, Homo sapiens
tcatccatatagaaagatgatt

SEQ ID NO: 9374655 - DNA, 22 bp, Homo sapiens
tcatctcagggcgacatcatgt

SEQ ID NO: 9374656 - DNA, 22 bp, Homo sapiens
tcatctctagacaggaggctgg

SEQ ID NO: 9374657 - DNA, 22 bp, Homo sapiens
tcatctcctcatgtatctggga

SEQ ID NO: 9374658 - DNA, 22 bp, Homo sapiens
tcatctctcaggataccagcag

SEQ ID NO: 9374659 - DNA, 22 bp, Homo sapiens
tcatctcagagaggtatgttag

SEQ ID NO: 9374660 - DNA, 22 bp, Homo sapiens
tcatctcaaaattatgctgcac

SEQ ID NO: 9374661 - DNA, 22 bp, Homo sapiens
tcatcctgtatcctcagaccat

SEQ ID NO: 9374662 - DNA, 22 bp, Homo sapiens
tcatctaagagtcttacattta

SEQ ID NO: 9374663 - DNA, 22 bp, Homo sapiens
tcatctaagagtcttacattta

SEQ ID NO: 9374664 - DNA, 22 bp, Homo sapiens
tcatctaagagtcttacattta

SEQ ID NO: 9374665 - DNA, 18 bp, Homo sapiens
tcaggctctctggctaga

SEQ ID NO: 9374666 - DNA, 22 bp, Homo sapiens
tcaggctctgagctgatgctaa

SEQ ID NO: 9374667 - DNA, 22 bp, Homo sapiens
tcaggctctgccacctagatta

SEQ ID NO: 9374668 - DNA, 22 bp, Homo sapiens
tcaggctgaaaggactccagtt

SEQ ID NO: 9374669 - DNA, 22 bp, Homo sapiens
tcaggctctgggtacacctgac

SEQ ID NO: 9374670 - DNA, 22 bp, Homo sapiens
tcaggctctgggtacacctgac

SEQ ID NO: 9374671 - DNA, 22 bp, Homo sapiens
tcaggctgaaaggactccagtt

SEQ ID NO: 9374672 - DNA, 22 bp, Homo sapiens
tcaggctctgggtacacctgac

SEQ ID NO: 9374673 - DNA, 22 bp, Homo sapiens
tcaggctgaaggaggcctatct

SEQ ID NO: 9374674 - DNA, 22 bp, Homo sapiens
tcaggctgaaggaggcctatct

SEQ ID NO: 9374675 - DNA, 22 bp, Homo sapiens
tcaggctgaaggaggcctatct

SEQ ID NO: 9374676 - DNA, 22 bp, Homo sapiens
tcaggctgaaaggactccagtt

SEQ ID NO: 9374677 - DNA, 22 bp, Homo sapiens
tcaggctgaatcatcctagctt

SEQ ID NO: 9374678 - DNA, 22 bp, Homo sapiens
tcaggctgaatcatcctagctt

SEQ ID NO: 9374679 - DNA, 22 bp, Homo sapiens
tcaggctctcagaccaacagca

SEQ ID NO: 9374680 - DNA, 18 bp, Homo sapiens
tcaggctctctggctaga

SEQ ID NO: 9374681 - DNA, 18 bp, Homo sapiens
tcaggctctctggctaga

SEQ ID NO: 9374682 - DNA, 20 bp, Homo sapiens
tcaggctccgcattaactta

SEQ ID NO: 9374683 - DNA, 22 bp, Homo sapiens
tcaggctctacacttgacacac

SEQ ID NO: 9374684 - DNA, 22 bp, Homo sapiens
tcaggctctacacttgacacac

SEQ ID NO: 9374685 - DNA, 22 bp, Homo sapiens
tcaggctcaggttaggggccaa

SEQ ID NO: 9374686 - DNA, 22 bp, Homo sapiens
tcaggctccctgctgggctctg

SEQ ID NO: 9374687 - DNA, 22 bp, Homo sapiens
tcaggctccctgctgggctctg

SEQ ID NO: 9374688 - DNA, 22 bp, Homo sapiens
tcaggcctttcttcagagcttc

SEQ ID NO: 9374689 - DNA, 22 bp, Homo sapiens
tcaggcctttcttcagagcttc

SEQ ID NO: 9374690 - DNA, 22 bp, Homo sapiens
tcaggcctttgaacttggagtg

SEQ ID NO: 9374691 - DNA, 22 bp, Homo sapiens
tcaggcgaggcttaatccaagg

SEQ ID NO: 9374692 - DNA, 22 bp, Homo sapiens
tcaggctcaggaatgtgtttat

SEQ ID NO: 9374693 - DNA, 22 bp, Homo sapiens
tcaggctcaaagggccggatga

SEQ ID NO: 9374694 - DNA, 22 bp, Homo sapiens
tcaggctgaggtcatctgcatc

SEQ ID NO: 9374695 - DNA, 22 bp, Homo sapiens
tcaggctgaggtcatctgcatc

SEQ ID NO: 9374696 - DNA, 22 bp, Homo sapiens
tcaggctgagaaaatctggacc

SEQ ID NO: 9374697 - DNA, 22 bp, Homo sapiens
tcaggctgaccaggttttgctc

SEQ ID NO: 9374698 - DNA, 22 bp, Homo sapiens
tcagggagagcctgtctgacgt

SEQ ID NO: 9374699 - DNA, 22 bp, Homo sapiens
tcagggactgttactgcctttg

SEQ ID NO: 9374700 - DNA, 22 bp, Homo sapiens
tcagggcaaaagggaaaccatt

SEQ ID NO: 9374701 - DNA, 22 bp, Homo sapiens
tcagggcaaaagggaaaccatt

SEQ ID NO: 9374702 - DNA, 22 bp, Homo sapiens
tcagggcaaaagggaaaccatt

SEQ ID NO: 9374703 - DNA, 22 bp, Homo sapiens
tcagggcaagtctcagaaggtt

SEQ ID NO: 9374704 - DNA, 22 bp, Homo sapiens
tcagggcaatgtccctcagaag

SEQ ID NO: 9374705 - DNA, 22 bp, Homo sapiens
tcagggcaagtctcagaaggtt

SEQ ID NO: 9374706 - DNA, 22 bp, Homo sapiens
tcagggcaaagggcagagtttg

SEQ ID NO: 9374707 - DNA, 22 bp, Homo sapiens
tcagggcaagattggttaataa

SEQ ID NO: 9374708 - DNA, 22 bp, Homo sapiens
tcagggcaaagggcagagtttg

SEQ ID NO: 9374709 - DNA, 22 bp, Homo sapiens
tcagggcaagattggttaataa

SEQ ID NO: 9374710 - DNA, 22 bp, Homo sapiens
tcagggcacattctgcagtggc

SEQ ID NO: 9374711 - DNA, 22 bp, Homo sapiens
tcagggcacaggcctgtgggtt

SEQ ID NO: 9374712 - DNA, 22 bp, Homo sapiens
tcagggcacaggcctgtgggtt

SEQ ID NO: 9374713 - DNA, 22 bp, Homo sapiens
tcagggcaatgtccctcagaag

SEQ ID NO: 9374714 - DNA, 22 bp, Homo sapiens
tcagggcaatgtccctcagaag

SEQ ID NO: 9374715 - DNA, 22 bp, Homo sapiens
tcagggcaccaaaaaagatgcc

SEQ ID NO: 9374716 - DNA, 22 bp, Homo sapiens
tcagggcaccaaaaaagatgcc

SEQ ID NO: 9374717 - DNA, 22 bp, Homo sapiens
tcagggcacattctgcagtggc

SEQ ID NO: 9374718 - DNA, 22 bp, Homo sapiens
tcaggggaaatctctcagcgaa

SEQ ID NO: 9374719 - DNA, 22 bp, Homo sapiens
tcaggggcccttccctcagcag

SEQ ID NO: 9374720 - DNA, 22 bp, Homo sapiens
tcagggcacgtttctgcaatgc

SEQ ID NO: 9374721 - DNA, 22 bp, Homo sapiens
tcagggcacgtttctgcaatgc

SEQ ID NO: 9374722 - DNA, 22 bp, Homo sapiens
tcagggcaccaaaaaagatgcc

SEQ ID NO: 9374723 - DNA, 22 bp, Homo sapiens
tcagggcactgtcacctgatat

SEQ ID NO: 9374724 - DNA, 22 bp, Homo sapiens
tcagggcactgtcacctgatat

SEQ ID NO: 9374725 - DNA, 22 bp, Homo sapiens
tcagggcagaatccaaagaatt

SEQ ID NO: 9374726 - DNA, 22 bp, Homo sapiens
tcagggcagaatccaaagaatt

SEQ ID NO: 9374727 - DNA, 16 bp, Homo sapiens
tcagggcagaatggca

SEQ ID NO: 9374728 - DNA, 22 bp, Homo sapiens
tcagggcagaatccaaagaatt

SEQ ID NO: 9374729 - DNA, 22 bp, Homo sapiens
tcagggcagcctaaggcacctc

SEQ ID NO: 9374730 - DNA, 16 bp, Homo sapiens
tcagggcagaatggca

SEQ ID NO: 9374731 - DNA, 22 bp, Homo sapiens
tcagggctgtggttccttttct

SEQ ID NO: 9374732 - DNA, 22 bp, Homo sapiens
tcagggctgccgggcagaccgt

SEQ ID NO: 9374733 - DNA, 22 bp, Homo sapiens
tcagggcagcctaaggcacctc

SEQ ID NO: 9374734 - DNA, 21 bp, Homo sapiens
tcagggcagctgctcttcaga

SEQ ID NO: 9374735 - DNA, 22 bp, Homo sapiens
tcagggcagcctaaggcacctc

SEQ ID NO: 9374736 - DNA, 22 bp, Homo sapiens
tcagggtcaggacccagctgtt

SEQ ID NO: 9374737 - DNA, 22 bp, Homo sapiens
tcagggtcaggacccagctgtt

SEQ ID NO: 9374738 - DNA, 21 bp, Homo sapiens
tcagggttcaaaggaactgat

SEQ ID NO: 9374739 - DNA, 22 bp, Homo sapiens
tcagggggaggagactgccagt

SEQ ID NO: 9374740 - DNA, 22 bp, Homo sapiens
tcagggtatgttctagatctga

SEQ ID NO: 9374741 - DNA, 22 bp, Homo sapiens
tcagggtcagattccagagcct

SEQ ID NO: 9374742 - DNA, 22 bp, Homo sapiens
tcagggtcaggacccagctgtt

SEQ ID NO: 9374743 - DNA, 22 bp, Homo sapiens
tcagggtcagattccagagcct

SEQ ID NO: 9374744 - DNA, 22 bp, Homo sapiens
tcaggtcccactgctagtaagt

SEQ ID NO: 9374745 - DNA, 22 bp, Homo sapiens
tcaggtaagtgtaatatataga

SEQ ID NO: 9374746 - DNA, 22 bp, Homo sapiens
tcaggtacttaagactctttag

SEQ ID NO: 9374747 - DNA, 22 bp, Homo sapiens
tcaggtcttgagccatcaggat

SEQ ID NO: 9374748 - DNA, 22 bp, Homo sapiens
tcaggtggaattaattaagaga

SEQ ID NO: 9374749 - DNA, 22 bp, Homo sapiens
tcaggtggaattaattaagaga

SEQ ID NO: 9374750 - DNA, 22 bp, Homo sapiens
tcagtgcatcacagaactttgt

SEQ ID NO: 9374751 - DNA, 22 bp, Homo sapiens
tccacgtgagcttcgtgtgcag

SEQ ID NO: 9374752 - DNA, 22 bp, Homo sapiens
tccacgttttcaacacagccaa

SEQ ID NO: 9374753 - DNA, 22 bp, Homo sapiens
tccactcatgagatctggctga

SEQ ID NO: 9374754 - DNA, 22 bp, Homo sapiens
tccactgacaggtgaatggata

SEQ ID NO: 9374755 - DNA, 22 bp, Homo sapiens
tccactctaattactaccttct

SEQ ID NO: 9374756 - DNA, 21 bp, Homo sapiens
tccaccctctctgctcccagt

SEQ ID NO: 9374757 - DNA, 22 bp, Homo sapiens
tccacctagcattcacctccta

SEQ ID NO: 9374758 - DNA, 22 bp, Homo sapiens
tccaccctgctttcttatctcc

SEQ ID NO: 9374759 - DNA, 19 bp, Homo sapiens
tccacctttcttcatttgg

SEQ ID NO: 9374760 - DNA, 22 bp, Homo sapiens
tccacctgagtttcagttattt

SEQ ID NO: 9374761 - DNA, 22 bp, Homo sapiens
tccacctccatgctgggcagag

SEQ ID NO: 9374762 - DNA, 22 bp, Homo sapiens
tccagaaaattttacagtgcct

SEQ ID NO: 9374763 - DNA, 22 bp, Homo sapiens
tccagaaaattcagaaattgtt

SEQ ID NO: 9374764 - DNA, 22 bp, Homo sapiens
tccacttgccctcttctgtgct

SEQ ID NO: 9374765 - DNA, 22 bp, Homo sapiens
tccacttcatccagggtcacca

SEQ ID NO: 9374766 - DNA, 20 bp, Homo sapiens
tccacttactagctctgtga

SEQ ID NO: 9374767 - DNA, 22 bp, Homo sapiens
tccactttagcaatgattgaat

SEQ ID NO: 9374768 - DNA, 22 bp, Homo sapiens
tccactttagcaatgattgaat

SEQ ID NO: 9374769 - DNA, 22 bp, Homo sapiens
tccactggcccacctcctcagt

SEQ ID NO: 9374770 - DNA, 22 bp, Homo sapiens
tccactggtaatacctagatcc

SEQ ID NO: 9374771 - DNA, 22 bp, Homo sapiens
tccactggcctctgtctttcag

SEQ ID NO: 9374772 - DNA, 22 bp, Homo sapiens
tccaccacttcctgcagccatt

SEQ ID NO: 9374773 - DNA, 22 bp, Homo sapiens
tccaccagcagcctgtcagcct

SEQ ID NO: 9374774 - DNA, 19 bp, Homo sapiens
tccaccccagccagctctg

SEQ ID NO: 9374775 - DNA, 23 bp, Homo sapiens
tccaccccagctgaggcttagcc

SEQ ID NO: 9374776 - DNA, 23 bp, Homo sapiens
tccaccccagctgaggcttagcc

SEQ ID NO: 9374777 - DNA, 23 bp, Homo sapiens
tccaccccagctgaggcttagcc

SEQ ID NO: 9374778 - DNA, 22 bp, Homo sapiens
tccacccctgggaatgtcaata

SEQ ID NO: 9374779 - DNA, 22 bp, Homo sapiens
tccaccatgtaacaagctctgt

SEQ ID NO: 9374780 - DNA, 22 bp, Homo sapiens
tccaccatgtaacaagctctgt

SEQ ID NO: 9374781 - DNA, 22 bp, Homo sapiens
tccacagggatgcctgcggctt

SEQ ID NO: 9374782 - DNA, 22 bp, Homo sapiens
tccacaggcaagtctcttggca

SEQ ID NO: 9374783 - DNA, 22 bp, Homo sapiens
tccacagggatgttgagttctt

SEQ ID NO: 9374784 - DNA, 22 bp, Homo sapiens
tccacagggatgcctgcggctt

SEQ ID NO: 9374785 - DNA, 22 bp, Homo sapiens
tccacaggaaagcacctcccat

SEQ ID NO: 9374786 - DNA, 22 bp, Homo sapiens
tccacaggaaagcacctcccat

SEQ ID NO: 9374787 - DNA, 22 bp, Homo sapiens
tccacaggctgaggcccttctg

SEQ ID NO: 9374788 - DNA, 22 bp, Homo sapiens
tccacaggctgaggcccttctg

SEQ ID NO: 9374789 - DNA, 22 bp, Homo sapiens
tccacagcattattagaaggat

SEQ ID NO: 9374790 - DNA, 22 bp, Homo sapiens
tccacagcacaaagccagtgtg

SEQ ID NO: 9374791 - DNA, 22 bp, Homo sapiens
tcattaaaatgcagattctgac

SEQ ID NO: 9374792 - DNA, 22 bp, Homo sapiens
tcattaaatgtttgttgtgcca

SEQ ID NO: 9374793 - DNA, 22 bp, Homo sapiens
tcattaaaatgcagattctgac

SEQ ID NO: 9374794 - DNA, 22 bp, Homo sapiens
tccacacacatttctatgtgca

SEQ ID NO: 9374795 - DNA, 22 bp, Homo sapiens
tcattacaagatttccaatttg

SEQ ID NO: 9374796 - DNA, 22 bp, Homo sapiens
tccacacacatttctatgtgca

SEQ ID NO: 9374797 - DNA, 22 bp, Homo sapiens
tccacacacatttctatgtgca

SEQ ID NO: 9374798 - DNA, 22 bp, Homo sapiens
tccacagaatgtaagatccaca

SEQ ID NO: 9374799 - DNA, 22 bp, Homo sapiens
tcatgtttttgccatatgactc

SEQ ID NO: 9374800 - DNA, 22 bp, Homo sapiens
tcatgtttttgccatatgactc

SEQ ID NO: 9374801 - DNA, 22 bp, Homo sapiens
tcatgttttagctgcaaaatga

SEQ ID NO: 9374802 - DNA, 22 bp, Homo sapiens
tcatgttttagctgcaaaatga

SEQ ID NO: 9374803 - DNA, 22 bp, Homo sapiens
tcatgttttagtaaagtgaagg

SEQ ID NO: 9374804 - DNA, 22 bp, Homo sapiens
tcatgtttctcttacagcagct

SEQ ID NO: 9374805 - DNA, 22 bp, Homo sapiens
tcatgtttctcttacagcagct

SEQ ID NO: 9374806 - DNA, 22 bp, Homo sapiens
tcatgtttgccctaagaaaaag

SEQ ID NO: 9374807 - DNA, 22 bp, Homo sapiens
tcatgtttggagtttgctcact

SEQ ID NO: 9374808 - DNA, 22 bp, Homo sapiens
tcatgtttgccctaagaaaaag

SEQ ID NO: 9374809 - DNA, 22 bp, Homo sapiens
tcatgtttgttggaaatgtggc

SEQ ID NO: 9374810 - DNA, 22 bp, Homo sapiens
tcatgtttgttggaaatgtggc

SEQ ID NO: 9374811 - DNA, 22 bp, Homo sapiens
tcatgttattgactcataatat

SEQ ID NO: 9374812 - DNA, 22 bp, Homo sapiens
tcatgtgttaaactccaagata

SEQ ID NO: 9374813 - DNA, 22 bp, Homo sapiens
tcatgtgttgcactgaggacct

SEQ ID NO: 9374814 - DNA, 22 bp, Homo sapiens
tcatgtgtgtttcatgtatgga

SEQ ID NO: 9374815 - DNA, 20 bp, Homo sapiens
tcatgtgtgtcctacagaga

SEQ ID NO: 9374816 - DNA, 22 bp, Homo sapiens
tcatgtgtgtttcatgtatgga

SEQ ID NO: 9374817 - DNA, 20 bp, Homo sapiens
tcatgtgtgtcctacagaga

SEQ ID NO: 9374818 - DNA, 22 bp, Homo sapiens
tcatgtgtctgctgcagctgtt

SEQ ID NO: 9374819 - DNA, 20 bp, Homo sapiens
tcatgtgtgtcctacagaga

SEQ ID NO: 9374820 - DNA, 21 bp, Homo sapiens
tcatgtgtaacttttgaccac

SEQ ID NO: 9374821 - DNA, 22 bp, Homo sapiens
tcatgtgtcctagttcatataa

SEQ ID NO: 9374822 - DNA, 22 bp, Homo sapiens
tcatgtgtctgccagtgtttat

SEQ ID NO: 9374823 - DNA, 22 bp, Homo sapiens
tcatgtgtcctagttcatataa

SEQ ID NO: 9374824 - DNA, 22 bp, Homo sapiens
tcatggcttcaaggaagcaggc

SEQ ID NO: 9374825 - DNA, 22 bp, Homo sapiens
tccagaaacttttccagtctca

SEQ ID NO: 9374826 - DNA, 20 bp, Homo sapiens
tccagcccaggtcctgcctg

SEQ ID NO: 9374827 - DNA, 22 bp, Homo sapiens
tccagcccaggctggagtgtag

SEQ ID NO: 9374828 - DNA, 22 bp, Homo sapiens
tccagcccaggctggagtgtag

SEQ ID NO: 9374829 - DNA, 20 bp, Homo sapiens
tccagcccaggtcctgcctg

SEQ ID NO: 9374830 - DNA, 22 bp, Homo sapiens
tccagccactcagcagggattg

SEQ ID NO: 9374831 - DNA, 19 bp, Homo sapiens
tccagcccctctgtgtgtg

SEQ ID NO: 9374832 - DNA, 19 bp, Homo sapiens
tccagcccctctgtgtgtg

SEQ ID NO: 9374833 - DNA, 22 bp, Homo sapiens
tccagcccctcctgagccaagc

SEQ ID NO: 9374834 - DNA, 22 bp, Homo sapiens
tccagcccctcctgagccaagc

SEQ ID NO: 9374835 - DNA, 22 bp, Homo sapiens
tccagcccctcctgagccaagc

SEQ ID NO: 9374836 - DNA, 22 bp, Homo sapiens
tccagccccggcttccttacag

SEQ ID NO: 9374837 - DNA, 22 bp, Homo sapiens
tccagccccgggatgttcttca

SEQ ID NO: 9374838 - DNA, 22 bp, Homo sapiens
tccagcccatccctagcctggg

SEQ ID NO: 9374839 - DNA, 20 bp, Homo sapiens
tccagcccaggtcctgcctg

SEQ ID NO: 9374840 - DNA, 22 bp, Homo sapiens
tccagcccagtttggtgaattg

SEQ ID NO: 9374841 - DNA, 22 bp, Homo sapiens
tccagccccgaggccggcgacg

SEQ ID NO: 9374842 - DNA, 22 bp, Homo sapiens
tccagccccgaggccggcgacg

SEQ ID NO: 9374843 - DNA, 22 bp, Homo sapiens
tccagcccatccctagcctggg

SEQ ID NO: 9374844 - DNA, 22 bp, Homo sapiens
tccagcccatccctagcctggg

SEQ ID NO: 9374845 - DNA, 22 bp, Homo sapiens
tccagccctcctgggatcacag

SEQ ID NO: 9374846 - DNA, 22 bp, Homo sapiens
tccagccctcctgggatcacag

SEQ ID NO: 9374847 - DNA, 22 bp, Homo sapiens
tccagccctcctgggatcacag

SEQ ID NO: 9374848 - DNA, 20 bp, Homo sapiens
tccagccctcatgtcgctca

SEQ ID NO: 9374849 - DNA, 20 bp, Homo sapiens
tccagccctcatgtcgctca

SEQ ID NO: 9374850 - DNA, 22 bp, Homo sapiens
tccagccctgcactgattagat

SEQ ID NO: 9374851 - DNA, 22 bp, Homo sapiens
tccagccctgcactgattagat

SEQ ID NO: 9374852 - DNA, 22 bp, Homo sapiens
tccagccctctggcccgcggtg

SEQ ID NO: 9374853 - DNA, 22 bp, Homo sapiens
tccagccctgcttcctgcctca

SEQ ID NO: 9374854 - DNA, 22 bp, Homo sapiens
tccagccctgcttcctgcctca

SEQ ID NO: 9374855 - DNA, 22 bp, Homo sapiens
tccagccctgcttcctgcctca

SEQ ID NO: 9374856 - DNA, 17 bp, Homo sapiens
tccagccctgcccgacg

SEQ ID NO: 9374857 - DNA, 22 bp, Homo sapiens
tccagccctgcccattctctcg

SEQ ID NO: 9374858 - DNA, 17 bp, Homo sapiens
tccagccctgcccgacg

SEQ ID NO: 9374859 - DNA, 22 bp, Homo sapiens
tccagcccgactgggcctgccg

SEQ ID NO: 9374860 - DNA, 22 bp, Homo sapiens
tccagcccgactgggcctgccg

SEQ ID NO: 9374861 - DNA, 22 bp, Homo sapiens
tccagccccttttactcattca

SEQ ID NO: 9374862 - DNA, 20 bp, Homo sapiens
tccagcccctgcatgttgct

SEQ ID NO: 9374863 - DNA, 20 bp, Homo sapiens
tccagcccctgcatgttgct

SEQ ID NO: 9374864 - DNA, 19 bp, Homo sapiens
tccagcccctctgtgtgtg

SEQ ID NO: 9374865 - DNA, 22 bp, Homo sapiens
tccagcccgggggcaggtgacc

SEQ ID NO: 9374866 - DNA, 22 bp, Homo sapiens
tccagcccgggggcaggtgacc

SEQ ID NO: 9374867 - DNA, 22 bp, Homo sapiens
tccagcccgggggcaggtgacc

SEQ ID NO: 9374868 - DNA, 22 bp, Homo sapiens
tccagcccgagggcgctgatga

SEQ ID NO: 9374869 - DNA, 22 bp, Homo sapiens
tccagcccgactgggcctgccg

SEQ ID NO: 9374870 - DNA, 22 bp, Homo sapiens
tccagccctcagccaagtggaa

SEQ ID NO: 9374871 - DNA, 22 bp, Homo sapiens
tccagccctcagccaagtggaa

SEQ ID NO: 9374872 - DNA, 20 bp, Homo sapiens
tccagccctcatgtcgctca

SEQ ID NO: 9374873 - DNA, 22 bp, Homo sapiens
tccagccctcagccaagtggaa

SEQ ID NO: 9374874 - DNA, 20 bp, Homo sapiens
tccaggagaactgggagccg

SEQ ID NO: 9374875 - DNA, 20 bp, Homo sapiens
tccaggagaactgggagccg

SEQ ID NO: 9374876 - DNA, 22 bp, Homo sapiens
tccaggagcatccaggtgaagc

SEQ ID NO: 9374877 - DNA, 23 bp, Homo sapiens
tccaggagcatgctggctggcga

SEQ ID NO: 9374878 - DNA, 23 bp, Homo sapiens
tccaggagcatgctggctggcga

SEQ ID NO: 9374879 - DNA, 22 bp, Homo sapiens
tccaggaggaggaaggctgcca

SEQ ID NO: 9374880 - DNA, 22 bp, Homo sapiens
tccaggaggactgagggggctg

SEQ ID NO: 9374881 - DNA, 22 bp, Homo sapiens
tccaggaggactgagggggctg

SEQ ID NO: 9374882 - DNA, 22 bp, Homo sapiens
tccaggacctcccaggctagag

SEQ ID NO: 9374883 - DNA, 22 bp, Homo sapiens
tccaggaccaaagacacatgta

SEQ ID NO: 9374884 - DNA, 22 bp, Homo sapiens
tccaggacagagtagaagcagc

SEQ ID NO: 9374885 - DNA, 22 bp, Homo sapiens
tccaggaatgtgtgtgggctag

SEQ ID NO: 9374886 - DNA, 22 bp, Homo sapiens
tccagccttctcaaggctggct

SEQ ID NO: 9374887 - DNA, 22 bp, Homo sapiens
tccagccttctcaaggctggct

SEQ ID NO: 9374888 - DNA, 22 bp, Homo sapiens
tccagccttctcaaggctggct

SEQ ID NO: 9374889 - DNA, 22 bp, Homo sapiens
tccagccttgccacttttctgt

SEQ ID NO: 9374890 - DNA, 22 bp, Homo sapiens
tccaggaacgagaggctgggca

SEQ ID NO: 9374891 - DNA, 22 bp, Homo sapiens
tccaggaatctgtgcctagccc

SEQ ID NO: 9374892 - DNA, 22 bp, Homo sapiens
tccaggaagccacactgggcct

SEQ ID NO: 9374893 - DNA, 22 bp, Homo sapiens
tccaggaatagatcagagattt

SEQ ID NO: 9374894 - DNA, 22 bp, Homo sapiens
tccaggaactgaagccaggtgt

SEQ ID NO: 9374895 - DNA, 22 bp, Homo sapiens
tccaggaactcttgatggtgat

SEQ ID NO: 9374896 - DNA, 20 bp, Homo sapiens
tccagccctgcttctctctt

SEQ ID NO: 9374897 - DNA, 22 bp, Homo sapiens
tccagccctgtggcttccaccc

SEQ ID NO: 9374898 - DNA, 20 bp, Homo sapiens
tccagccctgcttctctctt

SEQ ID NO: 9374899 - DNA, 22 bp, Homo sapiens
tccagcctgaactttgtccaga

SEQ ID NO: 9374900 - DNA, 22 bp, Homo sapiens
tccagcctgaactttgtccaga

SEQ ID NO: 9374901 - DNA, 19 bp, Homo sapiens
tccagcctgctgtttctct

SEQ ID NO: 9374902 - DNA, 22 bp, Homo sapiens
tccagcctggttgcgggcatcc

SEQ ID NO: 9374903 - DNA, 22 bp, Homo sapiens
tccagccttctcaaggctggct

SEQ ID NO: 9374904 - DNA, 22 bp, Homo sapiens
tccagccttccttttcactctc

SEQ ID NO: 9374905 - DNA, 22 bp, Homo sapiens
tccagccttctcaaggctggct

SEQ ID NO: 9374906 - DNA, 22 bp, Homo sapiens
tccagccttctcaaggctggct

SEQ ID NO: 9374907 - DNA, 22 bp, Homo sapiens
tccaggaggaggaaggctgcca

SEQ ID NO: 9374908 - DNA, 22 bp, Homo sapiens
tccaggaggcagggctgtgccc

SEQ ID NO: 9374909 - DNA, 22 bp, Homo sapiens
tccaggaggcagggctgtgccc

SEQ ID NO: 9374910 - DNA, 22 bp, Homo sapiens
tccaggccactgcagaggctct

SEQ ID NO: 9374911 - DNA, 22 bp, Homo sapiens
tccaggccagggtaagaggaga

SEQ ID NO: 9374912 - DNA, 21 bp, Homo sapiens
tccaggccatggtggggaggc

SEQ ID NO: 9374913 - DNA, 19 bp, Homo sapiens
tccaggccattcccagagc

SEQ ID NO: 9374914 - DNA, 19 bp, Homo sapiens
tccaggccattcccagagc

SEQ ID NO: 9374915 - DNA, 22 bp, Homo sapiens
tccaggccagggtaagaggaga

SEQ ID NO: 9374916 - DNA, 22 bp, Homo sapiens
tccaggccagggtaagaggaga

SEQ ID NO: 9374917 - DNA, 21 bp, Homo sapiens
tccaggccatggtggggaggc

SEQ ID NO: 9374918 - DNA, 21 bp, Homo sapiens
tccaggccatggtggggaggc

SEQ ID NO: 9374919 - DNA, 22 bp, Homo sapiens
tccaggcccactcagctgaaat

SEQ ID NO: 9374920 - DNA, 22 bp, Homo sapiens
tccaggcccactcagctgaaat

SEQ ID NO: 9374921 - DNA, 22 bp, Homo sapiens
tccaggcccactcggtggggct

SEQ ID NO: 9374922 - DNA, 22 bp, Homo sapiens
tccaggcccactcggtggggct

SEQ ID NO: 9374923 - DNA, 22 bp, Homo sapiens
tccaggcccagacggggtgagg

SEQ ID NO: 9374924 - DNA, 22 bp, Homo sapiens
tccaggcccagacggggtgagg

SEQ ID NO: 9374925 - DNA, 22 bp, Homo sapiens
tccaggcccagacggggtgagg

SEQ ID NO: 9374926 - DNA, 20 bp, Homo sapiens
tccaggcccactcagctgaa

SEQ ID NO: 9374927 - DNA, 20 bp, Homo sapiens
tccaggcccactcagctgaa

SEQ ID NO: 9374928 - DNA, 22 bp, Homo sapiens
tccaggcccactcagctgaaat

SEQ ID NO: 9374929 - DNA, 22 bp, Homo sapiens
tccaggccattgactgcatcct

SEQ ID NO: 9374930 - DNA, 22 bp, Homo sapiens
tccaggccattgactgcatcct

SEQ ID NO: 9374931 - DNA, 21 bp, Homo sapiens
tccaggcctcaggaagggatg

SEQ ID NO: 9374932 - DNA, 21 bp, Homo sapiens
tccaggcctcaggaagggatg

SEQ ID NO: 9374933 - DNA, 22 bp, Homo sapiens
tccaggcctaggccaagtgatt

SEQ ID NO: 9374934 - DNA, 22 bp, Homo sapiens
tccaggcctaggccaagtgatt

SEQ ID NO: 9374935 - DNA, 22 bp, Homo sapiens
tccaggccgcatagttactctg

SEQ ID NO: 9374936 - DNA, 22 bp, Homo sapiens
tccaggcctaggccaagtgatt

SEQ ID NO: 9374937 - DNA, 22 bp, Homo sapiens
tccaggccgcatagttactctg

SEQ ID NO: 9374938 - DNA, 22 bp, Homo sapiens
tccaggccgcaggggcagcccc

SEQ ID NO: 9374939 - DNA, 22 bp, Homo sapiens
tccaggccgcaggggcagcccc

SEQ ID NO: 9374940 - DNA, 22 bp, Homo sapiens
tccaggccctgggatgggagca

SEQ ID NO: 9374941 - DNA, 22 bp, Homo sapiens
tccaggccgcaggggcagcccc

SEQ ID NO: 9374942 - DNA, 22 bp, Homo sapiens
tccaggccctgggatgggagca

SEQ ID NO: 9374943 - DNA, 22 bp, Homo sapiens
tccaggccctgggatgggagca

SEQ ID NO: 9374944 - DNA, 22 bp, Homo sapiens
tccaggcccgagatgggctgga

SEQ ID NO: 9374945 - DNA, 22 bp, Homo sapiens
tccaggcccatagacacttctc

SEQ ID NO: 9374946 - DNA, 22 bp, Homo sapiens
tccaggcccatagacacttctc

SEQ ID NO: 9374947 - DNA, 21 bp, Homo sapiens
tccaggcctcaggaagggatg

SEQ ID NO: 9374948 - DNA, 22 bp, Homo sapiens
tccagggacagcgctggagcta

SEQ ID NO: 9374949 - DNA, 22 bp, Homo sapiens
tccagggacctccctgagagct

SEQ ID NO: 9374950 - DNA, 22 bp, Homo sapiens
tccagggagagccgctgctcca

SEQ ID NO: 9374951 - DNA, 22 bp, Homo sapiens
tccagggagatactggctgcca

SEQ ID NO: 9374952 - DNA, 22 bp, Homo sapiens
tccagggagatggcagaggctg

SEQ ID NO: 9374953 - DNA, 22 bp, Homo sapiens
tccagggagcaagtcaggccgg

SEQ ID NO: 9374954 - DNA, 22 bp, Homo sapiens
tccagggagatggcagaggctg

SEQ ID NO: 9374955 - DNA, 20 bp, Homo sapiens
tccagggcaaactcatcacc

SEQ ID NO: 9374956 - DNA, 20 bp, Homo sapiens
tccagggcaaactcatcacc

SEQ ID NO: 9374957 - DNA, 20 bp, Homo sapiens
tccagggcaactagagtgtg

SEQ ID NO: 9374958 - DNA, 22 bp, Homo sapiens
tccagggcagccgcgggtgcgc

SEQ ID NO: 9374959 - DNA, 20 bp, Homo sapiens
tccagggcaaactcatcacc

SEQ ID NO: 9374960 - DNA, 22 bp, Homo sapiens
tccagggatggtaatgagcagt

SEQ ID NO: 9374961 - DNA, 22 bp, Homo sapiens
tccagggatgccagccatgttg

SEQ ID NO: 9374962 - DNA, 22 bp, Homo sapiens
tccagggatctttagagtcttt

SEQ ID NO: 9374963 - DNA, 22 bp, Homo sapiens
tccagggagttggctggatagt

SEQ ID NO: 9374964 - DNA, 22 bp, Homo sapiens
tccagtctaatgagtcagagtg

SEQ ID NO: 9374965 - DNA, 22 bp, Homo sapiens
tccagtcctagaaactggagag

SEQ ID NO: 9374966 - DNA, 22 bp, Homo sapiens
tccagtctgtagtgcacagtga

SEQ ID NO: 9374967 - DNA, 22 bp, Homo sapiens
tccagtctctggctgtttgtga

SEQ ID NO: 9374968 - DNA, 22 bp, Homo sapiens
tccagtctctactctgagataa

SEQ ID NO: 9374969 - DNA, 22 bp, Homo sapiens
tccagtcttcttgcagctacat

SEQ ID NO: 9374970 - DNA, 22 bp, Homo sapiens
tccagtgcattcagacacttgg

SEQ ID NO: 9374971 - DNA, 21 bp, Homo sapiens
tccagtggggatctctgatat

SEQ ID NO: 9374972 - DNA, 21 bp, Homo sapiens
tccagtggggatctctgatat

SEQ ID NO: 9374973 - DNA, 22 bp, Homo sapiens
tccagtgggtctggcaagacca

SEQ ID NO: 9374974 - DNA, 21 bp, Homo sapiens
tccagtggggatctctgatat

SEQ ID NO: 9374975 - DNA, 22 bp, Homo sapiens
tccagtgggttgctgagggagg

SEQ ID NO: 9374976 - DNA, 22 bp, Homo sapiens
tccagtgggttgctgagggagg

SEQ ID NO: 9374977 - DNA, 22 bp, Homo sapiens
tccagtggcaggcggtgaggtc

SEQ ID NO: 9374978 - DNA, 20 bp, Homo sapiens
tccagtggcctgaatctgga

SEQ ID NO: 9374979 - DNA, 20 bp, Homo sapiens
tccagtggcctgaatctgga

SEQ ID NO: 9374980 - DNA, 22 bp, Homo sapiens
tccagtggcttcctggaaaaaa

SEQ ID NO: 9374981 - DNA, 22 bp, Homo sapiens
tccagtggctttgctgctttaa

SEQ ID NO: 9374982 - DNA, 22 bp, Homo sapiens
tccagtggtacatggagacact

SEQ ID NO: 9374983 - DNA, 22 bp, Homo sapiens
tccagtggtagtaaagaggtct

SEQ ID NO: 9374984 - DNA, 22 bp, Homo sapiens
tccagtggtggctcccggacct

SEQ ID NO: 9374985 - DNA, 21 bp, Homo sapiens
tccagtggtgtctagaatgtg

SEQ ID NO: 9374986 - DNA, 21 bp, Homo sapiens
tccagtggtgtctagaatgtg

SEQ ID NO: 9374987 - DNA, 22 bp, Homo sapiens
tccagtggtggtttgaagggca

SEQ ID NO: 9374988 - DNA, 22 bp, Homo sapiens
tccagtggtggtttgaagggca

SEQ ID NO: 9374989 - DNA, 22 bp, Homo sapiens
tccagtggaaattgtgttcatt

SEQ ID NO: 9374990 - DNA, 22 bp, Homo sapiens
tccagtgctggaccagagcacc

SEQ ID NO: 9374991 - DNA, 22 bp, Homo sapiens
tccagtggaacagatgttgcct

SEQ ID NO: 9374992 - DNA, 22 bp, Homo sapiens
tccagtgcctcactgaggattc

SEQ ID NO: 9374993 - DNA, 22 bp, Homo sapiens
tccagtgctggaccagagcacc

SEQ ID NO: 9374994 - DNA, 22 bp, Homo sapiens
tccagtggcaccttggccctca

SEQ ID NO: 9374995 - DNA, 22 bp, Homo sapiens
tccagtggcactggagactaga

SEQ ID NO: 9374996 - DNA, 15 bp, Homo sapiens
tccagtggaggcact

SEQ ID NO: 9374997 - DNA, 22 bp, Homo sapiens
tccagtggagtgtgggggtgaa

SEQ ID NO: 9374998 - DNA, 22 bp, Homo sapiens
tccagtggcactggagactaga

SEQ ID NO: 9374999 - DNA, 22 bp, Homo sapiens
tccagtggcaggcggtgaggtc

SEQ ID NO: 9375000 - DNA, 20 bp, Homo sapiens
tccagtggcctgaatctgga

SEQ ID NO: 9375001 - DNA, 22 bp, Homo sapiens
tcccacagtgaagttcatgata

SEQ ID NO: 9375002 - DNA, 22 bp, Homo sapiens
tcccacagtggtacagccctga

SEQ ID NO: 9375003 - DNA, 22 bp, Homo sapiens
tcccacagtggtacagccctga

SEQ ID NO: 9375004 - DNA, 22 bp, Homo sapiens
tcccactgagcccctgctggtg

SEQ ID NO: 9375005 - DNA, 22 bp, Homo sapiens
tcccactgagcccctgctggtg

SEQ ID NO: 9375006 - DNA, 22 bp, Homo sapiens
tccagtggtttgaaaggggtgt

SEQ ID NO: 9375007 - DNA, 22 bp, Homo sapiens
tcccactggacgtctgtgctgg

SEQ ID NO: 9375008 - DNA, 22 bp, Homo sapiens
tcccacttccggaggcctttgg

SEQ ID NO: 9375009 - DNA, 22 bp, Homo sapiens
tcccactgtgcctgttgtaatc

SEQ ID NO: 9375010 - DNA, 22 bp, Homo sapiens
tcccagagtcttctcctgtaat

SEQ ID NO: 9375011 - DNA, 22 bp, Homo sapiens
tcccagagtgtgggcatcaagg

SEQ ID NO: 9375012 - DNA, 22 bp, Homo sapiens
tcccagaagagatgccacttga

SEQ ID NO: 9375013 - DNA, 22 bp, Homo sapiens
tcccagaatggcccagctgccc

SEQ ID NO: 9375014 - DNA, 22 bp, Homo sapiens
tcccagaatctccagtgctaca

SEQ ID NO: 9375015 - DNA, 21 bp, Homo sapiens
tcccagctgggtcagtgctgc

SEQ ID NO: 9375016 - DNA, 22 bp, Homo sapiens
tcccaggaaaacactcgaggac

SEQ ID NO: 9375017 - DNA, 21 bp, Homo sapiens
tcccagctgggtcagtgctgc

SEQ ID NO: 9375018 - DNA, 17 bp, Homo sapiens
tcccaggaacagggaat

SEQ ID NO: 9375019 - DNA, 22 bp, Homo sapiens
tcccaggaagatcccagggacc

SEQ ID NO: 9375020 - DNA, 22 bp, Homo sapiens
tcccagcagagccagcaagccg

SEQ ID NO: 9375021 - DNA, 22 bp, Homo sapiens
tcccagcactgtaattctttgg

SEQ ID NO: 9375022 - DNA, 22 bp, Homo sapiens
tcccagcaagaaagggggtggc

SEQ ID NO: 9375023 - DNA, 22 bp, Homo sapiens
tcccagcacagggcagatgtga

SEQ ID NO: 9375024 - DNA, 22 bp, Homo sapiens
tcccagcacgtctgctgtttct

SEQ ID NO: 9375025 - DNA, 22 bp, Homo sapiens
tcccagattcctgctcttatat

SEQ ID NO: 9375026 - DNA, 22 bp, Homo sapiens
tcccagattcctgctcttatat

SEQ ID NO: 9375027 - DNA, 22 bp, Homo sapiens
tcccagagttcaatgggaaggt

SEQ ID NO: 9375028 - DNA, 22 bp, Homo sapiens
tcccagattcctgctcttatat

SEQ ID NO: 9375029 - DNA, 22 bp, Homo sapiens
tcccagcagcatagctcagaat

SEQ ID NO: 9375030 - DNA, 22 bp, Homo sapiens
tcccagcaggagtccagttccc

SEQ ID NO: 9375031 - DNA, 22 bp, Homo sapiens
tcccagcaggagtccagttccc

SEQ ID NO: 9375032 - DNA, 22 bp, Homo sapiens
tcccagcagatgagctgaccta

SEQ ID NO: 9375033 - DNA, 22 bp, Homo sapiens
tcccagcagatgagctgaccta

SEQ ID NO: 9375034 - DNA, 22 bp, Homo sapiens
tcccagcagtcagagctatgtg

SEQ ID NO: 9375035 - DNA, 23 bp, Homo sapiens
tcctcctgagtgagagtgccagc

SEQ ID NO: 9375036 - DNA, 23 bp, Homo sapiens
tcctcctgagtgagagtgccagc

SEQ ID NO: 9375037 - DNA, 23 bp, Homo sapiens
tcctcctgagtgagagtgccagc

SEQ ID NO: 9375038 - DNA, 23 bp, Homo sapiens
tcctcctgagtgagagtgccagc

SEQ ID NO: 9375039 - DNA, 22 bp, Homo sapiens
tcctcctgcctttgcttcttgt

SEQ ID NO: 9375040 - DNA, 22 bp, Homo sapiens
tcctcctgcctttgcttcttgt

SEQ ID NO: 9375041 - DNA, 23 bp, Homo sapiens
tcctcctggatacaaagggaaca

SEQ ID NO: 9375042 - DNA, 21 bp, Homo sapiens
tcctcctggccaggcggcccc

SEQ ID NO: 9375043 - DNA, 22 bp, Homo sapiens
tcctcctgcctttgcttcttgt

SEQ ID NO: 9375044 - DNA, 22 bp, Homo sapiens
tcctcctgctgttagtcttgaa

SEQ ID NO: 9375045 - DNA, 22 bp, Homo sapiens
tcctcctgctgttagtcttgaa

SEQ ID NO: 9375046 - DNA, 21 bp, Homo sapiens
tcctcctggccaggcggcccc

SEQ ID NO: 9375047 - DNA, 22 bp, Homo sapiens
tcctcctcctcacagtcacctg

SEQ ID NO: 9375048 - DNA, 22 bp, Homo sapiens
tcctcctcacgctgttgcttgt

SEQ ID NO: 9375049 - DNA, 22 bp, Homo sapiens
tcctcctcctcacagtcacctg

SEQ ID NO: 9375050 - DNA, 22 bp, Homo sapiens
tcctcctctatcagacagtgcc

SEQ ID NO: 9375051 - DNA, 23 bp, Homo sapiens
tcctcctgacacagcctgagtga

SEQ ID NO: 9375052 - DNA, 23 bp, Homo sapiens
tcctcctgacacagcctgagtga

SEQ ID NO: 9375053 - DNA, 23 bp, Homo sapiens
tcctcctgacacagcctgagtga

SEQ ID NO: 9375054 - DNA, 23 bp, Homo sapiens
tcctcctgacacagcctgagtga

SEQ ID NO: 9375055 - DNA, 22 bp, Homo sapiens
tcctccagtggcccagtccttc

SEQ ID NO: 9375056 - DNA, 22 bp, Homo sapiens
tcctccagtggtactggccaat

SEQ ID NO: 9375057 - DNA, 22 bp, Homo sapiens
tcctccagtggcccagtccttc

SEQ ID NO: 9375058 - DNA, 22 bp, Homo sapiens
tcctccaggtctagggtggctt

SEQ ID NO: 9375059 - DNA, 22 bp, Homo sapiens
tcctccaggtctagggtggctt

SEQ ID NO: 9375060 - DNA, 22 bp, Homo sapiens
tcctccagtggtactggccaat

SEQ ID NO: 9375061 - DNA, 22 bp, Homo sapiens
tcctcccctgcccatgaggagg

SEQ ID NO: 9375062 - DNA, 22 bp, Homo sapiens
tcctcccctgcccatgaggagg

SEQ ID NO: 9375063 - DNA, 22 bp, Homo sapiens
tcctccctgtaccattcctctg

SEQ ID NO: 9375064 - DNA, 22 bp, Homo sapiens
tcctccctgggagcttctgagt

SEQ ID NO: 9375065 - DNA, 22 bp, Homo sapiens
tcctccctgggagcttctgagt

SEQ ID NO: 9375066 - DNA, 22 bp, Homo sapiens
tcctcatctttcaggatttagc

SEQ ID NO: 9375067 - DNA, 22 bp, Homo sapiens
tcctccacactctggactgttg

SEQ ID NO: 9375068 - DNA, 22 bp, Homo sapiens
tcctccacgatggcacacctgg

SEQ ID NO: 9375069 - DNA, 20 bp, Homo sapiens
tcctccagaagggcagggtg

SEQ ID NO: 9375070 - DNA, 22 bp, Homo sapiens
tcctccacgtgagggcatacag

SEQ ID NO: 9375071 - DNA, 22 bp, Homo sapiens
tcctccactttgtctagcaaca

SEQ ID NO: 9375072 - DNA, 22 bp, Homo sapiens
tcctccacgatggcacacctgg

SEQ ID NO: 9375073 - DNA, 22 bp, Homo sapiens
tcctccacgatggcacacctgg

SEQ ID NO: 9375074 - DNA, 22 bp, Homo sapiens
tcctccagctgtatcctgcctg

SEQ ID NO: 9375075 - DNA, 22 bp, Homo sapiens
tcctccaggcacctcactggct

SEQ ID NO: 9375076 - DNA, 22 bp, Homo sapiens
tcctccaggcacctcactggct

SEQ ID NO: 9375077 - DNA, 23 bp, Homo sapiens
tcctccagaggccctccttggcc

SEQ ID NO: 9375078 - DNA, 23 bp, Homo sapiens
tcctccagaggccctccttggcc

SEQ ID NO: 9375079 - DNA, 22 bp, Homo sapiens
tccgggcaactgaagggaggtt

SEQ ID NO: 9375080 - DNA, 22 bp, Homo sapiens
tccgggcaactgaagggaggtt

SEQ ID NO: 9375081 - DNA, 22 bp, Homo sapiens
tccgctggagagggggctgcca

SEQ ID NO: 9375082 - DNA, 22 bp, Homo sapiens
tccgcccgcacgtatggagtgg

SEQ ID NO: 9375083 - DNA, 22 bp, Homo sapiens
tccgcgctctcacccgctcccg

SEQ ID NO: 9375084 - DNA, 22 bp, Homo sapiens
tccgcccgcacgtatggagtgg

SEQ ID NO: 9375085 - DNA, 22 bp, Homo sapiens
tccgaggcgcaccggcgctcct

SEQ ID NO: 9375086 - DNA, 22 bp, Homo sapiens
tccgaggccaaagctgtgaata

SEQ ID NO: 9375087 - DNA, 22 bp, Homo sapiens
tccgagaagcataaagcaggaa

SEQ ID NO: 9375088 - DNA, 22 bp, Homo sapiens
tccgggttttacactcacatca

SEQ ID NO: 9375089 - DNA, 22 bp, Homo sapiens
tccggtccgggtactcctctct

SEQ ID NO: 9375090 - DNA, 22 bp, Homo sapiens
tccggtccgggtactcctctct

SEQ ID NO: 9375091 - DNA, 23 bp, Homo sapiens
tcctcagtatataaaggcagatg

SEQ ID NO: 9375092 - DNA, 22 bp, Homo sapiens
tcctcatctcggaacctgccac

SEQ ID NO: 9375093 - DNA, 22 bp, Homo sapiens
tccctgggcatcacgttgcttc

SEQ ID NO: 9375094 - DNA, 22 bp, Homo sapiens
tccctgggcatcacgttgcttc

SEQ ID NO: 9375095 - DNA, 22 bp, Homo sapiens
tccctgggcacaatctgctggc

SEQ ID NO: 9375096 - DNA, 22 bp, Homo sapiens
tccctgggcacaatctgctggc

SEQ ID NO: 9375097 - DNA, 22 bp, Homo sapiens
tccctgggccacagctgtgagc

SEQ ID NO: 9375098 - DNA, 23 bp, Homo sapiens
tccctgggcccgtgccagcggtg

SEQ ID NO: 9375099 - DNA, 23 bp, Homo sapiens
tccctgggcccgtgccagcggtg

SEQ ID NO: 9375100 - DNA, 23 bp, Homo sapiens
tccctgggcccgtgccagcggtg

SEQ ID NO: 9375101 - DNA, 22 bp, Homo sapiens
tccctgccctcagtgcacccgg

SEQ ID NO: 9375102 - DNA, 22 bp, Homo sapiens
tccctgggcaagtttactcttc

SEQ ID NO: 9375103 - DNA, 22 bp, Homo sapiens
tccctgggcaagtttactcttc

SEQ ID NO: 9375104 - DNA, 22 bp, Homo sapiens
tccctgccaatgattggagcaa

SEQ ID NO: 9375105 - DNA, 22 bp, Homo sapiens
tccctgccagtcctggtctgaa

SEQ ID NO: 9375106 - DNA, 22 bp, Homo sapiens
tccctgcagtaggcagccctcc

SEQ ID NO: 9375107 - DNA, 22 bp, Homo sapiens
tccctgcagcccctgagccttc

SEQ ID NO: 9375108 - DNA, 22 bp, Homo sapiens
tccctgcagcccctgagccttc

SEQ ID NO: 9375109 - DNA, 22 bp, Homo sapiens
tccctgcagctgtaggccggcg

SEQ ID NO: 9375110 - DNA, 22 bp, Homo sapiens
tccctgcaggtggggtggccag

SEQ ID NO: 9375111 - DNA, 21 bp, Homo sapiens
tccctgagttctctgagcatc

SEQ ID NO: 9375112 - DNA, 22 bp, Homo sapiens
tccctgcacagccgagccatgc

SEQ ID NO: 9375113 - DNA, 22 bp, Homo sapiens
tccctgcacagccgagccatgc

SEQ ID NO: 9375114 - DNA, 22 bp, Homo sapiens
tccctgcacagccgagccatgc

SEQ ID NO: 9375115 - DNA, 22 bp, Homo sapiens
tccctgcagacgtcctgcgggt

SEQ ID NO: 9375116 - DNA, 22 bp, Homo sapiens
tccctgcagacgtcctgcgggt

SEQ ID NO: 9375117 - DNA, 22 bp, Homo sapiens
tccctgcacccttgctgggccc

SEQ ID NO: 9375118 - DNA, 22 bp, Homo sapiens
tccctgagcttcatcaggcttt

SEQ ID NO: 9375119 - DNA, 22 bp, Homo sapiens
tcccaggcagcttctttcatca

SEQ ID NO: 9375120 - DNA, 19 bp, Homo sapiens
tcccaggcaaaggcttctc

SEQ ID NO: 9375121 - DNA, 19 bp, Homo sapiens
tcccaggcaaaggcttctc

SEQ ID NO: 9375122 - DNA, 19 bp, Homo sapiens
tcccaggcaaaggcttctc

SEQ ID NO: 9375123 - DNA, 22 bp, Homo sapiens
tcccaggatgtttatggctggt

SEQ ID NO: 9375124 - DNA, 22 bp, Homo sapiens
tcccaggcaaaggcagctcatt

SEQ ID NO: 9375125 - DNA, 22 bp, Homo sapiens
tcccaggcaaaggcagctcatt

SEQ ID NO: 9375126 - DNA, 22 bp, Homo sapiens
tcccaggcaaaggcagctcatt

SEQ ID NO: 9375127 - DNA, 22 bp, Homo sapiens
tcccaggattttaggctctcag

SEQ ID NO: 9375128 - DNA, 22 bp, Homo sapiens
tccctgggcttctccagacttg

SEQ ID NO: 9375129 - DNA, 22 bp, Homo sapiens
tccctgggcttctccagacttg

SEQ ID NO: 9375130 - DNA, 22 bp, Homo sapiens
tccctgggcttctccagacttg

SEQ ID NO: 9375131 - DNA, 22 bp, Homo sapiens
tccctgggcggacattctccca

SEQ ID NO: 9375132 - DNA, 22 bp, Homo sapiens
tccctgggcggacattctccca

SEQ ID NO: 9375133 - DNA, 22 bp, Homo sapiens
tccctgggcctcctgctatgca

SEQ ID NO: 9375134 - DNA, 22 bp, Homo sapiens
tccctgggcctatcttagctcc

SEQ ID NO: 9375135 - DNA, 22 bp, Homo sapiens
tccctgggcctatcttagctcc

SEQ ID NO: 9375136 - DNA, 22 bp, Homo sapiens
tccctgggcctatcttagctcc

SEQ ID NO: 9375137 - DNA, 22 bp, Homo sapiens
tccctgggcctatcttagctcc

SEQ ID NO: 9375138 - DNA, 22 bp, Homo sapiens
tccctggggcagtggctcggag

SEQ ID NO: 9375139 - DNA, 22 bp, Homo sapiens
tccctggggcagtggctcggag

SEQ ID NO: 9375140 - DNA, 22 bp, Homo sapiens
tccctggggatgttggcctgcc

SEQ ID NO: 9375141 - DNA, 22 bp, Homo sapiens
tccctggggatgttggcctgcc

SEQ ID NO: 9375142 - DNA, 22 bp, Homo sapiens
tccctggggaagggcaagcaag

SEQ ID NO: 9375143 - DNA, 22 bp, Homo sapiens
tccctggggaagggcaagcaag

SEQ ID NO: 9375144 - DNA, 22 bp, Homo sapiens
tccctggggatgttggcctgcc

SEQ ID NO: 9375145 - DNA, 22 bp, Homo sapiens
tccctggggaagggcaagcaag

SEQ ID NO: 9375146 - DNA, 22 bp, Homo sapiens
tccctgtggatatctgcagctg

SEQ ID NO: 9375147 - DNA, 22 bp, Homo sapiens
tccctgtggaagactgccagag

SEQ ID NO: 9375148 - DNA, 21 bp, Homo sapiens
tccctgtgagcagctcttcct

SEQ ID NO: 9375149 - DNA, 20 bp, Homo sapiens
tccctggggccctacttcct

SEQ ID NO: 9375150 - DNA, 20 bp, Homo sapiens
tccctggggccctacttcct

SEQ ID NO: 9375151 - DNA, 20 bp, Homo sapiens
tccctggggccctacttcct

SEQ ID NO: 9375152 - DNA, 22 bp, Homo sapiens
tcccttatctggtattttttag

SEQ ID NO: 9375153 - DNA, 22 bp, Homo sapiens
tcccttcaataattcaacatta

SEQ ID NO: 9375154 - DNA, 22 bp, Homo sapiens
tcccttcacagatgcgatgttt

SEQ ID NO: 9375155 - DNA, 22 bp, Homo sapiens
tcccttcatcagtgagcaagcc

SEQ ID NO: 9375156 - DNA, 23 bp, Homo sapiens
tccctgtgtacagcctgcatgag

SEQ ID NO: 9375157 - DNA, 23 bp, Homo sapiens
tccctgtgtacagcctgcatgag

SEQ ID NO: 9375158 - DNA, 22 bp, Homo sapiens
tccctgtgggcagaggctgcct

SEQ ID NO: 9375159 - DNA, 22 bp, Homo sapiens
tccctgtgggcagaggctgcct

SEQ ID NO: 9375160 - DNA, 22 bp, Homo sapiens
tccctgtgggatgaggactctg

SEQ ID NO: 9375161 - DNA, 22 bp, Homo sapiens
tccctgtggctaagacatgaca

SEQ ID NO: 9375162 - DNA, 22 bp, Homo sapiens
tcccttcctcataggcagaagg

SEQ ID NO: 9375163 - DNA, 22 bp, Homo sapiens
tcccttcctcataggcagaagg

SEQ ID NO: 9375164 - DNA, 18 bp, Homo sapiens
tcccttctcccttgcctc

SEQ ID NO: 9375165 - DNA, 22 bp, Homo sapiens
tcccttctggcagcagtgtgag

SEQ ID NO: 9375166 - DNA, 22 bp, Homo sapiens
tcccttctggcagcagtgtgag

SEQ ID NO: 9375167 - DNA, 22 bp, Homo sapiens
tcccttctggcagcagtgtgag

SEQ ID NO: 9375168 - DNA, 22 bp, Homo sapiens
tcccttgtcctgtgggaagagc

SEQ ID NO: 9375169 - DNA, 22 bp, Homo sapiens
tcccttgtcctcttcgtcactg

SEQ ID NO: 9375170 - DNA, 22 bp, Homo sapiens
tcccttgtgagaacatgtgttg

SEQ ID NO: 9375171 - DNA, 22 bp, Homo sapiens
tcccttggttaaatatgtagga

SEQ ID NO: 9375172 - DNA, 22 bp, Homo sapiens
tcccttggtaattctgttcctt

SEQ ID NO: 9375173 - DNA, 22 bp, Homo sapiens
tcccttggttaaatatgtagga

SEQ ID NO: 9375174 - DNA, 22 bp, Homo sapiens
tcccttgtcacctcacactatg

SEQ ID NO: 9375175 - DNA, 22 bp, Homo sapiens
tcccttggaaagtagcctcaca

SEQ ID NO: 9375176 - DNA, 22 bp, Homo sapiens
tcccttggaaagtagcctcaca

SEQ ID NO: 9375177 - DNA, 21 bp, Homo sapiens
tcccttgggaaactttcttga

SEQ ID NO: 9375178 - DNA, 22 bp, Homo sapiens
tcccttgggagtggtgaccaca

SEQ ID NO: 9375179 - DNA, 22 bp, Homo sapiens
tcccttctggcagcagtgtgag

SEQ ID NO: 9375180 - DNA, 22 bp, Homo sapiens
taacacattttcctcatacgga

SEQ ID NO: 9375181 - DNA, 22 bp, Homo sapiens
taacacagtgtcctcagaaaca

SEQ ID NO: 9375182 - DNA, 17 bp, Homo sapiens
taacacaggctcagaga

SEQ ID NO: 9375183 - DNA, 22 bp, Homo sapiens
taacacagttctctgttgcaca

SEQ ID NO: 9375184 - DNA, 22 bp, Homo sapiens
taacacagttctctgttgcaca

SEQ ID NO: 9375185 - DNA, 22 bp, Homo sapiens
taaatacagtcatttgagccat

SEQ ID NO: 9375186 - DNA, 22 bp, Homo sapiens
taaatactgagttggagttggc

SEQ ID NO: 9375187 - DNA, 22 bp, Homo sapiens
taacaatagtgtttgctagtca

SEQ ID NO: 9375188 - DNA, 22 bp, Homo sapiens
taacacagagtaagtggtcaat

SEQ ID NO: 9375189 - DNA, 22 bp, Homo sapiens
taacacagagttttaaatgtgg

SEQ ID NO: 9375190 - DNA, 17 bp, Homo sapiens
taacacaggctcagaga

SEQ ID NO: 9375191 - DNA, 22 bp, Homo sapiens
taacaatggagttttgagaaag

SEQ ID NO: 9375192 - DNA, 22 bp, Homo sapiens
taactgtcacttctgcacatct

SEQ ID NO: 9375193 - DNA, 22 bp, Homo sapiens
taacttagaagtttaattgtat

SEQ ID NO: 9375194 - DNA, 22 bp, Homo sapiens
taacttctctgctatcatagga

SEQ ID NO: 9375195 - DNA, 22 bp, Homo sapiens
taactgtatagcttggactaaa

SEQ ID NO: 9375196 - DNA, 22 bp, Homo sapiens
taagaaatttagttatagaatg

SEQ ID NO: 9375197 - DNA, 22 bp, Homo sapiens
taacttctggaaatgcatctgc

SEQ ID NO: 9375198 - DNA, 22 bp, Homo sapiens
taagatcagttcaaacatgtgt

SEQ ID NO: 9375199 - DNA, 22 bp, Homo sapiens
taagatggcagatgagcttgtt

SEQ ID NO: 9375200 - DNA, 22 bp, Homo sapiens
taagcaacaaggtgtttaaatt

SEQ ID NO: 9375201 - DNA, 22 bp, Homo sapiens
taagcaacaagtggctggagga

SEQ ID NO: 9375202 - DNA, 22 bp, Homo sapiens
taagataagtgggttgagatgg

SEQ ID NO: 9375203 - DNA, 22 bp, Homo sapiens
taagataataagtatgtctatg

SEQ ID NO: 9375204 - DNA, 22 bp, Homo sapiens
taagaggcagcattcctcgcct

SEQ ID NO: 9375205 - DNA, 22 bp, Homo sapiens
taagaggcattagagacatagc

SEQ ID NO: 9375206 - DNA, 22 bp, Homo sapiens
taagaggcaaaagatactcaga

SEQ ID NO: 9375207 - DNA, 23 bp, Homo sapiens
taagagtgaggtcataaattttc

SEQ ID NO: 9375208 - DNA, 22 bp, Homo sapiens
taagagttactggtttagaacc

SEQ ID NO: 9375209 - DNA, 22 bp, Homo sapiens
taagagttgaaggagattttca

SEQ ID NO: 9375210 - DNA, 22 bp, Homo sapiens
taaacatgttgacatcttacct

SEQ ID NO: 9375211 - DNA, 21 bp, Homo sapiens
taaataataagttgctgagat

SEQ ID NO: 9375212 - DNA, 17 bp, Homo sapiens
taaatacacaagggtat

SEQ ID NO: 9375213 - DNA, 17 bp, Homo sapiens
taaatacacaagggtat

SEQ ID NO: 9375214 - DNA, 17 bp, Homo sapiens
taaatacacaagggtat

SEQ ID NO: 9375215 - DNA, 17 bp, Homo sapiens
taaatacacaagggtat

SEQ ID NO: 9375216 - DNA, 17 bp, Homo sapiens
taaatacacaagggtat

SEQ ID NO: 9375217 - DNA, 22 bp, Homo sapiens
taaataagttcttcattgtttg

SEQ ID NO: 9375218 - DNA, 22 bp, Homo sapiens
taaataagttcttcattgtttg

SEQ ID NO: 9375219 - DNA, 21 bp, Homo sapiens
taaataataagttgctgagat

SEQ ID NO: 9375220 - DNA, 21 bp, Homo sapiens
taaataataagttgctgagat

SEQ ID NO: 9375221 - DNA, 22 bp, Homo sapiens
taaagtttatttgaacatctct

SEQ ID NO: 9375222 - DNA, 22 bp, Homo sapiens
taaacatcaccttctgcagttg

SEQ ID NO: 9375223 - DNA, 22 bp, Homo sapiens
taaacatcagtacaaagactaa

SEQ ID NO: 9375224 - DNA, 22 bp, Homo sapiens
taaacatctgtcatgtgtttat

SEQ ID NO: 9375225 - DNA, 22 bp, Homo sapiens
gttttcagccaggagcacattt

SEQ ID NO: 9375226 - DNA, 22 bp, Homo sapiens
gttttcagccaggagcacattt

SEQ ID NO: 9375227 - DNA, 21 bp, Homo sapiens
gttttcatgatagagtctgta

SEQ ID NO: 9375228 - DNA, 22 bp, Homo sapiens
gttttcaattataagatggctt

SEQ ID NO: 9375229 - DNA, 22 bp, Homo sapiens
gttttcaaggggatttaactga

SEQ ID NO: 9375230 - DNA, 22 bp, Homo sapiens
taaacagagtgctagttcacgg

SEQ ID NO: 9375231 - DNA, 22 bp, Homo sapiens
gttttataggtgaaatattact

SEQ ID NO: 9375232 - DNA, 22 bp, Homo sapiens
gttttattggaacacagccatg

SEQ ID NO: 9375233 - DNA, 22 bp, Homo sapiens
gttttattggaacacagccatg

SEQ ID NO: 9375234 - DNA, 22 bp, Homo sapiens
gttttataggctgttgctatat

SEQ ID NO: 9375235 - DNA, 22 bp, Homo sapiens
gttttataattgcttcataaga

SEQ ID NO: 9375236 - DNA, 22 bp, Homo sapiens
gttttagtgggtggccactgat

SEQ ID NO: 9375237 - DNA, 22 bp, Homo sapiens
gttttatttccatgagagaccg

SEQ ID NO: 9375238 - DNA, 22 bp, Homo sapiens
gttttatttccatgagagaccg

SEQ ID NO: 9375239 - DNA, 22 bp, Homo sapiens
gttttatttccatgagagaccg

SEQ ID NO: 9375240 - DNA, 22 bp, Homo sapiens
gttttatttccatgagagaccg

SEQ ID NO: 9375241 - DNA, 22 bp, Homo sapiens
gttttattggaacacagccatg

SEQ ID NO: 9375242 - DNA, 22 bp, Homo sapiens
gttttattggaacacagccatg

SEQ ID NO: 9375243 - DNA, 22 bp, Homo sapiens
gtttacaaatattttaaatggt

SEQ ID NO: 9375244 - DNA, 22 bp, Homo sapiens
gtttacaaatattttaaatggt

SEQ ID NO: 9375245 - DNA, 22 bp, Homo sapiens
gtttacaaatattttaaatggt

SEQ ID NO: 9375246 - DNA, 22 bp, Homo sapiens
gtttacttagatgctcatgcag

SEQ ID NO: 9375247 - DNA, 22 bp, Homo sapiens
gtttacttgtgccttggcttaa

SEQ ID NO: 9375248 - DNA, 22 bp, Homo sapiens
gtttagaacacggaaatactga

SEQ ID NO: 9375249 - DNA, 22 bp, Homo sapiens
gtttataaggcccaatatttct

SEQ ID NO: 9375250 - DNA, 22 bp, Homo sapiens
gtttagcaataaaaacacatga

SEQ ID NO: 9375251 - DNA, 22 bp, Homo sapiens
gttccaggaccctggcctctga

SEQ ID NO: 9375252 - DNA, 22 bp, Homo sapiens
gttccagacttgccagtggaag

SEQ ID NO: 9375253 - DNA, 20 bp, Homo sapiens
gttcccaggaattgaagacc

SEQ ID NO: 9375254 - DNA, 20 bp, Homo sapiens
gttcccaggaattgaagacc

SEQ ID NO: 9375255 - DNA, 18 bp, Homo sapiens
gttcccagatggtgctga

SEQ ID NO: 9375256 - DNA, 18 bp, Homo sapiens
gttcccagatggtgctga

SEQ ID NO: 9375257 - DNA, 22 bp, Homo sapiens
gttccaggcagtggcaacagct

SEQ ID NO: 9375258 - DNA, 22 bp, Homo sapiens
gttccaggtggtcacagagctc

SEQ ID NO: 9375259 - DNA, 22 bp, Homo sapiens
gttccaggtggtcacagagctc

SEQ ID NO: 9375260 - DNA, 22 bp, Homo sapiens
gttccaggtggtcacagagctc

SEQ ID NO: 9375261 - DNA, 22 bp, Homo sapiens
gtttaattttaggttgtcaagc

SEQ ID NO: 9375262 - DNA, 22 bp, Homo sapiens
gtttaattttaggttgtcaagc

SEQ ID NO: 9375263 - DNA, 22 bp, Homo sapiens
gttccttcctatcccgagagcc

SEQ ID NO: 9375264 - DNA, 16 bp, Homo sapiens
gttccttcccacacct

SEQ ID NO: 9375265 - DNA, 23 bp, Homo sapiens
gttccttcatgtggtcattggtt

SEQ ID NO: 9375266 - DNA, 22 bp, Homo sapiens
gttcctggtggtcatggcagct

SEQ ID NO: 9375267 - DNA, 22 bp, Homo sapiens
gttcctggtggtcatggcagct

SEQ ID NO: 9375268 - DNA, 22 bp, Homo sapiens
gttcctgggaggcatgggctgg

SEQ ID NO: 9375269 - DNA, 22 bp, Homo sapiens
gttcctggtggtcatggcagct

SEQ ID NO: 9375270 - DNA, 22 bp, Homo sapiens
gtttctgattctagaggcaggc

SEQ ID NO: 9375271 - DNA, 22 bp, Homo sapiens
gtttctgtgttagatgagtctt

SEQ ID NO: 9375272 - DNA, 22 bp, Homo sapiens
gtttctctttgaagcctggctg

SEQ ID NO: 9375273 - DNA, 22 bp, Homo sapiens
gtttctgaagggattacttggt

SEQ ID NO: 9375274 - DNA, 22 bp, Homo sapiens
gtttctcttaacacataaagta

SEQ ID NO: 9375275 - DNA, 22 bp, Homo sapiens
gtttctcttaacacataaagta

SEQ ID NO: 9375276 - DNA, 18 bp, Homo sapiens
gtttctcccaggcggggc

SEQ ID NO: 9375277 - DNA, 22 bp, Homo sapiens
gtttctcctctgtgtcttgttt

SEQ ID NO: 9375278 - DNA, 22 bp, Homo sapiens
gtttctcctctgtgtcttgttt

SEQ ID NO: 9375279 - DNA, 23 bp, Homo sapiens
gttttacaggtgagaaaatggag

SEQ ID NO: 9375280 - DNA, 22 bp, Homo sapiens
gttttacaaggttaatcagcag

SEQ ID NO: 9375281 - DNA, 22 bp, Homo sapiens
gttttacaaggttaatcagcag

SEQ ID NO: 9375282 - DNA, 22 bp, Homo sapiens
gttttacacacctatgaaagac

SEQ ID NO: 9375283 - DNA, 22 bp, Homo sapiens
gttttacacacctatgaaagac

SEQ ID NO: 9375284 - DNA, 22 bp, Homo sapiens
gttttacacacctatgaaagac

SEQ ID NO: 9375285 - DNA, 22 bp, Homo sapiens
gtttatatgaacttcataccca

SEQ ID NO: 9375286 - DNA, 22 bp, Homo sapiens
gtttatatgtgtgccactctta

SEQ ID NO: 9375287 - DNA, 22 bp, Homo sapiens
gtttcctaggcttatacagctg

SEQ ID NO: 9375288 - DNA, 22 bp, Homo sapiens
gtttcctaccagtggttccaga

SEQ ID NO: 9375289 - DNA, 22 bp, Homo sapiens
gtttcctagatcagtgttctta

SEQ ID NO: 9375290 - DNA, 22 bp, Homo sapiens
gtttcctacactgtagtattat

SEQ ID NO: 9375291 - DNA, 22 bp, Homo sapiens
gtttctaaatgttctgagtttt

SEQ ID NO: 9375292 - DNA, 22 bp, Homo sapiens
gtttctaaatgttctgagtttt

SEQ ID NO: 9375293 - DNA, 22 bp, Homo sapiens
gtttctaagcacatgtgagtgt

SEQ ID NO: 9375294 - DNA, 22 bp, Homo sapiens
gtttctacatgcctctttcacc

SEQ ID NO: 9375295 - DNA, 22 bp, Homo sapiens
gtttctcagtttggtctgcaga

SEQ ID NO: 9375296 - DNA, 22 bp, Homo sapiens
gtgtgtcctcataagatggagg

SEQ ID NO: 9375297 - DNA, 22 bp, Homo sapiens
gtgtgtcctcttaactattatg

SEQ ID NO: 9375298 - DNA, 22 bp, Homo sapiens
gtgtgtcctgttttaaaatagt

SEQ ID NO: 9375299 - DNA, 22 bp, Homo sapiens
gtgtgtgtatctgcctatcaca

SEQ ID NO: 9375300 - DNA, 22 bp, Homo sapiens
gtgtgtccttgggcctctgcag

SEQ ID NO: 9375301 - DNA, 22 bp, Homo sapiens
gtgtgtgtgcatataacatata

SEQ ID NO: 9375302 - DNA, 22 bp, Homo sapiens
gtgtgtgtgcatataacatata

SEQ ID NO: 9375303 - DNA, 22 bp, Homo sapiens
gtgtgtgtctccgcggccgtag

SEQ ID NO: 9375304 - DNA, 22 bp, Homo sapiens
gtgtgtgtatctgcctatcaca

SEQ ID NO: 9375305 - DNA, 22 bp, Homo sapiens
gtgtgtgtctccgcggccgtag

SEQ ID NO: 9375306 - DNA, 22 bp, Homo sapiens
gtgctttaaagacagttatgct

SEQ ID NO: 9375307 - DNA, 22 bp, Homo sapiens
gtgctttactggcagtgatgta

SEQ ID NO: 9375308 - DNA, 21 bp, Homo sapiens
gtgcttttccttaatgttctt

SEQ ID NO: 9375309 - DNA, 22 bp, Homo sapiens
gtgcttttaaaggcaattagta

SEQ ID NO: 9375310 - DNA, 22 bp, Homo sapiens
gtgctttccatcctccctgctg

SEQ ID NO: 9375311 - DNA, 22 bp, Homo sapiens
gtgtgtgtgcctgcacacacac

SEQ ID NO: 9375312 - DNA, 22 bp, Homo sapiens
gtgtgtgtgcatctcttttatt

SEQ ID NO: 9375313 - DNA, 22 bp, Homo sapiens
gtgtgtgtgcatctcttttatt

SEQ ID NO: 9375314 - DNA, 22 bp, Homo sapiens
gtgtgtgtgtaaaaatccagag

SEQ ID NO: 9375315 - DNA, 22 bp, Homo sapiens
gtgtgtgtgtaaaaatccagag

SEQ ID NO: 9375316 - DNA, 22 bp, Homo sapiens
gtgtgtgtgcctgcacacacac

SEQ ID NO: 9375317 - DNA, 22 bp, Homo sapiens
gtgtgtgttcaataaatttaag

SEQ ID NO: 9375318 - DNA, 22 bp, Homo sapiens
gtgtgtgttcaataaatttaag

SEQ ID NO: 9375319 - DNA, 22 bp, Homo sapiens
gtgtgtttagcattagcagggg

SEQ ID NO: 9375320 - DNA, 22 bp, Homo sapiens
gtgtgtttcagaagccaggtgt

SEQ ID NO: 9375321 - DNA, 22 bp, Homo sapiens
gtgttaaccagctaaactttgc

SEQ ID NO: 9375322 - DNA, 22 bp, Homo sapiens
gtgttacagtaccttgtcacaa

SEQ ID NO: 9375323 - DNA, 22 bp, Homo sapiens
gtgttaaatttctaatttgtga

SEQ ID NO: 9375324 - DNA, 22 bp, Homo sapiens
gtgttaaatttctaatttgtga

SEQ ID NO: 9375325 - DNA, 22 bp, Homo sapiens
gtgttaaatgcaatcacatgca

SEQ ID NO: 9375326 - DNA, 22 bp, Homo sapiens
gtgttaaatgcaatcacatgca

SEQ ID NO: 9375327 - DNA, 22 bp, Homo sapiens
gtgttaaacatgttcacagcat

SEQ ID NO: 9375328 - DNA, 22 bp, Homo sapiens
gttactcttgagaggctgaggt

SEQ ID NO: 9375329 - DNA, 22 bp, Homo sapiens
gttagaaagtgtctgcttgggt

SEQ ID NO: 9375330 - DNA, 22 bp, Homo sapiens
gttactcttccccggggtctgg

SEQ ID NO: 9375331 - DNA, 22 bp, Homo sapiens
gttacaaaggtcataaaagtgt

SEQ ID NO: 9375332 - DNA, 22 bp, Homo sapiens
gttagcacaaccaagaaatgcg

SEQ ID NO: 9375333 - DNA, 20 bp, Homo sapiens
gttaggaggttggacatgga

SEQ ID NO: 9375334 - DNA, 22 bp, Homo sapiens
gttagggagtcaggtggctctt

SEQ ID NO: 9375335 - DNA, 22 bp, Homo sapiens
gttaggtagaagtttactttga

SEQ ID NO: 9375336 - DNA, 22 bp, Homo sapiens
gttataaaggtgataatggtca

SEQ ID NO: 9375337 - DNA, 22 bp, Homo sapiens
gttataaaggtgataatggtca

SEQ ID NO: 9375338 - DNA, 22 bp, Homo sapiens
gttataaatacctaataggatt

SEQ ID NO: 9375339 - DNA, 22 bp, Homo sapiens
gttcattttactgtaaatagca

SEQ ID NO: 9375340 - DNA, 22 bp, Homo sapiens
gttcattttactgtaaatagca

SEQ ID NO: 9375341 - DNA, 22 bp, Homo sapiens
gttataaaatgcacagttgttt

SEQ ID NO: 9375342 - DNA, 22 bp, Homo sapiens
gttataaaatgcacagttgttt

SEQ ID NO: 9375343 - DNA, 22 bp, Homo sapiens
gttagtgtgactgaggaatgca

SEQ ID NO: 9375344 - DNA, 22 bp, Homo sapiens
gttagtgtatattgccttcaaa

SEQ ID NO: 9375345 - DNA, 22 bp, Homo sapiens
gttccaaacaagtcataaagta

SEQ ID NO: 9375346 - DNA, 22 bp, Homo sapiens
gttcatttttactttgatctac

SEQ ID NO: 9375347 - DNA, 23 bp, Homo sapiens
gttcattttattgtctgattgct

SEQ ID NO: 9375348 - DNA, 23 bp, Homo sapiens
gttcattttattgtctgattgct

SEQ ID NO: 9375349 - DNA, 22 bp, Homo sapiens
gttcatttttccctaatgagta

SEQ ID NO: 9375350 - DNA, 22 bp, Homo sapiens
gttcatttttccctaatgagta

SEQ ID NO: 9375351 - DNA, 22 bp, Homo sapiens
gttcatttttccctaatgagta

SEQ ID NO: 9375352 - DNA, 22 bp, Homo sapiens
tacatacacaaatatactgttt

SEQ ID NO: 9375353 - DNA, 22 bp, Homo sapiens
tacatacacaaatgctgaatgg

SEQ ID NO: 9375354 - DNA, 22 bp, Homo sapiens
tacatacagccaagtatgaagt

SEQ ID NO: 9375355 - DNA, 22 bp, Homo sapiens
tacatacagagatgctagttaa

SEQ ID NO: 9375356 - DNA, 22 bp, Homo sapiens
tacatacaagatgtgtttaaaa

SEQ ID NO: 9375357 - DNA, 22 bp, Homo sapiens
tacatacaagatgtgtttaaaa

SEQ ID NO: 9375358 - DNA, 22 bp, Homo sapiens
tacatacaagcattcaatttta

SEQ ID NO: 9375359 - DNA, 22 bp, Homo sapiens
tacatacacaaatatactgttt

SEQ ID NO: 9375360 - DNA, 22 bp, Homo sapiens
tacatacacaaatatactgttt

SEQ ID NO: 9375361 - DNA, 22 bp, Homo sapiens
tacatacacaaatatactgttt

SEQ ID NO: 9375362 - DNA, 22 bp, Homo sapiens
tacatacacaaatatactgttt

SEQ ID NO: 9375363 - DNA, 22 bp, Homo sapiens
tacatgtatgtttatcttgaga

SEQ ID NO: 9375364 - DNA, 22 bp, Homo sapiens
tacatgtatgtttatcttgaga

SEQ ID NO: 9375365 - DNA, 22 bp, Homo sapiens
tacatgtattgatttctcttct

SEQ ID NO: 9375366 - DNA, 22 bp, Homo sapiens
tacatgtgataaattgattaaa

SEQ ID NO: 9375367 - DNA, 22 bp, Homo sapiens
tacatgtttggtaaatgatggc

SEQ ID NO: 9375368 - DNA, 22 bp, Homo sapiens
tacattaacttacgtccacatg

SEQ ID NO: 9375369 - DNA, 22 bp, Homo sapiens
tacattaaggatatggacatga

SEQ ID NO: 9375370 - DNA, 22 bp, Homo sapiens
tacatacatggtggaatggtta

SEQ ID NO: 9375371 - DNA, 22 bp, Homo sapiens
tacatacatattcatacaggtg

SEQ ID NO: 9375372 - DNA, 22 bp, Homo sapiens
tacatacatattcatacaggtg

SEQ ID NO: 9375373 - DNA, 22 bp, Homo sapiens
tacatacatattcatacaggtg

SEQ ID NO: 9375374 - DNA, 22 bp, Homo sapiens
tacatacagtggatgctttagg

SEQ ID NO: 9375375 - DNA, 22 bp, Homo sapiens
tacatacatattcatacaggtg

SEQ ID NO: 9375376 - DNA, 22 bp, Homo sapiens
tacatacagccaagtatgaagt

SEQ ID NO: 9375377 - DNA, 22 bp, Homo sapiens
tacatacagtggatgctttagg

SEQ ID NO: 9375378 - DNA, 22 bp, Homo sapiens
tacattaaggatatggacatga

SEQ ID NO: 9375379 - DNA, 22 bp, Homo sapiens
tacattaaggatatggacatga

SEQ ID NO: 9375380 - DNA, 22 bp, Homo sapiens
tacattagctcatctatttatt

SEQ ID NO: 9375381 - DNA, 22 bp, Homo sapiens
tacattatcctgtctttgtcct

SEQ ID NO: 9375382 - DNA, 22 bp, Homo sapiens
tacattagctcatctatttatt

SEQ ID NO: 9375383 - DNA, 22 bp, Homo sapiens
tacattcagaagaatggacacg

SEQ ID NO: 9375384 - DNA, 22 bp, Homo sapiens
tacatacaagatgtgtttaaaa

SEQ ID NO: 9375385 - DNA, 22 bp, Homo sapiens
tacataatgagctagttaagtt

SEQ ID NO: 9375386 - DNA, 22 bp, Homo sapiens
tacataatgagctagttaagtt

SEQ ID NO: 9375387 - DNA, 22 bp, Homo sapiens
tacagtttttattcatgacaag

SEQ ID NO: 9375388 - DNA, 22 bp, Homo sapiens
tacagtttttattcatgacaag

SEQ ID NO: 9375389 - DNA, 22 bp, Homo sapiens
tacagtttttattcatgacaag

SEQ ID NO: 9375390 - DNA, 22 bp, Homo sapiens
tacagtttgttacattgttagt

SEQ ID NO: 9375391 - DNA, 22 bp, Homo sapiens
tacagtttgttacattgttagt

SEQ ID NO: 9375392 - DNA, 22 bp, Homo sapiens
tacagtttgttacattgttagt

SEQ ID NO: 9375393 - DNA, 22 bp, Homo sapiens
tacagtttgttacattgttagt

SEQ ID NO: 9375394 - DNA, 22 bp, Homo sapiens
tacagttaccctggaaagaaat

SEQ ID NO: 9375395 - DNA, 22 bp, Homo sapiens
tacagttacgctgagaaacgaa

SEQ ID NO: 9375396 - DNA, 22 bp, Homo sapiens
tacaggaagttacagactatga

SEQ ID NO: 9375397 - DNA, 20 bp, Homo sapiens
tacaggaatcaagactgcat

SEQ ID NO: 9375398 - DNA, 20 bp, Homo sapiens
tacaggaatcaagactgcat

SEQ ID NO: 9375399 - DNA, 22 bp, Homo sapiens
tacaggagagatttagtaatca

SEQ ID NO: 9375400 - DNA, 22 bp, Homo sapiens
tacaggagagatttagtaatca

SEQ ID NO: 9375401 - DNA, 22 bp, Homo sapiens
tacagcactgtgcatagtggtt

SEQ ID NO: 9375402 - DNA, 22 bp, Homo sapiens
tacactatgggctttgtgtaat

SEQ ID NO: 9375403 - DNA, 22 bp, Homo sapiens
tacagcttcagtgtgccccagt

SEQ ID NO: 9375404 - DNA, 22 bp, Homo sapiens
tacagctttatacccatcaaaa

SEQ ID NO: 9375405 - DNA, 22 bp, Homo sapiens
tacaggaaagaaatttgaactc

SEQ ID NO: 9375406 - DNA, 22 bp, Homo sapiens
tacaggaactgggcaggacatt

SEQ ID NO: 9375407 - DNA, 22 bp, Homo sapiens
tacaggaagtaagtaatgaaat

SEQ ID NO: 9375408 - DNA, 22 bp, Homo sapiens
tacaggaagcactcaagaaatg

SEQ ID NO: 9375409 - DNA, 22 bp, Homo sapiens
tacaggaaggagcacatcggga

SEQ ID NO: 9375410 - DNA, 22 bp, Homo sapiens
tacaggaaggctctggaggtgc

SEQ ID NO: 9375411 - DNA, 22 bp, Homo sapiens
tacaggaaggctctggaggtgc

SEQ ID NO: 9375412 - DNA, 18 bp, Homo sapiens
tacaggaaggggttctcg

SEQ ID NO: 9375413 - DNA, 22 bp, Homo sapiens
tacctggggctgggctttgatt

SEQ ID NO: 9375414 - DNA, 22 bp, Homo sapiens
tacctgtcaaaagacatggaga

SEQ ID NO: 9375415 - DNA, 22 bp, Homo sapiens
tacctggaatcacagaggctga

SEQ ID NO: 9375416 - DNA, 22 bp, Homo sapiens
tacctggaatagagtctctcca

SEQ ID NO: 9375417 - DNA, 22 bp, Homo sapiens
tacctggagcaggaggcagaat

SEQ ID NO: 9375418 - DNA, 22 bp, Homo sapiens
tacctggatcctggtagacatc

SEQ ID NO: 9375419 - DNA, 22 bp, Homo sapiens
tacctggatatcattcattctc

SEQ ID NO: 9375420 - DNA, 22 bp, Homo sapiens
taccttgggagacgccaggccc

SEQ ID NO: 9375421 - DNA, 22 bp, Homo sapiens
taccttggaaatgctagagtaa

SEQ ID NO: 9375422 - DNA, 22 bp, Homo sapiens
taccttggaggccaagcagttt

SEQ ID NO: 9375423 - DNA, 22 bp, Homo sapiens
taccttgggctattatctttga

SEQ ID NO: 9375424 - DNA, 22 bp, Homo sapiens
taccttgggttgagttcattct

SEQ ID NO: 9375425 - DNA, 22 bp, Homo sapiens
taccttggggttttgttgctct

SEQ ID NO: 9375426 - DNA, 22 bp, Homo sapiens
taccttgagccgttgctgatga

SEQ ID NO: 9375427 - DNA, 22 bp, Homo sapiens
taccttgattttgaatccatga

SEQ ID NO: 9375428 - DNA, 22 bp, Homo sapiens
tacccagcccatgcctacctca

SEQ ID NO: 9375429 - DNA, 22 bp, Homo sapiens
tacccagctcctcagaagacca

SEQ ID NO: 9375430 - DNA, 19 bp, Homo sapiens
tacattccacacaatctct

SEQ ID NO: 9375431 - DNA, 22 bp, Homo sapiens
tacattccacaagcattgcttt

SEQ ID NO: 9375432 - DNA, 22 bp, Homo sapiens
tacccagagggagagcaactat

SEQ ID NO: 9375433 - DNA, 22 bp, Homo sapiens
tactaaatagtttaattcctca

SEQ ID NO: 9375434 - DNA, 22 bp, Homo sapiens
tacgggcacgcaccacgatgcc

SEQ ID NO: 9375435 - DNA, 22 bp, Homo sapiens
tacctttgatctggaattttaa

SEQ ID NO: 9375436 - DNA, 22 bp, Homo sapiens
tactgaaatggcagatatataa

SEQ ID NO: 9375437 - DNA, 20 bp, Homo sapiens
tactgaagaagctgcccaga

SEQ ID NO: 9375438 - DNA, 22 bp, Homo sapiens
tactaattgttcacacttgttt

SEQ ID NO: 9375439 - DNA, 22 bp, Homo sapiens
tactaagtgtttggcagtatca

SEQ ID NO: 9375440 - DNA, 22 bp, Homo sapiens
tactaagtggggcattgttata

SEQ ID NO: 9375441 - DNA, 22 bp, Homo sapiens
tactgaaagactgaatatttag

SEQ ID NO: 9375442 - DNA, 22 bp, Homo sapiens
tactgctagatgaaaatgtagg

SEQ ID NO: 9375443 - DNA, 22 bp, Homo sapiens
tactgctagatgaaaatgtagg

SEQ ID NO: 9375444 - DNA, 22 bp, Homo sapiens
tactggcatttagtgggcagaa

SEQ ID NO: 9375445 - DNA, 22 bp, Homo sapiens
tactggacacgtatatatagat

SEQ ID NO: 9375446 - DNA, 22 bp, Homo sapiens
tactggaagttagagatctttt

SEQ ID NO: 9375447 - DNA, 22 bp, Homo sapiens
tactggaatcccgggtggctgg

SEQ ID NO: 9375448 - DNA, 22 bp, Homo sapiens
tactggaatcccgggtggctgg

SEQ ID NO: 9375449 - DNA, 21 bp, Homo sapiens
tactgagacctcacagtgtgc

SEQ ID NO: 9375450 - DNA, 22 bp, Homo sapiens
tactgaggccatgagtctcata

SEQ ID NO: 9375451 - DNA, 22 bp, Homo sapiens
tactgaggttgagaagctgctc

SEQ ID NO: 9375452 - DNA, 22 bp, Homo sapiens
tactgatatgatgtgctttaga

SEQ ID NO: 9375453 - DNA, 22 bp, Homo sapiens
tactgcaaaccatttacagtag

SEQ ID NO: 9375454 - DNA, 22 bp, Homo sapiens
tactgcacttgagaaagctgag

SEQ ID NO: 9375455 - DNA, 22 bp, Homo sapiens
tacttattgttgaactgaatca

SEQ ID NO: 9375456 - DNA, 22 bp, Homo sapiens
tacttattggttcagaagttta

SEQ ID NO: 9375457 - DNA, 19 bp, Homo sapiens
tacttattagaaatatggg

SEQ ID NO: 9375458 - DNA, 22 bp, Homo sapiens
tacttataaggaggcacacaaa

SEQ ID NO: 9375459 - DNA, 22 bp, Homo sapiens
tacttctgccttagagaacact

SEQ ID NO: 9375460 - DNA, 22 bp, Homo sapiens
tacttctagcctgccccttgtg

SEQ ID NO: 9375461 - DNA, 22 bp, Homo sapiens
tacttctctccgcctcgtgctt

SEQ ID NO: 9375462 - DNA, 22 bp, Homo sapiens
tacttcattattctagttttga

SEQ ID NO: 9375463 - DNA, 22 bp, Homo sapiens
tacttccaggcggacaaagccc

SEQ ID NO: 9375464 - DNA, 22 bp, Homo sapiens
tacttccagcaatctgcatatt

SEQ ID NO: 9375465 - DNA, 22 bp, Homo sapiens
taatttcacagttcaacgcaca

SEQ ID NO: 9375466 - DNA, 22 bp, Homo sapiens
taatttcaatagcttgcataat

SEQ ID NO: 9375467 - DNA, 22 bp, Homo sapiens
taatttcaatagcttgcataat

SEQ ID NO: 9375468 - DNA, 22 bp, Homo sapiens
taatttcaatagcttgcataat

SEQ ID NO: 9375469 - DNA, 22 bp, Homo sapiens
taatttctaattcattttcagt

SEQ ID NO: 9375470 - DNA, 22 bp, Homo sapiens
taatttcagtgggctctgggct

SEQ ID NO: 9375471 - DNA, 22 bp, Homo sapiens
taatttcagtgcaagctcacgg

SEQ ID NO: 9375472 - DNA, 22 bp, Homo sapiens
taatttcactgatatgaagtca

SEQ ID NO: 9375473 - DNA, 22 bp, Homo sapiens
taatttcactgatatgaagtca

SEQ ID NO: 9375474 - DNA, 22 bp, Homo sapiens
taatttcactgatatgaagtca

SEQ ID NO: 9375475 - DNA, 22 bp, Homo sapiens
taatttcaccgttgctagaaat

SEQ ID NO: 9375476 - DNA, 22 bp, Homo sapiens
taatttcaccgttgctagaaat

SEQ ID NO: 9375477 - DNA, 22 bp, Homo sapiens
taatgcttaacagctggctttt

SEQ ID NO: 9375478 - DNA, 22 bp, Homo sapiens
taatgcttttccttcaaataag

SEQ ID NO: 9375479 - DNA, 22 bp, Homo sapiens
taatgcaaggaattccaagtag

SEQ ID NO: 9375480 - DNA, 22 bp, Homo sapiens
taatgatatttcccatttctct

SEQ ID NO: 9375481 - DNA, 22 bp, Homo sapiens
taatgcacagaattgacatggg

SEQ ID NO: 9375482 - DNA, 22 bp, Homo sapiens
taatgccacctacctgctttat

SEQ ID NO: 9375483 - DNA, 22 bp, Homo sapiens
taatgaggaaatagagggaatg

SEQ ID NO: 9375484 - DNA, 19 bp, Homo sapiens
taataagcaatatggaagt

SEQ ID NO: 9375485 - DNA, 22 bp, Homo sapiens
taataacaattgtaggacatga

SEQ ID NO: 9375486 - DNA, 22 bp, Homo sapiens
taatgaataaacttgagagtca

SEQ ID NO: 9375487 - DNA, 22 bp, Homo sapiens
taatgaataaacttgagagtca

SEQ ID NO: 9375488 - DNA, 22 bp, Homo sapiens
taatgaatgagaatataacaga

SEQ ID NO: 9375489 - DNA, 22 bp, Homo sapiens
taagtttaagtcatgtttgatg

SEQ ID NO: 9375490 - DNA, 22 bp, Homo sapiens
taagtttaagtcatgtttgatg

SEQ ID NO: 9375491 - DNA, 22 bp, Homo sapiens
taagtttaaatgtacatgaagc

SEQ ID NO: 9375492 - DNA, 22 bp, Homo sapiens
taagttctgagtaaatactgtt

SEQ ID NO: 9375493 - DNA, 22 bp, Homo sapiens
taataaatgaaagtgctggcat

SEQ ID NO: 9375494 - DNA, 22 bp, Homo sapiens
taataacaattgtaggacatga

SEQ ID NO: 9375495 - DNA, 22 bp, Homo sapiens
taataacaattgtaggacatga

SEQ ID NO: 9375496 - DNA, 22 bp, Homo sapiens
taagcactttatatgctttatc

SEQ ID NO: 9375497 - DNA, 22 bp, Homo sapiens
taagcagatgctgtctgcacaa

SEQ ID NO: 9375498 - DNA, 22 bp, Homo sapiens
taagcataagatacatgagaca

SEQ ID NO: 9375499 - DNA, 22 bp, Homo sapiens
taagcatacattctctcctttc

SEQ ID NO: 9375500 - DNA, 22 bp, Homo sapiens
taagcataactaaaaatgattt

SEQ ID NO: 9375501 - DNA, 22 bp, Homo sapiens
taagcaatgagataatcatggg

SEQ ID NO: 9375502 - DNA, 20 bp, Homo sapiens
taagcacatgaacagtcctc

SEQ ID NO: 9375503 - DNA, 22 bp, Homo sapiens
taagttacctgttttgtcatca

SEQ ID NO: 9375504 - DNA, 22 bp, Homo sapiens
taagttagatcttaattaaagt

SEQ ID NO: 9375505 - DNA, 22 bp, Homo sapiens
taagttagagcacaattcttac

SEQ ID NO: 9375506 - DNA, 22 bp, Homo sapiens
taagttagccctattaaattaa

SEQ ID NO: 9375507 - DNA, 22 bp, Homo sapiens
taagttatcggagtgtgtttca

SEQ ID NO: 9375508 - DNA, 22 bp, Homo sapiens
taattttatgacagtgtatttt

SEQ ID NO: 9375509 - DNA, 22 bp, Homo sapiens
taattttccactctgtttatct

SEQ ID NO: 9375510 - DNA, 22 bp, Homo sapiens
taatttctaattcattttcagt

SEQ ID NO: 9375511 - DNA, 22 bp, Homo sapiens
taatttctggagggagaaagag

SEQ ID NO: 9375512 - DNA, 22 bp, Homo sapiens
taattttaactgtgctgtttgg

SEQ ID NO: 9375513 - DNA, 22 bp, Homo sapiens
taatttgaatctcgctatttta

SEQ ID NO: 9375514 - DNA, 22 bp, Homo sapiens
taatttcttcatctctgcagct

SEQ ID NO: 9375515 - DNA, 22 bp, Homo sapiens
taattttaatagtatgtggcat

SEQ ID NO: 9375516 - DNA, 23 bp, Homo sapiens
taattttagccttacaggaccct

SEQ ID NO: 9375517 - DNA, 22 bp, Homo sapiens
taattttacttcctgagcacct

SEQ ID NO: 9375518 - DNA, 22 bp, Homo sapiens
tacaatgaccatattatgtaag

SEQ ID NO: 9375519 - DNA, 22 bp, Homo sapiens
tacaatgaccatattatgtaag

SEQ ID NO: 9375520 - DNA, 22 bp, Homo sapiens
tacaatcaggataataatagtg

SEQ ID NO: 9375521 - DNA, 22 bp, Homo sapiens
tacaatgagctgtacatctcca

SEQ ID NO: 9375522 - DNA, 22 bp, Homo sapiens
tacaatgatgatactttactgg

SEQ ID NO: 9375523 - DNA, 22 bp, Homo sapiens
tacaatgatgatactttactgg

SEQ ID NO: 9375524 - DNA, 19 bp, Homo sapiens
tacaatgatgttacctttg

SEQ ID NO: 9375525 - DNA, 19 bp, Homo sapiens
tacaatgatgttacctttg

SEQ ID NO: 9375526 - DNA, 22 bp, Homo sapiens
tacaatgagctgagccagaggc

SEQ ID NO: 9375527 - DNA, 22 bp, Homo sapiens
tacaatgcagtgacctccttta

SEQ ID NO: 9375528 - DNA, 23 bp, Homo sapiens
tacaatgcaaacttggcccatgg

SEQ ID NO: 9375529 - DNA, 22 bp, Homo sapiens
tacaatgcattcgttgtctcgg

SEQ ID NO: 9375530 - DNA, 22 bp, Homo sapiens
tacaatgtaattctgattatgt

SEQ ID NO: 9375531 - DNA, 22 bp, Homo sapiens
tacaatgtaattctgattatgt

SEQ ID NO: 9375532 - DNA, 22 bp, Homo sapiens
tacaagcttttgtgtataaatg

SEQ ID NO: 9375533 - DNA, 22 bp, Homo sapiens
tacaatatgtggccttttgtga

SEQ ID NO: 9375534 - DNA, 20 bp, Homo sapiens
tacaatattcccactttgct

SEQ ID NO: 9375535 - DNA, 20 bp, Homo sapiens
tacaatattcccactttgct

SEQ ID NO: 9375536 - DNA, 19 bp, Homo sapiens
tacaagcttaaagtaatgt

SEQ ID NO: 9375537 - DNA, 22 bp, Homo sapiens
tacaagctggcgcagttaagat

SEQ ID NO: 9375538 - DNA, 19 bp, Homo sapiens
tacaagcttaaagtaatgt

SEQ ID NO: 9375539 - DNA, 19 bp, Homo sapiens
tacaagcttaaagtaatgt

SEQ ID NO: 9375540 - DNA, 22 bp, Homo sapiens
tacaagctcacaaatttttaag

SEQ ID NO: 9375541 - DNA, 22 bp, Homo sapiens
tacaagctcacaaatttttaag

SEQ ID NO: 9375542 - DNA, 22 bp, Homo sapiens
tacaagctgaccctgaagatga

SEQ ID NO: 9375543 - DNA, 22 bp, Homo sapiens
tacacattacataatactatct

SEQ ID NO: 9375544 - DNA, 22 bp, Homo sapiens
tacacattacataatactatct

SEQ ID NO: 9375545 - DNA, 22 bp, Homo sapiens
tacacattacataatactatct

SEQ ID NO: 9375546 - DNA, 22 bp, Homo sapiens
tacacattctagggcacagtta

SEQ ID NO: 9375547 - DNA, 22 bp, Homo sapiens
tacacattagtgaggtattttg

SEQ ID NO: 9375548 - DNA, 22 bp, Homo sapiens
tacacatgtttggcaagtatgt

SEQ ID NO: 9375549 - DNA, 22 bp, Homo sapiens
tacaccattcccaggtggattt

SEQ ID NO: 9375550 - DNA, 21 bp, Homo sapiens
tacaccagtttacacttcctc

SEQ ID NO: 9375551 - DNA, 22 bp, Homo sapiens
tacaccagattatttataacat

SEQ ID NO: 9375552 - DNA, 22 bp, Homo sapiens
tacaccagtatcttaagcatga

SEQ ID NO: 9375553 - DNA, 22 bp, Homo sapiens
tacaccagcttgcctgggctct

SEQ ID NO: 9375554 - DNA, 22 bp, Homo sapiens
tacaccttaatcatatgtgtct

SEQ ID NO: 9375555 - DNA, 22 bp, Homo sapiens
tacacgtgtgtgtatgtacata

SEQ ID NO: 9375556 - DNA, 22 bp, Homo sapiens
tacacatatgtccattaatcag

SEQ ID NO: 9375557 - DNA, 22 bp, Homo sapiens
tacacatatgtgtgtatatgtg

SEQ ID NO: 9375558 - DNA, 22 bp, Homo sapiens
tacacatcaacctggctttggc

SEQ ID NO: 9375559 - DNA, 22 bp, Homo sapiens
tacacatatgtgtgtatatgtg

SEQ ID NO: 9375560 - DNA, 22 bp, Homo sapiens
tacacatccatgttttgacttt

SEQ ID NO: 9375561 - DNA, 22 bp, Homo sapiens
tacacatcatacactgggatta

SEQ ID NO: 9375562 - DNA, 22 bp, Homo sapiens
tacacatcactgtatctttcag

SEQ ID NO: 9375563 - DNA, 22 bp, Homo sapiens
tacacatctggagaagccctgt

SEQ ID NO: 9375564 - DNA, 22 bp, Homo sapiens
tacacatctctgtcagtagtga

SEQ ID NO: 9375565 - DNA, 22 bp, Homo sapiens
tacacatccttctgaacaacct

SEQ ID NO: 9375566 - DNA, 22 bp, Homo sapiens
tacacatctggtgtgactgcca

SEQ ID NO: 9375567 - DNA, 22 bp, Homo sapiens
tacaatttagtggtgtgtggtt

SEQ ID NO: 9375568 - DNA, 19 bp, Homo sapiens
tacaattggctttccattg

SEQ ID NO: 9375569 - DNA, 22 bp, Homo sapiens
tacaatttagtggtgtgtggtt

SEQ ID NO: 9375570 - DNA, 22 bp, Homo sapiens
tacaatttagtggtgtgtggtt

SEQ ID NO: 9375571 - DNA, 22 bp, Homo sapiens
tacacaaaggcactctgttgtt

SEQ ID NO: 9375572 - DNA, 22 bp, Homo sapiens
tacaatgttaaggaaagagaga

SEQ ID NO: 9375573 - DNA, 17 bp, Homo sapiens
tacaatgtgattcaatc

SEQ ID NO: 9375574 - DNA, 22 bp, Homo sapiens
tacaatgttcctagcaggaaag

SEQ ID NO: 9375575 - DNA, 22 bp, Homo sapiens
tatacgtgcaggtcacagggga

SEQ ID NO: 9375576 - DNA, 22 bp, Homo sapiens
tataccttccacaaaacagctt

SEQ ID NO: 9375577 - DNA, 20 bp, Homo sapiens
tatactaacatatatctgtt

SEQ ID NO: 9375578 - DNA, 20 bp, Homo sapiens
tatactaacatatatctgtt

SEQ ID NO: 9375579 - DNA, 22 bp, Homo sapiens
tatactatgcttctgatccaat

SEQ ID NO: 9375580 - DNA, 22 bp, Homo sapiens
tatactacgcaccaaacaaagg

SEQ ID NO: 9375581 - DNA, 22 bp, Homo sapiens
tatactatgcttctgatccaat

SEQ ID NO: 9375582 - DNA, 22 bp, Homo sapiens
tatacatgttttacataagtga

SEQ ID NO: 9375583 - DNA, 22 bp, Homo sapiens
tataccaaaatatcagaaaggg

SEQ ID NO: 9375584 - DNA, 22 bp, Homo sapiens
tatagaagagacatgtgcatag

SEQ ID NO: 9375585 - DNA, 22 bp, Homo sapiens
tatactgagagcaaatacattc

SEQ ID NO: 9375586 - DNA, 22 bp, Homo sapiens
tatacttatgctaaaaaatgtt

SEQ ID NO: 9375587 - DNA, 22 bp, Homo sapiens
tagttaaaataatggagatgtt

SEQ ID NO: 9375588 - DNA, 22 bp, Homo sapiens
tagttaaaataatggagatgtt

SEQ ID NO: 9375589 - DNA, 22 bp, Homo sapiens
tagtgtttgggaattgtagaga

SEQ ID NO: 9375590 - DNA, 23 bp, Homo sapiens
tagtgtcaagagggagtgtaatt

SEQ ID NO: 9375591 - DNA, 22 bp, Homo sapiens
tagtgtatgttcagcttatatg

SEQ ID NO: 9375592 - DNA, 22 bp, Homo sapiens
tagtgtatgtctaacatacact

SEQ ID NO: 9375593 - DNA, 22 bp, Homo sapiens
tagttaagaggccagtgtaata

SEQ ID NO: 9375594 - DNA, 22 bp, Homo sapiens
tagttaatgctaattaacaaat

SEQ ID NO: 9375595 - DNA, 22 bp, Homo sapiens
tatacagaactgcacgtgcacg

SEQ ID NO: 9375596 - DNA, 22 bp, Homo sapiens
tatacagaaccgcctgaagtct

SEQ ID NO: 9375597 - DNA, 22 bp, Homo sapiens
tagttaaagccctaaattgata

SEQ ID NO: 9375598 - DNA, 22 bp, Homo sapiens
tatattatcataaaaccattca

SEQ ID NO: 9375599 - DNA, 22 bp, Homo sapiens
tatattacctgcctgatctata

SEQ ID NO: 9375600 - DNA, 22 bp, Homo sapiens
tatattagtgagatttatccat

SEQ ID NO: 9375601 - DNA, 22 bp, Homo sapiens
tatattacctgcctgatctata

SEQ ID NO: 9375602 - DNA, 22 bp, Homo sapiens
tatattacatagtgtttgagat

SEQ ID NO: 9375603 - DNA, 22 bp, Homo sapiens
tatattaacttgtgatcctgga

SEQ ID NO: 9375604 - DNA, 22 bp, Homo sapiens
tatattaaccatagggttctag

SEQ ID NO: 9375605 - DNA, 22 bp, Homo sapiens
tatattaacacccacttgcctc

SEQ ID NO: 9375606 - DNA, 22 bp, Homo sapiens
tatattaacacccacttgcctc

SEQ ID NO: 9375607 - DNA, 20 bp, Homo sapiens
tatatgtgtacatacacaca

SEQ ID NO: 9375608 - DNA, 22 bp, Homo sapiens
tatatgtgtggattcttgtaga

SEQ ID NO: 9375609 - DNA, 22 bp, Homo sapiens
tatatgttgatactaattctgg

SEQ ID NO: 9375610 - DNA, 22 bp, Homo sapiens
tatatgtttcttacaaaatatt

SEQ ID NO: 9375611 - DNA, 22 bp, Homo sapiens
tatattaaaccctctctgtagg

SEQ ID NO: 9375612 - DNA, 22 bp, Homo sapiens
tatatgtttttctaattaggga

SEQ ID NO: 9375613 - DNA, 22 bp, Homo sapiens
tatattaaatgaccagttttaa

SEQ ID NO: 9375614 - DNA, 22 bp, Homo sapiens
tatattaaagtgctttgcagtg

SEQ ID NO: 9375615 - DNA, 22 bp, Homo sapiens
tatattaaagtgctttgcagtg

SEQ ID NO: 9375616 - DNA, 22 bp, Homo sapiens
tatagacttgatggtattaagt

SEQ ID NO: 9375617 - DNA, 18 bp, Homo sapiens
tatagacacatatgccag

SEQ ID NO: 9375618 - DNA, 22 bp, Homo sapiens
tatagatagactgacgatacag

SEQ ID NO: 9375619 - DNA, 22 bp, Homo sapiens
tatagatagtcacttgttgcta

SEQ ID NO: 9375620 - DNA, 22 bp, Homo sapiens
tatagatagtcacttgttgcta

SEQ ID NO: 9375621 - DNA, 22 bp, Homo sapiens
tatatgcaatgaggtgggagta

SEQ ID NO: 9375622 - DNA, 22 bp, Homo sapiens
tatatgcagattttcatcatcg

SEQ ID NO: 9375623 - DNA, 22 bp, Homo sapiens
tatagcaagcaggacagtctca

SEQ ID NO: 9375624 - DNA, 22 bp, Homo sapiens
tatatgtaagctatgtaagagt

SEQ ID NO: 9375625 - DNA, 22 bp, Homo sapiens
tatatgtaagctatgtaagagt

SEQ ID NO: 9375626 - DNA, 22 bp, Homo sapiens
tatatgtaaataagtctaatgt

SEQ ID NO: 9375627 - DNA, 22 bp, Homo sapiens
tatatgtaaataagtctaatgt

SEQ ID NO: 9375628 - DNA, 22 bp, Homo sapiens
tatatgtaaataagtctaatgt

SEQ ID NO: 9375629 - DNA, 22 bp, Homo sapiens
tatatgcatgcccatgtataca

SEQ ID NO: 9375630 - DNA, 22 bp, Homo sapiens
tatatgcatgcccatgtataca

SEQ ID NO: 9375631 - DNA, 22 bp, Homo sapiens
tatatgcatgcccatgtataca

SEQ ID NO: 9375632 - DNA, 22 bp, Homo sapiens
tatatgtctgctactgtataaa

SEQ ID NO: 9375633 - DNA, 17 bp, Homo sapiens
tatatgtatgcctctcc

SEQ ID NO: 9375634 - DNA, 22 bp, Homo sapiens
tatatgtctgctactgtataaa

SEQ ID NO: 9375635 - DNA, 22 bp, Homo sapiens
tatatgtagtcagtcagagtaa

SEQ ID NO: 9375636 - DNA, 22 bp, Homo sapiens
tatatgtagattgtaccaatgt

SEQ ID NO: 9375637 - DNA, 22 bp, Homo sapiens
tatatgtagattgtaccaatgt

SEQ ID NO: 9375638 - DNA, 22 bp, Homo sapiens
tatatgtagattgtaccaatgt

SEQ ID NO: 9375639 - DNA, 22 bp, Homo sapiens
tatcttacttatgctgatgtcc

SEQ ID NO: 9375640 - DNA, 20 bp, Homo sapiens
tatcttactttagtcatttg

SEQ ID NO: 9375641 - DNA, 22 bp, Homo sapiens
tatcttacagactgaatgttgg

SEQ ID NO: 9375642 - DNA, 23 bp, Homo sapiens
tatcttacctcccttctttcctg

SEQ ID NO: 9375643 - DNA, 22 bp, Homo sapiens
tatctgttgtcttttacatgta

SEQ ID NO: 9375644 - DNA, 22 bp, Homo sapiens
tatctgttgtagtacagatgat

SEQ ID NO: 9375645 - DNA, 22 bp, Homo sapiens
tatctgttgtccatgcagaaag

SEQ ID NO: 9375646 - DNA, 22 bp, Homo sapiens
tatctgtttgctcacaggtgtt

SEQ ID NO: 9375647 - DNA, 19 bp, Homo sapiens
tatctgtttcctgcttgtc

SEQ ID NO: 9375648 - DNA, 22 bp, Homo sapiens
tatcttaaatgcatgatagaca

SEQ ID NO: 9375649 - DNA, 22 bp, Homo sapiens
tatcttaaaaatcgaagcagat

SEQ ID NO: 9375650 - DNA, 22 bp, Homo sapiens
tatctttagaggaagagaatct

SEQ ID NO: 9375651 - DNA, 19 bp, Homo sapiens
tatctttatgcagtggtgg

SEQ ID NO: 9375652 - DNA, 22 bp, Homo sapiens
tatctttaacttgcagtattta

SEQ ID NO: 9375653 - DNA, 22 bp, Homo sapiens
tatctttaacttgcagtattta

SEQ ID NO: 9375654 - DNA, 22 bp, Homo sapiens
tatcttgtaataggtccacttg

SEQ ID NO: 9375655 - DNA, 22 bp, Homo sapiens
tatgcacatataacctgcactg

SEQ ID NO: 9375656 - DNA, 22 bp, Homo sapiens
tatgcatagtggaattagcaaa

SEQ ID NO: 9375657 - DNA, 22 bp, Homo sapiens
tatgcatagatattatcagcca

SEQ ID NO: 9375658 - DNA, 22 bp, Homo sapiens
tatgcataattggataagtaga

SEQ ID NO: 9375659 - DNA, 22 bp, Homo sapiens
tatgcatgtggtatatgcttat

SEQ ID NO: 9375660 - DNA, 22 bp, Homo sapiens
tatgcatgtggtatatgcttat

SEQ ID NO: 9375661 - DNA, 22 bp, Homo sapiens
tatgcattcagaggttgggtgt

SEQ ID NO: 9375662 - DNA, 22 bp, Homo sapiens
tatgcattatacattaatttct

SEQ ID NO: 9375663 - DNA, 18 bp, Homo sapiens
tatatttcacacatattc

SEQ ID NO: 9375664 - DNA, 18 bp, Homo sapiens
tatatttcacacatattc

SEQ ID NO: 9375665 - DNA, 18 bp, Homo sapiens
tatatttcacacatattc

SEQ ID NO: 9375666 - DNA, 22 bp, Homo sapiens
tatatttgctaaatgtgtgcaa

SEQ ID NO: 9375667 - DNA, 19 bp, Homo sapiens
tatatttgagtgtgcatgc

SEQ ID NO: 9375668 - DNA, 22 bp, Homo sapiens
tatatttgctaaatgtgtgcaa

SEQ ID NO: 9375669 - DNA, 22 bp, Homo sapiens
tatatttgtgtgtgatttatga

SEQ ID NO: 9375670 - DNA, 19 bp, Homo sapiens
tatatttgagtgtgcatgc

SEQ ID NO: 9375671 - DNA, 22 bp, Homo sapiens
tatatttaatcctagagccatt

SEQ ID NO: 9375672 - DNA, 22 bp, Homo sapiens
tatatttaaatccaggttgaaa

SEQ ID NO: 9375673 - DNA, 22 bp, Homo sapiens
tatatttaaatccaggttgaaa

SEQ ID NO: 9375674 - DNA, 22 bp, Homo sapiens
tatatttaaatccaggttgaaa

SEQ ID NO: 9375675 - DNA, 20 bp, Homo sapiens
tatattttctctttggcctt

SEQ ID NO: 9375676 - DNA, 20 bp, Homo sapiens
tatattttctctttggcctt

SEQ ID NO: 9375677 - DNA, 20 bp, Homo sapiens
tatattttctctttggcctt

SEQ ID NO: 9375678 - DNA, 19 bp, Homo sapiens
tatatttgttgaataaaaa

SEQ ID NO: 9375679 - DNA, 22 bp, Homo sapiens
tatatttgtgtgtgatttatga

SEQ ID NO: 9375680 - DNA, 22 bp, Homo sapiens
tatattttagacaccctcacgc

SEQ ID NO: 9375681 - DNA, 19 bp, Homo sapiens
tatatttgttgaataaaaa

SEQ ID NO: 9375682 - DNA, 22 bp, Homo sapiens
tatattttagacaccctcacgc

SEQ ID NO: 9375683 - DNA, 20 bp, Homo sapiens
tatattttctctttggcctt

SEQ ID NO: 9375684 - DNA, 22 bp, Homo sapiens
tatattttagacaccctcacgc

SEQ ID NO: 9375685 - DNA, 22 bp, Homo sapiens
tatattttagacaccctcacgc

SEQ ID NO: 9375686 - DNA, 22 bp, Homo sapiens
tatctgtcgcatacatacttgg

SEQ ID NO: 9375687 - DNA, 22 bp, Homo sapiens
tatctgtcacctgtagggtagg

SEQ ID NO: 9375688 - DNA, 22 bp, Homo sapiens
tatctataagtactaacatggt

SEQ ID NO: 9375689 - DNA, 22 bp, Homo sapiens
tatctagatttctttctctgtg

SEQ ID NO: 9375690 - DNA, 22 bp, Homo sapiens
tatctgttatgggctgaattgc

SEQ ID NO: 9375691 - DNA, 22 bp, Homo sapiens
tatctgttcaatggaagatgac

SEQ ID NO: 9375692 - DNA, 22 bp, Homo sapiens
tatctgttcatgtttatatgtc

SEQ ID NO: 9375693 - DNA, 22 bp, Homo sapiens
tatctgttaggatcagagctgg

SEQ ID NO: 9375694 - DNA, 22 bp, Homo sapiens
tatctgttccaggcactcagct

SEQ ID NO: 9375695 - DNA, 22 bp, Homo sapiens
tatctgttcttagctatagatg

SEQ ID NO: 9375696 - DNA, 22 bp, Homo sapiens
tatctgttggctcctagttgta

SEQ ID NO: 9375697 - DNA, 22 bp, Homo sapiens
tatcaagtgactatcacagaac

SEQ ID NO: 9375698 - DNA, 22 bp, Homo sapiens
tatcacactagcctatagtgga

SEQ ID NO: 9375699 - DNA, 22 bp, Homo sapiens
tatcaatacatgttatcagtgt

SEQ ID NO: 9375700 - DNA, 22 bp, Homo sapiens
tatttcacataccacagagtgt

SEQ ID NO: 9375701 - DNA, 22 bp, Homo sapiens
tatttcacagcagctcatttaa

SEQ ID NO: 9375702 - DNA, 22 bp, Homo sapiens
tatttcacataccacagagtgt

SEQ ID NO: 9375703 - DNA, 22 bp, Homo sapiens
tatttcacaagatgctgatgct

SEQ ID NO: 9375704 - DNA, 22 bp, Homo sapiens
tatttcacagcagctcatttaa

SEQ ID NO: 9375705 - DNA, 22 bp, Homo sapiens
tatttcacagcagctcatttaa

SEQ ID NO: 9375706 - DNA, 22 bp, Homo sapiens
tatttcacctaaaagtgtcaaa

SEQ ID NO: 9375707 - DNA, 22 bp, Homo sapiens
tatttcacctaaaagtgtcaaa

SEQ ID NO: 9375708 - DNA, 22 bp, Homo sapiens
tatttcaccttactaagctgtg

SEQ ID NO: 9375709 - DNA, 22 bp, Homo sapiens
tatttcacatctatgaagtgag

SEQ ID NO: 9375710 - DNA, 22 bp, Homo sapiens
tatttcaacgtatgaaaagctg

SEQ ID NO: 9375711 - DNA, 22 bp, Homo sapiens
tattgtatcttaccacatgtat

SEQ ID NO: 9375712 - DNA, 22 bp, Homo sapiens
tatttcaagaacttctatccat

SEQ ID NO: 9375713 - DNA, 22 bp, Homo sapiens
tatttcaccttactaagctgtg

SEQ ID NO: 9375714 - DNA, 22 bp, Homo sapiens
tatttcactccgagactctatg

SEQ ID NO: 9375715 - DNA, 22 bp, Homo sapiens
tatttcactcagtataccatag

SEQ ID NO: 9375716 - DNA, 21 bp, Homo sapiens
tatttcagaagagtctcagag

SEQ ID NO: 9375717 - DNA, 22 bp, Homo sapiens
tatttcagacactgatcttgca

SEQ ID NO: 9375718 - DNA, 22 bp, Homo sapiens
tatttcagagttgttttctgtc

SEQ ID NO: 9375719 - DNA, 22 bp, Homo sapiens
tatttcagctctttggattatc

SEQ ID NO: 9375720 - DNA, 19 bp, Homo sapiens
tatttcaggctcagagtct

SEQ ID NO: 9375721 - DNA, 22 bp, Homo sapiens
tattgggtaaagatccagtttt

SEQ ID NO: 9375722 - DNA, 22 bp, Homo sapiens
tattggtagatggagagagaca

SEQ ID NO: 9375723 - DNA, 22 bp, Homo sapiens
tattggtaggactcagctgaga

SEQ ID NO: 9375724 - DNA, 22 bp, Homo sapiens
tattgcatcttagtgtaagtca

SEQ ID NO: 9375725 - DNA, 22 bp, Homo sapiens
tattggtatggtaagaattgaa

SEQ ID NO: 9375726 - DNA, 19 bp, Homo sapiens
tattggtatgtgtgaggca

SEQ ID NO: 9375727 - DNA, 22 bp, Homo sapiens
tattggtcaagttgaggaccct

SEQ ID NO: 9375728 - DNA, 22 bp, Homo sapiens
tattggtcaatttcaccttgat

SEQ ID NO: 9375729 - DNA, 22 bp, Homo sapiens
tattggtatctgagacagagtt

SEQ ID NO: 9375730 - DNA, 22 bp, Homo sapiens
tattggtgatgacttgaggcca

SEQ ID NO: 9375731 - DNA, 22 bp, Homo sapiens
tattgtacatttcaaagtagct

SEQ ID NO: 9375732 - DNA, 22 bp, Homo sapiens
tattgtacatttcaaagtagct

SEQ ID NO: 9375733 - DNA, 22 bp, Homo sapiens
tattgtacatttcaaagtagct

SEQ ID NO: 9375734 - DNA, 22 bp, Homo sapiens
tattgtacatggttatgcagga

SEQ ID NO: 9375735 - DNA, 22 bp, Homo sapiens
tattgtacatggttatgcagga

SEQ ID NO: 9375736 - DNA, 22 bp, Homo sapiens
tattgtacagagagagaggttt

SEQ ID NO: 9375737 - DNA, 22 bp, Homo sapiens
tattggtttattgtgtatgaga

SEQ ID NO: 9375738 - DNA, 22 bp, Homo sapiens
tattggtgtacttatagcagag

SEQ ID NO: 9375739 - DNA, 22 bp, Homo sapiens
tattggtgggggcagagagaga

SEQ ID NO: 9375740 - DNA, 22 bp, Homo sapiens
tattgcagaagaaatgaatgaa

SEQ ID NO: 9375741 - DNA, 22 bp, Homo sapiens
tattgattcctgctttctgctc

SEQ ID NO: 9375742 - DNA, 21 bp, Homo sapiens
tattgattcaatttcttgagt

SEQ ID NO: 9375743 - DNA, 21 bp, Homo sapiens
tattgattcaatttcttgagt

SEQ ID NO: 9375744 - DNA, 22 bp, Homo sapiens
tattgcatattattctagtggc

SEQ ID NO: 9375745 - DNA, 22 bp, Homo sapiens
tattgcatccccattgtgcccc

SEQ ID NO: 9375746 - DNA, 22 bp, Homo sapiens
tatttgttgagttgttatgtct

SEQ ID NO: 9375747 - DNA, 22 bp, Homo sapiens
tatttgttccagagataaaaat

SEQ ID NO: 9375748 - DNA, 22 bp, Homo sapiens
tatttgttccagagataaaaat

SEQ ID NO: 9375749 - DNA, 22 bp, Homo sapiens
tatttgtatttcatgcagtaaa

SEQ ID NO: 9375750 - DNA, 22 bp, Homo sapiens
tatttgtatttcatgcagtaaa

SEQ ID NO: 9375751 - DNA, 22 bp, Homo sapiens
tattttcatcttgtccttggat

SEQ ID NO: 9375752 - DNA, 22 bp, Homo sapiens
tattttcatcttgtccttggat

SEQ ID NO: 9375753 - DNA, 22 bp, Homo sapiens
tattttcattctgtgtgactgt

SEQ ID NO: 9375754 - DNA, 22 bp, Homo sapiens
tattttcaccttctctggatat

SEQ ID NO: 9375755 - DNA, 22 bp, Homo sapiens
tattttcaccatgtatccctgt

SEQ ID NO: 9375756 - DNA, 22 bp, Homo sapiens
tatttccaggccccactctaga

SEQ ID NO: 9375757 - DNA, 22 bp, Homo sapiens
tatttccatgttagaactaagt

SEQ ID NO: 9375758 - DNA, 22 bp, Homo sapiens
tatttccagcagtaagaagaca

SEQ ID NO: 9375759 - DNA, 22 bp, Homo sapiens
tatttccagatgaggttacatt

SEQ ID NO: 9375760 - DNA, 22 bp, Homo sapiens
tatttccttgagacggagtctc

SEQ ID NO: 9375761 - DNA, 22 bp, Homo sapiens
tatttcctgtggatacttttag

SEQ ID NO: 9375762 - DNA, 22 bp, Homo sapiens
tatttcccagggagcaacaagc

SEQ ID NO: 9375763 - DNA, 22 bp, Homo sapiens
tatttcctgcatggtgatgtaa

SEQ ID NO: 9375764 - DNA, 22 bp, Homo sapiens
tatttctaagagatatctgtac

SEQ ID NO: 9375765 - DNA, 22 bp, Homo sapiens
tatttctaagagatatctgtac

SEQ ID NO: 9375766 - DNA, 22 bp, Homo sapiens
tatttctaagagatatctgtac

SEQ ID NO: 9375767 - DNA, 22 bp, Homo sapiens
tatttctaagagatatctgtac

SEQ ID NO: 9375768 - DNA, 22 bp, Homo sapiens
tatttctaagctgtaagtctga

SEQ ID NO: 9375769 - DNA, 22 bp, Homo sapiens
tatttctaagagatatctgtac

SEQ ID NO: 9375770 - DNA, 22 bp, Homo sapiens
tatttctaagctgtaagtctga

SEQ ID NO: 9375771 - DNA, 22 bp, Homo sapiens
tatttctaagctgtaagtctga

SEQ ID NO: 9375772 - DNA, 22 bp, Homo sapiens
tatttgtatgtgtgtacatata

SEQ ID NO: 9375773 - DNA, 22 bp, Homo sapiens
tatttgtatgtgtgtacatata

SEQ ID NO: 9375774 - DNA, 22 bp, Homo sapiens
tatttgtatgtgtgtacatata

SEQ ID NO: 9375775 - DNA, 22 bp, Homo sapiens
tatttgtatttcatgcagtaaa

SEQ ID NO: 9375776 - DNA, 22 bp, Homo sapiens
tatttgtatgtgtgtacatata

SEQ ID NO: 9375777 - DNA, 22 bp, Homo sapiens
tattgagaaccctcaggaggca

SEQ ID NO: 9375778 - DNA, 22 bp, Homo sapiens
tattgacttttaaagtgatata

SEQ ID NO: 9375779 - DNA, 22 bp, Homo sapiens
tattgagacttccagtatatga

SEQ ID NO: 9375780 - DNA, 22 bp, Homo sapiens
tattgagacttccagtatatga

SEQ ID NO: 9375781 - DNA, 22 bp, Homo sapiens
tattcatagtaaacaaaagtgg

SEQ ID NO: 9375782 - DNA, 22 bp, Homo sapiens
tattcagagggttgaattttta

SEQ ID NO: 9375783 - DNA, 22 bp, Homo sapiens
tattcacagttgatttacagtt

SEQ ID NO: 9375784 - DNA, 22 bp, Homo sapiens
tattcacagttgatttacagtt

SEQ ID NO: 9375785 - DNA, 22 bp, Homo sapiens
tattcacaggctggagtgatgt

SEQ ID NO: 9375786 - DNA, 22 bp, Homo sapiens
tattcacaggctggagtgatgt

SEQ ID NO: 9375787 - DNA, 22 bp, Homo sapiens
tattcacaggcacgaaatattg

SEQ ID NO: 9375788 - DNA, 22 bp, Homo sapiens
tatgtttatactttgatgtact

SEQ ID NO: 9375789 - DNA, 22 bp, Homo sapiens
tatgtttatactttgatgtact

SEQ ID NO: 9375790 - DNA, 22 bp, Homo sapiens
tatgtttagtatccattttcag

SEQ ID NO: 9375791 - DNA, 22 bp, Homo sapiens
tatgtttatactttgatgtact

SEQ ID NO: 9375792 - DNA, 17 bp, Homo sapiens
tatgtgtgtgtttatac

SEQ ID NO: 9375793 - DNA, 17 bp, Homo sapiens
tatgtgtgtgtttatac

SEQ ID NO: 9375794 - DNA, 19 bp, Homo sapiens
tatgtgtgtgtatttacat

SEQ ID NO: 9375795 - DNA, 19 bp, Homo sapiens
tatgtgtgtgtatttacat

SEQ ID NO: 9375796 - DNA, 22 bp, Homo sapiens
tatgctgtgctagatacaatat

SEQ ID NO: 9375797 - DNA, 22 bp, Homo sapiens
tatgtgttgtatatgtgcagag

SEQ ID NO: 9375798 - DNA, 22 bp, Homo sapiens
tatgtgttatttggtatacatt

SEQ ID NO: 9375799 - DNA, 22 bp, Homo sapiens
tatgtgttatttggtatacatt

SEQ ID NO: 9375800 - DNA, 22 bp, Homo sapiens
tatgtgttatttggtatacatt

SEQ ID NO: 9375801 - DNA, 22 bp, Homo sapiens
tatgtgtttgacaccctgcaag

SEQ ID NO: 9375802 - DNA, 22 bp, Homo sapiens
tatgttaaatgtttgatgttta

SEQ ID NO: 9375803 - DNA, 22 bp, Homo sapiens
tatgcctgataactgtgtctct

SEQ ID NO: 9375804 - DNA, 22 bp, Homo sapiens
tatgcctacctccaaaatatat

SEQ ID NO: 9375805 - DNA, 22 bp, Homo sapiens
tatgcccttacaatgagcacaa

SEQ ID NO: 9375806 - DNA, 22 bp, Homo sapiens
tatgctaagataaacagagtta

SEQ ID NO: 9375807 - DNA, 22 bp, Homo sapiens
tatgctccaaagacatgttgcc

SEQ ID NO: 9375808 - DNA, 22 bp, Homo sapiens
tatgctctcctcccagtcccag

SEQ ID NO: 9375809 - DNA, 22 bp, Homo sapiens
tatgtttaaatgtatgtgtatg

SEQ ID NO: 9375810 - DNA, 22 bp, Homo sapiens
tatgtttaaatgtatgtgtatg

SEQ ID NO: 9375811 - DNA, 22 bp, Homo sapiens
tatgtttaaatgtatgtgtatg

SEQ ID NO: 9375812 - DNA, 22 bp, Homo sapiens
tatgttctgactctacatggga

SEQ ID NO: 9375813 - DNA, 22 bp, Homo sapiens
tatgttctgtctgtacagattt

SEQ ID NO: 9375814 - DNA, 22 bp, Homo sapiens
tatgttgagcattcagtgatct

SEQ ID NO: 9375815 - DNA, 22 bp, Homo sapiens
tatgttgaaattctgaccttca

SEQ ID NO: 9375816 - DNA, 22 bp, Homo sapiens
tatgttcatctggtgcatcagt

SEQ ID NO: 9375817 - DNA, 22 bp, Homo sapiens
tatgttattttcatacaacaga

SEQ ID NO: 9375818 - DNA, 22 bp, Homo sapiens
tatgttaagtgggataatcaaa

SEQ ID NO: 9375819 - DNA, 22 bp, Homo sapiens
tatgttaagtgggataatcaaa

SEQ ID NO: 9375820 - DNA, 22 bp, Homo sapiens
tatgttacaaagtttttctaaa

SEQ ID NO: 9375821 - DNA, 22 bp, Homo sapiens
tatgttacaaagtttttctaaa

SEQ ID NO: 9375822 - DNA, 22 bp, Homo sapiens
tatgttaagtgggataatcaaa

SEQ ID NO: 9375823 - DNA, 22 bp, Homo sapiens
tatgttattttcatacaacaga

SEQ ID NO: 9375824 - DNA, 19 bp, Homo sapiens
tatgttatgttgtttactc

SEQ ID NO: 9375825 - DNA, 19 bp, Homo sapiens
tatgttatgttgtttactc

SEQ ID NO: 9375826 - DNA, 19 bp, Homo sapiens
tatgttatgttgtttactc

SEQ ID NO: 9375827 - DNA, 22 bp, Homo sapiens
tatgttactcacatgttcttgc

SEQ ID NO: 9375828 - DNA, 22 bp, Homo sapiens
tatgttatattttgtcaattgt

SEQ ID NO: 9375829 - DNA, 22 bp, Homo sapiens
taggaaggtccatgtcttatct

SEQ ID NO: 9375830 - DNA, 22 bp, Homo sapiens
taggaaggtgtttttaaggagc

SEQ ID NO: 9375831 - DNA, 22 bp, Homo sapiens
taggaaggtccatgtcttatct

SEQ ID NO: 9375832 - DNA, 22 bp, Homo sapiens
taggaagggctcagggctcggt

SEQ ID NO: 9375833 - DNA, 22 bp, Homo sapiens
taggaaggcctgtcactacttg

SEQ ID NO: 9375834 - DNA, 22 bp, Homo sapiens
taggaagggaaaggcttcaact

SEQ ID NO: 9375835 - DNA, 22 bp, Homo sapiens
taggaaggcctgtcactacttg

SEQ ID NO: 9375836 - DNA, 22 bp, Homo sapiens
taggaaggcctgtcactacttg

SEQ ID NO: 9375837 - DNA, 22 bp, Homo sapiens
taggaatgatgtatttttctct

SEQ ID NO: 9375838 - DNA, 22 bp, Homo sapiens
taggaatgatgtatttttctct

SEQ ID NO: 9375839 - DNA, 22 bp, Homo sapiens
taggaatgattggaattccagg

SEQ ID NO: 9375840 - DNA, 22 bp, Homo sapiens
taggaatgagagggtgaggatt

SEQ ID NO: 9375841 - DNA, 22 bp, Homo sapiens
taggaatgagagggtgaggatt

SEQ ID NO: 9375842 - DNA, 22 bp, Homo sapiens
taggaatgataatagtaaagag

SEQ ID NO: 9375843 - DNA, 22 bp, Homo sapiens
taggaatgataatagtaaagag

SEQ ID NO: 9375844 - DNA, 22 bp, Homo sapiens
taggaatgagaaagaattagat

SEQ ID NO: 9375845 - DNA, 22 bp, Homo sapiens
taggaatgagaaagaattagat

SEQ ID NO: 9375846 - DNA, 22 bp, Homo sapiens
taggaatgaaggataaggtgtg

SEQ ID NO: 9375847 - DNA, 22 bp, Homo sapiens
taggaatgaaggataaggtgtg

SEQ ID NO: 9375848 - DNA, 22 bp, Homo sapiens
taggaatgaagaagtatgatat

SEQ ID NO: 9375849 - DNA, 22 bp, Homo sapiens
taggaatgaagaagtatgatat

SEQ ID NO: 9375850 - DNA, 22 bp, Homo sapiens
taggaatgaaagtgttttgaaa

SEQ ID NO: 9375851 - DNA, 22 bp, Homo sapiens
taggaatgaaagtgttttgaaa

SEQ ID NO: 9375852 - DNA, 22 bp, Homo sapiens
taggaatgaaaatggccataga

SEQ ID NO: 9375853 - DNA, 22 bp, Homo sapiens
taggaatgaaaatggccataga

SEQ ID NO: 9375854 - DNA, 22 bp, Homo sapiens
taggaatgtctatgcagtgagg

SEQ ID NO: 9375855 - DNA, 22 bp, Homo sapiens
taggaatgtctatgcagtgagg

SEQ ID NO: 9375856 - DNA, 22 bp, Homo sapiens
taggaatgtggcaggcagaaca

SEQ ID NO: 9375857 - DNA, 22 bp, Homo sapiens
taggaatgtggcaggcagaaca

SEQ ID NO: 9375858 - DNA, 22 bp, Homo sapiens
taggaatgtttttatcaactta

SEQ ID NO: 9375859 - DNA, 22 bp, Homo sapiens
taggaatgtttttatcaactta

SEQ ID NO: 9375860 - DNA, 22 bp, Homo sapiens
taggaattatgatgctatcaag

SEQ ID NO: 9375861 - DNA, 22 bp, Homo sapiens
taggacagagttccctgatggc

SEQ ID NO: 9375862 - DNA, 22 bp, Homo sapiens
taggaatgtaatctctgttatg

SEQ ID NO: 9375863 - DNA, 22 bp, Homo sapiens
taggaatgtaatctctgttatg

SEQ ID NO: 9375864 - DNA, 19 bp, Homo sapiens
taggaatgtagaatcctag

SEQ ID NO: 9375865 - DNA, 19 bp, Homo sapiens
taggaatgtagaatcctag

SEQ ID NO: 9375866 - DNA, 22 bp, Homo sapiens
taggaatgggcaagacaaagaa

SEQ ID NO: 9375867 - DNA, 22 bp, Homo sapiens
taggaatgggctatcccaagct

SEQ ID NO: 9375868 - DNA, 22 bp, Homo sapiens
taggaatggtgctcagcagaaa

SEQ ID NO: 9375869 - DNA, 22 bp, Homo sapiens
taggaatgggctatcccaagct

SEQ ID NO: 9375870 - DNA, 22 bp, Homo sapiens
taggaatggtgctcagcagaaa

SEQ ID NO: 9375871 - DNA, 22 bp, Homo sapiens
taggaatgattggaattccagg

SEQ ID NO: 9375872 - DNA, 22 bp, Homo sapiens
taggaatgcagatgcataataa

SEQ ID NO: 9375873 - DNA, 22 bp, Homo sapiens
taggaatgcatgggggattctg

SEQ ID NO: 9375874 - DNA, 22 bp, Homo sapiens
taggaatgcagtgagacacaga

SEQ ID NO: 9375875 - DNA, 22 bp, Homo sapiens
taggaatgcagatgcataataa

SEQ ID NO: 9375876 - DNA, 22 bp, Homo sapiens
taggaatgcagtgagacacaga

SEQ ID NO: 9375877 - DNA, 22 bp, Homo sapiens
taggaatggaacactttgattt

SEQ ID NO: 9375878 - DNA, 22 bp, Homo sapiens
taggaatgcatgggggattctg

SEQ ID NO: 9375879 - DNA, 22 bp, Homo sapiens
taggaatggcagcagccggggg

SEQ ID NO: 9375880 - DNA, 22 bp, Homo sapiens
taggaatggaacactttgattt

SEQ ID NO: 9375881 - DNA, 22 bp, Homo sapiens
taggaatggcagcagccggggg

SEQ ID NO: 9375882 - DNA, 22 bp, Homo sapiens
taggaatgggcaagacaaagaa

SEQ ID NO: 9375883 - DNA, 23 bp, Homo sapiens
taggcctccctggagcacccagc

SEQ ID NO: 9375884 - DNA, 22 bp, Homo sapiens
taggcctggatctctgggagca

SEQ ID NO: 9375885 - DNA, 22 bp, Homo sapiens
taggcctcaggaccccagggct

SEQ ID NO: 9375886 - DNA, 19 bp, Homo sapiens
taggccctagctctgcagt

SEQ ID NO: 9375887 - DNA, 22 bp, Homo sapiens
taggcccctagtgccacgtggc

SEQ ID NO: 9375888 - DNA, 22 bp, Homo sapiens
taggctccaagagcgaactcag

SEQ ID NO: 9375889 - DNA, 22 bp, Homo sapiens
taggctcattaagtccccaggg

SEQ ID NO: 9375890 - DNA, 22 bp, Homo sapiens
taggctcagtgagtagggagtt

SEQ ID NO: 9375891 - DNA, 22 bp, Homo sapiens
taggctcagtgagtagggagtt

SEQ ID NO: 9375892 - DNA, 22 bp, Homo sapiens
taggctcccagatcgtttgctg

SEQ ID NO: 9375893 - DNA, 22 bp, Homo sapiens
taggctccagtgtgtggcgagt

SEQ ID NO: 9375894 - DNA, 22 bp, Homo sapiens
taggctcctctcacattctatt

SEQ ID NO: 9375895 - DNA, 22 bp, Homo sapiens
taggctcctgaggactccatgc

SEQ ID NO: 9375896 - DNA, 22 bp, Homo sapiens
taggctcctgagtccacagcac

SEQ ID NO: 9375897 - DNA, 23 bp, Homo sapiens
taggctctgtaggtagagatggg

SEQ ID NO: 9375898 - DNA, 22 bp, Homo sapiens
taggctcagggctgggtgacgg

SEQ ID NO: 9375899 - DNA, 22 bp, Homo sapiens
taggctcagaaggcactgaaaa

SEQ ID NO: 9375900 - DNA, 22 bp, Homo sapiens
taggctaggctgaaggttttgg

SEQ ID NO: 9375901 - DNA, 22 bp, Homo sapiens
taggaaagaaatgagtagtgat

SEQ ID NO: 9375902 - DNA, 22 bp, Homo sapiens
taggaaagaaatgagtagtgat

SEQ ID NO: 9375903 - DNA, 22 bp, Homo sapiens
taggaaactctcagctggtcat

SEQ ID NO: 9375904 - DNA, 22 bp, Homo sapiens
taggaaactcaaagggaagtgg

SEQ ID NO: 9375905 - DNA, 22 bp, Homo sapiens
taggaaactcaaagggaagtgg

SEQ ID NO: 9375906 - DNA, 22 bp, Homo sapiens
tagcccagcatgagcagagctg

SEQ ID NO: 9375907 - DNA, 22 bp, Homo sapiens
taggaaagcagtagagccagga

SEQ ID NO: 9375908 - DNA, 22 bp, Homo sapiens
taggaaagcagtagagccagga

SEQ ID NO: 9375909 - DNA, 22 bp, Homo sapiens
taggaaggaagagcctcagatt

SEQ ID NO: 9375910 - DNA, 22 bp, Homo sapiens
taggaaggaggccatcttggcg

SEQ ID NO: 9375911 - DNA, 22 bp, Homo sapiens
taggctggaggaagcagtgcct

SEQ ID NO: 9375912 - DNA, 22 bp, Homo sapiens
taggctggaggaagcagtgcct

SEQ ID NO: 9375913 - DNA, 22 bp, Homo sapiens
taggctggaggaagcagtgcct

SEQ ID NO: 9375914 - DNA, 22 bp, Homo sapiens
taggctgggaagaaagattctc

SEQ ID NO: 9375915 - DNA, 22 bp, Homo sapiens
taggctggaacttaggcagagg

SEQ ID NO: 9375916 - DNA, 22 bp, Homo sapiens
taggctggaacttaggcagagg

SEQ ID NO: 9375917 - DNA, 22 bp, Homo sapiens
taggctggaggaagcagtgcct

SEQ ID NO: 9375918 - DNA, 22 bp, Homo sapiens
taggctggaacttaggcagagg

SEQ ID NO: 9375919 - DNA, 22 bp, Homo sapiens
taggctggaacttaggcagagg

SEQ ID NO: 9375920 - DNA, 22 bp, Homo sapiens
taggctgctcaccaggctcaga

SEQ ID NO: 9375921 - DNA, 22 bp, Homo sapiens
taggctgagctaagagagctta

SEQ ID NO: 9375922 - DNA, 22 bp, Homo sapiens
taggctgagctaagagagctta

SEQ ID NO: 9375923 - DNA, 22 bp, Homo sapiens
taggctgggaagaaagattctc

SEQ ID NO: 9375924 - DNA, 22 bp, Homo sapiens
taggctgggagcctgaggctag

SEQ ID NO: 9375925 - DNA, 22 bp, Homo sapiens
taggctgggagcctgaggctag

SEQ ID NO: 9375926 - DNA, 20 bp, Homo sapiens
taggtgtctttgccagcttt

SEQ ID NO: 9375927 - DNA, 18 bp, Homo sapiens
taggttacagccagccag

SEQ ID NO: 9375928 - DNA, 20 bp, Homo sapiens
taggtgtctttgccagcttt

SEQ ID NO: 9375929 - DNA, 22 bp, Homo sapiens
taggtgtgggctcaggaatgtg

SEQ ID NO: 9375930 - DNA, 22 bp, Homo sapiens
taggctgggagcctgaggctag

SEQ ID NO: 9375931 - DNA, 22 bp, Homo sapiens
taggtttactgaattagtggaa

SEQ ID NO: 9375932 - DNA, 22 bp, Homo sapiens
taggtttactgaattagtggaa

SEQ ID NO: 9375933 - DNA, 22 bp, Homo sapiens
taggtttaggagtgaaggtgaa

SEQ ID NO: 9375934 - DNA, 22 bp, Homo sapiens
taggtttcagaggtgccgggaa

SEQ ID NO: 9375935 - DNA, 22 bp, Homo sapiens
taggtttactgaattagtggaa

SEQ ID NO: 9375936 - DNA, 22 bp, Homo sapiens
taggtttaggagtgaaggtgaa

SEQ ID NO: 9375937 - DNA, 22 bp, Homo sapiens
taggttttcctaaaattctggt

SEQ ID NO: 9375938 - DNA, 22 bp, Homo sapiens
taggtttcagaggtgccgggaa

SEQ ID NO: 9375939 - DNA, 22 bp, Homo sapiens
tagtaaaaagcaatggtgagta

SEQ ID NO: 9375940 - DNA, 22 bp, Homo sapiens
tagtaaaaggtcttcctttgtt

SEQ ID NO: 9375941 - DNA, 22 bp, Homo sapiens
tagtaaaaagcaatggtgagta

SEQ ID NO: 9375942 - DNA, 22 bp, Homo sapiens
tagtaaaaggtcttcctttgtt

SEQ ID NO: 9375943 - DNA, 22 bp, Homo sapiens
tagtaaaagtttagttgaaagt

SEQ ID NO: 9375944 - DNA, 22 bp, Homo sapiens
tagtagcaacaagaaacaaata

SEQ ID NO: 9375945 - DNA, 22 bp, Homo sapiens
tagtatatctttagtacatagt

SEQ ID NO: 9375946 - DNA, 22 bp, Homo sapiens
tagtatatctttagtacatagt

SEQ ID NO: 9375947 - DNA, 22 bp, Homo sapiens
tagtatatgtctatggttgtag

SEQ ID NO: 9375948 - DNA, 22 bp, Homo sapiens
tagtatagattgaagcagatca

SEQ ID NO: 9375949 - DNA, 22 bp, Homo sapiens
tagtataattgttctggaatca

SEQ ID NO: 9375950 - DNA, 22 bp, Homo sapiens
tagtcaactagtgagcatatgg

SEQ ID NO: 9375951 - DNA, 22 bp, Homo sapiens
tagtattttagaaaaccatgaa

SEQ ID NO: 9375952 - DNA, 20 bp, Homo sapiens
tagtatttgcataaggatag

SEQ ID NO: 9375953 - DNA, 20 bp, Homo sapiens
tagtatttgcataaggatag

SEQ ID NO: 9375954 - DNA, 22 bp, Homo sapiens
tagtattttagaaaaccatgaa

SEQ ID NO: 9375955 - DNA, 22 bp, Homo sapiens
tagtatgttgtctgatgttacc

SEQ ID NO: 9375956 - DNA, 22 bp, Homo sapiens
tagtatgtcttactctaataca

SEQ ID NO: 9375957 - DNA, 22 bp, Homo sapiens
tagtatttataatcatgcttaa

SEQ ID NO: 9375958 - DNA, 22 bp, Homo sapiens
tagtatttcctgtaagctatag

SEQ ID NO: 9375959 - DNA, 22 bp, Homo sapiens
tagtcacagtacaggataaaga

SEQ ID NO: 9375960 - DNA, 22 bp, Homo sapiens
tagtcaccagctacaggacagc

SEQ ID NO: 9375961 - DNA, 22 bp, Homo sapiens
tagtcacctttggcacctgcaa

SEQ ID NO: 9375962 - DNA, 22 bp, Homo sapiens
tagtcacttttttaccatgtgc

SEQ ID NO: 9375963 - DNA, 22 bp, Homo sapiens
tagtcagagtcttctctgttgt

SEQ ID NO: 9375964 - DNA, 22 bp, Homo sapiens
tagtcattctccttacaaagcc

SEQ ID NO: 9375965 - DNA, 22 bp, Homo sapiens
tagtgggtttatacaatttaaa

SEQ ID NO: 9375966 - DNA, 22 bp, Homo sapiens
tagtgggttaactagaagttaa

SEQ ID NO: 9375967 - DNA, 22 bp, Homo sapiens
tagtgtaatgacatttagacga

SEQ ID NO: 9375968 - DNA, 22 bp, Homo sapiens
tagtgtatgataaaaaattctt

SEQ ID NO: 9375969 - DNA, 22 bp, Homo sapiens
tagtgtatctgttcttttatct

SEQ ID NO: 9375970 - DNA, 23 bp, Homo sapiens
tagtgtatatcaacatttgtccc

SEQ ID NO: 9375971 - DNA, 23 bp, Homo sapiens
tagtgtatatcaacatttgtccc

SEQ ID NO: 9375972 - DNA, 22 bp, Homo sapiens
tagtgggtcttataattttagg

SEQ ID NO: 9375973 - DNA, 22 bp, Homo sapiens
tagtgggtgatttgatgaggaa

SEQ ID NO: 9375974 - DNA, 22 bp, Homo sapiens
tagtgggtgatttgatgaggaa

SEQ ID NO: 9375975 - DNA, 22 bp, Homo sapiens
tagtgggtggaggccagggatg

SEQ ID NO: 9375976 - DNA, 22 bp, Homo sapiens
tagtgggtagaggccagggacg

SEQ ID NO: 9375977 - DNA, 22 bp, Homo sapiens
tagtggggcctgggagggttcc

SEQ ID NO: 9375978 - DNA, 19 bp, Homo sapiens
tagtggagtgacaagttct

SEQ ID NO: 9375979 - DNA, 22 bp, Homo sapiens
tagtggatgttcagagatttga

SEQ ID NO: 9375980 - DNA, 19 bp, Homo sapiens
tagtggagtgacaagttct

SEQ ID NO: 9375981 - DNA, 22 bp, Homo sapiens
tagtggctgcttcattggtgag

SEQ ID NO: 9375982 - DNA, 17 bp, Homo sapiens
tagtggcaggaaatgaa

SEQ ID NO: 9375983 - DNA, 22 bp, Homo sapiens
tagtggcattgttgtgaggatt

SEQ ID NO: 9375984 - DNA, 17 bp, Homo sapiens
tagtggcaggaaatgaa

SEQ ID NO: 9375985 - DNA, 22 bp, Homo sapiens
tagtggcaaaagcattttgggt

SEQ ID NO: 9375986 - DNA, 22 bp, Homo sapiens
tagtccatgttgatatcctcat

SEQ ID NO: 9375987 - DNA, 22 bp, Homo sapiens
tagtcccattttgaggtatttg

SEQ ID NO: 9375988 - DNA, 22 bp, Homo sapiens
tagtcctcagctgaactgctgc

SEQ ID NO: 9375989 - DNA, 22 bp, Homo sapiens
tagaggcaccctggaggagact

SEQ ID NO: 9375990 - DNA, 22 bp, Homo sapiens
tagatgaccttgtgttaggcaa

SEQ ID NO: 9375991 - DNA, 22 bp, Homo sapiens
tagaggagcggcgagctgagct

SEQ ID NO: 9375992 - DNA, 22 bp, Homo sapiens
tagaggagcggcgagctgagct

SEQ ID NO: 9375993 - DNA, 22 bp, Homo sapiens
tagaggagagttgctggatgga

SEQ ID NO: 9375994 - DNA, 22 bp, Homo sapiens
tagaggagcggcgagctgagct

SEQ ID NO: 9375995 - DNA, 22 bp, Homo sapiens
tagaggagcggcgagctgagct

SEQ ID NO: 9375996 - DNA, 22 bp, Homo sapiens
tagaggagagttgctggatgga

SEQ ID NO: 9375997 - DNA, 22 bp, Homo sapiens
tagaggcacagtctatgtagag

SEQ ID NO: 9375998 - DNA, 22 bp, Homo sapiens
tagaggagggctgttcttcagt

SEQ ID NO: 9375999 - DNA, 23 bp, Homo sapiens
tagagcagtagatcaccatggga

SEQ ID NO: 9376000 - DNA, 22 bp, Homo sapiens
tagagcagtgttgtccatcaga

SEQ ID NO: 9376001 - DNA, 22 bp, Homo sapiens
tagagcagtgggtaccatggca

SEQ ID NO: 9376002 - DNA, 22 bp, Homo sapiens
tagagctactggcagcctcttc

SEQ ID NO: 9376003 - DNA, 22 bp, Homo sapiens
tagagatgccctagctgaagta

SEQ ID NO: 9376004 - DNA, 22 bp, Homo sapiens
tagagaggtttgaattggctgc

SEQ ID NO: 9376005 - DNA, 22 bp, Homo sapiens
tagagatgtgatatagcagagt

SEQ ID NO: 9376006 - DNA, 22 bp, Homo sapiens
tagagcagccttcagagcagtt

SEQ ID NO: 9376007 - DNA, 22 bp, Homo sapiens
tagagcagatagtgaaacagaa

SEQ ID NO: 9376008 - DNA, 22 bp, Homo sapiens
tagagcagccttcagagcagtt

SEQ ID NO: 9376009 - DNA, 22 bp, Homo sapiens
tactttctgtccttctgttaaa

SEQ ID NO: 9376010 - DNA, 19 bp, Homo sapiens
tagaagcactaggcaaact

SEQ ID NO: 9376011 - DNA, 19 bp, Homo sapiens
tagaagcactaggcaaact

SEQ ID NO: 9376012 - DNA, 22 bp, Homo sapiens
tagaagcagaaggaaggtggct

SEQ ID NO: 9376013 - DNA, 22 bp, Homo sapiens
tagaagcagcaggactcatggt

SEQ ID NO: 9376014 - DNA, 22 bp, Homo sapiens
tagaagcagcaggagtaaaggc

SEQ ID NO: 9376015 - DNA, 22 bp, Homo sapiens
tagaagcagcaggactcatggt

SEQ ID NO: 9376016 - DNA, 22 bp, Homo sapiens
tagaagcagcaggagtaaaggc

SEQ ID NO: 9376017 - DNA, 22 bp, Homo sapiens
tactttcatgtctatacatatt

SEQ ID NO: 9376018 - DNA, 22 bp, Homo sapiens
tactttctaagacatacaactt

SEQ ID NO: 9376019 - DNA, 22 bp, Homo sapiens
tactttctaagacatacaactt

SEQ ID NO: 9376020 - DNA, 22 bp, Homo sapiens
tacttggtctgggcagggggtt

SEQ ID NO: 9376021 - DNA, 22 bp, Homo sapiens
tacttggtttagtttggaggga

SEQ ID NO: 9376022 - DNA, 22 bp, Homo sapiens
tactttattgtaaatgctgatg

SEQ ID NO: 9376023 - DNA, 22 bp, Homo sapiens
tactttattgtaaatgctgatg

SEQ ID NO: 9376024 - DNA, 23 bp, Homo sapiens
tagaatcctctgagatggaatag

SEQ ID NO: 9376025 - DNA, 22 bp, Homo sapiens
tagaatcattgagaataacagg

SEQ ID NO: 9376026 - DNA, 22 bp, Homo sapiens
tagaatcagaagatttgactgt

SEQ ID NO: 9376027 - DNA, 22 bp, Homo sapiens
tagaagtgtctgtgaaatatac

SEQ ID NO: 9376028 - DNA, 22 bp, Homo sapiens
tagaagtgggaatataaaatat

SEQ ID NO: 9376029 - DNA, 22 bp, Homo sapiens
tagaagtggcaacactcagaaa

SEQ ID NO: 9376030 - DNA, 22 bp, Homo sapiens
tagaagtggcaacactcagaaa

SEQ ID NO: 9376031 - DNA, 22 bp, Homo sapiens
tagaagttaggaaataggaata

SEQ ID NO: 9376032 - DNA, 22 bp, Homo sapiens
tagaagttatgataataatagt

SEQ ID NO: 9376033 - DNA, 22 bp, Homo sapiens
tagaagttcatgcgaattattt

SEQ ID NO: 9376034 - DNA, 22 bp, Homo sapiens
tagaagtggattgaagtttgga

SEQ ID NO: 9376035 - DNA, 22 bp, Homo sapiens
tagaagctcaggaataggcata

SEQ ID NO: 9376036 - DNA, 22 bp, Homo sapiens
tagaagcagtaatagaaatagg

SEQ ID NO: 9376037 - DNA, 22 bp, Homo sapiens
tagaagcagtaatagaaatagg

SEQ ID NO: 9376038 - DNA, 22 bp, Homo sapiens
tagaaggaggactggcagtgtt

SEQ ID NO: 9376039 - DNA, 18 bp, Homo sapiens
tagcacagagcaggatgt

SEQ ID NO: 9376040 - DNA, 21 bp, Homo sapiens
tagcacagctgtagacagttt

SEQ ID NO: 9376041 - DNA, 22 bp, Homo sapiens
tagcacaggtcttgttgccatt

SEQ ID NO: 9376042 - DNA, 22 bp, Homo sapiens
tagcaaaaactgcagttacttt

SEQ ID NO: 9376043 - DNA, 22 bp, Homo sapiens
tagcacacactgcatctacaaa

SEQ ID NO: 9376044 - DNA, 22 bp, Homo sapiens
tagcacaagcaactactgaagt

SEQ ID NO: 9376045 - DNA, 22 bp, Homo sapiens
tagattttaggagattttactg

SEQ ID NO: 9376046 - DNA, 22 bp, Homo sapiens
tagattttaggagattttactg

SEQ ID NO: 9376047 - DNA, 22 bp, Homo sapiens
tagattatccctgatttgtcca

SEQ ID NO: 9376048 - DNA, 22 bp, Homo sapiens
tagattttacttctgtcattac

SEQ ID NO: 9376049 - DNA, 22 bp, Homo sapiens
tagattaagatgccagttttga

SEQ ID NO: 9376050 - DNA, 22 bp, Homo sapiens
tagattaacagttttgttgaag

SEQ ID NO: 9376051 - DNA, 18 bp, Homo sapiens
tagattaaaattgaattc

SEQ ID NO: 9376052 - DNA, 20 bp, Homo sapiens
tagatgtttcctgtcataaa

SEQ ID NO: 9376053 - DNA, 22 bp, Homo sapiens
tagatgttttgatatttgctga

SEQ ID NO: 9376054 - DNA, 22 bp, Homo sapiens
tagatgttgaagtcatatttgg

SEQ ID NO: 9376055 - DNA, 22 bp, Homo sapiens
tagatggctttctgaggtattt

SEQ ID NO: 9376056 - DNA, 22 bp, Homo sapiens
tagatggctggtgttctgagct

SEQ ID NO: 9376057 - DNA, 22 bp, Homo sapiens
tagatggcgtccatggccgcag

SEQ ID NO: 9376058 - DNA, 18 bp, Homo sapiens
tagatggcagtctgcaga

SEQ ID NO: 9376059 - DNA, 22 bp, Homo sapiens
tagatggcaccttctgtgtgtc

SEQ ID NO: 9376060 - DNA, 22 bp, Homo sapiens
tagatgtgttgcctggagttgt

SEQ ID NO: 9376061 - DNA, 22 bp, Homo sapiens
tagatgtgttgcctggagttgt

SEQ ID NO: 9376062 - DNA, 22 bp, Homo sapiens
tagcacattgttgaccagaagg

SEQ ID NO: 9376063 - DNA, 22 bp, Homo sapiens
tagcacatctggcgcttatagg

SEQ ID NO: 9376064 - DNA, 22 bp, Homo sapiens
tagcacatcttcttggcctgca

SEQ ID NO: 9376065 - DNA, 22 bp, Homo sapiens
tagcacagttcctgactctttg

SEQ ID NO: 9376066 - DNA, 22 bp, Homo sapiens
tagcacatacataatagataga

SEQ ID NO: 9376067 - DNA, 22 bp, Homo sapiens
tagcacttgtgttatgccttgt

SEQ ID NO: 9376068 - DNA, 21 bp, Homo sapiens
tagcacttcgctgtaattggg

SEQ ID NO: 9376069 - DNA, 22 bp, Homo sapiens
tagcacttgtgttatgccttgt

SEQ ID NO: 9376070 - DNA, 22 bp, Homo sapiens
tagcactccattatgatgtggc

SEQ ID NO: 9376071 - DNA, 21 bp, Homo sapiens
tagcacttcgctgtaattggg

SEQ ID NO: 9376072 - DNA, 22 bp, Homo sapiens
tagcagggttttgaagagggtt

SEQ ID NO: 9376073 - DNA, 22 bp, Homo sapiens
tagcagggttttgaagagggtt

SEQ ID NO: 9376074 - DNA, 22 bp, Homo sapiens
tagcatttcactgatcttcact

SEQ ID NO: 9376075 - DNA, 22 bp, Homo sapiens
tagccaccagaaaggttttcag

SEQ ID NO: 9376076 - DNA, 22 bp, Homo sapiens
tagcattttagctgttttctct

SEQ ID NO: 9376077 - DNA, 22 bp, Homo sapiens
tagcatttggacattgtcacct

SEQ ID NO: 9376078 - DNA, 22 bp, Homo sapiens
tagcatttcccaaatgcatttg

SEQ ID NO: 9376079 - DNA, 23 bp, Homo sapiens
tagccagtcattccagcaaggcc

SEQ ID NO: 9376080 - DNA, 22 bp, Homo sapiens
tagccaggctggaagcaaaagg

SEQ ID NO: 9376081 - DNA, 22 bp, Homo sapiens
tagccagttgcccagagtagaa

SEQ ID NO: 9376082 - DNA, 22 bp, Homo sapiens
tagccagtgggacggtgctgca

SEQ ID NO: 9376083 - DNA, 22 bp, Homo sapiens
tagccagtgccatgggactgat

SEQ ID NO: 9376084 - DNA, 23 bp, Homo sapiens
tagccaggcccagcatggacacc

SEQ ID NO: 9376085 - DNA, 22 bp, Homo sapiens
tagccaggcaattatgggtgat

SEQ ID NO: 9376086 - DNA, 22 bp, Homo sapiens
tagccaggcgaggtcagtgtcg

SEQ ID NO: 9376087 - DNA, 19 bp, Homo sapiens
ccttgtctggtgaaggact

SEQ ID NO: 9376088 - DNA, 22 bp, Homo sapiens
cctttaaagactgcataacttc

SEQ ID NO: 9376089 - DNA, 22 bp, Homo sapiens
ccttgttttggaaccaaaggat

SEQ ID NO: 9376090 - DNA, 22 bp, Homo sapiens
cctttaaatggatgttcaactg

SEQ ID NO: 9376091 - DNA, 22 bp, Homo sapiens
ccttgggttccaagtcactgaa

SEQ ID NO: 9376092 - DNA, 22 bp, Homo sapiens
ccttgggtgtttaatagatata

SEQ ID NO: 9376093 - DNA, 22 bp, Homo sapiens
ccttggggtgttggaggcagcc

SEQ ID NO: 9376094 - DNA, 22 bp, Homo sapiens
ccttggggaatatccattcttc

SEQ ID NO: 9376095 - DNA, 22 bp, Homo sapiens
ccttggtgatctgggctggaag

SEQ ID NO: 9376096 - DNA, 22 bp, Homo sapiens
ccttggtccctccccagaccaa

SEQ ID NO: 9376097 - DNA, 22 bp, Homo sapiens
ccttggtgctctgctgggatgg

SEQ ID NO: 9376098 - DNA, 22 bp, Homo sapiens
ccttggtgatctgggctggaag

SEQ ID NO: 9376099 - DNA, 22 bp, Homo sapiens
ttatctacgtatttaaactctt

SEQ ID NO: 9376100 - DNA, 22 bp, Homo sapiens
cctttaatttacaatgttaatt

SEQ ID NO: 9376101 - DNA, 22 bp, Homo sapiens
cctttacaaagttcttcatggg

SEQ ID NO: 9376102 - DNA, 21 bp, Homo sapiens
cctttacaattttgcattcct

SEQ ID NO: 9376103 - DNA, 21 bp, Homo sapiens
cctttacaattttgcattcct

SEQ ID NO: 9376104 - DNA, 22 bp, Homo sapiens
cctttacacgtaaggctgttga

SEQ ID NO: 9376105 - DNA, 22 bp, Homo sapiens
cctttacacatggaatgggtct

SEQ ID NO: 9376106 - DNA, 22 bp, Homo sapiens
ttatccactttagtttcagtat

SEQ ID NO: 9376107 - DNA, 22 bp, Homo sapiens
cctttacagtagcccttttgaa

SEQ ID NO: 9376108 - DNA, 22 bp, Homo sapiens
ttacgagtttgcaattttaaat

SEQ ID NO: 9376109 - DNA, 22 bp, Homo sapiens
ttacctggtgtttatggtccat

SEQ ID NO: 9376110 - DNA, 19 bp, Homo sapiens
ccttgcctgtccctgcagc

SEQ ID NO: 9376111 - DNA, 19 bp, Homo sapiens
ccttgcctgtccctgcagc

SEQ ID NO: 9376112 - DNA, 22 bp, Homo sapiens
ccttggcttgtgggctgcagcc

SEQ ID NO: 9376113 - DNA, 22 bp, Homo sapiens
ccttgggaccctgctggaggtt

SEQ ID NO: 9376114 - DNA, 22 bp, Homo sapiens
ccttgggaccctgctggaggtt

SEQ ID NO: 9376115 - DNA, 22 bp, Homo sapiens
ccttgggagaaattgcagagtc

SEQ ID NO: 9376116 - DNA, 22 bp, Homo sapiens
ccttgggaggcataattacttg

SEQ ID NO: 9376117 - DNA, 22 bp, Homo sapiens
ccttgggatgcataagagccca

SEQ ID NO: 9376118 - DNA, 21 bp, Homo sapiens
ccttgggatgcaagtgagact

SEQ ID NO: 9376119 - DNA, 22 bp, Homo sapiens
ccttgggcttgggcatagcttt

SEQ ID NO: 9376120 - DNA, 22 bp, Homo sapiens
ccttgggcttgggcatagcttt

SEQ ID NO: 9376121 - DNA, 22 bp, Homo sapiens
ttacaatgacaggtgtatcatt

SEQ ID NO: 9376122 - DNA, 22 bp, Homo sapiens
ttacagaagagtaacttggcaa

SEQ ID NO: 9376123 - DNA, 21 bp, Homo sapiens
ccttctcttgcttcagcttca

SEQ ID NO: 9376124 - DNA, 21 bp, Homo sapiens
ccttctcttgcttcagcttca

SEQ ID NO: 9376125 - DNA, 21 bp, Homo sapiens
ccttctccacagggtctccgg

SEQ ID NO: 9376126 - DNA, 21 bp, Homo sapiens
ccttctccacagggtctccgg

SEQ ID NO: 9376127 - DNA, 20 bp, Homo sapiens
ccttctctggaattgcctcc

SEQ ID NO: 9376128 - DNA, 21 bp, Homo sapiens
ccttctccacagggtctccgg

SEQ ID NO: 9376129 - DNA, 23 bp, Homo sapiens
ccttctgttaaccatctgggggg

SEQ ID NO: 9376130 - DNA, 22 bp, Homo sapiens
ccttcttcaccagtttacctga

SEQ ID NO: 9376131 - DNA, 22 bp, Homo sapiens
ccttctgtctccctcatattga

SEQ ID NO: 9376132 - DNA, 22 bp, Homo sapiens
ccttctgtgtgcccacgtttat

SEQ ID NO: 9376133 - DNA, 22 bp, Homo sapiens
ccttctgggccaacttccagga

SEQ ID NO: 9376134 - DNA, 22 bp, Homo sapiens
ccttctgctccctggccagggc

SEQ ID NO: 9376135 - DNA, 22 bp, Homo sapiens
ccttctgctggtcatcccagtg

SEQ ID NO: 9376136 - DNA, 22 bp, Homo sapiens
ccttctggagggtgtacgagag

SEQ ID NO: 9376137 - DNA, 22 bp, Homo sapiens
ccttctggatgtgctaaggaag

SEQ ID NO: 9376138 - DNA, 22 bp, Homo sapiens
ccttctggaagctctaagggag

SEQ ID NO: 9376139 - DNA, 22 bp, Homo sapiens
ccttctgataactgtgaaattg

SEQ ID NO: 9376140 - DNA, 22 bp, Homo sapiens
ccttctgagcttcaatttcagt

SEQ ID NO: 9376141 - DNA, 22 bp, Homo sapiens
ttaccacctgtatcacattttt

SEQ ID NO: 9376142 - DNA, 22 bp, Homo sapiens
ttaccagtggtacacatgacct

SEQ ID NO: 9376143 - DNA, 22 bp, Homo sapiens
ttaccagttttgccatttgcta

SEQ ID NO: 9376144 - DNA, 22 bp, Homo sapiens
ttaccaagctctgcatgttaag

SEQ ID NO: 9376145 - DNA, 22 bp, Homo sapiens
ttacccagtgtggtttatagca

SEQ ID NO: 9376146 - DNA, 22 bp, Homo sapiens
ttacctctagctctttgcttgt

SEQ ID NO: 9376147 - DNA, 22 bp, Homo sapiens
cctttctgatggcctcccagcc

SEQ ID NO: 9376148 - DNA, 22 bp, Homo sapiens
cctttctgatggcctcccagcc

SEQ ID NO: 9376149 - DNA, 22 bp, Homo sapiens
cctttcttgctaagagtttatg

SEQ ID NO: 9376150 - DNA, 17 bp, Homo sapiens
cctttcttcccagaggg

SEQ ID NO: 9376151 - DNA, 17 bp, Homo sapiens
cctttcttcccagaggg

SEQ ID NO: 9376152 - DNA, 22 bp, Homo sapiens
ttatgtatgaatatagtagaag

SEQ ID NO: 9376153 - DNA, 22 bp, Homo sapiens
ttatgtatgaatatagtagaag

SEQ ID NO: 9376154 - DNA, 22 bp, Homo sapiens
ttatgtatggatggctgaaagt

SEQ ID NO: 9376155 - DNA, 21 bp, Homo sapiens
cctttgagtgtgtttgaagta

SEQ ID NO: 9376156 - DNA, 22 bp, Homo sapiens
cctttcttttatccaccagcca

SEQ ID NO: 9376157 - DNA, 22 bp, Homo sapiens
cctttcttttatccaccagcca

SEQ ID NO: 9376158 - DNA, 22 bp, Homo sapiens
cctttcttgctaagagtttatg

SEQ ID NO: 9376159 - DNA, 22 bp, Homo sapiens
cctttcttttatccaccagcca

SEQ ID NO: 9376160 - DNA, 22 bp, Homo sapiens
ttatgggagcaattggggaggt

SEQ ID NO: 9376161 - DNA, 22 bp, Homo sapiens
ttatgggagcaattggggaggt

SEQ ID NO: 9376162 - DNA, 22 bp, Homo sapiens
ttatgtacctgaattagtaaag

SEQ ID NO: 9376163 - DNA, 22 bp, Homo sapiens
ttatgtacctgaattagtaaag

SEQ ID NO: 9376164 - DNA, 22 bp, Homo sapiens
ttatgtacctgaattagtaaag

SEQ ID NO: 9376165 - DNA, 22 bp, Homo sapiens
ttatgtacaatgttaatgtaaa

SEQ ID NO: 9376166 - DNA, 22 bp, Homo sapiens
ttatgtacaatgttaatgtaaa

SEQ ID NO: 9376167 - DNA, 22 bp, Homo sapiens
ttatgtactctgcaatgtttga

SEQ ID NO: 9376168 - DNA, 22 bp, Homo sapiens
ttatgtactctgcaatgtttga

SEQ ID NO: 9376169 - DNA, 22 bp, Homo sapiens
ttatgtactctgcaatgtttga

SEQ ID NO: 9376170 - DNA, 22 bp, Homo sapiens
cgagtccagggttaggagtccg

SEQ ID NO: 9376171 - DNA, 22 bp, Homo sapiens
cgaggtgatggcatttagactc

SEQ ID NO: 9376172 - DNA, 22 bp, Homo sapiens
cgatggagaggtcctgatagtt

SEQ ID NO: 9376173 - DNA, 22 bp, Homo sapiens
cgatggaattggaaagaggaat

SEQ ID NO: 9376174 - DNA, 22 bp, Homo sapiens
cgcaccactgaattccagcctg

SEQ ID NO: 9376175 - DNA, 22 bp, Homo sapiens
cgcaaggtcaggtcccggcggg

SEQ ID NO: 9376176 - DNA, 22 bp, Homo sapiens
cgcaacctgacagagccacgtc

SEQ ID NO: 9376177 - DNA, 17 bp, Homo sapiens
cgagggcttgctggctc

SEQ ID NO: 9376178 - DNA, 22 bp, Homo sapiens
cgagggctgtgttgctctcctt

SEQ ID NO: 9376179 - DNA, 17 bp, Homo sapiens
cgagggcttgctggctc

SEQ ID NO: 9376180 - DNA, 22 bp, Homo sapiens
cgaggtgactttggtttagaca

SEQ ID NO: 9376181 - DNA, 21 bp, Homo sapiens
cgaggtgagctcttggctcag

SEQ ID NO: 9376182 - DNA, 22 bp, Homo sapiens
cgcagagggcaggcagtgctgg

SEQ ID NO: 9376183 - DNA, 22 bp, Homo sapiens
cgcagagggcaggcagtgctgg

SEQ ID NO: 9376184 - DNA, 21 bp, Homo sapiens
cgcagagcgaacttgcggcgc

SEQ ID NO: 9376185 - DNA, 21 bp, Homo sapiens
cgcagagcgaacttgcggcgc

SEQ ID NO: 9376186 - DNA, 21 bp, Homo sapiens
cgcagagcgaacttgcggcgc

SEQ ID NO: 9376187 - DNA, 22 bp, Homo sapiens
cgcagaagaggttgtctagtcc

SEQ ID NO: 9376188 - DNA, 22 bp, Homo sapiens
ttatttttaaaagttcacacag

SEQ ID NO: 9376189 - DNA, 22 bp, Homo sapiens
ttatttttaaaagttcacacag

SEQ ID NO: 9376190 - DNA, 22 bp, Homo sapiens
ttatttttaaaagttcacacag

SEQ ID NO: 9376191 - DNA, 22 bp, Homo sapiens
ttatttttaaaagttcacacag

SEQ ID NO: 9376192 - DNA, 22 bp, Homo sapiens
ttatttttaaaagttcacacag

SEQ ID NO: 9376193 - DNA, 22 bp, Homo sapiens
ttcaaaaaggtatgttcaagtc

SEQ ID NO: 9376194 - DNA, 17 bp, Homo sapiens
ttattttttgggctgag

SEQ ID NO: 9376195 - DNA, 17 bp, Homo sapiens
ttattttttgggctgag

SEQ ID NO: 9376196 - DNA, 22 bp, Homo sapiens
ttattcactcatttaacattat

SEQ ID NO: 9376197 - DNA, 22 bp, Homo sapiens
ttattcactcatttaacattat

SEQ ID NO: 9376198 - DNA, 22 bp, Homo sapiens
ttattcacctctattagactca

SEQ ID NO: 9376199 - DNA, 22 bp, Homo sapiens
ttattcaccgcaggtgcttccc

SEQ ID NO: 9376200 - DNA, 22 bp, Homo sapiens
ttattcacctctattagactca

SEQ ID NO: 9376201 - DNA, 22 bp, Homo sapiens
ttatttttaaaagttcacacag

SEQ ID NO: 9376202 - DNA, 22 bp, Homo sapiens
ttatttcatgtaaaatttatgt

SEQ ID NO: 9376203 - DNA, 23 bp, Homo sapiens
ttattttgtcagaagggactttt

SEQ ID NO: 9376204 - DNA, 23 bp, Homo sapiens
ttattttgtcagaagggactttt

SEQ ID NO: 9376205 - DNA, 22 bp, Homo sapiens
ttattcaccagtgtaaaacact

SEQ ID NO: 9376206 - DNA, 22 bp, Homo sapiens
ttattattttgtgtacagcaaa

SEQ ID NO: 9376207 - DNA, 22 bp, Homo sapiens
ttattattttgtgtacagcaaa

SEQ ID NO: 9376208 - DNA, 22 bp, Homo sapiens
ttattattttgtgtacagcaaa

SEQ ID NO: 9376209 - DNA, 22 bp, Homo sapiens
ttattattgtggttgcattatc

SEQ ID NO: 9376210 - DNA, 22 bp, Homo sapiens
ttattattgtggttgcattatc

SEQ ID NO: 9376211 - DNA, 22 bp, Homo sapiens
ttattattgtgacctgagaatg

SEQ ID NO: 9376212 - DNA, 22 bp, Homo sapiens
ttattattgtgacctgagaatg

SEQ ID NO: 9376213 - DNA, 22 bp, Homo sapiens
cgcaccactgaattccagcctg

SEQ ID NO: 9376214 - DNA, 22 bp, Homo sapiens
ttattattgtgacctgagaatg

SEQ ID NO: 9376215 - DNA, 21 bp, Homo sapiens
tgttttccaccttgaggcaag

SEQ ID NO: 9376216 - DNA, 22 bp, Homo sapiens
tgttttcagtcatatagcaggt

SEQ ID NO: 9376217 - DNA, 22 bp, Homo sapiens
tgttttcatcacagaatgtaac

SEQ ID NO: 9376218 - DNA, 22 bp, Homo sapiens
tgttttcatggttatgtgtcta

SEQ ID NO: 9376219 - DNA, 22 bp, Homo sapiens
tgtttcttctcacacaaactca

SEQ ID NO: 9376220 - DNA, 19 bp, Homo sapiens
tgtttcttcctccatctga

SEQ ID NO: 9376221 - DNA, 22 bp, Homo sapiens
tgtttcttctcacacaaactca

SEQ ID NO: 9376222 - DNA, 22 bp, Homo sapiens
tgtttcttatccaagtggtctg

SEQ ID NO: 9376223 - DNA, 22 bp, Homo sapiens
tgtttcttatccaagtggtctg

SEQ ID NO: 9376224 - DNA, 22 bp, Homo sapiens
tgtttcttatccaagtggtctg

SEQ ID NO: 9376225 - DNA, 22 bp, Homo sapiens
tgtttctgtatgatcaatattg

SEQ ID NO: 9376226 - DNA, 22 bp, Homo sapiens
cctggggagccgcctgagcccc

SEQ ID NO: 9376227 - DNA, 22 bp, Homo sapiens
cctggggagagaaagcccagcc

SEQ ID NO: 9376228 - DNA, 23 bp, Homo sapiens
cctggggcacttgagtcctcatc

SEQ ID NO: 9376229 - DNA, 23 bp, Homo sapiens
cctggggcacttgagtcctcatc

SEQ ID NO: 9376230 - DNA, 22 bp, Homo sapiens
tgtttatacctgcaacctgtca

SEQ ID NO: 9376231 - DNA, 22 bp, Homo sapiens
tgtttataccttggtataacca

SEQ ID NO: 9376232 - DNA, 22 bp, Homo sapiens
tgtttctaggtcaataattttt

SEQ ID NO: 9376233 - DNA, 22 bp, Homo sapiens
tgtttataatatgcagtgagca

SEQ ID NO: 9376234 - DNA, 22 bp, Homo sapiens
cctggggctcaagatggcgccg

SEQ ID NO: 9376235 - DNA, 22 bp, Homo sapiens
cctggggctcaagatggcgccg

SEQ ID NO: 9376236 - DNA, 23 bp, Homo sapiens
cctggggcacttgagtcctcatc

SEQ ID NO: 9376237 - DNA, 22 bp, Homo sapiens
cctggggccccgagccagaagc

SEQ ID NO: 9376238 - DNA, 22 bp, Homo sapiens
cctggggccccgagccagaagc

SEQ ID NO: 9376239 - DNA, 22 bp, Homo sapiens
cctgctcctatctgggctcatt

SEQ ID NO: 9376240 - DNA, 22 bp, Homo sapiens
cctgctcctatctgggctcatt

SEQ ID NO: 9376241 - DNA, 22 bp, Homo sapiens
cctgctcctgctattcttctgg

SEQ ID NO: 9376242 - DNA, 22 bp, Homo sapiens
cctgctcccgggacgcgttcac

SEQ ID NO: 9376243 - DNA, 22 bp, Homo sapiens
cctgctcccgggacgcgttcac

SEQ ID NO: 9376244 - DNA, 22 bp, Homo sapiens
tgttcccacaccagcctcagcc

SEQ ID NO: 9376245 - DNA, 22 bp, Homo sapiens
tgttccatgtctttgtaggact

SEQ ID NO: 9376246 - DNA, 22 bp, Homo sapiens
tgttgcagaatctcaaaacagt

SEQ ID NO: 9376247 - DNA, 22 bp, Homo sapiens
tgttgattagtgtttagactta

SEQ ID NO: 9376248 - DNA, 20 bp, Homo sapiens
tgttgattggtgtcatctca

SEQ ID NO: 9376249 - DNA, 22 bp, Homo sapiens
tgttggcatctctgagagagtt

SEQ ID NO: 9376250 - DNA, 22 bp, Homo sapiens
tgttggaattaggatacagagg

SEQ ID NO: 9376251 - DNA, 22 bp, Homo sapiens
tgttggatgaccttgtaattat

SEQ ID NO: 9376252 - DNA, 22 bp, Homo sapiens
tgttggaataagtgcttgaagg

SEQ ID NO: 9376253 - DNA, 22 bp, Homo sapiens
tgttggaaggcaagcagcaatt

SEQ ID NO: 9376254 - DNA, 19 bp, Homo sapiens
tgttgccaggtatcatgtt

SEQ ID NO: 9376255 - DNA, 22 bp, Homo sapiens
tgttgcccaggttctctcctgc

SEQ ID NO: 9376256 - DNA, 22 bp, Homo sapiens
tgttgcccaggttctctcctgc

SEQ ID NO: 9376257 - DNA, 22 bp, Homo sapiens
tgttgcctgactttaaaatgtg

SEQ ID NO: 9376258 - DNA, 22 bp, Homo sapiens
tgttgctcttttttaggtgagt

SEQ ID NO: 9376259 - DNA, 22 bp, Homo sapiens
cctgctcatgggtccctggcag

SEQ ID NO: 9376260 - DNA, 22 bp, Homo sapiens
cctgctccatgctcaccatcag

SEQ ID NO: 9376261 - DNA, 23 bp, Homo sapiens
cctgctcaggcgtgtgccctgct

SEQ ID NO: 9376262 - DNA, 22 bp, Homo sapiens
cctgctcagctgtcctcacgct

SEQ ID NO: 9376263 - DNA, 22 bp, Homo sapiens
cctgctcagagcgtcttgtgtg

SEQ ID NO: 9376264 - DNA, 22 bp, Homo sapiens
cctgctcagagcgtcttgtgtg

SEQ ID NO: 9376265 - DNA, 22 bp, Homo sapiens
cctgctcagctgtcctcacgct

SEQ ID NO: 9376266 - DNA, 22 bp, Homo sapiens
cctgctcagccccagctcaccc

SEQ ID NO: 9376267 - DNA, 22 bp, Homo sapiens
cctgcgggctgtgctgaagcct

SEQ ID NO: 9376268 - DNA, 22 bp, Homo sapiens
cctgctcacctgatgtggcaac

SEQ ID NO: 9376269 - DNA, 22 bp, Homo sapiens
cctgccttctaaagcgcccgcc

SEQ ID NO: 9376270 - DNA, 22 bp, Homo sapiens
cctgccttgacgtaacgcatga

SEQ ID NO: 9376271 - DNA, 22 bp, Homo sapiens
cctgccttctaaagcgcccgcc

SEQ ID NO: 9376272 - DNA, 22 bp, Homo sapiens
cctgcctttctcagtaatcttt

SEQ ID NO: 9376273 - DNA, 22 bp, Homo sapiens
cctgcgcgtctgggtctgtctc

SEQ ID NO: 9376274 - DNA, 22 bp, Homo sapiens
tggttcctcaagcgctggcggc

SEQ ID NO: 9376275 - DNA, 22 bp, Homo sapiens
tggttcccttaacagctgtata

SEQ ID NO: 9376276 - DNA, 22 bp, Homo sapiens
cctgccttcccagcttggcttt

SEQ ID NO: 9376277 - DNA, 23 bp, Homo sapiens
cctgtggcaagtagatgagatga

SEQ ID NO: 9376278 - DNA, 22 bp, Homo sapiens
cctgtggccgcgtcgggcggcg

SEQ ID NO: 9376279 - DNA, 21 bp, Homo sapiens
cctgtggattttaaaattgga

SEQ ID NO: 9376280 - DNA, 22 bp, Homo sapiens
ttaatgccaacaaagtgatttt

SEQ ID NO: 9376281 - DNA, 22 bp, Homo sapiens
cctgtggaccaggaggcagccc

SEQ ID NO: 9376282 - DNA, 22 bp, Homo sapiens
cctgtggaccaggaggcagccc

SEQ ID NO: 9376283 - DNA, 22 bp, Homo sapiens
ttaatcttcagggactcttgct

SEQ ID NO: 9376284 - DNA, 22 bp, Homo sapiens
ttaatgaaaggcagtttggaac

SEQ ID NO: 9376285 - DNA, 22 bp, Homo sapiens
ttaatgatacctatgttaattt

SEQ ID NO: 9376286 - DNA, 22 bp, Homo sapiens
ttaatgacctggaagaagtgat

SEQ ID NO: 9376287 - DNA, 22 bp, Homo sapiens
ttaatcttatatgtaaaggtaa

SEQ ID NO: 9376288 - DNA, 22 bp, Homo sapiens
ttaatcttatattgttgggacc

SEQ ID NO: 9376289 - DNA, 22 bp, Homo sapiens
ttaatcttatatgtaaaggtaa

SEQ ID NO: 9376290 - DNA, 22 bp, Homo sapiens
ttaatccatggcagttattaaa

SEQ ID NO: 9376291 - DNA, 22 bp, Homo sapiens
ttaatccaatatcctggctatt

SEQ ID NO: 9376292 - DNA, 22 bp, Homo sapiens
ttaatccaataacaaggttcaa

SEQ ID NO: 9376293 - DNA, 20 bp, Homo sapiens
ttacaagtttctaataacca

SEQ ID NO: 9376294 - DNA, 20 bp, Homo sapiens
ttacaagtttctaataacca

SEQ ID NO: 9376295 - DNA, 22 bp, Homo sapiens
ttacaagtttctggcttcatcc

SEQ ID NO: 9376296 - DNA, 22 bp, Homo sapiens
ttacaagtttctggcttcatcc

SEQ ID NO: 9376297 - DNA, 22 bp, Homo sapiens
ttacaagttttcatgaaattga

SEQ ID NO: 9376298 - DNA, 22 bp, Homo sapiens
ttacaagtgtcaggtactggca

SEQ ID NO: 9376299 - DNA, 22 bp, Homo sapiens
ttacaagtgtcaggtactggca

SEQ ID NO: 9376300 - DNA, 22 bp, Homo sapiens
ttacaagttcagattttctcat

SEQ ID NO: 9376301 - DNA, 23 bp, Homo sapiens
ttacaagttctgaaatttccttc

SEQ ID NO: 9376302 - DNA, 23 bp, Homo sapiens
ttacaagttctgaaatttccttc

SEQ ID NO: 9376303 - DNA, 22 bp, Homo sapiens
ttacaagttttcatgaaattga

SEQ ID NO: 9376304 - DNA, 22 bp, Homo sapiens
ttacaataccacatcacctcat

SEQ ID NO: 9376305 - DNA, 22 bp, Homo sapiens
ttacaatagttccttcttttgt

SEQ ID NO: 9376306 - DNA, 22 bp, Homo sapiens
cctgtggctgccacttgggtga

SEQ ID NO: 9376307 - DNA, 22 bp, Homo sapiens
ttacaagtatttaagatgctgt

SEQ ID NO: 9376308 - DNA, 22 bp, Homo sapiens
ttacaagtgtcaggcgctggca

SEQ ID NO: 9376309 - DNA, 22 bp, Homo sapiens
ttacaagtatttaagatgctgt

SEQ ID NO: 9376310 - DNA, 22 bp, Homo sapiens
ttacaagtatttaagatgctgt

SEQ ID NO: 9376311 - DNA, 22 bp, Homo sapiens
ttacaagtactgaatatgattt

SEQ ID NO: 9376312 - DNA, 22 bp, Homo sapiens
ttacaagtactgaatatgattt

SEQ ID NO: 9376313 - DNA, 22 bp, Homo sapiens
ttacaagtactgaatatgattt

SEQ ID NO: 9376314 - DNA, 22 bp, Homo sapiens
cctgtggctggtcaggccagca

SEQ ID NO: 9376315 - DNA, 22 bp, Homo sapiens
ttaaaatctaaagcagttgtct

SEQ ID NO: 9376316 - DNA, 22 bp, Homo sapiens
ttaaaatcgctgttgcttctgt

SEQ ID NO: 9376317 - DNA, 22 bp, Homo sapiens
ttaaaatcgctgttgcttctgt

SEQ ID NO: 9376318 - DNA, 22 bp, Homo sapiens
ttaaaatctaaagcagttgtct

SEQ ID NO: 9376319 - DNA, 22 bp, Homo sapiens
ttaaaatccagtgttggtggat

SEQ ID NO: 9376320 - DNA, 22 bp, Homo sapiens
ttaaaatcacagtcacccagta

SEQ ID NO: 9376321 - DNA, 22 bp, Homo sapiens
ttaaaatagccagtgcccctct

SEQ ID NO: 9376322 - DNA, 22 bp, Homo sapiens
cctggtttgggtgccagtgagt

SEQ ID NO: 9376323 - DNA, 22 bp, Homo sapiens
cctggtttgggtgccagtgagt

SEQ ID NO: 9376324 - DNA, 22 bp, Homo sapiens
ttaaaatgaatattgattagca

SEQ ID NO: 9376325 - DNA, 22 bp, Homo sapiens
ttaaaagtctgatgatttacat

SEQ ID NO: 9376326 - DNA, 22 bp, Homo sapiens
ttaaaatagccagtgcccctct

SEQ ID NO: 9376327 - DNA, 22 bp, Homo sapiens
tgttttctcttgaaaagcagtc

SEQ ID NO: 9376328 - DNA, 22 bp, Homo sapiens
tgttttctattacctgagattg

SEQ ID NO: 9376329 - DNA, 22 bp, Homo sapiens
tgttttctagaaacaatgccta

SEQ ID NO: 9376330 - DNA, 22 bp, Homo sapiens
cctgtacaagctcttggtgaca

SEQ ID NO: 9376331 - DNA, 22 bp, Homo sapiens
cctgtacaagagccatctggat

SEQ ID NO: 9376332 - DNA, 22 bp, Homo sapiens
cctgtacagtgaatgaatgtga

SEQ ID NO: 9376333 - DNA, 22 bp, Homo sapiens
cctgtacattagctgtgaattg

SEQ ID NO: 9376334 - DNA, 22 bp, Homo sapiens
cctgtaccgcgatctgctgcgc

SEQ ID NO: 9376335 - DNA, 21 bp, Homo sapiens
cctgtaccactgtaagatgcc

SEQ ID NO: 9376336 - DNA, 22 bp, Homo sapiens
cctgtaccattttccctagtct

SEQ ID NO: 9376337 - DNA, 22 bp, Homo sapiens
cctgtattggaagcagtaggga

SEQ ID NO: 9376338 - DNA, 22 bp, Homo sapiens
cctgtcacgatgactgcactct

SEQ ID NO: 9376339 - DNA, 22 bp, Homo sapiens
cctgtcacctaggtactgagca

SEQ ID NO: 9376340 - DNA, 22 bp, Homo sapiens
ttaatatgttgaaatttattag

SEQ ID NO: 9376341 - DNA, 22 bp, Homo sapiens
ttaatatgttgaaatttattag

SEQ ID NO: 9376342 - DNA, 22 bp, Homo sapiens
ttaataggcttctaacatagct

SEQ ID NO: 9376343 - DNA, 22 bp, Homo sapiens
ttccagaaaaaaatgtatatct

SEQ ID NO: 9376344 - DNA, 22 bp, Homo sapiens
ttccagaaaacgctttatttag

SEQ ID NO: 9376345 - DNA, 22 bp, Homo sapiens
ttccacttttctctctcatgcc

SEQ ID NO: 9376346 - DNA, 21 bp, Homo sapiens
ttccagaaatctctttcttca

SEQ ID NO: 9376347 - DNA, 22 bp, Homo sapiens
ttccagaaagttctggaactgg

SEQ ID NO: 9376348 - DNA, 22 bp, Homo sapiens
ttccagaaacctgaaagtttct

SEQ ID NO: 9376349 - DNA, 22 bp, Homo sapiens
ttccagaaaactctgcctggta

SEQ ID NO: 9376350 - DNA, 22 bp, Homo sapiens
ttccactctccagtcaatttca

SEQ ID NO: 9376351 - DNA, 19 bp, Homo sapiens
ttccacttgggttagaatt

SEQ ID NO: 9376352 - DNA, 22 bp, Homo sapiens
ttccactttgggtctgtgcagg

SEQ ID NO: 9376353 - DNA, 22 bp, Homo sapiens
ttccacttagtggaagggcatg

SEQ ID NO: 9376354 - DNA, 22 bp, Homo sapiens
cgtcatcacggcaagcatctcc

SEQ ID NO: 9376355 - DNA, 22 bp, Homo sapiens
cgtcagtttactgttgccatgg

SEQ ID NO: 9376356 - DNA, 22 bp, Homo sapiens
cgtccaggaagatcggccgatg

SEQ ID NO: 9376357 - DNA, 22 bp, Homo sapiens
cgtcccagttccagccgcgctg

SEQ ID NO: 9376358 - DNA, 22 bp, Homo sapiens
cgtcccctcgttcccactttgg

SEQ ID NO: 9376359 - DNA, 20 bp, Homo sapiens
cgtccccttgagcaggtccc

SEQ ID NO: 9376360 - DNA, 22 bp, Homo sapiens
cgtccatattcatgagctgagt

SEQ ID NO: 9376361 - DNA, 22 bp, Homo sapiens
cgtccatattcctgagggctca

SEQ ID NO: 9376362 - DNA, 22 bp, Homo sapiens
cgtcctcagaggccatccgaaa

SEQ ID NO: 9376363 - DNA, 22 bp, Homo sapiens
cgtcccgggttcacgccattct

SEQ ID NO: 9376364 - DNA, 22 bp, Homo sapiens
cgtcctgggtctgggaaggcat

SEQ ID NO: 9376365 - DNA, 22 bp, Homo sapiens
cgtcctgggtctgggaaggcat

SEQ ID NO: 9376366 - DNA, 22 bp, Homo sapiens
cgtccttgcaagatctgtacaa

SEQ ID NO: 9376367 - DNA, 22 bp, Homo sapiens
cgtctctccgcaggggccttca

SEQ ID NO: 9376368 - DNA, 22 bp, Homo sapiens
cgtctaggccgtgccctgaggt

SEQ ID NO: 9376369 - DNA, 22 bp, Homo sapiens
cgtctggacgggaaggagaagt

SEQ ID NO: 9376370 - DNA, 22 bp, Homo sapiens
ttcctaaaagctgagtagagaa

SEQ ID NO: 9376371 - DNA, 22 bp, Homo sapiens
ttcctaacaaacttcagtgaat

SEQ ID NO: 9376372 - DNA, 22 bp, Homo sapiens
ttcctccagcctggagcacttc

SEQ ID NO: 9376373 - DNA, 22 bp, Homo sapiens
cgtgaaatgagttgaattattg

SEQ ID NO: 9376374 - DNA, 22 bp, Homo sapiens
ttcctcctacgcttatcacttt

SEQ ID NO: 9376375 - DNA, 22 bp, Homo sapiens
ttcctccctgcccacattgtgc

SEQ ID NO: 9376376 - DNA, 21 bp, Homo sapiens
ttcctcctctggagaagaaga

SEQ ID NO: 9376377 - DNA, 17 bp, Homo sapiens
ttcctcctcaccatgtt

SEQ ID NO: 9376378 - DNA, 17 bp, Homo sapiens
ttcctcctcaccatgtt

SEQ ID NO: 9376379 - DNA, 22 bp, Homo sapiens
ttcctctcgctctccggggccc

SEQ ID NO: 9376380 - DNA, 22 bp, Homo sapiens
ttcctctctcttgccagaatgt

SEQ ID NO: 9376381 - DNA, 22 bp, Homo sapiens
ttcctctgaaatggcttggaaa

SEQ ID NO: 9376382 - DNA, 22 bp, Homo sapiens
ttcctctgaaatggcttggaaa

SEQ ID NO: 9376383 - DNA, 22 bp, Homo sapiens
ctaaatgatggatttaaacttt

SEQ ID NO: 9376384 - DNA, 22 bp, Homo sapiens
ttcctctcaacatgcctgccgg

SEQ ID NO: 9376385 - DNA, 22 bp, Homo sapiens
ttcctctcaacatgcctgccgg

SEQ ID NO: 9376386 - DNA, 22 bp, Homo sapiens
ttcctccttgtcctagttactg

SEQ ID NO: 9376387 - DNA, 22 bp, Homo sapiens
cggctgggttcggctgcaggcc

SEQ ID NO: 9376388 - DNA, 22 bp, Homo sapiens
cggctggtgtcgggcacagcaa

SEQ ID NO: 9376389 - DNA, 22 bp, Homo sapiens
cggctggtgtcgggcacagcaa

SEQ ID NO: 9376390 - DNA, 22 bp, Homo sapiens
cgggaaggtggaggttgcagtg

SEQ ID NO: 9376391 - DNA, 22 bp, Homo sapiens
cgggaaggtggaggttgcagtg

SEQ ID NO: 9376392 - DNA, 22 bp, Homo sapiens
cgggaaggtggaggttgcagtg

SEQ ID NO: 9376393 - DNA, 22 bp, Homo sapiens
ttccaaattccaatcccctgaa

SEQ ID NO: 9376394 - DNA, 22 bp, Homo sapiens
ttccaaattaaaatgtacaatg

SEQ ID NO: 9376395 - DNA, 22 bp, Homo sapiens
ttccactctatgatagaagggt

SEQ ID NO: 9376396 - DNA, 22 bp, Homo sapiens
ttccacggggctccccgctctt

SEQ ID NO: 9376397 - DNA, 22 bp, Homo sapiens
ttccacggggctccccgctctt

SEQ ID NO: 9376398 - DNA, 22 bp, Homo sapiens
ttcagtttgaattctgtagaac

SEQ ID NO: 9376399 - DNA, 22 bp, Homo sapiens
ttcagtttcttccctgtgaaat

SEQ ID NO: 9376400 - DNA, 18 bp, Homo sapiens
ttcagtttctagttcctt

SEQ ID NO: 9376401 - DNA, 22 bp, Homo sapiens
ttcagtttctaaagatgttcct

SEQ ID NO: 9376402 - DNA, 22 bp, Homo sapiens
ttcagtttcgttatctatgaga

SEQ ID NO: 9376403 - DNA, 22 bp, Homo sapiens
ttcagtttcgttatctatgaga

SEQ ID NO: 9376404 - DNA, 22 bp, Homo sapiens
ttcagggccctgagagggcagt

SEQ ID NO: 9376405 - DNA, 22 bp, Homo sapiens
ttcagtttcaaatcctgtgaag

SEQ ID NO: 9376406 - DNA, 22 bp, Homo sapiens
ttcagggcttagggaaatagtg

SEQ ID NO: 9376407 - DNA, 20 bp, Homo sapiens
cgcagcagtggaagtggaat

SEQ ID NO: 9376408 - DNA, 22 bp, Homo sapiens
cgcagccccaacaaatgggaca

SEQ ID NO: 9376409 - DNA, 22 bp, Homo sapiens
cgcagctgcacggggctgagcc

SEQ ID NO: 9376410 - DNA, 22 bp, Homo sapiens
cgcagctgcacggggctgagcc

SEQ ID NO: 9376411 - DNA, 22 bp, Homo sapiens
cgcagctgcaaaggaaacattt

SEQ ID NO: 9376412 - DNA, 21 bp, Homo sapiens
cgcagctgagaaatatacaga

SEQ ID NO: 9376413 - DNA, 22 bp, Homo sapiens
cgcagcgaactgtccctcggtc

SEQ ID NO: 9376414 - DNA, 22 bp, Homo sapiens
ctaactacaagcggggcatcct

SEQ ID NO: 9376415 - DNA, 22 bp, Homo sapiens
ctaaattatcatgagaattatg

SEQ ID NO: 9376416 - DNA, 22 bp, Homo sapiens
ctaaattatttgcacattagag

SEQ ID NO: 9376417 - DNA, 22 bp, Homo sapiens
ctaaattatttgcacattagag

SEQ ID NO: 9376418 - DNA, 22 bp, Homo sapiens
ttctacatagtctcttggagct

SEQ ID NO: 9376419 - DNA, 22 bp, Homo sapiens
ttctacatatatttttctcact

SEQ ID NO: 9376420 - DNA, 21 bp, Homo sapiens
ttctacaggatgaatgaaaac

SEQ ID NO: 9376421 - DNA, 22 bp, Homo sapiens
ttctacaggtactgaagtacat

SEQ ID NO: 9376422 - DNA, 22 bp, Homo sapiens
ttctacaggtactgaagtacat

SEQ ID NO: 9376423 - DNA, 22 bp, Homo sapiens
ttctacagactataactgtgat

SEQ ID NO: 9376424 - DNA, 22 bp, Homo sapiens
ttctacagaataaatgtttaca

SEQ ID NO: 9376425 - DNA, 21 bp, Homo sapiens
ttctacaggatgaatgaaaac

SEQ ID NO: 9376426 - DNA, 22 bp, Homo sapiens
ctaactttatttgctaagtaga

SEQ ID NO: 9376427 - DNA, 22 bp, Homo sapiens
ctaactttagcttagattatca

SEQ ID NO: 9376428 - DNA, 22 bp, Homo sapiens
ctacataatctggatttgtctg

SEQ ID NO: 9376429 - DNA, 22 bp, Homo sapiens
ctacataatctggatttgtctg

SEQ ID NO: 9376430 - DNA, 22 bp, Homo sapiens
ctacataaatttatcacagact

SEQ ID NO: 9376431 - DNA, 22 bp, Homo sapiens
ctacataaatatttatgtgtct

SEQ ID NO: 9376432 - DNA, 22 bp, Homo sapiens
ctacagtgtgacaggcttggtg

SEQ ID NO: 9376433 - DNA, 22 bp, Homo sapiens
ttctacccgttgagagaatgct

SEQ ID NO: 9376434 - DNA, 22 bp, Homo sapiens
ttctacctcagtttcccactta

SEQ ID NO: 9376435 - DNA, 22 bp, Homo sapiens
ctacagtgaagactagctatag

SEQ ID NO: 9376436 - DNA, 22 bp, Homo sapiens
ttctaccagaccccagacttgt

SEQ ID NO: 9376437 - DNA, 22 bp, Homo sapiens
ttctacatttgaggagagtcag

SEQ ID NO: 9376438 - DNA, 22 bp, Homo sapiens
ttctacatttaaaaggaaaatc

SEQ ID NO: 9376439 - DNA, 22 bp, Homo sapiens
ttctacatcacttaacatgcta

SEQ ID NO: 9376440 - DNA, 22 bp, Homo sapiens
ttctacatcacttaacatgcta

SEQ ID NO: 9376441 - DNA, 22 bp, Homo sapiens
ttctacattgtgaagttcttta

SEQ ID NO: 9376442 - DNA, 22 bp, Homo sapiens
ttctacattcatgtattacctc

SEQ ID NO: 9376443 - DNA, 22 bp, Homo sapiens
ttctacattgtgaagttcttta

SEQ ID NO: 9376444 - DNA, 22 bp, Homo sapiens
ttctacatgagaaaatgtattt

SEQ ID NO: 9376445 - DNA, 22 bp, Homo sapiens
ttctacatggaagagccttctt

SEQ ID NO: 9376446 - DNA, 22 bp, Homo sapiens
ttctacatggttgctcagaggg

SEQ ID NO: 9376447 - DNA, 22 bp, Homo sapiens
ttctacatgtcaagtctccaag

SEQ ID NO: 9376448 - DNA, 22 bp, Homo sapiens
ttctacatgtgatgcgtgcctg

SEQ ID NO: 9376449 - DNA, 22 bp, Homo sapiens
ttctcctggagtgcttgttggg

SEQ ID NO: 9376450 - DNA, 22 bp, Homo sapiens
ttctcctgggaggggttgccca

SEQ ID NO: 9376451 - DNA, 22 bp, Homo sapiens
ttctcctgcgcaggcccaggga

SEQ ID NO: 9376452 - DNA, 22 bp, Homo sapiens
ttctcctgcccttggacttcca

SEQ ID NO: 9376453 - DNA, 19 bp, Homo sapiens
ttctcattcctttccactt

SEQ ID NO: 9376454 - DNA, 22 bp, Homo sapiens
ttctcattctgactcagtgtag

SEQ ID NO: 9376455 - DNA, 22 bp, Homo sapiens
ttctcctgcccttggacttcca

SEQ ID NO: 9376456 - DNA, 22 bp, Homo sapiens
ttctcctgcccttggacttcca

SEQ ID NO: 9376457 - DNA, 22 bp, Homo sapiens
ttctcattctgactcagtgtag

SEQ ID NO: 9376458 - DNA, 22 bp, Homo sapiens
ttctcatgaaactcgcttcctc

SEQ ID NO: 9376459 - DNA, 22 bp, Homo sapiens
ttctcatgaaactcgcttcctc

SEQ ID NO: 9376460 - DNA, 22 bp, Homo sapiens
ttctcatagagacatgattata

SEQ ID NO: 9376461 - DNA, 22 bp, Homo sapiens
ttctcaggtgaggctgaggctg

SEQ ID NO: 9376462 - DNA, 19 bp, Homo sapiens
ttctcagttcaggagaaga

SEQ ID NO: 9376463 - DNA, 22 bp, Homo sapiens
ttctcagtttcactgataacag

SEQ ID NO: 9376464 - DNA, 22 bp, Homo sapiens
ctacattgttatctgtaagtgt

SEQ ID NO: 9376465 - DNA, 22 bp, Homo sapiens
ttctatttttgtggaactgtag

SEQ ID NO: 9376466 - DNA, 22 bp, Homo sapiens
ttctcaggtcaccagggtgcca

SEQ ID NO: 9376467 - DNA, 22 bp, Homo sapiens
ttctatttttgtggaactgtag

SEQ ID NO: 9376468 - DNA, 22 bp, Homo sapiens
ttctcaggtgaggctgaggctg

SEQ ID NO: 9376469 - DNA, 19 bp, Homo sapiens
ctagggcttggcagcaggc

SEQ ID NO: 9376470 - DNA, 22 bp, Homo sapiens
ctagggcttccaagatgccttc

SEQ ID NO: 9376471 - DNA, 22 bp, Homo sapiens
ttctccttggtttatgggacat

SEQ ID NO: 9376472 - DNA, 21 bp, Homo sapiens
ttctcctgttttgcaccacag

SEQ ID NO: 9376473 - DNA, 22 bp, Homo sapiens
ttctcctggggccgtgatgtga

SEQ ID NO: 9376474 - DNA, 22 bp, Homo sapiens
ttctccttgaaaagctgcatct

SEQ ID NO: 9376475 - DNA, 22 bp, Homo sapiens
ctagtggaaactaactggaatt

SEQ ID NO: 9376476 - DNA, 22 bp, Homo sapiens
ctagttctagatccctgaggaa

SEQ ID NO: 9376477 - DNA, 22 bp, Homo sapiens
ctagtgtttattaatcatgagg

SEQ ID NO: 9376478 - DNA, 22 bp, Homo sapiens
ctagtgtttattaatcatgagg

SEQ ID NO: 9376479 - DNA, 22 bp, Homo sapiens
ctagttctgccattcagtgtca

SEQ ID NO: 9376480 - DNA, 22 bp, Homo sapiens
ctagttctcctgaaatgtttgg

SEQ ID NO: 9376481 - DNA, 22 bp, Homo sapiens
ctagttctagatccctgaggaa

SEQ ID NO: 9376482 - DNA, 22 bp, Homo sapiens
ctagttctaaatctgttgtcca

SEQ ID NO: 9376483 - DNA, 22 bp, Homo sapiens
ctagtttaaagcagctgaaagg

SEQ ID NO: 9376484 - DNA, 22 bp, Homo sapiens
ctagtttagagtatgcgtgtgt

SEQ ID NO: 9376485 - DNA, 22 bp, Homo sapiens
ctagtttagtcagagccttgct

SEQ ID NO: 9376486 - DNA, 22 bp, Homo sapiens
ctagtttggttagataagtctc

SEQ ID NO: 9376487 - DNA, 22 bp, Homo sapiens
ctagtttaaagcagctgaaagg

SEQ ID NO: 9376488 - DNA, 22 bp, Homo sapiens
ctagttgtttaatattgattga

SEQ ID NO: 9376489 - DNA, 22 bp, Homo sapiens
ctagttgtttaatattgattga

SEQ ID NO: 9376490 - DNA, 22 bp, Homo sapiens
ctagtttaaagcagctgaaagg

SEQ ID NO: 9376491 - DNA, 22 bp, Homo sapiens
ttgctgtagggggaaaatactt

SEQ ID NO: 9376492 - DNA, 22 bp, Homo sapiens
ttgctggtaaagtctttatcgg

SEQ ID NO: 9376493 - DNA, 22 bp, Homo sapiens
ctcaggctaagaaggccaagtg

SEQ ID NO: 9376494 - DNA, 22 bp, Homo sapiens
ctcaggctaagaaggccaagtg

SEQ ID NO: 9376495 - DNA, 22 bp, Homo sapiens
ctcaggctaagaaggccaagtg

SEQ ID NO: 9376496 - DNA, 22 bp, Homo sapiens
ctcaggctcatatcccatcagc

SEQ ID NO: 9376497 - DNA, 22 bp, Homo sapiens
ttgcacatgatagatgatttct

SEQ ID NO: 9376498 - DNA, 18 bp, Homo sapiens
ctcaggcctttccctgtg

SEQ ID NO: 9376499 - DNA, 18 bp, Homo sapiens
ctcaggcctttccctgtg

SEQ ID NO: 9376500 - DNA, 22 bp, Homo sapiens
ttgctgagctttggcaaggaag

SEQ ID NO: 9376501 - DNA, 22 bp, Homo sapiens
ttgccgtccttactccagcgga

SEQ ID NO: 9376502 - DNA, 22 bp, Homo sapiens
ttgccgccgtctgctcgccccg

SEQ ID NO: 9376503 - DNA, 22 bp, Homo sapiens
ttgcactccagcccgagcaaca

SEQ ID NO: 9376504 - DNA, 22 bp, Homo sapiens
ttgcactagacacatttcaagt

SEQ ID NO: 9376505 - DNA, 22 bp, Homo sapiens
ttgcacctcatttcatttgggc

SEQ ID NO: 9376506 - DNA, 22 bp, Homo sapiens
ttgcaccccttgattgagcctt

SEQ ID NO: 9376507 - DNA, 22 bp, Homo sapiens
ttgcacatttcctagaatttca

SEQ ID NO: 9376508 - DNA, 22 bp, Homo sapiens
ttgcacatgttggttcttgaaa

SEQ ID NO: 9376509 - DNA, 22 bp, Homo sapiens
ttgcacatgctatttatgtttt

SEQ ID NO: 9376510 - DNA, 22 bp, Homo sapiens
ttgatttttttctactatgcgc

SEQ ID NO: 9376511 - DNA, 22 bp, Homo sapiens
ttgatcaaatcagctactgagg

SEQ ID NO: 9376512 - DNA, 22 bp, Homo sapiens
ttgatcaaatcagctactgagg

SEQ ID NO: 9376513 - DNA, 22 bp, Homo sapiens
ctcagcagtgacaagagagtat

SEQ ID NO: 9376514 - DNA, 22 bp, Homo sapiens
ttgcaaagaattttacattcta

SEQ ID NO: 9376515 - DNA, 22 bp, Homo sapiens
ctcagcagtgacaagagagtat

SEQ ID NO: 9376516 - DNA, 23 bp, Homo sapiens
ttgcaaaatgagtcttgagtgaa

SEQ ID NO: 9376517 - DNA, 22 bp, Homo sapiens
ttgcaaaaccatcctaagtaaa

SEQ ID NO: 9376518 - DNA, 22 bp, Homo sapiens
ctcaggagttggaggctacagt

SEQ ID NO: 9376519 - DNA, 22 bp, Homo sapiens
ctcaggccaataagctccagcc

SEQ ID NO: 9376520 - DNA, 22 bp, Homo sapiens
ctcaggccaggtttctcccaca

SEQ ID NO: 9376521 - DNA, 22 bp, Homo sapiens
ctcaggccattcttccagctgc

SEQ ID NO: 9376522 - DNA, 22 bp, Homo sapiens
ctcaggcccacagcagacccac

SEQ ID NO: 9376523 - DNA, 22 bp, Homo sapiens
ctcaggcctgagtggcagtccc

SEQ ID NO: 9376524 - DNA, 22 bp, Homo sapiens
ctcaggccattcttccagctgc

SEQ ID NO: 9376525 - DNA, 22 bp, Homo sapiens
ctcaggcccacagcagacccac

SEQ ID NO: 9376526 - DNA, 22 bp, Homo sapiens
ctcagccagtgatctttccttt

SEQ ID NO: 9376527 - DNA, 22 bp, Homo sapiens
ctcagccagacatgacccagtc

SEQ ID NO: 9376528 - DNA, 22 bp, Homo sapiens
ctcagccatgcaacatgctggg

SEQ ID NO: 9376529 - DNA, 22 bp, Homo sapiens
ctcagccagtgatctttccttt

SEQ ID NO: 9376530 - DNA, 22 bp, Homo sapiens
ctcagccagacatgacccagtc

SEQ ID NO: 9376531 - DNA, 22 bp, Homo sapiens
ctcaggagtagttcagcagctg

SEQ ID NO: 9376532 - DNA, 22 bp, Homo sapiens
ctcagcccagcccaggaccagg

SEQ ID NO: 9376533 - DNA, 22 bp, Homo sapiens
ctcagcccagctcaggtctttc

SEQ ID NO: 9376534 - DNA, 22 bp, Homo sapiens
ctcagccatggggtggatcagc

SEQ ID NO: 9376535 - DNA, 22 bp, Homo sapiens
ctcagccatgtcatgcctacct

SEQ ID NO: 9376536 - DNA, 22 bp, Homo sapiens
ctcagccatgtcatgcctacct

SEQ ID NO: 9376537 - DNA, 22 bp, Homo sapiens
ctcagcccagcccaggaccagg

SEQ ID NO: 9376538 - DNA, 22 bp, Homo sapiens
ttcttaaagaggcaaaacacag

SEQ ID NO: 9376539 - DNA, 22 bp, Homo sapiens
ttcttaatggcaaaggatttta

SEQ ID NO: 9376540 - DNA, 22 bp, Homo sapiens
ttcttcaggtggttttggtaac

SEQ ID NO: 9376541 - DNA, 22 bp, Homo sapiens
ttcttcagtcccactagccaca

SEQ ID NO: 9376542 - DNA, 21 bp, Homo sapiens
ttcttcaggccaatgctcatt

SEQ ID NO: 9376543 - DNA, 22 bp, Homo sapiens
ttctgaaaattgggtcatactt

SEQ ID NO: 9376544 - DNA, 22 bp, Homo sapiens
ttctctttttgcatctcaacct

SEQ ID NO: 9376545 - DNA, 22 bp, Homo sapiens
ttctctttttgcatctcaacct

SEQ ID NO: 9376546 - DNA, 22 bp, Homo sapiens
ttctcttttgtgatgtgagatg

SEQ ID NO: 9376547 - DNA, 22 bp, Homo sapiens
ctataaatctacccagcattgg

SEQ ID NO: 9376548 - DNA, 22 bp, Homo sapiens
ttctgaaattcgactatccaat

SEQ ID NO: 9376549 - DNA, 22 bp, Homo sapiens
ttctgaaatgagatataaggta

SEQ ID NO: 9376550 - DNA, 22 bp, Homo sapiens
ttcttaaaattcaagctaggtt

SEQ ID NO: 9376551 - DNA, 22 bp, Homo sapiens
ttctgtcctgttggatgaatca

SEQ ID NO: 9376552 - DNA, 22 bp, Homo sapiens
ttgaaatatcaagttattagtg

SEQ ID NO: 9376553 - DNA, 22 bp, Homo sapiens
ttgaagttctgcatttctaata

SEQ ID NO: 9376554 - DNA, 22 bp, Homo sapiens
ttgaagtctcatgatttaaaga

SEQ ID NO: 9376555 - DNA, 22 bp, Homo sapiens
ttgaagtcagttcatattttta

SEQ ID NO: 9376556 - DNA, 22 bp, Homo sapiens
ttcttcagtgcccctctagtag

SEQ ID NO: 9376557 - DNA, 22 bp, Homo sapiens
ttcttcatgctgttgctgcttg

SEQ ID NO: 9376558 - DNA, 22 bp, Homo sapiens
ttcttcccagccagcacagccc

SEQ ID NO: 9376559 - DNA, 22 bp, Homo sapiens
ttcttcattcccttacttccga

SEQ ID NO: 9376560 - DNA, 22 bp, Homo sapiens
ctcactggcaagactacaggtg

SEQ ID NO: 9376561 - DNA, 22 bp, Homo sapiens
ctcagaaacggagctgccattt

SEQ ID NO: 9376562 - DNA, 22 bp, Homo sapiens
ctcactgcaagctctgcctccc

SEQ ID NO: 9376563 - DNA, 22 bp, Homo sapiens
ctcactgcaagctctgcctcca

SEQ ID NO: 9376564 - DNA, 22 bp, Homo sapiens
ctcactggcaagactacaggtg

SEQ ID NO: 9376565 - DNA, 22 bp, Homo sapiens
ctcactggcaagactacaggtg

SEQ ID NO: 9376566 - DNA, 22 bp, Homo sapiens
ttgaatgaaattgctgtgttat

SEQ ID NO: 9376567 - DNA, 22 bp, Homo sapiens
ttgaatctataatttcagtatt

SEQ ID NO: 9376568 - DNA, 19 bp, Homo sapiens
ttgaatatgcaaactgaag

SEQ ID NO: 9376569 - DNA, 22 bp, Homo sapiens
ttgaagtttaatggtagattcc

SEQ ID NO: 9376570 - DNA, 22 bp, Homo sapiens
ttgaagttgtagttcagtgaag

SEQ ID NO: 9376571 - DNA, 22 bp, Homo sapiens
ctgcgttctgcctggcggccta

SEQ ID NO: 9376572 - DNA, 22 bp, Homo sapiens
ctgctccacaccgtccatactc

SEQ ID NO: 9376573 - DNA, 20 bp, Homo sapiens
ctgctccacccggctctcag

SEQ ID NO: 9376574 - DNA, 22 bp, Homo sapiens
ctgctccacctccgggtcaggc

SEQ ID NO: 9376575 - DNA, 22 bp, Homo sapiens
ctgctccacacctccatttcct

SEQ ID NO: 9376576 - DNA, 22 bp, Homo sapiens
ctgctccacaccgtccatactc

SEQ ID NO: 9376577 - DNA, 22 bp, Homo sapiens
ctgctccacacctccatttcct

SEQ ID NO: 9376578 - DNA, 20 bp, Homo sapiens
ctgctccacccggctctcag

SEQ ID NO: 9376579 - DNA, 22 bp, Homo sapiens
ctgctccaggaacagagctgct

SEQ ID NO: 9376580 - DNA, 22 bp, Homo sapiens
ctgctccagacacctgcagggg

SEQ ID NO: 9376581 - DNA, 22 bp, Homo sapiens
ctgctccacctccgggtcaggc

SEQ ID NO: 9376582 - DNA, 22 bp, Homo sapiens
ctgctcctccccatcaggcagc

SEQ ID NO: 9376583 - DNA, 22 bp, Homo sapiens
ctgctcctccccatcaggcagc

SEQ ID NO: 9376584 - DNA, 19 bp, Homo sapiens
ctgctccctccttctggca

SEQ ID NO: 9376585 - DNA, 22 bp, Homo sapiens
ctgctccccagcctgcgccttt

SEQ ID NO: 9376586 - DNA, 22 bp, Homo sapiens
ctgctccccagcctgcgccttt

SEQ ID NO: 9376587 - DNA, 22 bp, Homo sapiens
ctgctccaggatttcaggccag

SEQ ID NO: 9376588 - DNA, 22 bp, Homo sapiens
ctgctccagtagccccatgtgg

SEQ ID NO: 9376589 - DNA, 22 bp, Homo sapiens
ctgctccaggatttcaggccag

SEQ ID NO: 9376590 - DNA, 18 bp, Homo sapiens
ctgctccagtctggccag

SEQ ID NO: 9376591 - DNA, 22 bp, Homo sapiens
ctgctcctctgaggtagccaca

SEQ ID NO: 9376592 - DNA, 22 bp, Homo sapiens
ctgctcctccccatcaggcagc

SEQ ID NO: 9376593 - DNA, 22 bp, Homo sapiens
ctgctcctctgaggtagccaca

SEQ ID NO: 9376594 - DNA, 22 bp, Homo sapiens
ctgctcctggtcatcctccact

SEQ ID NO: 9376595 - DNA, 22 bp, Homo sapiens
ctgctcctggtcatcctccact

SEQ ID NO: 9376596 - DNA, 22 bp, Homo sapiens
ctgctcctgtccagcagggcca

SEQ ID NO: 9376597 - DNA, 22 bp, Homo sapiens
ctgctcctggtcatcctccact

SEQ ID NO: 9376598 - DNA, 22 bp, Homo sapiens
ctgctcctggtcatcctccact

SEQ ID NO: 9376599 - DNA, 22 bp, Homo sapiens
ctgcctgcatgctgccatagct

SEQ ID NO: 9376600 - DNA, 22 bp, Homo sapiens
ctgcctgccacgttcagctgta

SEQ ID NO: 9376601 - DNA, 22 bp, Homo sapiens
ctgcctgcctggagacagatgg

SEQ ID NO: 9376602 - DNA, 22 bp, Homo sapiens
ctgcctgccttggcctccagga

SEQ ID NO: 9376603 - DNA, 22 bp, Homo sapiens
ctgcctgccttggcctccagga

SEQ ID NO: 9376604 - DNA, 22 bp, Homo sapiens
ctgcgtgagcgtgcccgtcttg

SEQ ID NO: 9376605 - DNA, 22 bp, Homo sapiens
ctgcctgagtggaggtcgaggg

SEQ ID NO: 9376606 - DNA, 22 bp, Homo sapiens
ctgcctgcactgcctggctcca

SEQ ID NO: 9376607 - DNA, 22 bp, Homo sapiens
ctgcctgcaggacacctcgcta

SEQ ID NO: 9376608 - DNA, 22 bp, Homo sapiens
ctgcctctgttgggcatggtct

SEQ ID NO: 9376609 - DNA, 22 bp, Homo sapiens
ctgcctcttaagtggatggagt

SEQ ID NO: 9376610 - DNA, 22 bp, Homo sapiens
ctgcctcttgacagatcgtggc

SEQ ID NO: 9376611 - DNA, 22 bp, Homo sapiens
ctgcctcttgacagatcgtggc

SEQ ID NO: 9376612 - DNA, 22 bp, Homo sapiens
ctgcctgaactgggtgagcaag

SEQ ID NO: 9376613 - DNA, 22 bp, Homo sapiens
ctgcctgaactgggtgagcaag

SEQ ID NO: 9376614 - DNA, 22 bp, Homo sapiens
ctgctgctcagtgtcatcatgt

SEQ ID NO: 9376615 - DNA, 22 bp, Homo sapiens
ctgctgctcgaccagtcccagg

SEQ ID NO: 9376616 - DNA, 22 bp, Homo sapiens
ctgctgctcagtgtcatcatgt

SEQ ID NO: 9376617 - DNA, 22 bp, Homo sapiens
ctgctgctcagtgtcatcatgt

SEQ ID NO: 9376618 - DNA, 22 bp, Homo sapiens
ctgctgctcttgtgcattagtg

SEQ ID NO: 9376619 - DNA, 22 bp, Homo sapiens
ctgctgctgagaatgcctcagg

SEQ ID NO: 9376620 - DNA, 22 bp, Homo sapiens
ctgctgctgctatctacccagg

SEQ ID NO: 9376621 - DNA, 22 bp, Homo sapiens
ctgctgctgagagctcagcctg

SEQ ID NO: 9376622 - DNA, 22 bp, Homo sapiens
ctgctgctgagaatgcctcagg

SEQ ID NO: 9376623 - DNA, 22 bp, Homo sapiens
ctgctgctgagagctcagcctg

SEQ ID NO: 9376624 - DNA, 22 bp, Homo sapiens
ctgctgcttagcatagcagagg

SEQ ID NO: 9376625 - DNA, 22 bp, Homo sapiens
ctgctgctgtaaggcagaatta

SEQ ID NO: 9376626 - DNA, 22 bp, Homo sapiens
ctgctgcttagcatagcagagg

SEQ ID NO: 9376627 - DNA, 22 bp, Homo sapiens
ctgctggcaagcccagttggag

SEQ ID NO: 9376628 - DNA, 22 bp, Homo sapiens
ctgctggaagtttgctgtggat

SEQ ID NO: 9376629 - DNA, 22 bp, Homo sapiens
ctgctggaagtttgctgtggat

SEQ ID NO: 9376630 - DNA, 22 bp, Homo sapiens
ctgctgggaaggtctgctcagt

SEQ ID NO: 9376631 - DNA, 17 bp, Homo sapiens
ctgctggctggggcttg

SEQ ID NO: 9376632 - DNA, 22 bp, Homo sapiens
ctgctggcttctagtcattcaa

SEQ ID NO: 9376633 - DNA, 20 bp, Homo sapiens
ctgctgtgattccctcctcc

SEQ ID NO: 9376634 - DNA, 22 bp, Homo sapiens
ctgctgtgagtttggaggtcta

SEQ ID NO: 9376635 - DNA, 22 bp, Homo sapiens
ctgctgtgagtttggaggtcta

SEQ ID NO: 9376636 - DNA, 22 bp, Homo sapiens
ctgctggcctcggccatgcctg

SEQ ID NO: 9376637 - DNA, 22 bp, Homo sapiens
ctgctggcctagcccatcctct

SEQ ID NO: 9376638 - DNA, 22 bp, Homo sapiens
ctgctctccccaggccagtctg

SEQ ID NO: 9376639 - DNA, 22 bp, Homo sapiens
ctgctcctgtgggccagtggcc

SEQ ID NO: 9376640 - DNA, 22 bp, Homo sapiens
ctgctctctgttcccctggatc

SEQ ID NO: 9376641 - DNA, 19 bp, Homo sapiens
ctgctctccttgacttgga

SEQ ID NO: 9376642 - DNA, 22 bp, Homo sapiens
ctgctctgaagccaggattctg

SEQ ID NO: 9376643 - DNA, 22 bp, Homo sapiens
ctgctgagcatttgcagggaca

SEQ ID NO: 9376644 - DNA, 22 bp, Homo sapiens
ctgctgagccctggcacaggtg

SEQ ID NO: 9376645 - DNA, 22 bp, Homo sapiens
ctgctgagccctggcacaggtg

SEQ ID NO: 9376646 - DNA, 20 bp, Homo sapiens
ctgctgccctgtcagcctct

SEQ ID NO: 9376647 - DNA, 22 bp, Homo sapiens
ctgctgcccctgagctcagcct

SEQ ID NO: 9376648 - DNA, 22 bp, Homo sapiens
ctgctgccggcgagcctccctt

SEQ ID NO: 9376649 - DNA, 22 bp, Homo sapiens
ctgctgccggcgagcctccctt

SEQ ID NO: 9376650 - DNA, 20 bp, Homo sapiens
ctgctgccctgtcagcctct

SEQ ID NO: 9376651 - DNA, 20 bp, Homo sapiens
ctgctgccctgtcagcctct

SEQ ID NO: 9376652 - DNA, 20 bp, Homo sapiens
ctgctgccctgtcagcctct

SEQ ID NO: 9376653 - DNA, 22 bp, Homo sapiens
ctgccctgggagtacctgtcct

SEQ ID NO: 9376654 - DNA, 22 bp, Homo sapiens
ctgccctggcagcctaccatgg

SEQ ID NO: 9376655 - DNA, 22 bp, Homo sapiens
ctgccctggaaaacgtatctta

SEQ ID NO: 9376656 - DNA, 22 bp, Homo sapiens
ctgccctgcttgatgacagcga

SEQ ID NO: 9376657 - DNA, 22 bp, Homo sapiens
ctgccctgcttgtttccagtgg

SEQ ID NO: 9376658 - DNA, 22 bp, Homo sapiens
ctgcctctggcctcaggcccag

SEQ ID NO: 9376659 - DNA, 22 bp, Homo sapiens
ctgcctctggcctcaggcccag

SEQ ID NO: 9376660 - DNA, 22 bp, Homo sapiens
ctgcctctggcctcaggcccag

SEQ ID NO: 9376661 - DNA, 22 bp, Homo sapiens
ctgcctctggttttggtccctg

SEQ ID NO: 9376662 - DNA, 22 bp, Homo sapiens
ctgcctctggttttggtccctg

SEQ ID NO: 9376663 - DNA, 22 bp, Homo sapiens
ctgcctctattcactgaggcag

SEQ ID NO: 9376664 - DNA, 18 bp, Homo sapiens
ctgccccttctctgagat

SEQ ID NO: 9376665 - DNA, 22 bp, Homo sapiens
ctgcccctggtgatggacgcca

SEQ ID NO: 9376666 - DNA, 18 bp, Homo sapiens
ctgccccttctctgagat

SEQ ID NO: 9376667 - DNA, 22 bp, Homo sapiens
ctgcccctggctggtgaagcag

SEQ ID NO: 9376668 - DNA, 22 bp, Homo sapiens
ctgccctgagtcatgccagatg

SEQ ID NO: 9376669 - DNA, 23 bp, Homo sapiens
ctgccctgatcttgatctattgt

SEQ ID NO: 9376670 - DNA, 22 bp, Homo sapiens
ctgccctgcagctccacggact

SEQ ID NO: 9376671 - DNA, 20 bp, Homo sapiens
ctgccctgccctgggtcctg

SEQ ID NO: 9376672 - DNA, 20 bp, Homo sapiens
ctgccctgccctgggtcctg

SEQ ID NO: 9376673 - DNA, 20 bp, Homo sapiens
ctgccctgccctgggtcctg

SEQ ID NO: 9376674 - DNA, 22 bp, Homo sapiens
ctgccctgcccaggccttgggc

SEQ ID NO: 9376675 - DNA, 22 bp, Homo sapiens
ctgccctgcccaggccttgggc

SEQ ID NO: 9376676 - DNA, 22 bp, Homo sapiens
ctgcagtcttccttccttaggc

SEQ ID NO: 9376677 - DNA, 22 bp, Homo sapiens
ctgcagtgcaagcccagatgga

SEQ ID NO: 9376678 - DNA, 22 bp, Homo sapiens
ctgcagtgttctggaatgcatt

SEQ ID NO: 9376679 - DNA, 22 bp, Homo sapiens
ctgcagtgcctgccactgagcc

SEQ ID NO: 9376680 - DNA, 23 bp, Homo sapiens
ctgcagtcgccggcctgggtgcc

SEQ ID NO: 9376681 - DNA, 22 bp, Homo sapiens
ctgcagtctacctggattttta

SEQ ID NO: 9376682 - DNA, 22 bp, Homo sapiens
ctgcccctgctcatggctgtcc

SEQ ID NO: 9376683 - DNA, 22 bp, Homo sapiens
ctgcccctgctcatggctgtcc

SEQ ID NO: 9376684 - DNA, 22 bp, Homo sapiens
ctgcatatgagaataggagaaa

SEQ ID NO: 9376685 - DNA, 22 bp, Homo sapiens
ctgcagtgttctggaatgcatt

SEQ ID NO: 9376686 - DNA, 22 bp, Homo sapiens
ctgcaggttaggagcactcctt

SEQ ID NO: 9376687 - DNA, 22 bp, Homo sapiens
ctgcaggttgagcagccaggtt

SEQ ID NO: 9376688 - DNA, 22 bp, Homo sapiens
ctgcaggttgagcagccaggtt

SEQ ID NO: 9376689 - DNA, 22 bp, Homo sapiens
ctgcaggttgagcagccaggtt

SEQ ID NO: 9376690 - DNA, 22 bp, Homo sapiens
ctgcagggtttttcaaggacaa

SEQ ID NO: 9376691 - DNA, 22 bp, Homo sapiens
ctgcaggtctctgtgtgcattc

SEQ ID NO: 9376692 - DNA, 21 bp, Homo sapiens
ctgcaggtgctgccatcaggg

SEQ ID NO: 9376693 - DNA, 22 bp, Homo sapiens
ctgcaggggctggagttggctt

SEQ ID NO: 9376694 - DNA, 22 bp, Homo sapiens
ctgcaggggctggagttggctt

SEQ ID NO: 9376695 - DNA, 22 bp, Homo sapiens
ctgagggcttccttgtcccggg

SEQ ID NO: 9376696 - DNA, 21 bp, Homo sapiens
ctgagggctttgaatccagac

SEQ ID NO: 9376697 - DNA, 22 bp, Homo sapiens
ctgcaggggcctcgagcacagg

SEQ ID NO: 9376698 - DNA, 23 bp, Homo sapiens
ctgagggctggtctgaagtctgc

SEQ ID NO: 9376699 - DNA, 22 bp, Homo sapiens
ctgagggctggagctgaggcct

SEQ ID NO: 9376700 - DNA, 21 bp, Homo sapiens
ctgagggccgcagctgggctc

SEQ ID NO: 9376701 - DNA, 21 bp, Homo sapiens
ctgagggccgcagctgggctc

SEQ ID NO: 9376702 - DNA, 22 bp, Homo sapiens
ctgagggccttctatgctgagc

SEQ ID NO: 9376703 - DNA, 22 bp, Homo sapiens
ctgagggccttctatgctgagc

SEQ ID NO: 9376704 - DNA, 22 bp, Homo sapiens
ctgagggccttggctcctgccc

SEQ ID NO: 9376705 - DNA, 22 bp, Homo sapiens
ctgaggaatgagtgaggagcca

SEQ ID NO: 9376706 - DNA, 22 bp, Homo sapiens
ctgaggaaggctgggggcatcc

SEQ ID NO: 9376707 - DNA, 22 bp, Homo sapiens
ctgaggaaggagttaggcagtt

SEQ ID NO: 9376708 - DNA, 22 bp, Homo sapiens
ctgaggaatgagtgaggagcca

SEQ ID NO: 9376709 - DNA, 22 bp, Homo sapiens
ctgaggaaagtattgcctggtg

SEQ ID NO: 9376710 - DNA, 22 bp, Homo sapiens
ctgaggaaagctgcagcggtac

SEQ ID NO: 9376711 - DNA, 22 bp, Homo sapiens
ctgagcttggccaggaatgaat

SEQ ID NO: 9376712 - DNA, 22 bp, Homo sapiens
ctgagcttggccaggaatgaat

SEQ ID NO: 9376713 - DNA, 22 bp, Homo sapiens
ctgagcttcagtgcactgggag

SEQ ID NO: 9376714 - DNA, 22 bp, Homo sapiens
ctgagctgttactctgtcctcg

SEQ ID NO: 9376715 - DNA, 21 bp, Homo sapiens
ctgagcttattgaaaggaaga

SEQ ID NO: 9376716 - DNA, 22 bp, Homo sapiens
ctgagctgtttaatcccagata

SEQ ID NO: 9376717 - DNA, 22 bp, Homo sapiens
ctgagctggtggaagcatgcag

SEQ ID NO: 9376718 - DNA, 22 bp, Homo sapiens
ctgagctggtggaagcatgcag

SEQ ID NO: 9376719 - DNA, 22 bp, Homo sapiens
ctgagctggtctatggacttgg

SEQ ID NO: 9376720 - DNA, 21 bp, Homo sapiens
ctgagctggggtgaaggttgc

SEQ ID NO: 9376721 - DNA, 22 bp, Homo sapiens
ctgagctgggctctcttgaggg

SEQ ID NO: 9376722 - DNA, 22 bp, Homo sapiens
ctgagctggtctatggacttgg

SEQ ID NO: 9376723 - DNA, 22 bp, Homo sapiens
ctgagctgtgtggtcctgggca

SEQ ID NO: 9376724 - DNA, 22 bp, Homo sapiens
ctgagctgtgctaagtgaaatg

SEQ ID NO: 9376725 - DNA, 22 bp, Homo sapiens
ctgagctgtcaggaatggaaag

SEQ ID NO: 9376726 - DNA, 22 bp, Homo sapiens
ctgagggaccctgtgagtacct

SEQ ID NO: 9376727 - DNA, 22 bp, Homo sapiens
ctgagggaccctgtgagtacct

SEQ ID NO: 9376728 - DNA, 22 bp, Homo sapiens
ctgagggaaggcagtcagttgg

SEQ ID NO: 9376729 - DNA, 18 bp, Homo sapiens
ctgaggctggcaggagcc

SEQ ID NO: 9376730 - DNA, 22 bp, Homo sapiens
ctgaggctgggcatggggtcca

SEQ ID NO: 9376731 - DNA, 22 bp, Homo sapiens
ctgagggagagaatggggcaaa

SEQ ID NO: 9376732 - DNA, 22 bp, Homo sapiens
ctgagggagctgctggccttgg

SEQ ID NO: 9376733 - DNA, 22 bp, Homo sapiens
ctgagggagaagtcacgggcag

SEQ ID NO: 9376734 - DNA, 22 bp, Homo sapiens
ctgagggagacagtgcggacta

SEQ ID NO: 9376735 - DNA, 22 bp, Homo sapiens
ctgagggagaagtgatctctac

SEQ ID NO: 9376736 - DNA, 22 bp, Homo sapiens
ctgagggcagtgatgaaggtga

SEQ ID NO: 9376737 - DNA, 22 bp, Homo sapiens
ctgagggcagtgatgaaggtga

SEQ ID NO: 9376738 - DNA, 18 bp, Homo sapiens
ctgagggcagcccctggg

SEQ ID NO: 9376739 - DNA, 22 bp, Homo sapiens
ctgagggcaccgacagagtgga

SEQ ID NO: 9376740 - DNA, 22 bp, Homo sapiens
ctgagggcaccgacagagtgga

SEQ ID NO: 9376741 - DNA, 22 bp, Homo sapiens
ctgagggagttcctgagcccac

SEQ ID NO: 9376742 - DNA, 22 bp, Homo sapiens
ctgagggatgggctgggccgcc

SEQ ID NO: 9376743 - DNA, 22 bp, Homo sapiens
ctgagaggtgctggtggctgca

SEQ ID NO: 9376744 - DNA, 22 bp, Homo sapiens
ctgagaggtgctggtggctgca

SEQ ID NO: 9376745 - DNA, 22 bp, Homo sapiens
ctgagaggtaagcagcgcagtg

SEQ ID NO: 9376746 - DNA, 22 bp, Homo sapiens
ctgagaggtaagcagcgcagtg

SEQ ID NO: 9376747 - DNA, 22 bp, Homo sapiens
ctgagaggtaagcagcgcagtg

SEQ ID NO: 9376748 - DNA, 22 bp, Homo sapiens
ctgaagtttttcaatttatgtt

SEQ ID NO: 9376749 - DNA, 22 bp, Homo sapiens
ctgaataatgttctcttgtatg

SEQ ID NO: 9376750 - DNA, 22 bp, Homo sapiens
ctgaagttttgacatctcattt

SEQ ID NO: 9376751 - DNA, 22 bp, Homo sapiens
ctgaagtttatgcttttcgggt

SEQ ID NO: 9376752 - DNA, 22 bp, Homo sapiens
ctgaagtttcgagatggatgtg

SEQ ID NO: 9376753 - DNA, 22 bp, Homo sapiens
ctgaagttctacaagcctcagg

SEQ ID NO: 9376754 - DNA, 22 bp, Homo sapiens
ctgaagttctacaagcctcagg

SEQ ID NO: 9376755 - DNA, 22 bp, Homo sapiens
ctgaagttcgccagactcgggc

SEQ ID NO: 9376756 - DNA, 22 bp, Homo sapiens
ctgaagttcatacaatggccat

SEQ ID NO: 9376757 - DNA, 22 bp, Homo sapiens
ctgagagatcaagccacaggat

SEQ ID NO: 9376758 - DNA, 22 bp, Homo sapiens
ctgagagatgatatagcttaat

SEQ ID NO: 9376759 - DNA, 22 bp, Homo sapiens
ctgagagatgatatagcttaat

SEQ ID NO: 9376760 - DNA, 19 bp, Homo sapiens
ctgagagatgcttcacaca

SEQ ID NO: 9376761 - DNA, 22 bp, Homo sapiens
ctgaatatcatttacatttgga

SEQ ID NO: 9376762 - DNA, 22 bp, Homo sapiens
ctgagagatcaagccacaggat

SEQ ID NO: 9376763 - DNA, 22 bp, Homo sapiens
ctgagcaatttcagctctcact

SEQ ID NO: 9376764 - DNA, 22 bp, Homo sapiens
ctgagcacctgctgtgtgccag

SEQ ID NO: 9376765 - DNA, 22 bp, Homo sapiens
ctgagccttattcaccagccct

SEQ ID NO: 9376766 - DNA, 22 bp, Homo sapiens
ctgagctgggagtagagactct

SEQ ID NO: 9376767 - DNA, 22 bp, Homo sapiens
ctgagctgggagcctggcacca

SEQ ID NO: 9376768 - DNA, 22 bp, Homo sapiens
ctgagctgggagtagagactct

SEQ ID NO: 9376769 - DNA, 22 bp, Homo sapiens
ctgagctgggagtagagactct

SEQ ID NO: 9376770 - DNA, 22 bp, Homo sapiens
ctgagctgggagtagagactct

SEQ ID NO: 9376771 - DNA, 22 bp, Homo sapiens
ctgagctgggagtggatagtgg

SEQ ID NO: 9376772 - DNA, 22 bp, Homo sapiens
ctgagctgggcaactcttagat

SEQ ID NO: 9376773 - DNA, 22 bp, Homo sapiens
ctgagatggagttttgctcttg

SEQ ID NO: 9376774 - DNA, 22 bp, Homo sapiens
ctgagatctttatacgaggcac

SEQ ID NO: 9376775 - DNA, 22 bp, Homo sapiens
ctgagatggagtttcgctcttc

SEQ ID NO: 9376776 - DNA, 22 bp, Homo sapiens
ctgagagtgtggcttccaggcc

SEQ ID NO: 9376777 - DNA, 20 bp, Homo sapiens
ctgagagtctgtgcttagtc

SEQ ID NO: 9376778 - DNA, 22 bp, Homo sapiens
ctgagagtgctctttgatgtca

SEQ ID NO: 9376779 - DNA, 22 bp, Homo sapiens
ctgagagtctgcatttctaaca

SEQ ID NO: 9376780 - DNA, 22 bp, Homo sapiens
ttttctcctttctaggtcacat

SEQ ID NO: 9376781 - DNA, 22 bp, Homo sapiens
ttttctctacaaaataaccagc

SEQ ID NO: 9376782 - DNA, 22 bp, Homo sapiens
ttttctctatattgtctgtgaa

SEQ ID NO: 9376783 - DNA, 22 bp, Homo sapiens
ttttctctatattgtctgtgaa

SEQ ID NO: 9376784 - DNA, 22 bp, Homo sapiens
ttttctccccagagaccatcat

SEQ ID NO: 9376785 - DNA, 22 bp, Homo sapiens
ttttctccagggaacaaggtga

SEQ ID NO: 9376786 - DNA, 22 bp, Homo sapiens
ttttctccagggaacaaggtga

SEQ ID NO: 9376787 - DNA, 22 bp, Homo sapiens
ttttctcccgctggctgctctt

SEQ ID NO: 9376788 - DNA, 22 bp, Homo sapiens
ttttctcccgctggctgctctt

SEQ ID NO: 9376789 - DNA, 17 bp, Homo sapiens
ttttctcctgcccattc

SEQ ID NO: 9376790 - DNA, 22 bp, Homo sapiens
ttttctcctttcaagatagcat

SEQ ID NO: 9376791 - DNA, 22 bp, Homo sapiens
ttttctcctttcaagatagcat

SEQ ID NO: 9376792 - DNA, 17 bp, Homo sapiens
ttttctcctgcccattc

SEQ ID NO: 9376793 - DNA, 22 bp, Homo sapiens
ttttctcctaagacccttcacc

SEQ ID NO: 9376794 - DNA, 22 bp, Homo sapiens
ttttctcctaagacccttcacc

SEQ ID NO: 9376795 - DNA, 22 bp, Homo sapiens
tttttctagctcaaagattcta

SEQ ID NO: 9376796 - DNA, 22 bp, Homo sapiens
tttttctagctcaaagattcta

SEQ ID NO: 9376797 - DNA, 19 bp, Homo sapiens
tttttaatgggctggagca

SEQ ID NO: 9376798 - DNA, 19 bp, Homo sapiens
tttttacaagtaggtgtga

SEQ ID NO: 9376799 - DNA, 22 bp, Homo sapiens
tttttctgccattcaaagagga

SEQ ID NO: 9376800 - DNA, 22 bp, Homo sapiens
tttttctgccattcaaagagga

SEQ ID NO: 9376801 - DNA, 22 bp, Homo sapiens
tttttctgagcggtaatcatca

SEQ ID NO: 9376802 - DNA, 18 bp, Homo sapiens
tttttctgataaaacaag

SEQ ID NO: 9376803 - DNA, 18 bp, Homo sapiens
tttttctgataaaacaag

SEQ ID NO: 9376804 - DNA, 22 bp, Homo sapiens
tttttctcttctgtaaagtggt

SEQ ID NO: 9376805 - DNA, 22 bp, Homo sapiens
tttttctgagaatatgagagga

SEQ ID NO: 9376806 - DNA, 22 bp, Homo sapiens
tttttctgagcggtaatcatca

SEQ ID NO: 9376807 - DNA, 22 bp, Homo sapiens
ttttctccaactcaaaggaaag

SEQ ID NO: 9376808 - DNA, 21 bp, Homo sapiens
ttttctccagctgtgatttta

SEQ ID NO: 9376809 - DNA, 22 bp, Homo sapiens
ttttctccaactcaaaggaaag

SEQ ID NO: 9376810 - DNA, 22 bp, Homo sapiens
ttttctcaggtgcttatctaag

SEQ ID NO: 9376811 - DNA, 20 bp, Homo sapiens
ttttcctgtggtttgatatg

SEQ ID NO: 9376812 - DNA, 22 bp, Homo sapiens
ttttcctgttaaatctgggcac

SEQ ID NO: 9376813 - DNA, 22 bp, Homo sapiens
ttttcctggggcttctggactc

SEQ ID NO: 9376814 - DNA, 22 bp, Homo sapiens
ttttcctgggctttctgtgtaa

SEQ ID NO: 9376815 - DNA, 22 bp, Homo sapiens
ttttcctggagatggagttgtt

SEQ ID NO: 9376816 - DNA, 22 bp, Homo sapiens
ttttcctgtccaggcaattatt

SEQ ID NO: 9376817 - DNA, 23 bp, Homo sapiens
ttttcctgtggagacatgactgg

SEQ ID NO: 9376818 - DNA, 20 bp, Homo sapiens
ttttcctgtggtttgatatg

SEQ ID NO: 9376819 - DNA, 22 bp, Homo sapiens
ttttcagttccatctctgctct

SEQ ID NO: 9376820 - DNA, 22 bp, Homo sapiens
ttttcagttccatctctgctct

SEQ ID NO: 9376821 - DNA, 22 bp, Homo sapiens
ttttcctctgtatttgaaatgc

SEQ ID NO: 9376822 - DNA, 22 bp, Homo sapiens
ttttcagttgtgctctctagtt

SEQ ID NO: 9376823 - DNA, 22 bp, Homo sapiens
ttttcagttgtgctctctagtt

SEQ ID NO: 9376824 - DNA, 22 bp, Homo sapiens
ctctggagtcctgtatcactcc

SEQ ID NO: 9376825 - DNA, 22 bp, Homo sapiens
ctctggagtgcagcctggtggc

SEQ ID NO: 9376826 - DNA, 19 bp, Homo sapiens
ttttcctgcctcattgttt

SEQ ID NO: 9376827 - DNA, 22 bp, Homo sapiens
ttttcctctgttattagtgtga

SEQ ID NO: 9376828 - DNA, 22 bp, Homo sapiens
ttttcctctgtatttgaaatgc

SEQ ID NO: 9376829 - DNA, 22 bp, Homo sapiens
ttttcctgcctttgctcaggga

SEQ ID NO: 9376830 - DNA, 19 bp, Homo sapiens
ttttcctgcctcattgttt

SEQ ID NO: 9376831 - DNA, 22 bp, Homo sapiens
ttttcctgcctgtctctagagg

SEQ ID NO: 9376832 - DNA, 22 bp, Homo sapiens
ctgaaggatgtgtggtgggagt

SEQ ID NO: 9376833 - DNA, 22 bp, Homo sapiens
ctgaaggaggtagagtgacata

SEQ ID NO: 9376834 - DNA, 22 bp, Homo sapiens
ctgaaggagcatagtcagtttt

SEQ ID NO: 9376835 - DNA, 22 bp, Homo sapiens
ctgaaggacttggtgatagttg

SEQ ID NO: 9376836 - DNA, 22 bp, Homo sapiens
ctgaaggagaaggccactgttc

SEQ ID NO: 9376837 - DNA, 22 bp, Homo sapiens
ctgaagatttttggtaatcatg

SEQ ID NO: 9376838 - DNA, 20 bp, Homo sapiens
ctgaaagacgtaacagtgca

SEQ ID NO: 9376839 - DNA, 22 bp, Homo sapiens
ctgaagatgtctgagatgctca

SEQ ID NO: 9376840 - DNA, 22 bp, Homo sapiens
ctgaagtgccaaatcataatca

SEQ ID NO: 9376841 - DNA, 22 bp, Homo sapiens
ctgaagttaacatcttgatgtc

SEQ ID NO: 9376842 - DNA, 22 bp, Homo sapiens
ctgaagtggacaaatggagtgg

SEQ ID NO: 9376843 - DNA, 22 bp, Homo sapiens
ctgaagttaaagtagtttttat

SEQ ID NO: 9376844 - DNA, 22 bp, Homo sapiens
ctgaagtggacaaatggagtgg

SEQ ID NO: 9376845 - DNA, 22 bp, Homo sapiens
ctgaagttattgtacaaatttg

SEQ ID NO: 9376846 - DNA, 22 bp, Homo sapiens
ctgaagttcatacaatggccat

SEQ ID NO: 9376847 - DNA, 22 bp, Homo sapiens
ctgaagttattgtacaaatttg

SEQ ID NO: 9376848 - DNA, 22 bp, Homo sapiens
ctgaagttattcagtgggctga

SEQ ID NO: 9376849 - DNA, 22 bp, Homo sapiens
ctgaagttaatcagaggtacaa

SEQ ID NO: 9376850 - DNA, 22 bp, Homo sapiens
ctgaagttagttatgcctaaaa

SEQ ID NO: 9376851 - DNA, 20 bp, Homo sapiens
tttttctgggcttccatagc

SEQ ID NO: 9376852 - DNA, 22 bp, Homo sapiens
tttttctgtaaagggccagaga

SEQ ID NO: 9376853 - DNA, 22 bp, Homo sapiens
tttttctggataactgtatctc

SEQ ID NO: 9376854 - DNA, 20 bp, Homo sapiens
tttttctgggcttccatagc

SEQ ID NO: 9376855 - DNA, 22 bp, Homo sapiens
tttttcttaaatgtgggttggc

SEQ ID NO: 9376856 - DNA, 22 bp, Homo sapiens
tttttctgtctcttacattgca

SEQ ID NO: 9376857 - DNA, 22 bp, Homo sapiens
tttttcttaaatgtgggttggc

SEQ ID NO: 9376858 - DNA, 22 bp, Homo sapiens
tttttctgtctcttacattgca

SEQ ID NO: 9376859 - DNA, 22 bp, Homo sapiens
tttttcttaaatgtgggttggc

SEQ ID NO: 9376860 - DNA, 22 bp, Homo sapiens
tttttcttaaatgtgggttggc

SEQ ID NO: 9376861 - DNA, 20 bp, Homo sapiens
ctgaaagacgtaacagtgca

SEQ ID NO: 9376862 - DNA, 22 bp, Homo sapiens
ctgaaacattgcaataacaaag

SEQ ID NO: 9376863 - DNA, 22 bp, Homo sapiens
ctgaaacattgcaataacaaag

SEQ ID NO: 9376864 - DNA, 22 bp, Homo sapiens
ctgaaactccatgagaaattgc

SEQ ID NO: 9376865 - DNA, 22 bp, Homo sapiens
ctgaaaatgttacacaggaaga

SEQ ID NO: 9376866 - DNA, 22 bp, Homo sapiens
ctgaaaatgttacacaggaaga

SEQ ID NO: 9376867 - DNA, 22 bp, Homo sapiens
ctgaaaatgttacacaggaaga

SEQ ID NO: 9376868 - DNA, 22 bp, Homo sapiens
ctgaaaaatatgttttggagaa

SEQ ID NO: 9376869 - DNA, 22 bp, Homo sapiens
ctcccagggccatcgagtcact

SEQ ID NO: 9376870 - DNA, 22 bp, Homo sapiens
ctcccatagcattttaaatagt

SEQ ID NO: 9376871 - DNA, 22 bp, Homo sapiens
ctcccatgctctctctgagaag

SEQ ID NO: 9376872 - DNA, 22 bp, Homo sapiens
ctccccacacactaggcctgat

SEQ ID NO: 9376873 - DNA, 22 bp, Homo sapiens
ctccccaagtcatggagccagg

SEQ ID NO: 9376874 - DNA, 22 bp, Homo sapiens
ctccccacgcctggactaagag

SEQ ID NO: 9376875 - DNA, 22 bp, Homo sapiens
ctccccacatttctccctgtct

SEQ ID NO: 9376876 - DNA, 22 bp, Homo sapiens
ctcaggctggtccttagtgaca

SEQ ID NO: 9376877 - DNA, 22 bp, Homo sapiens
ctcaggctggtttgggttgttt

SEQ ID NO: 9376878 - DNA, 22 bp, Homo sapiens
ctcaggctggtccttagtgaca

SEQ ID NO: 9376879 - DNA, 22 bp, Homo sapiens
ctcaggctgtgatgtgatggca

SEQ ID NO: 9376880 - DNA, 22 bp, Homo sapiens
ctcagggaagctatggtgaggg

SEQ ID NO: 9376881 - DNA, 22 bp, Homo sapiens
ctcaggcttgggaggaggccca

SEQ ID NO: 9376882 - DNA, 22 bp, Homo sapiens
ctcaggcttgggaggaggccca

SEQ ID NO: 9376883 - DNA, 22 bp, Homo sapiens
ctcaggctgccctgacagcccc

SEQ ID NO: 9376884 - DNA, 21 bp, Homo sapiens
ctcaggctggcagcaggctag

SEQ ID NO: 9376885 - DNA, 21 bp, Homo sapiens
ctcaggctggcagcaggctag

SEQ ID NO: 9376886 - DNA, 22 bp, Homo sapiens
ctcaggctctggccatccaagg

SEQ ID NO: 9376887 - DNA, 22 bp, Homo sapiens
ctcaggctccagacttccgtcc

SEQ ID NO: 9376888 - DNA, 22 bp, Homo sapiens
ctcaggctgccctgacagcccc

SEQ ID NO: 9376889 - DNA, 20 bp, Homo sapiens
ttgtttattatgttctgatc

SEQ ID NO: 9376890 - DNA, 20 bp, Homo sapiens
ttgtttattatgttctgatc

SEQ ID NO: 9376891 - DNA, 22 bp, Homo sapiens
ctccctcacaaagcattctctt

SEQ ID NO: 9376892 - DNA, 23 bp, Homo sapiens
ttgtttaccgtaggacttttaac

SEQ ID NO: 9376893 - DNA, 22 bp, Homo sapiens
ttgtttaatgcctcatacatct

SEQ ID NO: 9376894 - DNA, 22 bp, Homo sapiens
ttgtttacaagttactcagtct

SEQ ID NO: 9376895 - DNA, 22 bp, Homo sapiens
ctccccagcattctgacttcct

SEQ ID NO: 9376896 - DNA, 22 bp, Homo sapiens
ctccccagcattctgacttcct

SEQ ID NO: 9376897 - DNA, 22 bp, Homo sapiens
ctccccagctcgcgggtgacgg

SEQ ID NO: 9376898 - DNA, 22 bp, Homo sapiens
ctccccagctcgcgggtgacgg

SEQ ID NO: 9376899 - DNA, 18 bp, Homo sapiens
ctccccagctgcccccag

SEQ ID NO: 9376900 - DNA, 18 bp, Homo sapiens
ctccccagctgcccccag

SEQ ID NO: 9376901 - DNA, 22 bp, Homo sapiens
ctccccaggttcaggaggtggg

SEQ ID NO: 9376902 - DNA, 22 bp, Homo sapiens
ttgtttaatgcctcatacatct

SEQ ID NO: 9376903 - DNA, 22 bp, Homo sapiens
ttgtttaatgcctcatacatct

SEQ ID NO: 9376904 - DNA, 22 bp, Homo sapiens
ttgtttaatatcgtgaagtact

SEQ ID NO: 9376905 - DNA, 22 bp, Homo sapiens
ttgtttaatgcctcatacatct

SEQ ID NO: 9376906 - DNA, 22 bp, Homo sapiens
ctccctggtgtcccctccagga

SEQ ID NO: 9376907 - DNA, 22 bp, Homo sapiens
ctccctgtgctcagagccctgc

SEQ ID NO: 9376908 - DNA, 22 bp, Homo sapiens
ctccctggtgtcccctccagga

SEQ ID NO: 9376909 - DNA, 22 bp, Homo sapiens
ctccctggtgtcccctccagga

SEQ ID NO: 9376910 - DNA, 22 bp, Homo sapiens
ctccctggtgtcccctccagga

SEQ ID NO: 9376911 - DNA, 22 bp, Homo sapiens
ctccctggtgactcccaaagct

SEQ ID NO: 9376912 - DNA, 22 bp, Homo sapiens
ctccctggtctttcccatcatt

SEQ ID NO: 9376913 - DNA, 22 bp, Homo sapiens
ctccctggtgactcccaaagct

SEQ ID NO: 9376914 - DNA, 22 bp, Homo sapiens
ctccctggtctttcccatcatt

SEQ ID NO: 9376915 - DNA, 22 bp, Homo sapiens
ctccctggggctcctcctattt

SEQ ID NO: 9376916 - DNA, 22 bp, Homo sapiens
ctccctggggctcctcctattt

SEQ ID NO: 9376917 - DNA, 22 bp, Homo sapiens
ctcccttcaggagaggctcaca

SEQ ID NO: 9376918 - DNA, 22 bp, Homo sapiens
ctcccttcaggagaggctcaca

SEQ ID NO: 9376919 - DNA, 22 bp, Homo sapiens
ctccgagactcgagtgtcctca

SEQ ID NO: 9376920 - DNA, 19 bp, Homo sapiens
ctcctcagtcccagaggtc

SEQ ID NO: 9376921 - DNA, 19 bp, Homo sapiens
ctcctcagtcccagaggtc

SEQ ID NO: 9376922 - DNA, 19 bp, Homo sapiens
ctcctcagtcccagaggtc

SEQ ID NO: 9376923 - DNA, 20 bp, Homo sapiens
ctcctcagttccatgggagg

SEQ ID NO: 9376924 - DNA, 20 bp, Homo sapiens
ctcctcagttccatgggagg

SEQ ID NO: 9376925 - DNA, 21 bp, Homo sapiens
ctcctcaggaccagccacagg

SEQ ID NO: 9376926 - DNA, 22 bp, Homo sapiens
ctcctcaggaagtagcatgtgt

SEQ ID NO: 9376927 - DNA, 21 bp, Homo sapiens
ctcctcaggaccagccacagg

SEQ ID NO: 9376928 - DNA, 22 bp, Homo sapiens
ctcctcagtcaggtctagggtc

SEQ ID NO: 9376929 - DNA, 22 bp, Homo sapiens
ctccctggaggcccagacctgg

SEQ ID NO: 9376930 - DNA, 22 bp, Homo sapiens
ctccctgcttgtttcccttcag

SEQ ID NO: 9376931 - DNA, 22 bp, Homo sapiens
ctccctggaggcccagacctgg

SEQ ID NO: 9376932 - DNA, 22 bp, Homo sapiens
ctccctggaggcccagacctgg

SEQ ID NO: 9376933 - DNA, 22 bp, Homo sapiens
ctccctcacacccttgcccaga

SEQ ID NO: 9376934 - DNA, 22 bp, Homo sapiens
ctccctcacacccttgcccaga

SEQ ID NO: 9376935 - DNA, 22 bp, Homo sapiens
ctccctgacaggccatgggctt

SEQ ID NO: 9376936 - DNA, 22 bp, Homo sapiens
ctccctgaaattcagatgcctc

SEQ ID NO: 9376937 - DNA, 22 bp, Homo sapiens
ctccctggcagccgcactcctg

SEQ ID NO: 9376938 - DNA, 22 bp, Homo sapiens
ctccctggcagccgcactcctg

SEQ ID NO: 9376939 - DNA, 22 bp, Homo sapiens
ctccctggcacagcgagaggtt

SEQ ID NO: 9376940 - DNA, 22 bp, Homo sapiens
ctccctggcacagcgagaggtt

SEQ ID NO: 9376941 - DNA, 23 bp, Homo sapiens
ctccctggagtttctggaagatg

SEQ ID NO: 9376942 - DNA, 22 bp, Homo sapiens
ctccctgggcctcagtttctct

SEQ ID NO: 9376943 - DNA, 22 bp, Homo sapiens
ctccctgggcctcagtttctct

SEQ ID NO: 9376944 - DNA, 22 bp, Homo sapiens
ctccctgggcagatgtggctct

SEQ ID NO: 9376945 - DNA, 22 bp, Homo sapiens
ctccctgggcagatgtggctct

SEQ ID NO: 9376946 - DNA, 22 bp, Homo sapiens
ctccctggctttgtcctgaggc

SEQ ID NO: 9376947 - DNA, 22 bp, Homo sapiens
ctccctggctttgtcctgaggc

SEQ ID NO: 9376948 - DNA, 22 bp, Homo sapiens
ctccctggctttgtcctgaggc

SEQ ID NO: 9376949 - DNA, 22 bp, Homo sapiens
ctccctggctttgtcctgaggc

SEQ ID NO: 9376950 - DNA, 22 bp, Homo sapiens
ctccctgggcagatgtggctct

SEQ ID NO: 9376951 - DNA, 22 bp, Homo sapiens
ctccctggctttgtcctgaggc

SEQ ID NO: 9376952 - DNA, 23 bp, Homo sapiens
ctccctggcccttgggagacctg

SEQ ID NO: 9376953 - DNA, 22 bp, Homo sapiens
tttacaagtttacagaatgatg

SEQ ID NO: 9376954 - DNA, 22 bp, Homo sapiens
ctcctcagttgtcccatggaga

SEQ ID NO: 9376955 - DNA, 22 bp, Homo sapiens
tttacaattctctaccagtgtt

SEQ ID NO: 9376956 - DNA, 22 bp, Homo sapiens
tttacaattctctaccagtgtt

SEQ ID NO: 9376957 - DNA, 22 bp, Homo sapiens
tttacaagtttacagaatgatg

SEQ ID NO: 9376958 - DNA, 22 bp, Homo sapiens
tttacaagtttacagaatgatg

SEQ ID NO: 9376959 - DNA, 22 bp, Homo sapiens
tttacaatagggtctgaatgaa

SEQ ID NO: 9376960 - DNA, 22 bp, Homo sapiens
tttacaattggttttctctaat

SEQ ID NO: 9376961 - DNA, 22 bp, Homo sapiens
tttacaattggttttctctaat

SEQ ID NO: 9376962 - DNA, 22 bp, Homo sapiens
tttacaattctggtgccagcta

SEQ ID NO: 9376963 - DNA, 22 bp, Homo sapiens
tttacacaaaagatagcacacc

SEQ ID NO: 9376964 - DNA, 22 bp, Homo sapiens
tttacacaaaagatagcacacc

SEQ ID NO: 9376965 - DNA, 22 bp, Homo sapiens
tttacacaaaagatagcacacc

SEQ ID NO: 9376966 - DNA, 22 bp, Homo sapiens
ctcctgctgaatggccaggagc

SEQ ID NO: 9376967 - DNA, 22 bp, Homo sapiens
ctcctgctgaatggccaggagc

SEQ ID NO: 9376968 - DNA, 22 bp, Homo sapiens
ctcctgcttcacgggcaccgcc

SEQ ID NO: 9376969 - DNA, 22 bp, Homo sapiens
ctcctgcttcacgggcaccgcc

SEQ ID NO: 9376970 - DNA, 22 bp, Homo sapiens
ctcctgagctctgaggaagctt

SEQ ID NO: 9376971 - DNA, 22 bp, Homo sapiens
ctcctgagctctgaggaagctt

SEQ ID NO: 9376972 - DNA, 22 bp, Homo sapiens
ctcctgagctgcagccttgtgt

SEQ ID NO: 9376973 - DNA, 22 bp, Homo sapiens
ctcctgagctgcagccttgtgt

SEQ ID NO: 9376974 - DNA, 22 bp, Homo sapiens
ctcctgcctgtgggactgagga

SEQ ID NO: 9376975 - DNA, 22 bp, Homo sapiens
ctcctgcctgtgggactgagga

SEQ ID NO: 9376976 - DNA, 22 bp, Homo sapiens
ctcctgcgggagctccgcctag

SEQ ID NO: 9376977 - DNA, 22 bp, Homo sapiens
ctcctgcctgtgggactgagga

SEQ ID NO: 9376978 - DNA, 22 bp, Homo sapiens
tttacacataaatgtgtagaca

SEQ ID NO: 9376979 - DNA, 22 bp, Homo sapiens
tttacacaaaagatagcacacc

SEQ ID NO: 9376980 - DNA, 22 bp, Homo sapiens
tttacacaaaatgttagtagat

SEQ ID NO: 9376981 - DNA, 22 bp, Homo sapiens
tttacacagaggacactgggct

SEQ ID NO: 9376982 - DNA, 22 bp, Homo sapiens
tttacacaaaatgttagtagat

SEQ ID NO: 9376983 - DNA, 18 bp, Homo sapiens
tttatatggatagagacc

SEQ ID NO: 9376984 - DNA, 22 bp, Homo sapiens
tttatatccatctttgaagtaa

SEQ ID NO: 9376985 - DNA, 22 bp, Homo sapiens
tttatatggttgactatgagtt

SEQ ID NO: 9376986 - DNA, 22 bp, Homo sapiens
tttatatggttgactatgagtt

SEQ ID NO: 9376987 - DNA, 22 bp, Homo sapiens
tttatatgtgaaggtttgcaga

SEQ ID NO: 9376988 - DNA, 22 bp, Homo sapiens
tttatatgtgaaggtttgcaga

SEQ ID NO: 9376989 - DNA, 22 bp, Homo sapiens
tttatatgtttgtacaattaag

SEQ ID NO: 9376990 - DNA, 22 bp, Homo sapiens
ctcctggacatggagcggagga

SEQ ID NO: 9376991 - DNA, 22 bp, Homo sapiens
ctcctggaagcccgccctgctg

SEQ ID NO: 9376992 - DNA, 22 bp, Homo sapiens
ctcctggaagcccgccctgctg

SEQ ID NO: 9376993 - DNA, 22 bp, Homo sapiens
ctcctggacatggagcggagga

SEQ ID NO: 9376994 - DNA, 22 bp, Homo sapiens
ctcctggacatggagcggagga

SEQ ID NO: 9376995 - DNA, 22 bp, Homo sapiens
ctcctggagcagcaggcgcagg

SEQ ID NO: 9376996 - DNA, 22 bp, Homo sapiens
ctcctggagcagcaggcgcagg

SEQ ID NO: 9376997 - DNA, 22 bp, Homo sapiens
ctcctggaccagggctattggg

SEQ ID NO: 9376998 - DNA, 22 bp, Homo sapiens
ctcctggaccaccttgtggcca

SEQ ID NO: 9376999 - DNA, 23 bp, Homo sapiens
ctcctggagggtccggccctgcc

SEQ ID NO: 9377000 - DNA, 22 bp, Homo sapiens
ctcctggagtcctttcctattc

SEQ ID NO: 9377001 - DNA, 23 bp, Homo sapiens
ctcctggagggtccggccctgcc

SEQ ID NO: 9377002 - DNA, 23 bp, Homo sapiens
ctcctggagggtccggccctgcc

SEQ ID NO: 9377003 - DNA, 22 bp, Homo sapiens
ctcctggatcttagccagattc

SEQ ID NO: 9377004 - DNA, 22 bp, Homo sapiens
ctcctggagggccaaagaaata

SEQ ID NO: 9377005 - DNA, 23 bp, Homo sapiens
ctcctggagggtccggccctgcc

SEQ ID NO: 9377006 - DNA, 22 bp, Homo sapiens
ctcctggaggatagtgactggg

SEQ ID NO: 9377007 - DNA, 22 bp, Homo sapiens
ctcctggaggctccaagggaga

SEQ ID NO: 9377008 - DNA, 22 bp, Homo sapiens
ctccttctcctcgggaggccag

SEQ ID NO: 9377009 - DNA, 22 bp, Homo sapiens
ctcgggcttgaggctgtttacc

SEQ ID NO: 9377010 - DNA, 22 bp, Homo sapiens
ctccttcctggttagcacctta

SEQ ID NO: 9377011 - DNA, 22 bp, Homo sapiens
ctcgttgctgaagccaaagtca

SEQ ID NO: 9377012 - DNA, 22 bp, Homo sapiens
ctcggtgaatttttctagcgta

SEQ ID NO: 9377013 - DNA, 22 bp, Homo sapiens
ctcggtgatggaaggtttctcg

SEQ ID NO: 9377014 - DNA, 22 bp, Homo sapiens
ctctaatactgaccaagtcacc

SEQ ID NO: 9377015 - DNA, 22 bp, Homo sapiens
ctctaatactgaccaagtcacc

SEQ ID NO: 9377016 - DNA, 22 bp, Homo sapiens
ctctaacaccacagtgtggttt

SEQ ID NO: 9377017 - DNA, 22 bp, Homo sapiens
ctctaaatccacggtatagttg

SEQ ID NO: 9377018 - DNA, 22 bp, Homo sapiens
ctctaaatccaaataagtgtcc

SEQ ID NO: 9377019 - DNA, 22 bp, Homo sapiens
tttcaaataccataaacctaat

SEQ ID NO: 9377020 - DNA, 22 bp, Homo sapiens
tttcaaataccataaacctaat

SEQ ID NO: 9377021 - DNA, 22 bp, Homo sapiens
tttcaaataccataaacctaat

SEQ ID NO: 9377022 - DNA, 22 bp, Homo sapiens
tttcaaataccataaacctaat

SEQ ID NO: 9377023 - DNA, 22 bp, Homo sapiens
tttcaaataccataaacctaat

SEQ ID NO: 9377024 - DNA, 22 bp, Homo sapiens
ctcctgggcttcgaaggctccc

SEQ ID NO: 9377025 - DNA, 22 bp, Homo sapiens
ctcctgggcttcgaaggctccc

SEQ ID NO: 9377026 - DNA, 22 bp, Homo sapiens
ctcctgggctgtcggcgctctg

SEQ ID NO: 9377027 - DNA, 22 bp, Homo sapiens
tttatattacctggaatagctt

SEQ ID NO: 9377028 - DNA, 22 bp, Homo sapiens
tttatattacctggaatagctt

SEQ ID NO: 9377029 - DNA, 22 bp, Homo sapiens
ctcctgtcagaagcatcctgag

SEQ ID NO: 9377030 - DNA, 22 bp, Homo sapiens
ctcctgtcagaagcatcctgag

SEQ ID NO: 9377031 - DNA, 22 bp, Homo sapiens
ctcctgtcaataggctcctggc

SEQ ID NO: 9377032 - DNA, 22 bp, Homo sapiens
ctcctgtcaataggctcctggc

SEQ ID NO: 9377033 - DNA, 20 bp, Homo sapiens
ctcctgtgcctctctgggcc

SEQ ID NO: 9377034 - DNA, 20 bp, Homo sapiens
ctcctgtgcctctctgggcc

SEQ ID NO: 9377035 - DNA, 22 bp, Homo sapiens
ctcctgtgcatgcatctcccta

SEQ ID NO: 9377036 - DNA, 20 bp, Homo sapiens
ctcctgtgcctctctgggcc

SEQ ID NO: 9377037 - DNA, 22 bp, Homo sapiens
ctcctgtgggtcaccaataggc

SEQ ID NO: 9377038 - DNA, 22 bp, Homo sapiens
ctcctgtgcatgcatctcccta

SEQ ID NO: 9377039 - DNA, 22 bp, Homo sapiens
ctcctgtgcacctccagcggca

SEQ ID NO: 9377040 - DNA, 22 bp, Homo sapiens
ctcctgtgaggcttaagcccag

SEQ ID NO: 9377041 - DNA, 22 bp, Homo sapiens
ctcctgtcccggggaccgccga

SEQ ID NO: 9377042 - DNA, 22 bp, Homo sapiens
ctcctgtggtactcccagggcc

SEQ ID NO: 9377043 - DNA, 22 bp, Homo sapiens
ctcctgtggtactcccagggcc

SEQ ID NO: 9377044 - DNA, 20 bp, Homo sapiens
ctctcacagctccctcagcc

SEQ ID NO: 9377045 - DNA, 21 bp, Homo sapiens
tttctcaccatggtatggaaa

SEQ ID NO: 9377046 - DNA, 22 bp, Homo sapiens
ctctcaaatgtcattcctctat

SEQ ID NO: 9377047 - DNA, 22 bp, Homo sapiens
tttctctcagcctgtagaaact

SEQ ID NO: 9377048 - DNA, 22 bp, Homo sapiens
tttctctattaggggctagctt

SEQ ID NO: 9377049 - DNA, 22 bp, Homo sapiens
ctctatttatggcatctttatg

SEQ ID NO: 9377050 - DNA, 22 bp, Homo sapiens
ctctatttatggcatctttatg

SEQ ID NO: 9377051 - DNA, 22 bp, Homo sapiens
ctctatgttatgcagaattaag

SEQ ID NO: 9377052 - DNA, 22 bp, Homo sapiens
ctctagggtgcaggccccagga

SEQ ID NO: 9377053 - DNA, 22 bp, Homo sapiens
ctctagagtacgggctggcatg

SEQ ID NO: 9377054 - DNA, 22 bp, Homo sapiens
ctctagaggcttgaatgggcga

SEQ ID NO: 9377055 - DNA, 22 bp, Homo sapiens
ctctagacaacttgctgtgggt

SEQ ID NO: 9377056 - DNA, 22 bp, Homo sapiens
ctctagctgaggtcactgctat

SEQ ID NO: 9377057 - DNA, 22 bp, Homo sapiens
ctctagcagcagcccttcctta

SEQ ID NO: 9377058 - DNA, 22 bp, Homo sapiens
ctctagctgaggtcactgctat

SEQ ID NO: 9377059 - DNA, 22 bp, Homo sapiens
ctctaggccatccagggccatt

SEQ ID NO: 9377060 - DNA, 22 bp, Homo sapiens
ctctaggccatccagggccatt

SEQ ID NO: 9377061 - DNA, 22 bp, Homo sapiens
ctctaggccatccagggccatt

SEQ ID NO: 9377062 - DNA, 22 bp, Homo sapiens
ctctaggctgcccaggagctga

SEQ ID NO: 9377063 - DNA, 22 bp, Homo sapiens
ctctagacaacttgctgtgggt

SEQ ID NO: 9377064 - DNA, 22 bp, Homo sapiens
ctctagaatgaattagcgcagg

SEQ ID NO: 9377065 - DNA, 22 bp, Homo sapiens
ctctacagctgctgcccctggt

SEQ ID NO: 9377066 - DNA, 21 bp, Homo sapiens
ctctacattcccagcaactct

SEQ ID NO: 9377067 - DNA, 21 bp, Homo sapiens
ctctagaaatcgaataacctt

SEQ ID NO: 9377068 - DNA, 22 bp, Homo sapiens
ctctagaacagtgctgagcctt

SEQ ID NO: 9377069 - DNA, 22 bp, Homo sapiens
tttctctctatttagacaggta

SEQ ID NO: 9377070 - DNA, 22 bp, Homo sapiens
tttctctctatttagacaggta

SEQ ID NO: 9377071 - DNA, 22 bp, Homo sapiens
tttctctctatttagacaggta

SEQ ID NO: 9377072 - DNA, 22 bp, Homo sapiens
tttctctctggccctgattgtc

SEQ ID NO: 9377073 - DNA, 22 bp, Homo sapiens
tttctctctggccctgattgtc

SEQ ID NO: 9377074 - DNA, 22 bp, Homo sapiens
tttctctctggccctgattgtc

SEQ ID NO: 9377075 - DNA, 22 bp, Homo sapiens
tttctctcttaaggagtttaaa

SEQ ID NO: 9377076 - DNA, 23 bp, Homo sapiens
tttctctgagaagcagttctcta

SEQ ID NO: 9377077 - DNA, 23 bp, Homo sapiens
tttctctgagaagcagttctcta

SEQ ID NO: 9377078 - DNA, 19 bp, Homo sapiens
tttctctccctcatcccga

SEQ ID NO: 9377079 - DNA, 22 bp, Homo sapiens
tttctctctacagtactttcat

SEQ ID NO: 9377080 - DNA, 22 bp, Homo sapiens
tttctctctacagtactttcat

SEQ ID NO: 9377081 - DNA, 19 bp, Homo sapiens
tttctctccctcatcccga

SEQ ID NO: 9377082 - DNA, 22 bp, Homo sapiens
tttctctccccaagtggaattg

SEQ ID NO: 9377083 - DNA, 22 bp, Homo sapiens
tttctctcagcctgtagaaact

SEQ ID NO: 9377084 - DNA, 22 bp, Homo sapiens
ctctctggaattaaagcccaat

SEQ ID NO: 9377085 - DNA, 22 bp, Homo sapiens
ctctctggacttgagtatcagc

SEQ ID NO: 9377086 - DNA, 22 bp, Homo sapiens
ctctctggacttgagtatcagc

SEQ ID NO: 9377087 - DNA, 22 bp, Homo sapiens
ctctctggacttgagtatcagc

SEQ ID NO: 9377088 - DNA, 22 bp, Homo sapiens
ctctctggaattaaagcccaat

SEQ ID NO: 9377089 - DNA, 22 bp, Homo sapiens
tttctctgagttgttacaaaac

SEQ ID NO: 9377090 - DNA, 22 bp, Homo sapiens
tttctctgagttgttacaaaac

SEQ ID NO: 9377091 - DNA, 22 bp, Homo sapiens
tttctctgctgcctgtgtcgat

SEQ ID NO: 9377092 - DNA, 20 bp, Homo sapiens
ctctctggaaggtgggagcc

SEQ ID NO: 9377093 - DNA, 22 bp, Homo sapiens
tttctctggcattaggtataaa

SEQ ID NO: 9377094 - DNA, 22 bp, Homo sapiens
tttctctggcctcagtttaaca

SEQ ID NO: 9377095 - DNA, 22 bp, Homo sapiens
tttctctggcctcagtttaaca

SEQ ID NO: 9377096 - DNA, 22 bp, Homo sapiens
tttctgataattttgtgaaatc

SEQ ID NO: 9377097 - DNA, 22 bp, Homo sapiens
tttctgatattcatttagaaga

SEQ ID NO: 9377098 - DNA, 22 bp, Homo sapiens
tttctgatatactgtagaatcc

SEQ ID NO: 9377099 - DNA, 22 bp, Homo sapiens
tttctgatatactgtagaatcc

SEQ ID NO: 9377100 - DNA, 22 bp, Homo sapiens
tttctgataattttgtgaaatc

SEQ ID NO: 9377101 - DNA, 22 bp, Homo sapiens
tttctgataattttgtgaaatc

SEQ ID NO: 9377102 - DNA, 22 bp, Homo sapiens
tttctgcaagtgtagataccca

SEQ ID NO: 9377103 - DNA, 22 bp, Homo sapiens
tttctgcaaacttccacgtctc

SEQ ID NO: 9377104 - DNA, 22 bp, Homo sapiens
tttctgcaaaatctaagttaga

SEQ ID NO: 9377105 - DNA, 22 bp, Homo sapiens
tttctgcaacgagtctttgact

SEQ ID NO: 9377106 - DNA, 22 bp, Homo sapiens
tttctgatattcatttagaaga

SEQ ID NO: 9377107 - DNA, 22 bp, Homo sapiens
tttctgatttgacttgaagtat

SEQ ID NO: 9377108 - DNA, 22 bp, Homo sapiens
tttctgcaaaataaatagtgac

SEQ ID NO: 9377109 - DNA, 22 bp, Homo sapiens
tttctgcaaaatctaagttaga

SEQ ID NO: 9377110 - DNA, 22 bp, Homo sapiens
tttctgttgttggtgtctggct

SEQ ID NO: 9377111 - DNA, 22 bp, Homo sapiens
tttctgttgtacttaaactagg

SEQ ID NO: 9377112 - DNA, 22 bp, Homo sapiens
tttctgttgtacttaaactagg

SEQ ID NO: 9377113 - DNA, 19 bp, Homo sapiens
tttctgtttgcttctggtt

SEQ ID NO: 9377114 - DNA, 22 bp, Homo sapiens
tttctgttgttggtgtctggct

SEQ ID NO: 9377115 - DNA, 22 bp, Homo sapiens
tttctgtttagcataaagtggc

SEQ ID NO: 9377116 - DNA, 19 bp, Homo sapiens
tttctgcagcccagcagca

SEQ ID NO: 9377117 - DNA, 20 bp, Homo sapiens
tttctgcagatgtttacatg

SEQ ID NO: 9377118 - DNA, 20 bp, Homo sapiens
tttctgcagatgtttacatg

SEQ ID NO: 9377119 - DNA, 22 bp, Homo sapiens
tttctgcatctctacagttgtt

SEQ ID NO: 9377120 - DNA, 22 bp, Homo sapiens
tttctgcatatgtatgtatgga

SEQ ID NO: 9377121 - DNA, 22 bp, Homo sapiens
tttctgttgtacttaaactagg

SEQ ID NO: 9377122 - DNA, 22 bp, Homo sapiens
ctctgagggctcgagggacgcg

SEQ ID NO: 9377123 - DNA, 22 bp, Homo sapiens
ctctgaggctccatgcaggctt

SEQ ID NO: 9377124 - DNA, 22 bp, Homo sapiens
ctctctggcacttcattgctgt

SEQ ID NO: 9377125 - DNA, 22 bp, Homo sapiens
ctctctggcacttcattgctgt

SEQ ID NO: 9377126 - DNA, 22 bp, Homo sapiens
ctctctggcacttcattgctgt

SEQ ID NO: 9377127 - DNA, 22 bp, Homo sapiens
ctctctggcccatcctgttgcc

SEQ ID NO: 9377128 - DNA, 22 bp, Homo sapiens
ctctctggcccatcctgttgcc

SEQ ID NO: 9377129 - DNA, 22 bp, Homo sapiens
ctctgacagccttcattatgca

SEQ ID NO: 9377130 - DNA, 22 bp, Homo sapiens
ctctgacagccacatagaggct

SEQ ID NO: 9377131 - DNA, 22 bp, Homo sapiens
ctctgagctcgtgcagtacttc

SEQ ID NO: 9377132 - DNA, 22 bp, Homo sapiens
ctctgagctgaaacatgagcat

SEQ ID NO: 9377133 - DNA, 22 bp, Homo sapiens
tttcttgagcccaggaggtgga

SEQ ID NO: 9377134 - DNA, 22 bp, Homo sapiens
tttcttgagtgatgcttagtgt

SEQ ID NO: 9377135 - DNA, 19 bp, Homo sapiens
ctctgcctctggctgtggc

SEQ ID NO: 9377136 - DNA, 22 bp, Homo sapiens
ctctgctgctttgccagtggaa

SEQ ID NO: 9377137 - DNA, 22 bp, Homo sapiens
ctctgctgtgccgccagggcct

SEQ ID NO: 9377138 - DNA, 22 bp, Homo sapiens
ctctgctggtgaccactgggcc

SEQ ID NO: 9377139 - DNA, 22 bp, Homo sapiens
tttcttctgtttgtagttacac

SEQ ID NO: 9377140 - DNA, 22 bp, Homo sapiens
tttcttagtcctagagtgattt

SEQ ID NO: 9377141 - DNA, 21 bp, Homo sapiens
tttcttaggctctaaaatgac

SEQ ID NO: 9377142 - DNA, 21 bp, Homo sapiens
tttcttaggctctaaaatgac

SEQ ID NO: 9377143 - DNA, 21 bp, Homo sapiens
tttcttaggctctaaaatgac

SEQ ID NO: 9377144 - DNA, 22 bp, Homo sapiens
tttcttagggactgtaaaatag

SEQ ID NO: 9377145 - DNA, 22 bp, Homo sapiens
tttcttagggactgtaaaatag

SEQ ID NO: 9377146 - DNA, 19 bp, Homo sapiens
tttcttaggcctttggcct

SEQ ID NO: 9377147 - DNA, 22 bp, Homo sapiens
tttcttagcgatgcttgataaa

SEQ ID NO: 9377148 - DNA, 22 bp, Homo sapiens
tttcttaatttgagttccacta

SEQ ID NO: 9377149 - DNA, 22 bp, Homo sapiens
tttcttaaatatttgcaggaca

SEQ ID NO: 9377150 - DNA, 22 bp, Homo sapiens
tttcttcttaatactggctgct

SEQ ID NO: 9377151 - DNA, 22 bp, Homo sapiens
tttcttctgtttgtagttacac

SEQ ID NO: 9377152 - DNA, 22 bp, Homo sapiens
tttcttctgtttgtagttacac

SEQ ID NO: 9377153 - DNA, 22 bp, Homo sapiens
tttcttcttgatttaaacaggg

SEQ ID NO: 9377154 - DNA, 22 bp, Homo sapiens
tttcttgaccactatgttgata

SEQ ID NO: 9377155 - DNA, 22 bp, Homo sapiens
tttcttcttgatttaaacaggg

SEQ ID NO: 9377156 - DNA, 22 bp, Homo sapiens
tttcttcttgatttaaacaggg

SEQ ID NO: 9377157 - DNA, 22 bp, Homo sapiens
tttcttcttgatttaaacaggg

SEQ ID NO: 9377158 - DNA, 18 bp, Homo sapiens
tttgaaggatggcctgga

SEQ ID NO: 9377159 - DNA, 22 bp, Homo sapiens
tttgaagccatgtcaatagttt

SEQ ID NO: 9377160 - DNA, 22 bp, Homo sapiens
tttgaagtacctggttctgact

SEQ ID NO: 9377161 - DNA, 22 bp, Homo sapiens
tttgaagtcaaagattgattcc

SEQ ID NO: 9377162 - DNA, 22 bp, Homo sapiens
tttgaagtcagacactgctttg

SEQ ID NO: 9377163 - DNA, 22 bp, Homo sapiens
tttgaagtggatcccttcagtg

SEQ ID NO: 9377164 - DNA, 22 bp, Homo sapiens
tttgaagtgggcattagaacct

SEQ ID NO: 9377165 - DNA, 22 bp, Homo sapiens
tttgaagtggaaaaggatttaa

SEQ ID NO: 9377166 - DNA, 22 bp, Homo sapiens
tttgaagtggaaaaggatttaa

SEQ ID NO: 9377167 - DNA, 22 bp, Homo sapiens
tttgaagtgcctcttgtggatt

SEQ ID NO: 9377168 - DNA, 22 bp, Homo sapiens
tttgaagtcaggctttctaccc

SEQ ID NO: 9377169 - DNA, 22 bp, Homo sapiens
tttgaagtccatctggcccagt

SEQ ID NO: 9377170 - DNA, 22 bp, Homo sapiens
tttgaagtcagacactgctttg

SEQ ID NO: 9377171 - DNA, 22 bp, Homo sapiens
tttgaagtcagatggtctgagt

SEQ ID NO: 9377172 - DNA, 19 bp, Homo sapiens
ctctggagcagacactgga

SEQ ID NO: 9377173 - DNA, 22 bp, Homo sapiens
ctctggaattgacctgggaggg

SEQ ID NO: 9377174 - DNA, 22 bp, Homo sapiens
ctctggaattgacctgggaggg

SEQ ID NO: 9377175 - DNA, 22 bp, Homo sapiens
ctctggaattgacctgggaggg

SEQ ID NO: 9377176 - DNA, 22 bp, Homo sapiens
ctctggagcatttcacctacat

SEQ ID NO: 9377177 - DNA, 22 bp, Homo sapiens
tttgaagttggagatgggagat

SEQ ID NO: 9377178 - DNA, 22 bp, Homo sapiens
ctctggaattaaggaagcctgt

SEQ ID NO: 9377179 - DNA, 22 bp, Homo sapiens
tttgaataatcactgggcatta

SEQ ID NO: 9377180 - DNA, 22 bp, Homo sapiens
tttgaagtgtatgaaaatacag

SEQ ID NO: 9377181 - DNA, 22 bp, Homo sapiens
tttgaagtgttatttctatcac

SEQ ID NO: 9377182 - DNA, 22 bp, Homo sapiens
tttgaagtgtatgaaaatacag

SEQ ID NO: 9377183 - DNA, 23 bp, Homo sapiens
tttgaagttgactgccttccaga

SEQ ID NO: 9377184 - DNA, 22 bp, Homo sapiens
tttgaagttcccccatatcaga

SEQ ID NO: 9377185 - DNA, 22 bp, Homo sapiens
tttgaagtgttatttctatcac

SEQ ID NO: 9377186 - DNA, 22 bp, Homo sapiens
ctctggagggaggctgagctgg

SEQ ID NO: 9377187 - DNA, 22 bp, Homo sapiens
ctctggagggaggctgagctgg

SEQ ID NO: 9377188 - DNA, 22 bp, Homo sapiens
ctctggagggaggctgagctgg

SEQ ID NO: 9377189 - DNA, 19 bp, Homo sapiens
ctctggagggaccgccgtt

SEQ ID NO: 9377190 - DNA, 19 bp, Homo sapiens
ctctggagggaccgccgtt

SEQ ID NO: 9377191 - DNA, 22 bp, Homo sapiens
ctctggaggcctaaggaagtgg

SEQ ID NO: 9377192 - DNA, 22 bp, Homo sapiens
ctctggaggccgttggccctta

SEQ ID NO: 9377193 - DNA, 22 bp, Homo sapiens
ctctggaggcagcaccagccag

SEQ ID NO: 9377194 - DNA, 22 bp, Homo sapiens
ctctggagcgctgcttcccgcg

SEQ ID NO: 9377195 - DNA, 21 bp, Homo sapiens
ctctggaggcaagggagagtg

SEQ ID NO: 9377196 - DNA, 21 bp, Homo sapiens
ctctggaggcaagggagagtg

SEQ ID NO: 9377197 - DNA, 21 bp, Homo sapiens
ctctggaggcaagggagagtg

SEQ ID NO: 9377198 - DNA, 22 bp, Homo sapiens
ctctggaggcagcaccagccag

SEQ ID NO: 9377199 - DNA, 22 bp, Homo sapiens
ctctggaggttgagcccagcaa

SEQ ID NO: 9377200 - DNA, 22 bp, Homo sapiens
ctctggagtaagagctatgaaa

SEQ ID NO: 9377201 - DNA, 22 bp, Homo sapiens
ctctggagtaagagctatgaaa

SEQ ID NO: 9377202 - DNA, 22 bp, Homo sapiens
ctctggagtaagagctatgaaa

SEQ ID NO: 9377203 - DNA, 22 bp, Homo sapiens
ctctggaggtggaggttgcagt

SEQ ID NO: 9377204 - DNA, 22 bp, Homo sapiens
ctctggaggttgagcccagcaa

SEQ ID NO: 9377205 - DNA, 22 bp, Homo sapiens
ctctggaggtcaggtgtggtgg

SEQ ID NO: 9377206 - DNA, 22 bp, Homo sapiens
ctctggaggtggaggttgcagt

SEQ ID NO: 9377207 - DNA, 22 bp, Homo sapiens
ctctggaggtggaggttgcagt

SEQ ID NO: 9377208 - DNA, 22 bp, Homo sapiens
ctctggagtcaggcagccctgg

SEQ ID NO: 9377209 - DNA, 22 bp, Homo sapiens
ctctggagtcaggcagccctgg

SEQ ID NO: 9377210 - DNA, 21 bp, Homo sapiens
ctctggagtcaagagcttcca

SEQ ID NO: 9377211 - DNA, 22 bp, Homo sapiens
ctctggagtcaggcagccctgg

SEQ ID NO: 9377212 - DNA, 22 bp, Homo sapiens
gaaagagaggggctgagatgca

SEQ ID NO: 9377213 - DNA, 22 bp, Homo sapiens
gaaagaggaaggagatgtatta

SEQ ID NO: 9377214 - DNA, 22 bp, Homo sapiens
gaaagccatagcccagctttac

SEQ ID NO: 9377215 - DNA, 22 bp, Homo sapiens
gaaagccatctggctgctggga

SEQ ID NO: 9377216 - DNA, 22 bp, Homo sapiens
gaaagccatagcccagctttac

SEQ ID NO: 9377217 - DNA, 22 bp, Homo sapiens
gaaagccatagcccagctttac

SEQ ID NO: 9377218 - DNA, 22 bp, Homo sapiens
gaaagccagagagaaagggctc

SEQ ID NO: 9377219 - DNA, 22 bp, Homo sapiens
gaaagctaaatgaggtcttaca

SEQ ID NO: 9377220 - DNA, 22 bp, Homo sapiens
gaaagctctgcttcagcctgca

SEQ ID NO: 9377221 - DNA, 18 bp, Homo sapiens
gaaagccatgcagcagtg

SEQ ID NO: 9377222 - DNA, 22 bp, Homo sapiens
gaaagccatctggctgctggga

SEQ ID NO: 9377223 - DNA, 22 bp, Homo sapiens
gaaacacatgcagctccataga

SEQ ID NO: 9377224 - DNA, 22 bp, Homo sapiens
gaaacacatgcagctccataga

SEQ ID NO: 9377225 - DNA, 22 bp, Homo sapiens
gaaacagcacgtttggagagat

SEQ ID NO: 9377226 - DNA, 22 bp, Homo sapiens
gaaacacatgcagctccataga

SEQ ID NO: 9377227 - DNA, 22 bp, Homo sapiens
gaaaatttctgccacatgtgtg

SEQ ID NO: 9377228 - DNA, 22 bp, Homo sapiens
gaaaattattgaaaatggctct

SEQ ID NO: 9377229 - DNA, 22 bp, Homo sapiens
gaaaatacttcagtgttctggc

SEQ ID NO: 9377230 - DNA, 22 bp, Homo sapiens
gaaaatacttcagtgttctggc

SEQ ID NO: 9377231 - DNA, 22 bp, Homo sapiens
cttttctgtatcaaaaggatta

SEQ ID NO: 9377232 - DNA, 22 bp, Homo sapiens
cttttctgtgatgctgacagtc

SEQ ID NO: 9377233 - DNA, 22 bp, Homo sapiens
cttttctgggccccacgctgga

SEQ ID NO: 9377234 - DNA, 22 bp, Homo sapiens
cttttctgtatcaaaaggatta

SEQ ID NO: 9377235 - DNA, 22 bp, Homo sapiens
cttttctggccaggaacttgcc

SEQ ID NO: 9377236 - DNA, 22 bp, Homo sapiens
cttttctggaatcatctctaac

SEQ ID NO: 9377237 - DNA, 22 bp, Homo sapiens
cttttctgagagggccaagatt

SEQ ID NO: 9377238 - DNA, 22 bp, Homo sapiens
cttttctggaatcatctctaac

SEQ ID NO: 9377239 - DNA, 22 bp, Homo sapiens
cttttctcttacattccactgg

SEQ ID NO: 9377240 - DNA, 22 bp, Homo sapiens
cttttctctgcgggtctttcat

SEQ ID NO: 9377241 - DNA, 22 bp, Homo sapiens
cttttctctgcaccatgtgtga

SEQ ID NO: 9377242 - DNA, 22 bp, Homo sapiens
cttttctctgcgggtctttcat

SEQ ID NO: 9377243 - DNA, 21 bp, Homo sapiens
cttttctctccgcaggacatt

SEQ ID NO: 9377244 - DNA, 21 bp, Homo sapiens
cttttctgtgttcctccctgt

SEQ ID NO: 9377245 - DNA, 22 bp, Homo sapiens
cttttctgtgatgctgacagtc

SEQ ID NO: 9377246 - DNA, 21 bp, Homo sapiens
cttttctgtgttcctccctgt

SEQ ID NO: 9377247 - DNA, 22 bp, Homo sapiens
cttttctgtcagtgcccaaatt

SEQ ID NO: 9377248 - DNA, 22 bp, Homo sapiens
cttttcttactcccgcaaggca

SEQ ID NO: 9377249 - DNA, 22 bp, Homo sapiens
cttttgatagttgctgagcagg

SEQ ID NO: 9377250 - DNA, 22 bp, Homo sapiens
cttttgatggagttcaagaagc

SEQ ID NO: 9377251 - DNA, 22 bp, Homo sapiens
cttttgattgagcagtttcaaa

SEQ ID NO: 9377252 - DNA, 18 bp, Homo sapiens
ctttgcagttacagggca

SEQ ID NO: 9377253 - DNA, 22 bp, Homo sapiens
cttttacagtggacctgccatt

SEQ ID NO: 9377254 - DNA, 21 bp, Homo sapiens
cttttacattcagtcatgatg

SEQ ID NO: 9377255 - DNA, 22 bp, Homo sapiens
cttttccactgagcctcacaaa

SEQ ID NO: 9377256 - DNA, 22 bp, Homo sapiens
cttttcctattgattctgttac

SEQ ID NO: 9377257 - DNA, 22 bp, Homo sapiens
cttttccaaagtccatctggtc

SEQ ID NO: 9377258 - DNA, 22 bp, Homo sapiens
cttttccactgagcctcacaaa

SEQ ID NO: 9377259 - DNA, 22 bp, Homo sapiens
ctttgattccaggcacatgttt

SEQ ID NO: 9377260 - DNA, 22 bp, Homo sapiens
cttctggggatggagcccagaa

SEQ ID NO: 9377261 - DNA, 22 bp, Homo sapiens
cttctgggcatggcagagcctg

SEQ ID NO: 9377262 - DNA, 22 bp, Homo sapiens
cttctggcgttggaggtctgag

SEQ ID NO: 9377263 - DNA, 22 bp, Homo sapiens
cttctgggagagcttttgcttc

SEQ ID NO: 9377264 - DNA, 22 bp, Homo sapiens
cttctgggattaatttttcctg

SEQ ID NO: 9377265 - DNA, 22 bp, Homo sapiens
cttctggaaacttttccaattt

SEQ ID NO: 9377266 - DNA, 22 bp, Homo sapiens
cttctggaaacttttccaattt

SEQ ID NO: 9377267 - DNA, 22 bp, Homo sapiens
cttctggagctcaccaacttcc

SEQ ID NO: 9377268 - DNA, 22 bp, Homo sapiens
cttctggaggacactggcccca

SEQ ID NO: 9377269 - DNA, 22 bp, Homo sapiens
cttctggaggctccagggaggt

SEQ ID NO: 9377270 - DNA, 22 bp, Homo sapiens
cttctggaggctccagggaggt

SEQ ID NO: 9377271 - DNA, 22 bp, Homo sapiens
cttctggaggctccagggaggt

SEQ ID NO: 9377272 - DNA, 22 bp, Homo sapiens
cttctggataattgtgtgatta

SEQ ID NO: 9377273 - DNA, 22 bp, Homo sapiens
cttctggatttattcattcctt

SEQ ID NO: 9377274 - DNA, 22 bp, Homo sapiens
cttctggatttattcattcctt

SEQ ID NO: 9377275 - DNA, 19 bp, Homo sapiens
cttctggatccgcagggcc

SEQ ID NO: 9377276 - DNA, 22 bp, Homo sapiens
cttgtttttaagagatgtttac

SEQ ID NO: 9377277 - DNA, 22 bp, Homo sapiens
ctttaaataatacaaggtccag

SEQ ID NO: 9377278 - DNA, 22 bp, Homo sapiens
cttgttttctaaaacatcattt

SEQ ID NO: 9377279 - DNA, 22 bp, Homo sapiens
cttgttttctaaaacatcattt

SEQ ID NO: 9377280 - DNA, 22 bp, Homo sapiens
cttgttttctaaaacatcattt

SEQ ID NO: 9377281 - DNA, 22 bp, Homo sapiens
cttctgggtaattcttcttcat

SEQ ID NO: 9377282 - DNA, 22 bp, Homo sapiens
cttctgggtgcctgtgagtgtt

SEQ ID NO: 9377283 - DNA, 22 bp, Homo sapiens
cttctgggttgcaggtcttggc

SEQ ID NO: 9377284 - DNA, 22 bp, Homo sapiens
cttctgggttgcaggtcttggc

SEQ ID NO: 9377285 - DNA, 22 bp, Homo sapiens
cttctgggtgtggagtgaggac

SEQ ID NO: 9377286 - DNA, 22 bp, Homo sapiens
cttctgggtgtggagtgaggac

SEQ ID NO: 9377287 - DNA, 22 bp, Homo sapiens
cttctgggtgtggagtgaggac

SEQ ID NO: 9377288 - DNA, 19 bp, Homo sapiens
cttgtgcagttcacgctca

SEQ ID NO: 9377289 - DNA, 22 bp, Homo sapiens
cttgtgcagcctcctcttgcag

SEQ ID NO: 9377290 - DNA, 22 bp, Homo sapiens
cttgtgcaattgacattgaatc

SEQ ID NO: 9377291 - DNA, 22 bp, Homo sapiens
cttgtgcataagaagacctgag

SEQ ID NO: 9377292 - DNA, 22 bp, Homo sapiens
cttgtgcatcatagtttgccaa

SEQ ID NO: 9377293 - DNA, 19 bp, Homo sapiens
cttgtgcagttcacgctca

SEQ ID NO: 9377294 - DNA, 19 bp, Homo sapiens
cttgtgcagttcacgctca

SEQ ID NO: 9377295 - DNA, 22 bp, Homo sapiens
cttgtgcatctcttcatgacca

SEQ ID NO: 9377296 - DNA, 22 bp, Homo sapiens
cttgtgcatttcattcctcagg

SEQ ID NO: 9377297 - DNA, 22 bp, Homo sapiens
cttgtgcaagaaacctggaatg

SEQ ID NO: 9377298 - DNA, 22 bp, Homo sapiens
cttgtgcaaatcctcgagcaca

SEQ ID NO: 9377299 - DNA, 22 bp, Homo sapiens
cttctgggttgcaggtcttggc

SEQ ID NO: 9377300 - DNA, 22 bp, Homo sapiens
cttgtctttatttcatattcca

SEQ ID NO: 9377301 - DNA, 22 bp, Homo sapiens
ctttctcttcagcacccagccc

SEQ ID NO: 9377302 - DNA, 22 bp, Homo sapiens
ctttctttgtccaccaacaatg

SEQ ID NO: 9377303 - DNA, 22 bp, Homo sapiens
ctttctttgtccaccaacaatg

SEQ ID NO: 9377304 - DNA, 22 bp, Homo sapiens
ctttgaaaaatggtttcctaga

SEQ ID NO: 9377305 - DNA, 22 bp, Homo sapiens
ctttgaaaaatggtttcctaga

SEQ ID NO: 9377306 - DNA, 22 bp, Homo sapiens
ctttgaaaacacacgaatagac

SEQ ID NO: 9377307 - DNA, 22 bp, Homo sapiens
ctttgaaaacttaaataacagc

SEQ ID NO: 9377308 - DNA, 22 bp, Homo sapiens
ctttgaaaacttaaataacagc

SEQ ID NO: 9377309 - DNA, 22 bp, Homo sapiens
ctttgaaaacttaaataacagc

SEQ ID NO: 9377310 - DNA, 22 bp, Homo sapiens
ctttgaattgccgtttcatctg

SEQ ID NO: 9377311 - DNA, 22 bp, Homo sapiens
ctttgaattgccgtttcatctg

SEQ ID NO: 9377312 - DNA, 22 bp, Homo sapiens
ctttgacctcatatgacacatt

SEQ ID NO: 9377313 - DNA, 22 bp, Homo sapiens
ctttgactccatctctctttgt

SEQ ID NO: 9377314 - DNA, 22 bp, Homo sapiens
ctttgatgagcatgcaatattt

SEQ ID NO: 9377315 - DNA, 22 bp, Homo sapiens
ctttgagtaataattctgcctt

SEQ ID NO: 9377316 - DNA, 22 bp, Homo sapiens
ctttgatataagtatacatagt

SEQ ID NO: 9377317 - DNA, 22 bp, Homo sapiens
ctttgaaagctcccaggactta

SEQ ID NO: 9377318 - DNA, 22 bp, Homo sapiens
ctttgaaagctcccaggactta

SEQ ID NO: 9377319 - DNA, 22 bp, Homo sapiens
ctttgaaattcttcagctgaag

SEQ ID NO: 9377320 - DNA, 22 bp, Homo sapiens
ctttgaagagattactgtgctc

SEQ ID NO: 9377321 - DNA, 22 bp, Homo sapiens
ctttgaagatcacatgttgctc

SEQ ID NO: 9377322 - DNA, 22 bp, Homo sapiens
ctttacaaatagggagggagtg

SEQ ID NO: 9377323 - DNA, 22 bp, Homo sapiens
ctttacaaagcaattttgtctc

SEQ ID NO: 9377324 - DNA, 22 bp, Homo sapiens
ctttctcttcactgtcatgatc

SEQ ID NO: 9377325 - DNA, 22 bp, Homo sapiens
ctttctcttcactgtcatgatc

SEQ ID NO: 9377326 - DNA, 22 bp, Homo sapiens
ctttctcttcagcacccagccc

SEQ ID NO: 9377327 - DNA, 22 bp, Homo sapiens
ctttacaaactataaagtgcgg

SEQ ID NO: 9377328 - DNA, 22 bp, Homo sapiens
ctttacaaactataaagtgcgg

SEQ ID NO: 9377329 - DNA, 22 bp, Homo sapiens
ctttacaaactataaagtgcgg

SEQ ID NO: 9377330 - DNA, 22 bp, Homo sapiens
ctttaagactaaattagagttt

SEQ ID NO: 9377331 - DNA, 22 bp, Homo sapiens
ctttaaggtgatgagagatgct

SEQ ID NO: 9377332 - DNA, 22 bp, Homo sapiens
ctttaagactctgctcttggtg

SEQ ID NO: 9377333 - DNA, 22 bp, Homo sapiens
ctttaaataatacaaggtccag

SEQ ID NO: 9377334 - DNA, 22 bp, Homo sapiens
ctttaatgagtctttctgctgt

SEQ ID NO: 9377335 - DNA, 23 bp, Homo sapiens
ctttaatgaaattctctgtgaag

SEQ ID NO: 9377336 - DNA, 22 bp, Homo sapiens
ctttaatcaagataagtatact

SEQ ID NO: 9377337 - DNA, 22 bp, Homo sapiens
cttaaaatctggcagttagcta

SEQ ID NO: 9377338 - DNA, 20 bp, Homo sapiens
cttaaacacagagatagatt

SEQ ID NO: 9377339 - DNA, 20 bp, Homo sapiens
cttaaacacagagatagatt

SEQ ID NO: 9377340 - DNA, 22 bp, Homo sapiens
cttaaagaaattgaggagagga

SEQ ID NO: 9377341 - DNA, 22 bp, Homo sapiens
cttaaagaaattgaggagagga

SEQ ID NO: 9377342 - DNA, 22 bp, Homo sapiens
ctgtttctttgctgtcagagag

SEQ ID NO: 9377343 - DNA, 22 bp, Homo sapiens
ctgtttctttgctgtcagagag

SEQ ID NO: 9377344 - DNA, 22 bp, Homo sapiens
ctgtttgtgatttctacgattt

SEQ ID NO: 9377345 - DNA, 22 bp, Homo sapiens
ctgtttgtgattagcagtgggt

SEQ ID NO: 9377346 - DNA, 22 bp, Homo sapiens
ctgtttaatgaggtgtaacaac

SEQ ID NO: 9377347 - DNA, 22 bp, Homo sapiens
ctgtttaaccagatctcatatc

SEQ ID NO: 9377348 - DNA, 22 bp, Homo sapiens
ctgtggaagctgacacggtggt

SEQ ID NO: 9377349 - DNA, 22 bp, Homo sapiens
ctgtggaagagggtcaccagta

SEQ ID NO: 9377350 - DNA, 22 bp, Homo sapiens
ctgtggaagagggtcaccagta

SEQ ID NO: 9377351 - DNA, 21 bp, Homo sapiens
ctgtggaagggaactagaggg

SEQ ID NO: 9377352 - DNA, 22 bp, Homo sapiens
ctgtgcttgtgttcattgttaa

SEQ ID NO: 9377353 - DNA, 22 bp, Homo sapiens
ctgtgcttcgcaactccaaggt

SEQ ID NO: 9377354 - DNA, 22 bp, Homo sapiens
ctgtggaaaatttgtatgtaat

SEQ ID NO: 9377355 - DNA, 22 bp, Homo sapiens
ctgtggaaaatgctttacatat

SEQ ID NO: 9377356 - DNA, 22 bp, Homo sapiens
ctgtggaaataaacaatgctaa

SEQ ID NO: 9377357 - DNA, 22 bp, Homo sapiens
ctgtgctttcgagatgtgatct

SEQ ID NO: 9377358 - DNA, 21 bp, Homo sapiens
ctgtgctttttaagtgtgatg

SEQ ID NO: 9377359 - DNA, 22 bp, Homo sapiens
cttacagtacttctaatatgat

SEQ ID NO: 9377360 - DNA, 22 bp, Homo sapiens
cttacagtacttctaatatgat

SEQ ID NO: 9377361 - DNA, 22 bp, Homo sapiens
cttacagtacttctaatatgat

SEQ ID NO: 9377362 - DNA, 22 bp, Homo sapiens
cttacacactagatggtaggtg

SEQ ID NO: 9377363 - DNA, 22 bp, Homo sapiens
cttacaagaccaaagaaaggat

SEQ ID NO: 9377364 - DNA, 22 bp, Homo sapiens
cttacaagcaaaacaactgtag

SEQ ID NO: 9377365 - DNA, 22 bp, Homo sapiens
cttacagtgttgagggaattaa

SEQ ID NO: 9377366 - DNA, 22 bp, Homo sapiens
cttacagtgatcaacacaaaga

SEQ ID NO: 9377367 - DNA, 22 bp, Homo sapiens
cttacagtgatcaacacaaaga

SEQ ID NO: 9377368 - DNA, 22 bp, Homo sapiens
cttacagtgttgagggaattaa

SEQ ID NO: 9377369 - DNA, 22 bp, Homo sapiens
cttacagtgatcaacacaaaga

SEQ ID NO: 9377370 - DNA, 22 bp, Homo sapiens
cttacagtgaccctgcagattt

SEQ ID NO: 9377371 - DNA, 22 bp, Homo sapiens
cttacagtgaccctgcagattt

SEQ ID NO: 9377372 - DNA, 22 bp, Homo sapiens
cttagaaatcgaactcaggtta

SEQ ID NO: 9377373 - DNA, 22 bp, Homo sapiens
cttaaagttgacacagtccctg

SEQ ID NO: 9377374 - DNA, 22 bp, Homo sapiens
cttaaattttcatctacaagaa

SEQ ID NO: 9377375 - DNA, 22 bp, Homo sapiens
cttaatttcaaactgctagtga

SEQ ID NO: 9377376 - DNA, 22 bp, Homo sapiens
cttaatttaagcctagaatgca

SEQ ID NO: 9377377 - DNA, 22 bp, Homo sapiens
cttaatttaaaatagttcaggc

SEQ ID NO: 9377378 - DNA, 22 bp, Homo sapiens
cttaatttttgtagtagatgga

SEQ ID NO: 9377379 - DNA, 22 bp, Homo sapiens
cttacaaaggagaggagatagg

SEQ ID NO: 9377380 - DNA, 22 bp, Homo sapiens
cttacaaaggagaggagatagg

SEQ ID NO: 9377381 - DNA, 22 bp, Homo sapiens
cttacaaatacacttaggagag

SEQ ID NO: 9377382 - DNA, 22 bp, Homo sapiens
cttacaaatacacttaggagag

SEQ ID NO: 9377383 - DNA, 22 bp, Homo sapiens
cttccagcttgtggcgctttcc

SEQ ID NO: 9377384 - DNA, 22 bp, Homo sapiens
cttccagctgattggcatccag

SEQ ID NO: 9377385 - DNA, 22 bp, Homo sapiens
cttccagctgattacaggctat

SEQ ID NO: 9377386 - DNA, 22 bp, Homo sapiens
cttcctgggtctggagactgga

SEQ ID NO: 9377387 - DNA, 22 bp, Homo sapiens
cttccaggacaccagggtagta

SEQ ID NO: 9377388 - DNA, 22 bp, Homo sapiens
cttcctgggtctggagactgga

SEQ ID NO: 9377389 - DNA, 22 bp, Homo sapiens
cttcctgttgtcacagtctgcg

SEQ ID NO: 9377390 - DNA, 22 bp, Homo sapiens
cttccttcaatataatttttac

SEQ ID NO: 9377391 - DNA, 22 bp, Homo sapiens
cttcctgttgtatttgtgagcc

SEQ ID NO: 9377392 - DNA, 22 bp, Homo sapiens
cttcctgttgtcacagtctgcg

SEQ ID NO: 9377393 - DNA, 22 bp, Homo sapiens
cttccttccacaccttcagaat

SEQ ID NO: 9377394 - DNA, 22 bp, Homo sapiens
cttcctttccccaatcatatcg

SEQ ID NO: 9377395 - DNA, 22 bp, Homo sapiens
cttcctttgctgttcggaggtt

SEQ ID NO: 9377396 - DNA, 20 bp, Homo sapiens
cttccttttccttcgtcaaa

SEQ ID NO: 9377397 - DNA, 22 bp, Homo sapiens
cttcctttggttggagcgccgt

SEQ ID NO: 9377398 - DNA, 22 bp, Homo sapiens
cttccactactcttagatctgc

SEQ ID NO: 9377399 - DNA, 22 bp, Homo sapiens
cttccactctgagtccaccctg

SEQ ID NO: 9377400 - DNA, 22 bp, Homo sapiens
cttccagagctgggctgacctt

SEQ ID NO: 9377401 - DNA, 22 bp, Homo sapiens
cttccagagatagggcctcaag

SEQ ID NO: 9377402 - DNA, 22 bp, Homo sapiens
cttccagctgattacaggctat

SEQ ID NO: 9377403 - DNA, 22 bp, Homo sapiens
cttccagaggaactctgcagtg

SEQ ID NO: 9377404 - DNA, 22 bp, Homo sapiens
cttccagaggaactctgcagtg

SEQ ID NO: 9377405 - DNA, 22 bp, Homo sapiens
cttccagaggaactctgcagtg

SEQ ID NO: 9377406 - DNA, 22 bp, Homo sapiens
cttccagagctgggctgacctt

SEQ ID NO: 9377407 - DNA, 22 bp, Homo sapiens
cttccagagctgggctgacctt

SEQ ID NO: 9377408 - DNA, 22 bp, Homo sapiens
cttccaagtggggcacgtgcca

SEQ ID NO: 9377409 - DNA, 22 bp, Homo sapiens
cttccaagatgaacagcaagcg

SEQ ID NO: 9377410 - DNA, 22 bp, Homo sapiens
cttccaagatgaacagcaagcg

SEQ ID NO: 9377411 - DNA, 22 bp, Homo sapiens
cttccaagcccaggagccattt

SEQ ID NO: 9377412 - DNA, 20 bp, Homo sapiens
cttccaccagggccgctgat

SEQ ID NO: 9377413 - DNA, 22 bp, Homo sapiens
cttccacattatttaggaatcc

SEQ ID NO: 9377414 - DNA, 22 bp, Homo sapiens
cttccaatagcaacaaagatta

SEQ ID NO: 9377415 - DNA, 20 bp, Homo sapiens
cttccacacaagaagcacag

SEQ ID NO: 9377416 - DNA, 20 bp, Homo sapiens
cttccacacaagaagcacag

SEQ ID NO: 9377417 - DNA, 22 bp, Homo sapiens
cttctacacatccctcttgctt

SEQ ID NO: 9377418 - DNA, 22 bp, Homo sapiens
cttctacaaggttgtcctctat

SEQ ID NO: 9377419 - DNA, 22 bp, Homo sapiens
cttctacacgtggctgtgccaa

SEQ ID NO: 9377420 - DNA, 22 bp, Homo sapiens
cttctacaggcccagcgagtgt

SEQ ID NO: 9377421 - DNA, 17 bp, Homo sapiens
cttctagaaggcaaact

SEQ ID NO: 9377422 - DNA, 22 bp, Homo sapiens
cttctagagctggagcaaatgt

SEQ ID NO: 9377423 - DNA, 23 bp, Homo sapiens
cttctagagtcagctccaagttt

SEQ ID NO: 9377424 - DNA, 22 bp, Homo sapiens
cttctcagcttaggtatggttt

SEQ ID NO: 9377425 - DNA, 22 bp, Homo sapiens
cttctcagcattttgtcagtct

SEQ ID NO: 9377426 - DNA, 22 bp, Homo sapiens
cttctcagcattttgtcagtct

SEQ ID NO: 9377427 - DNA, 22 bp, Homo sapiens
cttctcagcatggttactgtga

SEQ ID NO: 9377428 - DNA, 22 bp, Homo sapiens
cttctcagcatggttactgtga

SEQ ID NO: 9377429 - DNA, 22 bp, Homo sapiens
cttctcagatctcagctttgag

SEQ ID NO: 9377430 - DNA, 22 bp, Homo sapiens
cttctcagatctcagctttgag

SEQ ID NO: 9377431 - DNA, 22 bp, Homo sapiens
cttctcagaggccagaagctat

SEQ ID NO: 9377432 - DNA, 23 bp, Homo sapiens
cttctcagaagtctgtgccagga

SEQ ID NO: 9377433 - DNA, 23 bp, Homo sapiens
cttctcagaagtctgtgccagga

SEQ ID NO: 9377434 - DNA, 23 bp, Homo sapiens
cttctcagaagtctgtgccagga

SEQ ID NO: 9377435 - DNA, 22 bp, Homo sapiens
cttatagtatgatgttgagaat

SEQ ID NO: 9377436 - DNA, 22 bp, Homo sapiens
cttatatttgtcaactttacaa

SEQ ID NO: 9377437 - DNA, 22 bp, Homo sapiens
cttcagtgttgccagggcctag

SEQ ID NO: 9377438 - DNA, 19 bp, Homo sapiens
cttcattcttcagcttttg

SEQ ID NO: 9377439 - DNA, 19 bp, Homo sapiens
cttcattcttcagcttttg

SEQ ID NO: 9377440 - DNA, 22 bp, Homo sapiens
cttcagtgttggttcattacga

SEQ ID NO: 9377441 - DNA, 22 bp, Homo sapiens
cttcatttcaggctgaagaata

SEQ ID NO: 9377442 - DNA, 22 bp, Homo sapiens
cttcatttcaggctgaagaata

SEQ ID NO: 9377443 - DNA, 18 bp, Homo sapiens
cttcatttgtagagttcc

SEQ ID NO: 9377444 - DNA, 22 bp, Homo sapiens
cttcatttggagaactgtgctt

SEQ ID NO: 9377445 - DNA, 22 bp, Homo sapiens
cttagcatgtggtgtccttgta

SEQ ID NO: 9377446 - DNA, 22 bp, Homo sapiens
cttaggcaagcagagcccatcc

SEQ ID NO: 9377447 - DNA, 22 bp, Homo sapiens
cttaggagttcacttgaatagt

SEQ ID NO: 9377448 - DNA, 22 bp, Homo sapiens
cttaggcagtttaggaaagaga

SEQ ID NO: 9377449 - DNA, 22 bp, Homo sapiens
cttagtttctctgtatgtttac

SEQ ID NO: 9377450 - DNA, 22 bp, Homo sapiens
cttagtttctgtttctgattaa

SEQ ID NO: 9377451 - DNA, 22 bp, Homo sapiens
cttagtttgcatgattatggag

SEQ ID NO: 9377452 - DNA, 22 bp, Homo sapiens
cttataaagtccatctgaacaa

SEQ ID NO: 9377453 - DNA, 22 bp, Homo sapiens
ctgtccttactgcttctggctt

SEQ ID NO: 9377454 - DNA, 22 bp, Homo sapiens
ctgtcctgtgtcagcctgaaat

SEQ ID NO: 9377455 - DNA, 22 bp, Homo sapiens
ctgtcctgtggtgacaggtaca

SEQ ID NO: 9377456 - DNA, 22 bp, Homo sapiens
ctgtcaggtttcccggctcacg

SEQ ID NO: 9377457 - DNA, 22 bp, Homo sapiens
ctgtcaggtttcccatctgcaa

SEQ ID NO: 9377458 - DNA, 22 bp, Homo sapiens
ctgtcaggtttcccatctgcaa

SEQ ID NO: 9377459 - DNA, 22 bp, Homo sapiens
ctgtcaggtttcccatctgcaa

SEQ ID NO: 9377460 - DNA, 19 bp, Homo sapiens
ctgtccttggctgcactgt

SEQ ID NO: 9377461 - DNA, 19 bp, Homo sapiens
ctgtccttggctgcactgt

SEQ ID NO: 9377462 - DNA, 22 bp, Homo sapiens
ctgtctgccaataatctatggc

SEQ ID NO: 9377463 - DNA, 22 bp, Homo sapiens
ctgtcaggggcgggtggagcgg

SEQ ID NO: 9377464 - DNA, 22 bp, Homo sapiens
ctgtcaggggcgggtggagcgg

SEQ ID NO: 9377465 - DNA, 19 bp, Homo sapiens
ctgtcaggggctggatgtt

SEQ ID NO: 9377466 - DNA, 19 bp, Homo sapiens
ctgtcaggggctggatgtt

SEQ ID NO: 9377467 - DNA, 22 bp, Homo sapiens
ctgtcagggggcctggccatca

SEQ ID NO: 9377468 - DNA, 19 bp, Homo sapiens
ctgtcaggggctggatgtt

SEQ ID NO: 9377469 - DNA, 18 bp, Homo sapiens
ctgtcagcagcttcacga

SEQ ID NO: 9377470 - DNA, 22 bp, Homo sapiens
ctgtcagcttctcctggccaga

SEQ ID NO: 9377471 - DNA, 22 bp, Homo sapiens
ctgtcaggaagctgggcatcca

SEQ ID NO: 9377472 - DNA, 22 bp, Homo sapiens
ctgtcaggaagctgggcatcca

SEQ ID NO: 9377473 - DNA, 22 bp, Homo sapiens
ctgtcaggaagctgggcatcca

SEQ ID NO: 9377474 - DNA, 22 bp, Homo sapiens
ctgtcactgatgggctcaccag

SEQ ID NO: 9377475 - DNA, 22 bp, Homo sapiens
ctgtcacttaaattcaggctga

SEQ ID NO: 9377476 - DNA, 22 bp, Homo sapiens
ctgtcacctgttcactgcagca

SEQ ID NO: 9377477 - DNA, 22 bp, Homo sapiens
ctgtcacctgttcactgcagca

SEQ ID NO: 9377478 - DNA, 22 bp, Homo sapiens
ctgtataacatcttttgtttcc

SEQ ID NO: 9377479 - DNA, 22 bp, Homo sapiens
ctgtataaccccatgcgactgt

SEQ ID NO: 9377480 - DNA, 22 bp, Homo sapiens
ctgtataagataccacactgaa

SEQ ID NO: 9377481 - DNA, 22 bp, Homo sapiens
ctgtataattcatgctcttatt

SEQ ID NO: 9377482 - DNA, 22 bp, Homo sapiens
ctgtataaacatattttcaagt

SEQ ID NO: 9377483 - DNA, 22 bp, Homo sapiens
ctgtagttgatgatttctgata

SEQ ID NO: 9377484 - DNA, 22 bp, Homo sapiens
ctgtagttgggcattataatag

SEQ ID NO: 9377485 - DNA, 20 bp, Homo sapiens
ctgtagggtgcagcaggctc

SEQ ID NO: 9377486 - DNA, 22 bp, Homo sapiens
ctgtatatggcttactttatat

SEQ ID NO: 9377487 - DNA, 22 bp, Homo sapiens
ctgtatttgaaagaaaagattt

SEQ ID NO: 9377488 - DNA, 22 bp, Homo sapiens
ctgtatatggcttactttatat

SEQ ID NO: 9377489 - DNA, 22 bp, Homo sapiens
ctgtatttgaaagaaaagattt

SEQ ID NO: 9377490 - DNA, 22 bp, Homo sapiens
ctgtatataatgtatgcatggg

SEQ ID NO: 9377491 - DNA, 22 bp, Homo sapiens
ctgtatatcatggttttgcagt

SEQ ID NO: 9377492 - DNA, 22 bp, Homo sapiens
ctgtatttgtcctctatttatt

SEQ ID NO: 9377493 - DNA, 22 bp, Homo sapiens
ctgtatttgaaagaaaagattt

SEQ ID NO: 9377494 - DNA, 23 bp, Homo sapiens
ctgtatttgacttgagcggaaat

SEQ ID NO: 9377495 - DNA, 23 bp, Homo sapiens
ctgtatttgacttgagcggaaat

SEQ ID NO: 9377496 - DNA, 22 bp, Homo sapiens
ctgtcaccatttgagccctgga

SEQ ID NO: 9377497 - DNA, 22 bp, Homo sapiens
ctgtcaccatttgagccctgga

SEQ ID NO: 9377498 - DNA, 22 bp, Homo sapiens
ctgtcacccacccagcctgtca

SEQ ID NO: 9377499 - DNA, 22 bp, Homo sapiens
ctgtattttcatgcctacgtac

SEQ ID NO: 9377500 - DNA, 22 bp, Homo sapiens
ctgtattttttaagaatatctc

SEQ ID NO: 9377501 - DNA, 22 bp, Homo sapiens
ctgtattttttaagtgatctgg

SEQ ID NO: 9377502 - DNA, 22 bp, Homo sapiens
ctgtcaaattcataacacttat

SEQ ID NO: 9377503 - DNA, 22 bp, Homo sapiens
ctgtctgtactgagagttctgt

SEQ ID NO: 9377504 - DNA, 22 bp, Homo sapiens
ctgtctgtgacctctgcatgtc

SEQ ID NO: 9377505 - DNA, 19 bp, Homo sapiens
ctgtctgtgcagagatgtg

SEQ ID NO: 9377506 - DNA, 19 bp, Homo sapiens
ctgtctgtgcagagatgtg

SEQ ID NO: 9377507 - DNA, 22 bp, Homo sapiens
ctgtctggatgtgagtcaccta

SEQ ID NO: 9377508 - DNA, 21 bp, Homo sapiens
ctgtctggccgcgggctccgc

SEQ ID NO: 9377509 - DNA, 22 bp, Homo sapiens
ctgtctgggtctacatcctctg

SEQ ID NO: 9377510 - DNA, 22 bp, Homo sapiens
ctgtctggaatgcagtacatag

SEQ ID NO: 9377511 - DNA, 22 bp, Homo sapiens
ctgtgctggagatgggccagag

SEQ ID NO: 9377512 - DNA, 22 bp, Homo sapiens
ctgtgctgtcttgggagcctta

SEQ ID NO: 9377513 - DNA, 22 bp, Homo sapiens
ctgtgctggtgaaacccacaga

SEQ ID NO: 9377514 - DNA, 22 bp, Homo sapiens
ctgtgctggtccagggagctgg

SEQ ID NO: 9377515 - DNA, 22 bp, Homo sapiens
ctgtgctctggcatcgctgcaa

SEQ ID NO: 9377516 - DNA, 17 bp, Homo sapiens
ctgtgctcgagtgatgg

SEQ ID NO: 9377517 - DNA, 22 bp, Homo sapiens
ctgtgctgattcagcacaggcc

SEQ ID NO: 9377518 - DNA, 22 bp, Homo sapiens
ctgtgctgattcagcacaggcc

SEQ ID NO: 9377519 - DNA, 22 bp, Homo sapiens
ctgtgccctggccaggcctctc

SEQ ID NO: 9377520 - DNA, 22 bp, Homo sapiens
ctgtgccctgtggctggcacct

SEQ ID NO: 9377521 - DNA, 17 bp, Homo sapiens
ctgtgctcgagtgatgg

SEQ ID NO: 9377522 - DNA, 18 bp, Homo sapiens
ctgtgccctgctcctact

SEQ ID NO: 9377523 - DNA, 22 bp, Homo sapiens
ctggggacgtcgggcagtgttc

SEQ ID NO: 9377524 - DNA, 22 bp, Homo sapiens
ctggggacgtcgggcagtgttc

SEQ ID NO: 9377525 - DNA, 20 bp, Homo sapiens
ctggggacagcaatggctgt

SEQ ID NO: 9377526 - DNA, 22 bp, Homo sapiens
ctggggaaggcggtgactgcgc

SEQ ID NO: 9377527 - DNA, 22 bp, Homo sapiens
ctggggaatagagctggagacc

SEQ ID NO: 9377528 - DNA, 22 bp, Homo sapiens
ctggggaatagagctggagacc

SEQ ID NO: 9377529 - DNA, 22 bp, Homo sapiens
ctggggactttggttctccatg

SEQ ID NO: 9377530 - DNA, 22 bp, Homo sapiens
ctgggctttcaggccctaaggc

SEQ ID NO: 9377531 - DNA, 22 bp, Homo sapiens
ctgggctttcaggccctaaggc

SEQ ID NO: 9377532 - DNA, 22 bp, Homo sapiens
ctgggcttgtgttagctgacaa

SEQ ID NO: 9377533 - DNA, 22 bp, Homo sapiens
ctgggcttgcactgcagcgaga

SEQ ID NO: 9377534 - DNA, 22 bp, Homo sapiens
ctgggcttgcactgcagcgaga

SEQ ID NO: 9377535 - DNA, 19 bp, Homo sapiens
ctgggcttgatgttgagtt

SEQ ID NO: 9377536 - DNA, 22 bp, Homo sapiens
ctgggcttctccccctggcaga

SEQ ID NO: 9377537 - DNA, 22 bp, Homo sapiens
ctgggcttgagttcctgctcgt

SEQ ID NO: 9377538 - DNA, 22 bp, Homo sapiens
ctgggcttaggacctggtgcgg

SEQ ID NO: 9377539 - DNA, 22 bp, Homo sapiens
ctgggcttaggacctggtgcgg

SEQ ID NO: 9377540 - DNA, 22 bp, Homo sapiens
ctgggctttgaagccaggctgc

SEQ ID NO: 9377541 - DNA, 22 bp, Homo sapiens
ctgggctttggtactgtgatta

SEQ ID NO: 9377542 - DNA, 22 bp, Homo sapiens
ctgggcttttgagtcacaaggg

SEQ ID NO: 9377543 - DNA, 22 bp, Homo sapiens
ctgggctttggtactgtgatta

SEQ ID NO: 9377544 - DNA, 22 bp, Homo sapiens
ctgggctttgaagccaggctgc

SEQ ID NO: 9377545 - DNA, 21 bp, Homo sapiens
ctgggctttctctcaaagaca

SEQ ID NO: 9377546 - DNA, 22 bp, Homo sapiens
ctgggcttttgagtcacaaggg

SEQ ID NO: 9377547 - DNA, 22 bp, Homo sapiens
ctggggaacaatttgccacact

SEQ ID NO: 9377548 - DNA, 22 bp, Homo sapiens
ctggggaacgcagcgagcagcg

SEQ ID NO: 9377549 - DNA, 20 bp, Homo sapiens
ctggtctgccactcacagtt

SEQ ID NO: 9377550 - DNA, 20 bp, Homo sapiens
ctggtctgccactcacagtt

SEQ ID NO: 9377551 - DNA, 22 bp, Homo sapiens
ctggtctgcaaggccatataga

SEQ ID NO: 9377552 - DNA, 22 bp, Homo sapiens
ctggtctgaggttgcccttgaa

SEQ ID NO: 9377553 - DNA, 22 bp, Homo sapiens
ctggtctgccacccacacccct

SEQ ID NO: 9377554 - DNA, 22 bp, Homo sapiens
ctggtctgagggctcttgaggc

SEQ ID NO: 9377555 - DNA, 22 bp, Homo sapiens
ctggtctgaggttgcccttgaa

SEQ ID NO: 9377556 - DNA, 22 bp, Homo sapiens
ctggtctgagggctcttgaggc

SEQ ID NO: 9377557 - DNA, 22 bp, Homo sapiens
ctggtctgaaaaggaggcatgc

SEQ ID NO: 9377558 - DNA, 19 bp, Homo sapiens
ctggtctgctgcttccagg

SEQ ID NO: 9377559 - DNA, 22 bp, Homo sapiens
ctggtctgctagaaagatgcat

SEQ ID NO: 9377560 - DNA, 22 bp, Homo sapiens
ctggtctgctagaaagatgcat

SEQ ID NO: 9377561 - DNA, 22 bp, Homo sapiens
ctggtctgcgggaaggcgtggg

SEQ ID NO: 9377562 - DNA, 22 bp, Homo sapiens
ctggtctgtggtattttattat

SEQ ID NO: 9377563 - DNA, 16 bp, Homo sapiens
ctggtcttgctgccga

SEQ ID NO: 9377564 - DNA, 19 bp, Homo sapiens
ctggtctgtcatgctcccc

SEQ ID NO: 9377565 - DNA, 22 bp, Homo sapiens
ctggtctgtccgcaggtcacct

SEQ ID NO: 9377566 - DNA, 16 bp, Homo sapiens
ctggtcttgctgccga

SEQ ID NO: 9377567 - DNA, 22 bp, Homo sapiens
ctggtctgtccgcaggtcacct

SEQ ID NO: 9377568 - DNA, 22 bp, Homo sapiens
ctggtctggctagtttaggcca

SEQ ID NO: 9377569 - DNA, 22 bp, Homo sapiens
ctggtctggtttgtttagacag

SEQ ID NO: 9377570 - DNA, 22 bp, Homo sapiens
ctggtctgggatgagggatgta

SEQ ID NO: 9377571 - DNA, 22 bp, Homo sapiens
ctggtctgggatgagggatgta

SEQ ID NO: 9377572 - DNA, 22 bp, Homo sapiens
ctggtctggctacccagcgaat

SEQ ID NO: 9377573 - DNA, 21 bp, Homo sapiens
ctggtctggccaataaggtcc

SEQ ID NO: 9377574 - DNA, 22 bp, Homo sapiens
ctggtctggctacccagcgaat

SEQ ID NO: 9377575 - DNA, 21 bp, Homo sapiens
ctggtctggccaataaggtcc

SEQ ID NO: 9377576 - DNA, 22 bp, Homo sapiens
ctggtctgaaaaggaggcatgc

SEQ ID NO: 9377577 - DNA, 22 bp, Homo sapiens
ctggtcagctgaagccccacac

SEQ ID NO: 9377578 - DNA, 23 bp, Homo sapiens
ctggtcagaggctgctggaaggg

SEQ ID NO: 9377579 - DNA, 23 bp, Homo sapiens
ctggtcagaggctgctggaaggg

SEQ ID NO: 9377580 - DNA, 22 bp, Homo sapiens
ctggtcagagcaactgctcaca

SEQ ID NO: 9377581 - DNA, 22 bp, Homo sapiens
ctggtcacctccttcccagcta

SEQ ID NO: 9377582 - DNA, 20 bp, Homo sapiens
ctggggagctgctcccacga

SEQ ID NO: 9377583 - DNA, 22 bp, Homo sapiens
ctgtagccagaagcagaaggcc

SEQ ID NO: 9377584 - DNA, 22 bp, Homo sapiens
ctgtagagaaagcatggaagct

SEQ ID NO: 9377585 - DNA, 22 bp, Homo sapiens
ctgtagagaaagcatggaagct

SEQ ID NO: 9377586 - DNA, 22 bp, Homo sapiens
ctgtacatatacatttttttcc

SEQ ID NO: 9377587 - DNA, 20 bp, Homo sapiens
ctgtacatcaccaaggtgac

SEQ ID NO: 9377588 - DNA, 22 bp, Homo sapiens
ctgtacaatgttacctatttat

SEQ ID NO: 9377589 - DNA, 22 bp, Homo sapiens
ctgtacaagtccttcatcaggg

SEQ ID NO: 9377590 - DNA, 22 bp, Homo sapiens
ctgtacaggagacgtctgtgca

SEQ ID NO: 9377591 - DNA, 22 bp, Homo sapiens
ctgtacagagttctgagtgtac

SEQ ID NO: 9377592 - DNA, 19 bp, Homo sapiens
ctgtacaggttgcttctgg

SEQ ID NO: 9377593 - DNA, 22 bp, Homo sapiens
ctgtaaaacactgtagtatctg

SEQ ID NO: 9377594 - DNA, 22 bp, Homo sapiens
ctggtgccctgtgtggcaggag

SEQ ID NO: 9377595 - DNA, 22 bp, Homo sapiens
ctggtgccattctgtggcctag

SEQ ID NO: 9377596 - DNA, 22 bp, Homo sapiens
ctggtgccattctgtggcctag

SEQ ID NO: 9377597 - DNA, 22 bp, Homo sapiens
ctggtttttagtgcttaggagt

SEQ ID NO: 9377598 - DNA, 22 bp, Homo sapiens
ctggtgccctgtgtggcaggag

SEQ ID NO: 9377599 - DNA, 22 bp, Homo sapiens
ctgtacaaatggcagttgagtt

SEQ ID NO: 9377600 - DNA, 22 bp, Homo sapiens
ctgtacaaagtagctgctggga

SEQ ID NO: 9377601 - DNA, 22 bp, Homo sapiens
ctgtacaaaagaaagttcctat

SEQ ID NO: 9377602 - DNA, 20 bp, Homo sapiens
ctgtaaaccaggcttcttgg

SEQ ID NO: 9377603 - DNA, 22 bp, Homo sapiens
ctggtgcaggaaggagctggca

SEQ ID NO: 9377604 - DNA, 22 bp, Homo sapiens
ctggtgcacattcgctctcata

SEQ ID NO: 9377605 - DNA, 22 bp, Homo sapiens
ctggtgcaaggctttggaatcc

SEQ ID NO: 9377606 - DNA, 22 bp, Homo sapiens
ctggtgaccttgccccaggtca

SEQ ID NO: 9377607 - DNA, 22 bp, Homo sapiens
ctggtgagactcagggatgctt

SEQ ID NO: 9377608 - DNA, 22 bp, Homo sapiens
ctggtgagacggttgacaggag

SEQ ID NO: 9377609 - DNA, 22 bp, Homo sapiens
ctgggcagaattttaggatggc

SEQ ID NO: 9377610 - DNA, 22 bp, Homo sapiens
ctgggcactttggggagcctac

SEQ ID NO: 9377611 - DNA, 22 bp, Homo sapiens
ctgggcagaattttaggatggc

SEQ ID NO: 9377612 - DNA, 22 bp, Homo sapiens
ctgggcagagtccggaagatgg

SEQ ID NO: 9377613 - DNA, 22 bp, Homo sapiens
ctgggcagagctaacacctgag

SEQ ID NO: 9377614 - DNA, 22 bp, Homo sapiens
ctgggcagcacatcatcgtatc

SEQ ID NO: 9377615 - DNA, 22 bp, Homo sapiens
ctgggcagcctcacacaatgtt

SEQ ID NO: 9377616 - DNA, 22 bp, Homo sapiens
ctgggcagctaccaccactgct

SEQ ID NO: 9377617 - DNA, 22 bp, Homo sapiens
ctgggcagctaccaccactgct

SEQ ID NO: 9377618 - DNA, 22 bp, Homo sapiens
ctgggcagctaccaccactgct

SEQ ID NO: 9377619 - DNA, 22 bp, Homo sapiens
ctgggcagctccataccaccca

SEQ ID NO: 9377620 - DNA, 22 bp, Homo sapiens
ctgggcagctgtatcagggagt

SEQ ID NO: 9377621 - DNA, 22 bp, Homo sapiens
ctgggcagctgtatcagggagt

SEQ ID NO: 9377622 - DNA, 22 bp, Homo sapiens
ctgggcagctgtatcagggagt

SEQ ID NO: 9377623 - DNA, 22 bp, Homo sapiens
ctgggcagctgtatcagggagt

SEQ ID NO: 9377624 - DNA, 22 bp, Homo sapiens
ctgggcagctgtatcagggagt

SEQ ID NO: 9377625 - DNA, 22 bp, Homo sapiens
ctgggcctccagctctgccagc

SEQ ID NO: 9377626 - DNA, 22 bp, Homo sapiens
ctgggcagctgtgcaaacaata

SEQ ID NO: 9377627 - DNA, 22 bp, Homo sapiens
ctgggcagctgtatcagggagt

SEQ ID NO: 9377628 - DNA, 22 bp, Homo sapiens
ctgggcacttgctcacagctct

SEQ ID NO: 9377629 - DNA, 22 bp, Homo sapiens
ctgggcacttgctcacagctct

SEQ ID NO: 9377630 - DNA, 22 bp, Homo sapiens
ctgggcactgcagcaggcatca

SEQ ID NO: 9377631 - DNA, 17 bp, Homo sapiens
ctgggatgtggactctt

SEQ ID NO: 9377632 - DNA, 22 bp, Homo sapiens
ctgggatgtgaggagcgcctct

SEQ ID NO: 9377633 - DNA, 22 bp, Homo sapiens
ctgggcaatatgctgggcctgg

SEQ ID NO: 9377634 - DNA, 22 bp, Homo sapiens
ctgggatgtgaggagcgcctct

SEQ ID NO: 9377635 - DNA, 22 bp, Homo sapiens
ctgggagcggctgtcactggtt

SEQ ID NO: 9377636 - DNA, 22 bp, Homo sapiens
ctgggagccctgactagcctgg

SEQ ID NO: 9377637 - DNA, 22 bp, Homo sapiens
ctgggagcccgcgtcctggtgg

SEQ ID NO: 9377638 - DNA, 22 bp, Homo sapiens
ctgggagcgcagcaggcacaac

SEQ ID NO: 9377639 - DNA, 22 bp, Homo sapiens
ctgggagcaagaggctgcaaat

SEQ ID NO: 9377640 - DNA, 22 bp, Homo sapiens
ctgggagcaccatacttgtttc

SEQ ID NO: 9377641 - DNA, 22 bp, Homo sapiens
ctgggccttcattgctctccca

SEQ ID NO: 9377642 - DNA, 22 bp, Homo sapiens
ctgggccttcattgctctccca

SEQ ID NO: 9377643 - DNA, 22 bp, Homo sapiens
ctgggccttagggcactccctt

SEQ ID NO: 9377644 - DNA, 22 bp, Homo sapiens
ctgggccttatgagtacctgga

SEQ ID NO: 9377645 - DNA, 22 bp, Homo sapiens
ctgggccttgatcacacaggtg

SEQ ID NO: 9377646 - DNA, 22 bp, Homo sapiens
ctgggccttgcatcccagagcc

SEQ ID NO: 9377647 - DNA, 22 bp, Homo sapiens
ctgggcctgtgggcacacggac

SEQ ID NO: 9377648 - DNA, 22 bp, Homo sapiens
ctgggccttagggcactccctt

SEQ ID NO: 9377649 - DNA, 17 bp, Homo sapiens
ctgggcctcccctgtcc

SEQ ID NO: 9377650 - DNA, 22 bp, Homo sapiens
ctgggcctggtgtggcacctgc

SEQ ID NO: 9377651 - DNA, 22 bp, Homo sapiens
ctgggcgtgtcttccagctggc

SEQ ID NO: 9377652 - DNA, 22 bp, Homo sapiens
ctgggcgcgtcccctgaggcgg

SEQ ID NO: 9377653 - DNA, 22 bp, Homo sapiens
ctgggccttggattgacactgt

SEQ ID NO: 9377654 - DNA, 22 bp, Homo sapiens
ctgggccttggattgacactgt

SEQ ID NO: 9377655 - DNA, 22 bp, Homo sapiens
ctgggccttggattgacactgt

SEQ ID NO: 9377656 - DNA, 22 bp, Homo sapiens
ctgggccttggattgacactgt

SEQ ID NO: 9377657 - DNA, 22 bp, Homo sapiens
ctgggccttggattgacactgt

SEQ ID NO: 9377658 - DNA, 22 bp, Homo sapiens
ctgggcctttgggagttcggtg

SEQ ID NO: 9377659 - DNA, 22 bp, Homo sapiens
ctgggctggataattctttgct

SEQ ID NO: 9377660 - DNA, 21 bp, Homo sapiens
ctgggctggcaggcattacct

SEQ ID NO: 9377661 - DNA, 22 bp, Homo sapiens
ctgggctggagtgcaatggcgc

SEQ ID NO: 9377662 - DNA, 22 bp, Homo sapiens
ctgggctggagtgcaatggcgc

SEQ ID NO: 9377663 - DNA, 22 bp, Homo sapiens
ctgggcttagcagctcctggtc

SEQ ID NO: 9377664 - DNA, 22 bp, Homo sapiens
ctgggctgtttgtttagaatgg

SEQ ID NO: 9377665 - DNA, 22 bp, Homo sapiens
ctgggcttagcagctcctggtc

SEQ ID NO: 9377666 - DNA, 22 bp, Homo sapiens
ctgggcttagcagctcctggtc

SEQ ID NO: 9377667 - DNA, 22 bp, Homo sapiens
ctgggctgtttgttctggtctc

SEQ ID NO: 9377668 - DNA, 22 bp, Homo sapiens
ctgggctgtttgttctggtctc

SEQ ID NO: 9377669 - DNA, 22 bp, Homo sapiens
ctgggctggcgcatccgacacg

SEQ ID NO: 9377670 - DNA, 22 bp, Homo sapiens
ctgcttcagcaaagctatttgc

SEQ ID NO: 9377671 - DNA, 22 bp, Homo sapiens
ctgcttcacgttgtgccttgtt

SEQ ID NO: 9377672 - DNA, 22 bp, Homo sapiens
ctgcttcaccctgcctgagaac

SEQ ID NO: 9377673 - DNA, 22 bp, Homo sapiens
ctgcttcatagccctggtctct

SEQ ID NO: 9377674 - DNA, 22 bp, Homo sapiens
ctgcttccaagaaagagatagg

SEQ ID NO: 9377675 - DNA, 22 bp, Homo sapiens
ctgcttcatatttcatagtgat

SEQ ID NO: 9377676 - DNA, 22 bp, Homo sapiens
ctgcttcatgtcctgggacctg

SEQ ID NO: 9377677 - DNA, 22 bp, Homo sapiens
ctgcttccatgcaatggcagtc

SEQ ID NO: 9377678 - DNA, 20 bp, Homo sapiens
ctgcttccaggctcaccccc

SEQ ID NO: 9377679 - DNA, 20 bp, Homo sapiens
ctgcttccaggctcaccccc

SEQ ID NO: 9377680 - DNA, 22 bp, Homo sapiens
ctgcttcctccctgtaaaggca

SEQ ID NO: 9377681 - DNA, 21 bp, Homo sapiens
ctgcttcctctcttcatggca

SEQ ID NO: 9377682 - DNA, 22 bp, Homo sapiens
ctgcttcctgctgggatactga

SEQ ID NO: 9377683 - DNA, 22 bp, Homo sapiens
ctgggaagaatccaagggccct

SEQ ID NO: 9377684 - DNA, 22 bp, Homo sapiens
ctgggaagatggtgacagaatt

SEQ ID NO: 9377685 - DNA, 22 bp, Homo sapiens
ctgggacacccagagctgcaga

SEQ ID NO: 9377686 - DNA, 22 bp, Homo sapiens
ctgggacagagcagcagtgggg

SEQ ID NO: 9377687 - DNA, 22 bp, Homo sapiens
ctgctgtgcacccaggaaggct

SEQ ID NO: 9377688 - DNA, 22 bp, Homo sapiens
ctgctgtgcaacattgcaccta

SEQ ID NO: 9377689 - DNA, 22 bp, Homo sapiens
ctgctgtgattgggagaaaccg

SEQ ID NO: 9377690 - DNA, 22 bp, Homo sapiens
ctgctgtgtggtgaaactcagt

SEQ ID NO: 9377691 - DNA, 22 bp, Homo sapiens
ctgctgtgtggattcaatggct

SEQ ID NO: 9377692 - DNA, 22 bp, Homo sapiens
ctgctgtgttcctcctgcatct

SEQ ID NO: 9377693 - DNA, 22 bp, Homo sapiens
ctgctgtgttgccagtgtcacc

SEQ ID NO: 9377694 - DNA, 22 bp, Homo sapiens
ctgctgtgttgccagtgtcacc

SEQ ID NO: 9377695 - DNA, 22 bp, Homo sapiens
ctgctgtgttcctcctgcatct

SEQ ID NO: 9377696 - DNA, 22 bp, Homo sapiens
ctgctgtgttcctcctgcatct

SEQ ID NO: 9377697 - DNA, 22 bp, Homo sapiens
ctgctgtgttcctcctgcatct

SEQ ID NO: 9377698 - DNA, 20 bp, Homo sapiens
ctgctgtgtgtgcctcagcc

SEQ ID NO: 9377699 - DNA, 20 bp, Homo sapiens
ctgctgtgtgtgcctcagcc

SEQ ID NO: 9377700 - DNA, 22 bp, Homo sapiens
ctgctgtgttagcaggtttagt

SEQ ID NO: 9377701 - DNA, 20 bp, Homo sapiens
ctgctgtgttattgtagaac

SEQ ID NO: 9377702 - DNA, 22 bp, Homo sapiens
ctgctgtgttagcaggtttagt

SEQ ID NO: 9377703 - DNA, 22 bp, Homo sapiens
ctgctgtgttgccagtgtcacc

SEQ ID NO: 9377704 - DNA, 22 bp, Homo sapiens
ctgctgtgttggcattggatag

SEQ ID NO: 9377705 - DNA, 23 bp, Homo sapiens
ctgctgtgttggtctcgatggga

SEQ ID NO: 9377706 - DNA, 22 bp, Homo sapiens
ctgctgtgtttctgctagaaaa

SEQ ID NO: 9377707 - DNA, 22 bp, Homo sapiens
ctgctgtgtttcacacctctgg

SEQ ID NO: 9377708 - DNA, 22 bp, Homo sapiens
ctgctgttgccacctgcatgga

SEQ ID NO: 9377709 - DNA, 23 bp, Homo sapiens
ctgctgttttctgtacctgaagc

SEQ ID NO: 9377710 - DNA, 22 bp, Homo sapiens
ctgctgtttctcaaaattaagt

SEQ ID NO: 9377711 - DNA, 22 bp, Homo sapiens
ctgcttcacccaactttgggat

SEQ ID NO: 9377712 - DNA, 22 bp, Homo sapiens
ctgggagatctgttgggactgg

SEQ ID NO: 9377713 - DNA, 22 bp, Homo sapiens
ctgggagatctgttgggactgg

SEQ ID NO: 9377714 - DNA, 22 bp, Homo sapiens
ctgggagatctcctgagggcag

SEQ ID NO: 9377715 - DNA, 22 bp, Homo sapiens
ctgggagatctcctgagggcag

SEQ ID NO: 9377716 - DNA, 22 bp, Homo sapiens
ctgggagatctgttgggactgg

SEQ ID NO: 9377717 - DNA, 22 bp, Homo sapiens
ctgggagatgactcagagcagg

SEQ ID NO: 9377718 - DNA, 22 bp, Homo sapiens
ctgggagattgctagagatgca

SEQ ID NO: 9377719 - DNA, 22 bp, Homo sapiens
ctgggagattgaggccatggtg

SEQ ID NO: 9377720 - DNA, 22 bp, Homo sapiens
ctgggagattgaggccatggtg

SEQ ID NO: 9377721 - DNA, 22 bp, Homo sapiens
ctgggagattgaggccatggtg

SEQ ID NO: 9377722 - DNA, 22 bp, Homo sapiens
ctgggagaggtggtgggaagta

SEQ ID NO: 9377723 - DNA, 22 bp, Homo sapiens
ctgggagaggtggtgggaagta

SEQ ID NO: 9377724 - DNA, 22 bp, Homo sapiens
ctgggagatatgaggatctgga

SEQ ID NO: 9377725 - DNA, 22 bp, Homo sapiens
ctgggagatctcctgagggcag

SEQ ID NO: 9377726 - DNA, 22 bp, Homo sapiens
ctgggactggacctctgcctgg

SEQ ID NO: 9377727 - DNA, 22 bp, Homo sapiens
ctgggactgggtcctcaggaca

SEQ ID NO: 9377728 - DNA, 22 bp, Homo sapiens
ctgggagaggctgctccgctct

SEQ ID NO: 9377729 - DNA, 22 bp, Homo sapiens
ctgggaccctgccctgtggcct

SEQ ID NO: 9377730 - DNA, 22 bp, Homo sapiens
ctgggaccatctgtgtctactt

SEQ ID NO: 9377731 - DNA, 22 bp, Homo sapiens
ctgggactcagaccagttctgt

SEQ ID NO: 9377732 - DNA, 22 bp, Homo sapiens
ctgggactggacctctgcctgg

SEQ ID NO: 9377733 - DNA, 23 bp, Homo sapiens
ctgggacatggtaggggcacaac

SEQ ID NO: 9377734 - DNA, 22 bp, Homo sapiens
ctgggacatggtgctgtcttta

SEQ ID NO: 9377735 - DNA, 23 bp, Homo sapiens
ctgggacatggtaggggcacaac

SEQ ID NO: 9377736 - DNA, 22 bp, Homo sapiens
ctgggacatggtgctgtcttta

SEQ ID NO: 9377737 - DNA, 22 bp, Homo sapiens
ctgggacatattgctagtgttg

SEQ ID NO: 9377738 - DNA, 22 bp, Homo sapiens
ctgggacatattgctagtgttg

SEQ ID NO: 9377739 - DNA, 22 bp, Homo sapiens
ctgggacatagatcagcctttt

SEQ ID NO: 9377740 - DNA, 22 bp, Homo sapiens
gagcatctctatagtgactgtg

SEQ ID NO: 9377741 - DNA, 22 bp, Homo sapiens
gagcatctgatgagattggatt

SEQ ID NO: 9377742 - DNA, 22 bp, Homo sapiens
gagcatctatgtgctgggtact

SEQ ID NO: 9377743 - DNA, 22 bp, Homo sapiens
gagcatcgctgagatcccagac

SEQ ID NO: 9377744 - DNA, 22 bp, Homo sapiens
gagcagttatttttagacatga

SEQ ID NO: 9377745 - DNA, 22 bp, Homo sapiens
gagcagttttatttcatgagac

SEQ ID NO: 9377746 - DNA, 22 bp, Homo sapiens
gagcagtgggaaggaacagggt

SEQ ID NO: 9377747 - DNA, 22 bp, Homo sapiens
gagcagtggtcacagggaggga

SEQ ID NO: 9377748 - DNA, 22 bp, Homo sapiens
gagcagtgtttgtggacctgga

SEQ ID NO: 9377749 - DNA, 22 bp, Homo sapiens
gagcagtgtttgtggacctgga

SEQ ID NO: 9377750 - DNA, 22 bp, Homo sapiens
gagcagtggtggtgtgttagag

SEQ ID NO: 9377751 - DNA, 22 bp, Homo sapiens
gagcagtggtggtgtgttagag

SEQ ID NO: 9377752 - DNA, 22 bp, Homo sapiens
gagcagtggtctgatcttctaa

SEQ ID NO: 9377753 - DNA, 22 bp, Homo sapiens
gagcatggtgcttcagtgaagg

SEQ ID NO: 9377754 - DNA, 18 bp, Homo sapiens
gagcatgggcagtgggga

SEQ ID NO: 9377755 - DNA, 18 bp, Homo sapiens
gagcatgggcagtgggga

SEQ ID NO: 9377756 - DNA, 22 bp, Homo sapiens
gagcatctggctagaggagtga

SEQ ID NO: 9377757 - DNA, 22 bp, Homo sapiens
gagcatggatcatgtgctgggt

SEQ ID NO: 9377758 - DNA, 22 bp, Homo sapiens
gagcatggatcatgtgctgggt

SEQ ID NO: 9377759 - DNA, 22 bp, Homo sapiens
gagcatggatagaaggtgggat

SEQ ID NO: 9377760 - DNA, 22 bp, Homo sapiens
gagaggggacctgtgtgtctag

SEQ ID NO: 9377761 - DNA, 22 bp, Homo sapiens
gagaggggacctgtgtgtctag

SEQ ID NO: 9377762 - DNA, 22 bp, Homo sapiens
gagagggctgcctggtgtgagg

SEQ ID NO: 9377763 - DNA, 22 bp, Homo sapiens
gagagggctggaaacttcctgg

SEQ ID NO: 9377764 - DNA, 22 bp, Homo sapiens
gagagggctggaaacttcctgg

SEQ ID NO: 9377765 - DNA, 22 bp, Homo sapiens
gagaggggcgcgcagctcgcga

SEQ ID NO: 9377766 - DNA, 22 bp, Homo sapiens
gagaggggcgcgcagctcgcga

SEQ ID NO: 9377767 - DNA, 22 bp, Homo sapiens
gagaggggcccaagccacatag

SEQ ID NO: 9377768 - DNA, 22 bp, Homo sapiens
gagaggggcgcgcagctcgcga

SEQ ID NO: 9377769 - DNA, 22 bp, Homo sapiens
gagaggggcgcgcagctcgcga

SEQ ID NO: 9377770 - DNA, 22 bp, Homo sapiens
gagcaggcttgcagagaagggg

SEQ ID NO: 9377771 - DNA, 22 bp, Homo sapiens
gagagggtgcctggaagccagg

SEQ ID NO: 9377772 - DNA, 20 bp, Homo sapiens
gagcagtggagtttccaggg

SEQ ID NO: 9377773 - DNA, 22 bp, Homo sapiens
gagcagtgccaaagaatttgcg

SEQ ID NO: 9377774 - DNA, 22 bp, Homo sapiens
gagcagtgatgggaggacgtca

SEQ ID NO: 9377775 - DNA, 22 bp, Homo sapiens
gagcagtgagtgaatgttgcct

SEQ ID NO: 9377776 - DNA, 19 bp, Homo sapiens
gagcagtgaggaccaccag

SEQ ID NO: 9377777 - DNA, 22 bp, Homo sapiens
gagcagggagacaactctggtg

SEQ ID NO: 9377778 - DNA, 22 bp, Homo sapiens
gagcccaggaagtggaggctga

SEQ ID NO: 9377779 - DNA, 22 bp, Homo sapiens
gagcccaggaagtggaggctga

SEQ ID NO: 9377780 - DNA, 22 bp, Homo sapiens
gagcccaggagtttgatgctgc

SEQ ID NO: 9377781 - DNA, 22 bp, Homo sapiens
gagcccagctgtccttggcaaa

SEQ ID NO: 9377782 - DNA, 22 bp, Homo sapiens
gagcccagctgtccttggcaaa

SEQ ID NO: 9377783 - DNA, 22 bp, Homo sapiens
gagcccaggaagtggaggctga

SEQ ID NO: 9377784 - DNA, 22 bp, Homo sapiens
gagcccagctctacctcagact

SEQ ID NO: 9377785 - DNA, 22 bp, Homo sapiens
gagcccagctgcggccctcagc

SEQ ID NO: 9377786 - DNA, 22 bp, Homo sapiens
gagcccagctctacctcagact

SEQ ID NO: 9377787 - DNA, 22 bp, Homo sapiens
gagccattgtccaagcctgttt

SEQ ID NO: 9377788 - DNA, 22 bp, Homo sapiens
gagcatggttccataggttggt

SEQ ID NO: 9377789 - DNA, 22 bp, Homo sapiens
gagccaggtttgaatctcagtc

SEQ ID NO: 9377790 - DNA, 22 bp, Homo sapiens
gagcccaggttctgcttccagc

SEQ ID NO: 9377791 - DNA, 22 bp, Homo sapiens
gagcccaggttctgcttccagc

SEQ ID NO: 9377792 - DNA, 22 bp, Homo sapiens
gagcccagtaggcaaagctgca

SEQ ID NO: 9377793 - DNA, 22 bp, Homo sapiens
gagcccagtctgctcctgcgcc

SEQ ID NO: 9377794 - DNA, 22 bp, Homo sapiens
gagcccagtctgctcctgcgcc

SEQ ID NO: 9377795 - DNA, 22 bp, Homo sapiens
gagccctgacactgagggagtt

SEQ ID NO: 9377796 - DNA, 22 bp, Homo sapiens
gagcccaggctggggttcagag

SEQ ID NO: 9377797 - DNA, 22 bp, Homo sapiens
gagcccaggctggggttcagag

SEQ ID NO: 9377798 - DNA, 22 bp, Homo sapiens
gagcccaggatggtgtatggct

SEQ ID NO: 9377799 - DNA, 22 bp, Homo sapiens
gagcccagggtgaaatagcagc

SEQ ID NO: 9377800 - DNA, 22 bp, Homo sapiens
gaggaaagaaccccagtcaata

SEQ ID NO: 9377801 - DNA, 23 bp, Homo sapiens
gaggaaagaatatagatgcaatc

SEQ ID NO: 9377802 - DNA, 22 bp, Homo sapiens
gaggaaagaaccccagtcaata

SEQ ID NO: 9377803 - DNA, 22 bp, Homo sapiens
gaggaaagaaccccagtcaata

SEQ ID NO: 9377804 - DNA, 22 bp, Homo sapiens
gaggaaacattgtagaagcagt

SEQ ID NO: 9377805 - DNA, 18 bp, Homo sapiens
gaggaaacaggctctgtg

SEQ ID NO: 9377806 - DNA, 18 bp, Homo sapiens
gaggaaacaaggcagagg

SEQ ID NO: 9377807 - DNA, 23 bp, Homo sapiens
gaggaaagaatatagatgcaatc

SEQ ID NO: 9377808 - DNA, 23 bp, Homo sapiens
gaggaaagaatatagatgcaatc

SEQ ID NO: 9377809 - DNA, 22 bp, Homo sapiens
gaggaaagagtcaaatctgaag

SEQ ID NO: 9377810 - DNA, 22 bp, Homo sapiens
gaggaaagctggtttaaagtat

SEQ ID NO: 9377811 - DNA, 22 bp, Homo sapiens
gaggaaagctggtttaaagtat

SEQ ID NO: 9377812 - DNA, 22 bp, Homo sapiens
gagctgcttccagagttgagtg

SEQ ID NO: 9377813 - DNA, 22 bp, Homo sapiens
gagctgctgtgaggggagcttc

SEQ ID NO: 9377814 - DNA, 22 bp, Homo sapiens
gagctgctgtgaggggagcttc

SEQ ID NO: 9377815 - DNA, 22 bp, Homo sapiens
gagctgctggttgctggtgcct

SEQ ID NO: 9377816 - DNA, 22 bp, Homo sapiens
gagctgctggaagtggagccct

SEQ ID NO: 9377817 - DNA, 22 bp, Homo sapiens
gagctgctggctcctcaggtta

SEQ ID NO: 9377818 - DNA, 22 bp, Homo sapiens
gaggagagagggactgtctgca

SEQ ID NO: 9377819 - DNA, 22 bp, Homo sapiens
gaggagagagggactgtctgca

SEQ ID NO: 9377820 - DNA, 22 bp, Homo sapiens
gaggaagaatcagggtggtgag

SEQ ID NO: 9377821 - DNA, 22 bp, Homo sapiens
gaggaagaagcaaaccagctaa

SEQ ID NO: 9377822 - DNA, 22 bp, Homo sapiens
gaggaagaaagcataggtgggg

SEQ ID NO: 9377823 - DNA, 22 bp, Homo sapiens
gaggaagaagggattagaactc

SEQ ID NO: 9377824 - DNA, 22 bp, Homo sapiens
gaggaacagcagccacatgtcc

SEQ ID NO: 9377825 - DNA, 22 bp, Homo sapiens
gaggaacagagacgggatcgct

SEQ ID NO: 9377826 - DNA, 22 bp, Homo sapiens
gaggaacagagacgggatcgct

SEQ ID NO: 9377827 - DNA, 19 bp, Homo sapiens
gaggaactggcttggttcc

SEQ ID NO: 9377828 - DNA, 22 bp, Homo sapiens
gaggaagaaagcataggtgggg

SEQ ID NO: 9377829 - DNA, 22 bp, Homo sapiens
gaggaagaaagcataggtgggg

SEQ ID NO: 9377830 - DNA, 22 bp, Homo sapiens
gaggaacctgggcttccatcct

SEQ ID NO: 9377831 - DNA, 22 bp, Homo sapiens
gagccctgtagcaagtcatgtc

SEQ ID NO: 9377832 - DNA, 22 bp, Homo sapiens
gagccctggcagtctgggatgg

SEQ ID NO: 9377833 - DNA, 22 bp, Homo sapiens
gagccctgtagcaagtcatgtc

SEQ ID NO: 9377834 - DNA, 22 bp, Homo sapiens
gagctgagatttgaagcaagtt

SEQ ID NO: 9377835 - DNA, 22 bp, Homo sapiens
gagctgagatcgtgccattgca

SEQ ID NO: 9377836 - DNA, 22 bp, Homo sapiens
gagctgagatcatgtacactag

SEQ ID NO: 9377837 - DNA, 22 bp, Homo sapiens
gagctgagatcatgtacactag

SEQ ID NO: 9377838 - DNA, 22 bp, Homo sapiens
gagccctgttcaggcctcctca

SEQ ID NO: 9377839 - DNA, 22 bp, Homo sapiens
gagccctgtgattctgttgtgt

SEQ ID NO: 9377840 - DNA, 22 bp, Homo sapiens
gagccctgtaggaatctctcaa

SEQ ID NO: 9377841 - DNA, 22 bp, Homo sapiens
gagccctgcttccaagggggca

SEQ ID NO: 9377842 - DNA, 22 bp, Homo sapiens
gagccctgctgggccttgtctc

SEQ ID NO: 9377843 - DNA, 18 bp, Homo sapiens
gagccctgagtctgcaca

SEQ ID NO: 9377844 - DNA, 18 bp, Homo sapiens
gagccctgagtctgcaca

SEQ ID NO: 9377845 - DNA, 18 bp, Homo sapiens
gagccctgagtctgcaca

SEQ ID NO: 9377846 - DNA, 22 bp, Homo sapiens
gagccctgcccacttgtctgag

SEQ ID NO: 9377847 - DNA, 22 bp, Homo sapiens
gagctgagggtctaggagggtt

SEQ ID NO: 9377848 - DNA, 22 bp, Homo sapiens
gagctgaggtgatgtggtcgtt

SEQ ID NO: 9377849 - DNA, 22 bp, Homo sapiens
gagctgagtatcccactgaagt

SEQ ID NO: 9377850 - DNA, 22 bp, Homo sapiens
gagctgagtatcccactgaagt

SEQ ID NO: 9377851 - DNA, 22 bp, Homo sapiens
gagctgagtatgaaggatgtga

SEQ ID NO: 9377852 - DNA, 23 bp, Homo sapiens
gagctgagtgtagggagactagg

SEQ ID NO: 9377853 - DNA, 22 bp, Homo sapiens
gagctgagtatgaaggatgtga

SEQ ID NO: 9377854 - DNA, 22 bp, Homo sapiens
gagctgagtctgcagtcgccat

SEQ ID NO: 9377855 - DNA, 22 bp, Homo sapiens
gagctgaggctcaggctggcgt

SEQ ID NO: 9377856 - DNA, 22 bp, Homo sapiens
gagctgaggccagagtcttctg

SEQ ID NO: 9377857 - DNA, 22 bp, Homo sapiens
gagctgaggccagagtcttctg

SEQ ID NO: 9377858 - DNA, 22 bp, Homo sapiens
gagctgaggctgaggcctcact

SEQ ID NO: 9377859 - DNA, 22 bp, Homo sapiens
gagctgagggtctaggagggtt

SEQ ID NO: 9377860 - DNA, 22 bp, Homo sapiens
gagctgagcttaactccttgaa

SEQ ID NO: 9377861 - DNA, 22 bp, Homo sapiens
gagctgaggatacatcagtgaa

SEQ ID NO: 9377862 - DNA, 22 bp, Homo sapiens
gagctgaggatacatcagtgaa

SEQ ID NO: 9377863 - DNA, 22 bp, Homo sapiens
gagctgagcctgggtggaccgc

SEQ ID NO: 9377864 - DNA, 22 bp, Homo sapiens
gagctgagcagggagcctcact

SEQ ID NO: 9377865 - DNA, 22 bp, Homo sapiens
gagggagggccaggtcccaacc

SEQ ID NO: 9377866 - DNA, 22 bp, Homo sapiens
gagggaggggagctccaccctc

SEQ ID NO: 9377867 - DNA, 22 bp, Homo sapiens
gagggagctggagcagacgccg

SEQ ID NO: 9377868 - DNA, 22 bp, Homo sapiens
gagggagctggagcagacgccg

SEQ ID NO: 9377869 - DNA, 22 bp, Homo sapiens
gagggaggcatcatgaatccag

SEQ ID NO: 9377870 - DNA, 22 bp, Homo sapiens
gagggaggcatcatgaatccag

SEQ ID NO: 9377871 - DNA, 22 bp, Homo sapiens
gagggagagtgatggaccattg

SEQ ID NO: 9377872 - DNA, 22 bp, Homo sapiens
gagggagccgccacagactggg

SEQ ID NO: 9377873 - DNA, 22 bp, Homo sapiens
gagggagccgccacagactggg

SEQ ID NO: 9377874 - DNA, 22 bp, Homo sapiens
gagggagagtgatggaccattg

SEQ ID NO: 9377875 - DNA, 22 bp, Homo sapiens
gaggctgcattcttcccactgc

SEQ ID NO: 9377876 - DNA, 22 bp, Homo sapiens
gaggctgcattcttcccactgc

SEQ ID NO: 9377877 - DNA, 22 bp, Homo sapiens
gaggctgcaggcaatgctgccc

SEQ ID NO: 9377878 - DNA, 22 bp, Homo sapiens
gaggctgcagctatcagacatt

SEQ ID NO: 9377879 - DNA, 22 bp, Homo sapiens
gaggctgcaggcaatgctgccc

SEQ ID NO: 9377880 - DNA, 22 bp, Homo sapiens
gaggctgcattcttcccactgc

SEQ ID NO: 9377881 - DNA, 22 bp, Homo sapiens
gaggctgcactggctaaaggct

SEQ ID NO: 9377882 - DNA, 22 bp, Homo sapiens
gaggctgcactggctaaaggct

SEQ ID NO: 9377883 - DNA, 22 bp, Homo sapiens
gaggctgcactggctaaaggct

SEQ ID NO: 9377884 - DNA, 22 bp, Homo sapiens
gaggctgattcggggaacagca

SEQ ID NO: 9377885 - DNA, 22 bp, Homo sapiens
gaggctgattcggggaacagca

SEQ ID NO: 9377886 - DNA, 22 bp, Homo sapiens
gaggctgagtagctttgtgctc

SEQ ID NO: 9377887 - DNA, 22 bp, Homo sapiens
gaggctgatgctgcctcacaga

SEQ ID NO: 9377888 - DNA, 22 bp, Homo sapiens
gaggctgagtagctttgtgctc

SEQ ID NO: 9377889 - DNA, 22 bp, Homo sapiens
gaggctgaggcggatggatcac

SEQ ID NO: 9377890 - DNA, 22 bp, Homo sapiens
gaggctgaggcggatggatcac

SEQ ID NO: 9377891 - DNA, 22 bp, Homo sapiens
gaggctgaggcaggaggatcac

SEQ ID NO: 9377892 - DNA, 22 bp, Homo sapiens
gaggctgaggcaggaggatcac

SEQ ID NO: 9377893 - DNA, 22 bp, Homo sapiens
gaggctgagggttagagagtca

SEQ ID NO: 9377894 - DNA, 22 bp, Homo sapiens
gaggctgagggttagagagtca

SEQ ID NO: 9377895 - DNA, 22 bp, Homo sapiens
gaggctgaggttgcagtgagct

SEQ ID NO: 9377896 - DNA, 22 bp, Homo sapiens
gaggctgaggttgcagtgagct

SEQ ID NO: 9377897 - DNA, 22 bp, Homo sapiens
gaggctgaggttgcagtgagct

SEQ ID NO: 9377898 - DNA, 22 bp, Homo sapiens
gaggctgaggttgcagtgagcc

SEQ ID NO: 9377899 - DNA, 22 bp, Homo sapiens
gaggctgaggttgcagtgagcc

SEQ ID NO: 9377900 - DNA, 22 bp, Homo sapiens
gaggctgaggttgcagtgagcc

SEQ ID NO: 9377901 - DNA, 22 bp, Homo sapiens
gaggctgaggttgcagtgagct

SEQ ID NO: 9377902 - DNA, 22 bp, Homo sapiens
gaggctgaggttgcagtgagcc

SEQ ID NO: 9377903 - DNA, 22 bp, Homo sapiens
gagggagtaacgtactacagtg

SEQ ID NO: 9377904 - DNA, 18 bp, Homo sapiens
gagggagtagctgaggtt

SEQ ID NO: 9377905 - DNA, 22 bp, Homo sapiens
gagggaggtgatactgaacgta

SEQ ID NO: 9377906 - DNA, 22 bp, Homo sapiens
gagggaggtgatactgaacgta

SEQ ID NO: 9377907 - DNA, 22 bp, Homo sapiens
gagggctgatgttgccacctca

SEQ ID NO: 9377908 - DNA, 22 bp, Homo sapiens
gagggctgatgttgccacctca

SEQ ID NO: 9377909 - DNA, 18 bp, Homo sapiens
gagggagtagctgaggtt

SEQ ID NO: 9377910 - DNA, 22 bp, Homo sapiens
gagggagtgccagagggccagc

SEQ ID NO: 9377911 - DNA, 22 bp, Homo sapiens
gagggctgcaatgagacagaga

SEQ ID NO: 9377912 - DNA, 22 bp, Homo sapiens
gagggctgcaatgagacagaga

SEQ ID NO: 9377913 - DNA, 22 bp, Homo sapiens
gagggctgcaatgagacagaga

SEQ ID NO: 9377914 - DNA, 22 bp, Homo sapiens
gagggctgcaatgagacagaga

SEQ ID NO: 9377915 - DNA, 22 bp, Homo sapiens
gagggctgcaatgagacagaga

SEQ ID NO: 9377916 - DNA, 22 bp, Homo sapiens
gagggctgcaatgagacagaga

SEQ ID NO: 9377917 - DNA, 22 bp, Homo sapiens
gagggctgatgttgccacctca

SEQ ID NO: 9377918 - DNA, 22 bp, Homo sapiens
gagggctgatgttgccacctca

SEQ ID NO: 9377919 - DNA, 22 bp, Homo sapiens
gagggctgctgccagatatgcc

SEQ ID NO: 9377920 - DNA, 22 bp, Homo sapiens
gagggctgctggaaaaatgcag

SEQ ID NO: 9377921 - DNA, 22 bp, Homo sapiens
gagggctgctgccagatatgcc

SEQ ID NO: 9377922 - DNA, 22 bp, Homo sapiens
gagggctgctgccagatatgcc

SEQ ID NO: 9377923 - DNA, 22 bp, Homo sapiens
gagggctgctgccagatatgcc

SEQ ID NO: 9377924 - DNA, 22 bp, Homo sapiens
gagggctgctgccagatatgcc

SEQ ID NO: 9377925 - DNA, 22 bp, Homo sapiens
gagggctgctgccagatatgcc

SEQ ID NO: 9377926 - DNA, 22 bp, Homo sapiens
gagggctgccacgttgggcgag

SEQ ID NO: 9377927 - DNA, 22 bp, Homo sapiens
gagggctgccacgttgggcgag

SEQ ID NO: 9377928 - DNA, 22 bp, Homo sapiens
gagggctgccacgttgggcgag

SEQ ID NO: 9377929 - DNA, 22 bp, Homo sapiens
gaggggctggcacgatggctgc

SEQ ID NO: 9377930 - DNA, 22 bp, Homo sapiens
gaggggctggcacgatggctgc

SEQ ID NO: 9377931 - DNA, 22 bp, Homo sapiens
gaggggctggcacgatggctgc

SEQ ID NO: 9377932 - DNA, 22 bp, Homo sapiens
gaggggctggctgtggtcccat

SEQ ID NO: 9377933 - DNA, 22 bp, Homo sapiens
gaggggctctttaatagtaaca

SEQ ID NO: 9377934 - DNA, 22 bp, Homo sapiens
gaggggaaagtgtgaggctgcg

SEQ ID NO: 9377935 - DNA, 22 bp, Homo sapiens
gaggggctgccctggtgtcagg

SEQ ID NO: 9377936 - DNA, 22 bp, Homo sapiens
gaggggctgccctggtgtcagg

SEQ ID NO: 9377937 - DNA, 22 bp, Homo sapiens
gaggggctggcacgatggctgc

SEQ ID NO: 9377938 - DNA, 22 bp, Homo sapiens
gagggctgtggggcatgaccag

SEQ ID NO: 9377939 - DNA, 22 bp, Homo sapiens
gagggctgtggggcatgaccag

SEQ ID NO: 9377940 - DNA, 22 bp, Homo sapiens
gagggctgtggggcatgaccag

SEQ ID NO: 9377941 - DNA, 22 bp, Homo sapiens
gagggctgtgaaggagcgggtt

SEQ ID NO: 9377942 - DNA, 22 bp, Homo sapiens
gagggctgtggggcatgaccag

SEQ ID NO: 9377943 - DNA, 22 bp, Homo sapiens
gagggctgtggggcatgaccag

SEQ ID NO: 9377944 - DNA, 22 bp, Homo sapiens
gagggctgtgaaggagcgggtt

SEQ ID NO: 9377945 - DNA, 22 bp, Homo sapiens
gagggctggggcttaggcttag

SEQ ID NO: 9377946 - DNA, 22 bp, Homo sapiens
gagggctggggcttaggcttag

SEQ ID NO: 9377947 - DNA, 22 bp, Homo sapiens
gagggctgtgaaggagcgggtt

SEQ ID NO: 9377948 - DNA, 22 bp, Homo sapiens
gagggctgtgaaggagcgggtt

SEQ ID NO: 9377949 - DNA, 22 bp, Homo sapiens
gagggctgtgaaggagcgggtt

SEQ ID NO: 9377950 - DNA, 22 bp, Homo sapiens
gagggctgctggaaaaatgcag

SEQ ID NO: 9377951 - DNA, 22 bp, Homo sapiens
gagggctgctggaaaaatgcag

SEQ ID NO: 9377952 - DNA, 22 bp, Homo sapiens
gagggctgctggaaaaatgcag

SEQ ID NO: 9377953 - DNA, 22 bp, Homo sapiens
gagggctggggcttaggcttag

SEQ ID NO: 9377954 - DNA, 22 bp, Homo sapiens
gagggctggggcttaggcttag

SEQ ID NO: 9377955 - DNA, 22 bp, Homo sapiens
gagggctgctggaaaaatgcag

SEQ ID NO: 9377956 - DNA, 22 bp, Homo sapiens
gaggctcagttatgtcatcagg

SEQ ID NO: 9377957 - DNA, 22 bp, Homo sapiens
gaggctcagttatgtcatcagg

SEQ ID NO: 9377958 - DNA, 22 bp, Homo sapiens
gaggctcagttatgtcatcagg

SEQ ID NO: 9377959 - DNA, 22 bp, Homo sapiens
gaggctcagggagtatatgaat

SEQ ID NO: 9377960 - DNA, 22 bp, Homo sapiens
gaggctccagcgacacctaggc

SEQ ID NO: 9377961 - DNA, 22 bp, Homo sapiens
gaggctcattgcattgtgcatt

SEQ ID NO: 9377962 - DNA, 22 bp, Homo sapiens
gaggctgaacaggttctcatga

SEQ ID NO: 9377963 - DNA, 22 bp, Homo sapiens
gaggctcagagggagcatggtc

SEQ ID NO: 9377964 - DNA, 22 bp, Homo sapiens
gaggctcagagggagcatggtc

SEQ ID NO: 9377965 - DNA, 22 bp, Homo sapiens
gaggctcagggaaacagcgcag

SEQ ID NO: 9377966 - DNA, 22 bp, Homo sapiens
gaggctcagagggagcatggtc

SEQ ID NO: 9377967 - DNA, 22 bp, Homo sapiens
gaggctcagagaggtccacata

SEQ ID NO: 9377968 - DNA, 22 bp, Homo sapiens
gaggctcagagaagtcatggta

SEQ ID NO: 9377969 - DNA, 22 bp, Homo sapiens
gaggctcagagggagcatggtc

SEQ ID NO: 9377970 - DNA, 22 bp, Homo sapiens
gaggctgaagtgtacatgggtg

SEQ ID NO: 9377971 - DNA, 22 bp, Homo sapiens
gaggctgaagtgtacatgggtg

SEQ ID NO: 9377972 - DNA, 20 bp, Homo sapiens
gaggctgaagtgtttttgct

SEQ ID NO: 9377973 - DNA, 20 bp, Homo sapiens
gaggctgaagtgtttttgct

SEQ ID NO: 9377974 - DNA, 22 bp, Homo sapiens
gaggctgaatggccagaagcca

SEQ ID NO: 9377975 - DNA, 22 bp, Homo sapiens
gaggctgaatggccagaagcca

SEQ ID NO: 9377976 - DNA, 22 bp, Homo sapiens
gaggctgaatggccagaagcca

SEQ ID NO: 9377977 - DNA, 22 bp, Homo sapiens
gaggctgaatggccagaagcca

SEQ ID NO: 9377978 - DNA, 22 bp, Homo sapiens
gaggctgagactctgaattttt

SEQ ID NO: 9377979 - DNA, 22 bp, Homo sapiens
gaggctgacggcaccatcttct

SEQ ID NO: 9377980 - DNA, 22 bp, Homo sapiens
gaggctgaggcaggaggatcac

SEQ ID NO: 9377981 - DNA, 22 bp, Homo sapiens
gaggctgagagtttgttctact

SEQ ID NO: 9377982 - DNA, 22 bp, Homo sapiens
gaggctgaggcaggaggatcac

SEQ ID NO: 9377983 - DNA, 22 bp, Homo sapiens
gaggctgagagtttgttctact

SEQ ID NO: 9377984 - DNA, 22 bp, Homo sapiens
gaggctgagagtttgttctact

SEQ ID NO: 9377985 - DNA, 22 bp, Homo sapiens
gaggcagtaattgtgggcaata

SEQ ID NO: 9377986 - DNA, 22 bp, Homo sapiens
gaggcagtgcattgtctagggg

SEQ ID NO: 9377987 - DNA, 22 bp, Homo sapiens
gaggcagggtgttgattacaga

SEQ ID NO: 9377988 - DNA, 22 bp, Homo sapiens
gaggcagggtgttgattacaga

SEQ ID NO: 9377989 - DNA, 22 bp, Homo sapiens
gaggcagtaattgtgggcaata

SEQ ID NO: 9377990 - DNA, 22 bp, Homo sapiens
gaggcagggtgttgattacaga

SEQ ID NO: 9377991 - DNA, 22 bp, Homo sapiens
gaggcagggtgttgattacaga

SEQ ID NO: 9377992 - DNA, 22 bp, Homo sapiens
gaggcaggccctgaatgagtca

SEQ ID NO: 9377993 - DNA, 22 bp, Homo sapiens
gaggcagggtgttgattacaga

SEQ ID NO: 9377994 - DNA, 22 bp, Homo sapiens
gaggcagggtgttgattacaga

SEQ ID NO: 9377995 - DNA, 22 bp, Homo sapiens
gaggctcaacccacaggggttg

SEQ ID NO: 9377996 - DNA, 22 bp, Homo sapiens
gaggctcaacccacaggggttg

SEQ ID NO: 9377997 - DNA, 22 bp, Homo sapiens
gaggcatctgggcacagaagtg

SEQ ID NO: 9377998 - DNA, 22 bp, Homo sapiens
gaggctcacctagggagcactg

SEQ ID NO: 9377999 - DNA, 22 bp, Homo sapiens
gaggctcacctagggagcactg

SEQ ID NO: 9378000 - DNA, 22 bp, Homo sapiens
gaggcagtgtttactgccctgt

SEQ ID NO: 9378001 - DNA, 22 bp, Homo sapiens
gaggcagtttgccatgccagga

SEQ ID NO: 9378002 - DNA, 22 bp, Homo sapiens
gaggcagtttgccatgccagga

SEQ ID NO: 9378003 - DNA, 22 bp, Homo sapiens
gaggctcactgggcaaagactc

SEQ ID NO: 9378004 - DNA, 22 bp, Homo sapiens
gaggctcacgacgggacgaact

SEQ ID NO: 9378005 - DNA, 22 bp, Homo sapiens
gaggctcactaggcatcctggg

SEQ ID NO: 9378006 - DNA, 22 bp, Homo sapiens
gaggctcacgacgggacgaact

SEQ ID NO: 9378007 - DNA, 22 bp, Homo sapiens
gaggctcacctagggagcactg

SEQ ID NO: 9378008 - DNA, 22 bp, Homo sapiens
gaggctcagagaagtcatggta

SEQ ID NO: 9378009 - DNA, 22 bp, Homo sapiens
gaggctcagagaagtcatggta

SEQ ID NO: 9378010 - DNA, 22 bp, Homo sapiens
gaggagaggctggacgcggtga

SEQ ID NO: 9378011 - DNA, 22 bp, Homo sapiens
gaggagagggctgcgggcccac

SEQ ID NO: 9378012 - DNA, 22 bp, Homo sapiens
gaggagagggctgcgggcccac

SEQ ID NO: 9378013 - DNA, 22 bp, Homo sapiens
gaggagaggggctcccaagagc

SEQ ID NO: 9378014 - DNA, 22 bp, Homo sapiens
gaggagagatggtagattgggt

SEQ ID NO: 9378015 - DNA, 22 bp, Homo sapiens
gaggagagcctgcactttgacc

SEQ ID NO: 9378016 - DNA, 22 bp, Homo sapiens
gaggagaggccatcgttgttat

SEQ ID NO: 9378017 - DNA, 22 bp, Homo sapiens
gaggagagcctgcactttgacc

SEQ ID NO: 9378018 - DNA, 22 bp, Homo sapiens
gaggagagcctgcactttgacc

SEQ ID NO: 9378019 - DNA, 22 bp, Homo sapiens
gaggagcatgggaaggctctgg

SEQ ID NO: 9378020 - DNA, 22 bp, Homo sapiens
gaggagccaaggtatgtgtgtt

SEQ ID NO: 9378021 - DNA, 22 bp, Homo sapiens
gaggagcatgggaaggctctgg

SEQ ID NO: 9378022 - DNA, 22 bp, Homo sapiens
gaggagcatgggaaggctctgg

SEQ ID NO: 9378023 - DNA, 22 bp, Homo sapiens
gaggagcacatgaggctgaggg

SEQ ID NO: 9378024 - DNA, 22 bp, Homo sapiens
gaggagcacatgaggctgaggg

SEQ ID NO: 9378025 - DNA, 22 bp, Homo sapiens
gaggagcatgggaaggctctgg

SEQ ID NO: 9378026 - DNA, 22 bp, Homo sapiens
gaggagcacatgaggctgaggg

SEQ ID NO: 9378027 - DNA, 22 bp, Homo sapiens
gaggagcacatgaggctgaggg

SEQ ID NO: 9378028 - DNA, 22 bp, Homo sapiens
gaggagcacatgaggctgaggg

SEQ ID NO: 9378029 - DNA, 22 bp, Homo sapiens
gaggagcaagaaatagtgccca

SEQ ID NO: 9378030 - DNA, 22 bp, Homo sapiens
gaggagaggggctcccaagagc

SEQ ID NO: 9378031 - DNA, 22 bp, Homo sapiens
gaggcaggccctgaatgagtca

SEQ ID NO: 9378032 - DNA, 22 bp, Homo sapiens
gaggcaggcagattgcttgagg

SEQ ID NO: 9378033 - DNA, 22 bp, Homo sapiens
gaggcaggccctgaatgagtca

SEQ ID NO: 9378034 - DNA, 22 bp, Homo sapiens
gaggcaggccctgaatgagtca

SEQ ID NO: 9378035 - DNA, 22 bp, Homo sapiens
gaggcaggcagattgcttgagg

SEQ ID NO: 9378036 - DNA, 22 bp, Homo sapiens
gaggcaggcagattgcttgagg

SEQ ID NO: 9378037 - DNA, 22 bp, Homo sapiens
gaggcaggcagattgcttgagg

SEQ ID NO: 9378038 - DNA, 22 bp, Homo sapiens
gaggcaggaggattgcttgagc

SEQ ID NO: 9378039 - DNA, 22 bp, Homo sapiens
gaggcaggcactgttatcagca

SEQ ID NO: 9378040 - DNA, 22 bp, Homo sapiens
gaggcaggcactgttatcagca

SEQ ID NO: 9378041 - DNA, 22 bp, Homo sapiens
gaggcaggcactgttatcagca

SEQ ID NO: 9378042 - DNA, 22 bp, Homo sapiens
gaggagcccccactgggctcac

SEQ ID NO: 9378043 - DNA, 22 bp, Homo sapiens
gaggagcccccactgggctcac

SEQ ID NO: 9378044 - DNA, 22 bp, Homo sapiens
gaggagccaggaggtctccctg

SEQ ID NO: 9378045 - DNA, 22 bp, Homo sapiens
gaggcaggaggattgcttgagc

SEQ ID NO: 9378046 - DNA, 22 bp, Homo sapiens
gaggcaggaggattgcttgagc

SEQ ID NO: 9378047 - DNA, 22 bp, Homo sapiens
gaggcaggaggattgcttgagc

SEQ ID NO: 9378048 - DNA, 22 bp, Homo sapiens
gaggcagcttggggctgtgggt

SEQ ID NO: 9378049 - DNA, 22 bp, Homo sapiens
gaggcagcttggggctgtgggt

SEQ ID NO: 9378050 - DNA, 22 bp, Homo sapiens
gaggcagcttggggctgtgggt

SEQ ID NO: 9378051 - DNA, 22 bp, Homo sapiens
gactgcataggaccaaatagta

SEQ ID NO: 9378052 - DNA, 22 bp, Homo sapiens
gactgcagtaagcctcatgact

SEQ ID NO: 9378053 - DNA, 22 bp, Homo sapiens
gactgaggtgcccagaggtgac

SEQ ID NO: 9378054 - DNA, 22 bp, Homo sapiens
gactgaggtgcccagaggtgac

SEQ ID NO: 9378055 - DNA, 22 bp, Homo sapiens
gactgaggtgacctaggactac

SEQ ID NO: 9378056 - DNA, 22 bp, Homo sapiens
gactgaggtgacctaggactac

SEQ ID NO: 9378057 - DNA, 22 bp, Homo sapiens
gagaaacactgttagtttatta

SEQ ID NO: 9378058 - DNA, 22 bp, Homo sapiens
gagaaacaggaattgagtcgct

SEQ ID NO: 9378059 - DNA, 22 bp, Homo sapiens
gagaaacaggaattgagtcgct

SEQ ID NO: 9378060 - DNA, 22 bp, Homo sapiens
gagaaacctgtaaggaaggaag

SEQ ID NO: 9378061 - DNA, 22 bp, Homo sapiens
gagaaactaacatctgaaggtg

SEQ ID NO: 9378062 - DNA, 22 bp, Homo sapiens
gagaaactgaaacatagggcca

SEQ ID NO: 9378063 - DNA, 22 bp, Homo sapiens
gagaaagaaagggaagtttgtt

SEQ ID NO: 9378064 - DNA, 22 bp, Homo sapiens
gagaaagacgtaggctgggagg

SEQ ID NO: 9378065 - DNA, 22 bp, Homo sapiens
gagaaagacgtaggctgggagg

SEQ ID NO: 9378066 - DNA, 22 bp, Homo sapiens
gagaaagacgtaggctgggagg

SEQ ID NO: 9378067 - DNA, 22 bp, Homo sapiens
gagaaagacgtaggctgggagg

SEQ ID NO: 9378068 - DNA, 22 bp, Homo sapiens
gagaaagatgaagagtggcgtt

SEQ ID NO: 9378069 - DNA, 22 bp, Homo sapiens
gagaaagatggaatcttacagg

SEQ ID NO: 9378070 - DNA, 22 bp, Homo sapiens
gagacagatgctgctggagcat

SEQ ID NO: 9378071 - DNA, 20 bp, Homo sapiens
gagacagcaaaagcctctcc

SEQ ID NO: 9378072 - DNA, 19 bp, Homo sapiens
gagacatgtagatagaaga

SEQ ID NO: 9378073 - DNA, 22 bp, Homo sapiens
gagaccaggaagtacagcagcc

SEQ ID NO: 9378074 - DNA, 18 bp, Homo sapiens
gagaaagcagggaatgtt

SEQ ID NO: 9378075 - DNA, 22 bp, Homo sapiens
gagaaagctaataggaatccta

SEQ ID NO: 9378076 - DNA, 22 bp, Homo sapiens
gagaaagcttcagaaatggcct

SEQ ID NO: 9378077 - DNA, 22 bp, Homo sapiens
gagaaagatgtaggctgggagg

SEQ ID NO: 9378078 - DNA, 22 bp, Homo sapiens
gagaaagatgtaggctgggagg

SEQ ID NO: 9378079 - DNA, 22 bp, Homo sapiens
gagaaagatgtaggctgggagg

SEQ ID NO: 9378080 - DNA, 22 bp, Homo sapiens
gagaaagatgtaggctgggagg

SEQ ID NO: 9378081 - DNA, 22 bp, Homo sapiens
gagagggccgggggccagctcc

SEQ ID NO: 9378082 - DNA, 22 bp, Homo sapiens
gagagggctctgtgtgggtact

SEQ ID NO: 9378083 - DNA, 22 bp, Homo sapiens
gagagggccgggggccagctcc

SEQ ID NO: 9378084 - DNA, 22 bp, Homo sapiens
gagagggctgcctggtgtgagg

SEQ ID NO: 9378085 - DNA, 22 bp, Homo sapiens
gagagggccagggtgagaacta

SEQ ID NO: 9378086 - DNA, 22 bp, Homo sapiens
gagagggccagggtgagaacta

SEQ ID NO: 9378087 - DNA, 21 bp, Homo sapiens
gagagggcattataggaagtg

SEQ ID NO: 9378088 - DNA, 21 bp, Homo sapiens
gagagggcattataggaagtg

SEQ ID NO: 9378089 - DNA, 22 bp, Homo sapiens
gagagggcaaacttgtagctaa

SEQ ID NO: 9378090 - DNA, 22 bp, Homo sapiens
gagagaacacaaagggccagct

SEQ ID NO: 9378091 - DNA, 18 bp, Homo sapiens
gagagggatccctcagga

SEQ ID NO: 9378092 - DNA, 22 bp, Homo sapiens
gagagaaaggcttgcaggctgt

SEQ ID NO: 9378093 - DNA, 22 bp, Homo sapiens
gagactggtgtttgctgggctg

SEQ ID NO: 9378094 - DNA, 22 bp, Homo sapiens
gagactggtgtttgctgggctg

SEQ ID NO: 9378095 - DNA, 22 bp, Homo sapiens
gagactggtgtttgctgggctg

SEQ ID NO: 9378096 - DNA, 22 bp, Homo sapiens
gagaccccagctcagcctccag

SEQ ID NO: 9378097 - DNA, 22 bp, Homo sapiens
gagacctgagtcaccctgtctg

SEQ ID NO: 9378098 - DNA, 22 bp, Homo sapiens
gagacctgcagctgtagtctgc

SEQ ID NO: 9378099 - DNA, 20 bp, Homo sapiens
gagactggatctggagagac

SEQ ID NO: 9378100 - DNA, 20 bp, Homo sapiens
gagactggatctggagagac

SEQ ID NO: 9378101 - DNA, 22 bp, Homo sapiens
gactctggtgacttgacctgta

SEQ ID NO: 9378102 - DNA, 22 bp, Homo sapiens
gactctgggctgagccagggcc

SEQ ID NO: 9378103 - DNA, 22 bp, Homo sapiens
gactctggtgtcagaagtgccc

SEQ ID NO: 9378104 - DNA, 22 bp, Homo sapiens
gactctggtgtcagaagtgccc

SEQ ID NO: 9378105 - DNA, 22 bp, Homo sapiens
gactctgggctgagccagggcc

SEQ ID NO: 9378106 - DNA, 22 bp, Homo sapiens
gactctgggcctttggtgactc

SEQ ID NO: 9378107 - DNA, 22 bp, Homo sapiens
gactctgggaggtggactgagg

SEQ ID NO: 9378108 - DNA, 22 bp, Homo sapiens
gactctagattcatggtggagt

SEQ ID NO: 9378109 - DNA, 22 bp, Homo sapiens
gactcctgggcctctgagaggc

SEQ ID NO: 9378110 - DNA, 22 bp, Homo sapiens
gactcctcccgctcccatgccg

SEQ ID NO: 9378111 - DNA, 21 bp, Homo sapiens
gactctctagtgctgtccagt

SEQ ID NO: 9378112 - DNA, 22 bp, Homo sapiens
gactctttcaaacagaaagcca

SEQ ID NO: 9378113 - DNA, 22 bp, Homo sapiens
gactgagaatcatagaaggcaa

SEQ ID NO: 9378114 - DNA, 22 bp, Homo sapiens
gactgaggaggtaaggtttgaa

SEQ ID NO: 9378115 - DNA, 22 bp, Homo sapiens
gactgaggcctttattgagaca

SEQ ID NO: 9378116 - DNA, 22 bp, Homo sapiens
gactgaggtaagtgaaataagc

SEQ ID NO: 9378117 - DNA, 17 bp, Homo sapiens
gactgaggtaaggtgag

SEQ ID NO: 9378118 - DNA, 22 bp, Homo sapiens
gactgaggtattaagatggctt

SEQ ID NO: 9378119 - DNA, 22 bp, Homo sapiens
gactgaggctcccctaggctca

SEQ ID NO: 9378120 - DNA, 22 bp, Homo sapiens
gactgagggacagggcagtgga

SEQ ID NO: 9378121 - DNA, 22 bp, Homo sapiens
gactgagggatagaggtgcttc

SEQ ID NO: 9378122 - DNA, 22 bp, Homo sapiens
gactgagggatagaggtgcttc

SEQ ID NO: 9378123 - DNA, 22 bp, Homo sapiens
gactccagggattggaagatgt

SEQ ID NO: 9378124 - DNA, 22 bp, Homo sapiens
gactccagcatatacttttagt

SEQ ID NO: 9378125 - DNA, 22 bp, Homo sapiens
gaccaggctagttcagagcttc

SEQ ID NO: 9378126 - DNA, 22 bp, Homo sapiens
gaccaggctagttcagagcttc

SEQ ID NO: 9378127 - DNA, 22 bp, Homo sapiens
gaccagctctctgaagaaagag

SEQ ID NO: 9378128 - DNA, 22 bp, Homo sapiens
gaccaggaaagagtgtgactaa

SEQ ID NO: 9378129 - DNA, 22 bp, Homo sapiens
gaccagctggtcctgtcctggg

SEQ ID NO: 9378130 - DNA, 22 bp, Homo sapiens
gacatttagaagttagattcaa

SEQ ID NO: 9378131 - DNA, 22 bp, Homo sapiens
gacatttagaagttagattcaa

SEQ ID NO: 9378132 - DNA, 22 bp, Homo sapiens
gacatttagctgttttgcattt

SEQ ID NO: 9378133 - DNA, 22 bp, Homo sapiens
gacatttagctgttttgcattt

SEQ ID NO: 9378134 - DNA, 22 bp, Homo sapiens
gacatttaggtagcttccagtt

SEQ ID NO: 9378135 - DNA, 22 bp, Homo sapiens
gacatttaggtagcttccagtt

SEQ ID NO: 9378136 - DNA, 22 bp, Homo sapiens
gacatttaggtagcttccagtt

SEQ ID NO: 9378137 - DNA, 22 bp, Homo sapiens
gaccagagaaaggcactggaag

SEQ ID NO: 9378138 - DNA, 22 bp, Homo sapiens
gaccagagaaaggcactggaag

SEQ ID NO: 9378139 - DNA, 22 bp, Homo sapiens
gacagcagatgaagcctgcaga

SEQ ID NO: 9378140 - DNA, 22 bp, Homo sapiens
gacagcagatgaagcctgcaga

SEQ ID NO: 9378141 - DNA, 22 bp, Homo sapiens
gacattcaactttgatgattat

SEQ ID NO: 9378142 - DNA, 22 bp, Homo sapiens
gacattcacaggtaaacattcc

SEQ ID NO: 9378143 - DNA, 22 bp, Homo sapiens
gacatttaaattgcaggcagcc

SEQ ID NO: 9378144 - DNA, 22 bp, Homo sapiens
gacatttaaattgcaggcagcc

SEQ ID NO: 9378145 - DNA, 22 bp, Homo sapiens
gacatttaaattgcaggcagcc

SEQ ID NO: 9378146 - DNA, 22 bp, Homo sapiens
gacatttagaagtctaatggcc

SEQ ID NO: 9378147 - DNA, 22 bp, Homo sapiens
gacatttactgaatactgatta

SEQ ID NO: 9378148 - DNA, 22 bp, Homo sapiens
gacatttactgaatactgatta

SEQ ID NO: 9378149 - DNA, 22 bp, Homo sapiens
gacatttaaggcagtcacttaa

SEQ ID NO: 9378150 - DNA, 22 bp, Homo sapiens
gacatttaaggcagtcacttaa

SEQ ID NO: 9378151 - DNA, 22 bp, Homo sapiens
gacatttaaggcagtcacttaa

SEQ ID NO: 9378152 - DNA, 22 bp, Homo sapiens
gacatttaatagtattgtggga

SEQ ID NO: 9378153 - DNA, 22 bp, Homo sapiens
gacatttaatagtattgtggga

SEQ ID NO: 9378154 - DNA, 22 bp, Homo sapiens
gacagaggagaagatgctgtgg

SEQ ID NO: 9378155 - DNA, 22 bp, Homo sapiens
gacagagccagttggaggtagg

SEQ ID NO: 9378156 - DNA, 22 bp, Homo sapiens
gacagagccagttggaggtagg

SEQ ID NO: 9378157 - DNA, 22 bp, Homo sapiens
gacagacatttcctgatccaat

SEQ ID NO: 9378158 - DNA, 22 bp, Homo sapiens
gacagacatgggacttcatact

SEQ ID NO: 9378159 - DNA, 22 bp, Homo sapiens
gacagcaagagacagagcatcc

SEQ ID NO: 9378160 - DNA, 22 bp, Homo sapiens
gacagaggcaagaccagaagcc

SEQ ID NO: 9378161 - DNA, 22 bp, Homo sapiens
gacagcagacagcctggcccct

SEQ ID NO: 9378162 - DNA, 22 bp, Homo sapiens
gaagggagaaggttgggtgacg

SEQ ID NO: 9378163 - DNA, 22 bp, Homo sapiens
gaagggaatttggagggtttca

SEQ ID NO: 9378164 - DNA, 22 bp, Homo sapiens
gaagggagaaggttgggtgacg

SEQ ID NO: 9378165 - DNA, 22 bp, Homo sapiens
gaaggccatttttaggtagaat

SEQ ID NO: 9378166 - DNA, 22 bp, Homo sapiens
gaaggccatttttaggtagaat

SEQ ID NO: 9378167 - DNA, 22 bp, Homo sapiens
gaaggccatttttaggtagaat

SEQ ID NO: 9378168 - DNA, 22 bp, Homo sapiens
gaaggccatttttaggtagaat

SEQ ID NO: 9378169 - DNA, 22 bp, Homo sapiens
gaaggccagttttgagataggt

SEQ ID NO: 9378170 - DNA, 22 bp, Homo sapiens
gaaggccattagagcctgtgcc

SEQ ID NO: 9378171 - DNA, 22 bp, Homo sapiens
gaaggccattagagcctgtgcc

SEQ ID NO: 9378172 - DNA, 22 bp, Homo sapiens
gaaggccattagagcctgtgcc

SEQ ID NO: 9378173 - DNA, 22 bp, Homo sapiens
gaaggccattagagcctgtgcc

SEQ ID NO: 9378174 - DNA, 22 bp, Homo sapiens
gaaggccattgcgtcctgggat

SEQ ID NO: 9378175 - DNA, 22 bp, Homo sapiens
gaaggccattgcgtcctgggat

SEQ ID NO: 9378176 - DNA, 22 bp, Homo sapiens
gaaggccattgcgtcctgggat

SEQ ID NO: 9378177 - DNA, 22 bp, Homo sapiens
gaaggcagtaaatggctgtttt

SEQ ID NO: 9378178 - DNA, 22 bp, Homo sapiens
gaaggcaggtttttcaaaactg

SEQ ID NO: 9378179 - DNA, 22 bp, Homo sapiens
gaaggccacggaatggagctgg

SEQ ID NO: 9378180 - DNA, 22 bp, Homo sapiens
gaaggccacggaatggagctgg

SEQ ID NO: 9378181 - DNA, 22 bp, Homo sapiens
gaaggccacaagagaagttaag

SEQ ID NO: 9378182 - DNA, 22 bp, Homo sapiens
gaaggccacaagagaagttaag

SEQ ID NO: 9378183 - DNA, 22 bp, Homo sapiens
gaaggccactttgtgttgagaa

SEQ ID NO: 9378184 - DNA, 22 bp, Homo sapiens
gaaggccactttgtgttgagaa

SEQ ID NO: 9378185 - DNA, 22 bp, Homo sapiens
gaaggccagttttgagataggt

SEQ ID NO: 9378186 - DNA, 22 bp, Homo sapiens
gaaggccagttttgagataggt

SEQ ID NO: 9378187 - DNA, 22 bp, Homo sapiens
gaaggccaagaggctccaagat

SEQ ID NO: 9378188 - DNA, 22 bp, Homo sapiens
gaaggccaagaggctccaagat

SEQ ID NO: 9378189 - DNA, 22 bp, Homo sapiens
gaaggccacaaaaaatgtcata

SEQ ID NO: 9378190 - DNA, 22 bp, Homo sapiens
gaaggccacaaaaaatgtcata

SEQ ID NO: 9378191 - DNA, 22 bp, Homo sapiens
gaaggcagggaatgtggtgcta

SEQ ID NO: 9378192 - DNA, 22 bp, Homo sapiens
gaaggcactgaactccttctgg

SEQ ID NO: 9378193 - DNA, 22 bp, Homo sapiens
gaaggcacagatggcagtccac

SEQ ID NO: 9378194 - DNA, 22 bp, Homo sapiens
gaaggcacccggcgtgcggcgg

SEQ ID NO: 9378195 - DNA, 22 bp, Homo sapiens
gaaggagctaccaagactgaat

SEQ ID NO: 9378196 - DNA, 22 bp, Homo sapiens
gaaggcaagtgagccaagagaa

SEQ ID NO: 9378197 - DNA, 16 bp, Homo sapiens
gaaggagattcagaaa

SEQ ID NO: 9378198 - DNA, 20 bp, Homo sapiens
gaagccagaggggaaaggag

SEQ ID NO: 9378199 - DNA, 22 bp, Homo sapiens
gaagccactatagatattctaa

SEQ ID NO: 9378200 - DNA, 22 bp, Homo sapiens
gaagccactatagatattctaa

SEQ ID NO: 9378201 - DNA, 22 bp, Homo sapiens
gaagccacgttaaattggctgt

SEQ ID NO: 9378202 - DNA, 22 bp, Homo sapiens
gaagccaccctccttccagccc

SEQ ID NO: 9378203 - DNA, 20 bp, Homo sapiens
gaagccaccctcagattcca

SEQ ID NO: 9378204 - DNA, 20 bp, Homo sapiens
gaagccaccctcagattcca

SEQ ID NO: 9378205 - DNA, 22 bp, Homo sapiens
gaagccaccctccttccagccc

SEQ ID NO: 9378206 - DNA, 22 bp, Homo sapiens
gaagccacagagattgtggggg

SEQ ID NO: 9378207 - DNA, 22 bp, Homo sapiens
gaagccacagggaaggagaaca

SEQ ID NO: 9378208 - DNA, 22 bp, Homo sapiens
gaagccacagggaaggagaaca

SEQ ID NO: 9378209 - DNA, 22 bp, Homo sapiens
gaagccacaactttttcttagc

SEQ ID NO: 9378210 - DNA, 23 bp, Homo sapiens
gaagccacacaaaggtcgccaag

SEQ ID NO: 9378211 - DNA, 22 bp, Homo sapiens
gaaaggagtgaatatttgtgac

SEQ ID NO: 9378212 - DNA, 20 bp, Homo sapiens
gaaaggagtgtccctgtgag

SEQ ID NO: 9378213 - DNA, 22 bp, Homo sapiens
gaaaggagtcagtcttactgaa

SEQ ID NO: 9378214 - DNA, 17 bp, Homo sapiens
gaaaggaggcaacactg

SEQ ID NO: 9378215 - DNA, 18 bp, Homo sapiens
gaaaggagagacagtagg

SEQ ID NO: 9378216 - DNA, 22 bp, Homo sapiens
gaaaggagagggttaaggagct

SEQ ID NO: 9378217 - DNA, 22 bp, Homo sapiens
gaaaggaaatattctaagcact

SEQ ID NO: 9378218 - DNA, 22 bp, Homo sapiens
gaaagctgtgaaatagtgctct

SEQ ID NO: 9378219 - DNA, 18 bp, Homo sapiens
gaaaggagagacagtagg

SEQ ID NO: 9378220 - DNA, 22 bp, Homo sapiens
gaagcatcagcaatggctggaa

SEQ ID NO: 9378221 - DNA, 22 bp, Homo sapiens
gaagccaagtcctcgagtttca

SEQ ID NO: 9378222 - DNA, 22 bp, Homo sapiens
gaagcagctttctggtgaggag

SEQ ID NO: 9378223 - DNA, 22 bp, Homo sapiens
gaagcagctttctggtgaggag

SEQ ID NO: 9378224 - DNA, 22 bp, Homo sapiens
gaagcagctttctggtgaggag

SEQ ID NO: 9378225 - DNA, 22 bp, Homo sapiens
gaagcagctggtgagatggagc

SEQ ID NO: 9378226 - DNA, 20 bp, Homo sapiens
gaagcagcttcatgtagaca

SEQ ID NO: 9378227 - DNA, 20 bp, Homo sapiens
gaaaggagtgtccctgtgag

SEQ ID NO: 9378228 - DNA, 22 bp, Homo sapiens
gaagcagctagcccactagtca

SEQ ID NO: 9378229 - DNA, 22 bp, Homo sapiens
gaagcagctaggatcttcattt

SEQ ID NO: 9378230 - DNA, 22 bp, Homo sapiens
gaagcagctcagattgactgaa

SEQ ID NO: 9378231 - DNA, 22 bp, Homo sapiens
gaagcagctggtgagatggagc

SEQ ID NO: 9378232 - DNA, 22 bp, Homo sapiens
gaagcagcgaagtggaagggac

SEQ ID NO: 9378233 - DNA, 22 bp, Homo sapiens
gaagcagcgaagtggaagggac

SEQ ID NO: 9378234 - DNA, 22 bp, Homo sapiens
gaagcagcagctggggacagtt

SEQ ID NO: 9378235 - DNA, 22 bp, Homo sapiens
gaatgaatctgtaagtgacaag

SEQ ID NO: 9378236 - DNA, 22 bp, Homo sapiens
gaatgaaaaccttggctcaaat

SEQ ID NO: 9378237 - DNA, 22 bp, Homo sapiens
gaatgaattttggatggtgaag

SEQ ID NO: 9378238 - DNA, 22 bp, Homo sapiens
gaatgaattcagcacatggaat

SEQ ID NO: 9378239 - DNA, 22 bp, Homo sapiens
gacacagtaatgtgtttcatct

SEQ ID NO: 9378240 - DNA, 19 bp, Homo sapiens
gacacagttggttcctttg

SEQ ID NO: 9378241 - DNA, 22 bp, Homo sapiens
gacacagtcaagagtggaggaa

SEQ ID NO: 9378242 - DNA, 22 bp, Homo sapiens
gacacagttacttattttgcct

SEQ ID NO: 9378243 - DNA, 22 bp, Homo sapiens
gacactgttatggtgaggtaag

SEQ ID NO: 9378244 - DNA, 22 bp, Homo sapiens
gacactgtgctagctgggctta

SEQ ID NO: 9378245 - DNA, 22 bp, Homo sapiens
gacagacaggggttctcctgga

SEQ ID NO: 9378246 - DNA, 22 bp, Homo sapiens
gacagacaggaggccacctgct

SEQ ID NO: 9378247 - DNA, 22 bp, Homo sapiens
gacagacaggaggccacctgct

SEQ ID NO: 9378248 - DNA, 22 bp, Homo sapiens
gacagacaggtgtggtaggcac

SEQ ID NO: 9378249 - DNA, 22 bp, Homo sapiens
gacagacaggggttctcctgga

SEQ ID NO: 9378250 - DNA, 22 bp, Homo sapiens
gacagacatgggacttcatact

SEQ ID NO: 9378251 - DNA, 22 bp, Homo sapiens
gacagacaggtgtggtaggcac

SEQ ID NO: 9378252 - DNA, 22 bp, Homo sapiens
gacagacaggagctcacaggca

SEQ ID NO: 9378253 - DNA, 22 bp, Homo sapiens
gacagacaggaggcattcaggg

SEQ ID NO: 9378254 - DNA, 22 bp, Homo sapiens
gacagacactgtgtcctcactt

SEQ ID NO: 9378255 - DNA, 22 bp, Homo sapiens
gacagacagagaatgggcttga

SEQ ID NO: 9378256 - DNA, 22 bp, Homo sapiens
gacagaaggcatctagggcacg

SEQ ID NO: 9378257 - DNA, 22 bp, Homo sapiens
gacagaaggcatctagggcacg

SEQ ID NO: 9378258 - DNA, 22 bp, Homo sapiens
gacactttctcaggtaaagcat

SEQ ID NO: 9378259 - DNA, 22 bp, Homo sapiens
gacactttattaagctgttgtt

SEQ ID NO: 9378260 - DNA, 22 bp, Homo sapiens
gacagaactcaaacatgagaag

SEQ ID NO: 9378261 - DNA, 22 bp, Homo sapiens
gacactttggtgctttgtggtt

SEQ ID NO: 9378262 - DNA, 22 bp, Homo sapiens
gacagacacagggccatgattg

SEQ ID NO: 9378263 - DNA, 22 bp, Homo sapiens
gacagacacctggggggttgct

SEQ ID NO: 9378264 - DNA, 22 bp, Homo sapiens
gacagacactattggtatgcct

SEQ ID NO: 9378265 - DNA, 22 bp, Homo sapiens
gacagacaaatgtttttaactt

SEQ ID NO: 9378266 - DNA, 22 bp, Homo sapiens
gacagacacaattgatccatga

SEQ ID NO: 9378267 - DNA, 22 bp, Homo sapiens
gaatctcaggaagatctctgca

SEQ ID NO: 9378268 - DNA, 22 bp, Homo sapiens
gaatctgcattttaacaagatc

SEQ ID NO: 9378269 - DNA, 22 bp, Homo sapiens
gaatcattcattgctcaattaa

SEQ ID NO: 9378270 - DNA, 22 bp, Homo sapiens
gaatatttgtaattactgttga

SEQ ID NO: 9378271 - DNA, 22 bp, Homo sapiens
gaatatttgtaattactgttga

SEQ ID NO: 9378272 - DNA, 22 bp, Homo sapiens
gaaggtttgatccttatttata

SEQ ID NO: 9378273 - DNA, 22 bp, Homo sapiens
gaaggtttgatccttatttata

SEQ ID NO: 9378274 - DNA, 17 bp, Homo sapiens
gaaggtttctcttaggt

SEQ ID NO: 9378275 - DNA, 22 bp, Homo sapiens
gaaggtttactgaagatttaaa

SEQ ID NO: 9378276 - DNA, 22 bp, Homo sapiens
gaaggtttgaaataggtataga

SEQ ID NO: 9378277 - DNA, 17 bp, Homo sapiens
gaaggtttctcttaggt

SEQ ID NO: 9378278 - DNA, 22 bp, Homo sapiens
gaaggtttgaaataggtataga

SEQ ID NO: 9378279 - DNA, 22 bp, Homo sapiens
gaaggtttactgaagatttaaa

SEQ ID NO: 9378280 - DNA, 22 bp, Homo sapiens
gaaggttatgggggttggatta

SEQ ID NO: 9378281 - DNA, 22 bp, Homo sapiens
gaaggtccagcgtggccaagtc

SEQ ID NO: 9378282 - DNA, 22 bp, Homo sapiens
gaaggtagctgctgagatgaca

SEQ ID NO: 9378283 - DNA, 22 bp, Homo sapiens
gaaggtgcaggcaaggttggtt

SEQ ID NO: 9378284 - DNA, 22 bp, Homo sapiens
gaaggtggcgagcggattgctg

SEQ ID NO: 9378285 - DNA, 22 bp, Homo sapiens
gaaggtgtccacttctcacctc

SEQ ID NO: 9378286 - DNA, 22 bp, Homo sapiens
gaaggtgtccatcaccaactgt

SEQ ID NO: 9378287 - DNA, 22 bp, Homo sapiens
gaagggtgcatggagggaagtc

SEQ ID NO: 9378288 - DNA, 22 bp, Homo sapiens
gaagggtgtgtgtgagggacac

SEQ ID NO: 9378289 - DNA, 22 bp, Homo sapiens
gaagggtgtgatttgcctgaga

SEQ ID NO: 9378290 - DNA, 22 bp, Homo sapiens
gaaggggagtggctagtgtgtg

SEQ ID NO: 9378291 - DNA, 20 bp, Homo sapiens
gaagggatcactgcatactt

SEQ ID NO: 9378292 - DNA, 22 bp, Homo sapiens
gaagggctgcaggtctgggccc

SEQ ID NO: 9378293 - DNA, 18 bp, Homo sapiens
gaagggagctggaatgca

SEQ ID NO: 9378294 - DNA, 22 bp, Homo sapiens
gaagggctttctgggagaagag

SEQ ID NO: 9378295 - DNA, 22 bp, Homo sapiens
gaagggctttctgggagaagag

SEQ ID NO: 9378296 - DNA, 21 bp, Homo sapiens
ccatacctacctcacctggtt

SEQ ID NO: 9378297 - DNA, 22 bp, Homo sapiens
ccatagtgaattgtctcagacg

SEQ ID NO: 9378298 - DNA, 22 bp, Homo sapiens
ccataggagccctggtccctga

SEQ ID NO: 9378299 - DNA, 22 bp, Homo sapiens
tgaggctgagatatcagggagg

SEQ ID NO: 9378300 - DNA, 22 bp, Homo sapiens
tgaggctgagatatcagggagg

SEQ ID NO: 9378301 - DNA, 18 bp, Homo sapiens
tgaggctgagggtagagg

SEQ ID NO: 9378302 - DNA, 18 bp, Homo sapiens
tgaggctgagggtagagg

SEQ ID NO: 9378303 - DNA, 18 bp, Homo sapiens
tgaggctgagggtagagg

SEQ ID NO: 9378304 - DNA, 23 bp, Homo sapiens
tgaggctgattgatttttgctca

SEQ ID NO: 9378305 - DNA, 22 bp, Homo sapiens
ccatcagcatgggagcatgggc

SEQ ID NO: 9378306 - DNA, 22 bp, Homo sapiens
ccatcagagggctgctctgcaa

SEQ ID NO: 9378307 - DNA, 21 bp, Homo sapiens
ccatccactgagtggttccct

SEQ ID NO: 9378308 - DNA, 22 bp, Homo sapiens
ccatccacagtcttgattattt

SEQ ID NO: 9378309 - DNA, 22 bp, Homo sapiens
ccatccagaccagtccatgggt

SEQ ID NO: 9378310 - DNA, 22 bp, Homo sapiens
ccatcatttgatacagctgtct

SEQ ID NO: 9378311 - DNA, 22 bp, Homo sapiens
ccatcattatcactgacaacct

SEQ ID NO: 9378312 - DNA, 23 bp, Homo sapiens
ccatcaggcctccgtgtccagcc

SEQ ID NO: 9378313 - DNA, 22 bp, Homo sapiens
ccatcagttctcagaccacact

SEQ ID NO: 9378314 - DNA, 18 bp, Homo sapiens
tgaggctgaatatggggc

SEQ ID NO: 9378315 - DNA, 18 bp, Homo sapiens
tgaggctgaatatggggc

SEQ ID NO: 9378316 - DNA, 22 bp, Homo sapiens
tgaggctgacaaaagatgaggt

SEQ ID NO: 9378317 - DNA, 22 bp, Homo sapiens
tgaggctgacaaaagatgaggt

SEQ ID NO: 9378318 - DNA, 22 bp, Homo sapiens
tgaggctgagatatcagggagg

SEQ ID NO: 9378319 - DNA, 22 bp, Homo sapiens
tgaggctgagatatcagggagg

SEQ ID NO: 9378320 - DNA, 22 bp, Homo sapiens
tgaggctgacaaaagatgaggt

SEQ ID NO: 9378321 - DNA, 22 bp, Homo sapiens
tgaggctgacaaaagatgaggt

SEQ ID NO: 9378322 - DNA, 22 bp, Homo sapiens
tgaggctgacaaaagatgaggt

SEQ ID NO: 9378323 - DNA, 22 bp, Homo sapiens
tgaggctgaaactggcgataga

SEQ ID NO: 9378324 - DNA, 22 bp, Homo sapiens
tgaggctgaaactggcgataga

SEQ ID NO: 9378325 - DNA, 22 bp, Homo sapiens
tgaggctgaaactggcgataga

SEQ ID NO: 9378326 - DNA, 18 bp, Homo sapiens
tgaggctgaatatggggc

SEQ ID NO: 9378327 - DNA, 18 bp, Homo sapiens
tgaggcccatctctctga

SEQ ID NO: 9378328 - DNA, 22 bp, Homo sapiens
tgaggccatggaactagcttgg

SEQ ID NO: 9378329 - DNA, 17 bp, Homo sapiens
tgaggccatggcaccat

SEQ ID NO: 9378330 - DNA, 22 bp, Homo sapiens
tgaggccatggtcttcccagtc

SEQ ID NO: 9378331 - DNA, 22 bp, Homo sapiens
tgaggccatggtcttcccagtc

SEQ ID NO: 9378332 - DNA, 17 bp, Homo sapiens
tgaggccatggcaccat

SEQ ID NO: 9378333 - DNA, 22 bp, Homo sapiens
tgaggccagtctcatcacaggc

SEQ ID NO: 9378334 - DNA, 22 bp, Homo sapiens
tgaggccagggattccatcatt

SEQ ID NO: 9378335 - DNA, 22 bp, Homo sapiens
tgaggccagggattccatcatt

SEQ ID NO: 9378336 - DNA, 22 bp, Homo sapiens
tgaggccaggcaaaggcgatct

SEQ ID NO: 9378337 - DNA, 22 bp, Homo sapiens
ccatcctgcaggacctccatat

SEQ ID NO: 9378338 - DNA, 22 bp, Homo sapiens
ccatcctgaatggtctcagcca

SEQ ID NO: 9378339 - DNA, 22 bp, Homo sapiens
ccatcctgaatggtctcagcca

SEQ ID NO: 9378340 - DNA, 22 bp, Homo sapiens
ccatcctgaatggtctcagcca

SEQ ID NO: 9378341 - DNA, 22 bp, Homo sapiens
ccatcctgcattgctattcaga

SEQ ID NO: 9378342 - DNA, 19 bp, Homo sapiens
tgaggtctacatgggcatc

SEQ ID NO: 9378343 - DNA, 22 bp, Homo sapiens
tgagtcagccagagctgccatg

SEQ ID NO: 9378344 - DNA, 20 bp, Homo sapiens
tgagtcagctgcatgggtgg

SEQ ID NO: 9378345 - DNA, 22 bp, Homo sapiens
tgagtcagtctgccctggcttc

SEQ ID NO: 9378346 - DNA, 22 bp, Homo sapiens
ccatccatatggtgacaaggtg

SEQ ID NO: 9378347 - DNA, 21 bp, Homo sapiens
ccatccatctccctttgctgg

SEQ ID NO: 9378348 - DNA, 21 bp, Homo sapiens
ccatccatctccctttgctgg

SEQ ID NO: 9378349 - DNA, 22 bp, Homo sapiens
ccatccatgaacgaggaagtgg

SEQ ID NO: 9378350 - DNA, 22 bp, Homo sapiens
ccatccctcctactcacagtca

SEQ ID NO: 9378351 - DNA, 22 bp, Homo sapiens
ccatccatgtggcagggctggc

SEQ ID NO: 9378352 - DNA, 22 bp, Homo sapiens
ccatccattttcttgcttgcct

SEQ ID NO: 9378353 - DNA, 22 bp, Homo sapiens
ccatccattttcttgcttgcct

SEQ ID NO: 9378354 - DNA, 22 bp, Homo sapiens
ccatccatggtgttggttgtat

SEQ ID NO: 9378355 - DNA, 22 bp, Homo sapiens
ccatccatgtggcagggctggc

SEQ ID NO: 9378356 - DNA, 22 bp, Homo sapiens
ccatccatgcgccagacagatt

SEQ ID NO: 9378357 - DNA, 22 bp, Homo sapiens
ccatccatggtgttggttgtat

SEQ ID NO: 9378358 - DNA, 19 bp, Homo sapiens
ccatccatggggccagagg

SEQ ID NO: 9378359 - DNA, 22 bp, Homo sapiens
ccatcccttctctggccagcag

SEQ ID NO: 9378360 - DNA, 23 bp, Homo sapiens
ccatcccttggaagctggtttta

SEQ ID NO: 9378361 - DNA, 22 bp, Homo sapiens
ccatccctgggccatgtcccct

SEQ ID NO: 9378362 - DNA, 22 bp, Homo sapiens
ccatccctgggccatgtcccct

SEQ ID NO: 9378363 - DNA, 22 bp, Homo sapiens
ccatccctcctccaccagctag

SEQ ID NO: 9378364 - DNA, 22 bp, Homo sapiens
ccatccctcctccaccagctag

SEQ ID NO: 9378365 - DNA, 22 bp, Homo sapiens
tgagtctctgcactaaggagag

SEQ ID NO: 9378366 - DNA, 21 bp, Homo sapiens
tgagtctctcagcttcaggta

SEQ ID NO: 9378367 - DNA, 22 bp, Homo sapiens
tgagtctcggtttcccctccaa

SEQ ID NO: 9378368 - DNA, 22 bp, Homo sapiens
tgagtctcgaaatgcaggaaag

SEQ ID NO: 9378369 - DNA, 22 bp, Homo sapiens
tgagtctcaggtttcccgtgcc

SEQ ID NO: 9378370 - DNA, 22 bp, Homo sapiens
tgagtcctaaagctgtgccctt

SEQ ID NO: 9378371 - DNA, 22 bp, Homo sapiens
tgagtcctggctttgggatgta

SEQ ID NO: 9378372 - DNA, 22 bp, Homo sapiens
tgagtcctgctgagcagagagg

SEQ ID NO: 9378373 - DNA, 22 bp, Homo sapiens
tgagtcctgctctgggcagggt

SEQ ID NO: 9378374 - DNA, 22 bp, Homo sapiens
tgagtcctgctctgggcagggt

SEQ ID NO: 9378375 - DNA, 22 bp, Homo sapiens
tgagttgccctgccctgtgctt

SEQ ID NO: 9378376 - DNA, 22 bp, Homo sapiens
tgagtctggcggagggaggagc

SEQ ID NO: 9378377 - DNA, 22 bp, Homo sapiens
tgagttgctatctagatccaga

SEQ ID NO: 9378378 - DNA, 22 bp, Homo sapiens
tgagtttagtgtgagacttatc

SEQ ID NO: 9378379 - DNA, 22 bp, Homo sapiens
tgagtttaatgatatttatatg

SEQ ID NO: 9378380 - DNA, 19 bp, Homo sapiens
tgagtttaatgcaaaactg

SEQ ID NO: 9378381 - DNA, 22 bp, Homo sapiens
tgagttttttcaacatatgaag

SEQ ID NO: 9378382 - DNA, 22 bp, Homo sapiens
tgagttttgtcttgctagaagt

SEQ ID NO: 9378383 - DNA, 22 bp, Homo sapiens
ccagtggagtttttatacccag

SEQ ID NO: 9378384 - DNA, 22 bp, Homo sapiens
ccagtggccatgcacgagcagc

SEQ ID NO: 9378385 - DNA, 22 bp, Homo sapiens
ccagtggacaatttctgaggaa

SEQ ID NO: 9378386 - DNA, 22 bp, Homo sapiens
ccagtggacaatttctgaggaa

SEQ ID NO: 9378387 - DNA, 22 bp, Homo sapiens
ccagtggaaatgtggtcaggat

SEQ ID NO: 9378388 - DNA, 22 bp, Homo sapiens
ccagtggacttctccctgtggt

SEQ ID NO: 9378389 - DNA, 22 bp, Homo sapiens
ccagtggacttctccctgtggt

SEQ ID NO: 9378390 - DNA, 22 bp, Homo sapiens
ccagtggaattaaaaataagtg

SEQ ID NO: 9378391 - DNA, 22 bp, Homo sapiens
ccagtggacaatttctgaggaa

SEQ ID NO: 9378392 - DNA, 22 bp, Homo sapiens
ccagtggaaatgtggtcaggat

SEQ ID NO: 9378393 - DNA, 22 bp, Homo sapiens
ccagtgcttctttgctagctgg

SEQ ID NO: 9378394 - DNA, 22 bp, Homo sapiens
ccagtgctaaggtagcctctgc

SEQ ID NO: 9378395 - DNA, 22 bp, Homo sapiens
ccagtgctaaggtagcctctgc

SEQ ID NO: 9378396 - DNA, 21 bp, Homo sapiens
ccagtgctacagctgcctgac

SEQ ID NO: 9378397 - DNA, 22 bp, Homo sapiens
ccagtgcttctttgctagctgg

SEQ ID NO: 9378398 - DNA, 22 bp, Homo sapiens
ccagtgcttccaggaatacggt

SEQ ID NO: 9378399 - DNA, 22 bp, Homo sapiens
ccagtgctgaatgaggaggtct

SEQ ID NO: 9378400 - DNA, 22 bp, Homo sapiens
ccagtgctcattcaagtcctta

SEQ ID NO: 9378401 - DNA, 22 bp, Homo sapiens
ccagtgctcattcaagtcctta

SEQ ID NO: 9378402 - DNA, 22 bp, Homo sapiens
ccagtgctcttaaaggtcataa

SEQ ID NO: 9378403 - DNA, 22 bp, Homo sapiens
ccagtgctcttaaaggtcataa

SEQ ID NO: 9378404 - DNA, 22 bp, Homo sapiens
ccagtgcccagctgcccaggca

SEQ ID NO: 9378405 - DNA, 22 bp, Homo sapiens
ccagtgcccagtctccctggtc

SEQ ID NO: 9378406 - DNA, 22 bp, Homo sapiens
ccagtgcccagtctccctggtc

SEQ ID NO: 9378407 - DNA, 22 bp, Homo sapiens
ccagtgcccagctgcccaggca

SEQ ID NO: 9378408 - DNA, 22 bp, Homo sapiens
ccagtgcccagctgcccaggca

SEQ ID NO: 9378409 - DNA, 22 bp, Homo sapiens
ccagtgcagtccccctgaactg

SEQ ID NO: 9378410 - DNA, 22 bp, Homo sapiens
ccagtgcccagctgcccaggca

SEQ ID NO: 9378411 - DNA, 22 bp, Homo sapiens
ccagtgcattgccgtgtctagg

SEQ ID NO: 9378412 - DNA, 22 bp, Homo sapiens
ccagtgcgagcctgtgctggcc

SEQ ID NO: 9378413 - DNA, 22 bp, Homo sapiens
ccagtgcctgtgggcatggtgc

SEQ ID NO: 9378414 - DNA, 17 bp, Homo sapiens
ccagtgcctgtggcaac

SEQ ID NO: 9378415 - DNA, 17 bp, Homo sapiens
ccagtgcctgtggcaac

SEQ ID NO: 9378416 - DNA, 19 bp, Homo sapiens
ccagtgccggcgctgggga

SEQ ID NO: 9378417 - DNA, 22 bp, Homo sapiens
ccagtgcccagtctccctggtc

SEQ ID NO: 9378418 - DNA, 19 bp, Homo sapiens
ccagtgccggcgctgggga

SEQ ID NO: 9378419 - DNA, 22 bp, Homo sapiens
tgagcccagagcccttgtaggg

SEQ ID NO: 9378420 - DNA, 22 bp, Homo sapiens
tgagcccagagatctgagctat

SEQ ID NO: 9378421 - DNA, 22 bp, Homo sapiens
tgagcccagagatctgagctat

SEQ ID NO: 9378422 - DNA, 22 bp, Homo sapiens
tgagcccagaagcccactcggc

SEQ ID NO: 9378423 - DNA, 23 bp, Homo sapiens
tgagcccaggaggtcaaggctgc

SEQ ID NO: 9378424 - DNA, 22 bp, Homo sapiens
tgagcccaggagtatgaggctg

SEQ ID NO: 9378425 - DNA, 22 bp, Homo sapiens
tgagcccagcgtcccgttctgt

SEQ ID NO: 9378426 - DNA, 22 bp, Homo sapiens
tgagcccaggaggcagaggttg

SEQ ID NO: 9378427 - DNA, 22 bp, Homo sapiens
tgagcccagcgtcccgttctgt

SEQ ID NO: 9378428 - DNA, 22 bp, Homo sapiens
tgagcccaggagttggagaccg

SEQ ID NO: 9378429 - DNA, 22 bp, Homo sapiens
ccagtgcaggtgagcaccaggt

SEQ ID NO: 9378430 - DNA, 22 bp, Homo sapiens
ccagtctgctgtggtaggaaga

SEQ ID NO: 9378431 - DNA, 22 bp, Homo sapiens
tgagccagttcttcagatccat

SEQ ID NO: 9378432 - DNA, 22 bp, Homo sapiens
tgagccatgggactccaaggga

SEQ ID NO: 9378433 - DNA, 22 bp, Homo sapiens
tgagccatgggactccaaggga

SEQ ID NO: 9378434 - DNA, 22 bp, Homo sapiens
tgagccagtggaagatggcagt

SEQ ID NO: 9378435 - DNA, 22 bp, Homo sapiens
ccagtcccagctctgccatgct

SEQ ID NO: 9378436 - DNA, 22 bp, Homo sapiens
ccagtcccagctctgccatgct

SEQ ID NO: 9378437 - DNA, 22 bp, Homo sapiens
tgagcaggtgagtctagggcag

SEQ ID NO: 9378438 - DNA, 18 bp, Homo sapiens
tgagcaggggctgacctt

SEQ ID NO: 9378439 - DNA, 21 bp, Homo sapiens
tgagcaggtgcagggaagtgg

SEQ ID NO: 9378440 - DNA, 22 bp, Homo sapiens
tgagcagtaacagctcacaggg

SEQ ID NO: 9378441 - DNA, 22 bp, Homo sapiens
tgagcaggggagagcgaatgtg

SEQ ID NO: 9378442 - DNA, 22 bp, Homo sapiens
tgagcagagacgggggcctcca

SEQ ID NO: 9378443 - DNA, 22 bp, Homo sapiens
ccagggctgctgtgggactcca

SEQ ID NO: 9378444 - DNA, 22 bp, Homo sapiens
ccagggctgctgtgggactcca

SEQ ID NO: 9378445 - DNA, 22 bp, Homo sapiens
ccagggctgctgtgggactcca

SEQ ID NO: 9378446 - DNA, 22 bp, Homo sapiens
ccagggctgctgggggagttga

SEQ ID NO: 9378447 - DNA, 22 bp, Homo sapiens
ccagggctgctgggggagttga

SEQ ID NO: 9378448 - DNA, 22 bp, Homo sapiens
ccagggctgctcattggctggt

SEQ ID NO: 9378449 - DNA, 22 bp, Homo sapiens
ccagggctgctcattggctggt

SEQ ID NO: 9378450 - DNA, 20 bp, Homo sapiens
ccagtccacctgagacatgt

SEQ ID NO: 9378451 - DNA, 22 bp, Homo sapiens
ccagtcagggcaggagcctggt

SEQ ID NO: 9378452 - DNA, 22 bp, Homo sapiens
ccagtcagtcagttgctggcat

SEQ ID NO: 9378453 - DNA, 22 bp, Homo sapiens
ccagtcagccaagctgcagcgg

SEQ ID NO: 9378454 - DNA, 22 bp, Homo sapiens
ccagtcagccaagctgcagcgg

SEQ ID NO: 9378455 - DNA, 22 bp, Homo sapiens
ccaggtgtgtcaccattgccca

SEQ ID NO: 9378456 - DNA, 22 bp, Homo sapiens
ccaggtgtgtcaccattgccca

SEQ ID NO: 9378457 - DNA, 22 bp, Homo sapiens
ccagtcactggaaaatgggaat

SEQ ID NO: 9378458 - DNA, 22 bp, Homo sapiens
ccaggtggataaggtttctgga

SEQ ID NO: 9378459 - DNA, 22 bp, Homo sapiens
ccaggtggaggtgtgaggtcct

SEQ ID NO: 9378460 - DNA, 22 bp, Homo sapiens
ccaggtggaggtgtgaggtcct

SEQ ID NO: 9378461 - DNA, 22 bp, Homo sapiens
ccaggtggccctgccctactct

SEQ ID NO: 9378462 - DNA, 22 bp, Homo sapiens
ccaggtggccctgccctactct

SEQ ID NO: 9378463 - DNA, 22 bp, Homo sapiens
ccaggtggataaggtttctgga

SEQ ID NO: 9378464 - DNA, 22 bp, Homo sapiens
ccaggtggacttgatttgaata

SEQ ID NO: 9378465 - DNA, 22 bp, Homo sapiens
ccaggtggaggtgtgaggtcct

SEQ ID NO: 9378466 - DNA, 22 bp, Homo sapiens
ccaggtggaggtgtgaggtcct

SEQ ID NO: 9378467 - DNA, 22 bp, Homo sapiens
ccaggtggacttgatttgaata

SEQ ID NO: 9378468 - DNA, 22 bp, Homo sapiens
ccaggtgggaggaaagcagaga

SEQ ID NO: 9378469 - DNA, 22 bp, Homo sapiens
ccaggtgggaggaaagcagaga

SEQ ID NO: 9378470 - DNA, 22 bp, Homo sapiens
ccaggtggcttctgcccgatgt

SEQ ID NO: 9378471 - DNA, 22 bp, Homo sapiens
ccaggtgggaggaaagcagaga

SEQ ID NO: 9378472 - DNA, 22 bp, Homo sapiens
ccaggtggcttctgcccgatgt

SEQ ID NO: 9378473 - DNA, 22 bp, Homo sapiens
ccaggtggcttctgcccgatgt

SEQ ID NO: 9378474 - DNA, 22 bp, Homo sapiens
ccaggtgggaggaaagcagaga

SEQ ID NO: 9378475 - DNA, 22 bp, Homo sapiens
ccaggtgtgtcaccattgccca

SEQ ID NO: 9378476 - DNA, 22 bp, Homo sapiens
ccaggtgtgtcaccattgccca

SEQ ID NO: 9378477 - DNA, 17 bp, Homo sapiens
ccaggtgggaggtgggg

SEQ ID NO: 9378478 - DNA, 17 bp, Homo sapiens
ccaggtgggaggtgggg

SEQ ID NO: 9378479 - DNA, 17 bp, Homo sapiens
ccaggtgggaggtgggg

SEQ ID NO: 9378480 - DNA, 17 bp, Homo sapiens
ccaggtgggaggtgggg

SEQ ID NO: 9378481 - DNA, 22 bp, Homo sapiens
tgcaggaattttttgcagaaag

SEQ ID NO: 9378482 - DNA, 22 bp, Homo sapiens
tgcaggaattttttgcagaaag

SEQ ID NO: 9378483 - DNA, 22 bp, Homo sapiens
tgcaggaattttttgcagaaag

SEQ ID NO: 9378484 - DNA, 20 bp, Homo sapiens
tgcaggaatttgcattcctt

SEQ ID NO: 9378485 - DNA, 22 bp, Homo sapiens
tgcaggaatgaggttctcagtt

SEQ ID NO: 9378486 - DNA, 22 bp, Homo sapiens
tgcaggaatcagaggggaagcg

SEQ ID NO: 9378487 - DNA, 22 bp, Homo sapiens
tgcaggaatattgatgaactta

SEQ ID NO: 9378488 - DNA, 23 bp, Homo sapiens
tgcaggactactcgagcactgct

SEQ ID NO: 9378489 - DNA, 22 bp, Homo sapiens
tgcagctgcaggagggtgggag

SEQ ID NO: 9378490 - DNA, 22 bp, Homo sapiens
tgcagctgcctagggctggctt

SEQ ID NO: 9378491 - DNA, 23 bp, Homo sapiens
tgcagctgcctctggcgggccgg

SEQ ID NO: 9378492 - DNA, 22 bp, Homo sapiens
tgcaggaatagctacagagctg

SEQ ID NO: 9378493 - DNA, 22 bp, Homo sapiens
tgcaggaatagctacagagctg

SEQ ID NO: 9378494 - DNA, 22 bp, Homo sapiens
tgcaggaatagctacagagctg

SEQ ID NO: 9378495 - DNA, 22 bp, Homo sapiens
tgcagctgctcattctctcagt

SEQ ID NO: 9378496 - DNA, 22 bp, Homo sapiens
tgcaggaagtttcctgaacttt

SEQ ID NO: 9378497 - DNA, 20 bp, Homo sapiens
tgcagctgcaggagggtggg

SEQ ID NO: 9378498 - DNA, 20 bp, Homo sapiens
tgcagctgcaggagggtggg

SEQ ID NO: 9378499 - DNA, 22 bp, Homo sapiens
tgcagctgcaagtccaggtcag

SEQ ID NO: 9378500 - DNA, 22 bp, Homo sapiens
tgcagctgcaagtccaggtcag

SEQ ID NO: 9378501 - DNA, 22 bp, Homo sapiens
tgcagctgattaaagggcagac

SEQ ID NO: 9378502 - DNA, 22 bp, Homo sapiens
tgcagctgcaagtccaggtcag

SEQ ID NO: 9378503 - DNA, 22 bp, Homo sapiens
cccagagggtggaggttgcagt

SEQ ID NO: 9378504 - DNA, 22 bp, Homo sapiens
tgcagctgattaaagggcagac

SEQ ID NO: 9378505 - DNA, 22 bp, Homo sapiens
tgcagctgattaaagggcagac

SEQ ID NO: 9378506 - DNA, 22 bp, Homo sapiens
cccagagggaagggaatgaggt

SEQ ID NO: 9378507 - DNA, 22 bp, Homo sapiens
cccagagggctgaggatatgaa

SEQ ID NO: 9378508 - DNA, 22 bp, Homo sapiens
cccagaggggtcgtctgagggg

SEQ ID NO: 9378509 - DNA, 22 bp, Homo sapiens
cccagaggaggcaaagctctgt

SEQ ID NO: 9378510 - DNA, 22 bp, Homo sapiens
cccagaggctgagttgggagca

SEQ ID NO: 9378511 - DNA, 22 bp, Homo sapiens
cccagagggaagggaatgaggt

SEQ ID NO: 9378512 - DNA, 22 bp, Homo sapiens
cccagcagcttgcacagtgctg

SEQ ID NO: 9378513 - DNA, 22 bp, Homo sapiens
cccagcagcttgcacagtgctg

SEQ ID NO: 9378514 - DNA, 22 bp, Homo sapiens
tgcaggcctcacacctggcacc

SEQ ID NO: 9378515 - DNA, 22 bp, Homo sapiens
tgcaggcctatggtggggcccc

SEQ ID NO: 9378516 - DNA, 22 bp, Homo sapiens
tgcaggcccagtgtagaggctc

SEQ ID NO: 9378517 - DNA, 22 bp, Homo sapiens
tgcaggccggccctaggcctca

SEQ ID NO: 9378518 - DNA, 22 bp, Homo sapiens
tgcaggcccagtgtagaggctc

SEQ ID NO: 9378519 - DNA, 22 bp, Homo sapiens
tgcaggcccagtgtagaggctc

SEQ ID NO: 9378520 - DNA, 21 bp, Homo sapiens
tgcaggcaggcagagatgctg

SEQ ID NO: 9378521 - DNA, 22 bp, Homo sapiens
tgcaggcagggccagcgtgagg

SEQ ID NO: 9378522 - DNA, 22 bp, Homo sapiens
tgcaggcaggggatgagcagcc

SEQ ID NO: 9378523 - DNA, 21 bp, Homo sapiens
tgcaggcaggcagagatgctg

SEQ ID NO: 9378524 - DNA, 21 bp, Homo sapiens
tgcaggcaggcagagatgctg

SEQ ID NO: 9378525 - DNA, 22 bp, Homo sapiens
tgcaggagaaagtacggagcgt

SEQ ID NO: 9378526 - DNA, 22 bp, Homo sapiens
tgcaggcattggtgagagaagc

SEQ ID NO: 9378527 - DNA, 22 bp, Homo sapiens
tgcaggcataaccgatgttgat

SEQ ID NO: 9378528 - DNA, 22 bp, Homo sapiens
tgcaggcataaccgatgttgat

SEQ ID NO: 9378529 - DNA, 22 bp, Homo sapiens
tgcaggcaggggatgagcagcc

SEQ ID NO: 9378530 - DNA, 22 bp, Homo sapiens
tgcaggcaggggatgagcagcc

SEQ ID NO: 9378531 - DNA, 22 bp, Homo sapiens
tgcaggcagtaggccagctcca

SEQ ID NO: 9378532 - DNA, 22 bp, Homo sapiens
tgcaggcaggggatgagcagcc

SEQ ID NO: 9378533 - DNA, 22 bp, Homo sapiens
cccagcagcttgcacagtgctg

SEQ ID NO: 9378534 - DNA, 22 bp, Homo sapiens
cccagcaggaggaggttgcagt

SEQ ID NO: 9378535 - DNA, 22 bp, Homo sapiens
cccagcagcttgcacagtgctg

SEQ ID NO: 9378536 - DNA, 22 bp, Homo sapiens
cccagcaggcatgttgggagga

SEQ ID NO: 9378537 - DNA, 22 bp, Homo sapiens
cccagcaggcatgttgggagga

SEQ ID NO: 9378538 - DNA, 22 bp, Homo sapiens
cccagcagggtctctgtgtcta

SEQ ID NO: 9378539 - DNA, 22 bp, Homo sapiens
cccagcagggtctctgtgtcta

SEQ ID NO: 9378540 - DNA, 22 bp, Homo sapiens
tgcagggatcctagctgaagag

SEQ ID NO: 9378541 - DNA, 22 bp, Homo sapiens
tgcagggatcctagctgaagag

SEQ ID NO: 9378542 - DNA, 22 bp, Homo sapiens
tgcagggccttctagaccatgg

SEQ ID NO: 9378543 - DNA, 22 bp, Homo sapiens
tgcagggccttgggatgtgtcc

SEQ ID NO: 9378544 - DNA, 22 bp, Homo sapiens
tgcagggccttgggatgtgtcc

SEQ ID NO: 9378545 - DNA, 22 bp, Homo sapiens
tgcagggccttctagaccatgg

SEQ ID NO: 9378546 - DNA, 22 bp, Homo sapiens
tgcagggccttctagaccatgg

SEQ ID NO: 9378547 - DNA, 22 bp, Homo sapiens
tgcagggccttctagaccatgg

SEQ ID NO: 9378548 - DNA, 20 bp, Homo sapiens
tgcagggcctaaaaagggaa

SEQ ID NO: 9378549 - DNA, 20 bp, Homo sapiens
tgcagggcctaaaaagggaa

SEQ ID NO: 9378550 - DNA, 22 bp, Homo sapiens
tgcagggccgctggaggtcatg

SEQ ID NO: 9378551 - DNA, 22 bp, Homo sapiens
tgcagggccgctggaggtcatg

SEQ ID NO: 9378552 - DNA, 22 bp, Homo sapiens
tgcagggccttgttgatgtgct

SEQ ID NO: 9378553 - DNA, 22 bp, Homo sapiens
tgcagggccttgttgatgtgct

SEQ ID NO: 9378554 - DNA, 22 bp, Homo sapiens
tgcagggccttgttgatgtgct

SEQ ID NO: 9378555 - DNA, 22 bp, Homo sapiens
tgcagggctaagtcagagcctg

SEQ ID NO: 9378556 - DNA, 22 bp, Homo sapiens
tgcagggctaagtcagagcctg

SEQ ID NO: 9378557 - DNA, 22 bp, Homo sapiens
tgcagggccttgggtctttctt

SEQ ID NO: 9378558 - DNA, 22 bp, Homo sapiens
tgcagggccttgggtctttctt

SEQ ID NO: 9378559 - DNA, 22 bp, Homo sapiens
tgcagggccttgttgatgtgct

SEQ ID NO: 9378560 - DNA, 22 bp, Homo sapiens
tgcagggccttgggatgtgtcc

SEQ ID NO: 9378561 - DNA, 22 bp, Homo sapiens
cccaaggcctctccttggcttg

SEQ ID NO: 9378562 - DNA, 22 bp, Homo sapiens
cccaaggctgcagtgagcatga

SEQ ID NO: 9378563 - DNA, 23 bp, Homo sapiens
cccaagcctgtgccctctgactc

SEQ ID NO: 9378564 - DNA, 22 bp, Homo sapiens
tgcactccaggctgggtgacag

SEQ ID NO: 9378565 - DNA, 22 bp, Homo sapiens
cccaaggggtgttgatggagga

SEQ ID NO: 9378566 - DNA, 22 bp, Homo sapiens
cccaaggggtgttgatggagga

SEQ ID NO: 9378567 - DNA, 22 bp, Homo sapiens
cccaaggggtgttgatggagga

SEQ ID NO: 9378568 - DNA, 22 bp, Homo sapiens
cccaagggtgcccagcagagga

SEQ ID NO: 9378569 - DNA, 22 bp, Homo sapiens
cccaaggggagattttcttgag

SEQ ID NO: 9378570 - DNA, 22 bp, Homo sapiens
cccaagggatgcttgagtagtt

SEQ ID NO: 9378571 - DNA, 22 bp, Homo sapiens
cccaagggatgcttgagtagtt

SEQ ID NO: 9378572 - DNA, 22 bp, Homo sapiens
tgcaagtgattctgttttctca

SEQ ID NO: 9378573 - DNA, 22 bp, Homo sapiens
tgcaagtgccatgtgcacagtg

SEQ ID NO: 9378574 - DNA, 19 bp, Homo sapiens
tgcaagtgtcttggacaag

SEQ ID NO: 9378575 - DNA, 19 bp, Homo sapiens
tgcaagtgtcttggacaag

SEQ ID NO: 9378576 - DNA, 22 bp, Homo sapiens
tgcaaatattgggacagtctag

SEQ ID NO: 9378577 - DNA, 22 bp, Homo sapiens
tgcaaatattccatgctgttca

SEQ ID NO: 9378578 - DNA, 22 bp, Homo sapiens
tgatacacagatttacatcaat

SEQ ID NO: 9378579 - DNA, 22 bp, Homo sapiens
tgcaatatgttgcattgtatgg

SEQ ID NO: 9378580 - DNA, 22 bp, Homo sapiens
tgcaatattttatatccaacaa

SEQ ID NO: 9378581 - DNA, 22 bp, Homo sapiens
tgcaatatgttgcattgtatgg

SEQ ID NO: 9378582 - DNA, 22 bp, Homo sapiens
tgcaatatcagattcaacacat

SEQ ID NO: 9378583 - DNA, 22 bp, Homo sapiens
tgcagagagatcctcagggttt

SEQ ID NO: 9378584 - DNA, 22 bp, Homo sapiens
cccagagcctcattctgttggg

SEQ ID NO: 9378585 - DNA, 22 bp, Homo sapiens
cccagagcctcattctgttggg

SEQ ID NO: 9378586 - DNA, 17 bp, Homo sapiens
cccagagatgctgcctt

SEQ ID NO: 9378587 - DNA, 22 bp, Homo sapiens
cccagagctgagggggcacgtt

SEQ ID NO: 9378588 - DNA, 22 bp, Homo sapiens
cccagagctgagtctgatatat

SEQ ID NO: 9378589 - DNA, 22 bp, Homo sapiens
cccagagctgagtctgatatat

SEQ ID NO: 9378590 - DNA, 22 bp, Homo sapiens
cccagagctcagtgtgcaaggt

SEQ ID NO: 9378591 - DNA, 22 bp, Homo sapiens
cccagagcctcattctgttggg

SEQ ID NO: 9378592 - DNA, 22 bp, Homo sapiens
cccagagctccggtcctgccca

SEQ ID NO: 9378593 - DNA, 23 bp, Homo sapiens
cccagaggagcagggcgtgagat

SEQ ID NO: 9378594 - DNA, 19 bp, Homo sapiens
cccagaggaatgcctggaa

SEQ ID NO: 9378595 - DNA, 19 bp, Homo sapiens
cccagaggaatgcctggaa

SEQ ID NO: 9378596 - DNA, 19 bp, Homo sapiens
cccagaggaatgcctggaa

SEQ ID NO: 9378597 - DNA, 19 bp, Homo sapiens
cccagaggaatgcctggaa

SEQ ID NO: 9378598 - DNA, 22 bp, Homo sapiens
cccagaggaggatctcggcccg

SEQ ID NO: 9378599 - DNA, 23 bp, Homo sapiens
cccagaggagcagggcgtgagat

SEQ ID NO: 9378600 - DNA, 23 bp, Homo sapiens
cccagaggagcagggcgtgagat

SEQ ID NO: 9378601 - DNA, 18 bp, Homo sapiens
cccagaggaatgcctgga

SEQ ID NO: 9378602 - DNA, 18 bp, Homo sapiens
cccagaggaatgcctgga

SEQ ID NO: 9378603 - DNA, 18 bp, Homo sapiens
cccagaggaatgcctgga

SEQ ID NO: 9378604 - DNA, 18 bp, Homo sapiens
cccagaggaatgcctgga

SEQ ID NO: 9378605 - DNA, 22 bp, Homo sapiens
cccagagctgggtgggcagcgg

SEQ ID NO: 9378606 - DNA, 22 bp, Homo sapiens
cccagagctgattgttggagcc

SEQ ID NO: 9378607 - DNA, 22 bp, Homo sapiens
cccagagctgattgttggagcc

SEQ ID NO: 9378608 - DNA, 22 bp, Homo sapiens
cccagagctgattgttggagcc

SEQ ID NO: 9378609 - DNA, 22 bp, Homo sapiens
tgcactgatgttttgccaagga

SEQ ID NO: 9378610 - DNA, 22 bp, Homo sapiens
tgcactgatcctgaccagtgaa

SEQ ID NO: 9378611 - DNA, 22 bp, Homo sapiens
tgcactgatcctgaccagtgaa

SEQ ID NO: 9378612 - DNA, 22 bp, Homo sapiens
tgcactccaggctgggtgacag

SEQ ID NO: 9378613 - DNA, 22 bp, Homo sapiens
tgcactccaggctgggtgacag

SEQ ID NO: 9378614 - DNA, 22 bp, Homo sapiens
tgcactgaatagtagactgtac

SEQ ID NO: 9378615 - DNA, 22 bp, Homo sapiens
tgcactgatcctgaccagtgaa

SEQ ID NO: 9378616 - DNA, 22 bp, Homo sapiens
tgcactgaatagtagactgtac

SEQ ID NO: 9378617 - DNA, 22 bp, Homo sapiens
tgcactccaggctgggtgacag

SEQ ID NO: 9378618 - DNA, 22 bp, Homo sapiens
tgcactttgcaggcatggaaac

SEQ ID NO: 9378619 - DNA, 22 bp, Homo sapiens
tgcactttatttcctctcacac

SEQ ID NO: 9378620 - DNA, 22 bp, Homo sapiens
tgcactttaaaaaatggtgatg

SEQ ID NO: 9378621 - DNA, 22 bp, Homo sapiens
tgcacttattgacatagaaaaa

SEQ ID NO: 9378622 - DNA, 22 bp, Homo sapiens
tgcagagaaaccagtggaggac

SEQ ID NO: 9378623 - DNA, 22 bp, Homo sapiens
tgcagagacttgtgtgcatttg

SEQ ID NO: 9378624 - DNA, 22 bp, Homo sapiens
tgcagagacttgtgtgcatttg

SEQ ID NO: 9378625 - DNA, 19 bp, Homo sapiens
tgcagagagaggcaaagaa

SEQ ID NO: 9378626 - DNA, 22 bp, Homo sapiens
tgcagagagatatggcaagagg

SEQ ID NO: 9378627 - DNA, 22 bp, Homo sapiens
tgcagagagatatggcaagagg

SEQ ID NO: 9378628 - DNA, 22 bp, Homo sapiens
tcttgcacttcatgaatatgtt

SEQ ID NO: 9378629 - DNA, 22 bp, Homo sapiens
tcttgcacttcatgaatatgtt

SEQ ID NO: 9378630 - DNA, 22 bp, Homo sapiens
tcttgcagcttcatctgcaatt

SEQ ID NO: 9378631 - DNA, 22 bp, Homo sapiens
tcttgcagaggcactgtgtcag

SEQ ID NO: 9378632 - DNA, 22 bp, Homo sapiens
tcttgcagagggcccttctgct

SEQ ID NO: 9378633 - DNA, 22 bp, Homo sapiens
tcttgcagagggcccttctgct

SEQ ID NO: 9378634 - DNA, 19 bp, Homo sapiens
ccaggcctctggggcctgt

SEQ ID NO: 9378635 - DNA, 19 bp, Homo sapiens
ccaggcctctggggcctgt

SEQ ID NO: 9378636 - DNA, 19 bp, Homo sapiens
ccaggcctctggggcctgt

SEQ ID NO: 9378637 - DNA, 22 bp, Homo sapiens
ccaggcctgattgggaatcttg

SEQ ID NO: 9378638 - DNA, 22 bp, Homo sapiens
ccaggcctgattgggaatcttg

SEQ ID NO: 9378639 - DNA, 22 bp, Homo sapiens
tcttgatttactctaatagctt

SEQ ID NO: 9378640 - DNA, 22 bp, Homo sapiens
ccaggcctgcatctgctgcgca

SEQ ID NO: 9378641 - DNA, 22 bp, Homo sapiens
ccaggcctgattgggaatcttg

SEQ ID NO: 9378642 - DNA, 22 bp, Homo sapiens
ccaggcctctggctgcttagtc

SEQ ID NO: 9378643 - DNA, 23 bp, Homo sapiens
ccaggcctctcagagggtgtgcc

SEQ ID NO: 9378644 - DNA, 23 bp, Homo sapiens
ccaggcctctcagagggtgtgcc

SEQ ID NO: 9378645 - DNA, 22 bp, Homo sapiens
ccaggcctctggctgcttagtc

SEQ ID NO: 9378646 - DNA, 22 bp, Homo sapiens
ccaggcctctggctgcttagtc

SEQ ID NO: 9378647 - DNA, 19 bp, Homo sapiens
ccaggcctctggggcctgt

SEQ ID NO: 9378648 - DNA, 19 bp, Homo sapiens
ccaggcctctggggcctgt

SEQ ID NO: 9378649 - DNA, 22 bp, Homo sapiens
tcttttgggttcttatgattta

SEQ ID NO: 9378650 - DNA, 22 bp, Homo sapiens
tcttttggaaatgatgtgcagg

SEQ ID NO: 9378651 - DNA, 22 bp, Homo sapiens
tcttttcttcttaatggttaat

SEQ ID NO: 9378652 - DNA, 22 bp, Homo sapiens
tcttttcttgcattattgcact

SEQ ID NO: 9378653 - DNA, 22 bp, Homo sapiens
tcttttcttgcattattgcact

SEQ ID NO: 9378654 - DNA, 22 bp, Homo sapiens
tcttttgagggccagaggaaga

SEQ ID NO: 9378655 - DNA, 22 bp, Homo sapiens
tctttggttgcactgcaggtgt

SEQ ID NO: 9378656 - DNA, 22 bp, Homo sapiens
tcttgccacttcatcccctttc

SEQ ID NO: 9378657 - DNA, 22 bp, Homo sapiens
tcttttctggactctgcatgga

SEQ ID NO: 9378658 - DNA, 22 bp, Homo sapiens
tcttttctgtaactcagtgtct

SEQ ID NO: 9378659 - DNA, 22 bp, Homo sapiens
tcttttctgtaactcagtgtct

SEQ ID NO: 9378660 - DNA, 22 bp, Homo sapiens
tcttttcttcttaatggttaat

SEQ ID NO: 9378661 - DNA, 22 bp, Homo sapiens
tcttttctgccacagcctgagc

SEQ ID NO: 9378662 - DNA, 22 bp, Homo sapiens
tcttttctgccacagcctgagc

SEQ ID NO: 9378663 - DNA, 22 bp, Homo sapiens
tctttggtttctgtctctgtaa

SEQ ID NO: 9378664 - DNA, 22 bp, Homo sapiens
tcttttctgccagctgagccct

SEQ ID NO: 9378665 - DNA, 22 bp, Homo sapiens
tcttttctgccagctgagccct

SEQ ID NO: 9378666 - DNA, 21 bp, Homo sapiens
ccaggctgggagggcagttcc

SEQ ID NO: 9378667 - DNA, 22 bp, Homo sapiens
tgaaacaattagaatgtaatga

SEQ ID NO: 9378668 - DNA, 22 bp, Homo sapiens
tcttttgtggatgaagaaatgg

SEQ ID NO: 9378669 - DNA, 22 bp, Homo sapiens
tcttttgtggatgaagaaatgg

SEQ ID NO: 9378670 - DNA, 22 bp, Homo sapiens
ccaggcttcctaatgtgtgcag

SEQ ID NO: 9378671 - DNA, 22 bp, Homo sapiens
ccaggcttcctaatgtgtgcag

SEQ ID NO: 9378672 - DNA, 22 bp, Homo sapiens
ccaggcttccctgagaggctgc

SEQ ID NO: 9378673 - DNA, 22 bp, Homo sapiens
ccaggcttcccccatcctagga

SEQ ID NO: 9378674 - DNA, 22 bp, Homo sapiens
ccaggcttccctgagaggctgc

SEQ ID NO: 9378675 - DNA, 22 bp, Homo sapiens
ccaggcttattatcttctccat

SEQ ID NO: 9378676 - DNA, 22 bp, Homo sapiens
ccaggcttcaggagtggtttcc

SEQ ID NO: 9378677 - DNA, 22 bp, Homo sapiens
ccaggcttctgattccaggcac

SEQ ID NO: 9378678 - DNA, 22 bp, Homo sapiens
tgaaatgaaacagaacatatca

SEQ ID NO: 9378679 - DNA, 22 bp, Homo sapiens
tgaaatgacagtcttaagctct

SEQ ID NO: 9378680 - DNA, 22 bp, Homo sapiens
tgaaatgagagcacagaataaa

SEQ ID NO: 9378681 - DNA, 22 bp, Homo sapiens
tgaaatgagagcacagaataaa

SEQ ID NO: 9378682 - DNA, 21 bp, Homo sapiens
tgaaatgagaatgctgagcac

SEQ ID NO: 9378683 - DNA, 22 bp, Homo sapiens
tgaaatgaagggcttgttctgg

SEQ ID NO: 9378684 - DNA, 22 bp, Homo sapiens
tgaaatgaatgtgattcgatag

SEQ ID NO: 9378685 - DNA, 22 bp, Homo sapiens
tgaaatgacaaaggtttttctt

SEQ ID NO: 9378686 - DNA, 22 bp, Homo sapiens
tgaaatgacagtcttaagctct

SEQ ID NO: 9378687 - DNA, 22 bp, Homo sapiens
tgaaatgaatgtgattcgatag

SEQ ID NO: 9378688 - DNA, 22 bp, Homo sapiens
ccaggctgtaagagtgatgttg

SEQ ID NO: 9378689 - DNA, 22 bp, Homo sapiens
ccaggctgtaagagtgatgttg

SEQ ID NO: 9378690 - DNA, 21 bp, Homo sapiens
ccaggctgggagggcagttcc

SEQ ID NO: 9378691 - DNA, 22 bp, Homo sapiens
ccaggctgtaagagtgatgttg

SEQ ID NO: 9378692 - DNA, 22 bp, Homo sapiens
ccaggctgtgcttttcataaat

SEQ ID NO: 9378693 - DNA, 22 bp, Homo sapiens
ccaggctgttttcaaacttggg

SEQ ID NO: 9378694 - DNA, 22 bp, Homo sapiens
ccaggctgttttcaaacttggg

SEQ ID NO: 9378695 - DNA, 22 bp, Homo sapiens
ccaggctgtggtttagatagag

SEQ ID NO: 9378696 - DNA, 22 bp, Homo sapiens
ccaggctgtggtttagatagag

SEQ ID NO: 9378697 - DNA, 22 bp, Homo sapiens
ccagggctctgcttctgccatg

SEQ ID NO: 9378698 - DNA, 22 bp, Homo sapiens
ccagggctctgcttctgccatg

SEQ ID NO: 9378699 - DNA, 22 bp, Homo sapiens
ccagggctctgcttctgccatg

SEQ ID NO: 9378700 - DNA, 22 bp, Homo sapiens
ccagggctctatgagggtggag

SEQ ID NO: 9378701 - DNA, 22 bp, Homo sapiens
ccagggctctgcttctgccatg

SEQ ID NO: 9378702 - DNA, 22 bp, Homo sapiens
ccagggctctgcttctgccatg

SEQ ID NO: 9378703 - DNA, 22 bp, Homo sapiens
ccagggctgagctgtgaccatg

SEQ ID NO: 9378704 - DNA, 22 bp, Homo sapiens
ccagggctgagactgtattggg

SEQ ID NO: 9378705 - DNA, 22 bp, Homo sapiens
ccagggctgagctgtgaccatg

SEQ ID NO: 9378706 - DNA, 22 bp, Homo sapiens
ccagggctgagctgtgaccatg

SEQ ID NO: 9378707 - DNA, 22 bp, Homo sapiens
ccagggctgagctgtgaccatg

SEQ ID NO: 9378708 - DNA, 22 bp, Homo sapiens
ccagggctgagctgtgaccatg

SEQ ID NO: 9378709 - DNA, 22 bp, Homo sapiens
ccagggctgccgcatccctggt

SEQ ID NO: 9378710 - DNA, 22 bp, Homo sapiens
ccagggctgagctgtgaccatg

SEQ ID NO: 9378711 - DNA, 22 bp, Homo sapiens
ccagggctgccgcatccctggt

SEQ ID NO: 9378712 - DNA, 22 bp, Homo sapiens
ccagggctgcctggccgtgtgt

SEQ ID NO: 9378713 - DNA, 22 bp, Homo sapiens
ccagggctgccgcatccctggt

SEQ ID NO: 9378714 - DNA, 22 bp, Homo sapiens
ccagggctccattgctcatcct

SEQ ID NO: 9378715 - DNA, 22 bp, Homo sapiens
tgaagtgggaatacttcttccc

SEQ ID NO: 9378716 - DNA, 22 bp, Homo sapiens
tgaagttatatatgttgaaaat

SEQ ID NO: 9378717 - DNA, 22 bp, Homo sapiens
ccagggcctacagcttaagtcc

SEQ ID NO: 9378718 - DNA, 22 bp, Homo sapiens
ccagggctccccagaagtaccc

SEQ ID NO: 9378719 - DNA, 22 bp, Homo sapiens
ccagggctccccagaagtaccc

SEQ ID NO: 9378720 - DNA, 22 bp, Homo sapiens
ccagggctccattgctcatcct

SEQ ID NO: 9378721 - DNA, 22 bp, Homo sapiens
ccagggctccattgctcatcct

SEQ ID NO: 9378722 - DNA, 22 bp, Homo sapiens
ccagggctctatgagggtggag

SEQ ID NO: 9378723 - DNA, 22 bp, Homo sapiens
ccagggctctatgagggtggag

SEQ ID NO: 9378724 - DNA, 22 bp, Homo sapiens
ccagggctcgggtgcttagtca

SEQ ID NO: 9378725 - DNA, 22 bp, Homo sapiens
ccagggctcgggtgcttagtca

SEQ ID NO: 9378726 - DNA, 22 bp, Homo sapiens
ccagggcatcacatccagtgtt

SEQ ID NO: 9378727 - DNA, 22 bp, Homo sapiens
ccagggcatcctcacatcgcag

SEQ ID NO: 9378728 - DNA, 22 bp, Homo sapiens
ccagggcatcctcacatcgcag

SEQ ID NO: 9378729 - DNA, 22 bp, Homo sapiens
ccagggcatgggaagaactgaa

SEQ ID NO: 9378730 - DNA, 22 bp, Homo sapiens
ccagggcatgggaagaactgaa

SEQ ID NO: 9378731 - DNA, 22 bp, Homo sapiens
ccagggcagtgggagaaggtgc

SEQ ID NO: 9378732 - DNA, 22 bp, Homo sapiens
ccagggcagtgggagaaggtgc

SEQ ID NO: 9378733 - DNA, 22 bp, Homo sapiens
ccagggcatcacatccagtgtt

SEQ ID NO: 9378734 - DNA, 22 bp, Homo sapiens
ccagggcatcctcacatcgcag

SEQ ID NO: 9378735 - DNA, 22 bp, Homo sapiens
ccagggcatcacatccagtgtt

SEQ ID NO: 9378736 - DNA, 22 bp, Homo sapiens
tgaagtggaccctggacagacc

SEQ ID NO: 9378737 - DNA, 22 bp, Homo sapiens
tgaagtgattagaaccacttga

SEQ ID NO: 9378738 - DNA, 22 bp, Homo sapiens
tgaagtgacctggggcagtgta

SEQ ID NO: 9378739 - DNA, 22 bp, Homo sapiens
tgaagtgaagaagcatgaatag

SEQ ID NO: 9378740 - DNA, 22 bp, Homo sapiens
tgaagtgaagaagcatgaatag

SEQ ID NO: 9378741 - DNA, 23 bp, Homo sapiens
tgaagtgaaatttcacaagggac

SEQ ID NO: 9378742 - DNA, 23 bp, Homo sapiens
tgaagtgaaatttcacaagggac

SEQ ID NO: 9378743 - DNA, 22 bp, Homo sapiens
tgaagtctttctgatcatttac

SEQ ID NO: 9378744 - DNA, 22 bp, Homo sapiens
tgaagtatacaggctctgctaa

SEQ ID NO: 9378745 - DNA, 22 bp, Homo sapiens
tgaagtatcccaagatttacag

SEQ ID NO: 9378746 - DNA, 22 bp, Homo sapiens
ccagggaagctggtcacgcagg

SEQ ID NO: 9378747 - DNA, 22 bp, Homo sapiens
tgaaatgatcagtttggttact

SEQ ID NO: 9378748 - DNA, 22 bp, Homo sapiens
tgaaatgatatctgataacaaa

SEQ ID NO: 9378749 - DNA, 22 bp, Homo sapiens
tgaaatgatcagtttggttact

SEQ ID NO: 9378750 - DNA, 22 bp, Homo sapiens
tgaaatgatgtacaagaaggca

SEQ ID NO: 9378751 - DNA, 22 bp, Homo sapiens
ccagggaagattagaagccact

SEQ ID NO: 9378752 - DNA, 22 bp, Homo sapiens
tgaaatgagcatttattcttta

SEQ ID NO: 9378753 - DNA, 22 bp, Homo sapiens
tgaaatgagatagataatcagg

SEQ ID NO: 9378754 - DNA, 22 bp, Homo sapiens
tgaaatgagcatttattcttta

SEQ ID NO: 9378755 - DNA, 22 bp, Homo sapiens
tgaaatgatatctgataacaaa

SEQ ID NO: 9378756 - DNA, 22 bp, Homo sapiens
tgaaatgagatagataatcagg

SEQ ID NO: 9378757 - DNA, 22 bp, Homo sapiens
tgaaatgagataatttaagtgc

SEQ ID NO: 9378758 - DNA, 18 bp, Homo sapiens
ccagggatgcatggtccc

SEQ ID NO: 9378759 - DNA, 22 bp, Homo sapiens
ccagggatgccaagctttacca

SEQ ID NO: 9378760 - DNA, 22 bp, Homo sapiens
ccagggatgctttcccaggact

SEQ ID NO: 9378761 - DNA, 22 bp, Homo sapiens
ccagggatgctttcccaggact

SEQ ID NO: 9378762 - DNA, 18 bp, Homo sapiens
ccagggatgcatggtccc

SEQ ID NO: 9378763 - DNA, 22 bp, Homo sapiens
ccagggatgcagaggttgcagt

SEQ ID NO: 9378764 - DNA, 23 bp, Homo sapiens
ccagggagtgctactatcaagcc

SEQ ID NO: 9378765 - DNA, 22 bp, Homo sapiens
ccagggagggtcctgtggcttc

SEQ ID NO: 9378766 - DNA, 17 bp, Homo sapiens
ccagggaggggccgcgc

SEQ ID NO: 9378767 - DNA, 22 bp, Homo sapiens
ccagggagggtcctgtggcttc

SEQ ID NO: 9378768 - DNA, 23 bp, Homo sapiens
ccagggaggttgattggttaccc

SEQ ID NO: 9378769 - DNA, 22 bp, Homo sapiens
ccagggagggtcctgtggcttc

SEQ ID NO: 9378770 - DNA, 22 bp, Homo sapiens
ccagggcaaatgagatcatagc

SEQ ID NO: 9378771 - DNA, 21 bp, Homo sapiens
ccagggatgttgaactgaaag

SEQ ID NO: 9378772 - DNA, 22 bp, Homo sapiens
ccagggatgtggcagcaccata

SEQ ID NO: 9378773 - DNA, 22 bp, Homo sapiens
ccagggcaacgctgtctcagag

SEQ ID NO: 9378774 - DNA, 22 bp, Homo sapiens
ccagggcaacgctgtctcagag

SEQ ID NO: 9378775 - DNA, 22 bp, Homo sapiens
ccagggcaaatgagatcatagc

SEQ ID NO: 9378776 - DNA, 22 bp, Homo sapiens
ccagggcaaatgagatcatagc

SEQ ID NO: 9378777 - DNA, 22 bp, Homo sapiens
ccagggcaataggaacactttt

SEQ ID NO: 9378778 - DNA, 22 bp, Homo sapiens
ccagggcaacgctgtctcagag

SEQ ID NO: 9378779 - DNA, 22 bp, Homo sapiens
ccagggcaataggaacactttt

SEQ ID NO: 9378780 - DNA, 22 bp, Homo sapiens
ccagggcaacgctgtctcagag

SEQ ID NO: 9378781 - DNA, 22 bp, Homo sapiens
ccagggcaacgctgtctcagag

SEQ ID NO: 9378782 - DNA, 22 bp, Homo sapiens
ccagggcaattatttggagggt

SEQ ID NO: 9378783 - DNA, 22 bp, Homo sapiens
ccagggcaataggaacactttt

SEQ ID NO: 9378784 - DNA, 22 bp, Homo sapiens
ccagggcaattatttggagggt

SEQ ID NO: 9378785 - DNA, 22 bp, Homo sapiens
ccagggcaggagaaagactcac

SEQ ID NO: 9378786 - DNA, 22 bp, Homo sapiens
ccagggcacgttgggacagtac

SEQ ID NO: 9378787 - DNA, 22 bp, Homo sapiens
ccagggcacgttgggacagtac

SEQ ID NO: 9378788 - DNA, 22 bp, Homo sapiens
ccagggcacgttgggacagtac

SEQ ID NO: 9378789 - DNA, 22 bp, Homo sapiens
ccagggcacgttgggacagtac

SEQ ID NO: 9378790 - DNA, 22 bp, Homo sapiens
ccagggcacgttgggacagtac

SEQ ID NO: 9378791 - DNA, 22 bp, Homo sapiens
ccagggcaattatttggagggt

SEQ ID NO: 9378792 - DNA, 22 bp, Homo sapiens
ccagggcagggaccacgtgtct

SEQ ID NO: 9378793 - DNA, 22 bp, Homo sapiens
ccagggcaggagaaagactcac

SEQ ID NO: 9378794 - DNA, 22 bp, Homo sapiens
ccagggcaggagaaagactcac

SEQ ID NO: 9378795 - DNA, 22 bp, Homo sapiens
ccagggcagggaccacgtgtct

SEQ ID NO: 9378796 - DNA, 22 bp, Homo sapiens
ccagggcagtgggagaaggtgc

SEQ ID NO: 9378797 - DNA, 22 bp, Homo sapiens
ccagggcaggggctggagttca

SEQ ID NO: 9378798 - DNA, 22 bp, Homo sapiens
ccagggcaggggctggagttca

SEQ ID NO: 9378799 - DNA, 22 bp, Homo sapiens
ccagggcaggggctggagttca

SEQ ID NO: 9378800 - DNA, 22 bp, Homo sapiens
ccagggcagggaccacgtgtct

SEQ ID NO: 9378801 - DNA, 22 bp, Homo sapiens
ccaggagcaccaggcctgtgcc

SEQ ID NO: 9378802 - DNA, 22 bp, Homo sapiens
ccaggagcaccaggcctgtgcc

SEQ ID NO: 9378803 - DNA, 22 bp, Homo sapiens
ccaggagcagatatggacataa

SEQ ID NO: 9378804 - DNA, 22 bp, Homo sapiens
ccaggagcaggagctgcagctg

SEQ ID NO: 9378805 - DNA, 22 bp, Homo sapiens
ccaggagcaggagctgcagctg

SEQ ID NO: 9378806 - DNA, 22 bp, Homo sapiens
ccaggagcaggagctggacaga

SEQ ID NO: 9378807 - DNA, 22 bp, Homo sapiens
ccaggagcaggagctggacaga

SEQ ID NO: 9378808 - DNA, 22 bp, Homo sapiens
ccaggagccctgccacaatggt

SEQ ID NO: 9378809 - DNA, 22 bp, Homo sapiens
ccaggagcattaagagaacata

SEQ ID NO: 9378810 - DNA, 22 bp, Homo sapiens
ccaggagccactcaggcccaca

SEQ ID NO: 9378811 - DNA, 19 bp, Homo sapiens
ccaggagcagtggtgagct

SEQ ID NO: 9378812 - DNA, 22 bp, Homo sapiens
ccaggagcagggctggctgcac

SEQ ID NO: 9378813 - DNA, 22 bp, Homo sapiens
ccaggagcagggctggctgcac

SEQ ID NO: 9378814 - DNA, 22 bp, Homo sapiens
ccaggagcctgggccaggctgg

SEQ ID NO: 9378815 - DNA, 22 bp, Homo sapiens
ccaggagcctgggccaggctgg

SEQ ID NO: 9378816 - DNA, 22 bp, Homo sapiens
tctgtggctatcatactgaagg

SEQ ID NO: 9378817 - DNA, 22 bp, Homo sapiens
tctgtggctatcatactgaagg

SEQ ID NO: 9378818 - DNA, 20 bp, Homo sapiens
tctgttattgcatgtacata

SEQ ID NO: 9378819 - DNA, 22 bp, Homo sapiens
tctgttattctgtctattgcca

SEQ ID NO: 9378820 - DNA, 23 bp, Homo sapiens
tctgtggctccttcaggctgctg

SEQ ID NO: 9378821 - DNA, 22 bp, Homo sapiens
tctgttcagttgtaccttcccc

SEQ ID NO: 9378822 - DNA, 22 bp, Homo sapiens
tctgttcctgcatagtacctca

SEQ ID NO: 9378823 - DNA, 22 bp, Homo sapiens
tctgttcctttgtgcagtgatg

SEQ ID NO: 9378824 - DNA, 22 bp, Homo sapiens
tctgttccatgcagtgtcagat

SEQ ID NO: 9378825 - DNA, 22 bp, Homo sapiens
tctgttcatgtctttttaagtg

SEQ ID NO: 9378826 - DNA, 22 bp, Homo sapiens
tctgggcctgtctcagagctgg

SEQ ID NO: 9378827 - DNA, 22 bp, Homo sapiens
tctgggcctgatggctaaagcc

SEQ ID NO: 9378828 - DNA, 22 bp, Homo sapiens
tctgggcctcacctgctgctca

SEQ ID NO: 9378829 - DNA, 22 bp, Homo sapiens
tctgggcctcagtttcttcatc

SEQ ID NO: 9378830 - DNA, 22 bp, Homo sapiens
tctgggcctcagtttcttcatc

SEQ ID NO: 9378831 - DNA, 22 bp, Homo sapiens
tctgggctatatggtctctgct

SEQ ID NO: 9378832 - DNA, 22 bp, Homo sapiens
tctgggctcacgagtctggaca

SEQ ID NO: 9378833 - DNA, 22 bp, Homo sapiens
tctgggctatatggtctctgct

SEQ ID NO: 9378834 - DNA, 22 bp, Homo sapiens
tctgggctcacgagtctggaca

SEQ ID NO: 9378835 - DNA, 22 bp, Homo sapiens
tctgggctctgcgaagcccttc

SEQ ID NO: 9378836 - DNA, 22 bp, Homo sapiens
tctgggctctgggaattaggga

SEQ ID NO: 9378837 - DNA, 22 bp, Homo sapiens
tctgggctctgggaattaggga

SEQ ID NO: 9378838 - DNA, 22 bp, Homo sapiens
tctgggctctgggaattaggga

SEQ ID NO: 9378839 - DNA, 22 bp, Homo sapiens
tctgggctctgcgaagcccttc

SEQ ID NO: 9378840 - DNA, 22 bp, Homo sapiens
ccagcactcctgtctcaagtct

SEQ ID NO: 9378841 - DNA, 22 bp, Homo sapiens
ccagcactcctgtctcaagtct

SEQ ID NO: 9378842 - DNA, 22 bp, Homo sapiens
ccagcactctattgaatattct

SEQ ID NO: 9378843 - DNA, 20 bp, Homo sapiens
tctgggagggacaagtctcc

SEQ ID NO: 9378844 - DNA, 22 bp, Homo sapiens
tctgggccctgagatgttcttc

SEQ ID NO: 9378845 - DNA, 22 bp, Homo sapiens
tctgggcctatagaagtctacc

SEQ ID NO: 9378846 - DNA, 22 bp, Homo sapiens
tctgggccggagccgacggcag

SEQ ID NO: 9378847 - DNA, 22 bp, Homo sapiens
tctgggcttttgcactggccat

SEQ ID NO: 9378848 - DNA, 21 bp, Homo sapiens
tctggggaagacatctaggat

SEQ ID NO: 9378849 - DNA, 21 bp, Homo sapiens
tctggggaagacatctaggat

SEQ ID NO: 9378850 - DNA, 22 bp, Homo sapiens
tctgggctctgtcagcacctct

SEQ ID NO: 9378851 - DNA, 22 bp, Homo sapiens
tctgggcttttccatgcctgtg

SEQ ID NO: 9378852 - DNA, 22 bp, Homo sapiens
tctgggctctgtcagcacctct

SEQ ID NO: 9378853 - DNA, 22 bp, Homo sapiens
tctgggcttttgcactggccat

SEQ ID NO: 9378854 - DNA, 22 bp, Homo sapiens
tctggggagggagccacaggtc

SEQ ID NO: 9378855 - DNA, 22 bp, Homo sapiens
tctggggagcagccctggtgag

SEQ ID NO: 9378856 - DNA, 22 bp, Homo sapiens
tctggggagcagccctggtgag

SEQ ID NO: 9378857 - DNA, 22 bp, Homo sapiens
ccaggagagcaaaggtcactct

SEQ ID NO: 9378858 - DNA, 22 bp, Homo sapiens
ccaggagcaacttgaaggcaag

SEQ ID NO: 9378859 - DNA, 22 bp, Homo sapiens
ccaggagcaacttgaaggcaag

SEQ ID NO: 9378860 - DNA, 22 bp, Homo sapiens
ccaggagcaacttgaaggcaag

SEQ ID NO: 9378861 - DNA, 22 bp, Homo sapiens
ccaggagcaccaggcctgtgcc

SEQ ID NO: 9378862 - DNA, 22 bp, Homo sapiens
tctggggatgaggacctagatg

SEQ ID NO: 9378863 - DNA, 22 bp, Homo sapiens
tctggggagtcaaagagacctg

SEQ ID NO: 9378864 - DNA, 22 bp, Homo sapiens
tctggggagtgcctaagtggaa

SEQ ID NO: 9378865 - DNA, 22 bp, Homo sapiens
tctggggagtgcctaagtggaa

SEQ ID NO: 9378866 - DNA, 22 bp, Homo sapiens
ccaggcccccgagcagaagaca

SEQ ID NO: 9378867 - DNA, 22 bp, Homo sapiens
ccaggcccccgagcagaagaca

SEQ ID NO: 9378868 - DNA, 22 bp, Homo sapiens
ccaggcaggcgatggtgcagtg

SEQ ID NO: 9378869 - DNA, 22 bp, Homo sapiens
ccaggcctcctgtgagtggacc

SEQ ID NO: 9378870 - DNA, 22 bp, Homo sapiens
ccaggcctcctgtgagtggacc

SEQ ID NO: 9378871 - DNA, 19 bp, Homo sapiens
ccaggcctcctgggaggtc

SEQ ID NO: 9378872 - DNA, 19 bp, Homo sapiens
ccaggcctcctgggaggtc

SEQ ID NO: 9378873 - DNA, 22 bp, Homo sapiens
ccaggcagccaagtgtgtgtgt

SEQ ID NO: 9378874 - DNA, 22 bp, Homo sapiens
ccaggcagccaagtgtgtgtgt

SEQ ID NO: 9378875 - DNA, 22 bp, Homo sapiens
ccaggcagccaagtgtgtgtgt

SEQ ID NO: 9378876 - DNA, 22 bp, Homo sapiens
ccaggcagctctgatttatgtc

SEQ ID NO: 9378877 - DNA, 22 bp, Homo sapiens
ccaggcagctctgatttatgtc

SEQ ID NO: 9378878 - DNA, 22 bp, Homo sapiens
ccaggcagcctgctccattctg

SEQ ID NO: 9378879 - DNA, 22 bp, Homo sapiens
ccaggcagcctgctccattctg

SEQ ID NO: 9378880 - DNA, 22 bp, Homo sapiens
ccaggcaggcagcgttctcagg

SEQ ID NO: 9378881 - DNA, 22 bp, Homo sapiens
ccaggcaggcgatggtgcagtg

SEQ ID NO: 9378882 - DNA, 22 bp, Homo sapiens
ccaggcaggcagcgttctcagg

SEQ ID NO: 9378883 - DNA, 22 bp, Homo sapiens
ccaggcaggcgatggtgcagtg

SEQ ID NO: 9378884 - DNA, 22 bp, Homo sapiens
ccaggcaggcgatggtgcagtg

SEQ ID NO: 9378885 - DNA, 19 bp, Homo sapiens
tcttctgacttcaagaaac

SEQ ID NO: 9378886 - DNA, 22 bp, Homo sapiens
tcttctgaaggtaggaagcatt

SEQ ID NO: 9378887 - DNA, 22 bp, Homo sapiens
tcttctgatgccagtaaccatg

SEQ ID NO: 9378888 - DNA, 22 bp, Homo sapiens
ccaggcagcaaattttctgaat

SEQ ID NO: 9378889 - DNA, 22 bp, Homo sapiens
tcttctggatcgatcacattgt

SEQ ID NO: 9378890 - DNA, 17 bp, Homo sapiens
tcttctcttccagtctt

SEQ ID NO: 9378891 - DNA, 17 bp, Homo sapiens
tcttctcttccagtctt

SEQ ID NO: 9378892 - DNA, 17 bp, Homo sapiens
tcttctcttccagtctt

SEQ ID NO: 9378893 - DNA, 17 bp, Homo sapiens
tcttctcttccagtctt

SEQ ID NO: 9378894 - DNA, 17 bp, Homo sapiens
tcttctcttccagtctt

SEQ ID NO: 9378895 - DNA, 17 bp, Homo sapiens
tcttctcttccagtctt

SEQ ID NO: 9378896 - DNA, 22 bp, Homo sapiens
tcttctctgtggcctggtggtg

SEQ ID NO: 9378897 - DNA, 22 bp, Homo sapiens
tcttctctcctgcttggcagaa

SEQ ID NO: 9378898 - DNA, 22 bp, Homo sapiens
tcttctctcatgtaggagggaa

SEQ ID NO: 9378899 - DNA, 22 bp, Homo sapiens
tcttcctcatgaattctcgtat

SEQ ID NO: 9378900 - DNA, 22 bp, Homo sapiens
tcttcctcatgaattctcgtat

SEQ ID NO: 9378901 - DNA, 22 bp, Homo sapiens
tcttctctgtggcctggtggtg

SEQ ID NO: 9378902 - DNA, 22 bp, Homo sapiens
tcttctctgtggcctggtggtg

SEQ ID NO: 9378903 - DNA, 22 bp, Homo sapiens
tcttctctcctgcttggcagaa

SEQ ID NO: 9378904 - DNA, 22 bp, Homo sapiens
tcttctctcctgcttggcagaa

SEQ ID NO: 9378905 - DNA, 22 bp, Homo sapiens
tcttagaaaaatggtatgtttt

SEQ ID NO: 9378906 - DNA, 22 bp, Homo sapiens
tcttagaaactgtatcgattag

SEQ ID NO: 9378907 - DNA, 22 bp, Homo sapiens
tcttagaaattccccagtggct

SEQ ID NO: 9378908 - DNA, 22 bp, Homo sapiens
tcttagaaatgaagttctttct

SEQ ID NO: 9378909 - DNA, 22 bp, Homo sapiens
tcttcctcaatgtaacaacccc

SEQ ID NO: 9378910 - DNA, 22 bp, Homo sapiens
tcttagaagtttatggcacgga

SEQ ID NO: 9378911 - DNA, 22 bp, Homo sapiens
tcttagaagttcatgttccagc

SEQ ID NO: 9378912 - DNA, 22 bp, Homo sapiens
tcttagaaattccccagtggct

SEQ ID NO: 9378913 - DNA, 22 bp, Homo sapiens
tcttagaagttcatgttccagc

SEQ ID NO: 9378914 - DNA, 22 bp, Homo sapiens
tcttagaagttcatgttccagc

SEQ ID NO: 9378915 - DNA, 22 bp, Homo sapiens
ccaggaggctctgactggaccc

SEQ ID NO: 9378916 - DNA, 22 bp, Homo sapiens
ccaggaggctctgactggaccc

SEQ ID NO: 9378917 - DNA, 22 bp, Homo sapiens
ccaggaggctctgactggaccc

SEQ ID NO: 9378918 - DNA, 22 bp, Homo sapiens
ccaggaggctcttgtccctggt

SEQ ID NO: 9378919 - DNA, 22 bp, Homo sapiens
ccaggaggcggaggttgcagtg

SEQ ID NO: 9378920 - DNA, 22 bp, Homo sapiens
ccaggaggcggaggttgcagtg

SEQ ID NO: 9378921 - DNA, 22 bp, Homo sapiens
ccaggaggcggaggttgcagtg

SEQ ID NO: 9378922 - DNA, 22 bp, Homo sapiens
ccaggaggcggaggttgcagcg

SEQ ID NO: 9378923 - DNA, 22 bp, Homo sapiens
ccaggaggcggaggttgcagcg

SEQ ID NO: 9378924 - DNA, 22 bp, Homo sapiens
ccaggcacttgtttgccaggca

SEQ ID NO: 9378925 - DNA, 22 bp, Homo sapiens
ccaggcacttgtttgccaggca

SEQ ID NO: 9378926 - DNA, 22 bp, Homo sapiens
ccaggcacttgtttgccaggca

SEQ ID NO: 9378927 - DNA, 22 bp, Homo sapiens
ccaggcagaatgaaacccctgt

SEQ ID NO: 9378928 - DNA, 22 bp, Homo sapiens
ccaggcagaatgaaacccctgt

SEQ ID NO: 9378929 - DNA, 21 bp, Homo sapiens
ccaggcagagctgtgagttct

SEQ ID NO: 9378930 - DNA, 22 bp, Homo sapiens
ccaggcacactgccctgccctt

SEQ ID NO: 9378931 - DNA, 22 bp, Homo sapiens
ccaggaggctcttgtccctggt

SEQ ID NO: 9378932 - DNA, 22 bp, Homo sapiens
ccaggcagagtgctccagaaag

SEQ ID NO: 9378933 - DNA, 22 bp, Homo sapiens
ccaggcagagggatccccatcc

SEQ ID NO: 9378934 - DNA, 22 bp, Homo sapiens
ccaggcagatgggccggcttca

SEQ ID NO: 9378935 - DNA, 22 bp, Homo sapiens
ccaggcagagtgctccagaaag

SEQ ID NO: 9378936 - DNA, 22 bp, Homo sapiens
ccaggcagagggatccccatcc

SEQ ID NO: 9378937 - DNA, 22 bp, Homo sapiens
ccaggcagagggatccccatcc

SEQ ID NO: 9378938 - DNA, 22 bp, Homo sapiens
ccaggcagagggaatagcaagt

SEQ ID NO: 9378939 - DNA, 21 bp, Homo sapiens
ccaggcagagctgtgagttct

SEQ ID NO: 9378940 - DNA, 22 bp, Homo sapiens
ccaggcagagggaatagcaagt

SEQ ID NO: 9378941 - DNA, 22 bp, Homo sapiens
ccaggcagagggaatagcaagt

SEQ ID NO: 9378942 - DNA, 22 bp, Homo sapiens
ccaggcagcaaattttctgaat

SEQ ID NO: 9378943 - DNA, 22 bp, Homo sapiens
ccaggcagatgggccggcttca

SEQ ID NO: 9378944 - DNA, 22 bp, Homo sapiens
tcttacaagaaataagccaatg

SEQ ID NO: 9378945 - DNA, 22 bp, Homo sapiens
tcttaattgagaacagtgtagg

SEQ ID NO: 9378946 - DNA, 22 bp, Homo sapiens
tcttacagaaaatagataacat

SEQ ID NO: 9378947 - DNA, 20 bp, Homo sapiens
tcttacaatcgttacatcca

SEQ ID NO: 9378948 - DNA, 20 bp, Homo sapiens
tcttacaatcgttacatcca

SEQ ID NO: 9378949 - DNA, 22 bp, Homo sapiens
tggtgggagtccgctgtgctgc

SEQ ID NO: 9378950 - DNA, 22 bp, Homo sapiens
tggtgggagtccgctgtgctgc

SEQ ID NO: 9378951 - DNA, 22 bp, Homo sapiens
cctgcctgattccaggatggct

SEQ ID NO: 9378952 - DNA, 19 bp, Homo sapiens
cctgcctgagctgtccctc

SEQ ID NO: 9378953 - DNA, 19 bp, Homo sapiens
cctgcctgagctgtccctc

SEQ ID NO: 9378954 - DNA, 19 bp, Homo sapiens
cctgcctgagctgtccctc

SEQ ID NO: 9378955 - DNA, 22 bp, Homo sapiens
cctgcctgaaggtcagccaccc

SEQ ID NO: 9378956 - DNA, 22 bp, Homo sapiens
cctgcctgaaggtcagccaccc

SEQ ID NO: 9378957 - DNA, 22 bp, Homo sapiens
cctgcctgaaggtcagccaccc

SEQ ID NO: 9378958 - DNA, 22 bp, Homo sapiens
cctgcccttctttccccagcat

SEQ ID NO: 9378959 - DNA, 22 bp, Homo sapiens
cctgcctcaggactctgcatat

SEQ ID NO: 9378960 - DNA, 22 bp, Homo sapiens
cctgcctcaggactctgcatat

SEQ ID NO: 9378961 - DNA, 22 bp, Homo sapiens
cctgcctatgagacgttttgcc

SEQ ID NO: 9378962 - DNA, 17 bp, Homo sapiens
tggtacaggctgaggga

SEQ ID NO: 9378963 - DNA, 22 bp, Homo sapiens
tggtacacatgtccaaggtcag

SEQ ID NO: 9378964 - DNA, 17 bp, Homo sapiens
tggtagaatgacaggcc

SEQ ID NO: 9378965 - DNA, 22 bp, Homo sapiens
tggtactgagaatagcgtctac

SEQ ID NO: 9378966 - DNA, 22 bp, Homo sapiens
tggtactgtcatccattttaaa

SEQ ID NO: 9378967 - DNA, 22 bp, Homo sapiens
tggtacatgggtaggtatctct

SEQ ID NO: 9378968 - DNA, 22 bp, Homo sapiens
tggtacataaatggatgttttc

SEQ ID NO: 9378969 - DNA, 22 bp, Homo sapiens
cctgccctgtcactggctaggg

SEQ ID NO: 9378970 - DNA, 22 bp, Homo sapiens
cctgcccagcttcacctcaggc

SEQ ID NO: 9378971 - DNA, 22 bp, Homo sapiens
cctgccctgtcactggctaggg

SEQ ID NO: 9378972 - DNA, 22 bp, Homo sapiens
tggtacacatgtccaaggtcag

SEQ ID NO: 9378973 - DNA, 22 bp, Homo sapiens
tgggtggcacttctggggtcca

SEQ ID NO: 9378974 - DNA, 22 bp, Homo sapiens
tgggtggcacttctggggtcca

SEQ ID NO: 9378975 - DNA, 22 bp, Homo sapiens
tgggtggcaaaggcccattgtc

SEQ ID NO: 9378976 - DNA, 22 bp, Homo sapiens
tgggtggcaaaggcccattgtc

SEQ ID NO: 9378977 - DNA, 22 bp, Homo sapiens
tgggtggattaggatagggtat

SEQ ID NO: 9378978 - DNA, 18 bp, Homo sapiens
tgggtggctagggagttt

SEQ ID NO: 9378979 - DNA, 22 bp, Homo sapiens
tgggtggcggcctggttctgag

SEQ ID NO: 9378980 - DNA, 22 bp, Homo sapiens
tgggtggcggcctggttctgag

SEQ ID NO: 9378981 - DNA, 18 bp, Homo sapiens
tgggtggctagggagttt

SEQ ID NO: 9378982 - DNA, 18 bp, Homo sapiens
tgggtggctagggagttt

SEQ ID NO: 9378983 - DNA, 18 bp, Homo sapiens
tgggtggctagggagttt

SEQ ID NO: 9378984 - DNA, 22 bp, Homo sapiens
tgggtggcggcctggttctgag

SEQ ID NO: 9378985 - DNA, 22 bp, Homo sapiens
tgggtggcggcctggttctgag

SEQ ID NO: 9378986 - DNA, 22 bp, Homo sapiens
tgggtggcacttctggggtcca

SEQ ID NO: 9378987 - DNA, 22 bp, Homo sapiens
tgggtggcacttctggggtcca

SEQ ID NO: 9378988 - DNA, 22 bp, Homo sapiens
tgggtggcagcttcagcatgtt

SEQ ID NO: 9378989 - DNA, 22 bp, Homo sapiens
tgggtggcagcttcagcatgtt

SEQ ID NO: 9378990 - DNA, 22 bp, Homo sapiens
tgggtggcagcttcagcatgtt

SEQ ID NO: 9378991 - DNA, 22 bp, Homo sapiens
cctgcaggtaaggctaactgcc

SEQ ID NO: 9378992 - DNA, 22 bp, Homo sapiens
cctgcaggtccccggatgcgca

SEQ ID NO: 9378993 - DNA, 22 bp, Homo sapiens
cctgcaggtccccggatgcgca

SEQ ID NO: 9378994 - DNA, 22 bp, Homo sapiens
cctgcagggtgctgccacagat

SEQ ID NO: 9378995 - DNA, 22 bp, Homo sapiens
cctgcagggtgctgccacagat

SEQ ID NO: 9378996 - DNA, 22 bp, Homo sapiens
cctgcagggtgctgccacagat

SEQ ID NO: 9378997 - DNA, 22 bp, Homo sapiens
cctgcaggggagagacttctag

SEQ ID NO: 9378998 - DNA, 22 bp, Homo sapiens
cctgcaggggagagacttctag

SEQ ID NO: 9378999 - DNA, 19 bp, Homo sapiens
cctgcagggatgagaggtt

SEQ ID NO: 9379000 - DNA, 22 bp, Homo sapiens
cctgcaggtttcccccggacgg

SEQ ID NO: 9379001 - DNA, 17 bp, Homo sapiens
cctgcagtgcctgtcgg

SEQ ID NO: 9379002 - DNA, 22 bp, Homo sapiens
cctgcaggttgcagaggcggaa

SEQ ID NO: 9379003 - DNA, 22 bp, Homo sapiens
cctgcatgtggtcagcactcct

SEQ ID NO: 9379004 - DNA, 22 bp, Homo sapiens
tgggtcagtttgggggccagcc

SEQ ID NO: 9379005 - DNA, 22 bp, Homo sapiens
tgggtcagtttgggggccagcc

SEQ ID NO: 9379006 - DNA, 22 bp, Homo sapiens
tgggtccacaaacatcagatat

SEQ ID NO: 9379007 - DNA, 22 bp, Homo sapiens
cctgccacttcttgctatggag

SEQ ID NO: 9379008 - DNA, 22 bp, Homo sapiens
cctgccacttcttgctatggag

SEQ ID NO: 9379009 - DNA, 22 bp, Homo sapiens
cctgcagggaatcgaggcagaa

SEQ ID NO: 9379010 - DNA, 22 bp, Homo sapiens
cctgcagggaatcgaggcagaa

SEQ ID NO: 9379011 - DNA, 22 bp, Homo sapiens
cctgcaggctgcaggccagttc

SEQ ID NO: 9379012 - DNA, 22 bp, Homo sapiens
cctgcagggaatcgaggcagaa

SEQ ID NO: 9379013 - DNA, 22 bp, Homo sapiens
cctgcaggctgcaggccagttc

SEQ ID NO: 9379014 - DNA, 22 bp, Homo sapiens
cctgcaggctgcaggccagttc

SEQ ID NO: 9379015 - DNA, 23 bp, Homo sapiens
cctgcagctgctggggctccacc

SEQ ID NO: 9379016 - DNA, 22 bp, Homo sapiens
tggggagagattgaggagtttt

SEQ ID NO: 9379017 - DNA, 22 bp, Homo sapiens
tggggagagattgaggagtttt

SEQ ID NO: 9379018 - DNA, 22 bp, Homo sapiens
tggggagagattgaggagtttt

SEQ ID NO: 9379019 - DNA, 22 bp, Homo sapiens
tggggagaggtatcattgagat

SEQ ID NO: 9379020 - DNA, 22 bp, Homo sapiens
tggggagagttacaaggaatct

SEQ ID NO: 9379021 - DNA, 22 bp, Homo sapiens
cctgatggagccctgctgcatg

SEQ ID NO: 9379022 - DNA, 22 bp, Homo sapiens
cctgataatattgacctacaga

SEQ ID NO: 9379023 - DNA, 22 bp, Homo sapiens
cctgataatgtaattgttaaat

SEQ ID NO: 9379024 - DNA, 22 bp, Homo sapiens
cctgagttagttgctgtgtctc

SEQ ID NO: 9379025 - DNA, 22 bp, Homo sapiens
cctgataaaccctggaatttgt

SEQ ID NO: 9379026 - DNA, 22 bp, Homo sapiens
cctgataacacagatacaagat

SEQ ID NO: 9379027 - DNA, 22 bp, Homo sapiens
cctgatggagccctgctgcatg

SEQ ID NO: 9379028 - DNA, 19 bp, Homo sapiens
cctgatggagctggtgcaa

SEQ ID NO: 9379029 - DNA, 22 bp, Homo sapiens
tggggagactggccgagatcct

SEQ ID NO: 9379030 - DNA, 22 bp, Homo sapiens
tggggagagaccggaatgtttc

SEQ ID NO: 9379031 - DNA, 22 bp, Homo sapiens
cctgagtggccaggcagctgtg

SEQ ID NO: 9379032 - DNA, 22 bp, Homo sapiens
cctgagtggcagggtttgggct

SEQ ID NO: 9379033 - DNA, 22 bp, Homo sapiens
cctgagtgcttccagagtcatg

SEQ ID NO: 9379034 - DNA, 22 bp, Homo sapiens
cctgagtgccatgagagcaccc

SEQ ID NO: 9379035 - DNA, 22 bp, Homo sapiens
cctgaggtctagagtcagggtg

SEQ ID NO: 9379036 - DNA, 22 bp, Homo sapiens
tgggcctggacatctgtatttt

SEQ ID NO: 9379037 - DNA, 23 bp, Homo sapiens
tgggcccttggaatctctatttt

SEQ ID NO: 9379038 - DNA, 21 bp, Homo sapiens
tgggcctcaagtgggtggcag

SEQ ID NO: 9379039 - DNA, 22 bp, Homo sapiens
tgggcctggagccctggagagt

SEQ ID NO: 9379040 - DNA, 22 bp, Homo sapiens
tgggcctggagccctggagagt

SEQ ID NO: 9379041 - DNA, 22 bp, Homo sapiens
tgggcctggagccctggagagt

SEQ ID NO: 9379042 - DNA, 22 bp, Homo sapiens
tgggcaggcaagtgaatacctt

SEQ ID NO: 9379043 - DNA, 22 bp, Homo sapiens
tgggcaggcaagtgaatacctt

SEQ ID NO: 9379044 - DNA, 22 bp, Homo sapiens
tgggcaggcaagtgaatacctt

SEQ ID NO: 9379045 - DNA, 22 bp, Homo sapiens
tgggcaggatgcgttgattctt

SEQ ID NO: 9379046 - DNA, 22 bp, Homo sapiens
tgggcaggataatatctcatgt

SEQ ID NO: 9379047 - DNA, 22 bp, Homo sapiens
tgggcaggatgcgttgattctt

SEQ ID NO: 9379048 - DNA, 22 bp, Homo sapiens
tgggcaggatgcgttgattctt

SEQ ID NO: 9379049 - DNA, 22 bp, Homo sapiens
tgggcaggataatatctcatgt

SEQ ID NO: 9379050 - DNA, 23 bp, Homo sapiens
tgggcctggcctcccagtccagc

SEQ ID NO: 9379051 - DNA, 22 bp, Homo sapiens
tgggcctgggagggcagacgct

SEQ ID NO: 9379052 - DNA, 22 bp, Homo sapiens
tgggcctgggagggcagacgct

SEQ ID NO: 9379053 - DNA, 22 bp, Homo sapiens
tgggctcatggcccagcactgg

SEQ ID NO: 9379054 - DNA, 22 bp, Homo sapiens
tgggcctgggagggcagacgct

SEQ ID NO: 9379055 - DNA, 22 bp, Homo sapiens
tgggctcagtgggagaaagggc

SEQ ID NO: 9379056 - DNA, 22 bp, Homo sapiens
tgggcctggccctgtggaggag

SEQ ID NO: 9379057 - DNA, 22 bp, Homo sapiens
tgggcctggccctgtggaggag

SEQ ID NO: 9379058 - DNA, 22 bp, Homo sapiens
tgggctccggcggcctcaggct

SEQ ID NO: 9379059 - DNA, 19 bp, Homo sapiens
tgggctcattcaggtggtt

SEQ ID NO: 9379060 - DNA, 22 bp, Homo sapiens
tgggctcatgtttctttgagga

SEQ ID NO: 9379061 - DNA, 22 bp, Homo sapiens
cctctcccacgtggcagaggct

SEQ ID NO: 9379062 - DNA, 22 bp, Homo sapiens
cctctcccagggagagcctgag

SEQ ID NO: 9379063 - DNA, 22 bp, Homo sapiens
cctctccagcggcctcagggcc

SEQ ID NO: 9379064 - DNA, 22 bp, Homo sapiens
cctctccagcggcctcagggcc

SEQ ID NO: 9379065 - DNA, 22 bp, Homo sapiens
tggctttagggttccttctacc

SEQ ID NO: 9379066 - DNA, 22 bp, Homo sapiens
cctctccagcggcctcagggcc

SEQ ID NO: 9379067 - DNA, 22 bp, Homo sapiens
tggctttaggagctatatacct

SEQ ID NO: 9379068 - DNA, 22 bp, Homo sapiens
tggctttactgtcattcttatg

SEQ ID NO: 9379069 - DNA, 22 bp, Homo sapiens
tggctttacatcaaattgagta

SEQ ID NO: 9379070 - DNA, 19 bp, Homo sapiens
cctctcccatgcttacctc

SEQ ID NO: 9379071 - DNA, 22 bp, Homo sapiens
cctctcccctcccaaggcggga

SEQ ID NO: 9379072 - DNA, 22 bp, Homo sapiens
tgggacacctcagatagtgtct

SEQ ID NO: 9379073 - DNA, 22 bp, Homo sapiens
tgggacagagtgagctttggcc

SEQ ID NO: 9379074 - DNA, 22 bp, Homo sapiens
tgggaaggcagtcactgtccta

SEQ ID NO: 9379075 - DNA, 22 bp, Homo sapiens
tgggaaggcagtcactgtccta

SEQ ID NO: 9379076 - DNA, 20 bp, Homo sapiens
tggctttaagttttttgcta

SEQ ID NO: 9379077 - DNA, 22 bp, Homo sapiens
tggctttaagaagactgacagc

SEQ ID NO: 9379078 - DNA, 22 bp, Homo sapiens
tggctttaagaagactgacagc

SEQ ID NO: 9379079 - DNA, 22 bp, Homo sapiens
tggctttaaaatggtttggtat

SEQ ID NO: 9379080 - DNA, 22 bp, Homo sapiens
tggctttaaatctgtattcata

SEQ ID NO: 9379081 - DNA, 22 bp, Homo sapiens
tggcttgtcatgtatctgaggc

SEQ ID NO: 9379082 - DNA, 22 bp, Homo sapiens
tggcttgggagattctcgaact

SEQ ID NO: 9379083 - DNA, 22 bp, Homo sapiens
tggcttgggagattctcgaact

SEQ ID NO: 9379084 - DNA, 22 bp, Homo sapiens
tggcttctttgtagaaattgaa

SEQ ID NO: 9379085 - DNA, 22 bp, Homo sapiens
tggcttgctactgaggtgtcag

SEQ ID NO: 9379086 - DNA, 22 bp, Homo sapiens
tggcttgcttccccattctcat

SEQ ID NO: 9379087 - DNA, 16 bp, Homo sapiens
tggcttcccagagata

SEQ ID NO: 9379088 - DNA, 22 bp, Homo sapiens
tggcttcccatagcttgctagt

SEQ ID NO: 9379089 - DNA, 22 bp, Homo sapiens
cctcctggtccagcatctcttt

SEQ ID NO: 9379090 - DNA, 22 bp, Homo sapiens
tggcttctttccactgtcctgt

SEQ ID NO: 9379091 - DNA, 22 bp, Homo sapiens
tggcttcccctaccttccaatt

SEQ ID NO: 9379092 - DNA, 20 bp, Homo sapiens
cctcctggtcaggtgtgcag

SEQ ID NO: 9379093 - DNA, 20 bp, Homo sapiens
cctcctggtcaggtgtgcag

SEQ ID NO: 9379094 - DNA, 22 bp, Homo sapiens
cctcctggtaattagcgaaagg

SEQ ID NO: 9379095 - DNA, 20 bp, Homo sapiens
cctcctggtcaggtgtgcag

SEQ ID NO: 9379096 - DNA, 22 bp, Homo sapiens
cctcctggtaattagcgaaagg

SEQ ID NO: 9379097 - DNA, 22 bp, Homo sapiens
cctcctgggttcaagcgattct

SEQ ID NO: 9379098 - DNA, 22 bp, Homo sapiens
cctcctggggtgaaggatggga

SEQ ID NO: 9379099 - DNA, 22 bp, Homo sapiens
cctcctggggtgaaggatggga

SEQ ID NO: 9379100 - DNA, 22 bp, Homo sapiens
cctcctgggttcaagcgattct

SEQ ID NO: 9379101 - DNA, 22 bp, Homo sapiens
tgggagagaattctggtgactg

SEQ ID NO: 9379102 - DNA, 22 bp, Homo sapiens
tgggagagaataatcaataggt

SEQ ID NO: 9379103 - DNA, 22 bp, Homo sapiens
tgggagagaattctggtgactg

SEQ ID NO: 9379104 - DNA, 22 bp, Homo sapiens
tgggagagaattctggtgactg

SEQ ID NO: 9379105 - DNA, 22 bp, Homo sapiens
tgggagagaattctggtgactg

SEQ ID NO: 9379106 - DNA, 22 bp, Homo sapiens
tgggacagggaatctgatcccc

SEQ ID NO: 9379107 - DNA, 22 bp, Homo sapiens
tgggagagaataatcaataggt

SEQ ID NO: 9379108 - DNA, 22 bp, Homo sapiens
tgggagagaataatcaataggt

SEQ ID NO: 9379109 - DNA, 22 bp, Homo sapiens
tgggacagggaatctgatcccc

SEQ ID NO: 9379110 - DNA, 22 bp, Homo sapiens
tgggagagaattctggtgactg

SEQ ID NO: 9379111 - DNA, 22 bp, Homo sapiens
tgggagagagaattcccagtgg

SEQ ID NO: 9379112 - DNA, 22 bp, Homo sapiens
tgggagagagaattcccagtgg

SEQ ID NO: 9379113 - DNA, 22 bp, Homo sapiens
tgggagagagaattcccagtgg

SEQ ID NO: 9379114 - DNA, 22 bp, Homo sapiens
tgggagagagaattcccagtgg

SEQ ID NO: 9379115 - DNA, 22 bp, Homo sapiens
tgggagagagaattcccagtgg

SEQ ID NO: 9379116 - DNA, 22 bp, Homo sapiens
tgggagagataggcttctggac

SEQ ID NO: 9379117 - DNA, 22 bp, Homo sapiens
tgggagagataggcttctggac

SEQ ID NO: 9379118 - DNA, 22 bp, Homo sapiens
tgggagagataggcttctggac

SEQ ID NO: 9379119 - DNA, 22 bp, Homo sapiens
tgggagagcactgcagccccgg

SEQ ID NO: 9379120 - DNA, 22 bp, Homo sapiens
tgggagagcactgcagccccgg

SEQ ID NO: 9379121 - DNA, 22 bp, Homo sapiens
tgggacaggaggcctctggaga

SEQ ID NO: 9379122 - DNA, 22 bp, Homo sapiens
tgggacaggaggcctctggaga

SEQ ID NO: 9379123 - DNA, 22 bp, Homo sapiens
tgggacaggaggcctctggaga

SEQ ID NO: 9379124 - DNA, 22 bp, Homo sapiens
tgggacaggaggcctctggaga

SEQ ID NO: 9379125 - DNA, 22 bp, Homo sapiens
tgggacaggatgaccagaaggt

SEQ ID NO: 9379126 - DNA, 22 bp, Homo sapiens
tgggacaggatgaccagaaggt

SEQ ID NO: 9379127 - DNA, 22 bp, Homo sapiens
tgggacaggatgaccagaaggt

SEQ ID NO: 9379128 - DNA, 22 bp, Homo sapiens
tgggacagagtgagctttggcc

SEQ ID NO: 9379129 - DNA, 22 bp, Homo sapiens
tgggacagagtgagctttggcc

SEQ ID NO: 9379130 - DNA, 22 bp, Homo sapiens
tgggacagagtgagctttggcc

SEQ ID NO: 9379131 - DNA, 22 bp, Homo sapiens
tgggacagattataagtctgca

SEQ ID NO: 9379132 - DNA, 22 bp, Homo sapiens
tgggacaggaggcctctggaga

SEQ ID NO: 9379133 - DNA, 22 bp, Homo sapiens
tgggacagattataagtctgca

SEQ ID NO: 9379134 - DNA, 22 bp, Homo sapiens
tgggcactgtagctggtgctgg

SEQ ID NO: 9379135 - DNA, 21 bp, Homo sapiens
tgggcactgagggtgctgctc

SEQ ID NO: 9379136 - DNA, 22 bp, Homo sapiens
tgggcactggaagcctgctgtg

SEQ ID NO: 9379137 - DNA, 22 bp, Homo sapiens
tgggcactgaagctttgagcag

SEQ ID NO: 9379138 - DNA, 22 bp, Homo sapiens
tgggcactcctggggacagctg

SEQ ID NO: 9379139 - DNA, 21 bp, Homo sapiens
tgggagagcgttgctgtcctc

SEQ ID NO: 9379140 - DNA, 21 bp, Homo sapiens
tgggagagcgttgctgtcctc

SEQ ID NO: 9379141 - DNA, 22 bp, Homo sapiens
tgggagagcactgcagccccgg

SEQ ID NO: 9379142 - DNA, 22 bp, Homo sapiens
tgggagagcagagaaccctctt

SEQ ID NO: 9379143 - DNA, 22 bp, Homo sapiens
tgggagagcagagaaccctctt

SEQ ID NO: 9379144 - DNA, 22 bp, Homo sapiens
tgggcagaaatcagtatcagat

SEQ ID NO: 9379145 - DNA, 22 bp, Homo sapiens
tgggcagaaggaagagccacct

SEQ ID NO: 9379146 - DNA, 22 bp, Homo sapiens
tgggcagaaggaagagccacct

SEQ ID NO: 9379147 - DNA, 22 bp, Homo sapiens
tgggcagaaggaagagccacct

SEQ ID NO: 9379148 - DNA, 22 bp, Homo sapiens
tgggcagaattgtggtagttaa

SEQ ID NO: 9379149 - DNA, 22 bp, Homo sapiens
tgggcaggagagaagctaaaga

SEQ ID NO: 9379150 - DNA, 22 bp, Homo sapiens
cctccagggcccctctcactgg

SEQ ID NO: 9379151 - DNA, 22 bp, Homo sapiens
cctccagggcccctctcactgg

SEQ ID NO: 9379152 - DNA, 21 bp, Homo sapiens
cctccaggtgattccgtgctc

SEQ ID NO: 9379153 - DNA, 21 bp, Homo sapiens
cctccaggtgattccgtgctc

SEQ ID NO: 9379154 - DNA, 21 bp, Homo sapiens
tggccaaggaatagaagctct

SEQ ID NO: 9379155 - DNA, 20 bp, Homo sapiens
tggccaagtatccaactgga

SEQ ID NO: 9379156 - DNA, 21 bp, Homo sapiens
tggccaaggaatagaagctct

SEQ ID NO: 9379157 - DNA, 22 bp, Homo sapiens
tggccacaaagagaacgaggtc

SEQ ID NO: 9379158 - DNA, 22 bp, Homo sapiens
cctccagctgcctcagtctctt

SEQ ID NO: 9379159 - DNA, 22 bp, Homo sapiens
tggccaagccactgctgggtct

SEQ ID NO: 9379160 - DNA, 22 bp, Homo sapiens
tggccaagccactgctgggtct

SEQ ID NO: 9379161 - DNA, 21 bp, Homo sapiens
tggcatttgtacagggacttt

SEQ ID NO: 9379162 - DNA, 22 bp, Homo sapiens
tggcattttagacatgatggtg

SEQ ID NO: 9379163 - DNA, 22 bp, Homo sapiens
tggcatttgtagccacttgcct

SEQ ID NO: 9379164 - DNA, 22 bp, Homo sapiens
tggcatttgtagccacttgcct

SEQ ID NO: 9379165 - DNA, 22 bp, Homo sapiens
tggcattttgtagctgtgtatc

SEQ ID NO: 9379166 - DNA, 22 bp, Homo sapiens
tggcattttccaatgatatgtt

SEQ ID NO: 9379167 - DNA, 19 bp, Homo sapiens
tggcaggtagtgagcagtc

SEQ ID NO: 9379168 - DNA, 19 bp, Homo sapiens
tggcaggtagtgagcagtc

SEQ ID NO: 9379169 - DNA, 19 bp, Homo sapiens
tggcaggtagtgagcagtc

SEQ ID NO: 9379170 - DNA, 22 bp, Homo sapiens
tggcagtgggaagctggaagtc

SEQ ID NO: 9379171 - DNA, 22 bp, Homo sapiens
tggcagtgggaagctggaagtc

SEQ ID NO: 9379172 - DNA, 22 bp, Homo sapiens
tggcagtgggaagctggaagtc

SEQ ID NO: 9379173 - DNA, 22 bp, Homo sapiens
tggcagtgggaagctggaagtc

SEQ ID NO: 9379174 - DNA, 22 bp, Homo sapiens
tggcagtgggaagctggaagtc

SEQ ID NO: 9379175 - DNA, 22 bp, Homo sapiens
tggcagtgggaagctggaagtc

SEQ ID NO: 9379176 - DNA, 22 bp, Homo sapiens
tggcagtgggaagctggaagtc

SEQ ID NO: 9379177 - DNA, 22 bp, Homo sapiens
tggcagtgggaagctggaagtc

SEQ ID NO: 9379178 - DNA, 22 bp, Homo sapiens
tggcagtgggaagctggaagtc

SEQ ID NO: 9379179 - DNA, 22 bp, Homo sapiens
tggcagtgtcttatcaggagtg

SEQ ID NO: 9379180 - DNA, 22 bp, Homo sapiens
tggcagtgtcttatcaggagtg

SEQ ID NO: 9379181 - DNA, 22 bp, Homo sapiens
tggcagtgtcttgctggggcag

SEQ ID NO: 9379182 - DNA, 22 bp, Homo sapiens
tggcagtgtcttgctggggcag

SEQ ID NO: 9379183 - DNA, 22 bp, Homo sapiens
tggcagtgtcttatcaggagtg

SEQ ID NO: 9379184 - DNA, 22 bp, Homo sapiens
tggcagtgtcttatcaggagtg

SEQ ID NO: 9379185 - DNA, 22 bp, Homo sapiens
tggcagtgtgggaggaaggtac

SEQ ID NO: 9379186 - DNA, 22 bp, Homo sapiens
tggcagtgtgggaggaaggtac

SEQ ID NO: 9379187 - DNA, 22 bp, Homo sapiens
tggcagtgtgggaggaaggtac

SEQ ID NO: 9379188 - DNA, 22 bp, Homo sapiens
tggcatttctgttagactctca

SEQ ID NO: 9379189 - DNA, 19 bp, Homo sapiens
tggcatttggaggcaacct

SEQ ID NO: 9379190 - DNA, 22 bp, Homo sapiens
tggcatttgctcccttgtgttc

SEQ ID NO: 9379191 - DNA, 22 bp, Homo sapiens
cctccaggtgttacatatgact

SEQ ID NO: 9379192 - DNA, 22 bp, Homo sapiens
cctccagtactccagtccagcg

SEQ ID NO: 9379193 - DNA, 22 bp, Homo sapiens
cctccagtactccagtccagcg

SEQ ID NO: 9379194 - DNA, 22 bp, Homo sapiens
cctccatcaccatctgccctca

SEQ ID NO: 9379195 - DNA, 22 bp, Homo sapiens
cctccatcaccatctgccctca

SEQ ID NO: 9379196 - DNA, 22 bp, Homo sapiens
cctccagtcacctggatgagaa

SEQ ID NO: 9379197 - DNA, 22 bp, Homo sapiens
cctccatctccagcttctgcct

SEQ ID NO: 9379198 - DNA, 22 bp, Homo sapiens
cctccatcaccatctgccctca

SEQ ID NO: 9379199 - DNA, 17 bp, Homo sapiens
cctcccacaccgccctg

SEQ ID NO: 9379200 - DNA, 23 bp, Homo sapiens
cctccatggtaagaagcttagag

SEQ ID NO: 9379201 - DNA, 23 bp, Homo sapiens
cctccatggtaagaagcttagag

SEQ ID NO: 9379202 - DNA, 22 bp, Homo sapiens
cctccatgtaaaggtcccctca

SEQ ID NO: 9379203 - DNA, 22 bp, Homo sapiens
cctccatgtaaaggtcccctca

SEQ ID NO: 9379204 - DNA, 22 bp, Homo sapiens
cctcccacttcttgctgaggtc

SEQ ID NO: 9379205 - DNA, 22 bp, Homo sapiens
cctcctctggtgctgccaaccc

SEQ ID NO: 9379206 - DNA, 23 bp, Homo sapiens
cctcccacctatttcactttctt

SEQ ID NO: 9379207 - DNA, 22 bp, Homo sapiens
cctcccaccatttagagagagc

SEQ ID NO: 9379208 - DNA, 22 bp, Homo sapiens
cctcccaccatttagagagagc

SEQ ID NO: 9379209 - DNA, 22 bp, Homo sapiens
cctcccacattgaggacatgct

SEQ ID NO: 9379210 - DNA, 23 bp, Homo sapiens
cctcctgggcacaggcctgatgg

SEQ ID NO: 9379211 - DNA, 23 bp, Homo sapiens
cctcctgggcacaggcctgatgg

SEQ ID NO: 9379212 - DNA, 23 bp, Homo sapiens
cctcctgggcacaggcctgatgg

SEQ ID NO: 9379213 - DNA, 22 bp, Homo sapiens
cctcctgggagagcacggaggg

SEQ ID NO: 9379214 - DNA, 22 bp, Homo sapiens
cctcctgggagagcacggaggg

SEQ ID NO: 9379215 - DNA, 22 bp, Homo sapiens
cctcctgggactcattagcacc

SEQ ID NO: 9379216 - DNA, 22 bp, Homo sapiens
cctcctgggagagcacggaggg

SEQ ID NO: 9379217 - DNA, 22 bp, Homo sapiens
cctcctgggctcctgtctgcac

SEQ ID NO: 9379218 - DNA, 22 bp, Homo sapiens
cctcctggggtgaaggatggga

SEQ ID NO: 9379219 - DNA, 22 bp, Homo sapiens
cctcctgggctcctgtctgcac

SEQ ID NO: 9379220 - DNA, 22 bp, Homo sapiens
cctcctgggccttgctctgtga

SEQ ID NO: 9379221 - DNA, 22 bp, Homo sapiens
cctcctgggccttgctctgtga

SEQ ID NO: 9379222 - DNA, 22 bp, Homo sapiens
cctcctgggccttgctctgtga

SEQ ID NO: 9379223 - DNA, 22 bp, Homo sapiens
cctcctgggccttgctctgtga

SEQ ID NO: 9379224 - DNA, 22 bp, Homo sapiens
cctcctctggtgctgccaaccc

SEQ ID NO: 9379225 - DNA, 22 bp, Homo sapiens
cctcctggcctgtgcagagccc

SEQ ID NO: 9379226 - DNA, 22 bp, Homo sapiens
cctcctggcctgtgcagagccc

SEQ ID NO: 9379227 - DNA, 22 bp, Homo sapiens
cctcctggcctgtgcagagccc

SEQ ID NO: 9379228 - DNA, 22 bp, Homo sapiens
cctcctggccctgggcctggaa

SEQ ID NO: 9379229 - DNA, 22 bp, Homo sapiens
cctcctgggacaggctggcaca

SEQ ID NO: 9379230 - DNA, 22 bp, Homo sapiens
cctcctgggacaggctggcaca

SEQ ID NO: 9379231 - DNA, 22 bp, Homo sapiens
cctcctgggactcattagcacc

SEQ ID NO: 9379232 - DNA, 22 bp, Homo sapiens
cctcctggcttttcccattgaa

SEQ ID NO: 9379233 - DNA, 22 bp, Homo sapiens
cctcctgggacaggctggcaca

SEQ ID NO: 9379234 - DNA, 22 bp, Homo sapiens
cctcctggcttttcccattgaa

SEQ ID NO: 9379235 - DNA, 22 bp, Homo sapiens
cctcctggcctgtgcagagccc

SEQ ID NO: 9379236 - DNA, 22 bp, Homo sapiens
cctcctggcttttcccattgaa

SEQ ID NO: 9379237 - DNA, 22 bp, Homo sapiens
cccagtggggaaatagctagct

SEQ ID NO: 9379238 - DNA, 22 bp, Homo sapiens
cccagtggggaaatagctagct

SEQ ID NO: 9379239 - DNA, 22 bp, Homo sapiens
cccagtggggagctgaggttca

SEQ ID NO: 9379240 - DNA, 22 bp, Homo sapiens
cccagtggggagcttctgcctt

SEQ ID NO: 9379241 - DNA, 22 bp, Homo sapiens
cccagtgggtcactgcatctca

SEQ ID NO: 9379242 - DNA, 22 bp, Homo sapiens
cccagtgggtcactgcatctca

SEQ ID NO: 9379243 - DNA, 22 bp, Homo sapiens
cccagtggtttgcagaaccaag

SEQ ID NO: 9379244 - DNA, 22 bp, Homo sapiens
cccagtggtttgcagaaccaag

SEQ ID NO: 9379245 - DNA, 22 bp, Homo sapiens
cccagtggtgctggcatctgtg

SEQ ID NO: 9379246 - DNA, 22 bp, Homo sapiens
cccagtggtgctggcatctgtg

SEQ ID NO: 9379247 - DNA, 22 bp, Homo sapiens
cccagtggtgctggcatctgtg

SEQ ID NO: 9379248 - DNA, 22 bp, Homo sapiens
cccagtggcttttgcccaggtt

SEQ ID NO: 9379249 - DNA, 22 bp, Homo sapiens
cccagtggcttttgcccaggtt

SEQ ID NO: 9379250 - DNA, 22 bp, Homo sapiens
tgctgggcaccagtgcctgcag

SEQ ID NO: 9379251 - DNA, 22 bp, Homo sapiens
cccagttgttgccggctctgga

SEQ ID NO: 9379252 - DNA, 22 bp, Homo sapiens
cccagtgtctcttgtgcctttc

SEQ ID NO: 9379253 - DNA, 22 bp, Homo sapiens
cccagtgtctgggcctgcaggg

SEQ ID NO: 9379254 - DNA, 22 bp, Homo sapiens
tgctgggggctttctggatacc

SEQ ID NO: 9379255 - DNA, 22 bp, Homo sapiens
tgctgggggctttctggatacc

SEQ ID NO: 9379256 - DNA, 22 bp, Homo sapiens
tgctggggctctgaccactcca

SEQ ID NO: 9379257 - DNA, 22 bp, Homo sapiens
tgctggggctctgaccactcca

SEQ ID NO: 9379258 - DNA, 22 bp, Homo sapiens
tgctggggctctgaccactcca

SEQ ID NO: 9379259 - DNA, 22 bp, Homo sapiens
tgctggggctctgaccactcca

SEQ ID NO: 9379260 - DNA, 22 bp, Homo sapiens
tgctgggggctttctggatacc

SEQ ID NO: 9379261 - DNA, 22 bp, Homo sapiens
tgctgggggctttctggatacc

SEQ ID NO: 9379262 - DNA, 22 bp, Homo sapiens
tgctgggggtagctctgcgtag

SEQ ID NO: 9379263 - DNA, 22 bp, Homo sapiens
tgctgggggtagctctgcgtag

SEQ ID NO: 9379264 - DNA, 22 bp, Homo sapiens
tgctgggggtgtctcaccaggc

SEQ ID NO: 9379265 - DNA, 22 bp, Homo sapiens
tgctgggggtgtctcaccaggc

SEQ ID NO: 9379266 - DNA, 22 bp, Homo sapiens
tgctgggggtgtctcaccaggc

SEQ ID NO: 9379267 - DNA, 22 bp, Homo sapiens
tgctgggggtgtctcaccaggc

SEQ ID NO: 9379268 - DNA, 18 bp, Homo sapiens
tgctggggtagaatccac

SEQ ID NO: 9379269 - DNA, 18 bp, Homo sapiens
tgctggggtagaatccac

SEQ ID NO: 9379270 - DNA, 22 bp, Homo sapiens
tgctgggggttcagatgagtaa

SEQ ID NO: 9379271 - DNA, 22 bp, Homo sapiens
tgctgggggttcagatgagtaa

SEQ ID NO: 9379272 - DNA, 23 bp, Homo sapiens
tgctggggtagtttgtggcacag

SEQ ID NO: 9379273 - DNA, 22 bp, Homo sapiens
ccccagctgcatacttgccaag

SEQ ID NO: 9379274 - DNA, 22 bp, Homo sapiens
ccccagctgcatacttgccaag

SEQ ID NO: 9379275 - DNA, 22 bp, Homo sapiens
tgcttgtcaccctgcctgagtg

SEQ ID NO: 9379276 - DNA, 22 bp, Homo sapiens
tgcttgtcacatacaggagcat

SEQ ID NO: 9379277 - DNA, 22 bp, Homo sapiens
tgcttgggcggccagcatggcg

SEQ ID NO: 9379278 - DNA, 22 bp, Homo sapiens
tgcttggctttctgagcttctg

SEQ ID NO: 9379279 - DNA, 22 bp, Homo sapiens
tgcttgggcggccagcatggcg

SEQ ID NO: 9379280 - DNA, 22 bp, Homo sapiens
tgcttggcctacttgtcctttg

SEQ ID NO: 9379281 - DNA, 22 bp, Homo sapiens
tgcttggctttctgagcttctg

SEQ ID NO: 9379282 - DNA, 22 bp, Homo sapiens
tgcttggctagcttggcagctc

SEQ ID NO: 9379283 - DNA, 22 bp, Homo sapiens
tgcttgctgggccaatggcaat

SEQ ID NO: 9379284 - DNA, 22 bp, Homo sapiens
tgcttccttgatcattcccaaa

SEQ ID NO: 9379285 - DNA, 22 bp, Homo sapiens
ccctccccagggtcatattgaa

SEQ ID NO: 9379286 - DNA, 22 bp, Homo sapiens
ccctccctatgtagatgatgtt

SEQ ID NO: 9379287 - DNA, 22 bp, Homo sapiens
ccctccctatgtagatgatgtt

SEQ ID NO: 9379288 - DNA, 22 bp, Homo sapiens
ccctccccacaaagcttcacac

SEQ ID NO: 9379289 - DNA, 22 bp, Homo sapiens
ccctccccacaaagcttcacac

SEQ ID NO: 9379290 - DNA, 22 bp, Homo sapiens
ccctccagtgtcccagtgggga

SEQ ID NO: 9379291 - DNA, 20 bp, Homo sapiens
tgcttgtcatgcactcaggc

SEQ ID NO: 9379292 - DNA, 22 bp, Homo sapiens
tgcttgtcaggataagctctgg

SEQ ID NO: 9379293 - DNA, 22 bp, Homo sapiens
tgcttcctgctaaggctgcctg

SEQ ID NO: 9379294 - DNA, 20 bp, Homo sapiens
tgcttcctggccactgcggg

SEQ ID NO: 9379295 - DNA, 22 bp, Homo sapiens
tgcttcctgctaaggctgcctg

SEQ ID NO: 9379296 - DNA, 19 bp, Homo sapiens
tgcttcctcaccatctccc

SEQ ID NO: 9379297 - DNA, 21 bp, Homo sapiens
tgcttccctgggccacactga

SEQ ID NO: 9379298 - DNA, 22 bp, Homo sapiens
ccccaggagatttgggagcaca

SEQ ID NO: 9379299 - DNA, 22 bp, Homo sapiens
ccccaggcagggcctaacagag

SEQ ID NO: 9379300 - DNA, 22 bp, Homo sapiens
tgcttccctgctctgcacacct

SEQ ID NO: 9379301 - DNA, 21 bp, Homo sapiens
tgcttccctgggccacactga

SEQ ID NO: 9379302 - DNA, 22 bp, Homo sapiens
tgcttaaaaacagtatggtagt

SEQ ID NO: 9379303 - DNA, 22 bp, Homo sapiens
tgcttccctgctctgcacacct

SEQ ID NO: 9379304 - DNA, 22 bp, Homo sapiens
tgctgcctttcaatgttgtcat

SEQ ID NO: 9379305 - DNA, 22 bp, Homo sapiens
tgctgcctttctgaatggtgga

SEQ ID NO: 9379306 - DNA, 22 bp, Homo sapiens
tgctgccttctaggcgtgccct

SEQ ID NO: 9379307 - DNA, 22 bp, Homo sapiens
tgctgcctgttgtggggccacg

SEQ ID NO: 9379308 - DNA, 22 bp, Homo sapiens
tgctgcctgtgccaggagggtc

SEQ ID NO: 9379309 - DNA, 22 bp, Homo sapiens
tgctgcctgtgccaggagggtc

SEQ ID NO: 9379310 - DNA, 22 bp, Homo sapiens
tgctgcctgctacgagggaaga

SEQ ID NO: 9379311 - DNA, 22 bp, Homo sapiens
tgctgcaggcagcccctctact

SEQ ID NO: 9379312 - DNA, 22 bp, Homo sapiens
tgctgcctctgctgatatggcc

SEQ ID NO: 9379313 - DNA, 22 bp, Homo sapiens
tgctctggacgctgagtggttt

SEQ ID NO: 9379314 - DNA, 22 bp, Homo sapiens
tgctctggaatagtcctaggca

SEQ ID NO: 9379315 - DNA, 22 bp, Homo sapiens
tgctctggaatagtcctaggca

SEQ ID NO: 9379316 - DNA, 20 bp, Homo sapiens
tgctctggaaatggtctgag

SEQ ID NO: 9379317 - DNA, 22 bp, Homo sapiens
tgctctgcacatccctcacaaa

SEQ ID NO: 9379318 - DNA, 22 bp, Homo sapiens
tgctctgcacatccctcacaaa

SEQ ID NO: 9379319 - DNA, 19 bp, Homo sapiens
tgctgcaggatgctgctgg

SEQ ID NO: 9379320 - DNA, 19 bp, Homo sapiens
tgctgcaggatgctgctgg

SEQ ID NO: 9379321 - DNA, 22 bp, Homo sapiens
tgctctggagggtgaagctttt

SEQ ID NO: 9379322 - DNA, 19 bp, Homo sapiens
tgctctggagccagctctc

SEQ ID NO: 9379323 - DNA, 22 bp, Homo sapiens
tgctctggacgctgagtggttt

SEQ ID NO: 9379324 - DNA, 19 bp, Homo sapiens
tgctctggagccagctctc

SEQ ID NO: 9379325 - DNA, 22 bp, Homo sapiens
cccagtggcccagcatgtggtg

SEQ ID NO: 9379326 - DNA, 22 bp, Homo sapiens
cccagtggcccagcatgtggtg

SEQ ID NO: 9379327 - DNA, 22 bp, Homo sapiens
cccagtggcccagcatgtggtg

SEQ ID NO: 9379328 - DNA, 22 bp, Homo sapiens
cccagtggagataggagtgtgg

SEQ ID NO: 9379329 - DNA, 22 bp, Homo sapiens
cccagtggcaaagcagcttaga

SEQ ID NO: 9379330 - DNA, 22 bp, Homo sapiens
cccagtggcaaagcagcttaga

SEQ ID NO: 9379331 - DNA, 22 bp, Homo sapiens
cccagtggaaggagtagaagac

SEQ ID NO: 9379332 - DNA, 22 bp, Homo sapiens
cccagtggagataggagtgtgg

SEQ ID NO: 9379333 - DNA, 22 bp, Homo sapiens
cccagtggaaggagtagaagac

SEQ ID NO: 9379334 - DNA, 18 bp, Homo sapiens
cccagtgctcactgcctc

SEQ ID NO: 9379335 - DNA, 22 bp, Homo sapiens
cccagtgctatgcctattacat

SEQ ID NO: 9379336 - DNA, 22 bp, Homo sapiens
tgctctgcacatccctcacaaa

SEQ ID NO: 9379337 - DNA, 22 bp, Homo sapiens
cccagtggctgtccccatgggc

SEQ ID NO: 9379338 - DNA, 19 bp, Homo sapiens
tgctctctggtgcttcatg

SEQ ID NO: 9379339 - DNA, 22 bp, Homo sapiens
tgctctgaaggggaagggatgg

SEQ ID NO: 9379340 - DNA, 22 bp, Homo sapiens
cccagtgccaggcacaggcagc

SEQ ID NO: 9379341 - DNA, 22 bp, Homo sapiens
cccagtgccaggcacaggcagc

SEQ ID NO: 9379342 - DNA, 22 bp, Homo sapiens
cccagtccagaccatgacctca

SEQ ID NO: 9379343 - DNA, 22 bp, Homo sapiens
tgctcaggtgccttggctgctg

SEQ ID NO: 9379344 - DNA, 22 bp, Homo sapiens
tgctcaggtcgttctgcccctt

SEQ ID NO: 9379345 - DNA, 22 bp, Homo sapiens
tgctcaggtcgttctgcccctt

SEQ ID NO: 9379346 - DNA, 22 bp, Homo sapiens
tgctcaggtgccttggctgctg

SEQ ID NO: 9379347 - DNA, 22 bp, Homo sapiens
cccaggtctgtgccagctctga

SEQ ID NO: 9379348 - DNA, 22 bp, Homo sapiens
cccaggtctgtgccagctctga

SEQ ID NO: 9379349 - DNA, 22 bp, Homo sapiens
cccaggtctgtgccagctctga

SEQ ID NO: 9379350 - DNA, 22 bp, Homo sapiens
tgcaggtgctccgggggtgccc

SEQ ID NO: 9379351 - DNA, 22 bp, Homo sapiens
tgcaggtgctccgggggtgccc

SEQ ID NO: 9379352 - DNA, 22 bp, Homo sapiens
tgcaggtgctgatacctactcc

SEQ ID NO: 9379353 - DNA, 22 bp, Homo sapiens
tgcaggtgctgatacctactcc

SEQ ID NO: 9379354 - DNA, 22 bp, Homo sapiens
tgcaggtgctacaagaactcac

SEQ ID NO: 9379355 - DNA, 22 bp, Homo sapiens
tgcaggtgctacaagaactcac

SEQ ID NO: 9379356 - DNA, 22 bp, Homo sapiens
tgcaggtgctccgggggtgccc

SEQ ID NO: 9379357 - DNA, 22 bp, Homo sapiens
tgcaggtgcgttttcaagcctc

SEQ ID NO: 9379358 - DNA, 22 bp, Homo sapiens
tgcaggtgcgttttcaagcctc

SEQ ID NO: 9379359 - DNA, 22 bp, Homo sapiens
tgcagggctaagtcagagcctg

SEQ ID NO: 9379360 - DNA, 22 bp, Homo sapiens
tgcagggctacaggactacaac

SEQ ID NO: 9379361 - DNA, 22 bp, Homo sapiens
tgcagggctaagtcagagcctg

SEQ ID NO: 9379362 - DNA, 22 bp, Homo sapiens
tgcagggctaagtcagagcctg

SEQ ID NO: 9379363 - DNA, 22 bp, Homo sapiens
tgcaggtgcctcttgagcttgt

SEQ ID NO: 9379364 - DNA, 22 bp, Homo sapiens
tgcaggtgcctcttgagcttgt

SEQ ID NO: 9379365 - DNA, 22 bp, Homo sapiens
tgcaggtgccatcgctgctcat

SEQ ID NO: 9379366 - DNA, 22 bp, Homo sapiens
tgcaggtgccatcgctgctcat

SEQ ID NO: 9379367 - DNA, 22 bp, Homo sapiens
tgcaggtgccatcgctgctcat

SEQ ID NO: 9379368 - DNA, 22 bp, Homo sapiens
tgcaggtgccatcgctgctcat

SEQ ID NO: 9379369 - DNA, 22 bp, Homo sapiens
tgctaagctgaggaagatgaga

SEQ ID NO: 9379370 - DNA, 22 bp, Homo sapiens
tgcaggtgctgtgtcaagagag

SEQ ID NO: 9379371 - DNA, 22 bp, Homo sapiens
tgcaggtgctgtgtcaagagag

SEQ ID NO: 9379372 - DNA, 22 bp, Homo sapiens
tgcaggtgctgtgtcaagagag

SEQ ID NO: 9379373 - DNA, 22 bp, Homo sapiens
tgctacagagccaggaagagtg

SEQ ID NO: 9379374 - DNA, 22 bp, Homo sapiens
tgctagtgcagggttttcagtt

SEQ ID NO: 9379375 - DNA, 22 bp, Homo sapiens
tgctaggtgattttattacttg

SEQ ID NO: 9379376 - DNA, 22 bp, Homo sapiens
tgctagccaagcccatcccttt

SEQ ID NO: 9379377 - DNA, 22 bp, Homo sapiens
tgctcaggccagccggacagag

SEQ ID NO: 9379378 - DNA, 19 bp, Homo sapiens
tgctcaggccaaggagccc

SEQ ID NO: 9379379 - DNA, 22 bp, Homo sapiens
tgctcaggccctgggccatcct

SEQ ID NO: 9379380 - DNA, 22 bp, Homo sapiens
tgctcaggccctgggccatcct

SEQ ID NO: 9379381 - DNA, 22 bp, Homo sapiens
tgctcagggacaatggagaggg

SEQ ID NO: 9379382 - DNA, 22 bp, Homo sapiens
tgctcagggacaatggagaggg

SEQ ID NO: 9379383 - DNA, 22 bp, Homo sapiens
tgctcagggagcatagtgaatt

SEQ ID NO: 9379384 - DNA, 22 bp, Homo sapiens
tgctcagggagcttcctggtgg

SEQ ID NO: 9379385 - DNA, 20 bp, Homo sapiens
tgctcaggatggagaggtgt

SEQ ID NO: 9379386 - DNA, 19 bp, Homo sapiens
tgctcaggccaaggagccc

SEQ ID NO: 9379387 - DNA, 22 bp, Homo sapiens
tgctcaggaggaggctgtgagg

SEQ ID NO: 9379388 - DNA, 22 bp, Homo sapiens
tgctcaggaggaggctgtgagg

SEQ ID NO: 9379389 - DNA, 22 bp, Homo sapiens
tgctcaggaaataatgtctgtg

SEQ ID NO: 9379390 - DNA, 22 bp, Homo sapiens
tgctcaggaaataatgtctgtg

SEQ ID NO: 9379391 - DNA, 22 bp, Homo sapiens
tgctcaggacagtggaacctaa

SEQ ID NO: 9379392 - DNA, 22 bp, Homo sapiens
tgctcaggagcttagagcacag

SEQ ID NO: 9379393 - DNA, 19 bp, Homo sapiens
tggcaggcccaggatggac

SEQ ID NO: 9379394 - DNA, 22 bp, Homo sapiens
tggcaggcattgatgcgagttc

SEQ ID NO: 9379395 - DNA, 19 bp, Homo sapiens
tggcaggcccaggatggac

SEQ ID NO: 9379396 - DNA, 19 bp, Homo sapiens
tggcaggcccaggatggac

SEQ ID NO: 9379397 - DNA, 19 bp, Homo sapiens
tggcaggcccaggatggac

SEQ ID NO: 9379398 - DNA, 22 bp, Homo sapiens
tggcagggaatacagatgttta

SEQ ID NO: 9379399 - DNA, 22 bp, Homo sapiens
tggcaggctgagttggcctggt

SEQ ID NO: 9379400 - DNA, 22 bp, Homo sapiens
tggcaggctgagttggcctggt

SEQ ID NO: 9379401 - DNA, 22 bp, Homo sapiens
tggcaggctgagttggcctggt

SEQ ID NO: 9379402 - DNA, 22 bp, Homo sapiens
tggcaggctctgagtagcacct

SEQ ID NO: 9379403 - DNA, 22 bp, Homo sapiens
tggcaggctctgagtagcacct

SEQ ID NO: 9379404 - DNA, 22 bp, Homo sapiens
tggcaggcgggagccatagagg

SEQ ID NO: 9379405 - DNA, 22 bp, Homo sapiens
ccctgggagctgcctggctgac

SEQ ID NO: 9379406 - DNA, 22 bp, Homo sapiens
ccctgggaggcttccaggcaga

SEQ ID NO: 9379407 - DNA, 22 bp, Homo sapiens
ccctgggagaagttgagggctg

SEQ ID NO: 9379408 - DNA, 22 bp, Homo sapiens
ccctgggacccgctgcagaggc

SEQ ID NO: 9379409 - DNA, 22 bp, Homo sapiens
ccctgggagaagttgagggctg

SEQ ID NO: 9379410 - DNA, 22 bp, Homo sapiens
ccctgggaagtattccagctat

SEQ ID NO: 9379411 - DNA, 22 bp, Homo sapiens
ccctgggaagtattccagctat

SEQ ID NO: 9379412 - DNA, 22 bp, Homo sapiens
ccctgggaagtattccagctat

SEQ ID NO: 9379413 - DNA, 22 bp, Homo sapiens
ccctggctggctctgcccggac

SEQ ID NO: 9379414 - DNA, 22 bp, Homo sapiens
ccctggctgcttgtagtctggc

SEQ ID NO: 9379415 - DNA, 22 bp, Homo sapiens
ccctggcttggcactctccact

SEQ ID NO: 9379416 - DNA, 22 bp, Homo sapiens
tggcagggagccaccggtcatg

SEQ ID NO: 9379417 - DNA, 22 bp, Homo sapiens
cccttgagcctggaggagctct

SEQ ID NO: 9379418 - DNA, 22 bp, Homo sapiens
cccttgaggtagactgaacacc

SEQ ID NO: 9379419 - DNA, 22 bp, Homo sapiens
cccttgagctgtggctgggtga

SEQ ID NO: 9379420 - DNA, 22 bp, Homo sapiens
cccttgctgccacagctgccca

SEQ ID NO: 9379421 - DNA, 22 bp, Homo sapiens
cccttgcatcccatgtgtggcc

SEQ ID NO: 9379422 - DNA, 22 bp, Homo sapiens
cccttgcacatttgtctttaat

SEQ ID NO: 9379423 - DNA, 19 bp, Homo sapiens
tggcagggagagtttgaag

SEQ ID NO: 9379424 - DNA, 19 bp, Homo sapiens
tggcagggagagtttgaag

SEQ ID NO: 9379425 - DNA, 22 bp, Homo sapiens
tggcagggagccaccggtcatg

SEQ ID NO: 9379426 - DNA, 22 bp, Homo sapiens
tggcagggaatacagatgttta

SEQ ID NO: 9379427 - DNA, 22 bp, Homo sapiens
tggcagggaatacagatgttta

SEQ ID NO: 9379428 - DNA, 19 bp, Homo sapiens
tggcagggagagtttgaag

SEQ ID NO: 9379429 - DNA, 22 bp, Homo sapiens
ccctttaaagttttaccagcag

SEQ ID NO: 9379430 - DNA, 22 bp, Homo sapiens
tggcaggtagtcagaggcgaca

SEQ ID NO: 9379431 - DNA, 22 bp, Homo sapiens
tggcaggtagtcagaggcgaca

SEQ ID NO: 9379432 - DNA, 22 bp, Homo sapiens
cccttggaggaagctctaggct

SEQ ID NO: 9379433 - DNA, 22 bp, Homo sapiens
cccttggaggaagctctaggct

SEQ ID NO: 9379434 - DNA, 22 bp, Homo sapiens
cccttggaggaagctctaggct

SEQ ID NO: 9379435 - DNA, 22 bp, Homo sapiens
cccttgggtgccagccacaagt

SEQ ID NO: 9379436 - DNA, 22 bp, Homo sapiens
cccttggggtggaggttgcagt

SEQ ID NO: 9379437 - DNA, 22 bp, Homo sapiens
cccttggggctctttgccaggc

SEQ ID NO: 9379438 - DNA, 22 bp, Homo sapiens
cccttggggatgctgtgtctgg

SEQ ID NO: 9379439 - DNA, 22 bp, Homo sapiens
cccttgggcttcagccctaccg

SEQ ID NO: 9379440 - DNA, 22 bp, Homo sapiens
cccttgggcttccacccagccc

SEQ ID NO: 9379441 - DNA, 22 bp, Homo sapiens
ccctggaggtggaggttgcagg

SEQ ID NO: 9379442 - DNA, 22 bp, Homo sapiens
ccctggaggtcagaggcctggg

SEQ ID NO: 9379443 - DNA, 22 bp, Homo sapiens
ccctggaggtcagaggcctggg

SEQ ID NO: 9379444 - DNA, 22 bp, Homo sapiens
ccctggaggtcagaggcctggg

SEQ ID NO: 9379445 - DNA, 22 bp, Homo sapiens
ccctggagggcagacagatgcc

SEQ ID NO: 9379446 - DNA, 22 bp, Homo sapiens
ccctggagggcagacagatgcc

SEQ ID NO: 9379447 - DNA, 22 bp, Homo sapiens
ccctggagggcagacagatgcc

SEQ ID NO: 9379448 - DNA, 22 bp, Homo sapiens
ccctggaggtcagaggcctggg

SEQ ID NO: 9379449 - DNA, 22 bp, Homo sapiens
ccctggaggttgaggctgcagt

SEQ ID NO: 9379450 - DNA, 22 bp, Homo sapiens
ccctggaggttgaggctgcagt

SEQ ID NO: 9379451 - DNA, 22 bp, Homo sapiens
ccctggaggttgaggctgcagt

SEQ ID NO: 9379452 - DNA, 22 bp, Homo sapiens
ccctggaggtggaggttgcagg

SEQ ID NO: 9379453 - DNA, 22 bp, Homo sapiens
ccctggaggtggaggttgcagg

SEQ ID NO: 9379454 - DNA, 22 bp, Homo sapiens
ccctggaggttgaggctgcagt

SEQ ID NO: 9379455 - DNA, 22 bp, Homo sapiens
ccctggaggtggaggttgcagg

SEQ ID NO: 9379456 - DNA, 22 bp, Homo sapiens
ccctggagtccggagctcacct

SEQ ID NO: 9379457 - DNA, 22 bp, Homo sapiens
ccctggagtcctggcagttgat

SEQ ID NO: 9379458 - DNA, 22 bp, Homo sapiens
ccctggagtccggagctcacct

SEQ ID NO: 9379459 - DNA, 22 bp, Homo sapiens
ccctggagtcctggcagttgat

SEQ ID NO: 9379460 - DNA, 22 bp, Homo sapiens
ccctggagtgccggaatcaaga

SEQ ID NO: 9379461 - DNA, 22 bp, Homo sapiens
ccctggagtgccggaatcaaga

SEQ ID NO: 9379462 - DNA, 22 bp, Homo sapiens
ccctggagtcctggcagttgat

SEQ ID NO: 9379463 - DNA, 22 bp, Homo sapiens
ccctggagtagcactgggtcgc

SEQ ID NO: 9379464 - DNA, 22 bp, Homo sapiens
ccctggagtagcactgggtcgc

SEQ ID NO: 9379465 - DNA, 22 bp, Homo sapiens
ccctggagtcaggttggcctgg

SEQ ID NO: 9379466 - DNA, 22 bp, Homo sapiens
ccctggagtcaggttggcctgg

SEQ ID NO: 9379467 - DNA, 22 bp, Homo sapiens
ccctggagtagcactgggtcgc

SEQ ID NO: 9379468 - DNA, 22 bp, Homo sapiens
ccctggagtagcactgggtcgc

SEQ ID NO: 9379469 - DNA, 22 bp, Homo sapiens
ccctggagtagcactgggtcgc

SEQ ID NO: 9379470 - DNA, 23 bp, Homo sapiens
ccctggagtaaattcttggaagg

SEQ ID NO: 9379471 - DNA, 23 bp, Homo sapiens
ccctggagtaaattcttggaagg

SEQ ID NO: 9379472 - DNA, 22 bp, Homo sapiens
tggcagaagtacacaagcatgc

SEQ ID NO: 9379473 - DNA, 22 bp, Homo sapiens
tggcacttggtaaatatgtgtt

SEQ ID NO: 9379474 - DNA, 22 bp, Homo sapiens
tggcacttggtaaatatgtgtt

SEQ ID NO: 9379475 - DNA, 22 bp, Homo sapiens
tggcacttgggagtcgtggcga

SEQ ID NO: 9379476 - DNA, 22 bp, Homo sapiens
tggcacttggctgagaggttct

SEQ ID NO: 9379477 - DNA, 22 bp, Homo sapiens
tggcacttttcccagttttggt

SEQ ID NO: 9379478 - DNA, 22 bp, Homo sapiens
tggcactttgagcaaaggtgca

SEQ ID NO: 9379479 - DNA, 22 bp, Homo sapiens
tggcactttacacccatttggc

SEQ ID NO: 9379480 - DNA, 22 bp, Homo sapiens
tggcacttgtcacctgctttca

SEQ ID NO: 9379481 - DNA, 22 bp, Homo sapiens
tggcactttacttcctcaggag

SEQ ID NO: 9379482 - DNA, 22 bp, Homo sapiens
ccctggagtgtgacgaggcatt

SEQ ID NO: 9379483 - DNA, 22 bp, Homo sapiens
ccctggagtgtgacgaggcatt

SEQ ID NO: 9379484 - DNA, 22 bp, Homo sapiens
ccctggagtgtgacgaggcatt

SEQ ID NO: 9379485 - DNA, 22 bp, Homo sapiens
tggcacagtgctggatggtgct

SEQ ID NO: 9379486 - DNA, 22 bp, Homo sapiens
tggcacttgatatttgatttgc

SEQ ID NO: 9379487 - DNA, 22 bp, Homo sapiens
tggcacttgcttcagatgatgt

SEQ ID NO: 9379488 - DNA, 22 bp, Homo sapiens
tggcagaatttctagcagattc

SEQ ID NO: 9379489 - DNA, 22 bp, Homo sapiens
tggcagaatttctagcagattc

SEQ ID NO: 9379490 - DNA, 22 bp, Homo sapiens
tggcagaattttaaagacagat

SEQ ID NO: 9379491 - DNA, 22 bp, Homo sapiens
tggcagaattttaaagacagat

SEQ ID NO: 9379492 - DNA, 22 bp, Homo sapiens
tggcagagaacacacatgattc

SEQ ID NO: 9379493 - DNA, 22 bp, Homo sapiens
tggcagagaacacacatgattc

SEQ ID NO: 9379494 - DNA, 22 bp, Homo sapiens
tggcagaccatcttattaacaa

SEQ ID NO: 9379495 - DNA, 22 bp, Homo sapiens
ccctggctgcttgtagtctggc

SEQ ID NO: 9379496 - DNA, 22 bp, Homo sapiens
tggcagagaacacacatgattc

SEQ ID NO: 9379497 - DNA, 22 bp, Homo sapiens
tggagatgggttaatggagaga

SEQ ID NO: 9379498 - DNA, 18 bp, Homo sapiens
tggagctgagggcaatgc

SEQ ID NO: 9379499 - DNA, 22 bp, Homo sapiens
tggagatgggaaaaaggaggta

SEQ ID NO: 9379500 - DNA, 22 bp, Homo sapiens
tggagatgtaaagcaaggctta

SEQ ID NO: 9379501 - DNA, 22 bp, Homo sapiens
tggagatgtaaagcaaggctta

SEQ ID NO: 9379502 - DNA, 23 bp, Homo sapiens
tggagatgccccactccctgtct

SEQ ID NO: 9379503 - DNA, 22 bp, Homo sapiens
tggagatgcacgagcaggtgga

SEQ ID NO: 9379504 - DNA, 22 bp, Homo sapiens
tggagatgcacgagcaggtgga

SEQ ID NO: 9379505 - DNA, 22 bp, Homo sapiens
tggagatgaggacatggacgtc

SEQ ID NO: 9379506 - DNA, 22 bp, Homo sapiens
tggagatggcctcaggccctca

SEQ ID NO: 9379507 - DNA, 23 bp, Homo sapiens
tggagatgccccactccctgtct

SEQ ID NO: 9379508 - DNA, 22 bp, Homo sapiens
tggagatgggaaaaaggaggta

SEQ ID NO: 9379509 - DNA, 22 bp, Homo sapiens
tggagatggcctcaggccctca

SEQ ID NO: 9379510 - DNA, 22 bp, Homo sapiens
tggagatgggttaatggagaga

SEQ ID NO: 9379511 - DNA, 22 bp, Homo sapiens
tggagatgggttaatggagaga

SEQ ID NO: 9379512 - DNA, 22 bp, Homo sapiens
tggaggaagtggctggccagaa

SEQ ID NO: 9379513 - DNA, 22 bp, Homo sapiens
tggaggaagtggacagttgtgt

SEQ ID NO: 9379514 - DNA, 19 bp, Homo sapiens
tggaggaagtatatttcat

SEQ ID NO: 9379515 - DNA, 22 bp, Homo sapiens
tggaggacgtgtccaccatgaa

SEQ ID NO: 9379516 - DNA, 22 bp, Homo sapiens
tggaggacaggactggacagcc

SEQ ID NO: 9379517 - DNA, 22 bp, Homo sapiens
tggaggaatcagggcttaggct

SEQ ID NO: 9379518 - DNA, 22 bp, Homo sapiens
tggaggccaaggcaggcggatc

SEQ ID NO: 9379519 - DNA, 22 bp, Homo sapiens
ccctggaggaagaaacaatggc

SEQ ID NO: 9379520 - DNA, 22 bp, Homo sapiens
ccctggaggaccccaatgtggc

SEQ ID NO: 9379521 - DNA, 22 bp, Homo sapiens
ccctggaggaccccaatgtggc

SEQ ID NO: 9379522 - DNA, 22 bp, Homo sapiens
ccctggagggacagctgctcta

SEQ ID NO: 9379523 - DNA, 22 bp, Homo sapiens
ccctggagggatttctcaatca

SEQ ID NO: 9379524 - DNA, 22 bp, Homo sapiens
ccctggagggatttctcaatca

SEQ ID NO: 9379525 - DNA, 22 bp, Homo sapiens
tggaggcatgacagtgtctgga

SEQ ID NO: 9379526 - DNA, 22 bp, Homo sapiens
tggaggcatgacagtgtctgga

SEQ ID NO: 9379527 - DNA, 22 bp, Homo sapiens
tggaggcattgtgactgctgaa

SEQ ID NO: 9379528 - DNA, 22 bp, Homo sapiens
tggaggcattgtgactgctgaa

SEQ ID NO: 9379529 - DNA, 22 bp, Homo sapiens
tggaggcattttaggttgtcac

SEQ ID NO: 9379530 - DNA, 22 bp, Homo sapiens
tggaggcatttgatgttcataa

SEQ ID NO: 9379531 - DNA, 22 bp, Homo sapiens
tggaggcattttaggttgtcac

SEQ ID NO: 9379532 - DNA, 22 bp, Homo sapiens
tggaggcatttctttttggtcg

SEQ ID NO: 9379533 - DNA, 22 bp, Homo sapiens
tggaggcatttgatgttcataa

SEQ ID NO: 9379534 - DNA, 22 bp, Homo sapiens
tggaggagaactccctggctac

SEQ ID NO: 9379535 - DNA, 22 bp, Homo sapiens
tggaggagaactccctggctac

SEQ ID NO: 9379536 - DNA, 22 bp, Homo sapiens
tggaggacaggactggacagcc

SEQ ID NO: 9379537 - DNA, 22 bp, Homo sapiens
tggaggacgtgtccaccatgaa

SEQ ID NO: 9379538 - DNA, 22 bp, Homo sapiens
tggaggcagtttaagtctgaga

SEQ ID NO: 9379539 - DNA, 22 bp, Homo sapiens
tggaggcagtttaagtctgaga

SEQ ID NO: 9379540 - DNA, 22 bp, Homo sapiens
tggaggcataggcctgggccct

SEQ ID NO: 9379541 - DNA, 22 bp, Homo sapiens
tggaggcataggcctgggccct

SEQ ID NO: 9379542 - DNA, 22 bp, Homo sapiens
tggaggcagtttaagtctgaga

SEQ ID NO: 9379543 - DNA, 22 bp, Homo sapiens
tggaggcataggcctgggccct

SEQ ID NO: 9379544 - DNA, 22 bp, Homo sapiens
tggaggcataggcctgggccct

SEQ ID NO: 9379545 - DNA, 22 bp, Homo sapiens
tggaggcatcagagtgcttggc

SEQ ID NO: 9379546 - DNA, 22 bp, Homo sapiens
tggaggcatcagagtgcttggc

SEQ ID NO: 9379547 - DNA, 22 bp, Homo sapiens
tggaggcatcagagtgcttggc

SEQ ID NO: 9379548 - DNA, 16 bp, Homo sapiens
tggaggcatctggccc

SEQ ID NO: 9379549 - DNA, 16 bp, Homo sapiens
tggaggcatctggccc

SEQ ID NO: 9379550 - DNA, 22 bp, Homo sapiens
tggaggcatgacagtgtctgga

SEQ ID NO: 9379551 - DNA, 22 bp, Homo sapiens
tggaggcatgacagtgtctgga

SEQ ID NO: 9379552 - DNA, 22 bp, Homo sapiens
tggaggcatcagagtgcttggc

SEQ ID NO: 9379553 - DNA, 22 bp, Homo sapiens
tggaggcatcagagtgcttggc

SEQ ID NO: 9379554 - DNA, 18 bp, Homo sapiens
tggagacatagacaatgt

SEQ ID NO: 9379555 - DNA, 22 bp, Homo sapiens
tggagacatgggcgaatctaag

SEQ ID NO: 9379556 - DNA, 22 bp, Homo sapiens
tggacatgtcttctccaagaaa

SEQ ID NO: 9379557 - DNA, 22 bp, Homo sapiens
tggacatgtccggccagacaat

SEQ ID NO: 9379558 - DNA, 22 bp, Homo sapiens
tggaaagaaagtaaaggcgtat

SEQ ID NO: 9379559 - DNA, 22 bp, Homo sapiens
tggagaattctatgttgagggg

SEQ ID NO: 9379560 - DNA, 22 bp, Homo sapiens
tggagatgaacatggtgatgtt

SEQ ID NO: 9379561 - DNA, 22 bp, Homo sapiens
tggagatgaacatggtgatgtt

SEQ ID NO: 9379562 - DNA, 22 bp, Homo sapiens
tggagagttctgtagatatcta

SEQ ID NO: 9379563 - DNA, 22 bp, Homo sapiens
tggagagtttagcctactggaa

SEQ ID NO: 9379564 - DNA, 22 bp, Homo sapiens
tggagatgaacatggtgatgtt

SEQ ID NO: 9379565 - DNA, 22 bp, Homo sapiens
tggagatgaacatggtgatgtt

SEQ ID NO: 9379566 - DNA, 22 bp, Homo sapiens
tggagatgaatatgtgtacctg

SEQ ID NO: 9379567 - DNA, 22 bp, Homo sapiens
tggagactgataaaggctattg

SEQ ID NO: 9379568 - DNA, 19 bp, Homo sapiens
tggagactgagagtgagca

SEQ ID NO: 9379569 - DNA, 22 bp, Homo sapiens
tggagactgataaaggctattg

SEQ ID NO: 9379570 - DNA, 22 bp, Homo sapiens
tggagactgtgctaagggagtt

SEQ ID NO: 9379571 - DNA, 22 bp, Homo sapiens
tggagactgactgcctgtattt

SEQ ID NO: 9379572 - DNA, 22 bp, Homo sapiens
tggagactctgcatctgtgaca

SEQ ID NO: 9379573 - DNA, 21 bp, Homo sapiens
tggagactctggttctttgtg

SEQ ID NO: 9379574 - DNA, 22 bp, Homo sapiens
tggagactctgcatctgtgaca

SEQ ID NO: 9379575 - DNA, 22 bp, Homo sapiens
tggagactctgcatctgtgaca

SEQ ID NO: 9379576 - DNA, 22 bp, Homo sapiens
tggagactcagaaggggaagca

SEQ ID NO: 9379577 - DNA, 22 bp, Homo sapiens
tggagactcagaaggggaagca

SEQ ID NO: 9379578 - DNA, 22 bp, Homo sapiens
ccctccctgtgtgcctcatttg

SEQ ID NO: 9379579 - DNA, 22 bp, Homo sapiens
ccctccctgtgtgcctcatttg

SEQ ID NO: 9379580 - DNA, 22 bp, Homo sapiens
ccctccctttgcagcagtgcat

SEQ ID NO: 9379581 - DNA, 22 bp, Homo sapiens
ccctccctgtgtgcctcatttg

SEQ ID NO: 9379582 - DNA, 22 bp, Homo sapiens
ccctcctcaactctggcttcca

SEQ ID NO: 9379583 - DNA, 23 bp, Homo sapiens
tggaaacattctgaatgtccatc

SEQ ID NO: 9379584 - DNA, 22 bp, Homo sapiens
ccctccctttgcagcagtgcat

SEQ ID NO: 9379585 - DNA, 22 bp, Homo sapiens
ccctcctcaactctggcttcca

SEQ ID NO: 9379586 - DNA, 22 bp, Homo sapiens
ccctcctcaactctggcttcca

SEQ ID NO: 9379587 - DNA, 22 bp, Homo sapiens
ccctcctcaactctggcttcca

SEQ ID NO: 9379588 - DNA, 22 bp, Homo sapiens
tggaaactgggagttaaatgta

SEQ ID NO: 9379589 - DNA, 22 bp, Homo sapiens
tggaaactgggagttaaatgta

SEQ ID NO: 9379590 - DNA, 22 bp, Homo sapiens
tggaaactgcagttcccgggga

SEQ ID NO: 9379591 - DNA, 19 bp, Homo sapiens
tggaaactcctgatattag

SEQ ID NO: 9379592 - DNA, 22 bp, Homo sapiens
tggaaactcagggccagaagga

SEQ ID NO: 9379593 - DNA, 22 bp, Homo sapiens
tggaaactctacctctctaaga

SEQ ID NO: 9379594 - DNA, 22 bp, Homo sapiens
tggaaactctacctctctaaga

SEQ ID NO: 9379595 - DNA, 19 bp, Homo sapiens
tggaaactcctgatattag

SEQ ID NO: 9379596 - DNA, 22 bp, Homo sapiens
tggaaactgtggtatttcttta

SEQ ID NO: 9379597 - DNA, 22 bp, Homo sapiens
tggaaactgtggtatttcttta

SEQ ID NO: 9379598 - DNA, 22 bp, Homo sapiens
tggaaacttatctgacacgaac

SEQ ID NO: 9379599 - DNA, 22 bp, Homo sapiens
tggaaacttaccgtttggggaa

SEQ ID NO: 9379600 - DNA, 23 bp, Homo sapiens
tggaaacttaagggggagatgtc

SEQ ID NO: 9379601 - DNA, 22 bp, Homo sapiens
tggaaacttggaacgtcttcag

SEQ ID NO: 9379602 - DNA, 21 bp, Homo sapiens
tggaaacttctagcttacgta

SEQ ID NO: 9379603 - DNA, 21 bp, Homo sapiens
tggaaacttctagcttacgta

SEQ ID NO: 9379604 - DNA, 22 bp, Homo sapiens
tggaaactagagtgtgggaagc

SEQ ID NO: 9379605 - DNA, 22 bp, Homo sapiens
tggaaactagagagtttgtatt

SEQ ID NO: 9379606 - DNA, 22 bp, Homo sapiens
tggaaactagagagtttgtatt

SEQ ID NO: 9379607 - DNA, 22 bp, Homo sapiens
tggaaactaacaacagagcaga

SEQ ID NO: 9379608 - DNA, 22 bp, Homo sapiens
tggaaactaagactagagagac

SEQ ID NO: 9379609 - DNA, 22 bp, Homo sapiens
tggaaactatagtcacaataga

SEQ ID NO: 9379610 - DNA, 22 bp, Homo sapiens
tggaaactataaaagcaccttc

SEQ ID NO: 9379611 - DNA, 22 bp, Homo sapiens
tggaaactatcctcacaactag

SEQ ID NO: 9379612 - DNA, 22 bp, Homo sapiens
tggaaactagccttttaggttg

SEQ ID NO: 9379613 - DNA, 22 bp, Homo sapiens
tggaaactagccttttaggttg

SEQ ID NO: 9379614 - DNA, 22 bp, Homo sapiens
tggaaactaggatggaagaaat

SEQ ID NO: 9379615 - DNA, 22 bp, Homo sapiens
cagggagggaggaaaatttgct

SEQ ID NO: 9379616 - DNA, 22 bp, Homo sapiens
cagggagggacaattgtcacct

SEQ ID NO: 9379617 - DNA, 22 bp, Homo sapiens
cagggatgaccagagggatgtg

SEQ ID NO: 9379618 - DNA, 22 bp, Homo sapiens
cagggatgagaaagctctctaa

SEQ ID NO: 9379619 - DNA, 22 bp, Homo sapiens
cagggatgaccagagggatgtg

SEQ ID NO: 9379620 - DNA, 22 bp, Homo sapiens
cagggatgagaaagctctctaa

SEQ ID NO: 9379621 - DNA, 22 bp, Homo sapiens
cagggagtcaacaaacagatca

SEQ ID NO: 9379622 - DNA, 22 bp, Homo sapiens
cagggagtgtacaccatgtgta

SEQ ID NO: 9379623 - DNA, 22 bp, Homo sapiens
cagggatgaccagagggatgtg

SEQ ID NO: 9379624 - DNA, 22 bp, Homo sapiens
cagggatgaccagagggatgtg

SEQ ID NO: 9379625 - DNA, 22 bp, Homo sapiens
cagggaggatgggctgttttgc

SEQ ID NO: 9379626 - DNA, 22 bp, Homo sapiens
cagggaggctgtcttatgcctg

SEQ ID NO: 9379627 - DNA, 22 bp, Homo sapiens
cagggagctttcccaggaccct

SEQ ID NO: 9379628 - DNA, 22 bp, Homo sapiens
cagggatgctgcttaggcagtt

SEQ ID NO: 9379629 - DNA, 22 bp, Homo sapiens
cagggatgctgcttaggcagtt

SEQ ID NO: 9379630 - DNA, 22 bp, Homo sapiens
cagggatgctgcttaggcagtt

SEQ ID NO: 9379631 - DNA, 22 bp, Homo sapiens
cagggatggagagactactggc

SEQ ID NO: 9379632 - DNA, 22 bp, Homo sapiens
cagggatggagagactactggc

SEQ ID NO: 9379633 - DNA, 22 bp, Homo sapiens
cagggatggagagactactggc

SEQ ID NO: 9379634 - DNA, 22 bp, Homo sapiens
cagggatggcctggcgggccac

SEQ ID NO: 9379635 - DNA, 22 bp, Homo sapiens
cagggatgagcagatggagcaa

SEQ ID NO: 9379636 - DNA, 22 bp, Homo sapiens
cagggatgagcagatggagcaa

SEQ ID NO: 9379637 - DNA, 22 bp, Homo sapiens
cagggatgagcagatggagcaa

SEQ ID NO: 9379638 - DNA, 22 bp, Homo sapiens
cagggatgagcagatggagcaa

SEQ ID NO: 9379639 - DNA, 22 bp, Homo sapiens
cagggatgagagatggcacaga

SEQ ID NO: 9379640 - DNA, 22 bp, Homo sapiens
cagggatgagagatggcacaga

SEQ ID NO: 9379641 - DNA, 22 bp, Homo sapiens
cagggatgagagatggcacaga

SEQ ID NO: 9379642 - DNA, 22 bp, Homo sapiens
cagggatgagagatggcacaga

SEQ ID NO: 9379643 - DNA, 22 bp, Homo sapiens
cagggatgagagatggcacaga

SEQ ID NO: 9379644 - DNA, 22 bp, Homo sapiens
tagcagcacaaatggactatga

SEQ ID NO: 9379645 - DNA, 22 bp, Homo sapiens
tagcagcaatttcagaagtttg

SEQ ID NO: 9379646 - DNA, 22 bp, Homo sapiens
tagcagcaatttcagaagtttg

SEQ ID NO: 9379647 - DNA, 22 bp, Homo sapiens
tagcagcacagaaagcctggag

SEQ ID NO: 9379648 - DNA, 22 bp, Homo sapiens
tagcagcaagaatgggatgtgt

SEQ ID NO: 9379649 - DNA, 22 bp, Homo sapiens
tagcagcaagaatgggatgtgt

SEQ ID NO: 9379650 - DNA, 22 bp, Homo sapiens
tagcagcaattacacagtccgt

SEQ ID NO: 9379651 - DNA, 22 bp, Homo sapiens
tagcagcaattcaggtgtgatg

SEQ ID NO: 9379652 - DNA, 22 bp, Homo sapiens
tagcagcaaagcaggatctgct

SEQ ID NO: 9379653 - DNA, 22 bp, Homo sapiens
tagcagcaaagcaggatctgct

SEQ ID NO: 9379654 - DNA, 22 bp, Homo sapiens
tagcagcaaaatgaccttctaa

SEQ ID NO: 9379655 - DNA, 22 bp, Homo sapiens
cagggccaagctgcagcatctg

SEQ ID NO: 9379656 - DNA, 22 bp, Homo sapiens
cagggcataagatgaggctgta

SEQ ID NO: 9379657 - DNA, 22 bp, Homo sapiens
cagggcatccgtgctccatgct

SEQ ID NO: 9379658 - DNA, 22 bp, Homo sapiens
cagggcatccgtgctccatgct

SEQ ID NO: 9379659 - DNA, 22 bp, Homo sapiens
cagggcatccgtgctccatgct

SEQ ID NO: 9379660 - DNA, 22 bp, Homo sapiens
cagggcatctggagtcgggcgg

SEQ ID NO: 9379661 - DNA, 22 bp, Homo sapiens
cagggcatgaggtgtgcttctc

SEQ ID NO: 9379662 - DNA, 22 bp, Homo sapiens
cagggcatgaggtgtgcttctc

SEQ ID NO: 9379663 - DNA, 22 bp, Homo sapiens
cagggcataagatgaggctgta

SEQ ID NO: 9379664 - DNA, 22 bp, Homo sapiens
cagggcataagatgaggctgta

SEQ ID NO: 9379665 - DNA, 22 bp, Homo sapiens
cagggcagttttacttctctct

SEQ ID NO: 9379666 - DNA, 22 bp, Homo sapiens
cagggcagttttacttctctct

SEQ ID NO: 9379667 - DNA, 22 bp, Homo sapiens
cagggcagtttgtgcctatgag

SEQ ID NO: 9379668 - DNA, 22 bp, Homo sapiens
cagggcagtgaagaacacacgt

SEQ ID NO: 9379669 - DNA, 22 bp, Homo sapiens
cagggcagtttgtgcctatgag

SEQ ID NO: 9379670 - DNA, 22 bp, Homo sapiens
cagggcagtttgtgcctatgag

SEQ ID NO: 9379671 - DNA, 22 bp, Homo sapiens
cagggcagtttgtgcctatgag

SEQ ID NO: 9379672 - DNA, 22 bp, Homo sapiens
cagggcagtaccgccctctggc

SEQ ID NO: 9379673 - DNA, 22 bp, Homo sapiens
cagggcagtgaagaacacacgt

SEQ ID NO: 9379674 - DNA, 22 bp, Homo sapiens
cagggcagtaccgccctctggc

SEQ ID NO: 9379675 - DNA, 22 bp, Homo sapiens
cagggcagtaccgccctctggc

SEQ ID NO: 9379676 - DNA, 22 bp, Homo sapiens
cagggcagtaccgccctctggc

SEQ ID NO: 9379677 - DNA, 22 bp, Homo sapiens
cagggcagtaccgccctctggc

SEQ ID NO: 9379678 - DNA, 22 bp, Homo sapiens
cagggcaggacagatacattac

SEQ ID NO: 9379679 - DNA, 22 bp, Homo sapiens
tagcagcacctttctaatctga

SEQ ID NO: 9379680 - DNA, 22 bp, Homo sapiens
tagcagcacctacacgtcagag

SEQ ID NO: 9379681 - DNA, 18 bp, Homo sapiens
tagcagcactggccgctt

SEQ ID NO: 9379682 - DNA, 20 bp, Homo sapiens
tagcagcagaaagaacttag

SEQ ID NO: 9379683 - DNA, 20 bp, Homo sapiens
tagcagcagaaagaacttag

SEQ ID NO: 9379684 - DNA, 22 bp, Homo sapiens
tagcagcaggggaaacagctgt

SEQ ID NO: 9379685 - DNA, 20 bp, Homo sapiens
tagcagcagaaagaacttag

SEQ ID NO: 9379686 - DNA, 22 bp, Homo sapiens
tagcataacaggtaagagtgag

SEQ ID NO: 9379687 - DNA, 22 bp, Homo sapiens
tagcataacaggtaagagtgag

SEQ ID NO: 9379688 - DNA, 22 bp, Homo sapiens
tagcataacaggtaagagtgag

SEQ ID NO: 9379689 - DNA, 22 bp, Homo sapiens
tagcataacaggtaagagtgag

SEQ ID NO: 9379690 - DNA, 22 bp, Homo sapiens
tagcataatttgtagaaaatca

SEQ ID NO: 9379691 - DNA, 22 bp, Homo sapiens
tagcatagcacctgacacagag

SEQ ID NO: 9379692 - DNA, 22 bp, Homo sapiens
tagcatggggagcagaaagtca

SEQ ID NO: 9379693 - DNA, 22 bp, Homo sapiens
tagcattaaaggtaagacatta

SEQ ID NO: 9379694 - DNA, 22 bp, Homo sapiens
tagcattagagatagaaatagt

SEQ ID NO: 9379695 - DNA, 22 bp, Homo sapiens
cagggcaggacagatacattac

SEQ ID NO: 9379696 - DNA, 22 bp, Homo sapiens
cagggcaggacagatacattac

SEQ ID NO: 9379697 - DNA, 22 bp, Homo sapiens
tagaaagagctttgcttccttt

SEQ ID NO: 9379698 - DNA, 22 bp, Homo sapiens
tagaaagatctgtaggcaagag

SEQ ID NO: 9379699 - DNA, 22 bp, Homo sapiens
tagaaagactgtccagatttca

SEQ ID NO: 9379700 - DNA, 22 bp, Homo sapiens
tagaaagactgtccagatttca

SEQ ID NO: 9379701 - DNA, 22 bp, Homo sapiens
tacctcaagttccaggaaagcg

SEQ ID NO: 9379702 - DNA, 22 bp, Homo sapiens
tacctcaagttccaggaaagcg

SEQ ID NO: 9379703 - DNA, 22 bp, Homo sapiens
tagaaagacaatgggaagtgct

SEQ ID NO: 9379704 - DNA, 22 bp, Homo sapiens
tagaaagaacttcatgtaaaac

SEQ ID NO: 9379705 - DNA, 22 bp, Homo sapiens
tagaaacaagtttctctttggg

SEQ ID NO: 9379706 - DNA, 22 bp, Homo sapiens
tacccaggaggaaactgaggct

SEQ ID NO: 9379707 - DNA, 22 bp, Homo sapiens
tacccagtgcaactggagtctc

SEQ ID NO: 9379708 - DNA, 22 bp, Homo sapiens
caggctgcagcagcagtggccc

SEQ ID NO: 9379709 - DNA, 22 bp, Homo sapiens
caggctgcagcagcagtggccc

SEQ ID NO: 9379710 - DNA, 22 bp, Homo sapiens
taccctctcccggtccagcttt

SEQ ID NO: 9379711 - DNA, 19 bp, Homo sapiens
taccctcagggcctcattt

SEQ ID NO: 9379712 - DNA, 22 bp, Homo sapiens
tacccagttccacacactgatg

SEQ ID NO: 9379713 - DNA, 20 bp, Homo sapiens
tacccagtggtggatggtaa

SEQ ID NO: 9379714 - DNA, 22 bp, Homo sapiens
tacccagtgccaccctctgagg

SEQ ID NO: 9379715 - DNA, 22 bp, Homo sapiens
tacccagttcagtgtttaaaaa

SEQ ID NO: 9379716 - DNA, 22 bp, Homo sapiens
tacccagttattttgtctttgt

SEQ ID NO: 9379717 - DNA, 20 bp, Homo sapiens
taccctggctatgcttctga

SEQ ID NO: 9379718 - DNA, 22 bp, Homo sapiens
taccctggagcaagtttcctca

SEQ ID NO: 9379719 - DNA, 22 bp, Homo sapiens
caggctgatagggtccaaagtt

SEQ ID NO: 9379720 - DNA, 22 bp, Homo sapiens
caggctgattaggcctcgtcca

SEQ ID NO: 9379721 - DNA, 22 bp, Homo sapiens
caggctgattaggcctcgtcca

SEQ ID NO: 9379722 - DNA, 22 bp, Homo sapiens
caggctgatcagggctgggatg

SEQ ID NO: 9379723 - DNA, 22 bp, Homo sapiens
caggctgatcagggctgggatg

SEQ ID NO: 9379724 - DNA, 22 bp, Homo sapiens
caggctgcaagaaaggcattca

SEQ ID NO: 9379725 - DNA, 22 bp, Homo sapiens
caggctgcaagaaaggcattca

SEQ ID NO: 9379726 - DNA, 22 bp, Homo sapiens
caggctgcaagaaaggcattca

SEQ ID NO: 9379727 - DNA, 22 bp, Homo sapiens
caggctgcaagaaaggcattca

SEQ ID NO: 9379728 - DNA, 22 bp, Homo sapiens
caggctgcagaggcctttcatg

SEQ ID NO: 9379729 - DNA, 22 bp, Homo sapiens
caggctgcagaggcctttcatg

SEQ ID NO: 9379730 - DNA, 22 bp, Homo sapiens
caggctgcagaggcctttcatg

SEQ ID NO: 9379731 - DNA, 22 bp, Homo sapiens
caggctgcagcagcagtggccc

SEQ ID NO: 9379732 - DNA, 22 bp, Homo sapiens
caggctgcagcagcagtggccc

SEQ ID NO: 9379733 - DNA, 22 bp, Homo sapiens
caggctgcagcagcagtggccc

SEQ ID NO: 9379734 - DNA, 22 bp, Homo sapiens
tagaaatgttggtattaacatt

SEQ ID NO: 9379735 - DNA, 22 bp, Homo sapiens
tagaaatgtaggcttcctgaca

SEQ ID NO: 9379736 - DNA, 22 bp, Homo sapiens
tagaacagcatttggctattaa

SEQ ID NO: 9379737 - DNA, 22 bp, Homo sapiens
tagaacataagtcattcatttg

SEQ ID NO: 9379738 - DNA, 22 bp, Homo sapiens
tagaacataagtcattcatttg

SEQ ID NO: 9379739 - DNA, 22 bp, Homo sapiens
cagggacagccttggggtggcg

SEQ ID NO: 9379740 - DNA, 22 bp, Homo sapiens
cagggacagccttggggtggcg

SEQ ID NO: 9379741 - DNA, 22 bp, Homo sapiens
cagggacagccttggggtggcg

SEQ ID NO: 9379742 - DNA, 22 bp, Homo sapiens
cagggagaagtctggtcagtcc

SEQ ID NO: 9379743 - DNA, 22 bp, Homo sapiens
cagggagaagtctggtcagtcc

SEQ ID NO: 9379744 - DNA, 22 bp, Homo sapiens
cagggagaaatctccaggaggt

SEQ ID NO: 9379745 - DNA, 22 bp, Homo sapiens
cagggagaagtctggtcagtcc

SEQ ID NO: 9379746 - DNA, 22 bp, Homo sapiens
cagggagaaatctccaggaggt

SEQ ID NO: 9379747 - DNA, 22 bp, Homo sapiens
cagggagaggcatcatagggaa

SEQ ID NO: 9379748 - DNA, 22 bp, Homo sapiens
cagggagaggcatcatagggaa

SEQ ID NO: 9379749 - DNA, 22 bp, Homo sapiens
cagggagaggcatcatagggaa

SEQ ID NO: 9379750 - DNA, 22 bp, Homo sapiens
cagggagaggctggtggagtaa

SEQ ID NO: 9379751 - DNA, 22 bp, Homo sapiens
cagggagatcttggctcctggt

SEQ ID NO: 9379752 - DNA, 22 bp, Homo sapiens
cagggagaggctggtggagtaa

SEQ ID NO: 9379753 - DNA, 22 bp, Homo sapiens
cagggagaggctggtggagtaa

SEQ ID NO: 9379754 - DNA, 22 bp, Homo sapiens
tagacagggtggcttagaaaca

SEQ ID NO: 9379755 - DNA, 22 bp, Homo sapiens
tagacaggagtcaggctagaat

SEQ ID NO: 9379756 - DNA, 22 bp, Homo sapiens
tagacagggtggcttagaaaca

SEQ ID NO: 9379757 - DNA, 22 bp, Homo sapiens
tagacatttgtcaagaatgact

SEQ ID NO: 9379758 - DNA, 22 bp, Homo sapiens
tagacatttggagttttatgac

SEQ ID NO: 9379759 - DNA, 22 bp, Homo sapiens
cagctctgcctctggggctgag

SEQ ID NO: 9379760 - DNA, 22 bp, Homo sapiens
cagctctgcctctggggctgag

SEQ ID NO: 9379761 - DNA, 22 bp, Homo sapiens
cagctctgccatcatctgcctt

SEQ ID NO: 9379762 - DNA, 22 bp, Homo sapiens
cagctctgccatcatctgcctt

SEQ ID NO: 9379763 - DNA, 22 bp, Homo sapiens
cagctctgctgggaggatgcag

SEQ ID NO: 9379764 - DNA, 22 bp, Homo sapiens
gtggagaggagcagctacctca

SEQ ID NO: 9379765 - DNA, 22 bp, Homo sapiens
cagctctgccacttcctagcta

SEQ ID NO: 9379766 - DNA, 17 bp, Homo sapiens
cagctctgcatcttcct

SEQ ID NO: 9379767 - DNA, 17 bp, Homo sapiens
cagctctgcatcttcct

SEQ ID NO: 9379768 - DNA, 22 bp, Homo sapiens
cagctctgccacttcctagcta

SEQ ID NO: 9379769 - DNA, 22 bp, Homo sapiens
cagctctgccacttcctagcta

SEQ ID NO: 9379770 - DNA, 22 bp, Homo sapiens
cagctctgccacttcctagcta

SEQ ID NO: 9379771 - DNA, 23 bp, Homo sapiens
gtggagccacatcacaggctcct

SEQ ID NO: 9379772 - DNA, 22 bp, Homo sapiens
gtggagccaggatctccgcaca

SEQ ID NO: 9379773 - DNA, 22 bp, Homo sapiens
gtggagcatgtgaggactgagt

SEQ ID NO: 9379774 - DNA, 22 bp, Homo sapiens
gtggagcaggactagctgagaa

SEQ ID NO: 9379775 - DNA, 22 bp, Homo sapiens
gtggagcaatcagagggtcagt

SEQ ID NO: 9379776 - DNA, 21 bp, Homo sapiens
gtggagagtgattttgatgca

SEQ ID NO: 9379777 - DNA, 20 bp, Homo sapiens
gtggagaggctggcgggact

SEQ ID NO: 9379778 - DNA, 22 bp, Homo sapiens
tacaatatgtgaactttggtgt

SEQ ID NO: 9379779 - DNA, 22 bp, Homo sapiens
tacacagactcttcaattcaga

SEQ ID NO: 9379780 - DNA, 22 bp, Homo sapiens
tacacagaggctgatgtcttag

SEQ ID NO: 9379781 - DNA, 22 bp, Homo sapiens
tacacagaggctgatgtcttag

SEQ ID NO: 9379782 - DNA, 22 bp, Homo sapiens
tacacagggtatggcttgagga

SEQ ID NO: 9379783 - DNA, 22 bp, Homo sapiens
tacacagggaaaggtctcagag

SEQ ID NO: 9379784 - DNA, 22 bp, Homo sapiens
tacacaggctgcctctttgcat

SEQ ID NO: 9379785 - DNA, 22 bp, Homo sapiens
tacacagatttcagtatcatca

SEQ ID NO: 9379786 - DNA, 22 bp, Homo sapiens
tacacagcctgtaatgatgact

SEQ ID NO: 9379787 - DNA, 22 bp, Homo sapiens
caggcccaggggtctggcccac

SEQ ID NO: 9379788 - DNA, 22 bp, Homo sapiens
caggccacgccccggcgtgtga

SEQ ID NO: 9379789 - DNA, 22 bp, Homo sapiens
caggccacgccccggcgtgtga

SEQ ID NO: 9379790 - DNA, 22 bp, Homo sapiens
caggccccattcctcttgggac

SEQ ID NO: 9379791 - DNA, 22 bp, Homo sapiens
caggccctcaggcaagggctct

SEQ ID NO: 9379792 - DNA, 22 bp, Homo sapiens
caggcccaggggtctggcccac

SEQ ID NO: 9379793 - DNA, 22 bp, Homo sapiens
caggcccaggggtctggcccac

SEQ ID NO: 9379794 - DNA, 22 bp, Homo sapiens
caggccacacggcggctccctg

SEQ ID NO: 9379795 - DNA, 22 bp, Homo sapiens
caggccaccagatacatgcccc

SEQ ID NO: 9379796 - DNA, 22 bp, Homo sapiens
caggccctcctgtgatctgcct

SEQ ID NO: 9379797 - DNA, 22 bp, Homo sapiens
caggccctcctgtgatctgcct

SEQ ID NO: 9379798 - DNA, 22 bp, Homo sapiens
caggccctcaggcaagggctct

SEQ ID NO: 9379799 - DNA, 22 bp, Homo sapiens
caggccctcctgtgatctgcct

SEQ ID NO: 9379800 - DNA, 22 bp, Homo sapiens
caggccctcctgtgatctgcct

SEQ ID NO: 9379801 - DNA, 22 bp, Homo sapiens
caggccctcaggcaagggctct

SEQ ID NO: 9379802 - DNA, 22 bp, Homo sapiens
caggccctcgtggtgagctggg

SEQ ID NO: 9379803 - DNA, 22 bp, Homo sapiens
caggccctcgtggtgagctggg

SEQ ID NO: 9379804 - DNA, 22 bp, Homo sapiens
caggccctcgcccgcagcgacc

SEQ ID NO: 9379805 - DNA, 22 bp, Homo sapiens
caggccctcgcccgcagcgacc

SEQ ID NO: 9379806 - DNA, 22 bp, Homo sapiens
caggccctcgcccgcagcgacc

SEQ ID NO: 9379807 - DNA, 22 bp, Homo sapiens
caggccctcgtggtgagctggg

SEQ ID NO: 9379808 - DNA, 22 bp, Homo sapiens
caggccctgcactaggccctgg

SEQ ID NO: 9379809 - DNA, 22 bp, Homo sapiens
caggccctgcactaggccctgg

SEQ ID NO: 9379810 - DNA, 22 bp, Homo sapiens
caggccctgcactaggccctgg

SEQ ID NO: 9379811 - DNA, 22 bp, Homo sapiens
caggccctgccttgagggacct

SEQ ID NO: 9379812 - DNA, 22 bp, Homo sapiens
caggccctgccttgagggacct

SEQ ID NO: 9379813 - DNA, 22 bp, Homo sapiens
caggccctgcacagtggtcctg

SEQ ID NO: 9379814 - DNA, 22 bp, Homo sapiens
caggccctgcacagtggtcctg

SEQ ID NO: 9379815 - DNA, 22 bp, Homo sapiens
caggccctgcacagtggtcctg

SEQ ID NO: 9379816 - DNA, 22 bp, Homo sapiens
caggccctgaggattcggcggg

SEQ ID NO: 9379817 - DNA, 22 bp, Homo sapiens
caggccctcgtggtgagctggg

SEQ ID NO: 9379818 - DNA, 22 bp, Homo sapiens
caggccctgaggattcggcggg

SEQ ID NO: 9379819 - DNA, 22 bp, Homo sapiens
caggccctctgcaccctcgtct

SEQ ID NO: 9379820 - DNA, 22 bp, Homo sapiens
caggccctctgcaccctcgtct

SEQ ID NO: 9379821 - DNA, 22 bp, Homo sapiens
tacacttataactctgtgtgtg

SEQ ID NO: 9379822 - DNA, 22 bp, Homo sapiens
tacagacattcaattttgaccc

SEQ ID NO: 9379823 - DNA, 22 bp, Homo sapiens
tacacttttcaatgtagtctgt

SEQ ID NO: 9379824 - DNA, 22 bp, Homo sapiens
tacactttgtgatgccgggagc

SEQ ID NO: 9379825 - DNA, 22 bp, Homo sapiens
tacagacatttactccactcct

SEQ ID NO: 9379826 - DNA, 22 bp, Homo sapiens
tacagacatttactccactcct

SEQ ID NO: 9379827 - DNA, 22 bp, Homo sapiens
tacactgtgacaatcatgacag

SEQ ID NO: 9379828 - DNA, 22 bp, Homo sapiens
tacactgtgacaatcatgacag

SEQ ID NO: 9379829 - DNA, 22 bp, Homo sapiens
tacactgtgtaaaatgcacttt

SEQ ID NO: 9379830 - DNA, 22 bp, Homo sapiens
caggccctgccttgagggacct

SEQ ID NO: 9379831 - DNA, 22 bp, Homo sapiens
caggccctgccttggcatgtgt

SEQ ID NO: 9379832 - DNA, 22 bp, Homo sapiens
caggccctgccttggcatgtgt

SEQ ID NO: 9379833 - DNA, 22 bp, Homo sapiens
caggccctgccttggcatgtgt

SEQ ID NO: 9379834 - DNA, 22 bp, Homo sapiens
caggctccttcccagggatggt

SEQ ID NO: 9379835 - DNA, 22 bp, Homo sapiens
caggctcggaagtgctggcttt

SEQ ID NO: 9379836 - DNA, 21 bp, Homo sapiens
caggctctgctagaggagcct

SEQ ID NO: 9379837 - DNA, 22 bp, Homo sapiens
caggctctaggttagtaggaga

SEQ ID NO: 9379838 - DNA, 22 bp, Homo sapiens
caggctctaggttagtaggaga

SEQ ID NO: 9379839 - DNA, 22 bp, Homo sapiens
caggctctaggttagtaggaga

SEQ ID NO: 9379840 - DNA, 22 bp, Homo sapiens
caggctcggtccagtggcaccc

SEQ ID NO: 9379841 - DNA, 17 bp, Homo sapiens
caggctccttccagatt

SEQ ID NO: 9379842 - DNA, 22 bp, Homo sapiens
caggctccttatcttacaactt

SEQ ID NO: 9379843 - DNA, 22 bp, Homo sapiens
caggctcctcactcatgctccc

SEQ ID NO: 9379844 - DNA, 20 bp, Homo sapiens
caggctccgcaggactaggg

SEQ ID NO: 9379845 - DNA, 20 bp, Homo sapiens
caggctccgcaggactaggg

SEQ ID NO: 9379846 - DNA, 23 bp, Homo sapiens
caggctcccggaccaggatccgc

SEQ ID NO: 9379847 - DNA, 22 bp, Homo sapiens
caggctcccgctccactgggca

SEQ ID NO: 9379848 - DNA, 22 bp, Homo sapiens
caggctcccgctccactgggca

SEQ ID NO: 9379849 - DNA, 23 bp, Homo sapiens
caggctcccggaccaggatccgc

SEQ ID NO: 9379850 - DNA, 22 bp, Homo sapiens
caggctccctaagtcagcagcc

SEQ ID NO: 9379851 - DNA, 22 bp, Homo sapiens
caggctccctaagtcagcagcc

SEQ ID NO: 9379852 - DNA, 22 bp, Homo sapiens
caggctccctgcaggccagtga

SEQ ID NO: 9379853 - DNA, 22 bp, Homo sapiens
caggctcccttctcggaattct

SEQ ID NO: 9379854 - DNA, 20 bp, Homo sapiens
caggctccgcaggactaggg

SEQ ID NO: 9379855 - DNA, 22 bp, Homo sapiens
caggctccctgggcagtggcag

SEQ ID NO: 9379856 - DNA, 22 bp, Homo sapiens
caggctccctgggcagtggcag

SEQ ID NO: 9379857 - DNA, 22 bp, Homo sapiens
caggctccctgcaggccagtga

SEQ ID NO: 9379858 - DNA, 22 bp, Homo sapiens
caggctccctgcaggccagtga

SEQ ID NO: 9379859 - DNA, 22 bp, Homo sapiens
caggctccctgggcagtggcag

SEQ ID NO: 9379860 - DNA, 22 bp, Homo sapiens
caggctccctgccagggccggc

SEQ ID NO: 9379861 - DNA, 22 bp, Homo sapiens
caggctccctgccagggccggc

SEQ ID NO: 9379862 - DNA, 22 bp, Homo sapiens
tacagtttcccagcagatgcaa

SEQ ID NO: 9379863 - DNA, 22 bp, Homo sapiens
tacagtttagaaccatagatgg

SEQ ID NO: 9379864 - DNA, 22 bp, Homo sapiens
tacagtttctcattatgctctc

SEQ ID NO: 9379865 - DNA, 22 bp, Homo sapiens
tacagtttcccagcagatgcaa

SEQ ID NO: 9379866 - DNA, 22 bp, Homo sapiens
tacagtttcccagcagatgcaa

SEQ ID NO: 9379867 - DNA, 22 bp, Homo sapiens
tacagtttaacactttggagaa

SEQ ID NO: 9379868 - DNA, 22 bp, Homo sapiens
tacagtttacatgagaggaagc

SEQ ID NO: 9379869 - DNA, 22 bp, Homo sapiens
tacagtttacatgagaggaagc

SEQ ID NO: 9379870 - DNA, 22 bp, Homo sapiens
tacagttctagtcaaaaatcac

SEQ ID NO: 9379871 - DNA, 22 bp, Homo sapiens
tacagttatatgtgataagtaa

SEQ ID NO: 9379872 - DNA, 23 bp, Homo sapiens
tacagttatgttcctgggtcact

SEQ ID NO: 9379873 - DNA, 22 bp, Homo sapiens
caggctcaaggctgacttccat

SEQ ID NO: 9379874 - DNA, 22 bp, Homo sapiens
caggctcaatggccacttgggc

SEQ ID NO: 9379875 - DNA, 22 bp, Homo sapiens
caggctcaatggccacttgggc

SEQ ID NO: 9379876 - DNA, 22 bp, Homo sapiens
tacagtttgtatggtcaggaat

SEQ ID NO: 9379877 - DNA, 22 bp, Homo sapiens
tacagtttctgtccttgtggag

SEQ ID NO: 9379878 - DNA, 22 bp, Homo sapiens
caggctccagcttcctgctcag

SEQ ID NO: 9379879 - DNA, 22 bp, Homo sapiens
caggctcccacaagctcccagc

SEQ ID NO: 9379880 - DNA, 22 bp, Homo sapiens
caggctccattaatcatcctgc

SEQ ID NO: 9379881 - DNA, 22 bp, Homo sapiens
caggctcccaccctcctgcagc

SEQ ID NO: 9379882 - DNA, 22 bp, Homo sapiens
caggctcccgctccactgggca

SEQ ID NO: 9379883 - DNA, 22 bp, Homo sapiens
caggctcccgaaatcacccatg

SEQ ID NO: 9379884 - DNA, 22 bp, Homo sapiens
caggctcccacttggcttaaag

SEQ ID NO: 9379885 - DNA, 22 bp, Homo sapiens
caggccttagtaggtgctccct

SEQ ID NO: 9379886 - DNA, 22 bp, Homo sapiens
caggccttgaaggcctgcggga

SEQ ID NO: 9379887 - DNA, 22 bp, Homo sapiens
caggccttgggacccagactgg

SEQ ID NO: 9379888 - DNA, 22 bp, Homo sapiens
caggccttgcgtcccatggcct

SEQ ID NO: 9379889 - DNA, 22 bp, Homo sapiens
caggccttgcgtcccatggcct

SEQ ID NO: 9379890 - DNA, 22 bp, Homo sapiens
caggcctgtgagttgaggcccc

SEQ ID NO: 9379891 - DNA, 22 bp, Homo sapiens
caggcctgtgagttgaggcccc

SEQ ID NO: 9379892 - DNA, 22 bp, Homo sapiens
caggcctgtgagttgaggcccc

SEQ ID NO: 9379893 - DNA, 22 bp, Homo sapiens
caggcctgtgacaccgtgtctg

SEQ ID NO: 9379894 - DNA, 22 bp, Homo sapiens
caggcctgtgacaccgtgtctg

SEQ ID NO: 9379895 - DNA, 22 bp, Homo sapiens
caggcctgtgagttgaggcccc

SEQ ID NO: 9379896 - DNA, 22 bp, Homo sapiens
caggcctgtctgcacatgaggc

SEQ ID NO: 9379897 - DNA, 22 bp, Homo sapiens
caggcctggagtgcaatggcac

SEQ ID NO: 9379898 - DNA, 22 bp, Homo sapiens
caggcctggagtgcaatggcac

SEQ ID NO: 9379899 - DNA, 22 bp, Homo sapiens
caggcctggagtgcaatggcac

SEQ ID NO: 9379900 - DNA, 22 bp, Homo sapiens
caggcctggagtgcaatggcac

SEQ ID NO: 9379901 - DNA, 22 bp, Homo sapiens
tacagcctcttccctggagtgg

SEQ ID NO: 9379902 - DNA, 22 bp, Homo sapiens
tacagctccaaaaatcactgtt

SEQ ID NO: 9379903 - DNA, 22 bp, Homo sapiens
tacagctcagaacctcactgtc

SEQ ID NO: 9379904 - DNA, 22 bp, Homo sapiens
tacagctaggcaaaaatgacat

SEQ ID NO: 9379905 - DNA, 22 bp, Homo sapiens
tacagccatggttaatttacct

SEQ ID NO: 9379906 - DNA, 22 bp, Homo sapiens
tacagccacaggtgactctcat

SEQ ID NO: 9379907 - DNA, 22 bp, Homo sapiens
tacagcattttgtagagtacta

SEQ ID NO: 9379908 - DNA, 22 bp, Homo sapiens
tacagcatatacagaatgaaca

SEQ ID NO: 9379909 - DNA, 22 bp, Homo sapiens
tacagcatgatcacaatggaaa

SEQ ID NO: 9379910 - DNA, 22 bp, Homo sapiens
tacagagacccacaagagactg

SEQ ID NO: 9379911 - DNA, 22 bp, Homo sapiens
tacagagagataagtgtaaaag

SEQ ID NO: 9379912 - DNA, 22 bp, Homo sapiens
tacagagagaggggttaccagg

SEQ ID NO: 9379913 - DNA, 22 bp, Homo sapiens
tagttttacttgcgatgataat

SEQ ID NO: 9379914 - DNA, 22 bp, Homo sapiens
tagtttgagaattgaaatagaa

SEQ ID NO: 9379915 - DNA, 22 bp, Homo sapiens
tagttttacatcagccattgtt

SEQ ID NO: 9379916 - DNA, 22 bp, Homo sapiens
tagtgtgtccctggggagtgtt

SEQ ID NO: 9379917 - DNA, 22 bp, Homo sapiens
tagtgttaattcagtttataat

SEQ ID NO: 9379918 - DNA, 22 bp, Homo sapiens
tagtgtggccccaagaggatct

SEQ ID NO: 9379919 - DNA, 22 bp, Homo sapiens
tagtgtggtatcttctatggaa

SEQ ID NO: 9379920 - DNA, 22 bp, Homo sapiens
tagtgtcttcaggagatatgag

SEQ ID NO: 9379921 - DNA, 22 bp, Homo sapiens
tagtgtcttccaggacatggta

SEQ ID NO: 9379922 - DNA, 22 bp, Homo sapiens
tagtgtctgacatttaagagca

SEQ ID NO: 9379923 - DNA, 22 bp, Homo sapiens
tagtgtctgatccgtagttaca

SEQ ID NO: 9379924 - DNA, 22 bp, Homo sapiens
tagtgtctgttgcttttgttca

SEQ ID NO: 9379925 - DNA, 21 bp, Homo sapiens
tagtgtcttaagagccttgca

SEQ ID NO: 9379926 - DNA, 22 bp, Homo sapiens
tagtgtctgtccatcagtaact

SEQ ID NO: 9379927 - DNA, 22 bp, Homo sapiens
tagtgtctgtccatcagtaact

SEQ ID NO: 9379928 - DNA, 22 bp, Homo sapiens
tatatagaaaagcagatgttgg

SEQ ID NO: 9379929 - DNA, 22 bp, Homo sapiens
tatatagaaaagcagatgttgg

SEQ ID NO: 9379930 - DNA, 20 bp, Homo sapiens
tatataggaaatattgtgtt

SEQ ID NO: 9379931 - DNA, 19 bp, Homo sapiens
tatatagatgtgtgtgtat

SEQ ID NO: 9379932 - DNA, 19 bp, Homo sapiens
tatatagatgtgtgtgtat

SEQ ID NO: 9379933 - DNA, 22 bp, Homo sapiens
tatatagctaaaagagatattg

SEQ ID NO: 9379934 - DNA, 22 bp, Homo sapiens
tatatacaaggtaggtttaggt

SEQ ID NO: 9379935 - DNA, 22 bp, Homo sapiens
tatatacaaggtaggtttaggt

SEQ ID NO: 9379936 - DNA, 22 bp, Homo sapiens
tatatacttttgtaagttggct

SEQ ID NO: 9379937 - DNA, 22 bp, Homo sapiens
tatatactttcttcctgggtag

SEQ ID NO: 9379938 - DNA, 22 bp, Homo sapiens
tatatatatgcacacacaccta

SEQ ID NO: 9379939 - DNA, 22 bp, Homo sapiens
tatatatatgcacacacaccta

SEQ ID NO: 9379940 - DNA, 22 bp, Homo sapiens
tatatatatgcacacacaccta

SEQ ID NO: 9379941 - DNA, 22 bp, Homo sapiens
tatataactactattttgctca

SEQ ID NO: 9379942 - DNA, 21 bp, Homo sapiens
tatacatgtgcacacacatgc

SEQ ID NO: 9379943 - DNA, 21 bp, Homo sapiens
tatacatgtgtgcatacgtgt

SEQ ID NO: 9379944 - DNA, 22 bp, Homo sapiens
tagttttagcagcaatgggatg

SEQ ID NO: 9379945 - DNA, 22 bp, Homo sapiens
tatataattttctgccatatcc

SEQ ID NO: 9379946 - DNA, 22 bp, Homo sapiens
tatataattttctgccatatcc

SEQ ID NO: 9379947 - DNA, 22 bp, Homo sapiens
tatatacaaggtaggtttaggt

SEQ ID NO: 9379948 - DNA, 22 bp, Homo sapiens
tatataattttctgccatatcc

SEQ ID NO: 9379949 - DNA, 22 bp, Homo sapiens
tatataattttctgccatatcc

SEQ ID NO: 9379950 - DNA, 22 bp, Homo sapiens
tatataattttctgccatatcc

SEQ ID NO: 9379951 - DNA, 22 bp, Homo sapiens
tatatacaaggtaggtttaggt

SEQ ID NO: 9379952 - DNA, 22 bp, Homo sapiens
cagggccaccctctgctgggtg

SEQ ID NO: 9379953 - DNA, 22 bp, Homo sapiens
cagggccaccctctgctgggtg

SEQ ID NO: 9379954 - DNA, 21 bp, Homo sapiens
cagggccaatcctgacctcta

SEQ ID NO: 9379955 - DNA, 22 bp, Homo sapiens
cagggccaagttggtgcctttt

SEQ ID NO: 9379956 - DNA, 22 bp, Homo sapiens
cagggccaagctgcagcatctg

SEQ ID NO: 9379957 - DNA, 21 bp, Homo sapiens
cagggccaatcctgacctcta

SEQ ID NO: 9379958 - DNA, 22 bp, Homo sapiens
tagtaacttttgttataaatca

SEQ ID NO: 9379959 - DNA, 22 bp, Homo sapiens
tagtaacaacaactagcatttt

SEQ ID NO: 9379960 - DNA, 22 bp, Homo sapiens
tagtaaatctcagaaaaagatc

SEQ ID NO: 9379961 - DNA, 22 bp, Homo sapiens
tagtaaatacacagtggaaaaa

SEQ ID NO: 9379962 - DNA, 22 bp, Homo sapiens
taggtatacagagatttctggg

SEQ ID NO: 9379963 - DNA, 17 bp, Homo sapiens
tagtaaatgagtagagc

SEQ ID NO: 9379964 - DNA, 22 bp, Homo sapiens
tagtaaattaaaatattgactt

SEQ ID NO: 9379965 - DNA, 22 bp, Homo sapiens
cagggctggatcctccagactc

SEQ ID NO: 9379966 - DNA, 22 bp, Homo sapiens
cagggctggatcctccagactc

SEQ ID NO: 9379967 - DNA, 22 bp, Homo sapiens
cagggctggatcctccagactc

SEQ ID NO: 9379968 - DNA, 22 bp, Homo sapiens
cagggctgctggccgtgccctc

SEQ ID NO: 9379969 - DNA, 22 bp, Homo sapiens
cagggctgctggccgtgccctc

SEQ ID NO: 9379970 - DNA, 22 bp, Homo sapiens
cagggctgctggccgtgccctc

SEQ ID NO: 9379971 - DNA, 22 bp, Homo sapiens
tagtgattgctgatattccatt

SEQ ID NO: 9379972 - DNA, 23 bp, Homo sapiens
tagtgattggaaaaactagtttt

SEQ ID NO: 9379973 - DNA, 22 bp, Homo sapiens
tagtgatttaagaaaggtgact

SEQ ID NO: 9379974 - DNA, 22 bp, Homo sapiens
tagtgatttaatggcaagagga

SEQ ID NO: 9379975 - DNA, 22 bp, Homo sapiens
tagtgatttccatttcagggtt

SEQ ID NO: 9379976 - DNA, 22 bp, Homo sapiens
tagtgatttagaattcaaatgt

SEQ ID NO: 9379977 - DNA, 22 bp, Homo sapiens
tagtgatttcagtgggttttgc

SEQ ID NO: 9379978 - DNA, 22 bp, Homo sapiens
tagtgattctgatgtaagacaa

SEQ ID NO: 9379979 - DNA, 22 bp, Homo sapiens
tagtgattctgtgagcctttac

SEQ ID NO: 9379980 - DNA, 22 bp, Homo sapiens
tagtgtctcggggcccaggatt

SEQ ID NO: 9379981 - DNA, 22 bp, Homo sapiens
tagtgtctcttcctgtttgaaa

SEQ ID NO: 9379982 - DNA, 22 bp, Homo sapiens
tagtgtctgaatgcacctgttt

SEQ ID NO: 9379983 - DNA, 22 bp, Homo sapiens
tagtgattttctgtttccatca

SEQ ID NO: 9379984 - DNA, 22 bp, Homo sapiens
tagtgattttcatattacatta

SEQ ID NO: 9379985 - DNA, 22 bp, Homo sapiens
tagtgtctagtgagtttgatgc

SEQ ID NO: 9379986 - DNA, 22 bp, Homo sapiens
tagtgtctattgaccggaaaga

SEQ ID NO: 9379987 - DNA, 22 bp, Homo sapiens
tagtacaactcacttgatttta

SEQ ID NO: 9379988 - DNA, 22 bp, Homo sapiens
cagggctgagaatttagagaca

SEQ ID NO: 9379989 - DNA, 22 bp, Homo sapiens
cagggctgagaatttagagaca

SEQ ID NO: 9379990 - DNA, 22 bp, Homo sapiens
cagggctgaggacacaagtaaa

SEQ ID NO: 9379991 - DNA, 22 bp, Homo sapiens
cagggctgaggacacaagtaaa

SEQ ID NO: 9379992 - DNA, 22 bp, Homo sapiens
cagggctgagtcatatagcctt

SEQ ID NO: 9379993 - DNA, 22 bp, Homo sapiens
cagggctgagtcatatagcctt

SEQ ID NO: 9379994 - DNA, 22 bp, Homo sapiens
cagggctgagtcatatagcctt

SEQ ID NO: 9379995 - DNA, 22 bp, Homo sapiens
cagggctgctggccgtgccctc

SEQ ID NO: 9379996 - DNA, 22 bp, Homo sapiens
tatgtacatcgttgaattcaaa

SEQ ID NO: 9379997 - DNA, 22 bp, Homo sapiens
caggtggggcgccctcaggcag

SEQ ID NO: 9379998 - DNA, 22 bp, Homo sapiens
caggtggggcgccctcaggcag

SEQ ID NO: 9379999 - DNA, 22 bp, Homo sapiens
caggtggggcgccctcaggcag

SEQ ID NO: 9380000 - DNA, 22 bp, Homo sapiens
caggtggggcagctgtgggagc

SEQ ID NO: 9380001 - DNA, 22 bp, Homo sapiens
caggtggggcgccctcaggcag

SEQ ID NO: 9380002 - DNA, 22 bp, Homo sapiens
caggtggggcgccctcaggcag

SEQ ID NO: 9380003 - DNA, 22 bp, Homo sapiens
caggtggggagagtgtggagca

SEQ ID NO: 9380004 - DNA, 22 bp, Homo sapiens
caggtggggagagtgtggagca

SEQ ID NO: 9380005 - DNA, 22 bp, Homo sapiens
caggtggggagagtgtggagca

SEQ ID NO: 9380006 - DNA, 22 bp, Homo sapiens
caggtgggcttgggagaacact

SEQ ID NO: 9380007 - DNA, 22 bp, Homo sapiens
caggtgggcttgggagaacact

SEQ ID NO: 9380008 - DNA, 22 bp, Homo sapiens
caggtgggcgtggcgagaaggc

SEQ ID NO: 9380009 - DNA, 22 bp, Homo sapiens
caggtgggcgtggcgagaaggc

SEQ ID NO: 9380010 - DNA, 22 bp, Homo sapiens
caggtggcttattagggtcagt

SEQ ID NO: 9380011 - DNA, 22 bp, Homo sapiens
cagtaaaagatggaaatagaat

SEQ ID NO: 9380012 - DNA, 22 bp, Homo sapiens
cagtaaaagatggaaatagaat

SEQ ID NO: 9380013 - DNA, 22 bp, Homo sapiens
cagtaattccaagtgcttatac

SEQ ID NO: 9380014 - DNA, 22 bp, Homo sapiens
tatgtacatggagagcaattga

SEQ ID NO: 9380015 - DNA, 22 bp, Homo sapiens
tatgtacatggagagcaattga

SEQ ID NO: 9380016 - DNA, 22 bp, Homo sapiens
tatgtacatggagagcaattga

SEQ ID NO: 9380017 - DNA, 22 bp, Homo sapiens
cagtaaaagatggaaatagaat

SEQ ID NO: 9380018 - DNA, 22 bp, Homo sapiens
cagtaaaaatgttgtcaaggca

SEQ ID NO: 9380019 - DNA, 22 bp, Homo sapiens
tatgtacatgatttcatttgct

SEQ ID NO: 9380020 - DNA, 22 bp, Homo sapiens
tatgtacatgatttcatttgct

SEQ ID NO: 9380021 - DNA, 22 bp, Homo sapiens
tatgtacatgatttcatttgct

SEQ ID NO: 9380022 - DNA, 22 bp, Homo sapiens
tatgtacatcttgagcaatgaa

SEQ ID NO: 9380023 - DNA, 22 bp, Homo sapiens
tatgtacatcttgagcaatgaa

SEQ ID NO: 9380024 - DNA, 22 bp, Homo sapiens
tatgtacatcgttgaattcaaa

SEQ ID NO: 9380025 - DNA, 22 bp, Homo sapiens
tatgtacatcgttgaattcaaa

SEQ ID NO: 9380026 - DNA, 22 bp, Homo sapiens
tatgtacatcgttgaattcaaa

SEQ ID NO: 9380027 - DNA, 22 bp, Homo sapiens
tatattcttaccagtgtatgta

SEQ ID NO: 9380028 - DNA, 22 bp, Homo sapiens
tatattcttaccagtgtatgta

SEQ ID NO: 9380029 - DNA, 22 bp, Homo sapiens
tatattgaccagtacaattggt

SEQ ID NO: 9380030 - DNA, 22 bp, Homo sapiens
tatattgtagctgatgacaaat

SEQ ID NO: 9380031 - DNA, 22 bp, Homo sapiens
tatattgtaggtgctatttgaa

SEQ ID NO: 9380032 - DNA, 22 bp, Homo sapiens
tatctgtagtcagaataatttt

SEQ ID NO: 9380033 - DNA, 18 bp, Homo sapiens
tatattctgtgccctggt

SEQ ID NO: 9380034 - DNA, 22 bp, Homo sapiens
tatattctgattccatctgtgt

SEQ ID NO: 9380035 - DNA, 22 bp, Homo sapiens
tatattctgattccatctgtgt

SEQ ID NO: 9380036 - DNA, 22 bp, Homo sapiens
tatgaactgtgagtgtgatggg

SEQ ID NO: 9380037 - DNA, 22 bp, Homo sapiens
tatgaactgctcttgtgttttg

SEQ ID NO: 9380038 - DNA, 23 bp, Homo sapiens
tatgaactgcattgctggtgtgt

SEQ ID NO: 9380039 - DNA, 22 bp, Homo sapiens
tatgaacattttggtatatatg

SEQ ID NO: 9380040 - DNA, 22 bp, Homo sapiens
tatgaacatgctgtggttataa

SEQ ID NO: 9380041 - DNA, 22 bp, Homo sapiens
tatgcacaatatgatctatttg

SEQ ID NO: 9380042 - DNA, 22 bp, Homo sapiens
tatgatgtgtacctaagtcacc

SEQ ID NO: 9380043 - DNA, 22 bp, Homo sapiens
tatgatttgtagacatttgatt

SEQ ID NO: 9380044 - DNA, 22 bp, Homo sapiens
tatgatatgcactttatcagaa

SEQ ID NO: 9380045 - DNA, 22 bp, Homo sapiens
tatgaagatatatctgatctct

SEQ ID NO: 9380046 - DNA, 22 bp, Homo sapiens
tatgatattctaaattgacacc

SEQ ID NO: 9380047 - DNA, 22 bp, Homo sapiens
tattccaactgtcatagtcata

SEQ ID NO: 9380048 - DNA, 22 bp, Homo sapiens
cagtagcaggcaggtgcttttg

SEQ ID NO: 9380049 - DNA, 22 bp, Homo sapiens
cagtagcatgcaccaggagggt

SEQ ID NO: 9380050 - DNA, 22 bp, Homo sapiens
tattccaattggttgtaaagaa

SEQ ID NO: 9380051 - DNA, 22 bp, Homo sapiens
tattccaattggttgtaaagaa

SEQ ID NO: 9380052 - DNA, 20 bp, Homo sapiens
tcaaagcactgcctgtcatc

SEQ ID NO: 9380053 - DNA, 21 bp, Homo sapiens
tcaaagcacatatttgcacat

SEQ ID NO: 9380054 - DNA, 22 bp, Homo sapiens
tcaaaacccagccatcaggact

SEQ ID NO: 9380055 - DNA, 22 bp, Homo sapiens
tcaaaacctaggctctctgctt

SEQ ID NO: 9380056 - DNA, 22 bp, Homo sapiens
tattcctaatttgcagggcatg

SEQ ID NO: 9380057 - DNA, 20 bp, Homo sapiens
tcaaaggcaaaggtgggtgt

SEQ ID NO: 9380058 - DNA, 22 bp, Homo sapiens
cagtctttgttcccattactga

SEQ ID NO: 9380059 - DNA, 22 bp, Homo sapiens
cagtctttgttcccattactga

SEQ ID NO: 9380060 - DNA, 22 bp, Homo sapiens
cagtctttgttcccattactga

SEQ ID NO: 9380061 - DNA, 22 bp, Homo sapiens
tcaaattagtggaataataatg

SEQ ID NO: 9380062 - DNA, 22 bp, Homo sapiens
tcaaattagtggaataataatg

SEQ ID NO: 9380063 - DNA, 22 bp, Homo sapiens
tcaaattagtggaataataatg

SEQ ID NO: 9380064 - DNA, 22 bp, Homo sapiens
tcaaattctattctatactcag

SEQ ID NO: 9380065 - DNA, 22 bp, Homo sapiens
tcaaattttaacatgcattaga

SEQ ID NO: 9380066 - DNA, 22 bp, Homo sapiens
tcaaattgtcatcttgataatg

SEQ ID NO: 9380067 - DNA, 22 bp, Homo sapiens
cagtctgtttctgagaaacaga

SEQ ID NO: 9380068 - DNA, 22 bp, Homo sapiens
cagtctgtaatgggttttaaaa

SEQ ID NO: 9380069 - DNA, 22 bp, Homo sapiens
cagtctggcacagcacactgaa

SEQ ID NO: 9380070 - DNA, 22 bp, Homo sapiens
cagtctggcacagcacactgaa

SEQ ID NO: 9380071 - DNA, 22 bp, Homo sapiens
cagtctggaggtcagctggctt

SEQ ID NO: 9380072 - DNA, 22 bp, Homo sapiens
cagtctggactcaggcatacct

SEQ ID NO: 9380073 - DNA, 23 bp, Homo sapiens
cagtctctccccggacagcaaaa

SEQ ID NO: 9380074 - DNA, 22 bp, Homo sapiens
cagtctctcagctttcagctgt

SEQ ID NO: 9380075 - DNA, 22 bp, Homo sapiens
cagtctctaaatcaatctgaat

SEQ ID NO: 9380076 - DNA, 22 bp, Homo sapiens
cagtctctcagctttcagctgt

SEQ ID NO: 9380077 - DNA, 22 bp, Homo sapiens
cagtccctgggggagtcaccag

SEQ ID NO: 9380078 - DNA, 22 bp, Homo sapiens
cagtcccatctcccaggtggct

SEQ ID NO: 9380079 - DNA, 22 bp, Homo sapiens
cagtcccatctcccaggtggct

SEQ ID NO: 9380080 - DNA, 22 bp, Homo sapiens
cagtcccagctgctcagaaggc

SEQ ID NO: 9380081 - DNA, 22 bp, Homo sapiens
cagtgcaggtttagggctgggg

SEQ ID NO: 9380082 - DNA, 22 bp, Homo sapiens
cagtgcagtcaaggaagaacca

SEQ ID NO: 9380083 - DNA, 22 bp, Homo sapiens
cagtgcagttggtggcaggggt

SEQ ID NO: 9380084 - DNA, 22 bp, Homo sapiens
cagtgcagttggtggcaggggt

SEQ ID NO: 9380085 - DNA, 22 bp, Homo sapiens
cagtgcagttggtggcaggggt

SEQ ID NO: 9380086 - DNA, 22 bp, Homo sapiens
cagtgcagttggtggcaggggt

SEQ ID NO: 9380087 - DNA, 22 bp, Homo sapiens
cagtgcaggtttagggctgggg

SEQ ID NO: 9380088 - DNA, 22 bp, Homo sapiens
cagtgcaggtttagggctgggg

SEQ ID NO: 9380089 - DNA, 22 bp, Homo sapiens
cagtgcaggtggcagaggacag

SEQ ID NO: 9380090 - DNA, 22 bp, Homo sapiens
cagtgcaggtggcagaggacag

SEQ ID NO: 9380091 - DNA, 20 bp, Homo sapiens
tcacacatggtaagctatga

SEQ ID NO: 9380092 - DNA, 22 bp, Homo sapiens
tcacacatgtaagggctttgga

SEQ ID NO: 9380093 - DNA, 22 bp, Homo sapiens
cagtgcatagatcctgaggcct

SEQ ID NO: 9380094 - DNA, 20 bp, Homo sapiens
tcacacatggtaagctatga

SEQ ID NO: 9380095 - DNA, 22 bp, Homo sapiens
cagtgcagtttcccagatgctg

SEQ ID NO: 9380096 - DNA, 22 bp, Homo sapiens
cagtgcagtttcccagatgctg

SEQ ID NO: 9380097 - DNA, 22 bp, Homo sapiens
tcacacatttctcaagtgtagg

SEQ ID NO: 9380098 - DNA, 22 bp, Homo sapiens
tcacacatttgaaggcctgtca

SEQ ID NO: 9380099 - DNA, 22 bp, Homo sapiens
tcacacatttgaaggcctgtca

SEQ ID NO: 9380100 - DNA, 16 bp, Homo sapiens
tcacacatttgttggt

SEQ ID NO: 9380101 - DNA, 22 bp, Homo sapiens
tcacacatttctcaagtgtagg

SEQ ID NO: 9380102 - DNA, 22 bp, Homo sapiens
tcacacattgttgcttaagttg

SEQ ID NO: 9380103 - DNA, 22 bp, Homo sapiens
tcacacattgttgcttaagttg

SEQ ID NO: 9380104 - DNA, 22 bp, Homo sapiens
tcacacatgtaagggctttgga

SEQ ID NO: 9380105 - DNA, 22 bp, Homo sapiens
tcacacattctaggtatgttga

SEQ ID NO: 9380106 - DNA, 22 bp, Homo sapiens
tcacacattctaggtatgttga

SEQ ID NO: 9380107 - DNA, 22 bp, Homo sapiens
tcacacattgttgcttaagttg

SEQ ID NO: 9380108 - DNA, 22 bp, Homo sapiens
tcacaccttgctggctgagtgc

SEQ ID NO: 9380109 - DNA, 23 bp, Homo sapiens
tcacactggatacacatgcaaga

SEQ ID NO: 9380110 - DNA, 23 bp, Homo sapiens
tcacactggatacacatgcaaga

SEQ ID NO: 9380111 - DNA, 22 bp, Homo sapiens
tcacactggcagtgctgaaggc

SEQ ID NO: 9380112 - DNA, 19 bp, Homo sapiens
cagtggagattggaggagg

SEQ ID NO: 9380113 - DNA, 19 bp, Homo sapiens
cagtggagattggaggagg

SEQ ID NO: 9380114 - DNA, 19 bp, Homo sapiens
cagtggagattggaggagg

SEQ ID NO: 9380115 - DNA, 19 bp, Homo sapiens
cagtggagattggaggagg

SEQ ID NO: 9380116 - DNA, 22 bp, Homo sapiens
cagtgctgttgtaagctcattg

SEQ ID NO: 9380117 - DNA, 22 bp, Homo sapiens
cagtgctgttgtaagctcattg

SEQ ID NO: 9380118 - DNA, 22 bp, Homo sapiens
tcacactgtgaagagacaagca

SEQ ID NO: 9380119 - DNA, 22 bp, Homo sapiens
cagtggagtgggactggtctga

SEQ ID NO: 9380120 - DNA, 22 bp, Homo sapiens
cagtggatggtttgtcttgcct

SEQ ID NO: 9380121 - DNA, 22 bp, Homo sapiens
cagtggatgatttggctgctag

SEQ ID NO: 9380122 - DNA, 22 bp, Homo sapiens
cagtggaggctcaagtgtgctt

SEQ ID NO: 9380123 - DNA, 22 bp, Homo sapiens
cagtggaggctcaagtgtgctt

SEQ ID NO: 9380124 - DNA, 22 bp, Homo sapiens
cagtggagtgggactggtctga

SEQ ID NO: 9380125 - DNA, 22 bp, Homo sapiens
cagtggaggccttgggaccttt

SEQ ID NO: 9380126 - DNA, 19 bp, Homo sapiens
cagtggagattggaggagg

SEQ ID NO: 9380127 - DNA, 22 bp, Homo sapiens
cagtggaggctcaagtgtgctt

SEQ ID NO: 9380128 - DNA, 22 bp, Homo sapiens
cagtggattagccagagctgga

SEQ ID NO: 9380129 - DNA, 22 bp, Homo sapiens
cagtggcaagaacagtaataat

SEQ ID NO: 9380130 - DNA, 22 bp, Homo sapiens
cagtggattaaggagggcagct

SEQ ID NO: 9380131 - DNA, 22 bp, Homo sapiens
cagtggattagccagagctgga

SEQ ID NO: 9380132 - DNA, 22 bp, Homo sapiens
cagtggcaagtccggtattgaa

SEQ ID NO: 9380133 - DNA, 22 bp, Homo sapiens
cagtggcaaggacagtaataat

SEQ ID NO: 9380134 - DNA, 22 bp, Homo sapiens
cagtggcaatgggacagagcac

SEQ ID NO: 9380135 - DNA, 22 bp, Homo sapiens
cagtggcaatgggacagagcac

SEQ ID NO: 9380136 - DNA, 22 bp, Homo sapiens
cagtggcaagtccggtattgaa

SEQ ID NO: 9380137 - DNA, 22 bp, Homo sapiens
tcacatgcttgaggaaagaaaa

SEQ ID NO: 9380138 - DNA, 22 bp, Homo sapiens
tcacatgtatatgcagcacagc

SEQ ID NO: 9380139 - DNA, 22 bp, Homo sapiens
cagtggtttaggtcaaggggag

SEQ ID NO: 9380140 - DNA, 22 bp, Homo sapiens
cagtggttgtcagcaacaatat

SEQ ID NO: 9380141 - DNA, 22 bp, Homo sapiens
cagtggtttaggtcaaggggag

SEQ ID NO: 9380142 - DNA, 22 bp, Homo sapiens
cagtggttggtagatacttgag

SEQ ID NO: 9380143 - DNA, 22 bp, Homo sapiens
cagtggttgcttgcatggctcc

SEQ ID NO: 9380144 - DNA, 22 bp, Homo sapiens
cagtggttggtagatacttgag

SEQ ID NO: 9380145 - DNA, 22 bp, Homo sapiens
cagtgggtgaaagatggctaag

SEQ ID NO: 9380146 - DNA, 22 bp, Homo sapiens
cagtgggtgagaggaaaagctt

SEQ ID NO: 9380147 - DNA, 21 bp, Homo sapiens
cagtggttgctgaattagtgg

SEQ ID NO: 9380148 - DNA, 22 bp, Homo sapiens
cagtgggtcctgcgtctgccag

SEQ ID NO: 9380149 - DNA, 22 bp, Homo sapiens
cagtggcaggatttcagctcag

SEQ ID NO: 9380150 - DNA, 17 bp, Homo sapiens
cagtggcagatcttctc

SEQ ID NO: 9380151 - DNA, 22 bp, Homo sapiens
cagtggcaggatttcagctcag

SEQ ID NO: 9380152 - DNA, 22 bp, Homo sapiens
cagtggcagagccgttgccatc

SEQ ID NO: 9380153 - DNA, 22 bp, Homo sapiens
cagtggcagatcaccaactgga

SEQ ID NO: 9380154 - DNA, 22 bp, Homo sapiens
cagtggcagagaacagagacct

SEQ ID NO: 9380155 - DNA, 22 bp, Homo sapiens
cagtggcagagaacagagacct

SEQ ID NO: 9380156 - DNA, 22 bp, Homo sapiens
cagtggcacttgtcatttctga

SEQ ID NO: 9380157 - DNA, 22 bp, Homo sapiens
cagtggcagagaacagagacct

SEQ ID NO: 9380158 - DNA, 22 bp, Homo sapiens
cagtggcacccacgggctgggc

SEQ ID NO: 9380159 - DNA, 22 bp, Homo sapiens
cagtggcacccacgggctgggc

SEQ ID NO: 9380160 - DNA, 21 bp, Homo sapiens
cagtggcacgatttcggctca

SEQ ID NO: 9380161 - DNA, 22 bp, Homo sapiens
cagtggcacgatctcagctcac

SEQ ID NO: 9380162 - DNA, 22 bp, Homo sapiens
cagtggcacgatctcagctcac

SEQ ID NO: 9380163 - DNA, 22 bp, Homo sapiens
cagtggcaatgggacagagcac

SEQ ID NO: 9380164 - DNA, 22 bp, Homo sapiens
cagtggcaatgggacagagcac

SEQ ID NO: 9380165 - DNA, 22 bp, Homo sapiens
cagtggcacccacgggctgggc

SEQ ID NO: 9380166 - DNA, 22 bp, Homo sapiens
cagtggcacatggaccttgtca

SEQ ID NO: 9380167 - DNA, 22 bp, Homo sapiens
cagtggcaatgggacagagcac

SEQ ID NO: 9380168 - DNA, 22 bp, Homo sapiens
tcacatgtgtggcagtgcaagt

SEQ ID NO: 9380169 - DNA, 22 bp, Homo sapiens
tcacatgtcagaataagtgcat

SEQ ID NO: 9380170 - DNA, 22 bp, Homo sapiens
tcacatgtatatgcagcacagc

SEQ ID NO: 9380171 - DNA, 22 bp, Homo sapiens
tcactgcaacctccacctcctg

SEQ ID NO: 9380172 - DNA, 22 bp, Homo sapiens
tcactgcaacctccacctcctg

SEQ ID NO: 9380173 - DNA, 22 bp, Homo sapiens
tcactgcaacctccacctcctg

SEQ ID NO: 9380174 - DNA, 22 bp, Homo sapiens
tcactctgaatggtactgagga

SEQ ID NO: 9380175 - DNA, 22 bp, Homo sapiens
tcactcctcattgctgcccatt

SEQ ID NO: 9380176 - DNA, 22 bp, Homo sapiens
tcactcctcattgctgcccatt

SEQ ID NO: 9380177 - DNA, 22 bp, Homo sapiens
tcactcctcattgctgcccatt

SEQ ID NO: 9380178 - DNA, 22 bp, Homo sapiens
tccagggcagtgactacagcgg

SEQ ID NO: 9380179 - DNA, 22 bp, Homo sapiens
tccagggcagtgactacagcgg

SEQ ID NO: 9380180 - DNA, 22 bp, Homo sapiens
tccagggcaggtgctgggctct

SEQ ID NO: 9380181 - DNA, 22 bp, Homo sapiens
tccagggcaggtgctgggctct

SEQ ID NO: 9380182 - DNA, 23 bp, Homo sapiens
tccagggcagtggctgggtctgc

SEQ ID NO: 9380183 - DNA, 22 bp, Homo sapiens
tccagggcagtgactacagcgg

SEQ ID NO: 9380184 - DNA, 22 bp, Homo sapiens
tccagggcagggtgcgcatggg

SEQ ID NO: 9380185 - DNA, 22 bp, Homo sapiens
tccagggcagggtgcgcatggg

SEQ ID NO: 9380186 - DNA, 22 bp, Homo sapiens
tccagggcaggtgctgggctct

SEQ ID NO: 9380187 - DNA, 22 bp, Homo sapiens
cattacaaccccaaattacaaa

SEQ ID NO: 9380188 - DNA, 22 bp, Homo sapiens
cattaataaacatttcagaaga

SEQ ID NO: 9380189 - DNA, 22 bp, Homo sapiens
cattaatattgttcttctttag

SEQ ID NO: 9380190 - DNA, 22 bp, Homo sapiens
cattacaaacatgttaagattt

SEQ ID NO: 9380191 - DNA, 22 bp, Homo sapiens
cattacaaacatgttaagattt

SEQ ID NO: 9380192 - DNA, 22 bp, Homo sapiens
cattacaaagttataaacagtt

SEQ ID NO: 9380193 - DNA, 22 bp, Homo sapiens
cattacaaccccaaattacaaa

SEQ ID NO: 9380194 - DNA, 22 bp, Homo sapiens
cattacaaccccaaattacaaa

SEQ ID NO: 9380195 - DNA, 22 bp, Homo sapiens
tccagggcatggggagagagtg

SEQ ID NO: 9380196 - DNA, 22 bp, Homo sapiens
tccagggcatgctcagactcag

SEQ ID NO: 9380197 - DNA, 23 bp, Homo sapiens
tccagggcagtggctgggtctgc

SEQ ID NO: 9380198 - DNA, 23 bp, Homo sapiens
tccagggcagtggctgggtctgc

SEQ ID NO: 9380199 - DNA, 22 bp, Homo sapiens
tccagggcatggggagagagtg

SEQ ID NO: 9380200 - DNA, 22 bp, Homo sapiens
tccaggtcccagactgggcagc

SEQ ID NO: 9380201 - DNA, 22 bp, Homo sapiens
tccaggtccagaggttcaactg

SEQ ID NO: 9380202 - DNA, 22 bp, Homo sapiens
tccaggtaatttggatgctagt

SEQ ID NO: 9380203 - DNA, 22 bp, Homo sapiens
tccaggtcagacttctgtgccc

SEQ ID NO: 9380204 - DNA, 22 bp, Homo sapiens
tccagggtcagaagtcacatac

SEQ ID NO: 9380205 - DNA, 21 bp, Homo sapiens
tccagggtcagaagttcagtg

SEQ ID NO: 9380206 - DNA, 22 bp, Homo sapiens
tccagggtgtgtttactggggt

SEQ ID NO: 9380207 - DNA, 22 bp, Homo sapiens
tccagggttgtgggcttcagca

SEQ ID NO: 9380208 - DNA, 22 bp, Homo sapiens
tccagggttgtgggcttcagca

SEQ ID NO: 9380209 - DNA, 22 bp, Homo sapiens
tccaggcttcacgtctgccctc

SEQ ID NO: 9380210 - DNA, 22 bp, Homo sapiens
tccaggcttgagaccaggctct

SEQ ID NO: 9380211 - DNA, 22 bp, Homo sapiens
tccaggcttcacgtctgccctc

SEQ ID NO: 9380212 - DNA, 22 bp, Homo sapiens
tccaggcttcacgtctgccctc

SEQ ID NO: 9380213 - DNA, 22 bp, Homo sapiens
tccaggcttcacgtctgccctc

SEQ ID NO: 9380214 - DNA, 22 bp, Homo sapiens
tccaggctgtgcgcaccgtgtg

SEQ ID NO: 9380215 - DNA, 22 bp, Homo sapiens
tccaggctgggctgaagggtgc

SEQ ID NO: 9380216 - DNA, 22 bp, Homo sapiens
tccaggctcctgactttttggg

SEQ ID NO: 9380217 - DNA, 20 bp, Homo sapiens
tccaggctcctccacttagt

SEQ ID NO: 9380218 - DNA, 22 bp, Homo sapiens
tccaggctgtgcatgagtttag

SEQ ID NO: 9380219 - DNA, 22 bp, Homo sapiens
catgtacatgcatgggcactgt

SEQ ID NO: 9380220 - DNA, 22 bp, Homo sapiens
catgtacagtttttctgtcctg

SEQ ID NO: 9380221 - DNA, 22 bp, Homo sapiens
catgtacactcatgtaactata

SEQ ID NO: 9380222 - DNA, 23 bp, Homo sapiens
catgtacagagtttgataaagtg

SEQ ID NO: 9380223 - DNA, 22 bp, Homo sapiens
catgtacagccagggttgagaa

SEQ ID NO: 9380224 - DNA, 22 bp, Homo sapiens
catgtacagccagggttgagaa

SEQ ID NO: 9380225 - DNA, 23 bp, Homo sapiens
catgtacagagtttgataaagtg

SEQ ID NO: 9380226 - DNA, 23 bp, Homo sapiens
catgtacagagtttgataaagtg

SEQ ID NO: 9380227 - DNA, 23 bp, Homo sapiens
catgtacacacagctgtacagtg

SEQ ID NO: 9380228 - DNA, 23 bp, Homo sapiens
catgtacacacagctgtacagtg

SEQ ID NO: 9380229 - DNA, 23 bp, Homo sapiens
catgtacacacagctgtacagtg

SEQ ID NO: 9380230 - DNA, 23 bp, Homo sapiens
catgtacacacagctgtacagtg

SEQ ID NO: 9380231 - DNA, 22 bp, Homo sapiens
catgtacacacaaagggacaat

SEQ ID NO: 9380232 - DNA, 22 bp, Homo sapiens
catgtacaaggatgctcagagt

SEQ ID NO: 9380233 - DNA, 22 bp, Homo sapiens
tccaggctttttcatgctgtct

SEQ ID NO: 9380234 - DNA, 22 bp, Homo sapiens
tccaggctttggggcaggagcg

SEQ ID NO: 9380235 - DNA, 22 bp, Homo sapiens
tccaggcttgagaccaggctct

SEQ ID NO: 9380236 - DNA, 22 bp, Homo sapiens
tccaggctttggggcaggagcg

SEQ ID NO: 9380237 - DNA, 22 bp, Homo sapiens
tccaggcttgagaccaggctct

SEQ ID NO: 9380238 - DNA, 22 bp, Homo sapiens
tccaggcttgagaccaggctct

SEQ ID NO: 9380239 - DNA, 22 bp, Homo sapiens
catgtgctgtagcagagaggaa

SEQ ID NO: 9380240 - DNA, 22 bp, Homo sapiens
catgtggcacaaagaaggaaat

SEQ ID NO: 9380241 - DNA, 22 bp, Homo sapiens
catgtggatatgaattgtagaa

SEQ ID NO: 9380242 - DNA, 22 bp, Homo sapiens
catgtggctttggcatgtgccc

SEQ ID NO: 9380243 - DNA, 22 bp, Homo sapiens
catgtgtcaaatgatgtagctg

SEQ ID NO: 9380244 - DNA, 19 bp, Homo sapiens
catgtgtcaatactgtacc

SEQ ID NO: 9380245 - DNA, 22 bp, Homo sapiens
catgtgtcacagccttttattg

SEQ ID NO: 9380246 - DNA, 19 bp, Homo sapiens
catgtgtcaatactgtacc

SEQ ID NO: 9380247 - DNA, 22 bp, Homo sapiens
catgtgtcacagccttttattg

SEQ ID NO: 9380248 - DNA, 22 bp, Homo sapiens
catgtgtcaaatgatgtagctg

SEQ ID NO: 9380249 - DNA, 22 bp, Homo sapiens
catgtgggaagaggccagctgg

SEQ ID NO: 9380250 - DNA, 22 bp, Homo sapiens
catgtgggacaatctcaggtat

SEQ ID NO: 9380251 - DNA, 22 bp, Homo sapiens
catgtgggactcctgctgtttt

SEQ ID NO: 9380252 - DNA, 22 bp, Homo sapiens
catgtgggttattgggttctag

SEQ ID NO: 9380253 - DNA, 22 bp, Homo sapiens
catgtgggactcctgctgtttt

SEQ ID NO: 9380254 - DNA, 22 bp, Homo sapiens
catgtgtaggtataacttgtga

SEQ ID NO: 9380255 - DNA, 22 bp, Homo sapiens
catgtgtaccagctgttctttg

SEQ ID NO: 9380256 - DNA, 22 bp, Homo sapiens
catgtgtaattgtaaaaggtaa

SEQ ID NO: 9380257 - DNA, 22 bp, Homo sapiens
catgtgtaggtatacaaaattc

SEQ ID NO: 9380258 - DNA, 22 bp, Homo sapiens
catgtgtagtgaaataagcagt

SEQ ID NO: 9380259 - DNA, 22 bp, Homo sapiens
catgtgtagtgaaataagcagt

SEQ ID NO: 9380260 - DNA, 22 bp, Homo sapiens
catgtgtatgcattcatacata

SEQ ID NO: 9380261 - DNA, 22 bp, Homo sapiens
tccagcagaaccagagacctgg

SEQ ID NO: 9380262 - DNA, 22 bp, Homo sapiens
tccagcacctggaggcgtcccc

SEQ ID NO: 9380263 - DNA, 22 bp, Homo sapiens
tccagcactcgcccagggcttg

SEQ ID NO: 9380264 - DNA, 20 bp, Homo sapiens
tccagcaccctcacagagaa

SEQ ID NO: 9380265 - DNA, 22 bp, Homo sapiens
tccagcacccaatgtggctaag

SEQ ID NO: 9380266 - DNA, 22 bp, Homo sapiens
tccagcacccaatgtggctaag

SEQ ID NO: 9380267 - DNA, 22 bp, Homo sapiens
tccagcaccaccacagggaaga

SEQ ID NO: 9380268 - DNA, 21 bp, Homo sapiens
tccagcacagatgacctcccc

SEQ ID NO: 9380269 - DNA, 22 bp, Homo sapiens
tccagcacagaatttcctagct

SEQ ID NO: 9380270 - DNA, 22 bp, Homo sapiens
tccagcaaagtgataggatttc

SEQ ID NO: 9380271 - DNA, 22 bp, Homo sapiens
catgctttttgacaacaagctg

SEQ ID NO: 9380272 - DNA, 22 bp, Homo sapiens
catgtaaagcacttcataacag

SEQ ID NO: 9380273 - DNA, 22 bp, Homo sapiens
catgtaaagcatccttctaggg

SEQ ID NO: 9380274 - DNA, 22 bp, Homo sapiens
catgtaatcctggggagatgaa

SEQ ID NO: 9380275 - DNA, 22 bp, Homo sapiens
catgtacaaaaggcaaatgcct

SEQ ID NO: 9380276 - DNA, 22 bp, Homo sapiens
catggttttaaggtcactgccg

SEQ ID NO: 9380277 - DNA, 22 bp, Homo sapiens
catggttttaaggtcactgccg

SEQ ID NO: 9380278 - DNA, 22 bp, Homo sapiens
catggttttgagcctattatgc

SEQ ID NO: 9380279 - DNA, 22 bp, Homo sapiens
catggttttgagcctattatgc

SEQ ID NO: 9380280 - DNA, 22 bp, Homo sapiens
catggtttttaccctacaccat

SEQ ID NO: 9380281 - DNA, 22 bp, Homo sapiens
catgtaaaaagaagaatctgga

SEQ ID NO: 9380282 - DNA, 22 bp, Homo sapiens
catgtaaaacactcagaacagt

SEQ ID NO: 9380283 - DNA, 20 bp, Homo sapiens
catggtggaggagcagggcc

SEQ ID NO: 9380284 - DNA, 22 bp, Homo sapiens
catggtttattagagcttattt

SEQ ID NO: 9380285 - DNA, 22 bp, Homo sapiens
catggtttcatgagaattaccc

SEQ ID NO: 9380286 - DNA, 22 bp, Homo sapiens
catggtttggtctttgtagtgg

SEQ ID NO: 9380287 - DNA, 22 bp, Homo sapiens
catggtttggtctttgtagtgg

SEQ ID NO: 9380288 - DNA, 22 bp, Homo sapiens
catggtttgatgactggaagga

SEQ ID NO: 9380289 - DNA, 22 bp, Homo sapiens
catggtttattagagcttattt

SEQ ID NO: 9380290 - DNA, 22 bp, Homo sapiens
catggtgtgaatgagcggataa

SEQ ID NO: 9380291 - DNA, 22 bp, Homo sapiens
catgggctcttctggactgcac

SEQ ID NO: 9380292 - DNA, 22 bp, Homo sapiens
catgggctcttctggactgcac

SEQ ID NO: 9380293 - DNA, 22 bp, Homo sapiens
catgggctcttctggactgcac

SEQ ID NO: 9380294 - DNA, 22 bp, Homo sapiens
catgggctctctgagctccagg

SEQ ID NO: 9380295 - DNA, 22 bp, Homo sapiens
catggaacaaggaagatgtttg

SEQ ID NO: 9380296 - DNA, 23 bp, Homo sapiens
catggaaaactgaaagctgacct

SEQ ID NO: 9380297 - DNA, 23 bp, Homo sapiens
catggaaaactgaaagctgacct

SEQ ID NO: 9380298 - DNA, 23 bp, Homo sapiens
catggaaaactgaaagctgacct

SEQ ID NO: 9380299 - DNA, 22 bp, Homo sapiens
catggaaagcactcagcccagt

SEQ ID NO: 9380300 - DNA, 18 bp, Homo sapiens
tccagaggtgttggagcc

SEQ ID NO: 9380301 - DNA, 22 bp, Homo sapiens
tccagaggtgaacacccaggca

SEQ ID NO: 9380302 - DNA, 22 bp, Homo sapiens
tccagaggtgaacacccaggca

SEQ ID NO: 9380303 - DNA, 22 bp, Homo sapiens
tccagaggtgaacacccaggca

SEQ ID NO: 9380304 - DNA, 22 bp, Homo sapiens
tccagagtttgagtctccttcc

SEQ ID NO: 9380305 - DNA, 18 bp, Homo sapiens
tccagaggtgttggagcc

SEQ ID NO: 9380306 - DNA, 17 bp, Homo sapiens
tccagagaggcttccct

SEQ ID NO: 9380307 - DNA, 22 bp, Homo sapiens
tccaagaagtcatctaaactgt

SEQ ID NO: 9380308 - DNA, 22 bp, Homo sapiens
tccaagagaatactggagagta

SEQ ID NO: 9380309 - DNA, 22 bp, Homo sapiens
tccaagatctacagcagtttag

SEQ ID NO: 9380310 - DNA, 22 bp, Homo sapiens
tccaagatctacagcagtttag

SEQ ID NO: 9380311 - DNA, 22 bp, Homo sapiens
tccaagagttcaaggctacagt

SEQ ID NO: 9380312 - DNA, 22 bp, Homo sapiens
tccaagagttcaaggctacagt

SEQ ID NO: 9380313 - DNA, 20 bp, Homo sapiens
tccaagagtgatgtttcata

SEQ ID NO: 9380314 - DNA, 22 bp, Homo sapiens
catgctctagattctctctaat

SEQ ID NO: 9380315 - DNA, 22 bp, Homo sapiens
catgctctagattctctctaat

SEQ ID NO: 9380316 - DNA, 22 bp, Homo sapiens
catgctcacaaaagatggcaaa

SEQ ID NO: 9380317 - DNA, 22 bp, Homo sapiens
tcatcagggatattggcctgaa

SEQ ID NO: 9380318 - DNA, 22 bp, Homo sapiens
tcatcagctcatctgctcctag

SEQ ID NO: 9380319 - DNA, 22 bp, Homo sapiens
tcatcagggatattggcctgaa

SEQ ID NO: 9380320 - DNA, 22 bp, Homo sapiens
catgctgggtaaaggtggtgaa

SEQ ID NO: 9380321 - DNA, 22 bp, Homo sapiens
catgctgagcacattctgtatt

SEQ ID NO: 9380322 - DNA, 22 bp, Homo sapiens
catgctctctggcaacttgtgt

SEQ ID NO: 9380323 - DNA, 22 bp, Homo sapiens
catgctgtgtggttagaactgt

SEQ ID NO: 9380324 - DNA, 22 bp, Homo sapiens
catgctgtgtgttttagctcca

SEQ ID NO: 9380325 - DNA, 22 bp, Homo sapiens
catgctgtgtggttagaactgt

SEQ ID NO: 9380326 - DNA, 22 bp, Homo sapiens
catgctgtgcatcttgatgacc

SEQ ID NO: 9380327 - DNA, 22 bp, Homo sapiens
catgctgtgctattcgtgctgt

SEQ ID NO: 9380328 - DNA, 22 bp, Homo sapiens
catgctggtcagccagtggatg

SEQ ID NO: 9380329 - DNA, 22 bp, Homo sapiens
tcacttagatggggatcatcac

SEQ ID NO: 9380330 - DNA, 22 bp, Homo sapiens
tcacttataaaatgcaagatct

SEQ ID NO: 9380331 - DNA, 21 bp, Homo sapiens
tcacttataatgtatttgctg

SEQ ID NO: 9380332 - DNA, 22 bp, Homo sapiens
tcactgttttgcctgcacttcc

SEQ ID NO: 9380333 - DNA, 22 bp, Homo sapiens
tcacttcccagacggggtggca

SEQ ID NO: 9380334 - DNA, 22 bp, Homo sapiens
tcaggaagttttgaatcaactg

SEQ ID NO: 9380335 - DNA, 22 bp, Homo sapiens
tcaggaagttttgaatcaactg

SEQ ID NO: 9380336 - DNA, 22 bp, Homo sapiens
tcacttattttctaaccaaagg

SEQ ID NO: 9380337 - DNA, 22 bp, Homo sapiens
tcacttattgctcatctcatgc

SEQ ID NO: 9380338 - DNA, 22 bp, Homo sapiens
tcacttattaactcataccatt

SEQ ID NO: 9380339 - DNA, 20 bp, Homo sapiens
tcacttattctcaacttgtg

SEQ ID NO: 9380340 - DNA, 22 bp, Homo sapiens
tcacttatatttcaggagatat

SEQ ID NO: 9380341 - DNA, 22 bp, Homo sapiens
tcacttatgccagctctggaag

SEQ ID NO: 9380342 - DNA, 22 bp, Homo sapiens
tcacttatgtgtgattgatgcc

SEQ ID NO: 9380343 - DNA, 22 bp, Homo sapiens
tcacttatgtgtgattgatgcc

SEQ ID NO: 9380344 - DNA, 22 bp, Homo sapiens
tcacttatgtgtaggcagctta

SEQ ID NO: 9380345 - DNA, 22 bp, Homo sapiens
tcactgtttcatccctagcact

SEQ ID NO: 9380346 - DNA, 22 bp, Homo sapiens
tcactgtttcctgtactggaca

SEQ ID NO: 9380347 - DNA, 22 bp, Homo sapiens
cagtgtctacagtggctggagg

SEQ ID NO: 9380348 - DNA, 22 bp, Homo sapiens
cagtgtcaccaggcgagtctcc

SEQ ID NO: 9380349 - DNA, 22 bp, Homo sapiens
cagtgtcaggatcagtatattt

SEQ ID NO: 9380350 - DNA, 22 bp, Homo sapiens
cagtggttttcagctgggagtt

SEQ ID NO: 9380351 - DNA, 22 bp, Homo sapiens
cagtggttttatatctaagctt

SEQ ID NO: 9380352 - DNA, 22 bp, Homo sapiens
cagtggttttgagattcagggt

SEQ ID NO: 9380353 - DNA, 22 bp, Homo sapiens
cagtggtttctgaacagtgtgc

SEQ ID NO: 9380354 - DNA, 22 bp, Homo sapiens
cagtggtttctgaacagtgtgc

SEQ ID NO: 9380355 - DNA, 22 bp, Homo sapiens
cagtggtttccaaacttgttcc

SEQ ID NO: 9380356 - DNA, 22 bp, Homo sapiens
cagtgtataaactttaacatag

SEQ ID NO: 9380357 - DNA, 22 bp, Homo sapiens
tcaggcagaattatcaaaagat

SEQ ID NO: 9380358 - DNA, 22 bp, Homo sapiens
tcaggcagaattatcaaaagat

SEQ ID NO: 9380359 - DNA, 22 bp, Homo sapiens
tcaggcagaaaaatcactaatt

SEQ ID NO: 9380360 - DNA, 22 bp, Homo sapiens
tcaggcagaaaaatcactaatt

SEQ ID NO: 9380361 - DNA, 22 bp, Homo sapiens
tcaggcagaaaaatcactaatt

SEQ ID NO: 9380362 - DNA, 21 bp, Homo sapiens
tcaggaggctcagactcctgc

SEQ ID NO: 9380363 - DNA, 22 bp, Homo sapiens
tcaggaggctcaagacctggca

SEQ ID NO: 9380364 - DNA, 22 bp, Homo sapiens
tcaggaggcgtctcgctggggc

SEQ ID NO: 9380365 - DNA, 22 bp, Homo sapiens
tcaggaggcggtgctgcctttg

SEQ ID NO: 9380366 - DNA, 22 bp, Homo sapiens
tcaggaggctcaagacctggca

SEQ ID NO: 9380367 - DNA, 22 bp, Homo sapiens
tcaggaggccaccaggacctgt

SEQ ID NO: 9380368 - DNA, 22 bp, Homo sapiens
tcaggaatgaggataaacattg

SEQ ID NO: 9380369 - DNA, 22 bp, Homo sapiens
tcaggaggcaagtaggtattga

SEQ ID NO: 9380370 - DNA, 22 bp, Homo sapiens
tcaggaatgaggataaacattg

SEQ ID NO: 9380371 - DNA, 22 bp, Homo sapiens
tcaggaggccggcaggatttga

SEQ ID NO: 9380372 - DNA, 22 bp, Homo sapiens
tcaggaggccgtgtgctcagtg

SEQ ID NO: 9380373 - DNA, 22 bp, Homo sapiens
tcaggaggccaccaggacctgt

SEQ ID NO: 9380374 - DNA, 22 bp, Homo sapiens
tcaggaggccaccaggacctgt

SEQ ID NO: 9380375 - DNA, 22 bp, Homo sapiens
tcaggaggcggtgctgcctttg

SEQ ID NO: 9380376 - DNA, 22 bp, Homo sapiens
tcaggaggcggaggttgcagtg

SEQ ID NO: 9380377 - DNA, 22 bp, Homo sapiens
tcaggaggcctgagtagctcta

SEQ ID NO: 9380378 - DNA, 22 bp, Homo sapiens
tcaggaggcctgagtagctcta

SEQ ID NO: 9380379 - DNA, 22 bp, Homo sapiens
tcaggaggccgtgtgctcagtg

SEQ ID NO: 9380380 - DNA, 22 bp, Homo sapiens
tcaggaggccgtgtgctcagtg

SEQ ID NO: 9380381 - DNA, 22 bp, Homo sapiens
catcaagagtcttactatcagt

SEQ ID NO: 9380382 - DNA, 22 bp, Homo sapiens
tcaggctgcagctgtcagcagc

SEQ ID NO: 9380383 - DNA, 22 bp, Homo sapiens
tcaggctgcagtggcaaaagac

SEQ ID NO: 9380384 - DNA, 22 bp, Homo sapiens
tcaggctgcagctgtcagcagc

SEQ ID NO: 9380385 - DNA, 22 bp, Homo sapiens
catcacaaaatgattattccct

SEQ ID NO: 9380386 - DNA, 22 bp, Homo sapiens
catcaatagggtttgaaagcaa

SEQ ID NO: 9380387 - DNA, 22 bp, Homo sapiens
tcaggctgatttcttttgaggg

SEQ ID NO: 9380388 - DNA, 22 bp, Homo sapiens
catcacattagtctcaagagaa

SEQ ID NO: 9380389 - DNA, 22 bp, Homo sapiens
tcaggctgcctatcagactgtg

SEQ ID NO: 9380390 - DNA, 18 bp, Homo sapiens
tcaggctgccctgtgtct

SEQ ID NO: 9380391 - DNA, 18 bp, Homo sapiens
tcaggctgccctgtgtct

SEQ ID NO: 9380392 - DNA, 22 bp, Homo sapiens
tcaggctgcccgttcagggctc

SEQ ID NO: 9380393 - DNA, 22 bp, Homo sapiens
tcaggctgcccgttcagggctc

SEQ ID NO: 9380394 - DNA, 22 bp, Homo sapiens
tcaggctgcatctgtaagggtg

SEQ ID NO: 9380395 - DNA, 22 bp, Homo sapiens
tcaggctgcatctgtaagggtg

SEQ ID NO: 9380396 - DNA, 22 bp, Homo sapiens
catcaaatggcaagtgaaagct

SEQ ID NO: 9380397 - DNA, 22 bp, Homo sapiens
catcaaaattagacattgttga

SEQ ID NO: 9380398 - DNA, 21 bp, Homo sapiens
catattaaatcggtgccttta

SEQ ID NO: 9380399 - DNA, 22 bp, Homo sapiens
tcaggcagagctgtggagctct

SEQ ID NO: 9380400 - DNA, 22 bp, Homo sapiens
tcaggcagagctgtggagctct

SEQ ID NO: 9380401 - DNA, 22 bp, Homo sapiens
tcaggcagaccaccgtgggcag

SEQ ID NO: 9380402 - DNA, 22 bp, Homo sapiens
tcaggcagagggagaagccaag

SEQ ID NO: 9380403 - DNA, 22 bp, Homo sapiens
tcaggcagagggagaagccaag

SEQ ID NO: 9380404 - DNA, 22 bp, Homo sapiens
catatgtatttctcataattag

SEQ ID NO: 9380405 - DNA, 22 bp, Homo sapiens
tcaggcagagggagaagccaag

SEQ ID NO: 9380406 - DNA, 22 bp, Homo sapiens
tcaggcagagggagaagccaag

SEQ ID NO: 9380407 - DNA, 22 bp, Homo sapiens
tcaggcagaggatggggagcgt

SEQ ID NO: 9380408 - DNA, 22 bp, Homo sapiens
catcatcaaaagtgacagagaa

SEQ ID NO: 9380409 - DNA, 22 bp, Homo sapiens
catcatcaaaacaaatggagtc

SEQ ID NO: 9380410 - DNA, 22 bp, Homo sapiens
catcatcaaaagtgacagagaa

SEQ ID NO: 9380411 - DNA, 22 bp, Homo sapiens
catcatcaaaacaaatggagtc

SEQ ID NO: 9380412 - DNA, 22 bp, Homo sapiens
catcagtttggtcaatgatggg

SEQ ID NO: 9380413 - DNA, 22 bp, Homo sapiens
tcagtgtcttctctttcctacc

SEQ ID NO: 9380414 - DNA, 22 bp, Homo sapiens
tcagtgtcttctctttcctacc

SEQ ID NO: 9380415 - DNA, 22 bp, Homo sapiens
tcagtgtcttctctttcctacc

SEQ ID NO: 9380416 - DNA, 22 bp, Homo sapiens
tcagtgtctgtgggcaggatgg

SEQ ID NO: 9380417 - DNA, 22 bp, Homo sapiens
tcagtgtctgtgggcaggatgg

SEQ ID NO: 9380418 - DNA, 22 bp, Homo sapiens
tcagtgctgtaaacaaaaggaa

SEQ ID NO: 9380419 - DNA, 22 bp, Homo sapiens
tcagtgctgctttatgacagtt

SEQ ID NO: 9380420 - DNA, 22 bp, Homo sapiens
tcagtgctgctttatgacagtt

SEQ ID NO: 9380421 - DNA, 22 bp, Homo sapiens
catcatcaactggcaggtaagt

SEQ ID NO: 9380422 - DNA, 22 bp, Homo sapiens
catcatcaaactggggggctgg

SEQ ID NO: 9380423 - DNA, 22 bp, Homo sapiens
catcatcaacaggtagactggt

SEQ ID NO: 9380424 - DNA, 20 bp, Homo sapiens
catcatcacatgagccaatt

SEQ ID NO: 9380425 - DNA, 22 bp, Homo sapiens
tcagtgctgctttatgacagtt

SEQ ID NO: 9380426 - DNA, 22 bp, Homo sapiens
tcagtgtgaattcaggagccta

SEQ ID NO: 9380427 - DNA, 22 bp, Homo sapiens
tcagtgtgactgatggctttat

SEQ ID NO: 9380428 - DNA, 22 bp, Homo sapiens
tcagtgtgagtaccatgctcag

SEQ ID NO: 9380429 - DNA, 22 bp, Homo sapiens
tcagtgtggaaaatcctttggc

SEQ ID NO: 9380430 - DNA, 22 bp, Homo sapiens
tcagtgtgcacatggtagcagt

SEQ ID NO: 9380431 - DNA, 20 bp, Homo sapiens
catcagtgcctgacaggtcc

SEQ ID NO: 9380432 - DNA, 22 bp, Homo sapiens
catcagtgtctctctggtactt

SEQ ID NO: 9380433 - DNA, 22 bp, Homo sapiens
catcagtgcggcatctgtcatc

SEQ ID NO: 9380434 - DNA, 21 bp, Homo sapiens
catcagatttagaagttctat

SEQ ID NO: 9380435 - DNA, 22 bp, Homo sapiens
catcagcaggcaacactcttgg

SEQ ID NO: 9380436 - DNA, 22 bp, Homo sapiens
catcagcaggcaacactcttgg

SEQ ID NO: 9380437 - DNA, 22 bp, Homo sapiens
catcaggagaccaggtcctgct

SEQ ID NO: 9380438 - DNA, 22 bp, Homo sapiens
catcagtcagtctcttcagtat

SEQ ID NO: 9380439 - DNA, 19 bp, Homo sapiens
tcatcacctaattctctat

SEQ ID NO: 9380440 - DNA, 19 bp, Homo sapiens
tcatcacccctcctctcta

SEQ ID NO: 9380441 - DNA, 22 bp, Homo sapiens
tcatcacatgtgtagtcatccc

SEQ ID NO: 9380442 - DNA, 22 bp, Homo sapiens
tcatcacatgtgtagtcatccc

SEQ ID NO: 9380443 - DNA, 22 bp, Homo sapiens
tcatcacatgtgtagtcatccc

SEQ ID NO: 9380444 - DNA, 22 bp, Homo sapiens
tcatcacatatgtcatgatttg

SEQ ID NO: 9380445 - DNA, 22 bp, Homo sapiens
tcatcacatatgtcatgatttg

SEQ ID NO: 9380446 - DNA, 22 bp, Homo sapiens
tcatcagctcatctgctcctag

SEQ ID NO: 9380447 - DNA, 22 bp, Homo sapiens
tcatcagcaccctatgtccttt

SEQ ID NO: 9380448 - DNA, 22 bp, Homo sapiens
tcatcaaagtcaaagaatgact

SEQ ID NO: 9380449 - DNA, 22 bp, Homo sapiens
tcataattgtatacatttatgg

SEQ ID NO: 9380450 - DNA, 22 bp, Homo sapiens
tcatacaaggagggtgttcaaa

SEQ ID NO: 9380451 - DNA, 22 bp, Homo sapiens
catcctgcggggagcagagggc

SEQ ID NO: 9380452 - DNA, 22 bp, Homo sapiens
catctaaatttgactccaagga

SEQ ID NO: 9380453 - DNA, 22 bp, Homo sapiens
catcctggttaccccatagtca

SEQ ID NO: 9380454 - DNA, 18 bp, Homo sapiens
catccttatagctgagaa

SEQ ID NO: 9380455 - DNA, 22 bp, Homo sapiens
catccttcatacgactgaccct

SEQ ID NO: 9380456 - DNA, 22 bp, Homo sapiens
catccttcaaaggctacaatta

SEQ ID NO: 9380457 - DNA, 22 bp, Homo sapiens
catccctgtctgccactctgaa

SEQ ID NO: 9380458 - DNA, 22 bp, Homo sapiens
catccctgtctgccactctgaa

SEQ ID NO: 9380459 - DNA, 19 bp, Homo sapiens
tcagtgtgtgggaggtggt

SEQ ID NO: 9380460 - DNA, 17 bp, Homo sapiens
catccgtgagctcggca

SEQ ID NO: 9380461 - DNA, 22 bp, Homo sapiens
catctacactgattaggtgaac

SEQ ID NO: 9380462 - DNA, 22 bp, Homo sapiens
catctacaggagaatgtcactg

SEQ ID NO: 9380463 - DNA, 22 bp, Homo sapiens
catcgtgtctaggtgtgcagca

SEQ ID NO: 9380464 - DNA, 22 bp, Homo sapiens
catctacctccaccctatatat

SEQ ID NO: 9380465 - DNA, 19 bp, Homo sapiens
catctatcctcattctctg

SEQ ID NO: 9380466 - DNA, 22 bp, Homo sapiens
tcagtttcacagtctgtgcaga

SEQ ID NO: 9380467 - DNA, 19 bp, Homo sapiens
tcataaggagagaggaaat

SEQ ID NO: 9380468 - DNA, 22 bp, Homo sapiens
catttccactctgggagtcaga

SEQ ID NO: 9380469 - DNA, 22 bp, Homo sapiens
catttccacttctgaaaactgg

SEQ ID NO: 9380470 - DNA, 22 bp, Homo sapiens
catttccagctcctgcatcatg

SEQ ID NO: 9380471 - DNA, 22 bp, Homo sapiens
catttccagctcctgcatcatg

SEQ ID NO: 9380472 - DNA, 22 bp, Homo sapiens
catttccacttctgaaaactgg

SEQ ID NO: 9380473 - DNA, 22 bp, Homo sapiens
catttccttcctgctgctcctc

SEQ ID NO: 9380474 - DNA, 22 bp, Homo sapiens
catttcctgtctggaggtcaaa

SEQ ID NO: 9380475 - DNA, 22 bp, Homo sapiens
catttccttcctgctgctcctc

SEQ ID NO: 9380476 - DNA, 22 bp, Homo sapiens
catttcctgtctggaggtcaaa

SEQ ID NO: 9380477 - DNA, 22 bp, Homo sapiens
catttctaccaaatgtgactgg

SEQ ID NO: 9380478 - DNA, 22 bp, Homo sapiens
catttctagggatcataaagta

SEQ ID NO: 9380479 - DNA, 22 bp, Homo sapiens
catttctaccaaatgtgactgg

SEQ ID NO: 9380480 - DNA, 22 bp, Homo sapiens
catttctacagcttcttcagaa

SEQ ID NO: 9380481 - DNA, 21 bp, Homo sapiens
catttcagtaaggaagcctgt

SEQ ID NO: 9380482 - DNA, 22 bp, Homo sapiens
catttcattcctttgaaagtgg

SEQ ID NO: 9380483 - DNA, 21 bp, Homo sapiens
catttcatgattatagaaatg

SEQ ID NO: 9380484 - DNA, 21 bp, Homo sapiens
catttcatgattatagaaatg

SEQ ID NO: 9380485 - DNA, 21 bp, Homo sapiens
catttcatgattatagaaatg

SEQ ID NO: 9380486 - DNA, 22 bp, Homo sapiens
catttcattcctttgaaagtgg

SEQ ID NO: 9380487 - DNA, 22 bp, Homo sapiens
tccatagtagaaaatgggacag

SEQ ID NO: 9380488 - DNA, 22 bp, Homo sapiens
tccatagtagaaaatgggacag

SEQ ID NO: 9380489 - DNA, 22 bp, Homo sapiens
tccatagtgaatgggtaatgca

SEQ ID NO: 9380490 - DNA, 22 bp, Homo sapiens
catttcacgcacactcattact

SEQ ID NO: 9380491 - DNA, 22 bp, Homo sapiens
catttcacgcacactcattact

SEQ ID NO: 9380492 - DNA, 22 bp, Homo sapiens
catttattgagtggccacagtg

SEQ ID NO: 9380493 - DNA, 22 bp, Homo sapiens
catttattggcatgtagtaggt

SEQ ID NO: 9380494 - DNA, 22 bp, Homo sapiens
catttattggcatgtagtaggt

SEQ ID NO: 9380495 - DNA, 22 bp, Homo sapiens
catttattggcatgtagtaggt

SEQ ID NO: 9380496 - DNA, 22 bp, Homo sapiens
tccataaaccagaaaatcaaga

SEQ ID NO: 9380497 - DNA, 22 bp, Homo sapiens
tccataaaccagaaaatcaaga

SEQ ID NO: 9380498 - DNA, 22 bp, Homo sapiens
tccataaatgaaatagaacgct

SEQ ID NO: 9380499 - DNA, 22 bp, Homo sapiens
tccataaattttatgaacatat

SEQ ID NO: 9380500 - DNA, 22 bp, Homo sapiens
tccatacacattgaattttagt

SEQ ID NO: 9380501 - DNA, 22 bp, Homo sapiens
cattttcagcacccatctgaaa

SEQ ID NO: 9380502 - DNA, 22 bp, Homo sapiens
cattttcagcacccatctgaaa

SEQ ID NO: 9380503 - DNA, 22 bp, Homo sapiens
cattttatgtttatggagtgct

SEQ ID NO: 9380504 - DNA, 22 bp, Homo sapiens
cattttatgtttatggagtgct

SEQ ID NO: 9380505 - DNA, 22 bp, Homo sapiens
cattttactgactcttgaatta

SEQ ID NO: 9380506 - DNA, 22 bp, Homo sapiens
cattttacctagaagctgaaag

SEQ ID NO: 9380507 - DNA, 19 bp, Homo sapiens
cattttaagcatccccagt

SEQ ID NO: 9380508 - DNA, 22 bp, Homo sapiens
cattttatcctctgggaagcta

SEQ ID NO: 9380509 - DNA, 22 bp, Homo sapiens
cattttatcctctgggaagcta

SEQ ID NO: 9380510 - DNA, 22 bp, Homo sapiens
cattttatgtttatggagtgct

SEQ ID NO: 9380511 - DNA, 21 bp, Homo sapiens
catttctattgatgagaaaag

SEQ ID NO: 9380512 - DNA, 21 bp, Homo sapiens
catttctattgatgagaaaag

SEQ ID NO: 9380513 - DNA, 22 bp, Homo sapiens
catttctagggatcataaagta

SEQ ID NO: 9380514 - DNA, 22 bp, Homo sapiens
catttgtctctaggaagtgagg

SEQ ID NO: 9380515 - DNA, 19 bp, Homo sapiens
cattttaagcatccccagt

SEQ ID NO: 9380516 - DNA, 22 bp, Homo sapiens
cattttaagatgacctggtttc

SEQ ID NO: 9380517 - DNA, 22 bp, Homo sapiens
cattttaaatgatttaagccaa

SEQ ID NO: 9380518 - DNA, 22 bp, Homo sapiens
cattttaaatgatttaagccaa

SEQ ID NO: 9380519 - DNA, 22 bp, Homo sapiens
cattttaaatgatttaagccaa

SEQ ID NO: 9380520 - DNA, 22 bp, Homo sapiens
tcctgagggcgattcagcaggt

SEQ ID NO: 9380521 - DNA, 22 bp, Homo sapiens
tcctgagggcgattcagcaggt

SEQ ID NO: 9380522 - DNA, 22 bp, Homo sapiens
tcctgaggctcactttgaatgt

SEQ ID NO: 9380523 - DNA, 20 bp, Homo sapiens
tcctgaggcttcgccagtgt

SEQ ID NO: 9380524 - DNA, 22 bp, Homo sapiens
ccaaaaattagatacacatata

SEQ ID NO: 9380525 - DNA, 22 bp, Homo sapiens
ccaaaaattagatacacatata

SEQ ID NO: 9380526 - DNA, 22 bp, Homo sapiens
tcctgacttaactactctctgg

SEQ ID NO: 9380527 - DNA, 22 bp, Homo sapiens
ccaaaaattagatacacatata

SEQ ID NO: 9380528 - DNA, 22 bp, Homo sapiens
tcctgactctggtgtcctctac

SEQ ID NO: 9380529 - DNA, 22 bp, Homo sapiens
ccaaaaattagatacacatata

SEQ ID NO: 9380530 - DNA, 22 bp, Homo sapiens
cattttgtaagtctctcttgtt

SEQ ID NO: 9380531 - DNA, 22 bp, Homo sapiens
cattttgtagcaatgactgttg

SEQ ID NO: 9380532 - DNA, 22 bp, Homo sapiens
cattttgtgctagacactatgg

SEQ ID NO: 9380533 - DNA, 22 bp, Homo sapiens
cattttgtagcaatgactgttg

SEQ ID NO: 9380534 - DNA, 22 bp, Homo sapiens
cattttgtagcaatgactgttg

SEQ ID NO: 9380535 - DNA, 22 bp, Homo sapiens
cattttgtgcacacgtggagtt

SEQ ID NO: 9380536 - DNA, 22 bp, Homo sapiens
cattttcatgagtttctgttca

SEQ ID NO: 9380537 - DNA, 22 bp, Homo sapiens
cattttcatgagtttctgttca

SEQ ID NO: 9380538 - DNA, 19 bp, Homo sapiens
cattttcccatcatccttt

SEQ ID NO: 9380539 - DNA, 22 bp, Homo sapiens
tcctggagctggtgtctttccc

SEQ ID NO: 9380540 - DNA, 22 bp, Homo sapiens
tcctggagctggtgtctttccc

SEQ ID NO: 9380541 - DNA, 22 bp, Homo sapiens
tcctggagcttcagtttccttt

SEQ ID NO: 9380542 - DNA, 22 bp, Homo sapiens
tcctggagcttcagtttccttt

SEQ ID NO: 9380543 - DNA, 22 bp, Homo sapiens
tcctggagcttcagtttccttt

SEQ ID NO: 9380544 - DNA, 22 bp, Homo sapiens
tcctggagctgactccgtttga

SEQ ID NO: 9380545 - DNA, 22 bp, Homo sapiens
tcctggagctgactccgtttga

SEQ ID NO: 9380546 - DNA, 22 bp, Homo sapiens
tcctggagcctcattcaaacac

SEQ ID NO: 9380547 - DNA, 22 bp, Homo sapiens
tcctggagcctcattcaaacac

SEQ ID NO: 9380548 - DNA, 22 bp, Homo sapiens
tcctggagctgactccgtttga

SEQ ID NO: 9380549 - DNA, 20 bp, Homo sapiens
tcctggagctgcttgaattc

SEQ ID NO: 9380550 - DNA, 20 bp, Homo sapiens
tcctggagctgcttgaattc

SEQ ID NO: 9380551 - DNA, 20 bp, Homo sapiens
tcctggagctgcttgaattc

SEQ ID NO: 9380552 - DNA, 22 bp, Homo sapiens
tcctggagcttccttcatggta

SEQ ID NO: 9380553 - DNA, 22 bp, Homo sapiens
tcctggaggaataagttttcca

SEQ ID NO: 9380554 - DNA, 22 bp, Homo sapiens
tcctggaggaataagttttcca

SEQ ID NO: 9380555 - DNA, 22 bp, Homo sapiens
tcctggaggacagaggcatctc

SEQ ID NO: 9380556 - DNA, 22 bp, Homo sapiens
tcctggagcttccttcatggta

SEQ ID NO: 9380557 - DNA, 22 bp, Homo sapiens
tcctggagcttccttcatggta

SEQ ID NO: 9380558 - DNA, 22 bp, Homo sapiens
tcctggagcttccttcatggta

SEQ ID NO: 9380559 - DNA, 22 bp, Homo sapiens
ccacagctgaccgcaggtgagc

SEQ ID NO: 9380560 - DNA, 22 bp, Homo sapiens
ccacagggaacatgacagcctt

SEQ ID NO: 9380561 - DNA, 22 bp, Homo sapiens
ccacagggactgttaaaaccct

SEQ ID NO: 9380562 - DNA, 22 bp, Homo sapiens
ccacaggctgctgcaggtcccg

SEQ ID NO: 9380563 - DNA, 22 bp, Homo sapiens
ccacaggctgctgcaggtcccg

SEQ ID NO: 9380564 - DNA, 22 bp, Homo sapiens
ccacagggcctttcctgctggc

SEQ ID NO: 9380565 - DNA, 16 bp, Homo sapiens
ccacagggcaaggggc

SEQ ID NO: 9380566 - DNA, 22 bp, Homo sapiens
tcctggcctgtctggagtagct

SEQ ID NO: 9380567 - DNA, 22 bp, Homo sapiens
tcctggccttagcgaggcggtc

SEQ ID NO: 9380568 - DNA, 20 bp, Homo sapiens
tcctggccttctcgggcagt

SEQ ID NO: 9380569 - DNA, 20 bp, Homo sapiens
tcctggccttctcgggcagt

SEQ ID NO: 9380570 - DNA, 20 bp, Homo sapiens
tcctggccttctcgggcagt

SEQ ID NO: 9380571 - DNA, 22 bp, Homo sapiens
ccacaggggtctctgtagctga

SEQ ID NO: 9380572 - DNA, 21 bp, Homo sapiens
ccacaggggctcccctgtcag

SEQ ID NO: 9380573 - DNA, 21 bp, Homo sapiens
ccacaggggctcccctgtcag

SEQ ID NO: 9380574 - DNA, 22 bp, Homo sapiens
ccacaggggtctctgtagctga

SEQ ID NO: 9380575 - DNA, 17 bp, Homo sapiens
tcctggcctggtgtgtg

SEQ ID NO: 9380576 - DNA, 22 bp, Homo sapiens
ccacagggcctttcctgctggc

SEQ ID NO: 9380577 - DNA, 22 bp, Homo sapiens
ccacagggctctaggcgcttcc

SEQ ID NO: 9380578 - DNA, 22 bp, Homo sapiens
ccacaggggcccacgagccgct

SEQ ID NO: 9380579 - DNA, 22 bp, Homo sapiens
tcctggctaacacggtgacacc

SEQ ID NO: 9380580 - DNA, 22 bp, Homo sapiens
tcctggctaacacggtgacacc

SEQ ID NO: 9380581 - DNA, 22 bp, Homo sapiens
tcctggccttgctcctgatgcc

SEQ ID NO: 9380582 - DNA, 22 bp, Homo sapiens
tcctggccttgctcctgatgcc

SEQ ID NO: 9380583 - DNA, 22 bp, Homo sapiens
tcctggccttgcgtcttgggag

SEQ ID NO: 9380584 - DNA, 22 bp, Homo sapiens
tcctggctccactgagcaggcc

SEQ ID NO: 9380585 - DNA, 22 bp, Homo sapiens
tcctggctccactgagcaggcc

SEQ ID NO: 9380586 - DNA, 22 bp, Homo sapiens
ccaccaggacagccctgagggg

SEQ ID NO: 9380587 - DNA, 22 bp, Homo sapiens
tcctgaggtgctcagccaggaa

SEQ ID NO: 9380588 - DNA, 22 bp, Homo sapiens
tcctgaggtgctcagccaggaa

SEQ ID NO: 9380589 - DNA, 22 bp, Homo sapiens
tcctgaggtgctcagccaggaa

SEQ ID NO: 9380590 - DNA, 22 bp, Homo sapiens
tcctgaggtgctcagccaggaa

SEQ ID NO: 9380591 - DNA, 22 bp, Homo sapiens
ccaacaacatagggctagttgg

SEQ ID NO: 9380592 - DNA, 22 bp, Homo sapiens
tcctgaggtggattgagcagag

SEQ ID NO: 9380593 - DNA, 22 bp, Homo sapiens
tcctgaggtggattgagcagag

SEQ ID NO: 9380594 - DNA, 22 bp, Homo sapiens
ccaacaggttgagagtctgaat

SEQ ID NO: 9380595 - DNA, 22 bp, Homo sapiens
ccaacagtccagatgagatggt

SEQ ID NO: 9380596 - DNA, 22 bp, Homo sapiens
ccaagagcctcagctgccgtgc

SEQ ID NO: 9380597 - DNA, 23 bp, Homo sapiens
ccaagactgttaggagtggggag

SEQ ID NO: 9380598 - DNA, 21 bp, Homo sapiens
ccaagagcaatgctaaggaga

SEQ ID NO: 9380599 - DNA, 22 bp, Homo sapiens
tcctgctctgatgggttctcct

SEQ ID NO: 9380600 - DNA, 22 bp, Homo sapiens
tcctggagccaatgtgctgctg

SEQ ID NO: 9380601 - DNA, 22 bp, Homo sapiens
tcctgctccaccgtgggctgga

SEQ ID NO: 9380602 - DNA, 22 bp, Homo sapiens
tcctgctccaccgtgggctgga

SEQ ID NO: 9380603 - DNA, 22 bp, Homo sapiens
tcctggagccaggacccttccc

SEQ ID NO: 9380604 - DNA, 22 bp, Homo sapiens
tcctggagccaggacccttccc

SEQ ID NO: 9380605 - DNA, 22 bp, Homo sapiens
tcctggagccatgattcccctc

SEQ ID NO: 9380606 - DNA, 22 bp, Homo sapiens
tcctggagccatgattcccctc

SEQ ID NO: 9380607 - DNA, 22 bp, Homo sapiens
tcctggagccaggacccttccc

SEQ ID NO: 9380608 - DNA, 22 bp, Homo sapiens
tcctggagccaggacccttccc

SEQ ID NO: 9380609 - DNA, 22 bp, Homo sapiens
tcctggagccacggagctttca

SEQ ID NO: 9380610 - DNA, 22 bp, Homo sapiens
tcctggagccacggagctttca

SEQ ID NO: 9380611 - DNA, 22 bp, Homo sapiens
tcctgccttcatactgctgtat

SEQ ID NO: 9380612 - DNA, 22 bp, Homo sapiens
tcctgccttgcctgggacatca

SEQ ID NO: 9380613 - DNA, 22 bp, Homo sapiens
ccaagaggtatcttgccataaa

SEQ ID NO: 9380614 - DNA, 19 bp, Homo sapiens
tcctgcccaccagccaggg

SEQ ID NO: 9380615 - DNA, 21 bp, Homo sapiens
tcctgccttagtccagagcag

SEQ ID NO: 9380616 - DNA, 22 bp, Homo sapiens
tcctgccttcatactgctgtat

SEQ ID NO: 9380617 - DNA, 21 bp, Homo sapiens
tcctgccttagtccagagcag

SEQ ID NO: 9380618 - DNA, 22 bp, Homo sapiens
tcctgccttagagcaaggaaaa

SEQ ID NO: 9380619 - DNA, 22 bp, Homo sapiens
tcctgtgttaaagggggtgcta

SEQ ID NO: 9380620 - DNA, 22 bp, Homo sapiens
tcctgtgttacccttgcagtga

SEQ ID NO: 9380621 - DNA, 22 bp, Homo sapiens
tcctgtgttactgcctggagcg

SEQ ID NO: 9380622 - DNA, 22 bp, Homo sapiens
tcctgttagtgttagacttccc

SEQ ID NO: 9380623 - DNA, 22 bp, Homo sapiens
tcctgtgttgatagagatggtt

SEQ ID NO: 9380624 - DNA, 22 bp, Homo sapiens
tcctgtgttctaggtatggtct

SEQ ID NO: 9380625 - DNA, 22 bp, Homo sapiens
tctaatgctctgagaacagtgc

SEQ ID NO: 9380626 - DNA, 22 bp, Homo sapiens
tctaatgcagttctgggtattt

SEQ ID NO: 9380627 - DNA, 23 bp, Homo sapiens
tctaatgcaattagaaattaggg

SEQ ID NO: 9380628 - DNA, 17 bp, Homo sapiens
tctagaagtgcttacat

SEQ ID NO: 9380629 - DNA, 22 bp, Homo sapiens
ccacccatgtgactacctcatg

SEQ ID NO: 9380630 - DNA, 18 bp, Homo sapiens
ccacccagggggagagga

SEQ ID NO: 9380631 - DNA, 18 bp, Homo sapiens
ccacccatctctgccttt

SEQ ID NO: 9380632 - DNA, 22 bp, Homo sapiens
ccacccctgtagagggacagac

SEQ ID NO: 9380633 - DNA, 22 bp, Homo sapiens
ccacccctgggtgcagggagcg

SEQ ID NO: 9380634 - DNA, 20 bp, Homo sapiens
ccaccctccaggaacacata

SEQ ID NO: 9380635 - DNA, 19 bp, Homo sapiens
ccacccctttgctgggccc

SEQ ID NO: 9380636 - DNA, 19 bp, Homo sapiens
ccacccctttgctgggccc

SEQ ID NO: 9380637 - DNA, 22 bp, Homo sapiens
tcctgtgtaaatagatctggtt

SEQ ID NO: 9380638 - DNA, 22 bp, Homo sapiens
tcctgtgtctcagcgtgaagca

SEQ ID NO: 9380639 - DNA, 22 bp, Homo sapiens
tcctgtggtctggaaggaatgg

SEQ ID NO: 9380640 - DNA, 22 bp, Homo sapiens
tcctgtggtcattcttctgccc

SEQ ID NO: 9380641 - DNA, 22 bp, Homo sapiens
tcctgtgtgtggcctttcccag

SEQ ID NO: 9380642 - DNA, 22 bp, Homo sapiens
tcctgtgttaaagggggtgcta

SEQ ID NO: 9380643 - DNA, 20 bp, Homo sapiens
tcctgtgtgtctcatcaacc

SEQ ID NO: 9380644 - DNA, 22 bp, Homo sapiens
tcctgtggtcattcttctgccc

SEQ ID NO: 9380645 - DNA, 22 bp, Homo sapiens
ccaccctggacaggcctctgag

SEQ ID NO: 9380646 - DNA, 22 bp, Homo sapiens
ccaccctggacaggcctctgag

SEQ ID NO: 9380647 - DNA, 22 bp, Homo sapiens
tctatacaagtttcactttgac

SEQ ID NO: 9380648 - DNA, 22 bp, Homo sapiens
tctataaattatgcagtctcag

SEQ ID NO: 9380649 - DNA, 21 bp, Homo sapiens
tctataactatagtgacagat

SEQ ID NO: 9380650 - DNA, 22 bp, Homo sapiens
tctataaattatgcagtctcag

SEQ ID NO: 9380651 - DNA, 22 bp, Homo sapiens
tctataaattatgcagtctcag

SEQ ID NO: 9380652 - DNA, 22 bp, Homo sapiens
tctataaatgcagatatgtgtg

SEQ ID NO: 9380653 - DNA, 22 bp, Homo sapiens
tctataaatgcagatatgtgtg

SEQ ID NO: 9380654 - DNA, 22 bp, Homo sapiens
tctcagagaagtgatgagcaat

SEQ ID NO: 9380655 - DNA, 22 bp, Homo sapiens
tctatagacttggacatatagt

SEQ ID NO: 9380656 - DNA, 22 bp, Homo sapiens
tctatacatgtgcacacacatc

SEQ ID NO: 9380657 - DNA, 22 bp, Homo sapiens
tctatacacacaaagaatgctt

SEQ ID NO: 9380658 - DNA, 23 bp, Homo sapiens
tctatacatactgcagcctctgg

SEQ ID NO: 9380659 - DNA, 22 bp, Homo sapiens
tctcagcttgagtggatgagct

SEQ ID NO: 9380660 - DNA, 22 bp, Homo sapiens
tctcagcttgagtggatgagct

SEQ ID NO: 9380661 - DNA, 22 bp, Homo sapiens
tctcagagacctgaactccctg

SEQ ID NO: 9380662 - DNA, 22 bp, Homo sapiens
tctcaggaaataggatttgagt

SEQ ID NO: 9380663 - DNA, 22 bp, Homo sapiens
tctcagtgggaagggcacagtt

SEQ ID NO: 9380664 - DNA, 22 bp, Homo sapiens
tctcagtgggttaaaagagaag

SEQ ID NO: 9380665 - DNA, 22 bp, Homo sapiens
tctcagtgtgttgagaggtctg

SEQ ID NO: 9380666 - DNA, 22 bp, Homo sapiens
tctcagtggtgttttgagtcca

SEQ ID NO: 9380667 - DNA, 22 bp, Homo sapiens
tctcagtgtgttttctctcaga

SEQ ID NO: 9380668 - DNA, 22 bp, Homo sapiens
tctcagtgtttaaaaagatttc

SEQ ID NO: 9380669 - DNA, 22 bp, Homo sapiens
ccagagaggccttggcaagaca

SEQ ID NO: 9380670 - DNA, 22 bp, Homo sapiens
tctcaggagccacagcgggagt

SEQ ID NO: 9380671 - DNA, 22 bp, Homo sapiens
tctcaggactcctctggccata

SEQ ID NO: 9380672 - DNA, 23 bp, Homo sapiens
tctcaggcaaaccaggacaagtt

SEQ ID NO: 9380673 - DNA, 23 bp, Homo sapiens
tctcaggcaaaccaggacaagtt

SEQ ID NO: 9380674 - DNA, 22 bp, Homo sapiens
tctcaggcattcccacatagaa

SEQ ID NO: 9380675 - DNA, 22 bp, Homo sapiens
tctcaggcccactgtgttgaaa

SEQ ID NO: 9380676 - DNA, 22 bp, Homo sapiens
tctcagtggatctcagaatttt

SEQ ID NO: 9380677 - DNA, 22 bp, Homo sapiens
tctcaggcatggtttgttcatc

SEQ ID NO: 9380678 - DNA, 22 bp, Homo sapiens
tctcaggcatctgtgtggcaca

SEQ ID NO: 9380679 - DNA, 22 bp, Homo sapiens
tctcaggcactgggtgccaact

SEQ ID NO: 9380680 - DNA, 17 bp, Homo sapiens
tctcaggcacgtgtggc

SEQ ID NO: 9380681 - DNA, 22 bp, Homo sapiens
ccagagcctcttatgaagatcg

SEQ ID NO: 9380682 - DNA, 22 bp, Homo sapiens
ccagagcctcttatgaagatcg

SEQ ID NO: 9380683 - DNA, 22 bp, Homo sapiens
ccagagcctcgcccggagcctc

SEQ ID NO: 9380684 - DNA, 22 bp, Homo sapiens
ccagagcctcgcccggagcctc

SEQ ID NO: 9380685 - DNA, 22 bp, Homo sapiens
ccagagcctcgcccggagcctc

SEQ ID NO: 9380686 - DNA, 22 bp, Homo sapiens
ccagagcctaagatctgatcct

SEQ ID NO: 9380687 - DNA, 22 bp, Homo sapiens
ccagagcctcaacacaggtcct

SEQ ID NO: 9380688 - DNA, 22 bp, Homo sapiens
ccagagcctcaacacaggtcct

SEQ ID NO: 9380689 - DNA, 22 bp, Homo sapiens
ccagagcctcaacacaggtcct

SEQ ID NO: 9380690 - DNA, 22 bp, Homo sapiens
ccagaggatcagtactggctgg

SEQ ID NO: 9380691 - DNA, 22 bp, Homo sapiens
ccagaggatcagtactggctgg

SEQ ID NO: 9380692 - DNA, 22 bp, Homo sapiens
ccagaggctggcagccagctga

SEQ ID NO: 9380693 - DNA, 22 bp, Homo sapiens
ccagagggagccaccagggtgt

SEQ ID NO: 9380694 - DNA, 22 bp, Homo sapiens
ccagagggaactgggcctcatt

SEQ ID NO: 9380695 - DNA, 22 bp, Homo sapiens
ccagagccggctccctcagctt

SEQ ID NO: 9380696 - DNA, 22 bp, Homo sapiens
ccagagccggattgtgaagtgc

SEQ ID NO: 9380697 - DNA, 22 bp, Homo sapiens
ccagagcccgggacctggactt

SEQ ID NO: 9380698 - DNA, 22 bp, Homo sapiens
ccagagcccctgagcttccctg

SEQ ID NO: 9380699 - DNA, 22 bp, Homo sapiens
ccagagcccctgagcttccctg

SEQ ID NO: 9380700 - DNA, 19 bp, Homo sapiens
ccagagcccgccagatggg

SEQ ID NO: 9380701 - DNA, 19 bp, Homo sapiens
ccagagcccgccagatggg

SEQ ID NO: 9380702 - DNA, 19 bp, Homo sapiens
ccagagcccgccagatggg

SEQ ID NO: 9380703 - DNA, 19 bp, Homo sapiens
ccagagcccgccagatggg

SEQ ID NO: 9380704 - DNA, 20 bp, Homo sapiens
ccagagcagccactgaagtt

SEQ ID NO: 9380705 - DNA, 22 bp, Homo sapiens
ccagagcagggcagcagggctc

SEQ ID NO: 9380706 - DNA, 20 bp, Homo sapiens
ccagagcagccactgaagtt

SEQ ID NO: 9380707 - DNA, 20 bp, Homo sapiens
ccagagcagccactgaagtt

SEQ ID NO: 9380708 - DNA, 22 bp, Homo sapiens
ccagagcagggcagcagggctc

SEQ ID NO: 9380709 - DNA, 22 bp, Homo sapiens
ccagagcagggcagcagggctc

SEQ ID NO: 9380710 - DNA, 22 bp, Homo sapiens
ccagagcagggcagcagggctc

SEQ ID NO: 9380711 - DNA, 22 bp, Homo sapiens
ccagagcccagggtcatgcagg

SEQ ID NO: 9380712 - DNA, 22 bp, Homo sapiens
ccagagcccagcacacggtgct

SEQ ID NO: 9380713 - DNA, 22 bp, Homo sapiens
ccagagcatgaagggcaatgac

SEQ ID NO: 9380714 - DNA, 22 bp, Homo sapiens
ccagagcatgaagggcaatgac

SEQ ID NO: 9380715 - DNA, 22 bp, Homo sapiens
ccagagccagagaggtgcctgc

SEQ ID NO: 9380716 - DNA, 22 bp, Homo sapiens
ccagagcatgaagggcaatgac

SEQ ID NO: 9380717 - DNA, 22 bp, Homo sapiens
ccagagcatgaagggcaatgac

SEQ ID NO: 9380718 - DNA, 22 bp, Homo sapiens
ccagattcagatatggcagtgg

SEQ ID NO: 9380719 - DNA, 22 bp, Homo sapiens
ccagattcatagaaactcatag

SEQ ID NO: 9380720 - DNA, 22 bp, Homo sapiens
ccagatttgagcgtcttaaacc

SEQ ID NO: 9380721 - DNA, 22 bp, Homo sapiens
ccagatttgagcgtcttaaacc

SEQ ID NO: 9380722 - DNA, 22 bp, Homo sapiens
ccagatgtccctctcaggtttg

SEQ ID NO: 9380723 - DNA, 22 bp, Homo sapiens
ccagatgtccctctcaggtttg

SEQ ID NO: 9380724 - DNA, 22 bp, Homo sapiens
ccagatgtccctctcaggtttg

SEQ ID NO: 9380725 - DNA, 20 bp, Homo sapiens
ccagcaccctctcagctgaa

SEQ ID NO: 9380726 - DNA, 20 bp, Homo sapiens
ccagcaccctctcagctgaa

SEQ ID NO: 9380727 - DNA, 20 bp, Homo sapiens
ccagcaccctctcagctgaa

SEQ ID NO: 9380728 - DNA, 22 bp, Homo sapiens
ccagcaccttgatcttggagtt

SEQ ID NO: 9380729 - DNA, 22 bp, Homo sapiens
ccagcaagccaggtctgtggct

SEQ ID NO: 9380730 - DNA, 22 bp, Homo sapiens
ccagcaagtgcagatggccaag

SEQ ID NO: 9380731 - DNA, 22 bp, Homo sapiens
tctctgtcacacaatctacaca

SEQ ID NO: 9380732 - DNA, 22 bp, Homo sapiens
tctctgtagggctgcttgagta

SEQ ID NO: 9380733 - DNA, 22 bp, Homo sapiens
tctctgtagttgggcagctgct

SEQ ID NO: 9380734 - DNA, 22 bp, Homo sapiens
tctctgtaaggaagaattagat

SEQ ID NO: 9380735 - DNA, 22 bp, Homo sapiens
tctctgtaaggaagaattagat

SEQ ID NO: 9380736 - DNA, 20 bp, Homo sapiens
ccagagggtagggccgcccc

SEQ ID NO: 9380737 - DNA, 22 bp, Homo sapiens
ccagagggccctggtctcagct

SEQ ID NO: 9380738 - DNA, 22 bp, Homo sapiens
ccagaggtctcctgcacgggat

SEQ ID NO: 9380739 - DNA, 22 bp, Homo sapiens
tctctgggataaactgggccag

SEQ ID NO: 9380740 - DNA, 22 bp, Homo sapiens
ccagaggtcctgctcactggtg

SEQ ID NO: 9380741 - DNA, 18 bp, Homo sapiens
ccagagggtgcgtcagct

SEQ ID NO: 9380742 - DNA, 18 bp, Homo sapiens
ccagagggtgcgtcagct

SEQ ID NO: 9380743 - DNA, 22 bp, Homo sapiens
tttggcatagctctttgttcct

SEQ ID NO: 9380744 - DNA, 22 bp, Homo sapiens
tttggcatttaataggtgatca

SEQ ID NO: 9380745 - DNA, 22 bp, Homo sapiens
tttggctcatctcagtcctagg

SEQ ID NO: 9380746 - DNA, 22 bp, Homo sapiens
tttggctcggctgctgatggtg

SEQ ID NO: 9380747 - DNA, 23 bp, Homo sapiens
tttggctccatgggtggctcatt

SEQ ID NO: 9380748 - DNA, 22 bp, Homo sapiens
tttggctctggttctggctcca

SEQ ID NO: 9380749 - DNA, 19 bp, Homo sapiens
tttggctctggtcagagag

SEQ ID NO: 9380750 - DNA, 22 bp, Homo sapiens
tttggctttagtgccttctgat

SEQ ID NO: 9380751 - DNA, 22 bp, Homo sapiens
tttggcttaacttacatgatat

SEQ ID NO: 9380752 - DNA, 22 bp, Homo sapiens
tttggggatgacaggttaggaa

SEQ ID NO: 9380753 - DNA, 22 bp, Homo sapiens
tttggggatgtctgagttgttg

SEQ ID NO: 9380754 - DNA, 22 bp, Homo sapiens
tttggggaggttatcggtgtgc

SEQ ID NO: 9380755 - DNA, 22 bp, Homo sapiens
tttggggagacatggccagctg

SEQ ID NO: 9380756 - DNA, 22 bp, Homo sapiens
tttgggctcttgctgacctggg

SEQ ID NO: 9380757 - DNA, 22 bp, Homo sapiens
tttgggctcactatgctgaaga

SEQ ID NO: 9380758 - DNA, 22 bp, Homo sapiens
tttgtcctctccatgtacaata

SEQ ID NO: 9380759 - DNA, 22 bp, Homo sapiens
tttgtcctctccatgtacaata

SEQ ID NO: 9380760 - DNA, 22 bp, Homo sapiens
tttgtcctataatcctcttaca

SEQ ID NO: 9380761 - DNA, 22 bp, Homo sapiens
tttgtcctaacagtggtaaagg

SEQ ID NO: 9380762 - DNA, 20 bp, Homo sapiens
tttgtccagcgtctactctg

SEQ ID NO: 9380763 - DNA, 22 bp, Homo sapiens
tttgtccagatgcacagataat

SEQ ID NO: 9380764 - DNA, 21 bp, Homo sapiens
tttgtccacctgtgttcacca

SEQ ID NO: 9380765 - DNA, 22 bp, Homo sapiens
tttgcagttccatccaggcaga

SEQ ID NO: 9380766 - DNA, 22 bp, Homo sapiens
tttgcagttcatctgagaaaaa

SEQ ID NO: 9380767 - DNA, 22 bp, Homo sapiens
tttgcagtttcattgctgaaat

SEQ ID NO: 9380768 - DNA, 22 bp, Homo sapiens
tttgcagtttcattgctgaaat

SEQ ID NO: 9380769 - DNA, 22 bp, Homo sapiens
tttgcatacatgagaatgtctt

SEQ ID NO: 9380770 - DNA, 22 bp, Homo sapiens
tttgcataggatggacatttta

SEQ ID NO: 9380771 - DNA, 22 bp, Homo sapiens
tttgcataaaggagcatttctc

SEQ ID NO: 9380772 - DNA, 22 bp, Homo sapiens
tttgcagtttgttcagctcttt

SEQ ID NO: 9380773 - DNA, 22 bp, Homo sapiens
tttgcataagtcatgtccagtg

SEQ ID NO: 9380774 - DNA, 22 bp, Homo sapiens
tttgcattagtttagatttcaa

SEQ ID NO: 9380775 - DNA, 22 bp, Homo sapiens
tttgcattacttgactttagtt

SEQ ID NO: 9380776 - DNA, 22 bp, Homo sapiens
tttgcattacttgactttagtt

SEQ ID NO: 9380777 - DNA, 22 bp, Homo sapiens
tttgcattatatttatagaaga

SEQ ID NO: 9380778 - DNA, 22 bp, Homo sapiens
tttgcattatctcacttatata

SEQ ID NO: 9380779 - DNA, 22 bp, Homo sapiens
tttgcagtgtcagcttctgtgt

SEQ ID NO: 9380780 - DNA, 22 bp, Homo sapiens
tttgcagtgttcatcagtattt

SEQ ID NO: 9380781 - DNA, 22 bp, Homo sapiens
tttgagatggagtcttgctctg

SEQ ID NO: 9380782 - DNA, 20 bp, Homo sapiens
tttgagaccagtctgcccaa

SEQ ID NO: 9380783 - DNA, 20 bp, Homo sapiens
tttgagaccagtctgcccaa

SEQ ID NO: 9380784 - DNA, 22 bp, Homo sapiens
tttgagaatggtaagtggatcg

SEQ ID NO: 9380785 - DNA, 19 bp, Homo sapiens
tttgagaagttattatcta

SEQ ID NO: 9380786 - DNA, 22 bp, Homo sapiens
tttgctgaatagattgtaaact

SEQ ID NO: 9380787 - DNA, 22 bp, Homo sapiens
tttgcttcacaagtatggttct

SEQ ID NO: 9380788 - DNA, 22 bp, Homo sapiens
tttgctgtgggatatccatgtg

SEQ ID NO: 9380789 - DNA, 20 bp, Homo sapiens
tttgctgtgggtgtaagaat

SEQ ID NO: 9380790 - DNA, 22 bp, Homo sapiens
tttgctgtgaatccattactgt

SEQ ID NO: 9380791 - DNA, 22 bp, Homo sapiens
tttgcattgtaatatttagttc

SEQ ID NO: 9380792 - DNA, 22 bp, Homo sapiens
tttgcattgtaatatttagttc

SEQ ID NO: 9380793 - DNA, 22 bp, Homo sapiens
tttgcattgtaatatttagttc

SEQ ID NO: 9380794 - DNA, 22 bp, Homo sapiens
tttgcattgcattaagtattct

SEQ ID NO: 9380795 - DNA, 22 bp, Homo sapiens
tttgcatttgttcaagtattga

SEQ ID NO: 9380796 - DNA, 22 bp, Homo sapiens
tttgcatttgcaaataatgaaa

SEQ ID NO: 9380797 - DNA, 22 bp, Homo sapiens
tttgcattgtttcaaaagtgaa

SEQ ID NO: 9380798 - DNA, 22 bp, Homo sapiens
tttgaacaagagcttcacatta

SEQ ID NO: 9380799 - DNA, 22 bp, Homo sapiens
tttgaacagacactttctacag

SEQ ID NO: 9380800 - DNA, 22 bp, Homo sapiens
tttgaacaggagtatctatagt

SEQ ID NO: 9380801 - DNA, 22 bp, Homo sapiens
tttgaacaggagtatctatagt

SEQ ID NO: 9380802 - DNA, 22 bp, Homo sapiens
tttgaacagtagcttaggtgtg

SEQ ID NO: 9380803 - DNA, 22 bp, Homo sapiens
tttgaacagggaatgttccaca

SEQ ID NO: 9380804 - DNA, 22 bp, Homo sapiens
tttgaacatgctgcatgataat

SEQ ID NO: 9380805 - DNA, 22 bp, Homo sapiens
tttgaacatgctgcatgataat

SEQ ID NO: 9380806 - DNA, 22 bp, Homo sapiens
tttgaacatcactgtagggtga

SEQ ID NO: 9380807 - DNA, 22 bp, Homo sapiens
tttgaacattcaacagacccag

SEQ ID NO: 9380808 - DNA, 23 bp, Homo sapiens
tttgaacatttctagattacata

SEQ ID NO: 9380809 - DNA, 22 bp, Homo sapiens
tttgacagcataatcctacacc

SEQ ID NO: 9380810 - DNA, 22 bp, Homo sapiens
tttgaagactactgggagtgaa

SEQ ID NO: 9380811 - DNA, 22 bp, Homo sapiens
tttgacagcagataaaataaaa

SEQ ID NO: 9380812 - DNA, 22 bp, Homo sapiens
tttgacagcagataaaataaaa

SEQ ID NO: 9380813 - DNA, 22 bp, Homo sapiens
tttgaagactactgggagtgaa

SEQ ID NO: 9380814 - DNA, 22 bp, Homo sapiens
tttgaagacatattgttacata

SEQ ID NO: 9380815 - DNA, 22 bp, Homo sapiens
tttgaacttctacctgtcatat

SEQ ID NO: 9380816 - DNA, 22 bp, Homo sapiens
tttgaagaagctgacctatttt

SEQ ID NO: 9380817 - DNA, 23 bp, Homo sapiens
tttgaagaagtgaatatcatata

SEQ ID NO: 9380818 - DNA, 22 bp, Homo sapiens
tttgaagacagatcaatataag

SEQ ID NO: 9380819 - DNA, 22 bp, Homo sapiens
tttgacagcttgttacaaagtt

SEQ ID NO: 9380820 - DNA, 22 bp, Homo sapiens
tttgacagcttgttacaaagtt

SEQ ID NO: 9380821 - DNA, 22 bp, Homo sapiens
tttgacaggactaacatatggc

SEQ ID NO: 9380822 - DNA, 22 bp, Homo sapiens
tttgacagggtgatgaggtggt

SEQ ID NO: 9380823 - DNA, 22 bp, Homo sapiens
tttgacagtaataaagcacaag

SEQ ID NO: 9380824 - DNA, 22 bp, Homo sapiens
tttgacagtgctgctaaaatgc

SEQ ID NO: 9380825 - DNA, 22 bp, Homo sapiens
tttgacatcaataccctagaat

SEQ ID NO: 9380826 - DNA, 22 bp, Homo sapiens
tttgacatctaagaattcttac

SEQ ID NO: 9380827 - DNA, 22 bp, Homo sapiens
tttgacagtgctattaagaaac

SEQ ID NO: 9380828 - DNA, 22 bp, Homo sapiens
tttgacagtgctattaagaaac

SEQ ID NO: 9380829 - DNA, 22 bp, Homo sapiens
tttgacagtactctgtaggatc

SEQ ID NO: 9380830 - DNA, 22 bp, Homo sapiens
tttgacattgccaatttgctca

SEQ ID NO: 9380831 - DNA, 22 bp, Homo sapiens
tttgagaagcatctggtccact

SEQ ID NO: 9380832 - DNA, 22 bp, Homo sapiens
tttgacattggcttattctgtt

SEQ ID NO: 9380833 - DNA, 19 bp, Homo sapiens
tttgagaagttattatcta

SEQ ID NO: 9380834 - DNA, 22 bp, Homo sapiens
tttgagaagctgtcttgggctc

SEQ ID NO: 9380835 - DNA, 22 bp, Homo sapiens
tttgagaaggtgacaaattcta

SEQ ID NO: 9380836 - DNA, 22 bp, Homo sapiens
tttgacatgtgcttataacttt

SEQ ID NO: 9380837 - DNA, 22 bp, Homo sapiens
tttgacatgcaaagcactttag

SEQ ID NO: 9380838 - DNA, 22 bp, Homo sapiens
tttgacattatcctgttactgg

SEQ ID NO: 9380839 - DNA, 22 bp, Homo sapiens
tttgacattatcctgttactgg

SEQ ID NO: 9380840 - DNA, 22 bp, Homo sapiens
tttctatatgaggagctaaagt

SEQ ID NO: 9380841 - DNA, 22 bp, Homo sapiens
tttctatatgaggagctaaagt

SEQ ID NO: 9380842 - DNA, 20 bp, Homo sapiens
tttctatggggccagcacat

SEQ ID NO: 9380843 - DNA, 22 bp, Homo sapiens
tttctattctggatctgtggca

SEQ ID NO: 9380844 - DNA, 22 bp, Homo sapiens
tttctatctagggttagagtga

SEQ ID NO: 9380845 - DNA, 22 bp, Homo sapiens
tttctattgatctaataaacat

SEQ ID NO: 9380846 - DNA, 22 bp, Homo sapiens
tttgaaagtcctaggagagtcc

SEQ ID NO: 9380847 - DNA, 21 bp, Homo sapiens
tttgaaagtgggtgattcttt

SEQ ID NO: 9380848 - DNA, 21 bp, Homo sapiens
tttgaaagtgggtgattcttt

SEQ ID NO: 9380849 - DNA, 22 bp, Homo sapiens
tttctattggcgtcactgttgt

SEQ ID NO: 9380850 - DNA, 22 bp, Homo sapiens
tttctattggcgtcactgttgt

SEQ ID NO: 9380851 - DNA, 22 bp, Homo sapiens
tttgaaagttcttctgacacta

SEQ ID NO: 9380852 - DNA, 22 bp, Homo sapiens
tttgaaatatgaggcattatga

SEQ ID NO: 9380853 - DNA, 22 bp, Homo sapiens
tttgaaatatgaggcattatga

SEQ ID NO: 9380854 - DNA, 22 bp, Homo sapiens
tttgaaatatgaggcattatga

SEQ ID NO: 9380855 - DNA, 22 bp, Homo sapiens
tttgaaatctaatcaaggaaca

SEQ ID NO: 9380856 - DNA, 22 bp, Homo sapiens
tttgaaatctaatcaaggaaca

SEQ ID NO: 9380857 - DNA, 22 bp, Homo sapiens
tttgaaattaagatattgtcca

SEQ ID NO: 9380858 - DNA, 22 bp, Homo sapiens
tttctagatcaaacttttatat

SEQ ID NO: 9380859 - DNA, 22 bp, Homo sapiens
tttctagagtgggcatgtctta

SEQ ID NO: 9380860 - DNA, 22 bp, Homo sapiens
tttctagagttcatcatggtaa

SEQ ID NO: 9380861 - DNA, 22 bp, Homo sapiens
tttctagagttcatcatggtaa

SEQ ID NO: 9380862 - DNA, 22 bp, Homo sapiens
tttctagactcaaagaggatat

SEQ ID NO: 9380863 - DNA, 22 bp, Homo sapiens
tttctagacatttctatgtaca

SEQ ID NO: 9380864 - DNA, 22 bp, Homo sapiens
tttctagatgcggggcttgtgc

SEQ ID NO: 9380865 - DNA, 22 bp, Homo sapiens
tttctagatgatacggtatgtg

SEQ ID NO: 9380866 - DNA, 22 bp, Homo sapiens
tttctagctgtaggaagctgag

SEQ ID NO: 9380867 - DNA, 17 bp, Homo sapiens
tttctagattatcctct

SEQ ID NO: 9380868 - DNA, 22 bp, Homo sapiens
tttctataactggactggattg

SEQ ID NO: 9380869 - DNA, 22 bp, Homo sapiens
tttctagtggttaagatttaca

SEQ ID NO: 9380870 - DNA, 22 bp, Homo sapiens
tttctagtggttaagatttaca

SEQ ID NO: 9380871 - DNA, 22 bp, Homo sapiens
tttctagtctcgatctcttaat

SEQ ID NO: 9380872 - DNA, 22 bp, Homo sapiens
tttctagtcagccatatctagt

SEQ ID NO: 9380873 - DNA, 20 bp, Homo sapiens
ttttccagaaagtatcattg

SEQ ID NO: 9380874 - DNA, 20 bp, Homo sapiens
ttttccagaaagtatcattg

SEQ ID NO: 9380875 - DNA, 20 bp, Homo sapiens
ttttccactcctcaaaacag

SEQ ID NO: 9380876 - DNA, 22 bp, Homo sapiens
ttttccactttagtgcaataac

SEQ ID NO: 9380877 - DNA, 20 bp, Homo sapiens
ttttccactcctcaaaacag

SEQ ID NO: 9380878 - DNA, 22 bp, Homo sapiens
ttttcacaagggtccaactagt

SEQ ID NO: 9380879 - DNA, 16 bp, Homo sapiens
ttttcaagagcggaga

SEQ ID NO: 9380880 - DNA, 22 bp, Homo sapiens
ttttcaagggcagggaaatcat

SEQ ID NO: 9380881 - DNA, 22 bp, Homo sapiens
ttttcaagggcagggaaatcat

SEQ ID NO: 9380882 - DNA, 16 bp, Homo sapiens
ttttattgtgacagcc

SEQ ID NO: 9380883 - DNA, 16 bp, Homo sapiens
ttttattgtgacagcc

SEQ ID NO: 9380884 - DNA, 16 bp, Homo sapiens
ttttattgtgacagcc

SEQ ID NO: 9380885 - DNA, 16 bp, Homo sapiens
ttttattgtgacagcc

SEQ ID NO: 9380886 - DNA, 22 bp, Homo sapiens
ttttattgtctcccagttctgg

SEQ ID NO: 9380887 - DNA, 22 bp, Homo sapiens
ttttattgtctcccagttctgg

SEQ ID NO: 9380888 - DNA, 22 bp, Homo sapiens
ttttattgtctgtattgcctat

SEQ ID NO: 9380889 - DNA, 22 bp, Homo sapiens
ttttattgtctgtattgcctat

SEQ ID NO: 9380890 - DNA, 22 bp, Homo sapiens
ttttattgtctgtattgcctat

SEQ ID NO: 9380891 - DNA, 22 bp, Homo sapiens
ttttattgtctgtattgcctat

SEQ ID NO: 9380892 - DNA, 22 bp, Homo sapiens
ttttattgtctcccagttctgg

SEQ ID NO: 9380893 - DNA, 22 bp, Homo sapiens
ttttattgtctcccagttctgg

SEQ ID NO: 9380894 - DNA, 22 bp, Homo sapiens
ttttattgtcaatgaagacaga

SEQ ID NO: 9380895 - DNA, 22 bp, Homo sapiens
ttttattgtcaatgaagacaga

SEQ ID NO: 9380896 - DNA, 22 bp, Homo sapiens
ttttattgtcaatgaagacaga

SEQ ID NO: 9380897 - DNA, 22 bp, Homo sapiens
ttttattgtcaatgaagacaga

SEQ ID NO: 9380898 - DNA, 22 bp, Homo sapiens
ttttacttaattcttggtcatg

SEQ ID NO: 9380899 - DNA, 22 bp, Homo sapiens
ttttacttcattcctgacttca

SEQ ID NO: 9380900 - DNA, 22 bp, Homo sapiens
ttttacttcattcctgacttca

SEQ ID NO: 9380901 - DNA, 22 bp, Homo sapiens
ttttattggtaatgataaaagt

SEQ ID NO: 9380902 - DNA, 22 bp, Homo sapiens
ttttattggtaatgataaaagt

SEQ ID NO: 9380903 - DNA, 22 bp, Homo sapiens
ttttattggtaatgataaaagt

SEQ ID NO: 9380904 - DNA, 22 bp, Homo sapiens
ttttattggtaatgataaaagt

SEQ ID NO: 9380905 - DNA, 22 bp, Homo sapiens
ttttattggtaatgataaaagt

SEQ ID NO: 9380906 - DNA, 22 bp, Homo sapiens
ttttattgggagtcctctactg

SEQ ID NO: 9380907 - DNA, 22 bp, Homo sapiens
ttttattgggagtcctctactg

SEQ ID NO: 9380908 - DNA, 22 bp, Homo sapiens
ttttagaagtgcctatcctatg

SEQ ID NO: 9380909 - DNA, 22 bp, Homo sapiens
ttttattgggagtcctctactg

SEQ ID NO: 9380910 - DNA, 22 bp, Homo sapiens
ttttattgggagtcctctactg

SEQ ID NO: 9380911 - DNA, 22 bp, Homo sapiens
ttttattgggagtcctctactg

SEQ ID NO: 9380912 - DNA, 22 bp, Homo sapiens
ttttacaaatgaggagctggag

SEQ ID NO: 9380913 - DNA, 22 bp, Homo sapiens
ttttacaagctgagtcgttaaa

SEQ ID NO: 9380914 - DNA, 22 bp, Homo sapiens
ttttaattttgcaaatctggtg

SEQ ID NO: 9380915 - DNA, 22 bp, Homo sapiens
ttttaattttagcccttctggt

SEQ ID NO: 9380916 - DNA, 22 bp, Homo sapiens
tttgtggcaggagcggagaccg

SEQ ID NO: 9380917 - DNA, 22 bp, Homo sapiens
tttgtgtaccttgtacatttgt

SEQ ID NO: 9380918 - DNA, 22 bp, Homo sapiens
ttttacaagctgagtcgttaaa

SEQ ID NO: 9380919 - DNA, 22 bp, Homo sapiens
ttttacacctcagatgagcaga

SEQ ID NO: 9380920 - DNA, 22 bp, Homo sapiens
ttttacacctcagatgagcaga

SEQ ID NO: 9380921 - DNA, 21 bp, Homo sapiens
ttttacagatgaggggaaggg

SEQ ID NO: 9380922 - DNA, 22 bp, Homo sapiens
ttttacacttcggttgtgtgca

SEQ ID NO: 9380923 - DNA, 22 bp, Homo sapiens
ttttacaggtcataggtatagt

SEQ ID NO: 9380924 - DNA, 22 bp, Homo sapiens
ttttacaggtcataggtatagt

SEQ ID NO: 9380925 - DNA, 22 bp, Homo sapiens
ttttacacctgttaactctaag

SEQ ID NO: 9380926 - DNA, 22 bp, Homo sapiens
ttttacacctgttaactctaag

SEQ ID NO: 9380927 - DNA, 22 bp, Homo sapiens
ttttacacctgttaactctaag

SEQ ID NO: 9380928 - DNA, 22 bp, Homo sapiens
ttttacacttcggttgtgtgca

SEQ ID NO: 9380929 - DNA, 22 bp, Homo sapiens
ttttacaggtcataggtatagt

SEQ ID NO: 9380930 - DNA, 22 bp, Homo sapiens
ttttacaggtgaaaaatgaaga

SEQ ID NO: 9380931 - DNA, 22 bp, Homo sapiens
ttttacagttccatgcaaagcg

SEQ ID NO: 9380932 - DNA, 22 bp, Homo sapiens
ttttacagttccatgcaaagcg

SEQ ID NO: 9380933 - DNA, 22 bp, Homo sapiens
ttttacagttccatgcaaagcg

SEQ ID NO: 9380934 - DNA, 22 bp, Homo sapiens
ttttacagtcagtcaaactcag

SEQ ID NO: 9380935 - DNA, 22 bp, Homo sapiens
ttttacagttccatgcaaagcg

SEQ ID NO: 9380936 - DNA, 22 bp, Homo sapiens
ttttacaggtgtgagccaccat

SEQ ID NO: 9380937 - DNA, 22 bp, Homo sapiens
tttgtggaactctcttcttgca

SEQ ID NO: 9380938 - DNA, 22 bp, Homo sapiens
tttgtggaactctcttcttgca

SEQ ID NO: 9380939 - DNA, 22 bp, Homo sapiens
tttgtgcattcaagtaggagcc

SEQ ID NO: 9380940 - DNA, 22 bp, Homo sapiens
tttgtgcataaagggctatagt

SEQ ID NO: 9380941 - DNA, 22 bp, Homo sapiens
tttgtgcatgggtatggccaat

SEQ ID NO: 9380942 - DNA, 22 bp, Homo sapiens
tttgtgcagtggttaagaccat

SEQ ID NO: 9380943 - DNA, 22 bp, Homo sapiens
tttgtgcaggtgtgtcagatcg

SEQ ID NO: 9380944 - DNA, 22 bp, Homo sapiens
tttgtgcagctaagaaaatggc

SEQ ID NO: 9380945 - DNA, 22 bp, Homo sapiens
tttgtgcaggtataggcggaga

SEQ ID NO: 9380946 - DNA, 22 bp, Homo sapiens
tttgtgcagatgtatatttgtg

SEQ ID NO: 9380947 - DNA, 19 bp, Homo sapiens
tttgtgcagcaacattaat

SEQ ID NO: 9380948 - DNA, 19 bp, Homo sapiens
tttgtgcagcaacattaat

SEQ ID NO: 9380949 - DNA, 22 bp, Homo sapiens
tttgtgcacattgcttttctat

SEQ ID NO: 9380950 - DNA, 22 bp, Homo sapiens
tttgtgcacattgcttttctat

SEQ ID NO: 9380951 - DNA, 23 bp, Homo sapiens
tttgtgcagaagacaaagtggcc

SEQ ID NO: 9380952 - DNA, 22 bp, Homo sapiens
tttgtgcagataggagacaatc

SEQ ID NO: 9380953 - DNA, 22 bp, Homo sapiens
tttgtgcacttctgtagctgcc

SEQ ID NO: 9380954 - DNA, 22 bp, Homo sapiens
tttgtgcaatttatgtactata

SEQ ID NO: 9380955 - DNA, 22 bp, Homo sapiens
tttgtgcaagagggccacctta

SEQ ID NO: 9380956 - DNA, 22 bp, Homo sapiens
tttgtgcaatttatgtactata

SEQ ID NO: 9380957 - DNA, 22 bp, Homo sapiens
tttgtgcacattgcttttctat

SEQ ID NO: 9380958 - DNA, 22 bp, Homo sapiens
tttgtgcaagacatgctaagag

SEQ ID NO: 9380959 - DNA, 22 bp, Homo sapiens
tttgtgcaagagggccacctta

SEQ ID NO: 9380960 - DNA, 22 bp, Homo sapiens
tttgtcttaaatcttgttactg

SEQ ID NO: 9380961 - DNA, 22 bp, Homo sapiens
tttgtccttgaatcaattcaca

SEQ ID NO: 9380962 - DNA, 22 bp, Homo sapiens
tttgtccttgtcctacatcggt

SEQ ID NO: 9380963 - DNA, 19 bp, Homo sapiens
tttgtcctgccctttctca

SEQ ID NO: 9380964 - DNA, 20 bp, Homo sapiens
tttgtctgttaagtgtttct

SEQ ID NO: 9380965 - DNA, 22 bp, Homo sapiens
ttttccagcataggtacatata

SEQ ID NO: 9380966 - DNA, 22 bp, Homo sapiens
ttttccagcataggtacatata

SEQ ID NO: 9380967 - DNA, 22 bp, Homo sapiens
ttttccagattggacttagtcc

SEQ ID NO: 9380968 - DNA, 22 bp, Homo sapiens
ttttccagattggacttagtcc

SEQ ID NO: 9380969 - DNA, 22 bp, Homo sapiens
ttttccagatggatactagaat

SEQ ID NO: 9380970 - DNA, 22 bp, Homo sapiens
ttttccagatggatactagaat

SEQ ID NO: 9380971 - DNA, 22 bp, Homo sapiens
ttttccagatggatactagaat

SEQ ID NO: 9380972 - DNA, 22 bp, Homo sapiens
ttttccagatgaattccacagt

SEQ ID NO: 9380973 - DNA, 22 bp, Homo sapiens
ttttccagatgaattccacagt

SEQ ID NO: 9380974 - DNA, 22 bp, Homo sapiens
ttttccagagctgtctcttgca

SEQ ID NO: 9380975 - DNA, 22 bp, Homo sapiens
ttttccagagctgtctcttgca

SEQ ID NO: 9380976 - DNA, 23 bp, Homo sapiens
ttttccagaatcgactctgtaga

SEQ ID NO: 9380977 - DNA, 23 bp, Homo sapiens
ttttccagaatcgactctgtaga

SEQ ID NO: 9380978 - DNA, 22 bp, Homo sapiens
ttttcctactgataaacagtta

SEQ ID NO: 9380979 - DNA, 22 bp, Homo sapiens
ttttcctagtaggcctattaga

SEQ ID NO: 9380980 - DNA, 22 bp, Homo sapiens
ttttcctcaggaatgctaagct

SEQ ID NO: 9380981 - DNA, 22 bp, Homo sapiens
ttttcctatatgcaaagaatgc

SEQ ID NO: 9380982 - DNA, 22 bp, Homo sapiens
ttttccttagcttctctgcgag

SEQ ID NO: 9380983 - DNA, 22 bp, Homo sapiens
ttttccttaacagagggagaaa

SEQ ID NO: 9380984 - DNA, 22 bp, Homo sapiens
ttttccttcatatcccttatgt

SEQ ID NO: 9380985 - DNA, 22 bp, Homo sapiens
ttttccttcatatcccttatgt

SEQ ID NO: 9380986 - DNA, 22 bp, Homo sapiens
ttttccttcacctcttgagcct

SEQ ID NO: 9380987 - DNA, 22 bp, Homo sapiens
ttttccttcacctcttgagcct

SEQ ID NO: 9380988 - DNA, 22 bp, Homo sapiens
ttttcctctgagctttgaataa

SEQ ID NO: 9380989 - DNA, 22 bp, Homo sapiens
ttttcctctgagctttgaataa

SEQ ID NO: 9380990 - DNA, 20 bp, Homo sapiens
ttttcctcgtgtttgttcta

SEQ ID NO: 9380991 - DNA, 22 bp, Homo sapiens
ttttcctctgcagagcagttag

SEQ ID NO: 9380992 - DNA, 22 bp, Homo sapiens
ttttcctctgcaataaaagcag

SEQ ID NO: 9380993 - DNA, 22 bp, Homo sapiens
ttttcctctgtatgcgtgagat

SEQ ID NO: 9380994 - DNA, 22 bp, Homo sapiens
ttttcctctgcagagcagttag

SEQ ID NO: 9380995 - DNA, 22 bp, Homo sapiens
ttttggtaaataatcaactttg

SEQ ID NO: 9380996 - DNA, 22 bp, Homo sapiens
ttttggtaatgaacttaggaag

SEQ ID NO: 9380997 - DNA, 22 bp, Homo sapiens
ttttgggtgaatttgccagtta

SEQ ID NO: 9380998 - DNA, 22 bp, Homo sapiens
ttttccttctagagcagatttc

SEQ ID NO: 9380999 - DNA, 18 bp, Homo sapiens
ttttccttccaccttgaa

SEQ ID NO: 9381000 - DNA, 18 bp, Homo sapiens
ttttccttccaccttgaa

SEQ ID NO: 9381001 - DNA, 19 bp, Homo sapiens
ttttccttctatatgtttc

SEQ ID NO: 9381002 - DNA, 22 bp, Homo sapiens
ttttggtttcccttcttatggt

SEQ ID NO: 9381003 - DNA, 22 bp, Homo sapiens
ttttggtagccaacaaaatgtt

SEQ ID NO: 9381004 - DNA, 22 bp, Homo sapiens
ttttggtagcttatgtgcagtt

SEQ ID NO: 9381005 - DNA, 22 bp, Homo sapiens
ttttggtacatgcaatagcaat

SEQ ID NO: 9381006 - DNA, 22 bp, Homo sapiens
ttttggtaatgcctaacttcgt

SEQ ID NO: 9381007 - DNA, 22 bp, Homo sapiens
ttttggtacctacagctgaatt

SEQ ID NO: 9381008 - DNA, 22 bp, Homo sapiens
ttttggtagaatcaacaatgta

SEQ ID NO: 9381009 - DNA, 22 bp, Homo sapiens
ttttggtagaatgatattggat

SEQ ID NO: 9381010 - DNA, 22 bp, Homo sapiens
ttttttatagcaatgaacccac

SEQ ID NO: 9381011 - DNA, 22 bp, Homo sapiens
ttttttacagaatcattaatca

SEQ ID NO: 9381012 - DNA, 22 bp, Homo sapiens
ttttttatatcaactgaagtct

SEQ ID NO: 9381013 - DNA, 22 bp, Homo sapiens
ttttttatatcaactgaagtct

SEQ ID NO: 9381014 - DNA, 22 bp, Homo sapiens
ttttttatctatggtagtacca

SEQ ID NO: 9381015 - DNA, 22 bp, Homo sapiens
ttttttatctatggtagtacca

SEQ ID NO: 9381016 - DNA, 22 bp, Homo sapiens
ttttttccagcttctagaggcc

SEQ ID NO: 9381017 - DNA, 22 bp, Homo sapiens
ttttttccaacttaagacttca

SEQ ID NO: 9381018 - DNA, 22 bp, Homo sapiens
tttttgtatagaaatgaactaa

SEQ ID NO: 9381019 - DNA, 22 bp, Homo sapiens
tttttgtatagaaatgaactaa

SEQ ID NO: 9381020 - DNA, 22 bp, Homo sapiens
tttttgtatatgcttcgaggat

SEQ ID NO: 9381021 - DNA, 22 bp, Homo sapiens
tttttgtatatgcttcgaggat

SEQ ID NO: 9381022 - DNA, 22 bp, Homo sapiens
ttttttacagaatcattaatca

SEQ ID NO: 9381023 - DNA, 22 bp, Homo sapiens
tttttgttctgattatactggt

SEQ ID NO: 9381024 - DNA, 22 bp, Homo sapiens
tttttgttcccagagaatttgt

SEQ ID NO: 9381025 - DNA, 22 bp, Homo sapiens
tttttgttcccagagaatttgt

SEQ ID NO: 9381026 - DNA, 17 bp, Homo sapiens
ttttgttcatcttcaaa

SEQ ID NO: 9381027 - DNA, 22 bp, Homo sapiens
tttttgtagtcattagaagagg

SEQ ID NO: 9381028 - DNA, 22 bp, Homo sapiens
ttttgtgttgccatgttaagca

SEQ ID NO: 9381029 - DNA, 22 bp, Homo sapiens
ttttgtgagctgagaaatgtat

SEQ ID NO: 9381030 - DNA, 22 bp, Homo sapiens
ttttgtgagcccataaatgcca

SEQ ID NO: 9381031 - DNA, 22 bp, Homo sapiens
ttttgtgagatgcgtatgaatg

SEQ ID NO: 9381032 - DNA, 22 bp, Homo sapiens
ttttgtgagctccttggaggta

SEQ ID NO: 9381033 - DNA, 22 bp, Homo sapiens
ttttgtctaagaactttgcaaa

SEQ ID NO: 9381034 - DNA, 22 bp, Homo sapiens
ttttgtgaatagtttatctaag

SEQ ID NO: 9381035 - DNA, 22 bp, Homo sapiens
ttttgtgacagaaagattaagt

SEQ ID NO: 9381036 - DNA, 22 bp, Homo sapiens
ttttgtaagaaactgccaagcc

SEQ ID NO: 9381037 - DNA, 22 bp, Homo sapiens
ttttgtatagtcaaagacaaga

SEQ ID NO: 9381038 - DNA, 22 bp, Homo sapiens
ttttgtatagtcaaagacaaga

SEQ ID NO: 9381039 - DNA, 22 bp, Homo sapiens
ttttgtatgagaagtgctttac

SEQ ID NO: 9381040 - DNA, 22 bp, Homo sapiens
ttttgtcagtgagaacagagtt

SEQ ID NO: 9381041 - DNA, 22 bp, Homo sapiens
ttttgtatcctccctttcactg

SEQ ID NO: 9381042 - DNA, 22 bp, Homo sapiens
ttttgtatcctccctttcactg

SEQ ID NO: 9381043 - DNA, 22 bp, Homo sapiens
ttttttccaggaagccactgga

SEQ ID NO: 9381044 - DNA, 22 bp, Homo sapiens
ttttttcctctgtgatggcaaa

SEQ ID NO: 9381045 - DNA, 22 bp, Homo sapiens
ttttttccagcttctagaggcc

SEQ ID NO: 9381046 - DNA, 22 bp, Homo sapiens
ttttttccttcatgacttaaga

SEQ ID NO: 9381047 - DNA, 22 bp, Homo sapiens
ttttttcctgagccttgtggtc

SEQ ID NO: 9381048 - DNA, 22 bp, Homo sapiens
ttcccaggtaattctgaggcag

SEQ ID NO: 9381049 - DNA, 22 bp, Homo sapiens
ttcccagtcaaacgaaggactt

SEQ ID NO: 9381050 - DNA, 22 bp, Homo sapiens
ttcccatagtgaccgatgctga

SEQ ID NO: 9381051 - DNA, 22 bp, Homo sapiens
ttcccatgcctggcccctatcc

SEQ ID NO: 9381052 - DNA, 21 bp, Homo sapiens
ttcccagcacctagcacaggt

SEQ ID NO: 9381053 - DNA, 22 bp, Homo sapiens
ttcccagattggagggcagggg

SEQ ID NO: 9381054 - DNA, 21 bp, Homo sapiens
ttcccagcacctagcacaggt

SEQ ID NO: 9381055 - DNA, 22 bp, Homo sapiens
ttcccaggctgtgctaccagag

SEQ ID NO: 9381056 - DNA, 22 bp, Homo sapiens
ttccccaggggctcctgccttt

SEQ ID NO: 9381057 - DNA, 22 bp, Homo sapiens
ttccccagggaagctcctgcgc

SEQ ID NO: 9381058 - DNA, 22 bp, Homo sapiens
ttccccaggctggagtgcagtg

SEQ ID NO: 9381059 - DNA, 22 bp, Homo sapiens
ttccccttgataagcagggttg

SEQ ID NO: 9381060 - DNA, 22 bp, Homo sapiens
ttccccttgcactatcaccctg

SEQ ID NO: 9381061 - DNA, 22 bp, Homo sapiens
ttcccctgtcacagtggttctc

SEQ ID NO: 9381062 - DNA, 17 bp, Homo sapiens
ttcccctgaccaagcct

SEQ ID NO: 9381063 - DNA, 22 bp, Homo sapiens
ttccccttatcaccagcctgtc

SEQ ID NO: 9381064 - DNA, 22 bp, Homo sapiens
ttccccttataagtctggcttc

SEQ ID NO: 9381065 - DNA, 19 bp, Homo sapiens
ttccatctatcttcttact

SEQ ID NO: 9381066 - DNA, 22 bp, Homo sapiens
ttccatctttcagctttgttgg

SEQ ID NO: 9381067 - DNA, 22 bp, Homo sapiens
ttccatcacatcactgaagaca

SEQ ID NO: 9381068 - DNA, 22 bp, Homo sapiens
ttccatccatgtcccgtttctg

SEQ ID NO: 9381069 - DNA, 22 bp, Homo sapiens
ttccatattgtactctttggag

SEQ ID NO: 9381070 - DNA, 22 bp, Homo sapiens
ttccatgcaagaagtatggctc

SEQ ID NO: 9381071 - DNA, 22 bp, Homo sapiens
ttccatgaagggcagcctctca

SEQ ID NO: 9381072 - DNA, 22 bp, Homo sapiens
ttccatgactgaagcaggggcg

SEQ ID NO: 9381073 - DNA, 22 bp, Homo sapiens
ttcccagactccacactgaggc

SEQ ID NO: 9381074 - DNA, 22 bp, Homo sapiens
ttcccagactccacactgaggc

SEQ ID NO: 9381075 - DNA, 22 bp, Homo sapiens
ttcccagaggcaaagtctggat

SEQ ID NO: 9381076 - DNA, 19 bp, Homo sapiens
ttcccagagccatgagtga

SEQ ID NO: 9381077 - DNA, 21 bp, Homo sapiens
ttccattatctctcagccatc

SEQ ID NO: 9381078 - DNA, 22 bp, Homo sapiens
ttccatgtactgggttttgtat

SEQ ID NO: 9381079 - DNA, 22 bp, Homo sapiens
ttccatgtactgggttttgtat

SEQ ID NO: 9381080 - DNA, 22 bp, Homo sapiens
ttcccagacctgtaggatcaga

SEQ ID NO: 9381081 - DNA, 22 bp, Homo sapiens
ttccaagtagaagcatttgcat

SEQ ID NO: 9381082 - DNA, 22 bp, Homo sapiens
ttccaagtgctgaggacagtag

SEQ ID NO: 9381083 - DNA, 22 bp, Homo sapiens
ttccaagtgcccatatttcatc

SEQ ID NO: 9381084 - DNA, 22 bp, Homo sapiens
ttccaagtctaagttataaatc

SEQ ID NO: 9381085 - DNA, 22 bp, Homo sapiens
ttccaagtcacccttagggtca

SEQ ID NO: 9381086 - DNA, 22 bp, Homo sapiens
ttccaagttgagcgattttcct

SEQ ID NO: 9381087 - DNA, 22 bp, Homo sapiens
ttccaagtgtcagatcagattt

SEQ ID NO: 9381088 - DNA, 22 bp, Homo sapiens
ttccaagtgggggaagctgagt

SEQ ID NO: 9381089 - DNA, 22 bp, Homo sapiens
ttccaagtgttgagattagagg

SEQ ID NO: 9381090 - DNA, 22 bp, Homo sapiens
ttccatacgactgaggtctcgg

SEQ ID NO: 9381091 - DNA, 21 bp, Homo sapiens
ttccagttttaattaaattgt

SEQ ID NO: 9381092 - DNA, 22 bp, Homo sapiens
ttccaattgtgagattttttaa

SEQ ID NO: 9381093 - DNA, 22 bp, Homo sapiens
ttccaattgtgagattttttaa

SEQ ID NO: 9381094 - DNA, 22 bp, Homo sapiens
ttccaatggaatcatgtcttga

SEQ ID NO: 9381095 - DNA, 22 bp, Homo sapiens
ttccaatgactagtggcatcct

SEQ ID NO: 9381096 - DNA, 22 bp, Homo sapiens
ttccaatatttacaatgcatta

SEQ ID NO: 9381097 - DNA, 22 bp, Homo sapiens
ttccaataaaatgttatttgca

SEQ ID NO: 9381098 - DNA, 22 bp, Homo sapiens
ttccaagagcctttcttctaga

SEQ ID NO: 9381099 - DNA, 22 bp, Homo sapiens
ttccaagacttggccagcaggg

SEQ ID NO: 9381100 - DNA, 22 bp, Homo sapiens
ttcatttttaccgcgtgtcaaa

SEQ ID NO: 9381101 - DNA, 22 bp, Homo sapiens
ttccaaaacaatattctgtgaa

SEQ ID NO: 9381102 - DNA, 19 bp, Homo sapiens
ttccaaaatcaggatttga

SEQ ID NO: 9381103 - DNA, 22 bp, Homo sapiens
ttccaactttaaaattcattct

SEQ ID NO: 9381104 - DNA, 22 bp, Homo sapiens
ttccaagaaacaagtgatgcag

SEQ ID NO: 9381105 - DNA, 22 bp, Homo sapiens
ttccaactttgtcatatattat

SEQ ID NO: 9381106 - DNA, 22 bp, Homo sapiens
ttccaactttgaaaatgttatg

SEQ ID NO: 9381107 - DNA, 22 bp, Homo sapiens
ttcactgtactgactgtcttat

SEQ ID NO: 9381108 - DNA, 17 bp, Homo sapiens
ttcaatgattaatgcat

SEQ ID NO: 9381109 - DNA, 22 bp, Homo sapiens
ttcaatatgatattagctgtgg

SEQ ID NO: 9381110 - DNA, 22 bp, Homo sapiens
ttcaatatctctaagaatgagg

SEQ ID NO: 9381111 - DNA, 22 bp, Homo sapiens
ttcaatatgatattagctgtgg

SEQ ID NO: 9381112 - DNA, 22 bp, Homo sapiens
ttcaagtcaaggaaagaggtct

SEQ ID NO: 9381113 - DNA, 22 bp, Homo sapiens
ttcaagtcaatttttgaatgac

SEQ ID NO: 9381114 - DNA, 22 bp, Homo sapiens
ttcactgtgatgtttaagagaa

SEQ ID NO: 9381115 - DNA, 22 bp, Homo sapiens
ttcagaaatccctcttctaccc

SEQ ID NO: 9381116 - DNA, 22 bp, Homo sapiens
ttcagaaatgaatattggtatt

SEQ ID NO: 9381117 - DNA, 22 bp, Homo sapiens
ttcagaataactttttattgaa

SEQ ID NO: 9381118 - DNA, 23 bp, Homo sapiens
ttcagaagaaatgagtacaggag

SEQ ID NO: 9381119 - DNA, 22 bp, Homo sapiens
ttcagaaggattttaacacatg

SEQ ID NO: 9381120 - DNA, 22 bp, Homo sapiens
ttcatagtgtttccttccagtg

SEQ ID NO: 9381121 - DNA, 22 bp, Homo sapiens
ttcatagtgtttccttccagtg

SEQ ID NO: 9381122 - DNA, 22 bp, Homo sapiens
ttcatagtgtttccttccagtg

SEQ ID NO: 9381123 - DNA, 22 bp, Homo sapiens
ttcatagtgattgttcagatag

SEQ ID NO: 9381124 - DNA, 22 bp, Homo sapiens
ttcatagcagtccctttctggg

SEQ ID NO: 9381125 - DNA, 22 bp, Homo sapiens
ttcataggtggatgctgccagg

SEQ ID NO: 9381126 - DNA, 22 bp, Homo sapiens
ttcatattcaaatactctgctt

SEQ ID NO: 9381127 - DNA, 22 bp, Homo sapiens
ttcagacagttttcagattcat

SEQ ID NO: 9381128 - DNA, 22 bp, Homo sapiens
ttcagaatgtgaccttatttgg

SEQ ID NO: 9381129 - DNA, 22 bp, Homo sapiens
ttcagaatgtactgatagaaca

SEQ ID NO: 9381130 - DNA, 22 bp, Homo sapiens
ttcagaatgattacattctggt

SEQ ID NO: 9381131 - DNA, 22 bp, Homo sapiens
ttcatacatttttactaacagc

SEQ ID NO: 9381132 - DNA, 22 bp, Homo sapiens
ttcagaccaagctggtggcatg

SEQ ID NO: 9381133 - DNA, 22 bp, Homo sapiens
ttcatacatttttactaacagc

SEQ ID NO: 9381134 - DNA, 18 bp, Homo sapiens
ttcaagagtttctctagg

SEQ ID NO: 9381135 - DNA, 22 bp, Homo sapiens
ttcaagaatcttcctgaccact

SEQ ID NO: 9381136 - DNA, 22 bp, Homo sapiens
ttcaagaggcttaattctggat

SEQ ID NO: 9381137 - DNA, 22 bp, Homo sapiens
ttcaagataataggaatgaaaa

SEQ ID NO: 9381138 - DNA, 17 bp, Homo sapiens
ttcaagatattgaaatg

SEQ ID NO: 9381139 - DNA, 21 bp, Homo sapiens
ttcaagatatttaaaaggtgg

SEQ ID NO: 9381140 - DNA, 22 bp, Homo sapiens
ttcaagcagttaagcagtctcc

SEQ ID NO: 9381141 - DNA, 22 bp, Homo sapiens
ttcaagcagggattggtgatgg

SEQ ID NO: 9381142 - DNA, 22 bp, Homo sapiens
ttcaaggagattggagtctact

SEQ ID NO: 9381143 - DNA, 22 bp, Homo sapiens
ttcaagcagggattggtgatgg

SEQ ID NO: 9381144 - DNA, 22 bp, Homo sapiens
ttcaagcaagtcctttgtgcat

SEQ ID NO: 9381145 - DNA, 22 bp, Homo sapiens
ttcaagatgacccagtcacacg

SEQ ID NO: 9381146 - DNA, 22 bp, Homo sapiens
ttcaagatcgagtttaaagtga

SEQ ID NO: 9381147 - DNA, 22 bp, Homo sapiens
ttcaagatcttccaaaggatac

SEQ ID NO: 9381148 - DNA, 22 bp, Homo sapiens
ttattttaccttcctctgagct

SEQ ID NO: 9381149 - DNA, 22 bp, Homo sapiens
ttattttaccttcctctgagct

SEQ ID NO: 9381150 - DNA, 22 bp, Homo sapiens
ttattttgccacaggtgacctt

SEQ ID NO: 9381151 - DNA, 22 bp, Homo sapiens
ttattttgccacaggtgacctt

SEQ ID NO: 9381152 - DNA, 22 bp, Homo sapiens
ttattttgagagaatgtgtgct

SEQ ID NO: 9381153 - DNA, 22 bp, Homo sapiens
ttattttctcctcagaaagtgg

SEQ ID NO: 9381154 - DNA, 22 bp, Homo sapiens
ttattttctcctcagaaagtgg

SEQ ID NO: 9381155 - DNA, 23 bp, Homo sapiens
ttcaaaactggaaaatcagatgc

SEQ ID NO: 9381156 - DNA, 22 bp, Homo sapiens
ttattttgtagctctgatcttt

SEQ ID NO: 9381157 - DNA, 22 bp, Homo sapiens
ttattttgtagctctgatcttt

SEQ ID NO: 9381158 - DNA, 22 bp, Homo sapiens
ttattttggtaaatgtttgcct

SEQ ID NO: 9381159 - DNA, 22 bp, Homo sapiens
ttattttggtaaatgtttgcct

SEQ ID NO: 9381160 - DNA, 22 bp, Homo sapiens
ttattttggtaaatgtttgcct

SEQ ID NO: 9381161 - DNA, 22 bp, Homo sapiens
ttatttgtggcatatgagacga

SEQ ID NO: 9381162 - DNA, 22 bp, Homo sapiens
ttatttatggcactgttggtgg

SEQ ID NO: 9381163 - DNA, 22 bp, Homo sapiens
ttatttatatctctgcagttta

SEQ ID NO: 9381164 - DNA, 22 bp, Homo sapiens
ttatttagtctagatgaatttt

SEQ ID NO: 9381165 - DNA, 22 bp, Homo sapiens
ttatttagtctagatgaatttt

SEQ ID NO: 9381166 - DNA, 22 bp, Homo sapiens
ttattttaccttcctctgagct

SEQ ID NO: 9381167 - DNA, 22 bp, Homo sapiens
ttatttgtggcatatgagacga

SEQ ID NO: 9381168 - DNA, 22 bp, Homo sapiens
ttatttgtggcatatgagacga

SEQ ID NO: 9381169 - DNA, 22 bp, Homo sapiens
ttatttgtggcatccatgttgg

SEQ ID NO: 9381170 - DNA, 22 bp, Homo sapiens
ttatttaattttctcactcaga

SEQ ID NO: 9381171 - DNA, 22 bp, Homo sapiens
ttatttaattttctcactcaga

SEQ ID NO: 9381172 - DNA, 22 bp, Homo sapiens
ttatttaattttctcactcaga

SEQ ID NO: 9381173 - DNA, 22 bp, Homo sapiens
ttatttacaactcttctcttcc

SEQ ID NO: 9381174 - DNA, 22 bp, Homo sapiens
ttatttacaactcttctcttcc

SEQ ID NO: 9381175 - DNA, 22 bp, Homo sapiens
ttatttaggaggaaactgaggt

SEQ ID NO: 9381176 - DNA, 22 bp, Homo sapiens
ttatttactggatggccttggg

SEQ ID NO: 9381177 - DNA, 22 bp, Homo sapiens
ttatttactggatggccttggg

SEQ ID NO: 9381178 - DNA, 22 bp, Homo sapiens
ttatgttttaagtgtgtatctt

SEQ ID NO: 9381179 - DNA, 22 bp, Homo sapiens
ttatgttttaagtgtgtatctt

SEQ ID NO: 9381180 - DNA, 22 bp, Homo sapiens
ttatgttttatggctatatcat

SEQ ID NO: 9381181 - DNA, 22 bp, Homo sapiens
ttatgttatgaatggatgatct

SEQ ID NO: 9381182 - DNA, 22 bp, Homo sapiens
ttatgttatgctatttcagata

SEQ ID NO: 9381183 - DNA, 22 bp, Homo sapiens
ttatgtttgagtatatgactca

SEQ ID NO: 9381184 - DNA, 22 bp, Homo sapiens
ttattgttagtgagactgtaga

SEQ ID NO: 9381185 - DNA, 22 bp, Homo sapiens
ttattgttagtgagactgtaga

SEQ ID NO: 9381186 - DNA, 22 bp, Homo sapiens
ttattgtttactagtttgcaga

SEQ ID NO: 9381187 - DNA, 22 bp, Homo sapiens
ttattgtttactagtttgcaga

SEQ ID NO: 9381188 - DNA, 22 bp, Homo sapiens
ttatttaaaagtggtaagattc

SEQ ID NO: 9381189 - DNA, 22 bp, Homo sapiens
ttattgtttgggtataatttga

SEQ ID NO: 9381190 - DNA, 22 bp, Homo sapiens
ttattgtttgggtataatttga

SEQ ID NO: 9381191 - DNA, 22 bp, Homo sapiens
ttattgtttgggtataatttga

SEQ ID NO: 9381192 - DNA, 22 bp, Homo sapiens
ttattgtttgggtataatttga

SEQ ID NO: 9381193 - DNA, 22 bp, Homo sapiens
ttatttaatgtgatctgaagag

SEQ ID NO: 9381194 - DNA, 22 bp, Homo sapiens
ttatttaaaatgtaggttggga

SEQ ID NO: 9381195 - DNA, 22 bp, Homo sapiens
ttatttaaaagtggtaagattc

SEQ ID NO: 9381196 - DNA, 21 bp, Homo sapiens
tcctctactgagccatgcaga

SEQ ID NO: 9381197 - DNA, 22 bp, Homo sapiens
tcctccttgttttgtctctgct

SEQ ID NO: 9381198 - DNA, 22 bp, Homo sapiens
tcctccttgttttcctgtttac

SEQ ID NO: 9381199 - DNA, 22 bp, Homo sapiens
tcctccttgttttgtctctgct

SEQ ID NO: 9381200 - DNA, 23 bp, Homo sapiens
tcctccttttgcttgtgcttccc

SEQ ID NO: 9381201 - DNA, 22 bp, Homo sapiens
tcctcctttccccgctggagcc

SEQ ID NO: 9381202 - DNA, 22 bp, Homo sapiens
tcctcctttccccgctggagcc

SEQ ID NO: 9381203 - DNA, 22 bp, Homo sapiens
tcctctgctcagcattcctcac

SEQ ID NO: 9381204 - DNA, 22 bp, Homo sapiens
tcctctgccccagatgaaattt

SEQ ID NO: 9381205 - DNA, 22 bp, Homo sapiens
tcctctccagcaaactggctat

SEQ ID NO: 9381206 - DNA, 22 bp, Homo sapiens
tcctctccagcaaactggctat

SEQ ID NO: 9381207 - DNA, 22 bp, Homo sapiens
tcctctccagcaaactggctat

SEQ ID NO: 9381208 - DNA, 22 bp, Homo sapiens
tcctcctgtctaccagttcctg

SEQ ID NO: 9381209 - DNA, 22 bp, Homo sapiens
tcctcctgtctaccagttcctg

SEQ ID NO: 9381210 - DNA, 22 bp, Homo sapiens
tcctcctgtctaccagttcctg

SEQ ID NO: 9381211 - DNA, 22 bp, Homo sapiens
tcctcctgtttctcaggcctgg

SEQ ID NO: 9381212 - DNA, 22 bp, Homo sapiens
tcctcctgtttctcaggcctgg

SEQ ID NO: 9381213 - DNA, 22 bp, Homo sapiens
tcctcctgtttctcaggcctgg

SEQ ID NO: 9381214 - DNA, 22 bp, Homo sapiens
tcctcctgtctaccagttcctg

SEQ ID NO: 9381215 - DNA, 21 bp, Homo sapiens
tcctcctgtagagggtcctgg

SEQ ID NO: 9381216 - DNA, 21 bp, Homo sapiens
tcctcctgtagagggtcctgg

SEQ ID NO: 9381217 - DNA, 22 bp, Homo sapiens
tcctcctgtttctcaggcctgg

SEQ ID NO: 9381218 - DNA, 19 bp, Homo sapiens
tcctccttacttcctcttg

SEQ ID NO: 9381219 - DNA, 20 bp, Homo sapiens
tcctccttgcagagcccaga

SEQ ID NO: 9381220 - DNA, 22 bp, Homo sapiens
tcctccttgttcttttgcctac

SEQ ID NO: 9381221 - DNA, 21 bp, Homo sapiens
tcctccttcaagtcctggcct

SEQ ID NO: 9381222 - DNA, 21 bp, Homo sapiens
tcctccttcaagtcctggcct

SEQ ID NO: 9381223 - DNA, 22 bp, Homo sapiens
tcctccttcgggactgcttgac

SEQ ID NO: 9381224 - DNA, 22 bp, Homo sapiens
tcctctggatataagcctcacc

SEQ ID NO: 9381225 - DNA, 22 bp, Homo sapiens
tcctctggatataagcctcacc

SEQ ID NO: 9381226 - DNA, 22 bp, Homo sapiens
tcctctggaacctcacccttgc

SEQ ID NO: 9381227 - DNA, 22 bp, Homo sapiens
tcctctgctccatctttactgt

SEQ ID NO: 9381228 - DNA, 22 bp, Homo sapiens
tcctctggctctttccctagga

SEQ ID NO: 9381229 - DNA, 22 bp, Homo sapiens
tcctctggctctttccctagga

SEQ ID NO: 9381230 - DNA, 22 bp, Homo sapiens
tcctctggccttggaatccttt

SEQ ID NO: 9381231 - DNA, 22 bp, Homo sapiens
tcctctggcccagctgcctctg

SEQ ID NO: 9381232 - DNA, 22 bp, Homo sapiens
tcctctggcccagctgcctctg

SEQ ID NO: 9381233 - DNA, 17 bp, Homo sapiens
ttagtgtatctgttttg

SEQ ID NO: 9381234 - DNA, 23 bp, Homo sapiens
ttagtgtaaggcaggcacagttg

SEQ ID NO: 9381235 - DNA, 22 bp, Homo sapiens
ttagtgtattttcaaatgtaga

SEQ ID NO: 9381236 - DNA, 22 bp, Homo sapiens
tcctctgggcctatttgttcac

SEQ ID NO: 9381237 - DNA, 22 bp, Homo sapiens
ttagtggtgttggtgaggactg

SEQ ID NO: 9381238 - DNA, 22 bp, Homo sapiens
ttagtgttagggcctgttacct

SEQ ID NO: 9381239 - DNA, 22 bp, Homo sapiens
ttagtgtttaaaggtttcagag

SEQ ID NO: 9381240 - DNA, 22 bp, Homo sapiens
ttagttaattgactatgttgca

SEQ ID NO: 9381241 - DNA, 22 bp, Homo sapiens
ttagttaaaagataattttgga

SEQ ID NO: 9381242 - DNA, 22 bp, Homo sapiens
ttagtgtctggctatatttaaa

SEQ ID NO: 9381243 - DNA, 22 bp, Homo sapiens
ttagtgtgcatggatctgtgga

SEQ ID NO: 9381244 - DNA, 22 bp, Homo sapiens
ttagtgtgtccagttctgaaaa

SEQ ID NO: 9381245 - DNA, 22 bp, Homo sapiens
ttatggaatacttatgctgcag

SEQ ID NO: 9381246 - DNA, 22 bp, Homo sapiens
ttatgtgtataattacaggaag

SEQ ID NO: 9381247 - DNA, 20 bp, Homo sapiens
ttatgtgtacctgtgctccc

SEQ ID NO: 9381248 - DNA, 22 bp, Homo sapiens
ttatgtgtgtgtatacatacaa

SEQ ID NO: 9381249 - DNA, 22 bp, Homo sapiens
ttatgtgtgtgtatacatacaa

SEQ ID NO: 9381250 - DNA, 22 bp, Homo sapiens
ttatgtgtgtacatgcatatgt

SEQ ID NO: 9381251 - DNA, 22 bp, Homo sapiens
ttatgtgtgtacatgcatatgt

SEQ ID NO: 9381252 - DNA, 20 bp, Homo sapiens
ttatgtgtacctgtgctccc

SEQ ID NO: 9381253 - DNA, 22 bp, Homo sapiens
ttatgtcttaagtatgctaatt

SEQ ID NO: 9381254 - DNA, 22 bp, Homo sapiens
ttatgtcttaagtatgctaatt

SEQ ID NO: 9381255 - DNA, 22 bp, Homo sapiens
ttatgcttcctgattggactct

SEQ ID NO: 9381256 - DNA, 22 bp, Homo sapiens
ttatggaaaatacaattataag

SEQ ID NO: 9381257 - DNA, 22 bp, Homo sapiens
ttatacagcattgctagtgatg

SEQ ID NO: 9381258 - DNA, 22 bp, Homo sapiens
ttataattctggcataggctgt

SEQ ID NO: 9381259 - DNA, 22 bp, Homo sapiens
ttatacagtttatacttagaat

SEQ ID NO: 9381260 - DNA, 22 bp, Homo sapiens
ttatacaggagattccttactt

SEQ ID NO: 9381261 - DNA, 22 bp, Homo sapiens
ttataagactgtagtgagtatt

SEQ ID NO: 9381262 - DNA, 23 bp, Homo sapiens
ttataagaagcatcacaggaaga

SEQ ID NO: 9381263 - DNA, 22 bp, Homo sapiens
ttataagagtatatagtgtact

SEQ ID NO: 9381264 - DNA, 22 bp, Homo sapiens
ttagttcttgggtgaacttttg

SEQ ID NO: 9381265 - DNA, 22 bp, Homo sapiens
ttagttctcatgaattttaagt

SEQ ID NO: 9381266 - DNA, 22 bp, Homo sapiens
ttagttgatgttctggaggtag

SEQ ID NO: 9381267 - DNA, 22 bp, Homo sapiens
ttagttacttataggtgataga

SEQ ID NO: 9381268 - DNA, 22 bp, Homo sapiens
ttagttatagtgaagaaatact

SEQ ID NO: 9381269 - DNA, 22 bp, Homo sapiens
ttctcctcactgcagcctttca

SEQ ID NO: 9381270 - DNA, 22 bp, Homo sapiens
ttctcctcagcaaggcagcttt

SEQ ID NO: 9381271 - DNA, 21 bp, Homo sapiens
ttctcctccaagttgctcctg

SEQ ID NO: 9381272 - DNA, 22 bp, Homo sapiens
ttctccctgtcctatcaagact

SEQ ID NO: 9381273 - DNA, 22 bp, Homo sapiens
ttctccctgtcctatcaagact

SEQ ID NO: 9381274 - DNA, 22 bp, Homo sapiens
ttctccgctaagttctctgcag

SEQ ID NO: 9381275 - DNA, 22 bp, Homo sapiens
ttctccgctaagttctctgcag

SEQ ID NO: 9381276 - DNA, 22 bp, Homo sapiens
ttctcctctgttaccttgcaaa

SEQ ID NO: 9381277 - DNA, 22 bp, Homo sapiens
ttctcctctgttaccttgcaaa

SEQ ID NO: 9381278 - DNA, 22 bp, Homo sapiens
ttctcctctgttggccttccct

SEQ ID NO: 9381279 - DNA, 22 bp, Homo sapiens
ttctcctctgttaccttgcaaa

SEQ ID NO: 9381280 - DNA, 21 bp, Homo sapiens
ttctcctccaagttgctcctg

SEQ ID NO: 9381281 - DNA, 21 bp, Homo sapiens
ttctcctccaagttgctcctg

SEQ ID NO: 9381282 - DNA, 17 bp, Homo sapiens
ttctcctctgtgtcctt

SEQ ID NO: 9381283 - DNA, 20 bp, Homo sapiens
ttctccagtgcggtagccat

SEQ ID NO: 9381284 - DNA, 20 bp, Homo sapiens
ttctccagtgcggtagccat

SEQ ID NO: 9381285 - DNA, 20 bp, Homo sapiens
ttctccagtgcggtagccat

SEQ ID NO: 9381286 - DNA, 21 bp, Homo sapiens
ttctccagggggagctctctc

SEQ ID NO: 9381287 - DNA, 22 bp, Homo sapiens
ttctccatttaacttccttatg

SEQ ID NO: 9381288 - DNA, 22 bp, Homo sapiens
ttctccagtttctcccttcagt

SEQ ID NO: 9381289 - DNA, 22 bp, Homo sapiens
ttctccagtttctcccttcagt

SEQ ID NO: 9381290 - DNA, 21 bp, Homo sapiens
ttctccccagcgaatcctcgg

SEQ ID NO: 9381291 - DNA, 22 bp, Homo sapiens
ttctccccaactccatcaacac

SEQ ID NO: 9381292 - DNA, 22 bp, Homo sapiens
ttctcccatctcagtcttacat

SEQ ID NO: 9381293 - DNA, 22 bp, Homo sapiens
ttctcccctttagggcctacgg

SEQ ID NO: 9381294 - DNA, 22 bp, Homo sapiens
ttctcccctgaccctgatgagg

SEQ ID NO: 9381295 - DNA, 22 bp, Homo sapiens
ttctcccctctgaaatggggct

SEQ ID NO: 9381296 - DNA, 22 bp, Homo sapiens
ttctccccgtctctctgaggcc

SEQ ID NO: 9381297 - DNA, 22 bp, Homo sapiens
ttctcccactccgtgcttcagt

SEQ ID NO: 9381298 - DNA, 22 bp, Homo sapiens
ttctcccactccgtgcttcagt

SEQ ID NO: 9381299 - DNA, 22 bp, Homo sapiens
ttctcccagaccaaaggcagca

SEQ ID NO: 9381300 - DNA, 22 bp, Homo sapiens
ttctcccactccgtgcttcagt

SEQ ID NO: 9381301 - DNA, 23 bp, Homo sapiens
ttctctttagatttacattactc

SEQ ID NO: 9381302 - DNA, 22 bp, Homo sapiens
ttctcttgtgccaagttgttgc

SEQ ID NO: 9381303 - DNA, 22 bp, Homo sapiens
ttctcttctgttcagtgcccaa

SEQ ID NO: 9381304 - DNA, 22 bp, Homo sapiens
ttctcttgagctggtcatgttt

SEQ ID NO: 9381305 - DNA, 22 bp, Homo sapiens
ttctcttgactaccagttagga

SEQ ID NO: 9381306 - DNA, 22 bp, Homo sapiens
ttctcttctgttcagtgcccaa

SEQ ID NO: 9381307 - DNA, 22 bp, Homo sapiens
ttctcttccagccgggcttgca

SEQ ID NO: 9381308 - DNA, 22 bp, Homo sapiens
ttctcttccagccgggcttgca

SEQ ID NO: 9381309 - DNA, 22 bp, Homo sapiens
ttctcttcccactttctgtatt

SEQ ID NO: 9381310 - DNA, 22 bp, Homo sapiens
ttctcttcatctcagtaaatgt

SEQ ID NO: 9381311 - DNA, 22 bp, Homo sapiens
ttctcttcccactttctgtatt

SEQ ID NO: 9381312 - DNA, 22 bp, Homo sapiens
ttctcttcccactttctgtatt

SEQ ID NO: 9381313 - DNA, 22 bp, Homo sapiens
ttctcttcccactttctgtatt

SEQ ID NO: 9381314 - DNA, 17 bp, Homo sapiens
ttctcttcctggatagt

SEQ ID NO: 9381315 - DNA, 17 bp, Homo sapiens
ttctcttcctggatagt

SEQ ID NO: 9381316 - DNA, 22 bp, Homo sapiens
ttctcttattctggatatgcag

SEQ ID NO: 9381317 - DNA, 22 bp, Homo sapiens
ttctcttattctggatatgcag

SEQ ID NO: 9381318 - DNA, 22 bp, Homo sapiens
ttctcttagctgtaaagtcaat

SEQ ID NO: 9381319 - DNA, 22 bp, Homo sapiens
ttctcttagctgtaaagtcaat

SEQ ID NO: 9381320 - DNA, 22 bp, Homo sapiens
ttctcttagctgtaaagtcaat

SEQ ID NO: 9381321 - DNA, 22 bp, Homo sapiens
ttctctgtgagggtgctggatt

SEQ ID NO: 9381322 - DNA, 22 bp, Homo sapiens
ttctctgtgagggtgctggatt

SEQ ID NO: 9381323 - DNA, 22 bp, Homo sapiens
ttctctgtagttgcctggtgga

SEQ ID NO: 9381324 - DNA, 22 bp, Homo sapiens
ttctctgtagttgcctggtgga

SEQ ID NO: 9381325 - DNA, 22 bp, Homo sapiens
ttctctggtttgctgtttctga

SEQ ID NO: 9381326 - DNA, 19 bp, Homo sapiens
ttctctgtgctagactctg

SEQ ID NO: 9381327 - DNA, 22 bp, Homo sapiens
ttctctgtgagggtgctggatt

SEQ ID NO: 9381328 - DNA, 16 bp, Homo sapiens
ttctctgttccttgtg

SEQ ID NO: 9381329 - DNA, 16 bp, Homo sapiens
ttctctgttccttgtg

SEQ ID NO: 9381330 - DNA, 22 bp, Homo sapiens
ttctctgttttcccctcgatgt

SEQ ID NO: 9381331 - DNA, 22 bp, Homo sapiens
ttctctgtggattgggtgagag

SEQ ID NO: 9381332 - DNA, 19 bp, Homo sapiens
ttctctgtgctagactctg

SEQ ID NO: 9381333 - DNA, 22 bp, Homo sapiens
ttctgcattcaaattatgtgag

SEQ ID NO: 9381334 - DNA, 23 bp, Homo sapiens
ttctgcatgtttcagagctggga

SEQ ID NO: 9381335 - DNA, 22 bp, Homo sapiens
ttctgcacagtcactcctggct

SEQ ID NO: 9381336 - DNA, 22 bp, Homo sapiens
ttctgcaccgttacagcaagag

SEQ ID NO: 9381337 - DNA, 22 bp, Homo sapiens
ttctgcagatcaacttgactgc

SEQ ID NO: 9381338 - DNA, 22 bp, Homo sapiens
ttctgcagcatgaggctggagc

SEQ ID NO: 9381339 - DNA, 22 bp, Homo sapiens
ttctgcagatcaacttgactgc

SEQ ID NO: 9381340 - DNA, 22 bp, Homo sapiens
ttctgcattgacttttatttcc

SEQ ID NO: 9381341 - DNA, 22 bp, Homo sapiens
ttctgcattggagtctattctt

SEQ ID NO: 9381342 - DNA, 22 bp, Homo sapiens
ttctgcattcaaattatgtgag

SEQ ID NO: 9381343 - DNA, 22 bp, Homo sapiens
ttctgcattggagtctattctt

SEQ ID NO: 9381344 - DNA, 22 bp, Homo sapiens
ttctgcatttctaataagttcc

SEQ ID NO: 9381345 - DNA, 22 bp, Homo sapiens
ttctgcctgatgtagtcatacc

SEQ ID NO: 9381346 - DNA, 22 bp, Homo sapiens
ttctgcccttgccagacaagta

SEQ ID NO: 9381347 - DNA, 22 bp, Homo sapiens
ttctggaggagaaagggtgggc

SEQ ID NO: 9381348 - DNA, 22 bp, Homo sapiens
ttctggaggctccagggaagaa

SEQ ID NO: 9381349 - DNA, 22 bp, Homo sapiens
ttctgatatagtgattgattta

SEQ ID NO: 9381350 - DNA, 22 bp, Homo sapiens
ttctgatgatggcggctggagc

SEQ ID NO: 9381351 - DNA, 22 bp, Homo sapiens
ttctgataacaaacaccaattt

SEQ ID NO: 9381352 - DNA, 22 bp, Homo sapiens
ttctgataacaaacaccaattt

SEQ ID NO: 9381353 - DNA, 22 bp, Homo sapiens
ttctgataccttgcaggatcct

SEQ ID NO: 9381354 - DNA, 22 bp, Homo sapiens
ttctgataataccacatcgcag

SEQ ID NO: 9381355 - DNA, 22 bp, Homo sapiens
ttctgatacagtcccaacacaa

SEQ ID NO: 9381356 - DNA, 22 bp, Homo sapiens
ttctgataccttgcaggatcct

SEQ ID NO: 9381357 - DNA, 22 bp, Homo sapiens
ttctgatacagtcccaacacaa

SEQ ID NO: 9381358 - DNA, 22 bp, Homo sapiens
ttctgataataccacatcgcag

SEQ ID NO: 9381359 - DNA, 22 bp, Homo sapiens
ttctgaggctttcccgtcccct

SEQ ID NO: 9381360 - DNA, 22 bp, Homo sapiens
ttctctttgacattattcaggt

SEQ ID NO: 9381361 - DNA, 22 bp, Homo sapiens
ttctctttgacattattcaggt

SEQ ID NO: 9381362 - DNA, 22 bp, Homo sapiens
ttctctttgacattattcaggt

SEQ ID NO: 9381363 - DNA, 22 bp, Homo sapiens
ttctctttatgtatttagtggg

SEQ ID NO: 9381364 - DNA, 20 bp, Homo sapiens
ttctctttgggtccagagaa

SEQ ID NO: 9381365 - DNA, 22 bp, Homo sapiens
ttctgagctgcaacactaacat

SEQ ID NO: 9381366 - DNA, 22 bp, Homo sapiens
ttctgagctacatagtactggg

SEQ ID NO: 9381367 - DNA, 22 bp, Homo sapiens
ttctgaggcatagaggatgaga

SEQ ID NO: 9381368 - DNA, 22 bp, Homo sapiens
ttctgaggcactggctctccca

SEQ ID NO: 9381369 - DNA, 22 bp, Homo sapiens
ttctccaggggagggttctcca

SEQ ID NO: 9381370 - DNA, 19 bp, Homo sapiens
ttctccagggacttaggga

SEQ ID NO: 9381371 - DNA, 19 bp, Homo sapiens
ttctccaggctgcagaggg

SEQ ID NO: 9381372 - DNA, 19 bp, Homo sapiens
ttctccaggctgcagaggg

SEQ ID NO: 9381373 - DNA, 19 bp, Homo sapiens
ttctccaggctgcagaggg

SEQ ID NO: 9381374 - DNA, 22 bp, Homo sapiens
ttctccagcctattggcctatc

SEQ ID NO: 9381375 - DNA, 22 bp, Homo sapiens
ttctccagcctattggcctatc

SEQ ID NO: 9381376 - DNA, 22 bp, Homo sapiens
ttctccagagtttctctcactg

SEQ ID NO: 9381377 - DNA, 22 bp, Homo sapiens
ttctccagagtttctctcactg

SEQ ID NO: 9381378 - DNA, 19 bp, Homo sapiens
ttctccagcctgacctgag

SEQ ID NO: 9381379 - DNA, 22 bp, Homo sapiens
ttctccagctcatcagggaggg

SEQ ID NO: 9381380 - DNA, 19 bp, Homo sapiens
ttctccagcctgacctgag

SEQ ID NO: 9381381 - DNA, 19 bp, Homo sapiens
ttctccagcctgacctgag

SEQ ID NO: 9381382 - DNA, 22 bp, Homo sapiens
ttctcagaggagtcgggagctg

SEQ ID NO: 9381383 - DNA, 22 bp, Homo sapiens
ttctcagagctcactgtagtaa

SEQ ID NO: 9381384 - DNA, 22 bp, Homo sapiens
ttctcagagctcactgtagtaa

SEQ ID NO: 9381385 - DNA, 22 bp, Homo sapiens
ttctcagaattgactgggagca

SEQ ID NO: 9381386 - DNA, 22 bp, Homo sapiens
ttctcagaattgactgggagca

SEQ ID NO: 9381387 - DNA, 18 bp, Homo sapiens
ttctcagactttggaagt

SEQ ID NO: 9381388 - DNA, 22 bp, Homo sapiens
ttctcagagcactgctgacaaa

SEQ ID NO: 9381389 - DNA, 21 bp, Homo sapiens
ttctcagagtctattacagtt

SEQ ID NO: 9381390 - DNA, 22 bp, Homo sapiens
ttctcagagtgaccaagtcttt

SEQ ID NO: 9381391 - DNA, 22 bp, Homo sapiens
ttctcagagtgaccaagtcttt

SEQ ID NO: 9381392 - DNA, 22 bp, Homo sapiens
ttctcagatatttactgagcat

SEQ ID NO: 9381393 - DNA, 22 bp, Homo sapiens
ttctccagaggtggctagagtt

SEQ ID NO: 9381394 - DNA, 22 bp, Homo sapiens
ttctccagaggtggctagagtt

SEQ ID NO: 9381395 - DNA, 22 bp, Homo sapiens
ttctcagatatttgtatggaac

SEQ ID NO: 9381396 - DNA, 22 bp, Homo sapiens
ttctcacaattcttgtatttgc

SEQ ID NO: 9381397 - DNA, 22 bp, Homo sapiens
ttctcacactttccactgaggt

SEQ ID NO: 9381398 - DNA, 22 bp, Homo sapiens
ttctcacaaatccatccaggag

SEQ ID NO: 9381399 - DNA, 22 bp, Homo sapiens
ttctcacaaatccatccaggag

SEQ ID NO: 9381400 - DNA, 22 bp, Homo sapiens
ttctcacaggatttcttttagt

SEQ ID NO: 9381401 - DNA, 22 bp, Homo sapiens
ttctcacaggaagtaggacttt

SEQ ID NO: 9381402 - DNA, 22 bp, Homo sapiens
ttctcacaggctggaatgatga

SEQ ID NO: 9381403 - DNA, 22 bp, Homo sapiens
ttctcacattcagaacttttat

SEQ ID NO: 9381404 - DNA, 22 bp, Homo sapiens
ttctcacagtacctaacatgta

SEQ ID NO: 9381405 - DNA, 22 bp, Homo sapiens
ttctcagaaaatgtagagaaaa

SEQ ID NO: 9381406 - DNA, 22 bp, Homo sapiens
ttctatcatacttgaatacatt

SEQ ID NO: 9381407 - DNA, 22 bp, Homo sapiens
ttctatatttatgggcatcacc

SEQ ID NO: 9381408 - DNA, 22 bp, Homo sapiens
ttctatctcatatgtgttctag

SEQ ID NO: 9381409 - DNA, 22 bp, Homo sapiens
ttctaactggcttgacagtttc

SEQ ID NO: 9381410 - DNA, 21 bp, Homo sapiens
ttctaactgggtgggccttga

SEQ ID NO: 9381411 - DNA, 22 bp, Homo sapiens
ttctaactttcaaggtcctttc

SEQ ID NO: 9381412 - DNA, 22 bp, Homo sapiens
ttctcaaagaaagctgtcatta

SEQ ID NO: 9381413 - DNA, 22 bp, Homo sapiens
ttctcaaagggtggtttgcaaa

SEQ ID NO: 9381414 - DNA, 22 bp, Homo sapiens
ttctcaagaacatatgtagggt

SEQ ID NO: 9381415 - DNA, 22 bp, Homo sapiens
ttctcaactctcaagagaagct

SEQ ID NO: 9381416 - DNA, 22 bp, Homo sapiens
ttctaaaaccaattctgcttct

SEQ ID NO: 9381417 - DNA, 22 bp, Homo sapiens
ttctaaaataagtttatctggt

SEQ ID NO: 9381418 - DNA, 22 bp, Homo sapiens
ttctaaaaccaattctgcttct

SEQ ID NO: 9381419 - DNA, 22 bp, Homo sapiens
ttctaaaataagtttatctggt

SEQ ID NO: 9381420 - DNA, 22 bp, Homo sapiens
ttctaaatgtaaatagtatgat

SEQ ID NO: 9381421 - DNA, 22 bp, Homo sapiens
ttctaaatgtaaatagtatgat

SEQ ID NO: 9381422 - DNA, 22 bp, Homo sapiens
ttctaaagtgcaatctgacaga

SEQ ID NO: 9381423 - DNA, 22 bp, Homo sapiens
ttctaaagtgcaatctgacaga

SEQ ID NO: 9381424 - DNA, 22 bp, Homo sapiens
ttctaactctgttatgtgtttc

SEQ ID NO: 9381425 - DNA, 22 bp, Homo sapiens
ttctaactcaaagcttctttca

SEQ ID NO: 9381426 - DNA, 22 bp, Homo sapiens
ttctaactctacactagctttg

SEQ ID NO: 9381427 - DNA, 22 bp, Homo sapiens
ttctaactaaagtctttgtttt

SEQ ID NO: 9381428 - DNA, 22 bp, Homo sapiens
ttccctgagtctccctgagtct

SEQ ID NO: 9381429 - DNA, 22 bp, Homo sapiens
ttccctgaagacctcatgtgac

SEQ ID NO: 9381430 - DNA, 22 bp, Homo sapiens
ttccctgaagacctcatgtgac

SEQ ID NO: 9381431 - DNA, 22 bp, Homo sapiens
ttccctgatggccccaaggata

SEQ ID NO: 9381432 - DNA, 22 bp, Homo sapiens
ttccctgcaacctttccctggg

SEQ ID NO: 9381433 - DNA, 22 bp, Homo sapiens
ttccctgatcacgtgtcaggag

SEQ ID NO: 9381434 - DNA, 22 bp, Homo sapiens
ttccctgagtctccctgagtct

SEQ ID NO: 9381435 - DNA, 22 bp, Homo sapiens
ttcctttagtgtcatatacttt

SEQ ID NO: 9381436 - DNA, 22 bp, Homo sapiens
ttcctttagtgtcatatacttt

SEQ ID NO: 9381437 - DNA, 22 bp, Homo sapiens
ttcctttagggaaatcgtctca

SEQ ID NO: 9381438 - DNA, 22 bp, Homo sapiens
ttcgactctgtgcctgaagagc

SEQ ID NO: 9381439 - DNA, 22 bp, Homo sapiens
ttcgactctgtgcctgaagagc

SEQ ID NO: 9381440 - DNA, 22 bp, Homo sapiens
ttccctccgaacctcagtgctg

SEQ ID NO: 9381441 - DNA, 22 bp, Homo sapiens
ttccctcctatgcccactgaaa

SEQ ID NO: 9381442 - DNA, 22 bp, Homo sapiens
ttccctccgaacctcagtgctg

SEQ ID NO: 9381443 - DNA, 22 bp, Homo sapiens
ttccctccctggctgccatttc

SEQ ID NO: 9381444 - DNA, 22 bp, Homo sapiens
ttccctccctggctgccatttc

SEQ ID NO: 9381445 - DNA, 22 bp, Homo sapiens
ttccctcccccagcctggcagg

SEQ ID NO: 9381446 - DNA, 22 bp, Homo sapiens
ttccctccatttcattttataa

SEQ ID NO: 9381447 - DNA, 22 bp, Homo sapiens
ttccctctccaggagccctgag

SEQ ID NO: 9381448 - DNA, 22 bp, Homo sapiens
ttccctcctatgcccactgaaa

SEQ ID NO: 9381449 - DNA, 22 bp, Homo sapiens
ttccctctcctactcaggaaag

SEQ ID NO: 9381450 - DNA, 22 bp, Homo sapiens
ttgacatcaaatagatatcttt

SEQ ID NO: 9381451 - DNA, 22 bp, Homo sapiens
ttgagaaacctggcagtagaga

SEQ ID NO: 9381452 - DNA, 22 bp, Homo sapiens
ttgagaaactaacggcttgagc

SEQ ID NO: 9381453 - DNA, 22 bp, Homo sapiens
ttgacataagacttagagtatt

SEQ ID NO: 9381454 - DNA, 22 bp, Homo sapiens
ttgacagttgagggttgtctaa

SEQ ID NO: 9381455 - DNA, 22 bp, Homo sapiens
ttgaaaggaatacagaggccta

SEQ ID NO: 9381456 - DNA, 22 bp, Homo sapiens
ttgaaagaactcttcagagata

SEQ ID NO: 9381457 - DNA, 22 bp, Homo sapiens
ttgaaacttttcttggagaaac

SEQ ID NO: 9381458 - DNA, 22 bp, Homo sapiens
ttgaaagacattatttatatat

SEQ ID NO: 9381459 - DNA, 22 bp, Homo sapiens
ttgaaagatagtgaagccagcc

SEQ ID NO: 9381460 - DNA, 22 bp, Homo sapiens
ttgaaacttagaaattgagctg

SEQ ID NO: 9381461 - DNA, 22 bp, Homo sapiens
ttgaaactgagtgtgtttgggg

SEQ ID NO: 9381462 - DNA, 22 bp, Homo sapiens
ttgaaactgcttattgaatttg

SEQ ID NO: 9381463 - DNA, 22 bp, Homo sapiens
ttgaaactcatcttagtgatgt

SEQ ID NO: 9381464 - DNA, 22 bp, Homo sapiens
ttgaaacattacctgtatttcc

SEQ ID NO: 9381465 - DNA, 22 bp, Homo sapiens
ttgaaaacagcgtagattcaca

SEQ ID NO: 9381466 - DNA, 22 bp, Homo sapiens
ttctttttggatagctgatgaa

SEQ ID NO: 9381467 - DNA, 22 bp, Homo sapiens
ttgaaacagtagctcatagacc

SEQ ID NO: 9381468 - DNA, 22 bp, Homo sapiens
ttgaaaatggtaagcatgatat

SEQ ID NO: 9381469 - DNA, 22 bp, Homo sapiens
ttgaaaatggtaagcatgatat

SEQ ID NO: 9381470 - DNA, 22 bp, Homo sapiens
ttgaaaatggtaagcatgatat

SEQ ID NO: 9381471 - DNA, 22 bp, Homo sapiens
ttgaaaagttttgaaacactct

SEQ ID NO: 9381472 - DNA, 20 bp, Homo sapiens
ttgaaaatgcattgtgcagt

SEQ ID NO: 9381473 - DNA, 20 bp, Homo sapiens
ttgaaaatgcattgtgcagt

SEQ ID NO: 9381474 - DNA, 22 bp, Homo sapiens
ttgaaaatatcacaggagcagc

SEQ ID NO: 9381475 - DNA, 19 bp, Homo sapiens
ttgagaaatgggaaaagca

SEQ ID NO: 9381476 - DNA, 22 bp, Homo sapiens
ttgagaaatgttttttaagctg

SEQ ID NO: 9381477 - DNA, 16 bp, Homo sapiens
ttgagaaatgaagttt

SEQ ID NO: 9381478 - DNA, 22 bp, Homo sapiens
ttgagaaataagcatgtctaga

SEQ ID NO: 9381479 - DNA, 18 bp, Homo sapiens
ttgagaaataagcactaa

SEQ ID NO: 9381480 - DNA, 22 bp, Homo sapiens
ttgagacacaaggcacagtaag

SEQ ID NO: 9381481 - DNA, 22 bp, Homo sapiens
ttgagacactttgggcatcact

SEQ ID NO: 9381482 - DNA, 22 bp, Homo sapiens
ttgagacacagtttcactctgt

SEQ ID NO: 9381483 - DNA, 22 bp, Homo sapiens
ttgagacactttgggcatcact

SEQ ID NO: 9381484 - DNA, 22 bp, Homo sapiens
ttgagaactctgtatgtccagc

SEQ ID NO: 9381485 - DNA, 22 bp, Homo sapiens
ttgagaactactttattattct

SEQ ID NO: 9381486 - DNA, 22 bp, Homo sapiens
ttgagaacaggagtgttctttt

SEQ ID NO: 9381487 - DNA, 22 bp, Homo sapiens
ttgagaaccactgagttagata

SEQ ID NO: 9381488 - DNA, 22 bp, Homo sapiens
ttgagggtctggatctgctgct

SEQ ID NO: 9381489 - DNA, 22 bp, Homo sapiens
ttgaggcccggcaggccgagcg

SEQ ID NO: 9381490 - DNA, 22 bp, Homo sapiens
ttgaggcccggcaggccgagcg

SEQ ID NO: 9381491 - DNA, 22 bp, Homo sapiens
ttgagggacagaggtgctgtct

SEQ ID NO: 9381492 - DNA, 22 bp, Homo sapiens
ttgagggaacatgagaatcatc

SEQ ID NO: 9381493 - DNA, 22 bp, Homo sapiens
ttgagggaacatgagaatcatc

SEQ ID NO: 9381494 - DNA, 22 bp, Homo sapiens
ttgaggctgcacagtacaggct

SEQ ID NO: 9381495 - DNA, 22 bp, Homo sapiens
ttgagatagatctcatcttccc

SEQ ID NO: 9381496 - DNA, 22 bp, Homo sapiens
ttcttctgaaacataatcaata

SEQ ID NO: 9381497 - DNA, 22 bp, Homo sapiens
ttcttctgacactgatgctgta

SEQ ID NO: 9381498 - DNA, 22 bp, Homo sapiens
ttcttctgaaacataatcaata

SEQ ID NO: 9381499 - DNA, 22 bp, Homo sapiens
ttcttctgaaacataatcaata

SEQ ID NO: 9381500 - DNA, 20 bp, Homo sapiens
ttcttctctagttatcttca

SEQ ID NO: 9381501 - DNA, 22 bp, Homo sapiens
ttcttctctcatagattaaggt

SEQ ID NO: 9381502 - DNA, 22 bp, Homo sapiens
ttcttctctcatagattaaggt

SEQ ID NO: 9381503 - DNA, 22 bp, Homo sapiens
ttcttctctcatagattaaggt

SEQ ID NO: 9381504 - DNA, 22 bp, Homo sapiens
ttcttctgttggcagagcatac

SEQ ID NO: 9381505 - DNA, 22 bp, Homo sapiens
ttcttctgtgaggtgtgtgcct

SEQ ID NO: 9381506 - DNA, 22 bp, Homo sapiens
ttcttctgtgaggtgtgtgcct

SEQ ID NO: 9381507 - DNA, 22 bp, Homo sapiens
ttcttctgcctcccacctgata

SEQ ID NO: 9381508 - DNA, 22 bp, Homo sapiens
ttcttctgagagaaaaagctca

SEQ ID NO: 9381509 - DNA, 22 bp, Homo sapiens
ttctttcttctcaggctgggta

SEQ ID NO: 9381510 - DNA, 22 bp, Homo sapiens
ttctttcttagcaatctatggt

SEQ ID NO: 9381511 - DNA, 22 bp, Homo sapiens
ttctttctctactagcagagct

SEQ ID NO: 9381512 - DNA, 22 bp, Homo sapiens
ttctttctcactctttaggaag

SEQ ID NO: 9381513 - DNA, 22 bp, Homo sapiens
ttctttctcactctttaggaag

SEQ ID NO: 9381514 - DNA, 22 bp, Homo sapiens
ttctttctcagtgggcagatac

SEQ ID NO: 9381515 - DNA, 22 bp, Homo sapiens
ttctttctcactctttaggaag

SEQ ID NO: 9381516 - DNA, 22 bp, Homo sapiens
ttcttcttcaagtgctgcattc

SEQ ID NO: 9381517 - DNA, 22 bp, Homo sapiens
ttctttggcttacgtctggcct

SEQ ID NO: 9381518 - DNA, 22 bp, Homo sapiens
ttctttgcccatgtttcctaag

SEQ ID NO: 9381519 - DNA, 22 bp, Homo sapiens
ttctttgagttagtacagtcca

SEQ ID NO: 9381520 - DNA, 22 bp, Homo sapiens
ttctttctttgtagtcctgaac

SEQ ID NO: 9381521 - DNA, 22 bp, Homo sapiens
ttctttctttgtagtcctgaac

SEQ ID NO: 9381522 - DNA, 22 bp, Homo sapiens
ttctttctttgtagtcctgaac

SEQ ID NO: 9381523 - DNA, 22 bp, Homo sapiens
ttctttcttggggaacacactc

SEQ ID NO: 9381524 - DNA, 22 bp, Homo sapiens
ttctttcttctcaggctgggta

SEQ ID NO: 9381525 - DNA, 22 bp, Homo sapiens
ttctttcttggggaacacactc

SEQ ID NO: 9381526 - DNA, 22 bp, Homo sapiens
ttcttcctctgtaaaaggtgac

SEQ ID NO: 9381527 - DNA, 22 bp, Homo sapiens
ttcttccttggtttcctggata

SEQ ID NO: 9381528 - DNA, 22 bp, Homo sapiens
ttcttccttggtttcctggata

SEQ ID NO: 9381529 - DNA, 22 bp, Homo sapiens
ttcttctccgaggagggctggt

SEQ ID NO: 9381530 - DNA, 22 bp, Homo sapiens
ttcttctcagggtcccacatgg

SEQ ID NO: 9381531 - DNA, 22 bp, Homo sapiens
ttcttctcagggtcccacatgg

SEQ ID NO: 9381532 - DNA, 23 bp, Homo sapiens
ttcttctcaattagttgattcag

SEQ ID NO: 9381533 - DNA, 22 bp, Homo sapiens
ttcttctcggctgtcagatagt

SEQ ID NO: 9381534 - DNA, 22 bp, Homo sapiens
ttcttctcggctgtcagatagt

SEQ ID NO: 9381535 - DNA, 22 bp, Homo sapiens
ttcttctcggctgtcagatagt

SEQ ID NO: 9381536 - DNA, 22 bp, Homo sapiens
ttcttctcctaaggagagtcct

SEQ ID NO: 9381537 - DNA, 22 bp, Homo sapiens
ttcttctccgaggagggctggt

SEQ ID NO: 9381538 - DNA, 22 bp, Homo sapiens
ttcttcctcagcagggctgcct

SEQ ID NO: 9381539 - DNA, 22 bp, Homo sapiens
ttcttcctcacactctcaccca

SEQ ID NO: 9381540 - DNA, 22 bp, Homo sapiens
ttcttcagcccatatcttccag

SEQ ID NO: 9381541 - DNA, 22 bp, Homo sapiens
ttcttcagatggtgagacctcc

SEQ ID NO: 9381542 - DNA, 22 bp, Homo sapiens
ttctgggcacacaggccctggt

SEQ ID NO: 9381543 - DNA, 19 bp, Homo sapiens
ttctgggaggggctgactg

SEQ ID NO: 9381544 - DNA, 22 bp, Homo sapiens
ttctgggaggctggctgtcata

SEQ ID NO: 9381545 - DNA, 22 bp, Homo sapiens
ttctgggacattgcaggtattc

SEQ ID NO: 9381546 - DNA, 22 bp, Homo sapiens
ttctgggagaatctaaatggtt

SEQ ID NO: 9381547 - DNA, 22 bp, Homo sapiens
ttctgggagattcatatgaaaa

SEQ ID NO: 9381548 - DNA, 22 bp, Homo sapiens
ttctgggaggctggctgtcata

SEQ ID NO: 9381549 - DNA, 22 bp, Homo sapiens
ttctgggaggatgggaaatcat

SEQ ID NO: 9381550 - DNA, 22 bp, Homo sapiens
ttctggaggctctaagggacaa

SEQ ID NO: 9381551 - DNA, 22 bp, Homo sapiens
ttctggagggcctgatcacaca

SEQ ID NO: 9381552 - DNA, 22 bp, Homo sapiens
ttctggagggcctgatcacaca

SEQ ID NO: 9381553 - DNA, 22 bp, Homo sapiens
ttctggagggcatgctgctgcc

SEQ ID NO: 9381554 - DNA, 19 bp, Homo sapiens
ttctggaggttaccctgag

SEQ ID NO: 9381555 - DNA, 22 bp, Homo sapiens
ttctggaggttattaggagtct

SEQ ID NO: 9381556 - DNA, 22 bp, Homo sapiens
ttctggagtcccacagccaggg

SEQ ID NO: 9381557 - DNA, 22 bp, Homo sapiens
ttctggagttcaggtccctaaa

SEQ ID NO: 9381558 - DNA, 22 bp, Homo sapiens
ttctggagtgtattgggtctgc

SEQ ID NO: 9381559 - DNA, 22 bp, Homo sapiens
ttctggagtattcctggcagcc

SEQ ID NO: 9381560 - DNA, 22 bp, Homo sapiens
ttctggagtattcctggcagcc

SEQ ID NO: 9381561 - DNA, 22 bp, Homo sapiens
ttctggagtcattggggctgat

SEQ ID NO: 9381562 - DNA, 22 bp, Homo sapiens
ttctgggaacaaagtggagtgg

SEQ ID NO: 9381563 - DNA, 22 bp, Homo sapiens
ttctgggacatctggacagttt

SEQ ID NO: 9381564 - DNA, 22 bp, Homo sapiens
ttctgggaacaaagtggagtgg

SEQ ID NO: 9381565 - DNA, 22 bp, Homo sapiens
ttctgggacatctggacagttt

SEQ ID NO: 9381566 - DNA, 22 bp, Homo sapiens
ttctgggacattgcaggtattc

SEQ ID NO: 9381567 - DNA, 20 bp, Homo sapiens
ttctgggaattgggtagctg

SEQ ID NO: 9381568 - DNA, 21 bp, Homo sapiens
ttctgggaaatgagctggggc

SEQ ID NO: 9381569 - DNA, 22 bp, Homo sapiens
ttctggctttgaccaagttcaa

SEQ ID NO: 9381570 - DNA, 22 bp, Homo sapiens
ttctggctttcttgtcaggatg

SEQ ID NO: 9381571 - DNA, 22 bp, Homo sapiens
ttctggagtttgaagatcaggt

SEQ ID NO: 9381572 - DNA, 22 bp, Homo sapiens
ttctggagttgtgacctcaggg

SEQ ID NO: 9381573 - DNA, 22 bp, Homo sapiens
tttcacaggagtcctttctata

SEQ ID NO: 9381574 - DNA, 22 bp, Homo sapiens
tttcacaggaatacccggcttt

SEQ ID NO: 9381575 - DNA, 22 bp, Homo sapiens
tttcacaggaatacccggcttt

SEQ ID NO: 9381576 - DNA, 23 bp, Homo sapiens
tttcacagcttttattctgcatc

SEQ ID NO: 9381577 - DNA, 22 bp, Homo sapiens
tttcacaatcaaatggtgaaat

SEQ ID NO: 9381578 - DNA, 20 bp, Homo sapiens
tttcacaatgaacatgtctc

SEQ ID NO: 9381579 - DNA, 22 bp, Homo sapiens
tttcacatggactttttgttct

SEQ ID NO: 9381580 - DNA, 22 bp, Homo sapiens
tttcacattcttctgaatctac

SEQ ID NO: 9381581 - DNA, 22 bp, Homo sapiens
tttcacattggcttctatttct

SEQ ID NO: 9381582 - DNA, 22 bp, Homo sapiens
tttcacattggcttctatttct

SEQ ID NO: 9381583 - DNA, 22 bp, Homo sapiens
tttcagtttgaaggaaaggcca

SEQ ID NO: 9381584 - DNA, 22 bp, Homo sapiens
tttcagtgtgagtgtcttattt

SEQ ID NO: 9381585 - DNA, 22 bp, Homo sapiens
tttcagtgtcagtaatgcagca

SEQ ID NO: 9381586 - DNA, 21 bp, Homo sapiens
tttcagtgtatgacagtgaaa

SEQ ID NO: 9381587 - DNA, 22 bp, Homo sapiens
tttcagtgtatcttccaaaagc

SEQ ID NO: 9381588 - DNA, 22 bp, Homo sapiens
tttcacatttgttttaagaagt

SEQ ID NO: 9381589 - DNA, 22 bp, Homo sapiens
tttcagtgtaaggtttccagga

SEQ ID NO: 9381590 - DNA, 22 bp, Homo sapiens
tttcagtgtaaggtttccagga

SEQ ID NO: 9381591 - DNA, 20 bp, Homo sapiens
tttcagtggtttgtgcctag

SEQ ID NO: 9381592 - DNA, 22 bp, Homo sapiens
tttcagtgggtttatttcatgt

SEQ ID NO: 9381593 - DNA, 22 bp, Homo sapiens
tttcagtggcatcgattaccct

SEQ ID NO: 9381594 - DNA, 22 bp, Homo sapiens
tttcaagtggggacatttgaga

SEQ ID NO: 9381595 - DNA, 22 bp, Homo sapiens
tttcaagtggggacatttgaga

SEQ ID NO: 9381596 - DNA, 22 bp, Homo sapiens
tttcaagtggcgagataaggaa

SEQ ID NO: 9381597 - DNA, 20 bp, Homo sapiens
tttcaagttgtaaggtatca

SEQ ID NO: 9381598 - DNA, 22 bp, Homo sapiens
tttcaagttctgttcctaaact

SEQ ID NO: 9381599 - DNA, 22 bp, Homo sapiens
tttcaagttcccagttttgtgg

SEQ ID NO: 9381600 - DNA, 22 bp, Homo sapiens
tttcaagttaaatggggtcttt

SEQ ID NO: 9381601 - DNA, 22 bp, Homo sapiens
tttcaagtgtcctgattaatgg

SEQ ID NO: 9381602 - DNA, 22 bp, Homo sapiens
tttcaagttgttgcattaaatg

SEQ ID NO: 9381603 - DNA, 20 bp, Homo sapiens
tttcaagttgtaaggtatca

SEQ ID NO: 9381604 - DNA, 22 bp, Homo sapiens
tttcaagttgtttatatccaga

SEQ ID NO: 9381605 - DNA, 22 bp, Homo sapiens
tttcaagttgttgcattaaatg

SEQ ID NO: 9381606 - DNA, 22 bp, Homo sapiens
tttcaagttgttgcattaaatg

SEQ ID NO: 9381607 - DNA, 22 bp, Homo sapiens
tttcaatcaccataaagcaact

SEQ ID NO: 9381608 - DNA, 22 bp, Homo sapiens
tttcaagttgtttatatccaga

SEQ ID NO: 9381609 - DNA, 22 bp, Homo sapiens
tttcacaagacagctactgttg

SEQ ID NO: 9381610 - DNA, 22 bp, Homo sapiens
tttcacaagacagctactgttg

SEQ ID NO: 9381611 - DNA, 22 bp, Homo sapiens
tttcacaactgcttatttgaga

SEQ ID NO: 9381612 - DNA, 18 bp, Homo sapiens
tttcacaacctccagagg

SEQ ID NO: 9381613 - DNA, 22 bp, Homo sapiens
tttcacaacgttgtggtgagag

SEQ ID NO: 9381614 - DNA, 21 bp, Homo sapiens
tttatttatataggacacatg

SEQ ID NO: 9381615 - DNA, 22 bp, Homo sapiens
tttatttatccttctggattgc

SEQ ID NO: 9381616 - DNA, 22 bp, Homo sapiens
tttatttatccttctggattgc

SEQ ID NO: 9381617 - DNA, 22 bp, Homo sapiens
tttatttatccttctggattgc

SEQ ID NO: 9381618 - DNA, 22 bp, Homo sapiens
tttatttatccttctggattgc

SEQ ID NO: 9381619 - DNA, 22 bp, Homo sapiens
tttatttatccttctggattgc

SEQ ID NO: 9381620 - DNA, 22 bp, Homo sapiens
tttatttatccttctggattgc

SEQ ID NO: 9381621 - DNA, 23 bp, Homo sapiens
tttatttatttaggctgagggat

SEQ ID NO: 9381622 - DNA, 22 bp, Homo sapiens
tttatttataagccacttgctg

SEQ ID NO: 9381623 - DNA, 22 bp, Homo sapiens
tttatttataagccacttgctg

SEQ ID NO: 9381624 - DNA, 22 bp, Homo sapiens
tttatttataagccacttgctg

SEQ ID NO: 9381625 - DNA, 22 bp, Homo sapiens
tttatttataagccacttgctg

SEQ ID NO: 9381626 - DNA, 22 bp, Homo sapiens
tttatttataagccacttgctg

SEQ ID NO: 9381627 - DNA, 21 bp, Homo sapiens
tttatttatataggacacatg

SEQ ID NO: 9381628 - DNA, 21 bp, Homo sapiens
tttatttatataggacacatg

SEQ ID NO: 9381629 - DNA, 21 bp, Homo sapiens
tttatttatataggacacatg

SEQ ID NO: 9381630 - DNA, 22 bp, Homo sapiens
tttcaagtactgtaaacatgct

SEQ ID NO: 9381631 - DNA, 22 bp, Homo sapiens
tttcaagtaagatacatttcag

SEQ ID NO: 9381632 - DNA, 22 bp, Homo sapiens
tttcaagtaagatacatttcag

SEQ ID NO: 9381633 - DNA, 22 bp, Homo sapiens
tttcaagtagagggatcgctag

SEQ ID NO: 9381634 - DNA, 20 bp, Homo sapiens
tttcaagtcggtagagtcta

SEQ ID NO: 9381635 - DNA, 20 bp, Homo sapiens
tttcaagtcggtagagtcta

SEQ ID NO: 9381636 - DNA, 22 bp, Homo sapiens
tttcaagtcattctataatatc

SEQ ID NO: 9381637 - DNA, 22 bp, Homo sapiens
tttcaagtcagtagctaatcat

SEQ ID NO: 9381638 - DNA, 22 bp, Homo sapiens
tttcaaggccttctggttcagt

SEQ ID NO: 9381639 - DNA, 23 bp, Homo sapiens
tttatttatttaggctgagggat

SEQ ID NO: 9381640 - DNA, 22 bp, Homo sapiens
tttcgagggattagctaggact

SEQ ID NO: 9381641 - DNA, 22 bp, Homo sapiens
tttctaaaatagattttatggt

SEQ ID NO: 9381642 - DNA, 22 bp, Homo sapiens
tttctaagcttagtatgaggca

SEQ ID NO: 9381643 - DNA, 22 bp, Homo sapiens
tttctaagacatttgtcatctt

SEQ ID NO: 9381644 - DNA, 22 bp, Homo sapiens
tttctaacgtagacagggaggt

SEQ ID NO: 9381645 - DNA, 22 bp, Homo sapiens
tttctaacgtagacagggaggt

SEQ ID NO: 9381646 - DNA, 22 bp, Homo sapiens
tttctaacagcaaatgtttatc

SEQ ID NO: 9381647 - DNA, 22 bp, Homo sapiens
tttctaaatggtggctgcattg

SEQ ID NO: 9381648 - DNA, 22 bp, Homo sapiens
tttccttcttagcggtgttctt

SEQ ID NO: 9381649 - DNA, 22 bp, Homo sapiens
tttcctttctggtttggtcata

SEQ ID NO: 9381650 - DNA, 22 bp, Homo sapiens
tttccttgcacattggtttcca

SEQ ID NO: 9381651 - DNA, 22 bp, Homo sapiens
tttccatgttatcttgcagact

SEQ ID NO: 9381652 - DNA, 22 bp, Homo sapiens
tttccagtgcatggcaaatgct

SEQ ID NO: 9381653 - DNA, 22 bp, Homo sapiens
tttccagtgcatggcaaatgct

SEQ ID NO: 9381654 - DNA, 22 bp, Homo sapiens
tttccagttgtcctatcacctg

SEQ ID NO: 9381655 - DNA, 22 bp, Homo sapiens
tttccagttgttctagaaagct

SEQ ID NO: 9381656 - DNA, 22 bp, Homo sapiens
tttccagttgttctagaaagct

SEQ ID NO: 9381657 - DNA, 22 bp, Homo sapiens
tttccaggaagtaaggataatc

SEQ ID NO: 9381658 - DNA, 22 bp, Homo sapiens
tttccagattaagataccactt

SEQ ID NO: 9381659 - DNA, 22 bp, Homo sapiens
tttccagattaagataccactt

SEQ ID NO: 9381660 - DNA, 17 bp, Homo sapiens
tttcatctgggaccacc

SEQ ID NO: 9381661 - DNA, 22 bp, Homo sapiens
tttcatcttcccagagaccttg

SEQ ID NO: 9381662 - DNA, 22 bp, Homo sapiens
tttccaaataaggtcacattct

SEQ ID NO: 9381663 - DNA, 22 bp, Homo sapiens
tttccagtctctgcctccaagg

SEQ ID NO: 9381664 - DNA, 22 bp, Homo sapiens
tttccagtctcagccctgtaac

SEQ ID NO: 9381665 - DNA, 22 bp, Homo sapiens
tttccagtaagtggcaaggagc

SEQ ID NO: 9381666 - DNA, 22 bp, Homo sapiens
tttccagtccctggatttaacc

SEQ ID NO: 9381667 - DNA, 22 bp, Homo sapiens
tttccagtcaccactagatcag

SEQ ID NO: 9381668 - DNA, 22 bp, Homo sapiens
tttccagtgatggggtctggct

SEQ ID NO: 9381669 - DNA, 22 bp, Homo sapiens
tttccagtgagcaaatgtagaa

SEQ ID NO: 9381670 - DNA, 22 bp, Homo sapiens
tttccagtgaattagtctgttt

SEQ ID NO: 9381671 - DNA, 22 bp, Homo sapiens
tttccagtgaaattttgaatgt

SEQ ID NO: 9381672 - DNA, 22 bp, Homo sapiens
tttccaggtatcaagcttcagg

SEQ ID NO: 9381673 - DNA, 22 bp, Homo sapiens
tttcatatgggcattggcaata

SEQ ID NO: 9381674 - DNA, 22 bp, Homo sapiens
tttcatctatttgctttgtgaa

SEQ ID NO: 9381675 - DNA, 22 bp, Homo sapiens
tttcatctaacactacataggg

SEQ ID NO: 9381676 - DNA, 22 bp, Homo sapiens
tttcatcatcaaaatagtgagg

SEQ ID NO: 9381677 - DNA, 22 bp, Homo sapiens
tttcatcatgttggcagattgg

SEQ ID NO: 9381678 - DNA, 22 bp, Homo sapiens
tttcataatatccagagatttt

SEQ ID NO: 9381679 - DNA, 22 bp, Homo sapiens
tttcataatagtgcagtttgtt

SEQ ID NO: 9381680 - DNA, 22 bp, Homo sapiens
tttcataacctcaagctacagt

SEQ ID NO: 9381681 - DNA, 22 bp, Homo sapiens
tttcataatactgtacatgaaa

SEQ ID NO: 9381682 - DNA, 22 bp, Homo sapiens
tttacactgcttgaacaatctc

SEQ ID NO: 9381683 - DNA, 22 bp, Homo sapiens
tttacactgtgaaacaggtatc

SEQ ID NO: 9381684 - DNA, 22 bp, Homo sapiens
tttacactgcttgaacaatctc

SEQ ID NO: 9381685 - DNA, 22 bp, Homo sapiens
tttacacgtcacattagcggag

SEQ ID NO: 9381686 - DNA, 22 bp, Homo sapiens
tttacacggcattatcttcatg

SEQ ID NO: 9381687 - DNA, 22 bp, Homo sapiens
tttacactcctggaaatgatat

SEQ ID NO: 9381688 - DNA, 22 bp, Homo sapiens
tttacacattattttcagtgtg

SEQ ID NO: 9381689 - DNA, 22 bp, Homo sapiens
tttacaccaaaatgacacagag

SEQ ID NO: 9381690 - DNA, 22 bp, Homo sapiens
tttacaagtctgttgatcccaa

SEQ ID NO: 9381691 - DNA, 22 bp, Homo sapiens
tttacaagtcagggactgttct

SEQ ID NO: 9381692 - DNA, 19 bp, Homo sapiens
tttacaagttctttgtatg

SEQ ID NO: 9381693 - DNA, 22 bp, Homo sapiens
tttacacattattttcagtgtg

SEQ ID NO: 9381694 - DNA, 22 bp, Homo sapiens
tttacacattattttcagtgtg

SEQ ID NO: 9381695 - DNA, 22 bp, Homo sapiens
tttacacattattttcagtgtg

SEQ ID NO: 9381696 - DNA, 22 bp, Homo sapiens
tttaagagctagtatgtcattt

SEQ ID NO: 9381697 - DNA, 22 bp, Homo sapiens
tttaagatcatttgtattatcc

SEQ ID NO: 9381698 - DNA, 22 bp, Homo sapiens
tttaagactcttgtagtacaca

SEQ ID NO: 9381699 - DNA, 22 bp, Homo sapiens
tttaagagcatttgcaatttat

SEQ ID NO: 9381700 - DNA, 22 bp, Homo sapiens
tttacagatgaggaaactgaga

SEQ ID NO: 9381701 - DNA, 22 bp, Homo sapiens
tttacagatgaggaaactgaga

SEQ ID NO: 9381702 - DNA, 22 bp, Homo sapiens
tttacagatctgttgatttgtt

SEQ ID NO: 9381703 - DNA, 22 bp, Homo sapiens
tttacagatgaggatactgagg

SEQ ID NO: 9381704 - DNA, 22 bp, Homo sapiens
tttacagatgaggatactgagg

SEQ ID NO: 9381705 - DNA, 22 bp, Homo sapiens
tttacagatgtggaaagtgagc

SEQ ID NO: 9381706 - DNA, 22 bp, Homo sapiens
tttacagatgtggaaagtgagc

SEQ ID NO: 9381707 - DNA, 22 bp, Homo sapiens
tttacagatgtggaaagtgagc

SEQ ID NO: 9381708 - DNA, 22 bp, Homo sapiens
tttacagcactgaagccagggg

SEQ ID NO: 9381709 - DNA, 22 bp, Homo sapiens
tttacagcagcatgatttataa

SEQ ID NO: 9381710 - DNA, 22 bp, Homo sapiens
tttacagattctgggtattagg

SEQ ID NO: 9381711 - DNA, 22 bp, Homo sapiens
tttacagagagagaactggact

SEQ ID NO: 9381712 - DNA, 22 bp, Homo sapiens
tttacagagaatgtacataaag

SEQ ID NO: 9381713 - DNA, 22 bp, Homo sapiens
tttacagagaatgtacataaag

SEQ ID NO: 9381714 - DNA, 22 bp, Homo sapiens
tttacagagaatgtacataaag

SEQ ID NO: 9381715 - DNA, 22 bp, Homo sapiens
tttacactgtgaaacaggtatc

SEQ ID NO: 9381716 - DNA, 22 bp, Homo sapiens
tttacacttgaggaaactgagg

SEQ ID NO: 9381717 - DNA, 22 bp, Homo sapiens
tttacacttgaggaaactgagg

SEQ ID NO: 9381718 - DNA, 22 bp, Homo sapiens
tttacacttgaggaaactgagg

SEQ ID NO: 9381719 - DNA, 22 bp, Homo sapiens
tttacagaatgttgaatttggg

SEQ ID NO: 9381720 - DNA, 23 bp, Homo sapiens
tttaacatttgaacatgtggcca

SEQ ID NO: 9381721 - DNA, 22 bp, Homo sapiens
tttaacatgttcaagaaacata

SEQ ID NO: 9381722 - DNA, 22 bp, Homo sapiens
tttaacatgttcaagaaacata

SEQ ID NO: 9381723 - DNA, 22 bp, Homo sapiens
tttaacctctaatttagttctc

SEQ ID NO: 9381724 - DNA, 22 bp, Homo sapiens
tttaacctgtcaatttgcatgc

SEQ ID NO: 9381725 - DNA, 23 bp, Homo sapiens
tttaactttccaataattcattg

SEQ ID NO: 9381726 - DNA, 23 bp, Homo sapiens
tttaactttccaataattcattg

SEQ ID NO: 9381727 - DNA, 22 bp, Homo sapiens
tttaaattatagttaatgtctg

SEQ ID NO: 9381728 - DNA, 22 bp, Homo sapiens
tttaaattatagttaatgtctg

SEQ ID NO: 9381729 - DNA, 22 bp, Homo sapiens
tttaaattatagttaatgtctg

SEQ ID NO: 9381730 - DNA, 22 bp, Homo sapiens
tttaacatgttcaagaaacata

SEQ ID NO: 9381731 - DNA, 22 bp, Homo sapiens
tttaacaggtaaagtaaatgtg

SEQ ID NO: 9381732 - DNA, 22 bp, Homo sapiens
tttaacaggtaaagtaaatgtg

SEQ ID NO: 9381733 - DNA, 22 bp, Homo sapiens
tttaacagatgtgaaattttca

SEQ ID NO: 9381734 - DNA, 22 bp, Homo sapiens
ttgttcttttgcttagacagat

SEQ ID NO: 9381735 - DNA, 22 bp, Homo sapiens
ttgttgcaacagacaccatatg

SEQ ID NO: 9381736 - DNA, 22 bp, Homo sapiens
ttgttcttctctagagaagtgg

SEQ ID NO: 9381737 - DNA, 23 bp, Homo sapiens
ttgttcttggatcttcctgaagc

SEQ ID NO: 9381738 - DNA, 22 bp, Homo sapiens
ttgttcttggagcaggcagaga

SEQ ID NO: 9381739 - DNA, 22 bp, Homo sapiens
ttgttcttggagcaggcagaga

SEQ ID NO: 9381740 - DNA, 22 bp, Homo sapiens
ttgttcttctctagagaagtgg

SEQ ID NO: 9381741 - DNA, 22 bp, Homo sapiens
ttgttcttacttaagagtgaat

SEQ ID NO: 9381742 - DNA, 22 bp, Homo sapiens
ttgttcttacttaagagtgaat

SEQ ID NO: 9381743 - DNA, 22 bp, Homo sapiens
ttgttcttagtatgcattgttt

SEQ ID NO: 9381744 - DNA, 22 bp, Homo sapiens
ttgttgttataggtggtacaag

SEQ ID NO: 9381745 - DNA, 22 bp, Homo sapiens
ttgttgtcattgtagaggattt

SEQ ID NO: 9381746 - DNA, 22 bp, Homo sapiens
ttgttgtttccaggatactgtg

SEQ ID NO: 9381747 - DNA, 22 bp, Homo sapiens
ttgttgttggagccaatatgca

SEQ ID NO: 9381748 - DNA, 22 bp, Homo sapiens
ttgtttaaaagaaatcatagaa

SEQ ID NO: 9381749 - DNA, 22 bp, Homo sapiens
ttgtttaaaagaaatcatagaa

SEQ ID NO: 9381750 - DNA, 22 bp, Homo sapiens
ttgttggtgaatagggtggaat

SEQ ID NO: 9381751 - DNA, 22 bp, Homo sapiens
ttgttggtggaattgatgctag

SEQ ID NO: 9381752 - DNA, 22 bp, Homo sapiens
ttgttgtagacgcgaagtgact

SEQ ID NO: 9381753 - DNA, 22 bp, Homo sapiens
ttgttgggcatgcagtggctgt

SEQ ID NO: 9381754 - DNA, 22 bp, Homo sapiens
ttgttgcatttcaagtatgaga

SEQ ID NO: 9381755 - DNA, 22 bp, Homo sapiens
tttagcttaaattgtaagtgaa

SEQ ID NO: 9381756 - DNA, 22 bp, Homo sapiens
tttagcttaaatggagaaagag

SEQ ID NO: 9381757 - DNA, 22 bp, Homo sapiens
tttagcttcatcttcaagctgg

SEQ ID NO: 9381758 - DNA, 22 bp, Homo sapiens
tttagcattaagcttttcaaat

SEQ ID NO: 9381759 - DNA, 22 bp, Homo sapiens
tttacagcttctatactatgtg

SEQ ID NO: 9381760 - DNA, 22 bp, Homo sapiens
tttacagctgctggcaagcttg

SEQ ID NO: 9381761 - DNA, 22 bp, Homo sapiens
tttaggcaagaactcactgaga

SEQ ID NO: 9381762 - DNA, 22 bp, Homo sapiens
tttatctgttcctcttggaggc

SEQ ID NO: 9381763 - DNA, 22 bp, Homo sapiens
tttatctgtggtaaataacatt

SEQ ID NO: 9381764 - DNA, 22 bp, Homo sapiens
tttatctggactgtgatataaa

SEQ ID NO: 9381765 - DNA, 22 bp, Homo sapiens
tttatctttaggactttgcaga

SEQ ID NO: 9381766 - DNA, 22 bp, Homo sapiens
tttatctttaggactttgcaga

SEQ ID NO: 9381767 - DNA, 22 bp, Homo sapiens
tttatctttaggactttgcaga

SEQ ID NO: 9381768 - DNA, 22 bp, Homo sapiens
tttatctttaggactttgcaga

SEQ ID NO: 9381769 - DNA, 22 bp, Homo sapiens
tttatctttaggactttgcaga

SEQ ID NO: 9381770 - DNA, 22 bp, Homo sapiens
tttatctgttgtacatttatgc

SEQ ID NO: 9381771 - DNA, 18 bp, Homo sapiens
tttagtggtgcatttgac

SEQ ID NO: 9381772 - DNA, 22 bp, Homo sapiens
tttagtgtaagcataaagaaca

SEQ ID NO: 9381773 - DNA, 22 bp, Homo sapiens
tttagtgtaattctgccttttg

SEQ ID NO: 9381774 - DNA, 22 bp, Homo sapiens
tttagtgtaattctgccttttg

SEQ ID NO: 9381775 - DNA, 22 bp, Homo sapiens
tttagtgtagcattcagagtca

SEQ ID NO: 9381776 - DNA, 22 bp, Homo sapiens
tttagtgtagcattcagagtca

SEQ ID NO: 9381777 - DNA, 22 bp, Homo sapiens
tttagtgtagcctaagcagaat

SEQ ID NO: 9381778 - DNA, 22 bp, Homo sapiens
tttagtgtgacagtccccagta

SEQ ID NO: 9381779 - DNA, 22 bp, Homo sapiens
tttagtgtggcactgatgttca

SEQ ID NO: 9381780 - DNA, 22 bp, Homo sapiens
tttagtgtggcactgatgttca

SEQ ID NO: 9381781 - DNA, 22 bp, Homo sapiens
tttagtgtttgcgtgtactcct

SEQ ID NO: 9381782 - DNA, 22 bp, Homo sapiens
tttattgctgtgttagggacag

SEQ ID NO: 9381783 - DNA, 22 bp, Homo sapiens
tttattgctgtgttagggacag

SEQ ID NO: 9381784 - DNA, 22 bp, Homo sapiens
tttattggaacacagccatgac

SEQ ID NO: 9381785 - DNA, 22 bp, Homo sapiens
tttattggaacacagccatgac

SEQ ID NO: 9381786 - DNA, 22 bp, Homo sapiens
tttattggaacacagccatgac

SEQ ID NO: 9381787 - DNA, 20 bp, Homo sapiens
tttattggcctttcaggaac

SEQ ID NO: 9381788 - DNA, 22 bp, Homo sapiens
tttattggatgggtcagctcta

SEQ ID NO: 9381789 - DNA, 22 bp, Homo sapiens
tttattggatggatggatggat

SEQ ID NO: 9381790 - DNA, 22 bp, Homo sapiens
tttattggatatttacaagata

SEQ ID NO: 9381791 - DNA, 22 bp, Homo sapiens
tttattggatatttacaagata

SEQ ID NO: 9381792 - DNA, 22 bp, Homo sapiens
tttattgggtgcagtgcccaca

SEQ ID NO: 9381793 - DNA, 22 bp, Homo sapiens
tttattgggcctggaggatcta

SEQ ID NO: 9381794 - DNA, 22 bp, Homo sapiens
tttattgtctatgaactgcttg

SEQ ID NO: 9381795 - DNA, 22 bp, Homo sapiens
tttatttataagccacttgctg

SEQ ID NO: 9381796 - DNA, 22 bp, Homo sapiens
tttattgtgttgaaactgaatt

SEQ ID NO: 9381797 - DNA, 16 bp, Homo sapiens
tttatttactagtgtt

SEQ ID NO: 9381798 - DNA, 16 bp, Homo sapiens
tttatttactagtgtt

SEQ ID NO: 9381799 - DNA, 16 bp, Homo sapiens
tttatttactagtgtt

SEQ ID NO: 9381800 - DNA, 22 bp, Homo sapiens
tttattgtctatgaactgcttg

SEQ ID NO: 9381801 - DNA, 22 bp, Homo sapiens
tttatgttcctcttgagctttc

SEQ ID NO: 9381802 - DNA, 21 bp, Homo sapiens
tttatgtacttcatagagtag

SEQ ID NO: 9381803 - DNA, 21 bp, Homo sapiens
tttatgtacttcatagagtag

SEQ ID NO: 9381804 - DNA, 21 bp, Homo sapiens
tttatgtacttcatagagtag

SEQ ID NO: 9381805 - DNA, 22 bp, Homo sapiens
tttatgtttgcattttcaaaga

SEQ ID NO: 9381806 - DNA, 22 bp, Homo sapiens
tttattgccctgtagtacagga

SEQ ID NO: 9381807 - DNA, 22 bp, Homo sapiens
tttattgccctgtagtacagga

SEQ ID NO: 9381808 - DNA, 22 bp, Homo sapiens
tttatgtttgacaatgatctgg

SEQ ID NO: 9381809 - DNA, 22 bp, Homo sapiens
tttatgtttgacaatgatctgg

SEQ ID NO: 9381810 - DNA, 21 bp, Homo sapiens
tttatgtacttcatagagtag

SEQ ID NO: 9381811 - DNA, 22 bp, Homo sapiens
tttatgtacatatccacaagga

SEQ ID NO: 9381812 - DNA, 22 bp, Homo sapiens
tttatgtaatttcataggtgtg

SEQ ID NO: 9381813 - DNA, 22 bp, Homo sapiens
tttatgaactacagatataact

SEQ ID NO: 9381814 - DNA, 22 bp, Homo sapiens
tttatgaactacagatataact

SEQ ID NO: 9381815 - DNA, 22 bp, Homo sapiens
tttatctttggatcttcagaaa

SEQ ID NO: 9381816 - DNA, 22 bp, Homo sapiens
tttatctttggatcttcagaaa

SEQ ID NO: 9381817 - DNA, 22 bp, Homo sapiens
ttgggctcaggagtttgagacc

SEQ ID NO: 9381818 - DNA, 22 bp, Homo sapiens
ttgggctgaaccctgcagctga

SEQ ID NO: 9381819 - DNA, 22 bp, Homo sapiens
ttgggctgaagtagagggcaga

SEQ ID NO: 9381820 - DNA, 22 bp, Homo sapiens
ttgggctgaagtagagggcaga

SEQ ID NO: 9381821 - DNA, 22 bp, Homo sapiens
ttgggctgaggagggcgtggcc

SEQ ID NO: 9381822 - DNA, 22 bp, Homo sapiens
ttgggctgaagtagagggcaga

SEQ ID NO: 9381823 - DNA, 22 bp, Homo sapiens
ttgggctgatctgtggaagaag

SEQ ID NO: 9381824 - DNA, 22 bp, Homo sapiens
ttgggctgaggagggcgtggcc

SEQ ID NO: 9381825 - DNA, 22 bp, Homo sapiens
ttgggcttggtcggtttgaggc

SEQ ID NO: 9381826 - DNA, 22 bp, Homo sapiens
ttgggcttgacaagctgtcaag

SEQ ID NO: 9381827 - DNA, 22 bp, Homo sapiens
ttgggcttgtctgggaaactgc

SEQ ID NO: 9381828 - DNA, 22 bp, Homo sapiens
ttgggctttaattccagagagg

SEQ ID NO: 9381829 - DNA, 22 bp, Homo sapiens
ttggggaagctttgaaatactt

SEQ ID NO: 9381830 - DNA, 22 bp, Homo sapiens
ttggggagttaatgccaaagat

SEQ ID NO: 9381831 - DNA, 22 bp, Homo sapiens
ttggggagaaatgaaatgaagt

SEQ ID NO: 9381832 - DNA, 22 bp, Homo sapiens
ttggggagttaatgccaaagat

SEQ ID NO: 9381833 - DNA, 22 bp, Homo sapiens
ttggggcacctccccagcattt

SEQ ID NO: 9381834 - DNA, 22 bp, Homo sapiens
ttggggcagagaggatacggca

SEQ ID NO: 9381835 - DNA, 22 bp, Homo sapiens
ttggctttagcccaaatgactg

SEQ ID NO: 9381836 - DNA, 22 bp, Homo sapiens
ttggctttcagaatccctatct

SEQ ID NO: 9381837 - DNA, 23 bp, Homo sapiens
ttgggaaatagttaagacatgag

SEQ ID NO: 9381838 - DNA, 22 bp, Homo sapiens
ttgggaagaaacatgtccatca

SEQ ID NO: 9381839 - DNA, 22 bp, Homo sapiens
ttggcttctgttttggctctgt

SEQ ID NO: 9381840 - DNA, 22 bp, Homo sapiens
ttggcttcttataatgcaatag

SEQ ID NO: 9381841 - DNA, 22 bp, Homo sapiens
ttggcttctgttttggctctgt

SEQ ID NO: 9381842 - DNA, 22 bp, Homo sapiens
ttggcttctttagtcagtttgg

SEQ ID NO: 9381843 - DNA, 18 bp, Homo sapiens
ttggcttctttccttcct

SEQ ID NO: 9381844 - DNA, 22 bp, Homo sapiens
ttggcttcaatgtcagagacag

SEQ ID NO: 9381845 - DNA, 22 bp, Homo sapiens
ttggcttcattgatctcacttt

SEQ ID NO: 9381846 - DNA, 22 bp, Homo sapiens
ttggcttctcttaaccctaaag

SEQ ID NO: 9381847 - DNA, 22 bp, Homo sapiens
ttggcttccaggatctcagcag

SEQ ID NO: 9381848 - DNA, 22 bp, Homo sapiens
ttggcgcccaggacgccgccgc

SEQ ID NO: 9381849 - DNA, 20 bp, Homo sapiens
ttggcggctattatgaataa

SEQ ID NO: 9381850 - DNA, 22 bp, Homo sapiens
ttggctacatcgaggctccagc

SEQ ID NO: 9381851 - DNA, 22 bp, Homo sapiens
ttggctatgcttgtgttcagtt

SEQ ID NO: 9381852 - DNA, 22 bp, Homo sapiens
ttggctcctgttcctctgtctg

SEQ ID NO: 9381853 - DNA, 22 bp, Homo sapiens
ttggctgctggtctttggatat

SEQ ID NO: 9381854 - DNA, 22 bp, Homo sapiens
ttggctgctttactctgacggg

SEQ ID NO: 9381855 - DNA, 22 bp, Homo sapiens
ttggctggctacctgggccgag

SEQ ID NO: 9381856 - DNA, 22 bp, Homo sapiens
ttggctggtaagccaaatgaaa

SEQ ID NO: 9381857 - DNA, 22 bp, Homo sapiens
ttggctggcttctcgacttgtt

SEQ ID NO: 9381858 - DNA, 22 bp, Homo sapiens
ttggctgggcacagtgtctcat

SEQ ID NO: 9381859 - DNA, 22 bp, Homo sapiens
ttggctggttttgagtatgtgc

SEQ ID NO: 9381860 - DNA, 22 bp, Homo sapiens
ttggctggtttcaagaaggcat

SEQ ID NO: 9381861 - DNA, 22 bp, Homo sapiens
ttggccctgaggaggcagctgc

SEQ ID NO: 9381862 - DNA, 22 bp, Homo sapiens
ttggccctagatgattaagttg

SEQ ID NO: 9381863 - DNA, 22 bp, Homo sapiens
ttggccctccacctggctgtgc

SEQ ID NO: 9381864 - DNA, 22 bp, Homo sapiens
ttggccctgaggttatcatcta

SEQ ID NO: 9381865 - DNA, 22 bp, Homo sapiens
ttggccctggcacacccccacg

SEQ ID NO: 9381866 - DNA, 22 bp, Homo sapiens
ttggccctggggccagcttcga

SEQ ID NO: 9381867 - DNA, 22 bp, Homo sapiens
ttggccctttatgggatgggca

SEQ ID NO: 9381868 - DNA, 22 bp, Homo sapiens
ttggcagactgggtcctgggga

SEQ ID NO: 9381869 - DNA, 22 bp, Homo sapiens
ttggcagagagtatgctgaaga

SEQ ID NO: 9381870 - DNA, 22 bp, Homo sapiens
ttggcagatgaacacaactgga

SEQ ID NO: 9381871 - DNA, 22 bp, Homo sapiens
ttggcagcaagaggctcttctg

SEQ ID NO: 9381872 - DNA, 22 bp, Homo sapiens
ttggcagcacggggaacgtctg

SEQ ID NO: 9381873 - DNA, 20 bp, Homo sapiens
ttggcagcagctcagccacc

SEQ ID NO: 9381874 - DNA, 22 bp, Homo sapiens
ttggcagcagagtgtggtgctc

SEQ ID NO: 9381875 - DNA, 22 bp, Homo sapiens
ttggccctagactctaagtccg

SEQ ID NO: 9381876 - DNA, 22 bp, Homo sapiens
ttggcagcagggagttggccgc

SEQ ID NO: 9381877 - DNA, 22 bp, Homo sapiens
ttgtataagaagttggcagata

SEQ ID NO: 9381878 - DNA, 22 bp, Homo sapiens
ttgtagtctaggatagattttt

SEQ ID NO: 9381879 - DNA, 22 bp, Homo sapiens
ttgtatagcccagagagtgaga

SEQ ID NO: 9381880 - DNA, 22 bp, Homo sapiens
ttgtatataaagcccccactgt

SEQ ID NO: 9381881 - DNA, 22 bp, Homo sapiens
ttgtatagtaagtgaatgttta

SEQ ID NO: 9381882 - DNA, 22 bp, Homo sapiens
ttgtatgtggcaaatgggggag

SEQ ID NO: 9381883 - DNA, 22 bp, Homo sapiens
ttgtatgtctcaatatcctgtc

SEQ ID NO: 9381884 - DNA, 22 bp, Homo sapiens
ttgtatgtaccacaggtggtgg

SEQ ID NO: 9381885 - DNA, 22 bp, Homo sapiens
ttgtatgaatgtatcctaattt

SEQ ID NO: 9381886 - DNA, 22 bp, Homo sapiens
ttgtatgagtatggtgtatagg

SEQ ID NO: 9381887 - DNA, 22 bp, Homo sapiens
ttgtatttatattgaatagctt

SEQ ID NO: 9381888 - DNA, 22 bp, Homo sapiens
ttgtatttatattgaatagctt

SEQ ID NO: 9381889 - DNA, 22 bp, Homo sapiens
ttgtatttatattgaatagctt

SEQ ID NO: 9381890 - DNA, 22 bp, Homo sapiens
ttgtatttcctataacctttct

SEQ ID NO: 9381891 - DNA, 22 bp, Homo sapiens
ttgtatttcctataacctttct

SEQ ID NO: 9381892 - DNA, 22 bp, Homo sapiens
ttgtattggcaaagaacttgag

SEQ ID NO: 9381893 - DNA, 22 bp, Homo sapiens
ttgtatgtttctgtgcacatga

SEQ ID NO: 9381894 - DNA, 22 bp, Homo sapiens
ttgtattaattgaaatgaatgc

SEQ ID NO: 9381895 - DNA, 22 bp, Homo sapiens
ttgtattagctgtaaattttct

SEQ ID NO: 9381896 - DNA, 22 bp, Homo sapiens
ttgggggaagaggatagacagt

SEQ ID NO: 9381897 - DNA, 22 bp, Homo sapiens
ttggggcatgattagattatga

SEQ ID NO: 9381898 - DNA, 20 bp, Homo sapiens
ttggggcatccaccgaatgg

SEQ ID NO: 9381899 - DNA, 22 bp, Homo sapiens
ttggggcagttattctgtgccc

SEQ ID NO: 9381900 - DNA, 22 bp, Homo sapiens
ttggggggttgaggagtagata

SEQ ID NO: 9381901 - DNA, 18 bp, Homo sapiens
ttggggtgaggccaggaa

SEQ ID NO: 9381902 - DNA, 19 bp, Homo sapiens
ttggggtgaatgccagaca

SEQ ID NO: 9381903 - DNA, 22 bp, Homo sapiens
ttgtagctgaaagtaaagaagt

SEQ ID NO: 9381904 - DNA, 22 bp, Homo sapiens
ttgtagaagcagggtgccctct

SEQ ID NO: 9381905 - DNA, 22 bp, Homo sapiens
ttgtacttacattttaaagcta

SEQ ID NO: 9381906 - DNA, 22 bp, Homo sapiens
ttgtgagagccaaacatgtaag

SEQ ID NO: 9381907 - DNA, 22 bp, Homo sapiens
ttgtgagagaaaatgtgtatat

SEQ ID NO: 9381908 - DNA, 22 bp, Homo sapiens
ttgtgataacagaattcactct

SEQ ID NO: 9381909 - DNA, 22 bp, Homo sapiens
ttgtgatagggcaatttttctc

SEQ ID NO: 9381910 - DNA, 22 bp, Homo sapiens
ttgtgcaaagggggttaatcat

SEQ ID NO: 9381911 - DNA, 22 bp, Homo sapiens
ttgtgcaaagggggttaatcat

SEQ ID NO: 9381912 - DNA, 22 bp, Homo sapiens
ttgtgcaagaagccagcaccaa

SEQ ID NO: 9381913 - DNA, 22 bp, Homo sapiens
ttgtgcaagaattggaaagcaa

SEQ ID NO: 9381914 - DNA, 22 bp, Homo sapiens
ttgtgcaagaattggaaagcaa

SEQ ID NO: 9381915 - DNA, 22 bp, Homo sapiens
ttgtgcaagaagccagcaccaa

SEQ ID NO: 9381916 - DNA, 22 bp, Homo sapiens
ttgtgcaatcccctcattttat

SEQ ID NO: 9381917 - DNA, 22 bp, Homo sapiens
ttgtgcaatagttttctcatga

SEQ ID NO: 9381918 - DNA, 22 bp, Homo sapiens
ttgtgcaatcccctcattttat

SEQ ID NO: 9381919 - DNA, 22 bp, Homo sapiens
ttgtgcaatggtgtttaggttt

SEQ ID NO: 9381920 - DNA, 22 bp, Homo sapiens
ttgtgcaatggtgtttaggttt

SEQ ID NO: 9381921 - DNA, 22 bp, Homo sapiens
ttgtgcaatttaaaatcttcct

SEQ ID NO: 9381922 - DNA, 22 bp, Homo sapiens
ttgtgcaaggtctggactatag

SEQ ID NO: 9381923 - DNA, 22 bp, Homo sapiens
ttgtgcaatagttttctcatga

SEQ ID NO: 9381924 - DNA, 22 bp, Homo sapiens
ttgtgcaaggtctggactatag

SEQ ID NO: 9381925 - DNA, 22 bp, Homo sapiens
ttgtgcaaggctcttggaatgt

SEQ ID NO: 9381926 - DNA, 22 bp, Homo sapiens
ttgtgcaaggctcttggaatgt

SEQ ID NO: 9381927 - DNA, 22 bp, Homo sapiens
ttgtgcaaggtaaagagggctt

SEQ ID NO: 9381928 - DNA, 22 bp, Homo sapiens
ttgtgcaaggtaaagagggctt

SEQ ID NO: 9381929 - DNA, 22 bp, Homo sapiens
ttgtgcaatttaaaatcttcct

SEQ ID NO: 9381930 - DNA, 22 bp, Homo sapiens
ttgtgcatatagagttagatgg

SEQ ID NO: 9381931 - DNA, 19 bp, Homo sapiens
ttgtgcatatgcagtgcat

SEQ ID NO: 9381932 - DNA, 22 bp, Homo sapiens
ttgtgcatattaggtacatgct

SEQ ID NO: 9381933 - DNA, 22 bp, Homo sapiens
ttgtgcatgactgtgaatagct

SEQ ID NO: 9381934 - DNA, 22 bp, Homo sapiens
ttgtgcattgcagcagtgcttt

SEQ ID NO: 9381935 - DNA, 22 bp, Homo sapiens
ttgtgcatggctactttttatg

SEQ ID NO: 9381936 - DNA, 22 bp, Homo sapiens
ttgtgcatgatgcatacatggt

SEQ ID NO: 9381937 - DNA, 22 bp, Homo sapiens
ttgtgcatggagaaggcagggc

SEQ ID NO: 9381938 - DNA, 22 bp, Homo sapiens
ttgtgcatgcatacgtatgtgt

SEQ ID NO: 9381939 - DNA, 22 bp, Homo sapiens
ttgtgcatgcatacgtatgtgt

SEQ ID NO: 9381940 - DNA, 22 bp, Homo sapiens
ttgtgcctggcttgtattcaca

SEQ ID NO: 9381941 - DNA, 22 bp, Homo sapiens
ttgtgcctttgcttttacaagt

SEQ ID NO: 9381942 - DNA, 22 bp, Homo sapiens
ttgtgcatttctctgagtgtgt

SEQ ID NO: 9381943 - DNA, 22 bp, Homo sapiens
ttgtgctgtatcatatttgtat

SEQ ID NO: 9381944 - DNA, 22 bp, Homo sapiens
ttgtggaaatacagactccaag

SEQ ID NO: 9381945 - DNA, 22 bp, Homo sapiens
ttgtggaactcatctgcctggt

SEQ ID NO: 9381946 - DNA, 22 bp, Homo sapiens
ttgtggaagccctatgagagac

SEQ ID NO: 9381947 - DNA, 22 bp, Homo sapiens
ttgtggaagccctatgagagac

SEQ ID NO: 9381948 - DNA, 22 bp, Homo sapiens
ttgtgctcctgtgagaatctag

SEQ ID NO: 9381949 - DNA, 22 bp, Homo sapiens
ttgtgctcctatgagaatctaa

SEQ ID NO: 9381950 - DNA, 22 bp, Homo sapiens
ttgttcatcgtccttgctctgt

SEQ ID NO: 9381951 - DNA, 22 bp, Homo sapiens
ttgttcatggttgtaagtttga

SEQ ID NO: 9381952 - DNA, 20 bp, Homo sapiens
ttgttcattgagctgttttc

SEQ ID NO: 9381953 - DNA, 22 bp, Homo sapiens
ttgttcttacttaagagtgaat

SEQ ID NO: 9381954 - DNA, 22 bp, Homo sapiens
ttgttctatggtgaggcagcca

SEQ ID NO: 9381955 - DNA, 22 bp, Homo sapiens
ttgttcataaagacagttcaga

SEQ ID NO: 9381956 - DNA, 22 bp, Homo sapiens
ttgtggcagaccatgagtctaa

SEQ ID NO: 9381957 - DNA, 22 bp, Homo sapiens
ttgtggaatgtggctgtcaatt

SEQ ID NO: 9381958 - DNA, 22 bp, Homo sapiens
ttgtggaatgtggctgtcaatt

SEQ ID NO: 9381959 - DNA, 22 bp, Homo sapiens
ttgttatttaggtctgggttag

SEQ ID NO: 9381960 - DNA, 22 bp, Homo sapiens
ttgttatttacaacaatcctat

SEQ ID NO: 9381961 - DNA, 22 bp, Homo sapiens
ttgccagtgccagcccaggcag

SEQ ID NO: 9381962 - DNA, 22 bp, Homo sapiens
ttgccagtttccctggatgtgt

SEQ ID NO: 9381963 - DNA, 22 bp, Homo sapiens
ttgccatcccttacctcagtca

SEQ ID NO: 9381964 - DNA, 22 bp, Homo sapiens
ttgccagggctttggtggcatc

SEQ ID NO: 9381965 - DNA, 22 bp, Homo sapiens
ttgccagggaacagggagaggc

SEQ ID NO: 9381966 - DNA, 22 bp, Homo sapiens
ttgccagggaacagggagaggc

SEQ ID NO: 9381967 - DNA, 22 bp, Homo sapiens
ttgccagggaacagggagaggc

SEQ ID NO: 9381968 - DNA, 22 bp, Homo sapiens
ttgccaggagagccacttgcag

SEQ ID NO: 9381969 - DNA, 22 bp, Homo sapiens
ttgcatttttagatgcttctgt

SEQ ID NO: 9381970 - DNA, 22 bp, Homo sapiens
ttgcatttttagatgcttctgt

SEQ ID NO: 9381971 - DNA, 22 bp, Homo sapiens
ttgcatttttagatgcttctgt

SEQ ID NO: 9381972 - DNA, 22 bp, Homo sapiens
ttgcatttttacaagtagccag

SEQ ID NO: 9381973 - DNA, 22 bp, Homo sapiens
ttgcatttttacaagtagccag

SEQ ID NO: 9381974 - DNA, 22 bp, Homo sapiens
ttgcatttttacaagtagccag

SEQ ID NO: 9381975 - DNA, 22 bp, Homo sapiens
ttgcatttttagatgcttctgt

SEQ ID NO: 9381976 - DNA, 22 bp, Homo sapiens
ttgcatttttagatgcttctgt

SEQ ID NO: 9381977 - DNA, 22 bp, Homo sapiens
ttgcatttttgagcacgaagtt

SEQ ID NO: 9381978 - DNA, 21 bp, Homo sapiens
ttgcattttaagtttactgct

SEQ ID NO: 9381979 - DNA, 21 bp, Homo sapiens
ttgcattttaagtttactgct

SEQ ID NO: 9381980 - DNA, 22 bp, Homo sapiens
ttgcatttgtttgagtagaatg

SEQ ID NO: 9381981 - DNA, 22 bp, Homo sapiens
ttgcatttgtttgagtagaatg

SEQ ID NO: 9381982 - DNA, 22 bp, Homo sapiens
ttgcattttggttgtaaatatg

SEQ ID NO: 9381983 - DNA, 22 bp, Homo sapiens
ttgcattttggttgtaaatatg

SEQ ID NO: 9381984 - DNA, 22 bp, Homo sapiens
ttgcatttgctcatttgatatg

SEQ ID NO: 9381985 - DNA, 22 bp, Homo sapiens
ttgcatttgctcatttgatatg

SEQ ID NO: 9381986 - DNA, 22 bp, Homo sapiens
ttgcatttgtggcatgggtgtt

SEQ ID NO: 9381987 - DNA, 22 bp, Homo sapiens
ttgcatttcctgtactgtttga

SEQ ID NO: 9381988 - DNA, 22 bp, Homo sapiens
ttgcatttcccattgagtaatg

SEQ ID NO: 9381989 - DNA, 22 bp, Homo sapiens
ttgcatttcctgtactgtttga

SEQ ID NO: 9381990 - DNA, 22 bp, Homo sapiens
ttgcatttcctgtactgtttga

SEQ ID NO: 9381991 - DNA, 22 bp, Homo sapiens
ttgcatttgacaaattatttaa

SEQ ID NO: 9381992 - DNA, 22 bp, Homo sapiens
ttgcatttgagaaagttctcct

SEQ ID NO: 9381993 - DNA, 22 bp, Homo sapiens
ttgcatttgagaaagttctcct

SEQ ID NO: 9381994 - DNA, 22 bp, Homo sapiens
ttgcatttgacaaattatttaa

SEQ ID NO: 9381995 - DNA, 22 bp, Homo sapiens
ttgcatttgagaaagttctcct

SEQ ID NO: 9381996 - DNA, 22 bp, Homo sapiens
ttgcatttgatcttgggttctc

SEQ ID NO: 9381997 - DNA, 22 bp, Homo sapiens
ttgcatttgctcatttgatatg

SEQ ID NO: 9381998 - DNA, 22 bp, Homo sapiens
ttgcatttcactttcagtaggc

SEQ ID NO: 9381999 - DNA, 19 bp, Homo sapiens
ttgcatttcatgtttgatt

SEQ ID NO: 9382000 - DNA, 22 bp, Homo sapiens
ttgcatttcactttcagtaggc

SEQ ID NO: 9382001 - DNA, 22 bp, Homo sapiens
ttgcatttcccattgagtaatg

SEQ ID NO: 9382002 - DNA, 22 bp, Homo sapiens
ttgaggtccccagtacccactg

SEQ ID NO: 9382003 - DNA, 22 bp, Homo sapiens
ttgaggtctctacagaagagtg

SEQ ID NO: 9382004 - DNA, 22 bp, Homo sapiens
ttgaggtcaaagaagtgagtgg

SEQ ID NO: 9382005 - DNA, 22 bp, Homo sapiens
ttgcctgtttgagagctgtgtt

SEQ ID NO: 9382006 - DNA, 22 bp, Homo sapiens
ttgcctttcccctctggaagca

SEQ ID NO: 9382007 - DNA, 22 bp, Homo sapiens
ttgccattccagggtattaggg

SEQ ID NO: 9382008 - DNA, 22 bp, Homo sapiens
ttgccattgcaaagtactatga

SEQ ID NO: 9382009 - DNA, 22 bp, Homo sapiens
ttgccattgctcagtgaacaga

SEQ ID NO: 9382010 - DNA, 16 bp, Homo sapiens
ttgcccacttgttcat

SEQ ID NO: 9382011 - DNA, 22 bp, Homo sapiens
ttgcctgattagtctcagattg

SEQ ID NO: 9382012 - DNA, 22 bp, Homo sapiens
ttgcttcctcgaggccagcgtg

SEQ ID NO: 9382013 - DNA, 22 bp, Homo sapiens
ttgcttcctctgtgcaatcctc

SEQ ID NO: 9382014 - DNA, 18 bp, Homo sapiens
ttgctcactctccttccc

SEQ ID NO: 9382015 - DNA, 22 bp, Homo sapiens
ttgctcaggctggtgtgcagtg

SEQ ID NO: 9382016 - DNA, 22 bp, Homo sapiens
ttgctcagcactggagccagct

SEQ ID NO: 9382017 - DNA, 22 bp, Homo sapiens
ttgctcagcactggagccagct

SEQ ID NO: 9382018 - DNA, 22 bp, Homo sapiens
ttgctcagcactggagccagct

SEQ ID NO: 9382019 - DNA, 22 bp, Homo sapiens
ttgctcaggctggtgtgcagtg

SEQ ID NO: 9382020 - DNA, 22 bp, Homo sapiens
ttgctcaggcttagagctacta

SEQ ID NO: 9382021 - DNA, 22 bp, Homo sapiens
ttgctaaatttattttcgaaca

SEQ ID NO: 9382022 - DNA, 22 bp, Homo sapiens
ttgctaaatgtttgtttccaga

SEQ ID NO: 9382023 - DNA, 22 bp, Homo sapiens
ttgctacttagagtgcagcagc

SEQ ID NO: 9382024 - DNA, 22 bp, Homo sapiens
ttgctagctggtgtatgcattg

SEQ ID NO: 9382025 - DNA, 22 bp, Homo sapiens
ttgctatactcattagttattt

SEQ ID NO: 9382026 - DNA, 22 bp, Homo sapiens
ttgctaccattgataccagcac

SEQ ID NO: 9382027 - DNA, 22 bp, Homo sapiens
ttgctactggcatctcgtgggt

SEQ ID NO: 9382028 - DNA, 22 bp, Homo sapiens
ttgctaccattgataccagcac

SEQ ID NO: 9382029 - DNA, 22 bp, Homo sapiens
ttggcacaaatttctgaaataa

SEQ ID NO: 9382030 - DNA, 22 bp, Homo sapiens
ttggcacagtaatctctcttca

SEQ ID NO: 9382031 - DNA, 22 bp, Homo sapiens
ttggcacttttaggcagtaccg

SEQ ID NO: 9382032 - DNA, 22 bp, Homo sapiens
ttggcactttgaatgagctcag

SEQ ID NO: 9382033 - DNA, 22 bp, Homo sapiens
ttggcactttctcagcagcctg

SEQ ID NO: 9382034 - DNA, 22 bp, Homo sapiens
ttggcactgtgcctggcacatt

SEQ ID NO: 9382035 - DNA, 22 bp, Homo sapiens
ttggcacttcacgagacagcta

SEQ ID NO: 9382036 - DNA, 22 bp, Homo sapiens
ttggcactattcactccatggg

SEQ ID NO: 9382037 - DNA, 22 bp, Homo sapiens
ttggcactattgacattttggg

SEQ ID NO: 9382038 - DNA, 22 bp, Homo sapiens
ttggcactcaaaatagatggtt

SEQ ID NO: 9382039 - DNA, 22 bp, Homo sapiens
ttggcactcaaaattttatcgg

SEQ ID NO: 9382040 - DNA, 22 bp, Homo sapiens
ttggcactcaactgtcgttgtt

SEQ ID NO: 9382041 - DNA, 22 bp, Homo sapiens
ttggcactcaaagccctctgca

SEQ ID NO: 9382042 - DNA, 22 bp, Homo sapiens
ttggcactgaccaaagaagtcc

SEQ ID NO: 9382043 - DNA, 22 bp, Homo sapiens
ttggcactgcagatgaattgca

SEQ ID NO: 9382044 - DNA, 22 bp, Homo sapiens
ttggcactgcattgaccacacc

SEQ ID NO: 9382045 - DNA, 22 bp, Homo sapiens
ttggcactctccctgcactggt

SEQ ID NO: 9382046 - DNA, 22 bp, Homo sapiens
ttggcactcatcctggttgttt

SEQ ID NO: 9382047 - DNA, 22 bp, Homo sapiens
ttggcactcagcaagtgttaat

SEQ ID NO: 9382048 - DNA, 22 bp, Homo sapiens
ttggaagagagccacagttaat

SEQ ID NO: 9382049 - DNA, 22 bp, Homo sapiens
ttggaagaccagaggccttgtc

SEQ ID NO: 9382050 - DNA, 22 bp, Homo sapiens
ttggaagaggaaaatgagccta

SEQ ID NO: 9382051 - DNA, 22 bp, Homo sapiens
ttggaagacattaaagagagtg

SEQ ID NO: 9382052 - DNA, 22 bp, Homo sapiens
ttggaagttgatttaaaaagga

SEQ ID NO: 9382053 - DNA, 20 bp, Homo sapiens
ttggaatcacctggagaggt

SEQ ID NO: 9382054 - DNA, 22 bp, Homo sapiens
ttggaatcattcttaaaggtct

SEQ ID NO: 9382055 - DNA, 22 bp, Homo sapiens
ttggaatcctgagatgagaatt

SEQ ID NO: 9382056 - DNA, 22 bp, Homo sapiens
ttggaatctgcaatttaacaaa

SEQ ID NO: 9382057 - DNA, 22 bp, Homo sapiens
ttggaggatgtcggcatattta

SEQ ID NO: 9382058 - DNA, 15 bp, Homo sapiens
ttggaggatgtagta

SEQ ID NO: 9382059 - DNA, 18 bp, Homo sapiens
ttggaggatgtccatgaa

SEQ ID NO: 9382060 - DNA, 22 bp, Homo sapiens
ttggaggattgctctcagccca

SEQ ID NO: 9382061 - DNA, 22 bp, Homo sapiens
ttggatgtttgaaatcacgtac

SEQ ID NO: 9382062 - DNA, 20 bp, Homo sapiens
ttggatgtgcatggccgtgc

SEQ ID NO: 9382063 - DNA, 22 bp, Homo sapiens
ttggaggataaggatattgatt

SEQ ID NO: 9382064 - DNA, 22 bp, Homo sapiens
ttggaggatgcaatgagggagt

SEQ ID NO: 9382065 - DNA, 22 bp, Homo sapiens
ttggaggatggagttagcatct

SEQ ID NO: 9382066 - DNA, 22 bp, Homo sapiens
ttggaattaatatttgtataca

SEQ ID NO: 9382067 - DNA, 22 bp, Homo sapiens
ttggaatgcacactgagcctgc

SEQ ID NO: 9382068 - DNA, 21 bp, Homo sapiens
ttggaatcttaggagtgtggg

SEQ ID NO: 9382069 - DNA, 22 bp, Homo sapiens
ttgcttctggaactttctgttc

SEQ ID NO: 9382070 - DNA, 23 bp, Homo sapiens
ttgcttctgtgcaattcagtact

SEQ ID NO: 9382071 - DNA, 22 bp, Homo sapiens
ttgcttcttagatattcctctc

SEQ ID NO: 9382072 - DNA, 22 bp, Homo sapiens
ttgcttgcctgttaggagaaac

SEQ ID NO: 9382073 - DNA, 22 bp, Homo sapiens
ttgctttaggatttaagtggca

SEQ ID NO: 9382074 - DNA, 23 bp, Homo sapiens
ttggaacacagtaaatgcacaat

SEQ ID NO: 9382075 - DNA, 23 bp, Homo sapiens
ttggaacacagtaaatgcacaat

SEQ ID NO: 9382076 - DNA, 22 bp, Homo sapiens
ttggaacatgccggggtccagg

SEQ ID NO: 9382077 - DNA, 22 bp, Homo sapiens
ttggaagaaatatcaatagtgt

SEQ ID NO: 9382078 - DNA, 22 bp, Homo sapiens
ttggaagacaatgctgattctc

SEQ ID NO: 9382079 - DNA, 22 bp, Homo sapiens
ttggaagacagccgtctttatt

SEQ ID NO: 9382080 - DNA, 22 bp, Homo sapiens
ttggaagacagtgaaacagcac

SEQ ID NO: 9382081 - DNA, 22 bp, Homo sapiens
ttggaacagagccctaaggaca

SEQ ID NO: 9382082 - DNA, 22 bp, Homo sapiens
ttggaacagagccctaaggaca

SEQ ID NO: 9382083 - DNA, 22 bp, Homo sapiens
ttggaacagaactgcgttcatt

SEQ ID NO: 9382084 - DNA, 22 bp, Homo sapiens
ttggaacagaaacagacaaata

SEQ ID NO: 9382085 - DNA, 22 bp, Homo sapiens
ttggaacaggattcaattaaag

SEQ ID NO: 9382086 - DNA, 20 bp, Homo sapiens
ttggaacagtggatcagcag

SEQ ID NO: 9382087 - DNA, 22 bp, Homo sapiens
ttggaacagtgtgaaaaggtta

SEQ ID NO: 9382088 - DNA, 20 bp, Homo sapiens
ttggaacagtggatcagcag

SEQ ID NO: 9382089 - DNA, 22 bp, Homo sapiens
ttggaacatccaggacagatat

SEQ ID NO: 9382090 - DNA, 22 bp, Homo sapiens
ttggaacagtgtgaaaaggtta

SEQ ID NO: 9382091 - DNA, 22 bp, Homo sapiens
ttggaacatccaggacagatat

SEQ ID NO: 9382092 - DNA, 22 bp, Homo sapiens
ccagttatccagcatgctgtct

SEQ ID NO: 9382093 - DNA, 22 bp, Homo sapiens
aggctgaggcgggaggatcact

SEQ ID NO: 9382094 - DNA, 22 bp, Homo sapiens
ccagttgggatttgtcctggtt

SEQ ID NO: 9382095 - DNA, 22 bp, Homo sapiens
ccagtgcaccaagaggcctaga

SEQ ID NO: 9382096 - DNA, 22 bp, Homo sapiens
aggctgaggcaggtggatcact

SEQ ID NO: 9382097 - DNA, 22 bp, Homo sapiens
aggctgaggcaggtggatcact

SEQ ID NO: 9382098 - DNA, 22 bp, Homo sapiens
aggctgaggcaggtggatcact

SEQ ID NO: 9382099 - DNA, 22 bp, Homo sapiens
aggctgaggcaggtggatcatt

SEQ ID NO: 9382100 - DNA, 22 bp, Homo sapiens
aggctgaggcgggaggatcact

SEQ ID NO: 9382101 - DNA, 22 bp, Homo sapiens
aggctgaggcgggaggatcact

SEQ ID NO: 9382102 - DNA, 22 bp, Homo sapiens
aggctgaggcgggaggatcact

SEQ ID NO: 9382103 - DNA, 22 bp, Homo sapiens
aggctgaggcgggaggatcact

SEQ ID NO: 9382104 - DNA, 22 bp, Homo sapiens
aggctgaggcaggtggatcatt

SEQ ID NO: 9382105 - DNA, 22 bp, Homo sapiens
aggctgaggcaggtggatcatt

SEQ ID NO: 9382106 - DNA, 22 bp, Homo sapiens
ccagtctgttctcacctctgag

SEQ ID NO: 9382107 - DNA, 22 bp, Homo sapiens
ccagtctgtgtgccagcctgcg

SEQ ID NO: 9382108 - DNA, 22 bp, Homo sapiens
ccagtctgtgtgccagcctgcg

SEQ ID NO: 9382109 - DNA, 22 bp, Homo sapiens
ccagtgatgataggaagaccct

SEQ ID NO: 9382110 - DNA, 21 bp, Homo sapiens
ccagtgattcaatgaaaacag

SEQ ID NO: 9382111 - DNA, 22 bp, Homo sapiens
ccagtgatttagtacaatgtag

SEQ ID NO: 9382112 - DNA, 22 bp, Homo sapiens
ccagtgcacagccaggcaggtg

SEQ ID NO: 9382113 - DNA, 23 bp, Homo sapiens
ccagtgattgcctggaaggaggt

SEQ ID NO: 9382114 - DNA, 22 bp, Homo sapiens
ccagtgattcattcatttacct

SEQ ID NO: 9382115 - DNA, 23 bp, Homo sapiens
aggctgagctctcccagcttcag

SEQ ID NO: 9382116 - DNA, 22 bp, Homo sapiens
aggctgagctgacctggtttgg

SEQ ID NO: 9382117 - DNA, 22 bp, Homo sapiens
ccagtcactctgtgagagctac

SEQ ID NO: 9382118 - DNA, 22 bp, Homo sapiens
ccagtcactctgtgagagctac

SEQ ID NO: 9382119 - DNA, 22 bp, Homo sapiens
ccagtctgtactttgctctgtt

SEQ ID NO: 9382120 - DNA, 22 bp, Homo sapiens
ccagtctgtactttgctctgtt

SEQ ID NO: 9382121 - DNA, 22 bp, Homo sapiens
ccagtcactggaaaatgggaat

SEQ ID NO: 9382122 - DNA, 23 bp, Homo sapiens
aggctgagctctcccagcttcag

SEQ ID NO: 9382123 - DNA, 23 bp, Homo sapiens
aggctgagctctcccagcttcag

SEQ ID NO: 9382124 - DNA, 23 bp, Homo sapiens
aggctgagctctcccagcttcag

SEQ ID NO: 9382125 - DNA, 22 bp, Homo sapiens
aggctgagcggggtcccagagc

SEQ ID NO: 9382126 - DNA, 22 bp, Homo sapiens
aggctgagcggggtcccagagc

SEQ ID NO: 9382127 - DNA, 22 bp, Homo sapiens
aggctgagcggggtcccagagc

SEQ ID NO: 9382128 - DNA, 22 bp, Homo sapiens
aggctgagcggggtcccagagc

SEQ ID NO: 9382129 - DNA, 22 bp, Homo sapiens
aggctctgatgcaagcccaggg

SEQ ID NO: 9382130 - DNA, 22 bp, Homo sapiens
aggctctgatcaggtggctgtg

SEQ ID NO: 9382131 - DNA, 22 bp, Homo sapiens
aggctctgatcaggtggctgtg

SEQ ID NO: 9382132 - DNA, 22 bp, Homo sapiens
aggctctgatcaggtggctgtg

SEQ ID NO: 9382133 - DNA, 22 bp, Homo sapiens
aggctctgagtagagctgccag

SEQ ID NO: 9382134 - DNA, 22 bp, Homo sapiens
aggctctgagtctggtgtctgc

SEQ ID NO: 9382135 - DNA, 22 bp, Homo sapiens
aggctctgagtctggtgtctgc

SEQ ID NO: 9382136 - DNA, 22 bp, Homo sapiens
aggctctgatcaggtggctgtg

SEQ ID NO: 9382137 - DNA, 22 bp, Homo sapiens
aggctctgagtctggtgtctgc

SEQ ID NO: 9382138 - DNA, 19 bp, Homo sapiens
aggctctgagctcctggag

SEQ ID NO: 9382139 - DNA, 19 bp, Homo sapiens
aggctctgagctcctggag

SEQ ID NO: 9382140 - DNA, 19 bp, Homo sapiens
aggctctgagctcctggag

SEQ ID NO: 9382141 - DNA, 19 bp, Homo sapiens
aggctctgagctcctggag

SEQ ID NO: 9382142 - DNA, 22 bp, Homo sapiens
aggctctgagtagagctgccag

SEQ ID NO: 9382143 - DNA, 22 bp, Homo sapiens
aggctctgaggcagattttcgt

SEQ ID NO: 9382144 - DNA, 22 bp, Homo sapiens
aggctctgagtagagctgccag

SEQ ID NO: 9382145 - DNA, 22 bp, Homo sapiens
aggctctgagtagagctgccag

SEQ ID NO: 9382146 - DNA, 22 bp, Homo sapiens
aggctctgagtagagctgccag

SEQ ID NO: 9382147 - DNA, 22 bp, Homo sapiens
aggctctgcagtgctggaggac

SEQ ID NO: 9382148 - DNA, 22 bp, Homo sapiens
aggctctgcagtgctggaggac

SEQ ID NO: 9382149 - DNA, 22 bp, Homo sapiens
aggctctgcagtgctggaggac

SEQ ID NO: 9382150 - DNA, 22 bp, Homo sapiens
aggctctgcagtgctggaggac

SEQ ID NO: 9382151 - DNA, 22 bp, Homo sapiens
aggctctgcagtccatcccgtg

SEQ ID NO: 9382152 - DNA, 22 bp, Homo sapiens
aggctctgcagtccatcccgtg

SEQ ID NO: 9382153 - DNA, 22 bp, Homo sapiens
aggctctgcagtgctggaggac

SEQ ID NO: 9382154 - DNA, 20 bp, Homo sapiens
aggctctgcatttctgagtg

SEQ ID NO: 9382155 - DNA, 22 bp, Homo sapiens
aggctctgcatccaggctttat

SEQ ID NO: 9382156 - DNA, 22 bp, Homo sapiens
aggctctgatgcaagcccaggg

SEQ ID NO: 9382157 - DNA, 22 bp, Homo sapiens
aggctctgatgcaagcccaggg

SEQ ID NO: 9382158 - DNA, 22 bp, Homo sapiens
aggctctgcagaccccagctgt

SEQ ID NO: 9382159 - DNA, 22 bp, Homo sapiens
aggctctgcagaccccagctgt

SEQ ID NO: 9382160 - DNA, 22 bp, Homo sapiens
aggctctgcagaccccagctgt

SEQ ID NO: 9382161 - DNA, 22 bp, Homo sapiens
aggctctgatgcaagcccaggg

SEQ ID NO: 9382162 - DNA, 22 bp, Homo sapiens
aggctctgcagtccatcccgtg

SEQ ID NO: 9382163 - DNA, 22 bp, Homo sapiens
aggctctgcagtccatcccgtg

SEQ ID NO: 9382164 - DNA, 22 bp, Homo sapiens
aggctctgcagtccatcccgtg

SEQ ID NO: 9382165 - DNA, 22 bp, Homo sapiens
aggctctgcagaccccagctgt

SEQ ID NO: 9382166 - DNA, 22 bp, Homo sapiens
aggctctgcaggtatttcttga

SEQ ID NO: 9382167 - DNA, 22 bp, Homo sapiens
aggctgagcaaagggccttacc

SEQ ID NO: 9382168 - DNA, 22 bp, Homo sapiens
aggctgagccacggggctggct

SEQ ID NO: 9382169 - DNA, 22 bp, Homo sapiens
aggctgagccacggggctggct

SEQ ID NO: 9382170 - DNA, 22 bp, Homo sapiens
aggctgagccacggggctggct

SEQ ID NO: 9382171 - DNA, 22 bp, Homo sapiens
aggctgagcctgggcgtggtgg

SEQ ID NO: 9382172 - DNA, 22 bp, Homo sapiens
aggctgagcctgggcgtggtgg

SEQ ID NO: 9382173 - DNA, 22 bp, Homo sapiens
aggctgagcctgggcgtggtgg

SEQ ID NO: 9382174 - DNA, 22 bp, Homo sapiens
aggctgagagcaacgtgtcaga

SEQ ID NO: 9382175 - DNA, 22 bp, Homo sapiens
aggctgagataggtggatcatt

SEQ ID NO: 9382176 - DNA, 22 bp, Homo sapiens
aggctgagagcaacgtgtcaga

SEQ ID NO: 9382177 - DNA, 22 bp, Homo sapiens
aggctgagataggtggatcatt

SEQ ID NO: 9382178 - DNA, 22 bp, Homo sapiens
aggctgagataggtggatcatt

SEQ ID NO: 9382179 - DNA, 22 bp, Homo sapiens
aggctgagcaaagggccttacc

SEQ ID NO: 9382180 - DNA, 22 bp, Homo sapiens
aggctgagcaaagggccttacc

SEQ ID NO: 9382181 - DNA, 22 bp, Homo sapiens
aggctgagcaaagggccttacc

SEQ ID NO: 9382182 - DNA, 22 bp, Homo sapiens
aggctgagagcaacgtgtcaga

SEQ ID NO: 9382183 - DNA, 22 bp, Homo sapiens
aggctgagagcaacgtgtcaga

SEQ ID NO: 9382184 - DNA, 22 bp, Homo sapiens
aggctctgttattctagagggc

SEQ ID NO: 9382185 - DNA, 22 bp, Homo sapiens
aggctctgttattctagagggc

SEQ ID NO: 9382186 - DNA, 22 bp, Homo sapiens
aggctgagactgtgcattagtg

SEQ ID NO: 9382187 - DNA, 22 bp, Homo sapiens
aggctctgttattctagagggc

SEQ ID NO: 9382188 - DNA, 22 bp, Homo sapiens
aggctctgttattctagagggc

SEQ ID NO: 9382189 - DNA, 20 bp, Homo sapiens
aggctctgcctgcaggccca

SEQ ID NO: 9382190 - DNA, 20 bp, Homo sapiens
aggctctgcctgcaggccca

SEQ ID NO: 9382191 - DNA, 22 bp, Homo sapiens
aggctctgccaattccttcctc

SEQ ID NO: 9382192 - DNA, 22 bp, Homo sapiens
aggctctgccaattccttcctc

SEQ ID NO: 9382193 - DNA, 22 bp, Homo sapiens
aggctctgccaattccttcctc

SEQ ID NO: 9382194 - DNA, 20 bp, Homo sapiens
aggctctgcatttctgagtg

SEQ ID NO: 9382195 - DNA, 22 bp, Homo sapiens
aggctctgccaattccttcctc

SEQ ID NO: 9382196 - DNA, 20 bp, Homo sapiens
aggctctgcatttctgagtg

SEQ ID NO: 9382197 - DNA, 20 bp, Homo sapiens
aggctctgcatttctgagtg

SEQ ID NO: 9382198 - DNA, 20 bp, Homo sapiens
aggctctgccattgtccctg

SEQ ID NO: 9382199 - DNA, 20 bp, Homo sapiens
aggctctgcctgcaggccca

SEQ ID NO: 9382200 - DNA, 20 bp, Homo sapiens
aggctctgcctgcaggccca

SEQ ID NO: 9382201 - DNA, 22 bp, Homo sapiens
aggctccattcatgtgaaggca

SEQ ID NO: 9382202 - DNA, 22 bp, Homo sapiens
aggctccatgcaaaggctgttt

SEQ ID NO: 9382203 - DNA, 22 bp, Homo sapiens
aggctccatgcaaaggctgttt

SEQ ID NO: 9382204 - DNA, 22 bp, Homo sapiens
aggctccagtctgaaccttggg

SEQ ID NO: 9382205 - DNA, 22 bp, Homo sapiens
aggctccacggcaggatgctgt

SEQ ID NO: 9382206 - DNA, 22 bp, Homo sapiens
ccaggcctagcccctgagggta

SEQ ID NO: 9382207 - DNA, 22 bp, Homo sapiens
ccaggcctcacctgcccaccta

SEQ ID NO: 9382208 - DNA, 22 bp, Homo sapiens
ccaggcctcacctgcccaccta

SEQ ID NO: 9382209 - DNA, 22 bp, Homo sapiens
ccaggccctgcctgtggttcct

SEQ ID NO: 9382210 - DNA, 22 bp, Homo sapiens
ccaggccctgcctgtggttcct

SEQ ID NO: 9382211 - DNA, 22 bp, Homo sapiens
ccaggccctgcctgtggttcct

SEQ ID NO: 9382212 - DNA, 22 bp, Homo sapiens
ccaggcccgttcccttctccag

SEQ ID NO: 9382213 - DNA, 22 bp, Homo sapiens
ccaggcccgttcccttctccag

SEQ ID NO: 9382214 - DNA, 22 bp, Homo sapiens
ccaggcccgttcccttctccag

SEQ ID NO: 9382215 - DNA, 22 bp, Homo sapiens
ccaggccctgctcctcacacca

SEQ ID NO: 9382216 - DNA, 22 bp, Homo sapiens
ccaggcccttgcaagtcccacc

SEQ ID NO: 9382217 - DNA, 22 bp, Homo sapiens
ccaggcctagcccctgagggta

SEQ ID NO: 9382218 - DNA, 22 bp, Homo sapiens
ccaggcctagcccctgagggta

SEQ ID NO: 9382219 - DNA, 22 bp, Homo sapiens
ccaggcctagcccctgagggta

SEQ ID NO: 9382220 - DNA, 22 bp, Homo sapiens
ccaggctctatccctccttctt

SEQ ID NO: 9382221 - DNA, 22 bp, Homo sapiens
ccaggctctatccctccttctt

SEQ ID NO: 9382222 - DNA, 22 bp, Homo sapiens
ccaggctctgacatagatggga

SEQ ID NO: 9382223 - DNA, 22 bp, Homo sapiens
ccaggctctatccctccttctt

SEQ ID NO: 9382224 - DNA, 22 bp, Homo sapiens
ccaggctctatccctccttctt

SEQ ID NO: 9382225 - DNA, 22 bp, Homo sapiens
aggctcccatggtgtggcagga

SEQ ID NO: 9382226 - DNA, 21 bp, Homo sapiens
ccaggctcctgaggctggtca

SEQ ID NO: 9382227 - DNA, 22 bp, Homo sapiens
aggctccattttcctgcagctg

SEQ ID NO: 9382228 - DNA, 21 bp, Homo sapiens
aggctcccagaaatgggcatc

SEQ ID NO: 9382229 - DNA, 22 bp, Homo sapiens
aggctccattttcctgcagctg

SEQ ID NO: 9382230 - DNA, 22 bp, Homo sapiens
ccaggctctgagcctcactctt

SEQ ID NO: 9382231 - DNA, 22 bp, Homo sapiens
ccaggctctgagcctcactctt

SEQ ID NO: 9382232 - DNA, 22 bp, Homo sapiens
ccaggctctgcaaaatcaggct

SEQ ID NO: 9382233 - DNA, 22 bp, Homo sapiens
ccaggctctgagaggaatgtga

SEQ ID NO: 9382234 - DNA, 22 bp, Homo sapiens
ccaggctctgagcctcactctt

SEQ ID NO: 9382235 - DNA, 22 bp, Homo sapiens
ccaggctctgacatagatggga

SEQ ID NO: 9382236 - DNA, 22 bp, Homo sapiens
ccaggctctgcgctggacatgg

SEQ ID NO: 9382237 - DNA, 22 bp, Homo sapiens
ccaggctctgccaggcccttga

SEQ ID NO: 9382238 - DNA, 22 bp, Homo sapiens
ccaggctctgccaggcccttga

SEQ ID NO: 9382239 - DNA, 15 bp, Homo sapiens
ccaggctctgcactc

SEQ ID NO: 9382240 - DNA, 22 bp, Homo sapiens
ccaggcatccattgcttcctct

SEQ ID NO: 9382241 - DNA, 22 bp, Homo sapiens
ccaggcagtggaagctaaaatt

SEQ ID NO: 9382242 - DNA, 22 bp, Homo sapiens
ccaggcagtggaagctaaaatt

SEQ ID NO: 9382243 - DNA, 22 bp, Homo sapiens
ccaggcatcacgggcatgtggc

SEQ ID NO: 9382244 - DNA, 22 bp, Homo sapiens
ccaggcagtcagggttgtgtgt

SEQ ID NO: 9382245 - DNA, 22 bp, Homo sapiens
ccaggcagtcagggttgtgtgt

SEQ ID NO: 9382246 - DNA, 22 bp, Homo sapiens
ccaggcatggggagagccagat

SEQ ID NO: 9382247 - DNA, 22 bp, Homo sapiens
ccaggcattgtgagtgggcagg

SEQ ID NO: 9382248 - DNA, 22 bp, Homo sapiens
ccaggcattgtgagtgggcagg

SEQ ID NO: 9382249 - DNA, 22 bp, Homo sapiens
ccaggccagagtgcagtggcac

SEQ ID NO: 9382250 - DNA, 22 bp, Homo sapiens
ccaggccaaattcagtcagcag

SEQ ID NO: 9382251 - DNA, 22 bp, Homo sapiens
aggcctctgagcagcactcatg

SEQ ID NO: 9382252 - DNA, 22 bp, Homo sapiens
ccaggcacttcatcattagggt

SEQ ID NO: 9382253 - DNA, 22 bp, Homo sapiens
ccaggcacttcatcattagggt

SEQ ID NO: 9382254 - DNA, 22 bp, Homo sapiens
aggcctctgagcagcactcatg

SEQ ID NO: 9382255 - DNA, 22 bp, Homo sapiens
aggcctctgagcagcactcatg

SEQ ID NO: 9382256 - DNA, 22 bp, Homo sapiens
aggcctcctggctccaggcctt

SEQ ID NO: 9382257 - DNA, 22 bp, Homo sapiens
aggcctcctggctccaggcctt

SEQ ID NO: 9382258 - DNA, 22 bp, Homo sapiens
aggcctctctccttggcttgta

SEQ ID NO: 9382259 - DNA, 23 bp, Homo sapiens
ccaggcagtagctattgaagtga

SEQ ID NO: 9382260 - DNA, 23 bp, Homo sapiens
ccaggcagtagctattgaagtga

SEQ ID NO: 9382261 - DNA, 22 bp, Homo sapiens
ccaggcagggctcaaggaacct

SEQ ID NO: 9382262 - DNA, 22 bp, Homo sapiens
ccaggcagggctcaaggaacct

SEQ ID NO: 9382263 - DNA, 22 bp, Homo sapiens
ccaggcagggagctgtttggcc

SEQ ID NO: 9382264 - DNA, 22 bp, Homo sapiens
aggcctcagttcttgccaggtg

SEQ ID NO: 9382265 - DNA, 22 bp, Homo sapiens
aggcctcagttcttgccaggtg

SEQ ID NO: 9382266 - DNA, 22 bp, Homo sapiens
aggcctcagctcagtgtgacag

SEQ ID NO: 9382267 - DNA, 22 bp, Homo sapiens
aggcctcagtgatcatcatcag

SEQ ID NO: 9382268 - DNA, 22 bp, Homo sapiens
aggcctcaggaaggtaaagaag

SEQ ID NO: 9382269 - DNA, 22 bp, Homo sapiens
aggcctcagcctgccaggcctg

SEQ ID NO: 9382270 - DNA, 22 bp, Homo sapiens
aggcctcagcctgccaggcctg

SEQ ID NO: 9382271 - DNA, 22 bp, Homo sapiens
aggcctcactctcagagcttct

SEQ ID NO: 9382272 - DNA, 22 bp, Homo sapiens
aggcctagaggaatggccaggg

SEQ ID NO: 9382273 - DNA, 22 bp, Homo sapiens
aggcctcacacaacagatgcat

SEQ ID NO: 9382274 - DNA, 22 bp, Homo sapiens
aggcctcatagtagacctgccc

SEQ ID NO: 9382275 - DNA, 22 bp, Homo sapiens
aggcctcagtttgtcatctgta

SEQ ID NO: 9382276 - DNA, 22 bp, Homo sapiens
aggcctcatagtagacctgccc

SEQ ID NO: 9382277 - DNA, 22 bp, Homo sapiens
aggcctcatgtcaaagcagcaa

SEQ ID NO: 9382278 - DNA, 17 bp, Homo sapiens
aggcctccctccaggcc

SEQ ID NO: 9382279 - DNA, 17 bp, Homo sapiens
aggcctccctccaggcc

SEQ ID NO: 9382280 - DNA, 22 bp, Homo sapiens
aggcctccagccacatgccagt

SEQ ID NO: 9382281 - DNA, 17 bp, Homo sapiens
aggcctccctccaggcc

SEQ ID NO: 9382282 - DNA, 22 bp, Homo sapiens
aggccaggaatccttgtcccag

SEQ ID NO: 9382283 - DNA, 22 bp, Homo sapiens
aggccaggaatccttgtcccag

SEQ ID NO: 9382284 - DNA, 22 bp, Homo sapiens
aggccaggacacttaagtaaga

SEQ ID NO: 9382285 - DNA, 22 bp, Homo sapiens
aggccaggaccattagcccaga

SEQ ID NO: 9382286 - DNA, 22 bp, Homo sapiens
aggccaggaccattagcccaga

SEQ ID NO: 9382287 - DNA, 22 bp, Homo sapiens
aggccagcttctaccctctgtt

SEQ ID NO: 9382288 - DNA, 22 bp, Homo sapiens
aggccaggatagcatggatcag

SEQ ID NO: 9382289 - DNA, 22 bp, Homo sapiens
aggccaggatagcatggatcag

SEQ ID NO: 9382290 - DNA, 22 bp, Homo sapiens
aggcccagctgggccaggaaca

SEQ ID NO: 9382291 - DNA, 22 bp, Homo sapiens
aggccaggatagcatggatcag

SEQ ID NO: 9382292 - DNA, 22 bp, Homo sapiens
aggcccagtagtgctgccttta

SEQ ID NO: 9382293 - DNA, 22 bp, Homo sapiens
aggcccagctgggccaggaaca

SEQ ID NO: 9382294 - DNA, 22 bp, Homo sapiens
aggcccagtgtggcttcctgga

SEQ ID NO: 9382295 - DNA, 22 bp, Homo sapiens
aggcccagtagtgctgccttta

SEQ ID NO: 9382296 - DNA, 22 bp, Homo sapiens
aggcccagtagtgctgccttta

SEQ ID NO: 9382297 - DNA, 22 bp, Homo sapiens
aggcccagtcctctgccgtctg

SEQ ID NO: 9382298 - DNA, 22 bp, Homo sapiens
aggcccagtcctctgccgtctg

SEQ ID NO: 9382299 - DNA, 22 bp, Homo sapiens
aggcccagttatcctacttgtt

SEQ ID NO: 9382300 - DNA, 22 bp, Homo sapiens
aggcccagttatcctacttgtt

SEQ ID NO: 9382301 - DNA, 22 bp, Homo sapiens
aggcccagtgtggcttcctgga

SEQ ID NO: 9382302 - DNA, 22 bp, Homo sapiens
aggccccaaagcagtgcaagta

SEQ ID NO: 9382303 - DNA, 22 bp, Homo sapiens
aggccccaaagcagtgcaagta

SEQ ID NO: 9382304 - DNA, 22 bp, Homo sapiens
aggccccctccacccattctgg

SEQ ID NO: 9382305 - DNA, 18 bp, Homo sapiens
aggcccgttgtgtggaat

SEQ ID NO: 9382306 - DNA, 22 bp, Homo sapiens
aggccccctccacccattctgg

SEQ ID NO: 9382307 - DNA, 20 bp, Homo sapiens
aggccccaggtggacactag

SEQ ID NO: 9382308 - DNA, 22 bp, Homo sapiens
aggccgtgtgagcatgtgtgag

SEQ ID NO: 9382309 - DNA, 22 bp, Homo sapiens
aggcctagagctttggagggca

SEQ ID NO: 9382310 - DNA, 22 bp, Homo sapiens
aggccctgacctgggagatcta

SEQ ID NO: 9382311 - DNA, 22 bp, Homo sapiens
aggccctgggttagggcccact

SEQ ID NO: 9382312 - DNA, 22 bp, Homo sapiens
aggccctgggttagggcccact

SEQ ID NO: 9382313 - DNA, 22 bp, Homo sapiens
aggccctggtcaggtctggctg

SEQ ID NO: 9382314 - DNA, 22 bp, Homo sapiens
aggccctgaagtcggcccctca

SEQ ID NO: 9382315 - DNA, 22 bp, Homo sapiens
aggccctccattgatgtttatt

SEQ ID NO: 9382316 - DNA, 22 bp, Homo sapiens
aggccctctagaggagtgtttg

SEQ ID NO: 9382317 - DNA, 22 bp, Homo sapiens
aggccctctcattccagaggca

SEQ ID NO: 9382318 - DNA, 22 bp, Homo sapiens
aggccctattcaatggggccca

SEQ ID NO: 9382319 - DNA, 22 bp, Homo sapiens
aggccctattcaatggggccca

SEQ ID NO: 9382320 - DNA, 22 bp, Homo sapiens
aggccctattcaatggggccca

SEQ ID NO: 9382321 - DNA, 22 bp, Homo sapiens
aggccctaatccaacatgactg

SEQ ID NO: 9382322 - DNA, 22 bp, Homo sapiens
aggccaagtagctagcattgaa

SEQ ID NO: 9382323 - DNA, 22 bp, Homo sapiens
aggccaagtagctagcattgaa

SEQ ID NO: 9382324 - DNA, 22 bp, Homo sapiens
aggccaagtagccgctgtccta

SEQ ID NO: 9382325 - DNA, 22 bp, Homo sapiens
aggccaagggcaaagcggagag

SEQ ID NO: 9382326 - DNA, 22 bp, Homo sapiens
aggccaagtgctgggacaggtg

SEQ ID NO: 9382327 - DNA, 22 bp, Homo sapiens
aggccaagtgctgggacaggtg

SEQ ID NO: 9382328 - DNA, 22 bp, Homo sapiens
aggccaagttacttgggaaagc

SEQ ID NO: 9382329 - DNA, 22 bp, Homo sapiens
aggccacaaccaccctgtgccc

SEQ ID NO: 9382330 - DNA, 22 bp, Homo sapiens
aggccacaaccaccctgtgccc

SEQ ID NO: 9382331 - DNA, 22 bp, Homo sapiens
aggccaagattttggatcagct

SEQ ID NO: 9382332 - DNA, 22 bp, Homo sapiens
aggccaagctcccagagaagct

SEQ ID NO: 9382333 - DNA, 22 bp, Homo sapiens
aggccaagattttggatcagct

SEQ ID NO: 9382334 - DNA, 22 bp, Homo sapiens
aggccaagattttggatcagct

SEQ ID NO: 9382335 - DNA, 22 bp, Homo sapiens
aggcattttctgtatggacaga

SEQ ID NO: 9382336 - DNA, 22 bp, Homo sapiens
aggccagctgttactagagcca

SEQ ID NO: 9382337 - DNA, 22 bp, Homo sapiens
aggccagcttccagaggggcag

SEQ ID NO: 9382338 - DNA, 22 bp, Homo sapiens
aggccagctgttactagagcca

SEQ ID NO: 9382339 - DNA, 22 bp, Homo sapiens
aggccagctgccacccggtccg

SEQ ID NO: 9382340 - DNA, 22 bp, Homo sapiens
aggccagctgttactagagcca

SEQ ID NO: 9382341 - DNA, 22 bp, Homo sapiens
aggccagctgttactagagcca

SEQ ID NO: 9382342 - DNA, 22 bp, Homo sapiens
aggccagctcaccctggctcct

SEQ ID NO: 9382343 - DNA, 22 bp, Homo sapiens
aggccagctctacccttggact

SEQ ID NO: 9382344 - DNA, 22 bp, Homo sapiens
aggccagctctacccttggact

SEQ ID NO: 9382345 - DNA, 22 bp, Homo sapiens
aggccagctgccacccggtccg

SEQ ID NO: 9382346 - DNA, 22 bp, Homo sapiens
aggccagcgctgctagctcccg

SEQ ID NO: 9382347 - DNA, 22 bp, Homo sapiens
aggccagcgctgctagctcccg

SEQ ID NO: 9382348 - DNA, 22 bp, Homo sapiens
aggccagatgtcgggctagaag

SEQ ID NO: 9382349 - DNA, 22 bp, Homo sapiens
aggccagatgtcgggctagaag

SEQ ID NO: 9382350 - DNA, 22 bp, Homo sapiens
aggccacaagaaaatgcttcat

SEQ ID NO: 9382351 - DNA, 22 bp, Homo sapiens
aggccagcctcaggcagggacc

SEQ ID NO: 9382352 - DNA, 22 bp, Homo sapiens
aggcagccattaccaagggcat

SEQ ID NO: 9382353 - DNA, 22 bp, Homo sapiens
aggcagcccacaggacacagga

SEQ ID NO: 9382354 - DNA, 22 bp, Homo sapiens
aggcagccattaccaagggcat

SEQ ID NO: 9382355 - DNA, 22 bp, Homo sapiens
aggcagccatctgcaggaagga

SEQ ID NO: 9382356 - DNA, 22 bp, Homo sapiens
aggcagccatctgcaggaagga

SEQ ID NO: 9382357 - DNA, 22 bp, Homo sapiens
aggcagccagttcaggtttctt

SEQ ID NO: 9382358 - DNA, 22 bp, Homo sapiens
aggcagccatccaggaggctca

SEQ ID NO: 9382359 - DNA, 22 bp, Homo sapiens
aggcagcctggtttgaatggaa

SEQ ID NO: 9382360 - DNA, 22 bp, Homo sapiens
aggcagcctatggggagctcag

SEQ ID NO: 9382361 - DNA, 22 bp, Homo sapiens
aggcagcctatggggagctcag

SEQ ID NO: 9382362 - DNA, 22 bp, Homo sapiens
aggcagcccacaggacacagga

SEQ ID NO: 9382363 - DNA, 22 bp, Homo sapiens
aggcagccctgtgctggatgct

SEQ ID NO: 9382364 - DNA, 22 bp, Homo sapiens
aggcagccctgtgctggatgct

SEQ ID NO: 9382365 - DNA, 22 bp, Homo sapiens
aggcaggttggtgagaagactg

SEQ ID NO: 9382366 - DNA, 22 bp, Homo sapiens
aggcaggtttactcttatttgg

SEQ ID NO: 9382367 - DNA, 22 bp, Homo sapiens
aggcaggttggtgagaagactg

SEQ ID NO: 9382368 - DNA, 18 bp, Homo sapiens
aggcaggtgctggaagtc

SEQ ID NO: 9382369 - DNA, 18 bp, Homo sapiens
aggcaggtgctaatattt

SEQ ID NO: 9382370 - DNA, 21 bp, Homo sapiens
aggcagcgattttcatattgc

SEQ ID NO: 9382371 - DNA, 18 bp, Homo sapiens
aggcaggtgctaatattt

SEQ ID NO: 9382372 - DNA, 22 bp, Homo sapiens
aggcagcctttttggaaacata

SEQ ID NO: 9382373 - DNA, 22 bp, Homo sapiens
aggcagcctttagacagtctgc

SEQ ID NO: 9382374 - DNA, 22 bp, Homo sapiens
aggcagcctttagacagtctgc

SEQ ID NO: 9382375 - DNA, 22 bp, Homo sapiens
aggcagcctggtttgaatggaa

SEQ ID NO: 9382376 - DNA, 19 bp, Homo sapiens
aggcagtcattggaatata

SEQ ID NO: 9382377 - DNA, 22 bp, Homo sapiens
aggcagtctatctctggagcct

SEQ ID NO: 9382378 - DNA, 22 bp, Homo sapiens
aggcaggtttcccggctgtcaa

SEQ ID NO: 9382379 - DNA, 22 bp, Homo sapiens
aggcaggtttactcttatttgg

SEQ ID NO: 9382380 - DNA, 22 bp, Homo sapiens
aggcaggtttcccggctgtcaa

SEQ ID NO: 9382381 - DNA, 23 bp, Homo sapiens
aggcaggtttgggctcttcttgt

SEQ ID NO: 9382382 - DNA, 22 bp, Homo sapiens
aggcaggtttcccggctgtcaa

SEQ ID NO: 9382383 - DNA, 23 bp, Homo sapiens
aggcaggtttgggctcttcttgt

SEQ ID NO: 9382384 - DNA, 22 bp, Homo sapiens
aggcagtggagctggaataggc

SEQ ID NO: 9382385 - DNA, 22 bp, Homo sapiens
aggcagtggagctggaataggc

SEQ ID NO: 9382386 - DNA, 22 bp, Homo sapiens
aggcagtggagctggaataggc

SEQ ID NO: 9382387 - DNA, 22 bp, Homo sapiens
aggcagtggagaaggtttgtga

SEQ ID NO: 9382388 - DNA, 22 bp, Homo sapiens
aggcagtggaaggagaaagcaa

SEQ ID NO: 9382389 - DNA, 22 bp, Homo sapiens
aggcagtggctgagaccagggg

SEQ ID NO: 9382390 - DNA, 22 bp, Homo sapiens
aggcagtggctgagaccagggg

SEQ ID NO: 9382391 - DNA, 22 bp, Homo sapiens
aggcagtggatgtcaggaatgg

SEQ ID NO: 9382392 - DNA, 22 bp, Homo sapiens
aggcagtgagcagggtgtcatg

SEQ ID NO: 9382393 - DNA, 22 bp, Homo sapiens
aggcagtgagcagggtgtcatg

SEQ ID NO: 9382394 - DNA, 22 bp, Homo sapiens
aggcagtgcagagtcctcttct

SEQ ID NO: 9382395 - DNA, 22 bp, Homo sapiens
aggcagtgcctggaccccagct

SEQ ID NO: 9382396 - DNA, 22 bp, Homo sapiens
aggcagtgctcaagacagcagc

SEQ ID NO: 9382397 - DNA, 22 bp, Homo sapiens
aggcagtgctcaagacagcagc

SEQ ID NO: 9382398 - DNA, 23 bp, Homo sapiens
aggcagtgggggccactttgctt

SEQ ID NO: 9382399 - DNA, 22 bp, Homo sapiens
aggcagtggctgagaccagggg

SEQ ID NO: 9382400 - DNA, 23 bp, Homo sapiens
aggcagtggtggtaacatgtcaa

SEQ ID NO: 9382401 - DNA, 23 bp, Homo sapiens
aggcagtggtggtaacatgtcaa

SEQ ID NO: 9382402 - DNA, 23 bp, Homo sapiens
aggcagtggtggtaacatgtcaa

SEQ ID NO: 9382403 - DNA, 22 bp, Homo sapiens
aggcatcaggagtatagccaga

SEQ ID NO: 9382404 - DNA, 21 bp, Homo sapiens
aggcatgagccctgcatggac

SEQ ID NO: 9382405 - DNA, 22 bp, Homo sapiens
aggcatgactttggctgaagaa

SEQ ID NO: 9382406 - DNA, 22 bp, Homo sapiens
aggcatgatgtgcagtggcaaa

SEQ ID NO: 9382407 - DNA, 17 bp, Homo sapiens
aggcatgaggcatcact

SEQ ID NO: 9382408 - DNA, 22 bp, Homo sapiens
aggcatgatgtgcagtggcaaa

SEQ ID NO: 9382409 - DNA, 20 bp, Homo sapiens
aggcatctgagtcacatctt

SEQ ID NO: 9382410 - DNA, 23 bp, Homo sapiens
aggcatcttctgagttaagagca

SEQ ID NO: 9382411 - DNA, 20 bp, Homo sapiens
aggcatctgagtcacatctt

SEQ ID NO: 9382412 - DNA, 22 bp, Homo sapiens
aggcatggcatggggcagatgt

SEQ ID NO: 9382413 - DNA, 22 bp, Homo sapiens
aggcatggcatggggcagatgt

SEQ ID NO: 9382414 - DNA, 22 bp, Homo sapiens
aggcattcaggctatttgatca

SEQ ID NO: 9382415 - DNA, 22 bp, Homo sapiens
aggcatttgatgaagattggct

SEQ ID NO: 9382416 - DNA, 22 bp, Homo sapiens
aggcattaatgtaatacagtga

SEQ ID NO: 9382417 - DNA, 22 bp, Homo sapiens
aggcattctagaagtagaagta

SEQ ID NO: 9382418 - DNA, 22 bp, Homo sapiens
aggcattacatctaaatattta

SEQ ID NO: 9382419 - DNA, 22 bp, Homo sapiens
aggcattagttgtaaagtattg

SEQ ID NO: 9382420 - DNA, 22 bp, Homo sapiens
ccactgctctgccaggagctgg

SEQ ID NO: 9382421 - DNA, 21 bp, Homo sapiens
ccactgctcttccctagggcc

SEQ ID NO: 9382422 - DNA, 22 bp, Homo sapiens
ccactggaagatgctgaggtca

SEQ ID NO: 9382423 - DNA, 22 bp, Homo sapiens
ccactgctgttacttacgcaaa

SEQ ID NO: 9382424 - DNA, 22 bp, Homo sapiens
ccactggaaatgacacgtcact

SEQ ID NO: 9382425 - DNA, 22 bp, Homo sapiens
ccactggcatccagctgccatc

SEQ ID NO: 9382426 - DNA, 22 bp, Homo sapiens
ccactggattttcttactgtag

SEQ ID NO: 9382427 - DNA, 22 bp, Homo sapiens
ccactggagactggtctctgtg

SEQ ID NO: 9382428 - DNA, 19 bp, Homo sapiens
agggccaggattctggaac

SEQ ID NO: 9382429 - DNA, 19 bp, Homo sapiens
agggccaggattctggaac

SEQ ID NO: 9382430 - DNA, 22 bp, Homo sapiens
agggccaggatcacagccaaga

SEQ ID NO: 9382431 - DNA, 22 bp, Homo sapiens
agggccaggaacacctgaaggg

SEQ ID NO: 9382432 - DNA, 22 bp, Homo sapiens
agggccaggaacacctgaaggg

SEQ ID NO: 9382433 - DNA, 18 bp, Homo sapiens
agggccagctgtgagtag

SEQ ID NO: 9382434 - DNA, 22 bp, Homo sapiens
agggccagctgcagaattagca

SEQ ID NO: 9382435 - DNA, 22 bp, Homo sapiens
agggccaggaacacctgaaggg

SEQ ID NO: 9382436 - DNA, 18 bp, Homo sapiens
agggccagctgtgagtag

SEQ ID NO: 9382437 - DNA, 22 bp, Homo sapiens
agggccagctagagccctcgcc

SEQ ID NO: 9382438 - DNA, 22 bp, Homo sapiens
agggccagctagagccctcgcc

SEQ ID NO: 9382439 - DNA, 22 bp, Homo sapiens
agggccagctagagccctcgcc

SEQ ID NO: 9382440 - DNA, 22 bp, Homo sapiens
agggccagctagagccctcgcc

SEQ ID NO: 9382441 - DNA, 22 bp, Homo sapiens
agggccagctgcagaattagca

SEQ ID NO: 9382442 - DNA, 18 bp, Homo sapiens
agggccagctgtgagtag

SEQ ID NO: 9382443 - DNA, 22 bp, Homo sapiens
agggccagctgatgagaatgag

SEQ ID NO: 9382444 - DNA, 22 bp, Homo sapiens
agggccagctgatgagaatgag

SEQ ID NO: 9382445 - DNA, 22 bp, Homo sapiens
agggccagctgatgagaatgag

SEQ ID NO: 9382446 - DNA, 22 bp, Homo sapiens
agggccagggaaacgatcagca

SEQ ID NO: 9382447 - DNA, 22 bp, Homo sapiens
agggccagggaaacgatcagca

SEQ ID NO: 9382448 - DNA, 22 bp, Homo sapiens
agggccagggaaacgatcagca

SEQ ID NO: 9382449 - DNA, 22 bp, Homo sapiens
agggccaggctcccatgtcagg

SEQ ID NO: 9382450 - DNA, 22 bp, Homo sapiens
agggccaggctcccatgtcagg

SEQ ID NO: 9382451 - DNA, 22 bp, Homo sapiens
agggccagggaagctgtatttt

SEQ ID NO: 9382452 - DNA, 22 bp, Homo sapiens
ccctggcccctcactccgaggc

SEQ ID NO: 9382453 - DNA, 22 bp, Homo sapiens
ccctggcccctcactccgaggc

SEQ ID NO: 9382454 - DNA, 21 bp, Homo sapiens
ccctgggatgggcttggactt

SEQ ID NO: 9382455 - DNA, 21 bp, Homo sapiens
ccctgggatgggcttggactt

SEQ ID NO: 9382456 - DNA, 22 bp, Homo sapiens
ccctgggatggattggcaggaa

SEQ ID NO: 9382457 - DNA, 22 bp, Homo sapiens
ccctggggagcaggcgaaggag

SEQ ID NO: 9382458 - DNA, 22 bp, Homo sapiens
ccctggggagcaggcgaaggag

SEQ ID NO: 9382459 - DNA, 22 bp, Homo sapiens
ccctgggctcagagcaggtagc

SEQ ID NO: 9382460 - DNA, 22 bp, Homo sapiens
ccctgggcaccaggcctggtaa

SEQ ID NO: 9382461 - DNA, 22 bp, Homo sapiens
ccctgggcaagccctattttcc

SEQ ID NO: 9382462 - DNA, 22 bp, Homo sapiens
ccctgggcagtctgcacttcag

SEQ ID NO: 9382463 - DNA, 22 bp, Homo sapiens
ccctgggcaccaggcctggtaa

SEQ ID NO: 9382464 - DNA, 22 bp, Homo sapiens
ccctgggcaccaggcctggtaa

SEQ ID NO: 9382465 - DNA, 22 bp, Homo sapiens
agggcagcctctcagcctaggt

SEQ ID NO: 9382466 - DNA, 22 bp, Homo sapiens
agggcagcctctcagcctaggt

SEQ ID NO: 9382467 - DNA, 22 bp, Homo sapiens
agggcagcctgagtgctggccc

SEQ ID NO: 9382468 - DNA, 22 bp, Homo sapiens
agggcagcctgagtgctggccc

SEQ ID NO: 9382469 - DNA, 22 bp, Homo sapiens
agggcagctagctgtagaaaga

SEQ ID NO: 9382470 - DNA, 22 bp, Homo sapiens
agggcagctctcacctctggcc

SEQ ID NO: 9382471 - DNA, 22 bp, Homo sapiens
agggcagctgtgagccactgtg

SEQ ID NO: 9382472 - DNA, 22 bp, Homo sapiens
agggccagccccaccctctctg

SEQ ID NO: 9382473 - DNA, 22 bp, Homo sapiens
agggccagccccaccctctctg

SEQ ID NO: 9382474 - DNA, 22 bp, Homo sapiens
agggaggaccaatgtgtggtta

SEQ ID NO: 9382475 - DNA, 22 bp, Homo sapiens
agggaggaccaatgtgtggtta

SEQ ID NO: 9382476 - DNA, 22 bp, Homo sapiens
agggaggagaatggactccttc

SEQ ID NO: 9382477 - DNA, 22 bp, Homo sapiens
agggaggagaatggactccttc

SEQ ID NO: 9382478 - DNA, 22 bp, Homo sapiens
agggaggaaggaactccttcta

SEQ ID NO: 9382479 - DNA, 22 bp, Homo sapiens
agggaggaccaatgtgtggtta

SEQ ID NO: 9382480 - DNA, 22 bp, Homo sapiens
agggaggaaggatgttccaaag

SEQ ID NO: 9382481 - DNA, 22 bp, Homo sapiens
agggaggaaggatgttccaaag

SEQ ID NO: 9382482 - DNA, 22 bp, Homo sapiens
agggcagagggtgcctcacctg

SEQ ID NO: 9382483 - DNA, 22 bp, Homo sapiens
agggaggagtcctcaaagtcat

SEQ ID NO: 9382484 - DNA, 22 bp, Homo sapiens
agggaggagaatggactccttc

SEQ ID NO: 9382485 - DNA, 22 bp, Homo sapiens
agggaggagaatggactccttc

SEQ ID NO: 9382486 - DNA, 22 bp, Homo sapiens
agggcagcagctgtccctgaga

SEQ ID NO: 9382487 - DNA, 22 bp, Homo sapiens
agggcagccatgagccttcagg

SEQ ID NO: 9382488 - DNA, 22 bp, Homo sapiens
agggcagcccttctgggagggc

SEQ ID NO: 9382489 - DNA, 22 bp, Homo sapiens
agggcagccattgagggattct

SEQ ID NO: 9382490 - DNA, 22 bp, Homo sapiens
cctccccacccacggctggtgg

SEQ ID NO: 9382491 - DNA, 22 bp, Homo sapiens
cctccccacccacggctggtgg

SEQ ID NO: 9382492 - DNA, 22 bp, Homo sapiens
cctcgagcagcgacccctccac

SEQ ID NO: 9382493 - DNA, 22 bp, Homo sapiens
cctctccttgcacccgtcccgc

SEQ ID NO: 9382494 - DNA, 22 bp, Homo sapiens
cctcgcggcactcgggccggat

SEQ ID NO: 9382495 - DNA, 22 bp, Homo sapiens
cctctctcagcttgctgcaact

SEQ ID NO: 9382496 - DNA, 22 bp, Homo sapiens
cctctctcagcttgctgcaact

SEQ ID NO: 9382497 - DNA, 22 bp, Homo sapiens
cctctctcagcttgctgcaact

SEQ ID NO: 9382498 - DNA, 22 bp, Homo sapiens
cctctctccaagggaaatccta

SEQ ID NO: 9382499 - DNA, 22 bp, Homo sapiens
cctctctccaattttcacctca

SEQ ID NO: 9382500 - DNA, 22 bp, Homo sapiens
cctctctccaagggaaatccta

SEQ ID NO: 9382501 - DNA, 21 bp, Homo sapiens
cctctctcattgtaatgaagt

SEQ ID NO: 9382502 - DNA, 21 bp, Homo sapiens
cctctctcattgtaatgaagt

SEQ ID NO: 9382503 - DNA, 22 bp, Homo sapiens
cctcccatggagctctgtccat

SEQ ID NO: 9382504 - DNA, 22 bp, Homo sapiens
cctccccacagcccaggagact

SEQ ID NO: 9382505 - DNA, 22 bp, Homo sapiens
cctccccacagcccaggagact

SEQ ID NO: 9382506 - DNA, 22 bp, Homo sapiens
cctccccacagcccaggagact

SEQ ID NO: 9382507 - DNA, 23 bp, Homo sapiens
cctccccaccagactctaacata

SEQ ID NO: 9382508 - DNA, 22 bp, Homo sapiens
cctccccacaggccaaataggc

SEQ ID NO: 9382509 - DNA, 22 bp, Homo sapiens
cctccccacaggccaaataggc

SEQ ID NO: 9382510 - DNA, 22 bp, Homo sapiens
cctcccagtgccggggccggct

SEQ ID NO: 9382511 - DNA, 22 bp, Homo sapiens
cctcccagtgcctccagagcag

SEQ ID NO: 9382512 - DNA, 22 bp, Homo sapiens
cctcccagtgcctccagagcag

SEQ ID NO: 9382513 - DNA, 22 bp, Homo sapiens
cctcccagtgcctccagagcag

SEQ ID NO: 9382514 - DNA, 22 bp, Homo sapiens
cctcccagtgcctccagagcag

SEQ ID NO: 9382515 - DNA, 22 bp, Homo sapiens
cctcccatggagctctgtccat

SEQ ID NO: 9382516 - DNA, 21 bp, Homo sapiens
cctccaggagcagagccctga

SEQ ID NO: 9382517 - DNA, 21 bp, Homo sapiens
cctccaggagcagagccctga

SEQ ID NO: 9382518 - DNA, 22 bp, Homo sapiens
cctccaggaggaaatggaacac

SEQ ID NO: 9382519 - DNA, 21 bp, Homo sapiens
cctccaggagcagagccctga

SEQ ID NO: 9382520 - DNA, 22 bp, Homo sapiens
cctccaggaggaaatggaacac

SEQ ID NO: 9382521 - DNA, 22 bp, Homo sapiens
cctccaggaacttgagagacac

SEQ ID NO: 9382522 - DNA, 20 bp, Homo sapiens
cctccaggcacacccatgtg

SEQ ID NO: 9382523 - DNA, 20 bp, Homo sapiens
cctccaggcacacccatgtg

SEQ ID NO: 9382524 - DNA, 20 bp, Homo sapiens
cctccaggcacacccatgtg

SEQ ID NO: 9382525 - DNA, 22 bp, Homo sapiens
cctccaggataagtcagggcct

SEQ ID NO: 9382526 - DNA, 22 bp, Homo sapiens
cctccaggataagtcagggcct

SEQ ID NO: 9382527 - DNA, 22 bp, Homo sapiens
cctccaggataagtcagggcct

SEQ ID NO: 9382528 - DNA, 22 bp, Homo sapiens
cctccaggccttgcaggttaac

SEQ ID NO: 9382529 - DNA, 23 bp, Homo sapiens
cctcccaggctgcgagtcccgag

SEQ ID NO: 9382530 - DNA, 23 bp, Homo sapiens
cctcccaggctgcgagtcccgag

SEQ ID NO: 9382531 - DNA, 22 bp, Homo sapiens
ccctgggtctaggttatgtgct

SEQ ID NO: 9382532 - DNA, 22 bp, Homo sapiens
ccctgtggtgacaggcctgtct

SEQ ID NO: 9382533 - DNA, 17 bp, Homo sapiens
ccctgggtgagttctca

SEQ ID NO: 9382534 - DNA, 22 bp, Homo sapiens
ccctgggttctggctgggctgc

SEQ ID NO: 9382535 - DNA, 22 bp, Homo sapiens
ccctgtgtagttaactttccac

SEQ ID NO: 9382536 - DNA, 23 bp, Homo sapiens
cccttcagcgagggcattaaggt

SEQ ID NO: 9382537 - DNA, 22 bp, Homo sapiens
cccttagctcaatttcttgccc

SEQ ID NO: 9382538 - DNA, 22 bp, Homo sapiens
cccttagctccaaggggtttgg

SEQ ID NO: 9382539 - DNA, 22 bp, Homo sapiens
cccttcagggttaagtagaggg

SEQ ID NO: 9382540 - DNA, 22 bp, Homo sapiens
cccttcagggttaagtagaggg

SEQ ID NO: 9382541 - DNA, 22 bp, Homo sapiens
cccttcagctgagtgggacagc

SEQ ID NO: 9382542 - DNA, 22 bp, Homo sapiens
cctcaaataagttttatttatc

SEQ ID NO: 9382543 - DNA, 20 bp, Homo sapiens
cctcaaataagtgccagcat

SEQ ID NO: 9382544 - DNA, 22 bp, Homo sapiens
cctcaaataagttttatttatc

SEQ ID NO: 9382545 - DNA, 22 bp, Homo sapiens
cctcagagaaatgtctattcaa

SEQ ID NO: 9382546 - DNA, 22 bp, Homo sapiens
cctcagacttgataattgggtt

SEQ ID NO: 9382547 - DNA, 22 bp, Homo sapiens
cctcagagaaaggtatggctga

SEQ ID NO: 9382548 - DNA, 21 bp, Homo sapiens
cctcagagacagatacgggtg

SEQ ID NO: 9382549 - DNA, 22 bp, Homo sapiens
cctcagaccttgctagtagtct

SEQ ID NO: 9382550 - DNA, 22 bp, Homo sapiens
cctcagaccttgctagtagtct

SEQ ID NO: 9382551 - DNA, 22 bp, Homo sapiens
cctcagacgcaggcctatgggc

SEQ ID NO: 9382552 - DNA, 22 bp, Homo sapiens
cctcagactcagtgcgttgtga

SEQ ID NO: 9382553 - DNA, 22 bp, Homo sapiens
cctcagacccctgctgagcttc

SEQ ID NO: 9382554 - DNA, 22 bp, Homo sapiens
cctcagacccctgctgagcttc

SEQ ID NO: 9382555 - DNA, 22 bp, Homo sapiens
cctcagacacagtcaagctttt

SEQ ID NO: 9382556 - DNA, 22 bp, Homo sapiens
cctcagaccccacagggcctgt

SEQ ID NO: 9382557 - DNA, 22 bp, Homo sapiens
cctcagaccccacagggcctgt

SEQ ID NO: 9382558 - DNA, 22 bp, Homo sapiens
cctcagagcctccagaaggaat

SEQ ID NO: 9382559 - DNA, 22 bp, Homo sapiens
cctcagagccatgcctgagttc

SEQ ID NO: 9382560 - DNA, 23 bp, Homo sapiens
cctcagagaggcagagccacatg

SEQ ID NO: 9382561 - DNA, 22 bp, Homo sapiens
cctcagagcagcacccagatga

SEQ ID NO: 9382562 - DNA, 22 bp, Homo sapiens
cctcagagactgcatcttccct

SEQ ID NO: 9382563 - DNA, 22 bp, Homo sapiens
cctcagagacagtaactggaat

SEQ ID NO: 9382564 - DNA, 20 bp, Homo sapiens
cctcaagcagactgacagct

SEQ ID NO: 9382565 - DNA, 22 bp, Homo sapiens
cctcaagtcaattctgtctcgc

SEQ ID NO: 9382566 - DNA, 21 bp, Homo sapiens
cctcaagtgcctcctgctgct

SEQ ID NO: 9382567 - DNA, 22 bp, Homo sapiens
cctcacacagttatctcttcat

SEQ ID NO: 9382568 - DNA, 22 bp, Homo sapiens
cctcagacacagtcaagctttt

SEQ ID NO: 9382569 - DNA, 22 bp, Homo sapiens
cctcagaatagtcctcagatca

SEQ ID NO: 9382570 - DNA, 22 bp, Homo sapiens
cctcaaattgtcaaataagaat

SEQ ID NO: 9382571 - DNA, 22 bp, Homo sapiens
cctcaaattggcattaattaag

SEQ ID NO: 9382572 - DNA, 22 bp, Homo sapiens
cctcaaattgctcagcgtctag

SEQ ID NO: 9382573 - DNA, 23 bp, Homo sapiens
cctcaaatgtagcctttttccca

SEQ ID NO: 9382574 - DNA, 22 bp, Homo sapiens
cctcaaatagcccccagtctag

SEQ ID NO: 9382575 - DNA, 22 bp, Homo sapiens
cctcaaatctttagagttattt

SEQ ID NO: 9382576 - DNA, 22 bp, Homo sapiens
agggagagtagatatcaggtgt

SEQ ID NO: 9382577 - DNA, 22 bp, Homo sapiens
agggagaggttgaaacctcagt

SEQ ID NO: 9382578 - DNA, 22 bp, Homo sapiens
agggagagtagatatcaggtgt

SEQ ID NO: 9382579 - DNA, 22 bp, Homo sapiens
agggagaggctgaactatccta

SEQ ID NO: 9382580 - DNA, 22 bp, Homo sapiens
agggagaggttgaaacctcagt

SEQ ID NO: 9382581 - DNA, 19 bp, Homo sapiens
agggaatccggctgaggga

SEQ ID NO: 9382582 - DNA, 19 bp, Homo sapiens
agggaatccggctgaggga

SEQ ID NO: 9382583 - DNA, 22 bp, Homo sapiens
agggagaaggtttagctgtgag

SEQ ID NO: 9382584 - DNA, 22 bp, Homo sapiens
agggaatgctccgtataaatct

SEQ ID NO: 9382585 - DNA, 22 bp, Homo sapiens
agggaatgctccgtataaatct

SEQ ID NO: 9382586 - DNA, 22 bp, Homo sapiens
agggagaggctgaactatccta

SEQ ID NO: 9382587 - DNA, 22 bp, Homo sapiens
agggagaaggtttagctgtgag

SEQ ID NO: 9382588 - DNA, 22 bp, Homo sapiens
agggaagggcagggtctatgca

SEQ ID NO: 9382589 - DNA, 22 bp, Homo sapiens
agggaagggcagggtctatgca

SEQ ID NO: 9382590 - DNA, 22 bp, Homo sapiens
agggaagggcagggtctatgca

SEQ ID NO: 9382591 - DNA, 22 bp, Homo sapiens
agggaagggcagggtctatgca

SEQ ID NO: 9382592 - DNA, 23 bp, Homo sapiens
agggaagggggcttattccacag

SEQ ID NO: 9382593 - DNA, 23 bp, Homo sapiens
agggaagggggcttattccacag

SEQ ID NO: 9382594 - DNA, 19 bp, Homo sapiens
agggaatccggctgaggga

SEQ ID NO: 9382595 - DNA, 22 bp, Homo sapiens
agggaaggtagaggtcaccggc

SEQ ID NO: 9382596 - DNA, 22 bp, Homo sapiens
agggaaggtagaggtcaccggc

SEQ ID NO: 9382597 - DNA, 22 bp, Homo sapiens
agggaagtccatgggggcggtg

SEQ ID NO: 9382598 - DNA, 22 bp, Homo sapiens
agggaaggaggttagaacccac

SEQ ID NO: 9382599 - DNA, 19 bp, Homo sapiens
agggaaggattctgtcatt

SEQ ID NO: 9382600 - DNA, 22 bp, Homo sapiens
agggaaggaggttagaacccac

SEQ ID NO: 9382601 - DNA, 22 bp, Homo sapiens
agggaaggaggttagaacccac

SEQ ID NO: 9382602 - DNA, 22 bp, Homo sapiens
agggaaggaggccatgtgtccc

SEQ ID NO: 9382603 - DNA, 22 bp, Homo sapiens
agggaaggaggccatgtgtccc

SEQ ID NO: 9382604 - DNA, 19 bp, Homo sapiens
agggaaggattctgtcatt

SEQ ID NO: 9382605 - DNA, 22 bp, Homo sapiens
agggaaggcttttgacatttcc

SEQ ID NO: 9382606 - DNA, 19 bp, Homo sapiens
agggaaggattctgtcatt

SEQ ID NO: 9382607 - DNA, 22 bp, Homo sapiens
agggaaggcttttgacatttcc

SEQ ID NO: 9382608 - DNA, 22 bp, Homo sapiens
agggaaggcttttgacatttcc

SEQ ID NO: 9382609 - DNA, 22 bp, Homo sapiens
agggaagggaaaaacactcgtc

SEQ ID NO: 9382610 - DNA, 22 bp, Homo sapiens
agggaaggaaaagctgtcgctt

SEQ ID NO: 9382611 - DNA, 22 bp, Homo sapiens
agggaaggaaaagctgtcgctt

SEQ ID NO: 9382612 - DNA, 22 bp, Homo sapiens
agggaaggaaaagctgtcgctt

SEQ ID NO: 9382613 - DNA, 22 bp, Homo sapiens
agggaaggaaaagctgtcgctt

SEQ ID NO: 9382614 - DNA, 22 bp, Homo sapiens
agggaaggaggccatgtgtccc

SEQ ID NO: 9382615 - DNA, 22 bp, Homo sapiens
agggaaggaaaagctgtcgctt

SEQ ID NO: 9382616 - DNA, 22 bp, Homo sapiens
aggcttagactacctggtctgt

SEQ ID NO: 9382617 - DNA, 21 bp, Homo sapiens
aggcttagcaatttcctatgg

SEQ ID NO: 9382618 - DNA, 22 bp, Homo sapiens
aggcttaatgagttaaatcact

SEQ ID NO: 9382619 - DNA, 22 bp, Homo sapiens
agggaagaagctggtagtaggt

SEQ ID NO: 9382620 - DNA, 22 bp, Homo sapiens
agggaagaagctggtagtaggt

SEQ ID NO: 9382621 - DNA, 22 bp, Homo sapiens
ccccagcacttggagtggggag

SEQ ID NO: 9382622 - DNA, 22 bp, Homo sapiens
ccccagcacttggagtggggag

SEQ ID NO: 9382623 - DNA, 22 bp, Homo sapiens
ccccagcagactcagggcaggt

SEQ ID NO: 9382624 - DNA, 22 bp, Homo sapiens
ccccagggaagctttgcttact

SEQ ID NO: 9382625 - DNA, 22 bp, Homo sapiens
ccccagggaagctttgcttact

SEQ ID NO: 9382626 - DNA, 22 bp, Homo sapiens
ccccagggactggtttcatgga

SEQ ID NO: 9382627 - DNA, 22 bp, Homo sapiens
ccccagggactggtttcatgga

SEQ ID NO: 9382628 - DNA, 22 bp, Homo sapiens
ccccagggtcagtgtgtggagg

SEQ ID NO: 9382629 - DNA, 22 bp, Homo sapiens
ccccagggtcagtgtgtggagg

SEQ ID NO: 9382630 - DNA, 22 bp, Homo sapiens
ccccagggtcagtgtgtggagg

SEQ ID NO: 9382631 - DNA, 19 bp, Homo sapiens
ccccagggtaggctagggg

SEQ ID NO: 9382632 - DNA, 19 bp, Homo sapiens
ccccagggtaggctagggg

SEQ ID NO: 9382633 - DNA, 22 bp, Homo sapiens
ccccatcctattcatgtttctg

SEQ ID NO: 9382634 - DNA, 22 bp, Homo sapiens
ccccatcctattcatgtttctg

SEQ ID NO: 9382635 - DNA, 22 bp, Homo sapiens
agggaggaaggaactccttcta

SEQ ID NO: 9382636 - DNA, 22 bp, Homo sapiens
agggagctttttcatgtgtcta

SEQ ID NO: 9382637 - DNA, 22 bp, Homo sapiens
ccccatggcaactgctgggggt

SEQ ID NO: 9382638 - DNA, 21 bp, Homo sapiens
ccccatggagtacagttgggc

SEQ ID NO: 9382639 - DNA, 22 bp, Homo sapiens
agggagcatgggtgaagcaggc

SEQ ID NO: 9382640 - DNA, 22 bp, Homo sapiens
agggagcatgggtgaagcaggc

SEQ ID NO: 9382641 - DNA, 22 bp, Homo sapiens
agggagcatgggtgaagcaggc

SEQ ID NO: 9382642 - DNA, 22 bp, Homo sapiens
agggagccagagttgggagctc

SEQ ID NO: 9382643 - DNA, 22 bp, Homo sapiens
agggagccagagttgggagctc

SEQ ID NO: 9382644 - DNA, 22 bp, Homo sapiens
agggagccaggaacgcaggtcg

SEQ ID NO: 9382645 - DNA, 22 bp, Homo sapiens
agggagccaggaacgcaggtcg

SEQ ID NO: 9382646 - DNA, 22 bp, Homo sapiens
agggagccagagttgggagctc

SEQ ID NO: 9382647 - DNA, 22 bp, Homo sapiens
agggagccctgaaccagagggt

SEQ ID NO: 9382648 - DNA, 18 bp, Homo sapiens
agggagcatctggttgcc

SEQ ID NO: 9382649 - DNA, 22 bp, Homo sapiens
agggagcatgggtgaagcaggc

SEQ ID NO: 9382650 - DNA, 22 bp, Homo sapiens
agggagcagggctcctttgggt

SEQ ID NO: 9382651 - DNA, 18 bp, Homo sapiens
agggagcatctggttgcc

SEQ ID NO: 9382652 - DNA, 22 bp, Homo sapiens
agggagcaaaggtttcagggtt

SEQ ID NO: 9382653 - DNA, 22 bp, Homo sapiens
agggagagtttgatgtttcctc

SEQ ID NO: 9382654 - DNA, 22 bp, Homo sapiens
agggagagtagatatcaggtgt

SEQ ID NO: 9382655 - DNA, 22 bp, Homo sapiens
agggagagtttgatgtttcctc

SEQ ID NO: 9382656 - DNA, 22 bp, Homo sapiens
agggagagtttgatgtttcctc

SEQ ID NO: 9382657 - DNA, 18 bp, Homo sapiens
cccagcctctcctttcta

SEQ ID NO: 9382658 - DNA, 22 bp, Homo sapiens
cccagcctctggattctgccct

SEQ ID NO: 9382659 - DNA, 22 bp, Homo sapiens
cccagcctctgggctcacccaa

SEQ ID NO: 9382660 - DNA, 22 bp, Homo sapiens
cccagcctctgtttgctcctct

SEQ ID NO: 9382661 - DNA, 22 bp, Homo sapiens
cccagcctctgggttctgccgg

SEQ ID NO: 9382662 - DNA, 22 bp, Homo sapiens
cccagcctctgtttgctcctct

SEQ ID NO: 9382663 - DNA, 22 bp, Homo sapiens
cccagcctggtgcactgtgggg

SEQ ID NO: 9382664 - DNA, 22 bp, Homo sapiens
cccagctccttgtttgcatctc

SEQ ID NO: 9382665 - DNA, 22 bp, Homo sapiens
cccagctccttgtttgcatctc

SEQ ID NO: 9382666 - DNA, 22 bp, Homo sapiens
cccagctcgccgccgatgtgcg

SEQ ID NO: 9382667 - DNA, 22 bp, Homo sapiens
cccagctctaggagtggtggca

SEQ ID NO: 9382668 - DNA, 22 bp, Homo sapiens
cccagctctgccatctacccac

SEQ ID NO: 9382669 - DNA, 22 bp, Homo sapiens
cccagctctgccatctacccac

SEQ ID NO: 9382670 - DNA, 22 bp, Homo sapiens
cccagctctgccatctacccac

SEQ ID NO: 9382671 - DNA, 22 bp, Homo sapiens
cccagctctgcagacctgccct

SEQ ID NO: 9382672 - DNA, 22 bp, Homo sapiens
cccagctctcgcacttactagc

SEQ ID NO: 9382673 - DNA, 19 bp, Homo sapiens
cccagctctcgtggtgtgc

SEQ ID NO: 9382674 - DNA, 22 bp, Homo sapiens
cccagctctcgcacttactagc

SEQ ID NO: 9382675 - DNA, 22 bp, Homo sapiens
cccagctctctgctcttagcct

SEQ ID NO: 9382676 - DNA, 22 bp, Homo sapiens
cccagctctctgctcttagcct

SEQ ID NO: 9382677 - DNA, 22 bp, Homo sapiens
cccagctctctcagttctgctt

SEQ ID NO: 9382678 - DNA, 22 bp, Homo sapiens
aggctgtgtttaagtggtaatg

SEQ ID NO: 9382679 - DNA, 22 bp, Homo sapiens
aggctgtgtaaagtgctttccc

SEQ ID NO: 9382680 - DNA, 22 bp, Homo sapiens
aggctgtgtttcccctggagct

SEQ ID NO: 9382681 - DNA, 22 bp, Homo sapiens
aggctgtgtttcccctggagct

SEQ ID NO: 9382682 - DNA, 22 bp, Homo sapiens
aggctgtgtttcccctggagct

SEQ ID NO: 9382683 - DNA, 22 bp, Homo sapiens
ccatctggatctgtccactgac

SEQ ID NO: 9382684 - DNA, 22 bp, Homo sapiens
ccatctccagtttattcttcct

SEQ ID NO: 9382685 - DNA, 22 bp, Homo sapiens
ccatctccagtttattcttcct

SEQ ID NO: 9382686 - DNA, 22 bp, Homo sapiens
ccatgaattcactccatgctag

SEQ ID NO: 9382687 - DNA, 22 bp, Homo sapiens
ccatcttctcttgaacctcctt

SEQ ID NO: 9382688 - DNA, 22 bp, Homo sapiens
ccatgaattcactccatgctag

SEQ ID NO: 9382689 - DNA, 22 bp, Homo sapiens
ccatgaattcactccatgctag

SEQ ID NO: 9382690 - DNA, 22 bp, Homo sapiens
ccatgaattcactccatgctag

SEQ ID NO: 9382691 - DNA, 22 bp, Homo sapiens
ccatgaccatacctgggcctga

SEQ ID NO: 9382692 - DNA, 22 bp, Homo sapiens
ccatgacccctggcatccaggg

SEQ ID NO: 9382693 - DNA, 22 bp, Homo sapiens
ccatgagccagctctaagcaaa

SEQ ID NO: 9382694 - DNA, 22 bp, Homo sapiens
ccatccttgtcatcttcatgtt

SEQ ID NO: 9382695 - DNA, 21 bp, Homo sapiens
ccataattttgtttcagaagt

SEQ ID NO: 9382696 - DNA, 22 bp, Homo sapiens
ccataattgggtagccatctga

SEQ ID NO: 9382697 - DNA, 21 bp, Homo sapiens
ccataattttgtttcagaagt

SEQ ID NO: 9382698 - DNA, 22 bp, Homo sapiens
ccagtttgaggaagaagtagat

SEQ ID NO: 9382699 - DNA, 22 bp, Homo sapiens
ccataaagcactgaatcaccga

SEQ ID NO: 9382700 - DNA, 22 bp, Homo sapiens
ccataaggagccagacattcca

SEQ ID NO: 9382701 - DNA, 22 bp, Homo sapiens
ccataaggttgaaaactgtaca

SEQ ID NO: 9382702 - DNA, 22 bp, Homo sapiens
cccagcagtgacccagtgatac

SEQ ID NO: 9382703 - DNA, 22 bp, Homo sapiens
cccagcagtgacccagtgatac

SEQ ID NO: 9382704 - DNA, 22 bp, Homo sapiens
cccagcagtacccaagcccttg

SEQ ID NO: 9382705 - DNA, 22 bp, Homo sapiens
cccagcacaggcaattccatac

SEQ ID NO: 9382706 - DNA, 22 bp, Homo sapiens
cccagcatcccagtgggcagca

SEQ ID NO: 9382707 - DNA, 22 bp, Homo sapiens
cccagcatcccagtgggcagca

SEQ ID NO: 9382708 - DNA, 22 bp, Homo sapiens
cccagcatcctcagggagcggg

SEQ ID NO: 9382709 - DNA, 22 bp, Homo sapiens
cccagcagttgttggtgcacat

SEQ ID NO: 9382710 - DNA, 22 bp, Homo sapiens
cccagcagtggttctcaaactt

SEQ ID NO: 9382711 - DNA, 22 bp, Homo sapiens
cccagcagtttgcttagagtga

SEQ ID NO: 9382712 - DNA, 22 bp, Homo sapiens
caggacagacagaatgcctaac

SEQ ID NO: 9382713 - DNA, 22 bp, Homo sapiens
caggacagaaataaggaatata

SEQ ID NO: 9382714 - DNA, 22 bp, Homo sapiens
caggacagaaataaggaatata

SEQ ID NO: 9382715 - DNA, 22 bp, Homo sapiens
caggacagaccaagatcgtgct

SEQ ID NO: 9382716 - DNA, 22 bp, Homo sapiens
caggacagaccaagatcgtgct

SEQ ID NO: 9382717 - DNA, 22 bp, Homo sapiens
caggacagaccaagatcgtgct

SEQ ID NO: 9382718 - DNA, 22 bp, Homo sapiens
caggacagaccaagatcgtgct

SEQ ID NO: 9382719 - DNA, 22 bp, Homo sapiens
agctggcaggtgaagatgattt

SEQ ID NO: 9382720 - DNA, 22 bp, Homo sapiens
agctggcagtatgactggtgac

SEQ ID NO: 9382721 - DNA, 22 bp, Homo sapiens
agctggaggataactcacttct

SEQ ID NO: 9382722 - DNA, 22 bp, Homo sapiens
caggacagagcccagactgtgt

SEQ ID NO: 9382723 - DNA, 22 bp, Homo sapiens
agctggcagtatgactggtgac

SEQ ID NO: 9382724 - DNA, 22 bp, Homo sapiens
agctggcagtcatcctagtgag

SEQ ID NO: 9382725 - DNA, 22 bp, Homo sapiens
agctggcagtcatcctagtgag

SEQ ID NO: 9382726 - DNA, 22 bp, Homo sapiens
agctggcagtcatcctagtgag

SEQ ID NO: 9382727 - DNA, 22 bp, Homo sapiens
agctggcagtcatcctagtgag

SEQ ID NO: 9382728 - DNA, 22 bp, Homo sapiens
agctggcagtatgactggtgac

SEQ ID NO: 9382729 - DNA, 22 bp, Homo sapiens
agctggcaggtgaagatgattt

SEQ ID NO: 9382730 - DNA, 22 bp, Homo sapiens
agctggcagtatgactggtgac

SEQ ID NO: 9382731 - DNA, 22 bp, Homo sapiens
agctggcagttgcgataatgca

SEQ ID NO: 9382732 - DNA, 22 bp, Homo sapiens
agctggcatactttgctaggaa

SEQ ID NO: 9382733 - DNA, 22 bp, Homo sapiens
agctggcagttgcgataatgca

SEQ ID NO: 9382734 - DNA, 21 bp, Homo sapiens
agctggcagtgcctggacctc

SEQ ID NO: 9382735 - DNA, 21 bp, Homo sapiens
agctggcagtgcctggacctc

SEQ ID NO: 9382736 - DNA, 22 bp, Homo sapiens
agctggcagtcggccttgatgc

SEQ ID NO: 9382737 - DNA, 22 bp, Homo sapiens
agctggcagtcggccttgatgc

SEQ ID NO: 9382738 - DNA, 22 bp, Homo sapiens
agctggcagtcggccttgatgc

SEQ ID NO: 9382739 - DNA, 22 bp, Homo sapiens
agctgctgaagtgagagaattg

SEQ ID NO: 9382740 - DNA, 22 bp, Homo sapiens
agctgctgaagtgagagaattg

SEQ ID NO: 9382741 - DNA, 22 bp, Homo sapiens
agctgctctttgaaggacactt

SEQ ID NO: 9382742 - DNA, 22 bp, Homo sapiens
agctgctgaatgacactgcaag

SEQ ID NO: 9382743 - DNA, 22 bp, Homo sapiens
agctgctgaagtgagagaattg

SEQ ID NO: 9382744 - DNA, 22 bp, Homo sapiens
agctgctgagccaggctgatgt

SEQ ID NO: 9382745 - DNA, 22 bp, Homo sapiens
agctgctgagccaggctgatgt

SEQ ID NO: 9382746 - DNA, 22 bp, Homo sapiens
agctgctgaatgacactgcaag

SEQ ID NO: 9382747 - DNA, 22 bp, Homo sapiens
agctgctgagagtctgccgggc

SEQ ID NO: 9382748 - DNA, 22 bp, Homo sapiens
agctgctcctttcctgcaggcg

SEQ ID NO: 9382749 - DNA, 20 bp, Homo sapiens
agctgctctcatccagacct

SEQ ID NO: 9382750 - DNA, 22 bp, Homo sapiens
agctgctctgagccctgattct

SEQ ID NO: 9382751 - DNA, 22 bp, Homo sapiens
agctgctcttgggtgacttcaa

SEQ ID NO: 9382752 - DNA, 22 bp, Homo sapiens
agctgctcattactttctgttg

SEQ ID NO: 9382753 - DNA, 22 bp, Homo sapiens
agctgctccaatttttaccatt

SEQ ID NO: 9382754 - DNA, 22 bp, Homo sapiens
agctgctccaacccagcgggct

SEQ ID NO: 9382755 - DNA, 22 bp, Homo sapiens
agctgcctggccggagccactg

SEQ ID NO: 9382756 - DNA, 22 bp, Homo sapiens
agctgcctggccggagccactg

SEQ ID NO: 9382757 - DNA, 21 bp, Homo sapiens
agctgctccagggagctcagg

SEQ ID NO: 9382758 - DNA, 22 bp, Homo sapiens
agctgctcctttcctgcaggcg

SEQ ID NO: 9382759 - DNA, 22 bp, Homo sapiens
agctgctccctatcctttcctt

SEQ ID NO: 9382760 - DNA, 21 bp, Homo sapiens
caggaaaagcggaagtctagc

SEQ ID NO: 9382761 - DNA, 22 bp, Homo sapiens
agctgcctggagtcatttcctg

SEQ ID NO: 9382762 - DNA, 22 bp, Homo sapiens
agctggccagcacctccaggtc

SEQ ID NO: 9382763 - DNA, 22 bp, Homo sapiens
agctggccagcacctccaggtc

SEQ ID NO: 9382764 - DNA, 22 bp, Homo sapiens
agctggcattgcagggagctgc

SEQ ID NO: 9382765 - DNA, 22 bp, Homo sapiens
agctggccagcacctccaggtc

SEQ ID NO: 9382766 - DNA, 22 bp, Homo sapiens
agctggcattgcagggagctgc

SEQ ID NO: 9382767 - DNA, 22 bp, Homo sapiens
agctggcattgaagaatggtta

SEQ ID NO: 9382768 - DNA, 22 bp, Homo sapiens
agctggcattgcagggagctgc

SEQ ID NO: 9382769 - DNA, 22 bp, Homo sapiens
agctggcatctgaagtcagggc

SEQ ID NO: 9382770 - DNA, 22 bp, Homo sapiens
agctggcatctgaagtcagggc

SEQ ID NO: 9382771 - DNA, 22 bp, Homo sapiens
agctggcatctgaagtcagggc

SEQ ID NO: 9382772 - DNA, 22 bp, Homo sapiens
agctggcatcgagcatttgaac

SEQ ID NO: 9382773 - DNA, 22 bp, Homo sapiens
agctggcatactttgctaggaa

SEQ ID NO: 9382774 - DNA, 22 bp, Homo sapiens
agctggcatactttgctaggaa

SEQ ID NO: 9382775 - DNA, 22 bp, Homo sapiens
agctggcatactttgctaggaa

SEQ ID NO: 9382776 - DNA, 22 bp, Homo sapiens
agctggcatactttgctaggaa

SEQ ID NO: 9382777 - DNA, 22 bp, Homo sapiens
agctggcattacaggagcatgc

SEQ ID NO: 9382778 - DNA, 22 bp, Homo sapiens
agctggcattacaggagcatgc

SEQ ID NO: 9382779 - DNA, 22 bp, Homo sapiens
agctggcattacaggagcatgc

SEQ ID NO: 9382780 - DNA, 22 bp, Homo sapiens
agctggcattctccttgttatt

SEQ ID NO: 9382781 - DNA, 22 bp, Homo sapiens
agctggcattgaagaatggtta

SEQ ID NO: 9382782 - DNA, 22 bp, Homo sapiens
agctggcattctccttgttatt

SEQ ID NO: 9382783 - DNA, 22 bp, Homo sapiens
agctggcattgaagaatggtta

SEQ ID NO: 9382784 - DNA, 22 bp, Homo sapiens
caggaggttgtaagagcaggcc

SEQ ID NO: 9382785 - DNA, 22 bp, Homo sapiens
caggaggttggtagcagtagat

SEQ ID NO: 9382786 - DNA, 22 bp, Homo sapiens
caggaggttggtagcagtagat

SEQ ID NO: 9382787 - DNA, 22 bp, Homo sapiens
caggaggttggtagcagtagat

SEQ ID NO: 9382788 - DNA, 22 bp, Homo sapiens
caggaggttgtaagagcaggcc

SEQ ID NO: 9382789 - DNA, 22 bp, Homo sapiens
caggaggttgtaagagcaggcc

SEQ ID NO: 9382790 - DNA, 22 bp, Homo sapiens
caggagtccagagtgtcatttt

SEQ ID NO: 9382791 - DNA, 22 bp, Homo sapiens
caggaggtacatagattcagat

SEQ ID NO: 9382792 - DNA, 22 bp, Homo sapiens
caggaggtacatagattcagat

SEQ ID NO: 9382793 - DNA, 22 bp, Homo sapiens
caggaggttgagggtgcagtga

SEQ ID NO: 9382794 - DNA, 22 bp, Homo sapiens
caggaggtggagctcaagtggt

SEQ ID NO: 9382795 - DNA, 22 bp, Homo sapiens
caggaggtgccctctagtggca

SEQ ID NO: 9382796 - DNA, 22 bp, Homo sapiens
agctggcttctctgcagacatt

SEQ ID NO: 9382797 - DNA, 22 bp, Homo sapiens
agctggcttctctgcagacatt

SEQ ID NO: 9382798 - DNA, 22 bp, Homo sapiens
agctggctgggtgccagtctcc

SEQ ID NO: 9382799 - DNA, 22 bp, Homo sapiens
agctggctgggtgccagtctcc

SEQ ID NO: 9382800 - DNA, 22 bp, Homo sapiens
agctggcttcacaggcagtgtg

SEQ ID NO: 9382801 - DNA, 22 bp, Homo sapiens
agctggctgggtgccagtctcc

SEQ ID NO: 9382802 - DNA, 22 bp, Homo sapiens
agctggcttcacaggcagtgtg

SEQ ID NO: 9382803 - DNA, 22 bp, Homo sapiens
agctggctttatggttggctaa

SEQ ID NO: 9382804 - DNA, 22 bp, Homo sapiens
agctggctttatggttggctaa

SEQ ID NO: 9382805 - DNA, 22 bp, Homo sapiens
agctggcttgcatgctaaggag

SEQ ID NO: 9382806 - DNA, 22 bp, Homo sapiens
agctggctttatggttggctaa

SEQ ID NO: 9382807 - DNA, 22 bp, Homo sapiens
agctggctttgagctgggaggt

SEQ ID NO: 9382808 - DNA, 22 bp, Homo sapiens
agctggctttgagctgggaggt

SEQ ID NO: 9382809 - DNA, 22 bp, Homo sapiens
caggagtctgttcctcatttgt

SEQ ID NO: 9382810 - DNA, 22 bp, Homo sapiens
agctggcctccgggtgcctggg

SEQ ID NO: 9382811 - DNA, 22 bp, Homo sapiens
agctggcctccgggtgcctggg

SEQ ID NO: 9382812 - DNA, 22 bp, Homo sapiens
agctggcctccgggtgcctggg

SEQ ID NO: 9382813 - DNA, 22 bp, Homo sapiens
caggagtccctctggccagcat

SEQ ID NO: 9382814 - DNA, 22 bp, Homo sapiens
agctggctgccttctccttagg

SEQ ID NO: 9382815 - DNA, 22 bp, Homo sapiens
agctggctgccttctccttagg

SEQ ID NO: 9382816 - DNA, 19 bp, Homo sapiens
agctggctcttctttgtct

SEQ ID NO: 9382817 - DNA, 21 bp, Homo sapiens
agctggcctggtttgagctcc

SEQ ID NO: 9382818 - DNA, 22 bp, Homo sapiens
agctggctggccccttcctgcc

SEQ ID NO: 9382819 - DNA, 22 bp, Homo sapiens
agctggctgccttctccttagg

SEQ ID NO: 9382820 - DNA, 22 bp, Homo sapiens
agctggctggccccttcctgcc

SEQ ID NO: 9382821 - DNA, 22 bp, Homo sapiens
agctggctggccccttcctgcc

SEQ ID NO: 9382822 - DNA, 22 bp, Homo sapiens
agctggctggccccttcctgcc

SEQ ID NO: 9382823 - DNA, 22 bp, Homo sapiens
agctctggaactcccggctgct

SEQ ID NO: 9382824 - DNA, 22 bp, Homo sapiens
agctctggaactcccggctgct

SEQ ID NO: 9382825 - DNA, 23 bp, Homo sapiens
agctctgctcgggcatgccctgc

SEQ ID NO: 9382826 - DNA, 23 bp, Homo sapiens
agctctgctcgggcatgccctgc

SEQ ID NO: 9382827 - DNA, 22 bp, Homo sapiens
agctctgccttgacaccttctc

SEQ ID NO: 9382828 - DNA, 22 bp, Homo sapiens
agctctgccttgacaccttctc

SEQ ID NO: 9382829 - DNA, 22 bp, Homo sapiens
agctctgcaggcacagctgagg

SEQ ID NO: 9382830 - DNA, 22 bp, Homo sapiens
agctctgcagcccagcaggtgg

SEQ ID NO: 9382831 - DNA, 22 bp, Homo sapiens
agctctggaagccctggtagtt

SEQ ID NO: 9382832 - DNA, 22 bp, Homo sapiens
agctctggaagccctggtagtt

SEQ ID NO: 9382833 - DNA, 22 bp, Homo sapiens
agctctggaagccctggtagtt

SEQ ID NO: 9382834 - DNA, 22 bp, Homo sapiens
cagctcctgcctgggcagctgt

SEQ ID NO: 9382835 - DNA, 22 bp, Homo sapiens
cagctcctgttggtcttgagga

SEQ ID NO: 9382836 - DNA, 22 bp, Homo sapiens
cagctcctgcctgggcagctgt

SEQ ID NO: 9382837 - DNA, 22 bp, Homo sapiens
agctctgactgaagagatgcaa

SEQ ID NO: 9382838 - DNA, 22 bp, Homo sapiens
agctctgaagcttatctgatgt

SEQ ID NO: 9382839 - DNA, 22 bp, Homo sapiens
agctctgacattgattctcagc

SEQ ID NO: 9382840 - DNA, 22 bp, Homo sapiens
agctctgatctttacaacaaag

SEQ ID NO: 9382841 - DNA, 22 bp, Homo sapiens
agctctcttccagatccacttg

SEQ ID NO: 9382842 - DNA, 23 bp, Homo sapiens
agctctgaaatagggaaagagga

SEQ ID NO: 9382843 - DNA, 22 bp, Homo sapiens
agctctcccaccttcttcttac

SEQ ID NO: 9382844 - DNA, 22 bp, Homo sapiens
cagctctcacacttagcttcta

SEQ ID NO: 9382845 - DNA, 22 bp, Homo sapiens
cagctcctgttggtcttgagga

SEQ ID NO: 9382846 - DNA, 23 bp, Homo sapiens
cagctcgcttttgttccctccct

SEQ ID NO: 9382847 - DNA, 22 bp, Homo sapiens
cagctctacgtttctatgaatc

SEQ ID NO: 9382848 - DNA, 22 bp, Homo sapiens
cagctctgaagaaaggtgtcta

SEQ ID NO: 9382849 - DNA, 21 bp, Homo sapiens
cagcttcttctgtgacctggt

SEQ ID NO: 9382850 - DNA, 21 bp, Homo sapiens
cagcttcttctgtgacctggt

SEQ ID NO: 9382851 - DNA, 22 bp, Homo sapiens
cagcttctttgggattctttat

SEQ ID NO: 9382852 - DNA, 22 bp, Homo sapiens
cagcttctttgggattctttat

SEQ ID NO: 9382853 - DNA, 22 bp, Homo sapiens
cagcttcttacgagctggtact

SEQ ID NO: 9382854 - DNA, 22 bp, Homo sapiens
cagcttctgtttctagcccctg

SEQ ID NO: 9382855 - DNA, 22 bp, Homo sapiens
cagcttcttacgagctggtact

SEQ ID NO: 9382856 - DNA, 22 bp, Homo sapiens
cagcttcttcagtcctggagct

SEQ ID NO: 9382857 - DNA, 22 bp, Homo sapiens
cagcttcttcagtcctggagct

SEQ ID NO: 9382858 - DNA, 22 bp, Homo sapiens
cagcttcttcagtcctggagct

SEQ ID NO: 9382859 - DNA, 22 bp, Homo sapiens
cagcttcttagtctttccttgt

SEQ ID NO: 9382860 - DNA, 22 bp, Homo sapiens
cagcttcttagtctttccttgt

SEQ ID NO: 9382861 - DNA, 22 bp, Homo sapiens
cagcttctgtcctagaaactgg

SEQ ID NO: 9382862 - DNA, 22 bp, Homo sapiens
cagcttctgtctgattagcaag

SEQ ID NO: 9382863 - DNA, 22 bp, Homo sapiens
cagcttctgtttctagcccctg

SEQ ID NO: 9382864 - DNA, 22 bp, Homo sapiens
cagcttctgtttattgtgtgcc

SEQ ID NO: 9382865 - DNA, 22 bp, Homo sapiens
cagcttctgtttattgtgtgcc

SEQ ID NO: 9382866 - DNA, 22 bp, Homo sapiens
cagcttctgctcatggaggggt

SEQ ID NO: 9382867 - DNA, 22 bp, Homo sapiens
cagcttctggcgtggagcctga

SEQ ID NO: 9382868 - DNA, 22 bp, Homo sapiens
agctgaggccacgagtgaaggg

SEQ ID NO: 9382869 - DNA, 22 bp, Homo sapiens
agctgaggccacgagtgaaggg

SEQ ID NO: 9382870 - DNA, 22 bp, Homo sapiens
agctgaggcatggacaggctgc

SEQ ID NO: 9382871 - DNA, 22 bp, Homo sapiens
agctgaggcatggacaggctgc

SEQ ID NO: 9382872 - DNA, 22 bp, Homo sapiens
agctgaggcatggacaggctgc

SEQ ID NO: 9382873 - DNA, 23 bp, Homo sapiens
cagcttctttgggattctttata

SEQ ID NO: 9382874 - DNA, 23 bp, Homo sapiens
cagcttctttgggattctttata

SEQ ID NO: 9382875 - DNA, 23 bp, Homo sapiens
cagcttctttgggattctttata

SEQ ID NO: 9382876 - DNA, 21 bp, Homo sapiens
agctgcagccatgtacatggc

SEQ ID NO: 9382877 - DNA, 21 bp, Homo sapiens
agctgcagccatgtacatggc

SEQ ID NO: 9382878 - DNA, 21 bp, Homo sapiens
agctgcagccatgtacatggc

SEQ ID NO: 9382879 - DNA, 23 bp, Homo sapiens
agctgaggctgtgggtgtcagag

SEQ ID NO: 9382880 - DNA, 22 bp, Homo sapiens
agctgaggctctgagagggaag

SEQ ID NO: 9382881 - DNA, 23 bp, Homo sapiens
agctgaggctgtgggtgtcagag

SEQ ID NO: 9382882 - DNA, 21 bp, Homo sapiens
agctgcagcccaaaggcctgt

SEQ ID NO: 9382883 - DNA, 22 bp, Homo sapiens
agctgcaggcccatgctcagtc

SEQ ID NO: 9382884 - DNA, 22 bp, Homo sapiens
agctgcaggcctctcctgggga

SEQ ID NO: 9382885 - DNA, 21 bp, Homo sapiens
agctgcaggcctcccagggat

SEQ ID NO: 9382886 - DNA, 21 bp, Homo sapiens
agctgcaggcctcccagggat

SEQ ID NO: 9382887 - DNA, 22 bp, Homo sapiens
cagctttgtcatttgatttggg

SEQ ID NO: 9382888 - DNA, 22 bp, Homo sapiens
cagcttttaggactgtgagaaa

SEQ ID NO: 9382889 - DNA, 21 bp, Homo sapiens
agctgcagtcaagccagaggt

SEQ ID NO: 9382890 - DNA, 22 bp, Homo sapiens
agctgcagtatgaggctggtgg

SEQ ID NO: 9382891 - DNA, 22 bp, Homo sapiens
agctgcagtatgaggctggtgg

SEQ ID NO: 9382892 - DNA, 22 bp, Homo sapiens
agctgcagtatgaggctggtgg

SEQ ID NO: 9382893 - DNA, 22 bp, Homo sapiens
agctgcagtcaagctgggccac

SEQ ID NO: 9382894 - DNA, 22 bp, Homo sapiens
agctgcagtcaagctgggccac

SEQ ID NO: 9382895 - DNA, 22 bp, Homo sapiens
agctgcagtcaagctgggccac

SEQ ID NO: 9382896 - DNA, 21 bp, Homo sapiens
agctgcagtcaagccagaggt

SEQ ID NO: 9382897 - DNA, 22 bp, Homo sapiens
agctgcagtaaagctctccagg

SEQ ID NO: 9382898 - DNA, 22 bp, Homo sapiens
agctgcaggttcagcattccac

SEQ ID NO: 9382899 - DNA, 22 bp, Homo sapiens
agctgcaggtggacccgtaccg

SEQ ID NO: 9382900 - DNA, 22 bp, Homo sapiens
agctgcaggcctctcctgggga

SEQ ID NO: 9382901 - DNA, 22 bp, Homo sapiens
agctgcagggcttgggtttccc

SEQ ID NO: 9382902 - DNA, 22 bp, Homo sapiens
agctgcaggcgccggggccgat

SEQ ID NO: 9382903 - DNA, 22 bp, Homo sapiens
agctgcaggcgccggggccgat

SEQ ID NO: 9382904 - DNA, 22 bp, Homo sapiens
caggcctggcccccggcacacc

SEQ ID NO: 9382905 - DNA, 22 bp, Homo sapiens
caggcctggcccccggcacacc

SEQ ID NO: 9382906 - DNA, 22 bp, Homo sapiens
caggcctcccggtgcacactga

SEQ ID NO: 9382907 - DNA, 22 bp, Homo sapiens
caggcctgggctgggtatcagg

SEQ ID NO: 9382908 - DNA, 22 bp, Homo sapiens
caggcctgggcttcggggctga

SEQ ID NO: 9382909 - DNA, 22 bp, Homo sapiens
caggcctggctgcagctcgcct

SEQ ID NO: 9382910 - DNA, 22 bp, Homo sapiens
caggcctggctgcagctcgcct

SEQ ID NO: 9382911 - DNA, 22 bp, Homo sapiens
caggcctggctgcagctcgcct

SEQ ID NO: 9382912 - DNA, 22 bp, Homo sapiens
agctgtggccagatgtgagcgg

SEQ ID NO: 9382913 - DNA, 22 bp, Homo sapiens
caggcctgggttcaaatccctt

SEQ ID NO: 9382914 - DNA, 22 bp, Homo sapiens
caggcctggggctggcttccag

SEQ ID NO: 9382915 - DNA, 22 bp, Homo sapiens
caggcctggggctggcttccag

SEQ ID NO: 9382916 - DNA, 22 bp, Homo sapiens
caggcctggggctggcttccag

SEQ ID NO: 9382917 - DNA, 22 bp, Homo sapiens
caggcctgggcttcggggctga

SEQ ID NO: 9382918 - DNA, 22 bp, Homo sapiens
caggcctggttgagccctgaga

SEQ ID NO: 9382919 - DNA, 22 bp, Homo sapiens
caggcctggttgagccctgaga

SEQ ID NO: 9382920 - DNA, 22 bp, Homo sapiens
caggcctggttgagccctgaga

SEQ ID NO: 9382921 - DNA, 22 bp, Homo sapiens
caggcctcaccagcggagctgc

SEQ ID NO: 9382922 - DNA, 21 bp, Homo sapiens
caggccgggtgagcaggcagc

SEQ ID NO: 9382923 - DNA, 22 bp, Homo sapiens
caggccggtgattctggatgta

SEQ ID NO: 9382924 - DNA, 22 bp, Homo sapiens
caggccggtgattctggatgta

SEQ ID NO: 9382925 - DNA, 22 bp, Homo sapiens
caggcctcagagagtggcgggg

SEQ ID NO: 9382926 - DNA, 22 bp, Homo sapiens
caggcctcagagagtggcgggg

SEQ ID NO: 9382927 - DNA, 22 bp, Homo sapiens
caggcctcagggctgtccgtag

SEQ ID NO: 9382928 - DNA, 22 bp, Homo sapiens
caggcctcaggggctcaggctg

SEQ ID NO: 9382929 - DNA, 22 bp, Homo sapiens
caggcctcagggctgtccgtag

SEQ ID NO: 9382930 - DNA, 22 bp, Homo sapiens
caggcctcaggggctcaggctg

SEQ ID NO: 9382931 - DNA, 22 bp, Homo sapiens
caggcctcaggggctcaggctg

SEQ ID NO: 9382932 - DNA, 22 bp, Homo sapiens
caggcctcaggggctcaggctg

SEQ ID NO: 9382933 - DNA, 22 bp, Homo sapiens
caggcctcaggggctcaggctg

SEQ ID NO: 9382934 - DNA, 22 bp, Homo sapiens
caggcctcaggggctcaggctg

SEQ ID NO: 9382935 - DNA, 22 bp, Homo sapiens
caggcctccactccacgcagac

SEQ ID NO: 9382936 - DNA, 22 bp, Homo sapiens
caggcctccactccacgcagac

SEQ ID NO: 9382937 - DNA, 22 bp, Homo sapiens
caggcctcatggtgtgtccttc

SEQ ID NO: 9382938 - DNA, 22 bp, Homo sapiens
caggcctcatggtgtgtccttc

SEQ ID NO: 9382939 - DNA, 23 bp, Homo sapiens
agctgggaattttctgaagcttt

SEQ ID NO: 9382940 - DNA, 22 bp, Homo sapiens
agctgggaagagttttctgcag

SEQ ID NO: 9382941 - DNA, 22 bp, Homo sapiens
agctgggaagactggaagacag

SEQ ID NO: 9382942 - DNA, 22 bp, Homo sapiens
agctgggaagagttttctgcag

SEQ ID NO: 9382943 - DNA, 22 bp, Homo sapiens
agctgggaagagttttctgcag

SEQ ID NO: 9382944 - DNA, 22 bp, Homo sapiens
agctggctttgagctgggaggt

SEQ ID NO: 9382945 - DNA, 22 bp, Homo sapiens
agctggcttttgtgaaggtttt

SEQ ID NO: 9382946 - DNA, 22 bp, Homo sapiens
agctggcttttgtgaaggtttt

SEQ ID NO: 9382947 - DNA, 22 bp, Homo sapiens
agctgggaagactggaagacag

SEQ ID NO: 9382948 - DNA, 22 bp, Homo sapiens
agctgggacagacaactatgtt

SEQ ID NO: 9382949 - DNA, 22 bp, Homo sapiens
agctgggactcaactgtctggg

SEQ ID NO: 9382950 - DNA, 21 bp, Homo sapiens
caggccccaggcctggggtgc

SEQ ID NO: 9382951 - DNA, 21 bp, Homo sapiens
caggccgggtgagcaggcagc

SEQ ID NO: 9382952 - DNA, 22 bp, Homo sapiens
agctgttgcagggatcagcacc

SEQ ID NO: 9382953 - DNA, 22 bp, Homo sapiens
agctgtttaaatgacttacttt

SEQ ID NO: 9382954 - DNA, 22 bp, Homo sapiens
agctgttttctaatgcatttga

SEQ ID NO: 9382955 - DNA, 22 bp, Homo sapiens
agctgttttcctggttagagac

SEQ ID NO: 9382956 - DNA, 21 bp, Homo sapiens
agctgtttgaagctatattgg

SEQ ID NO: 9382957 - DNA, 22 bp, Homo sapiens
agcttacagttcaatgacaaag

SEQ ID NO: 9382958 - DNA, 22 bp, Homo sapiens
agcttcttttacagctcatgct

SEQ ID NO: 9382959 - DNA, 22 bp, Homo sapiens
agcttcttaagttcctgcagca

SEQ ID NO: 9382960 - DNA, 22 bp, Homo sapiens
agcttacagttcaatgacaaag

SEQ ID NO: 9382961 - DNA, 22 bp, Homo sapiens
agcttgaattattctgctctta

SEQ ID NO: 9382962 - DNA, 22 bp, Homo sapiens
agcttgacagacagatggtagc

SEQ ID NO: 9382963 - DNA, 22 bp, Homo sapiens
agcttgaaacgtaccaacattg

SEQ ID NO: 9382964 - DNA, 22 bp, Homo sapiens
agcttgaacctaaaacaataat

SEQ ID NO: 9382965 - DNA, 22 bp, Homo sapiens
agcttgaagccttggcgagatt

SEQ ID NO: 9382966 - DNA, 22 bp, Homo sapiens
agcttcttttaccaggaagttg

SEQ ID NO: 9382967 - DNA, 22 bp, Homo sapiens
agcttgtagaaggccacgagca

SEQ ID NO: 9382968 - DNA, 22 bp, Homo sapiens
agcttgtaacagacataaaaat

SEQ ID NO: 9382969 - DNA, 22 bp, Homo sapiens
agcttgctgtattttctggagg

SEQ ID NO: 9382970 - DNA, 22 bp, Homo sapiens
agcttgggcaacacagcaagac

SEQ ID NO: 9382971 - DNA, 17 bp, Homo sapiens
agcttggagcagcatga

SEQ ID NO: 9382972 - DNA, 22 bp, Homo sapiens
cagggccactgtagatgaggag

SEQ ID NO: 9382973 - DNA, 22 bp, Homo sapiens
cagggccagagagggctggctg

SEQ ID NO: 9382974 - DNA, 22 bp, Homo sapiens
cagggccagccatcctgctggg

SEQ ID NO: 9382975 - DNA, 22 bp, Homo sapiens
cagggccagccatcctgctggg

SEQ ID NO: 9382976 - DNA, 22 bp, Homo sapiens
cagggccagccatcctgctggg

SEQ ID NO: 9382977 - DNA, 22 bp, Homo sapiens
cagggccagccgcagcatccac

SEQ ID NO: 9382978 - DNA, 22 bp, Homo sapiens
cagggccagccgcagcatccac

SEQ ID NO: 9382979 - DNA, 22 bp, Homo sapiens
cagggccagcgcccaggcccag

SEQ ID NO: 9382980 - DNA, 22 bp, Homo sapiens
cagggccagccgcagcatccac

SEQ ID NO: 9382981 - DNA, 20 bp, Homo sapiens
aggaaagcctgtgtgagtct

SEQ ID NO: 9382982 - DNA, 21 bp, Homo sapiens
aggaaaggaagtccccagggt

SEQ ID NO: 9382983 - DNA, 21 bp, Homo sapiens
aggaaaggaagtccccagggt

SEQ ID NO: 9382984 - DNA, 21 bp, Homo sapiens
aggaaaggaagtccccagggt

SEQ ID NO: 9382985 - DNA, 22 bp, Homo sapiens
aggaaagcaatggctgagaaca

SEQ ID NO: 9382986 - DNA, 22 bp, Homo sapiens
aggaaagatggaaggaggataa

SEQ ID NO: 9382987 - DNA, 22 bp, Homo sapiens
aggaaagaagtacattctcatg

SEQ ID NO: 9382988 - DNA, 22 bp, Homo sapiens
aggaaagaagtacattctcatg

SEQ ID NO: 9382989 - DNA, 18 bp, Homo sapiens
aggaaagacgaagagggc

SEQ ID NO: 9382990 - DNA, 18 bp, Homo sapiens
aggaaagacgaagagggc

SEQ ID NO: 9382991 - DNA, 22 bp, Homo sapiens
aggaaactaaagcccagagagg

SEQ ID NO: 9382992 - DNA, 22 bp, Homo sapiens
agctttatatgttgtttctcca

SEQ ID NO: 9382993 - DNA, 22 bp, Homo sapiens
agctttatatgttgtttctcca

SEQ ID NO: 9382994 - DNA, 22 bp, Homo sapiens
agctttatagaaaggatcagtg

SEQ ID NO: 9382995 - DNA, 22 bp, Homo sapiens
agctttatataaaagagtacat

SEQ ID NO: 9382996 - DNA, 22 bp, Homo sapiens
agctttatatgttgtttctcca

SEQ ID NO: 9382997 - DNA, 22 bp, Homo sapiens
agctttatataaaagagtacat

SEQ ID NO: 9382998 - DNA, 22 bp, Homo sapiens
agctttatagaaaggatcagtg

SEQ ID NO: 9382999 - DNA, 22 bp, Homo sapiens
agctttagagagccaagactca

SEQ ID NO: 9383000 - DNA, 22 bp, Homo sapiens
agctttaaagcatatttctaag

SEQ ID NO: 9383001 - DNA, 23 bp, Homo sapiens
agctttaaccctttcaggagcat

SEQ ID NO: 9383002 - DNA, 22 bp, Homo sapiens
agctttaaatcaatccagtgag

SEQ ID NO: 9383003 - DNA, 22 bp, Homo sapiens
agctttaaaaatccaatatcca

SEQ ID NO: 9383004 - DNA, 22 bp, Homo sapiens
agcttgtgtttttctaagtatc

SEQ ID NO: 9383005 - DNA, 22 bp, Homo sapiens
agctttaaaaatccaatatcca

SEQ ID NO: 9383006 - DNA, 22 bp, Homo sapiens
aggaacaagggagccttttctc

SEQ ID NO: 9383007 - DNA, 22 bp, Homo sapiens
aggaacacaacttcctgagagc

SEQ ID NO: 9383008 - DNA, 22 bp, Homo sapiens
aggaaatgggaatagatggtat

SEQ ID NO: 9383009 - DNA, 22 bp, Homo sapiens
cagggccagcgcccaggcccag

SEQ ID NO: 9383010 - DNA, 22 bp, Homo sapiens
aggaaaggggtaggtgtggacg

SEQ ID NO: 9383011 - DNA, 22 bp, Homo sapiens
aggaaccagaggttgagcaact

SEQ ID NO: 9383012 - DNA, 23 bp, Homo sapiens
aggaaccttagaattcactgcca

SEQ ID NO: 9383013 - DNA, 22 bp, Homo sapiens
aggaactctgtctccagagttg

SEQ ID NO: 9383014 - DNA, 22 bp, Homo sapiens
aggaactctgtctccagagttg

SEQ ID NO: 9383015 - DNA, 22 bp, Homo sapiens
aggaactagtgcaacaggagcg

SEQ ID NO: 9383016 - DNA, 20 bp, Homo sapiens
aggaactggaagggaggaaa

SEQ ID NO: 9383017 - DNA, 22 bp, Homo sapiens
aggaagcagcccatggatatag

SEQ ID NO: 9383018 - DNA, 18 bp, Homo sapiens
aggaagcaggaggaaggc

SEQ ID NO: 9383019 - DNA, 22 bp, Homo sapiens
aggaactggggctattcaccct

SEQ ID NO: 9383020 - DNA, 22 bp, Homo sapiens
aggaagctctctgcttttaaga

SEQ ID NO: 9383021 - DNA, 22 bp, Homo sapiens
aggaagctcggagagggcaaat

SEQ ID NO: 9383022 - DNA, 22 bp, Homo sapiens
aggaagctcctggagagccagt

SEQ ID NO: 9383023 - DNA, 22 bp, Homo sapiens
aggaagctcaaagccatgatgt

SEQ ID NO: 9383024 - DNA, 22 bp, Homo sapiens
aggaagctcagagaagtctttt

SEQ ID NO: 9383025 - DNA, 22 bp, Homo sapiens
aggaagctccatgaaggcagag

SEQ ID NO: 9383026 - DNA, 22 bp, Homo sapiens
aggaagctcattttgacatatc

SEQ ID NO: 9383027 - DNA, 21 bp, Homo sapiens
aggaggagagcttggcctacc

SEQ ID NO: 9383028 - DNA, 21 bp, Homo sapiens
aggaggagagcttggcctacc

SEQ ID NO: 9383029 - DNA, 21 bp, Homo sapiens
aggaggagagcttggcctacc

SEQ ID NO: 9383030 - DNA, 22 bp, Homo sapiens
aggaggaggctggagtacaccc

SEQ ID NO: 9383031 - DNA, 22 bp, Homo sapiens
aggaggaggctggagtacaccc

SEQ ID NO: 9383032 - DNA, 22 bp, Homo sapiens
aggaggagcagctttttgtctc

SEQ ID NO: 9383033 - DNA, 22 bp, Homo sapiens
aggaggaggctggagtacaccc

SEQ ID NO: 9383034 - DNA, 22 bp, Homo sapiens
aggaggaattgacacagaagcc

SEQ ID NO: 9383035 - DNA, 22 bp, Homo sapiens
aggaggaattgacacagaagcc

SEQ ID NO: 9383036 - DNA, 22 bp, Homo sapiens
aggaggaatacaatccagcagc

SEQ ID NO: 9383037 - DNA, 17 bp, Homo sapiens
aggaggatcagagagta

SEQ ID NO: 9383038 - DNA, 22 bp, Homo sapiens
aggaggcaaaggtctctgataa

SEQ ID NO: 9383039 - DNA, 22 bp, Homo sapiens
aggaggcaactgagatttagaa

SEQ ID NO: 9383040 - DNA, 22 bp, Homo sapiens
aggaggcaactgagatttagaa

SEQ ID NO: 9383041 - DNA, 22 bp, Homo sapiens
aggaggcaaaggtctctgataa

SEQ ID NO: 9383042 - DNA, 20 bp, Homo sapiens
aggaggcaatgtagataagc

SEQ ID NO: 9383043 - DNA, 20 bp, Homo sapiens
aggaggcaatgtagataagc

SEQ ID NO: 9383044 - DNA, 20 bp, Homo sapiens
aggaggcaatgtagataagc

SEQ ID NO: 9383045 - DNA, 22 bp, Homo sapiens
aggaggaggtgggacacagtga

SEQ ID NO: 9383046 - DNA, 22 bp, Homo sapiens
aggaggaggtgggacacagtga

SEQ ID NO: 9383047 - DNA, 22 bp, Homo sapiens
aggaggaggtgggacacagtga

SEQ ID NO: 9383048 - DNA, 22 bp, Homo sapiens
aggaggaggtgggacacagtga

SEQ ID NO: 9383049 - DNA, 22 bp, Homo sapiens
aggagctgagtcagcccgacag

SEQ ID NO: 9383050 - DNA, 22 bp, Homo sapiens
aggagctgagtcagcccgacag

SEQ ID NO: 9383051 - DNA, 22 bp, Homo sapiens
aggagctgataaaagggggtca

SEQ ID NO: 9383052 - DNA, 22 bp, Homo sapiens
aggagctgataaaagggggtca

SEQ ID NO: 9383053 - DNA, 22 bp, Homo sapiens
aggagctgagggagcgcccttg

SEQ ID NO: 9383054 - DNA, 22 bp, Homo sapiens
aggagctgagtcagcccgacag

SEQ ID NO: 9383055 - DNA, 22 bp, Homo sapiens
aggagctgagtcagcccgacag

SEQ ID NO: 9383056 - DNA, 22 bp, Homo sapiens
aggagctgatagtctatggaga

SEQ ID NO: 9383057 - DNA, 22 bp, Homo sapiens
aggagctgataaaagggggtca

SEQ ID NO: 9383058 - DNA, 22 bp, Homo sapiens
aggagctgtgaatgggaggggt

SEQ ID NO: 9383059 - DNA, 22 bp, Homo sapiens
aggagctgtgaatgggaggggt

SEQ ID NO: 9383060 - DNA, 22 bp, Homo sapiens
aggagctgtgaatgggaggggt

SEQ ID NO: 9383061 - DNA, 22 bp, Homo sapiens
aggaggaagggaagacaagtaa

SEQ ID NO: 9383062 - DNA, 22 bp, Homo sapiens
aggagctcttgatgcttgaggg

SEQ ID NO: 9383063 - DNA, 22 bp, Homo sapiens
aggagctctgggcagggcctcc

SEQ ID NO: 9383064 - DNA, 22 bp, Homo sapiens
aggagctgaaacttctcatatg

SEQ ID NO: 9383065 - DNA, 22 bp, Homo sapiens
aggagctgaaacttctcatatg

SEQ ID NO: 9383066 - DNA, 22 bp, Homo sapiens
aggagctgaagtctctgcactc

SEQ ID NO: 9383067 - DNA, 22 bp, Homo sapiens
aggagctgaagtctctgcactc

SEQ ID NO: 9383068 - DNA, 20 bp, Homo sapiens
aggagctgaattagagggtt

SEQ ID NO: 9383069 - DNA, 20 bp, Homo sapiens
aggagctgaattagagggtt

SEQ ID NO: 9383070 - DNA, 20 bp, Homo sapiens
aggagctgaattagagggtt

SEQ ID NO: 9383071 - DNA, 22 bp, Homo sapiens
aggagctgagggagcgcccttg

SEQ ID NO: 9383072 - DNA, 20 bp, Homo sapiens
aggagctgaattagagggtt

SEQ ID NO: 9383073 - DNA, 20 bp, Homo sapiens
aggagctgaattagagggtt

SEQ ID NO: 9383074 - DNA, 20 bp, Homo sapiens
aggagctgaattagagggtt

SEQ ID NO: 9383075 - DNA, 22 bp, Homo sapiens
aggagagagctgagctttgctg

SEQ ID NO: 9383076 - DNA, 22 bp, Homo sapiens
aggagagaggttttaaatgggg

SEQ ID NO: 9383077 - DNA, 22 bp, Homo sapiens
aggagagagctgagctttgctg

SEQ ID NO: 9383078 - DNA, 22 bp, Homo sapiens
aggagagcaggccagccgtccc

SEQ ID NO: 9383079 - DNA, 22 bp, Homo sapiens
aggagagcaggccagccgtccc

SEQ ID NO: 9383080 - DNA, 22 bp, Homo sapiens
aggagagaattactgggtgtca

SEQ ID NO: 9383081 - DNA, 22 bp, Homo sapiens
aggagactcagagacctggccg

SEQ ID NO: 9383082 - DNA, 22 bp, Homo sapiens
aggagagaattactgggtgtca

SEQ ID NO: 9383083 - DNA, 22 bp, Homo sapiens
aggagagaattactgggtgtca

SEQ ID NO: 9383084 - DNA, 22 bp, Homo sapiens
aggagagaattactgggtgtca

SEQ ID NO: 9383085 - DNA, 22 bp, Homo sapiens
aggagaggcatcaagaaaatcg

SEQ ID NO: 9383086 - DNA, 22 bp, Homo sapiens
aggagaggcatcaagaaaatcg

SEQ ID NO: 9383087 - DNA, 22 bp, Homo sapiens
aggagagcaggccagccgtccc

SEQ ID NO: 9383088 - DNA, 22 bp, Homo sapiens
aggagaggaatcattattacaa

SEQ ID NO: 9383089 - DNA, 22 bp, Homo sapiens
aggagaggaatcattattacaa

SEQ ID NO: 9383090 - DNA, 22 bp, Homo sapiens
aggagaggctctaactctgtgt

SEQ ID NO: 9383091 - DNA, 22 bp, Homo sapiens
aggagaggctctaactctgtgt

SEQ ID NO: 9383092 - DNA, 22 bp, Homo sapiens
aggagaggggtaggattaattt

SEQ ID NO: 9383093 - DNA, 22 bp, Homo sapiens
aggagaggggtaggattaattt

SEQ ID NO: 9383094 - DNA, 22 bp, Homo sapiens
aggagaggggtaggattaattt

SEQ ID NO: 9383095 - DNA, 22 bp, Homo sapiens
aggagaggctctaactctgtgt

SEQ ID NO: 9383096 - DNA, 22 bp, Homo sapiens
aggagccatgagcaggaggcaa

SEQ ID NO: 9383097 - DNA, 22 bp, Homo sapiens
aggagagttcacactggtcaga

SEQ ID NO: 9383098 - DNA, 22 bp, Homo sapiens
aggagatcagcctccctgcaac

SEQ ID NO: 9383099 - DNA, 22 bp, Homo sapiens
aggagatagtcaaagcttcttg

SEQ ID NO: 9383100 - DNA, 22 bp, Homo sapiens
aggagcctggctggcccacagg

SEQ ID NO: 9383101 - DNA, 22 bp, Homo sapiens
aggagcctggctggcccacagg

SEQ ID NO: 9383102 - DNA, 22 bp, Homo sapiens
aggagccatgagcaggaggcaa

SEQ ID NO: 9383103 - DNA, 22 bp, Homo sapiens
aggagccatgagcaggaggcaa

SEQ ID NO: 9383104 - DNA, 22 bp, Homo sapiens
aggagaggtctcccttccccag

SEQ ID NO: 9383105 - DNA, 22 bp, Homo sapiens
aggagaggtctcccttccccag

SEQ ID NO: 9383106 - DNA, 22 bp, Homo sapiens
aggagagggtggcattaagttt

SEQ ID NO: 9383107 - DNA, 22 bp, Homo sapiens
aggagagggtggcattaagttt

SEQ ID NO: 9383108 - DNA, 22 bp, Homo sapiens
aggagagtaccattgggccgca

SEQ ID NO: 9383109 - DNA, 19 bp, Homo sapiens
aggagccttgagcagtgag

SEQ ID NO: 9383110 - DNA, 18 bp, Homo sapiens
aggagcctttgcactgga

SEQ ID NO: 9383111 - DNA, 19 bp, Homo sapiens
aggagccttgagcagtgag

SEQ ID NO: 9383112 - DNA, 22 bp, Homo sapiens
aggagctcaaagatgccaggag

SEQ ID NO: 9383113 - DNA, 22 bp, Homo sapiens
aggagctcaaagatgccaggag

SEQ ID NO: 9383114 - DNA, 22 bp, Homo sapiens
aggagctcattgaagtggatga

SEQ ID NO: 9383115 - DNA, 22 bp, Homo sapiens
aggagctccagcccagggaagt

SEQ ID NO: 9383116 - DNA, 21 bp, Homo sapiens
aggagctctccaaggacaaag

SEQ ID NO: 9383117 - DNA, 22 bp, Homo sapiens
aggagctcatgtggctgcctgt

SEQ ID NO: 9383118 - DNA, 23 bp, Homo sapiens
aggagaagagatttccacatgca

SEQ ID NO: 9383119 - DNA, 23 bp, Homo sapiens
aggagaagagatttccacatgca

SEQ ID NO: 9383120 - DNA, 19 bp, Homo sapiens
aggagaagactctctcccc

SEQ ID NO: 9383121 - DNA, 19 bp, Homo sapiens
aggagaagactctctcccc

SEQ ID NO: 9383122 - DNA, 22 bp, Homo sapiens
aggagaagccaagttgtgagca

SEQ ID NO: 9383123 - DNA, 22 bp, Homo sapiens
cagtctctctccttgcaggcgt

SEQ ID NO: 9383124 - DNA, 22 bp, Homo sapiens
cagtctctctccttgcaggcgt

SEQ ID NO: 9383125 - DNA, 22 bp, Homo sapiens
cagtctctggcagctgctggcc

SEQ ID NO: 9383126 - DNA, 22 bp, Homo sapiens
cagtctctcttgtagtgcagct

SEQ ID NO: 9383127 - DNA, 22 bp, Homo sapiens
cagtctctggtgagttgacagt

SEQ ID NO: 9383128 - DNA, 22 bp, Homo sapiens
cagtctctggtgagttgacagt

SEQ ID NO: 9383129 - DNA, 22 bp, Homo sapiens
cagtctctggcagctgctggcc

SEQ ID NO: 9383130 - DNA, 22 bp, Homo sapiens
cagtctctggcagctgctggcc

SEQ ID NO: 9383131 - DNA, 22 bp, Homo sapiens
cagtctctgtcatctcatggga

SEQ ID NO: 9383132 - DNA, 22 bp, Homo sapiens
cagtctctgtgccagatcctgg

SEQ ID NO: 9383133 - DNA, 22 bp, Homo sapiens
cagtctctgtcatctcatggga

SEQ ID NO: 9383134 - DNA, 22 bp, Homo sapiens
cagtctctgtcatctcatggga

SEQ ID NO: 9383135 - DNA, 22 bp, Homo sapiens
cagtctctttatccaccaagcc

SEQ ID NO: 9383136 - DNA, 22 bp, Homo sapiens
cagtctctttatccaccaagcc

SEQ ID NO: 9383137 - DNA, 22 bp, Homo sapiens
cagtctcttttcagctccatcc

SEQ ID NO: 9383138 - DNA, 22 bp, Homo sapiens
cagtctcttgcttcattagttg

SEQ ID NO: 9383139 - DNA, 22 bp, Homo sapiens
cagtctcttgcttcattagttg

SEQ ID NO: 9383140 - DNA, 22 bp, Homo sapiens
aggagaattaggaactcaagat

SEQ ID NO: 9383141 - DNA, 22 bp, Homo sapiens
cagtctcttttcagctccatcc

SEQ ID NO: 9383142 - DNA, 21 bp, Homo sapiens
aggagaaacacaggtcagccc

SEQ ID NO: 9383143 - DNA, 22 bp, Homo sapiens
aggactgacttttgccatgaaa

SEQ ID NO: 9383144 - DNA, 22 bp, Homo sapiens
aggactgacttttgccatgaaa

SEQ ID NO: 9383145 - DNA, 22 bp, Homo sapiens
aggactgacttttgccatgaaa

SEQ ID NO: 9383146 - DNA, 20 bp, Homo sapiens
aggagaaattcgggacacct

SEQ ID NO: 9383147 - DNA, 18 bp, Homo sapiens
aggagaaagggaccaggg

SEQ ID NO: 9383148 - DNA, 18 bp, Homo sapiens
aggagaaagggaccaggg

SEQ ID NO: 9383149 - DNA, 22 bp, Homo sapiens
aggacagcccttgagagcacat

SEQ ID NO: 9383150 - DNA, 21 bp, Homo sapiens
aggacaggaactggctgaata

SEQ ID NO: 9383151 - DNA, 21 bp, Homo sapiens
aggacaggaactggctgaata

SEQ ID NO: 9383152 - DNA, 21 bp, Homo sapiens
aggacaggaactggctgaata

SEQ ID NO: 9383153 - DNA, 21 bp, Homo sapiens
aggacaggaactggctgaata

SEQ ID NO: 9383154 - DNA, 22 bp, Homo sapiens
aggaaggaagagacaccatttg

SEQ ID NO: 9383155 - DNA, 19 bp, Homo sapiens
aggaaggaacctgagtctg

SEQ ID NO: 9383156 - DNA, 22 bp, Homo sapiens
aggaagcttgtgtgtattggtc

SEQ ID NO: 9383157 - DNA, 22 bp, Homo sapiens
aggaagctttatgaccagctaa

SEQ ID NO: 9383158 - DNA, 22 bp, Homo sapiens
aggaaggactgcagcatttggt

SEQ ID NO: 9383159 - DNA, 20 bp, Homo sapiens
aggaaggaagtttgcatgga

SEQ ID NO: 9383160 - DNA, 22 bp, Homo sapiens
aggaaggaagagacaccatttg

SEQ ID NO: 9383161 - DNA, 22 bp, Homo sapiens
aggaagctgctaagaaacaatg

SEQ ID NO: 9383162 - DNA, 22 bp, Homo sapiens
aggaagctgcctgggatgggaa

SEQ ID NO: 9383163 - DNA, 22 bp, Homo sapiens
aggaagctgggaaactgacatt

SEQ ID NO: 9383164 - DNA, 22 bp, Homo sapiens
aggaagctgctggagtagtgtg

SEQ ID NO: 9383165 - DNA, 20 bp, Homo sapiens
aggaagctgagatgtagagg

SEQ ID NO: 9383166 - DNA, 21 bp, Homo sapiens
aggaagctgcccagatagtag

SEQ ID NO: 9383167 - DNA, 22 bp, Homo sapiens
aggaagctgcctgggatgggaa

SEQ ID NO: 9383168 - DNA, 22 bp, Homo sapiens
aggaagctggttacgaagggat

SEQ ID NO: 9383169 - DNA, 22 bp, Homo sapiens
aggaagctggtgtgaggatgaa

SEQ ID NO: 9383170 - DNA, 22 bp, Homo sapiens
aggaagctggggtgttcttcat

SEQ ID NO: 9383171 - DNA, 22 bp, Homo sapiens
aggaagctggtgtgaggatgaa

SEQ ID NO: 9383172 - DNA, 22 bp, Homo sapiens
aggaagcttggggcagggctac

SEQ ID NO: 9383173 - DNA, 23 bp, Homo sapiens
aggaagcttggcaataaggtttg

SEQ ID NO: 9383174 - DNA, 22 bp, Homo sapiens
aggaagcttagtgaaaggacca

SEQ ID NO: 9383175 - DNA, 22 bp, Homo sapiens
aggaagctggttacgaagggat

SEQ ID NO: 9383176 - DNA, 22 bp, Homo sapiens
aggaagcttagatttccagatc

SEQ ID NO: 9383177 - DNA, 20 bp, Homo sapiens
cagtcctgcaggcgggagaa

SEQ ID NO: 9383178 - DNA, 22 bp, Homo sapiens
cagtcctgcccaggctgacaga

SEQ ID NO: 9383179 - DNA, 20 bp, Homo sapiens
cagtcctgcaggcgggagaa

SEQ ID NO: 9383180 - DNA, 22 bp, Homo sapiens
cagtcctgagctcctgggctga

SEQ ID NO: 9383181 - DNA, 22 bp, Homo sapiens
cagtccagtgatttttccagtt

SEQ ID NO: 9383182 - DNA, 22 bp, Homo sapiens
cagtcctctgcaacaccccttc

SEQ ID NO: 9383183 - DNA, 22 bp, Homo sapiens
cagtcctgagccaatcatgatg

SEQ ID NO: 9383184 - DNA, 22 bp, Homo sapiens
cagtcctgaatactggacggtg

SEQ ID NO: 9383185 - DNA, 17 bp, Homo sapiens
cagtcctctgctctaag

SEQ ID NO: 9383186 - DNA, 22 bp, Homo sapiens
cagtcctgggcacagccctggg

SEQ ID NO: 9383187 - DNA, 22 bp, Homo sapiens
cagtcctgctagtgtgaaaagc

SEQ ID NO: 9383188 - DNA, 22 bp, Homo sapiens
cagtcctgggcacagccctggg

SEQ ID NO: 9383189 - DNA, 22 bp, Homo sapiens
cagtcctgggcacagccctggg

SEQ ID NO: 9383190 - DNA, 22 bp, Homo sapiens
aggacagcaaccgttattcaca

SEQ ID NO: 9383191 - DNA, 22 bp, Homo sapiens
aggacagcagtgctggcacttg

SEQ ID NO: 9383192 - DNA, 22 bp, Homo sapiens
catgcagcctgtgaacagtgtc

SEQ ID NO: 9383193 - DNA, 22 bp, Homo sapiens
catgcaggcctatggagcagtg

SEQ ID NO: 9383194 - DNA, 22 bp, Homo sapiens
catgccaggattaggacccagc

SEQ ID NO: 9383195 - DNA, 22 bp, Homo sapiens
catgcaggcctatggagcagtg

SEQ ID NO: 9383196 - DNA, 22 bp, Homo sapiens
catgccagggcttgctgcctgg

SEQ ID NO: 9383197 - DNA, 22 bp, Homo sapiens
catgccaggactctggaggctt

SEQ ID NO: 9383198 - DNA, 21 bp, Homo sapiens
catgcaggatttaacctagaa

SEQ ID NO: 9383199 - DNA, 22 bp, Homo sapiens
catgcaggaggaaaaagcagct

SEQ ID NO: 9383200 - DNA, 22 bp, Homo sapiens
catgcctgtaatcccagcactt

SEQ ID NO: 9383201 - DNA, 22 bp, Homo sapiens
catgcccagagctccgggcgcc

SEQ ID NO: 9383202 - DNA, 17 bp, Homo sapiens
catgccccaggcttagc

SEQ ID NO: 9383203 - DNA, 22 bp, Homo sapiens
catgccaggattaggacccagc

SEQ ID NO: 9383204 - DNA, 22 bp, Homo sapiens
catgccaggtttgagtatcttg

SEQ ID NO: 9383205 - DNA, 22 bp, Homo sapiens
catgccagttttgagatgcacc

SEQ ID NO: 9383206 - DNA, 23 bp, Homo sapiens
catgccagtttgtgcaggcagat

SEQ ID NO: 9383207 - DNA, 22 bp, Homo sapiens
catgccagttttgagatgcacc

SEQ ID NO: 9383208 - DNA, 22 bp, Homo sapiens
catgccatttacttggaggaga

SEQ ID NO: 9383209 - DNA, 22 bp, Homo sapiens
catgccatgtgtgaggagagga

SEQ ID NO: 9383210 - DNA, 22 bp, Homo sapiens
aggcacaggaggtggtaagaag

SEQ ID NO: 9383211 - DNA, 22 bp, Homo sapiens
aggcacaggaggtggtaagaag

SEQ ID NO: 9383212 - DNA, 22 bp, Homo sapiens
aggcacaggaatgtcatccagt

SEQ ID NO: 9383213 - DNA, 22 bp, Homo sapiens
aggcacaggaatgtcatccagt

SEQ ID NO: 9383214 - DNA, 22 bp, Homo sapiens
aggcacaggcctcagcacccag

SEQ ID NO: 9383215 - DNA, 22 bp, Homo sapiens
catggccaggcacgcgcatagc

SEQ ID NO: 9383216 - DNA, 22 bp, Homo sapiens
catggccaggcccagggcccag

SEQ ID NO: 9383217 - DNA, 22 bp, Homo sapiens
catggccagggcagatggcagg

SEQ ID NO: 9383218 - DNA, 22 bp, Homo sapiens
catggccagggcagatggcagg

SEQ ID NO: 9383219 - DNA, 22 bp, Homo sapiens
aggcacaggaacaggaaaagag

SEQ ID NO: 9383220 - DNA, 22 bp, Homo sapiens
aggcacaggaacaggaaaagag

SEQ ID NO: 9383221 - DNA, 22 bp, Homo sapiens
aggcacaggaatgtcatccagt

SEQ ID NO: 9383222 - DNA, 22 bp, Homo sapiens
aggcacagcctcccttcacatg

SEQ ID NO: 9383223 - DNA, 22 bp, Homo sapiens
aggcacagcctcccttcacatg

SEQ ID NO: 9383224 - DNA, 22 bp, Homo sapiens
aggcacagcctcccccaactcc

SEQ ID NO: 9383225 - DNA, 22 bp, Homo sapiens
catgagtgctatatgtgaagag

SEQ ID NO: 9383226 - DNA, 22 bp, Homo sapiens
aggaggtgttgatagaaggttt

SEQ ID NO: 9383227 - DNA, 22 bp, Homo sapiens
aggaggtgttgatagaaggttt

SEQ ID NO: 9383228 - DNA, 22 bp, Homo sapiens
catgcacagagcttggtcattg

SEQ ID NO: 9383229 - DNA, 22 bp, Homo sapiens
catgcacactgcaacaaggact

SEQ ID NO: 9383230 - DNA, 22 bp, Homo sapiens
catgcacactgcaacaaggact

SEQ ID NO: 9383231 - DNA, 22 bp, Homo sapiens
catgcacactgcaacaaggact

SEQ ID NO: 9383232 - DNA, 22 bp, Homo sapiens
catgcacagtgatatctgaaga

SEQ ID NO: 9383233 - DNA, 20 bp, Homo sapiens
catgcacagccatagcgcta

SEQ ID NO: 9383234 - DNA, 22 bp, Homo sapiens
catgcacagtgatatctgaaga

SEQ ID NO: 9383235 - DNA, 22 bp, Homo sapiens
catgcacagtgatatctgaaga

SEQ ID NO: 9383236 - DNA, 22 bp, Homo sapiens
catgcacattattcaaagccca

SEQ ID NO: 9383237 - DNA, 22 bp, Homo sapiens
catgcacatgtggctatgtaat

SEQ ID NO: 9383238 - DNA, 22 bp, Homo sapiens
catgcacatgtggctatgtaat

SEQ ID NO: 9383239 - DNA, 22 bp, Homo sapiens
aggaggtggctgaacttgaggg

SEQ ID NO: 9383240 - DNA, 22 bp, Homo sapiens
aggaggtggcctgagcgtgccc

SEQ ID NO: 9383241 - DNA, 22 bp, Homo sapiens
aggaggtggcctgagcgtgccc

SEQ ID NO: 9383242 - DNA, 22 bp, Homo sapiens
aggaggtggctgaacttgaggg

SEQ ID NO: 9383243 - DNA, 22 bp, Homo sapiens
aggaggtggctgaacttgaggg

SEQ ID NO: 9383244 - DNA, 22 bp, Homo sapiens
aggaggtggctgaacttgaggg

SEQ ID NO: 9383245 - DNA, 22 bp, Homo sapiens
aggaggtgtagatttcctgtca

SEQ ID NO: 9383246 - DNA, 22 bp, Homo sapiens
aggaggtgtagatttcctgtca

SEQ ID NO: 9383247 - DNA, 22 bp, Homo sapiens
aggaggtgctagagaagatgtt

SEQ ID NO: 9383248 - DNA, 22 bp, Homo sapiens
aggaggtgctagagaagatgtt

SEQ ID NO: 9383249 - DNA, 22 bp, Homo sapiens
aggaggtgctagagaagatgtt

SEQ ID NO: 9383250 - DNA, 22 bp, Homo sapiens
aggaggtgctagagaagatgtt

SEQ ID NO: 9383251 - DNA, 22 bp, Homo sapiens
aggaggtgctgtttgtcctgga

SEQ ID NO: 9383252 - DNA, 22 bp, Homo sapiens
aggaggtgctgtttgtcctgga

SEQ ID NO: 9383253 - DNA, 22 bp, Homo sapiens
aggaggtgctgtttgtcctgga

SEQ ID NO: 9383254 - DNA, 22 bp, Homo sapiens
aggaggtggcaactgtcgacag

SEQ ID NO: 9383255 - DNA, 22 bp, Homo sapiens
aggaggtggcctgagcgtgccc

SEQ ID NO: 9383256 - DNA, 22 bp, Homo sapiens
aggaggcactcactctcagggt

SEQ ID NO: 9383257 - DNA, 22 bp, Homo sapiens
aggaggcactcactctcagggt

SEQ ID NO: 9383258 - DNA, 22 bp, Homo sapiens
aggaggcactcactctcagggt

SEQ ID NO: 9383259 - DNA, 22 bp, Homo sapiens
aggaggcactcactctcagggt

SEQ ID NO: 9383260 - DNA, 22 bp, Homo sapiens
aggaggcagatgcttggctgta

SEQ ID NO: 9383261 - DNA, 17 bp, Homo sapiens
catctttaaaatcctga

SEQ ID NO: 9383262 - DNA, 22 bp, Homo sapiens
catgaaagcaggaatggtttta

SEQ ID NO: 9383263 - DNA, 22 bp, Homo sapiens
catgaaatattagtaactgttt

SEQ ID NO: 9383264 - DNA, 22 bp, Homo sapiens
catgaaatgtgttaatctcttg

SEQ ID NO: 9383265 - DNA, 22 bp, Homo sapiens
catgaaattgctcctttggtgc

SEQ ID NO: 9383266 - DNA, 22 bp, Homo sapiens
aggaggtgcgtggtgatcccct

SEQ ID NO: 9383267 - DNA, 22 bp, Homo sapiens
aggcagccacatgagctcctga

SEQ ID NO: 9383268 - DNA, 22 bp, Homo sapiens
aggcagccagatggcagcctgc

SEQ ID NO: 9383269 - DNA, 22 bp, Homo sapiens
aggcagccagatggcagcctgc

SEQ ID NO: 9383270 - DNA, 22 bp, Homo sapiens
aggcagccacatgagctcctga

SEQ ID NO: 9383271 - DNA, 22 bp, Homo sapiens
aggcagccagttcaggtttctt

SEQ ID NO: 9383272 - DNA, 21 bp, Homo sapiens
aggcagccagtcatgctccct

SEQ ID NO: 9383273 - DNA, 21 bp, Homo sapiens
aggcagccagtcatgctccct

SEQ ID NO: 9383274 - DNA, 22 bp, Homo sapiens
aggcagccaatcagaggctgac

SEQ ID NO: 9383275 - DNA, 22 bp, Homo sapiens
aggcagccaatcagaggctgac

SEQ ID NO: 9383276 - DNA, 22 bp, Homo sapiens
aggcagccaaaaagaagtcctc

SEQ ID NO: 9383277 - DNA, 22 bp, Homo sapiens
aggcagcatttgaatccaggtc

SEQ ID NO: 9383278 - DNA, 22 bp, Homo sapiens
aggcagcatttgaatccaggtc

SEQ ID NO: 9383279 - DNA, 19 bp, Homo sapiens
aggcagcattctggggctt

SEQ ID NO: 9383280 - DNA, 22 bp, Homo sapiens
aggcagcatttctgcttatcca

SEQ ID NO: 9383281 - DNA, 22 bp, Homo sapiens
catttacatttaaggttaatat

SEQ ID NO: 9383282 - DNA, 22 bp, Homo sapiens
catttacatttaaggttaatat

SEQ ID NO: 9383283 - DNA, 22 bp, Homo sapiens
aggcagcagtcatgaggaaaga

SEQ ID NO: 9383284 - DNA, 21 bp, Homo sapiens
catttacatgacagattggtt

SEQ ID NO: 9383285 - DNA, 22 bp, Homo sapiens
catttacatttaaggttaatat

SEQ ID NO: 9383286 - DNA, 22 bp, Homo sapiens
aggcagcagcttgctggttgcc

SEQ ID NO: 9383287 - DNA, 18 bp, Homo sapiens
aggcagcagcatcttctc

SEQ ID NO: 9383288 - DNA, 22 bp, Homo sapiens
aggcagcagaggttgaggaaag

SEQ ID NO: 9383289 - DNA, 22 bp, Homo sapiens
aggcagcagactgttaatcaga

SEQ ID NO: 9383290 - DNA, 22 bp, Homo sapiens
catttacataacagtaacgctg

SEQ ID NO: 9383291 - DNA, 22 bp, Homo sapiens
catttacataacagtaacgctg

SEQ ID NO: 9383292 - DNA, 21 bp, Homo sapiens
catttacatgacagattggtt

SEQ ID NO: 9383293 - DNA, 22 bp, Homo sapiens
catttacataacagtaacgctg

SEQ ID NO: 9383294 - DNA, 22 bp, Homo sapiens
catttacagtgagagtttttac

SEQ ID NO: 9383295 - DNA, 22 bp, Homo sapiens
catttacagcagactgatgaaa

SEQ ID NO: 9383296 - DNA, 22 bp, Homo sapiens
catttacagcagactgatgaaa

SEQ ID NO: 9383297 - DNA, 22 bp, Homo sapiens
catttacagcagactgatgaaa

SEQ ID NO: 9383298 - DNA, 22 bp, Homo sapiens
catttacagcagactgatgaaa

SEQ ID NO: 9383299 - DNA, 22 bp, Homo sapiens
catttacagcagactgatgaaa

SEQ ID NO: 9383300 - DNA, 22 bp, Homo sapiens
catttacagtgagagtttttac

SEQ ID NO: 9383301 - DNA, 19 bp, Homo sapiens
aggcagaggcttggctagc

SEQ ID NO: 9383302 - DNA, 19 bp, Homo sapiens
aggcagcacccagtccttg

SEQ ID NO: 9383303 - DNA, 19 bp, Homo sapiens
aggcagcacccagtccttg

SEQ ID NO: 9383304 - DNA, 22 bp, Homo sapiens
cattccgctccccttccttgcg

SEQ ID NO: 9383305 - DNA, 22 bp, Homo sapiens
cattcctattatgtccctagtg

SEQ ID NO: 9383306 - DNA, 22 bp, Homo sapiens
cattcatttgcccagtaagtca

SEQ ID NO: 9383307 - DNA, 22 bp, Homo sapiens
cattcaaagcaggaaaggcctt

SEQ ID NO: 9383308 - DNA, 22 bp, Homo sapiens
cattcccacgtgttctttgctt

SEQ ID NO: 9383309 - DNA, 22 bp, Homo sapiens
cattcccatgactcctgctcag

SEQ ID NO: 9383310 - DNA, 22 bp, Homo sapiens
cattccagctctcatactctgg

SEQ ID NO: 9383311 - DNA, 22 bp, Homo sapiens
cattccagagctgcctctgcta

SEQ ID NO: 9383312 - DNA, 22 bp, Homo sapiens
cattccaagtatatacatgata

SEQ ID NO: 9383313 - DNA, 22 bp, Homo sapiens
cattccacactgcaggaaatat

SEQ ID NO: 9383314 - DNA, 22 bp, Homo sapiens
catggcctgcctcctcctggtg

SEQ ID NO: 9383315 - DNA, 22 bp, Homo sapiens
catggcctctctcctggaatgg

SEQ ID NO: 9383316 - DNA, 22 bp, Homo sapiens
catggcctgcctcctcctggtg

SEQ ID NO: 9383317 - DNA, 22 bp, Homo sapiens
catggcctcaaaggactgcaga

SEQ ID NO: 9383318 - DNA, 22 bp, Homo sapiens
catggccctcttctggagcaat

SEQ ID NO: 9383319 - DNA, 22 bp, Homo sapiens
catggccccaaatcccatgcat

SEQ ID NO: 9383320 - DNA, 22 bp, Homo sapiens
catggctcacaggatgggctag

SEQ ID NO: 9383321 - DNA, 22 bp, Homo sapiens
catggctcggggacaggaggta

SEQ ID NO: 9383322 - DNA, 22 bp, Homo sapiens
catggctcggggacaggaggta

SEQ ID NO: 9383323 - DNA, 22 bp, Homo sapiens
catggccttgagtgactgcact

SEQ ID NO: 9383324 - DNA, 22 bp, Homo sapiens
catggcggtcaggatgtaggtg

SEQ ID NO: 9383325 - DNA, 22 bp, Homo sapiens
cattatggcagccaggatattg

SEQ ID NO: 9383326 - DNA, 20 bp, Homo sapiens
cattatggttgggcacagtg

SEQ ID NO: 9383327 - DNA, 22 bp, Homo sapiens
cattatgtgggaaaatgttctt

SEQ ID NO: 9383328 - DNA, 22 bp, Homo sapiens
cattatgtgcgtacatgtatct

SEQ ID NO: 9383329 - DNA, 22 bp, Homo sapiens
cattatgttcagtagcttaaaa

SEQ ID NO: 9383330 - DNA, 22 bp, Homo sapiens
atactctttatgacattccagc

SEQ ID NO: 9383331 - DNA, 22 bp, Homo sapiens
atacttatgataaataattgct

SEQ ID NO: 9383332 - DNA, 22 bp, Homo sapiens
atacttatgataaataattgct

SEQ ID NO: 9383333 - DNA, 22 bp, Homo sapiens
ctggagtgatactcagaatgtg

SEQ ID NO: 9383334 - DNA, 22 bp, Homo sapiens
ctggagtgaggtctgggagcct

SEQ ID NO: 9383335 - DNA, 22 bp, Homo sapiens
ctggagtgaggtctgggagcct

SEQ ID NO: 9383336 - DNA, 22 bp, Homo sapiens
ctggagtgaggtctgggagcct

SEQ ID NO: 9383337 - DNA, 22 bp, Homo sapiens
ctggagtgaggtctgggagcct

SEQ ID NO: 9383338 - DNA, 22 bp, Homo sapiens
ctggagtgactttgttcctttt

SEQ ID NO: 9383339 - DNA, 22 bp, Homo sapiens
ctggagtgactttgttcctttt

SEQ ID NO: 9383340 - DNA, 22 bp, Homo sapiens
ctggagtgcaatgaacaaggtc

SEQ ID NO: 9383341 - DNA, 22 bp, Homo sapiens
ctggagtgcaacctctgcctcc

SEQ ID NO: 9383342 - DNA, 22 bp, Homo sapiens
ctggagtgcaacctctgcctcc

SEQ ID NO: 9383343 - DNA, 22 bp, Homo sapiens
ctggagtgatactcagaatgtg

SEQ ID NO: 9383344 - DNA, 22 bp, Homo sapiens
ctggagtgatactcagaatgtg

SEQ ID NO: 9383345 - DNA, 21 bp, Homo sapiens
ctggagtctgggggtggcagt

SEQ ID NO: 9383346 - DNA, 22 bp, Homo sapiens
ctggagtgaagcttatttttca

SEQ ID NO: 9383347 - DNA, 22 bp, Homo sapiens
ctggagtgaggtctgggagcct

SEQ ID NO: 9383348 - DNA, 22 bp, Homo sapiens
ctggagtgaggtctgggagcct

SEQ ID NO: 9383349 - DNA, 22 bp, Homo sapiens
ctggagtgaagtctggcagctt

SEQ ID NO: 9383350 - DNA, 22 bp, Homo sapiens
ctggagtgaagtctggcagctt

SEQ ID NO: 9383351 - DNA, 22 bp, Homo sapiens
ctggagtgaagtctggcagctt

SEQ ID NO: 9383352 - DNA, 22 bp, Homo sapiens
ctggagtgaagtctggcagctt

SEQ ID NO: 9383353 - DNA, 22 bp, Homo sapiens
ctggagtgaagtctggcagctt

SEQ ID NO: 9383354 - DNA, 22 bp, Homo sapiens
ctggagtgaagtctggcagctt

SEQ ID NO: 9383355 - DNA, 22 bp, Homo sapiens
ctggagggctgcagcgaggctg

SEQ ID NO: 9383356 - DNA, 22 bp, Homo sapiens
ctggagggctgcagcgaggctg

SEQ ID NO: 9383357 - DNA, 22 bp, Homo sapiens
ctggagggctgcagcgaggctg

SEQ ID NO: 9383358 - DNA, 22 bp, Homo sapiens
ctggagggctgcagcgaggctg

SEQ ID NO: 9383359 - DNA, 22 bp, Homo sapiens
ctggagggctgcagcgaggctg

SEQ ID NO: 9383360 - DNA, 22 bp, Homo sapiens
ctggcagcgtgagcagcatcca

SEQ ID NO: 9383361 - DNA, 22 bp, Homo sapiens
ctggcagcggtttgcagcctgg

SEQ ID NO: 9383362 - DNA, 22 bp, Homo sapiens
ctggcagcggtttgcagcctgg

SEQ ID NO: 9383363 - DNA, 22 bp, Homo sapiens
ctggcagcggtttgcagcctgg

SEQ ID NO: 9383364 - DNA, 22 bp, Homo sapiens
atactttagagctagattgcct

SEQ ID NO: 9383365 - DNA, 19 bp, Homo sapiens
ctggcagcctgtctgtgtc

SEQ ID NO: 9383366 - DNA, 19 bp, Homo sapiens
ctggcagcctgtctgtgtc

SEQ ID NO: 9383367 - DNA, 22 bp, Homo sapiens
ctggcagcgcagcatgaagtcg

SEQ ID NO: 9383368 - DNA, 22 bp, Homo sapiens
ctggcagcgtgtttatgaacat

SEQ ID NO: 9383369 - DNA, 22 bp, Homo sapiens
ctggcagctctactcagagcct

SEQ ID NO: 9383370 - DNA, 22 bp, Homo sapiens
ctggcagctctactcagagcct

SEQ ID NO: 9383371 - DNA, 22 bp, Homo sapiens
ctggcagcgtgagcagcatcca

SEQ ID NO: 9383372 - DNA, 22 bp, Homo sapiens
ctggcagctctgagtcccttct

SEQ ID NO: 9383373 - DNA, 22 bp, Homo sapiens
ctggcagctgcccgagatgccc

SEQ ID NO: 9383374 - DNA, 22 bp, Homo sapiens
atacttctagaaatactatgca

SEQ ID NO: 9383375 - DNA, 22 bp, Homo sapiens
atacttctttagcatattgaac

SEQ ID NO: 9383376 - DNA, 22 bp, Homo sapiens
atacttctttgatgttcacagg

SEQ ID NO: 9383377 - DNA, 22 bp, Homo sapiens
atactttagagctagattgcct

SEQ ID NO: 9383378 - DNA, 22 bp, Homo sapiens
atactttaacgtggcgaacctt

SEQ ID NO: 9383379 - DNA, 22 bp, Homo sapiens
atactttagagctagattgcct

SEQ ID NO: 9383380 - DNA, 22 bp, Homo sapiens
atacagagcagtaatagaggag

SEQ ID NO: 9383381 - DNA, 22 bp, Homo sapiens
atacagaattcactacagtttc

SEQ ID NO: 9383382 - DNA, 22 bp, Homo sapiens
atacagaattcactacagtttc

SEQ ID NO: 9383383 - DNA, 22 bp, Homo sapiens
atacagagggtttcatgggcag

SEQ ID NO: 9383384 - DNA, 22 bp, Homo sapiens
atacagatgcttgctcgtgact

SEQ ID NO: 9383385 - DNA, 22 bp, Homo sapiens
atacagatgagatcaggcataa

SEQ ID NO: 9383386 - DNA, 22 bp, Homo sapiens
atacagatcccacagcatgtga

SEQ ID NO: 9383387 - DNA, 22 bp, Homo sapiens
ctggaggaaaacaactgcagac

SEQ ID NO: 9383388 - DNA, 22 bp, Homo sapiens
ctggaggaaaacaactgcagac

SEQ ID NO: 9383389 - DNA, 22 bp, Homo sapiens
ctggaggaaaacaactgcagac

SEQ ID NO: 9383390 - DNA, 22 bp, Homo sapiens
ctggagggagattcaaaggagg

SEQ ID NO: 9383391 - DNA, 22 bp, Homo sapiens
ctggaggaaaacaactgcagac

SEQ ID NO: 9383392 - DNA, 22 bp, Homo sapiens
ctggagggagattcaaaggagg

SEQ ID NO: 9383393 - DNA, 22 bp, Homo sapiens
ctggagggagattcaaaggagg

SEQ ID NO: 9383394 - DNA, 22 bp, Homo sapiens
ctggagggagattcaaaggagg

SEQ ID NO: 9383395 - DNA, 22 bp, Homo sapiens
ctggagggagttaggacccgga

SEQ ID NO: 9383396 - DNA, 22 bp, Homo sapiens
ctggagggagttaggacccgga

SEQ ID NO: 9383397 - DNA, 22 bp, Homo sapiens
ctggagggatgtagggtgtatt

SEQ ID NO: 9383398 - DNA, 22 bp, Homo sapiens
ctggagggatgtagggtgtatt

SEQ ID NO: 9383399 - DNA, 22 bp, Homo sapiens
ctggagggatgtagggtgtatt

SEQ ID NO: 9383400 - DNA, 22 bp, Homo sapiens
ctggagggaggaggctgctatt

SEQ ID NO: 9383401 - DNA, 22 bp, Homo sapiens
ctggagggaggaggctgctatt

SEQ ID NO: 9383402 - DNA, 22 bp, Homo sapiens
ctggagggaggaggctgctatt

SEQ ID NO: 9383403 - DNA, 22 bp, Homo sapiens
ctggagccatgtatagcctatg

SEQ ID NO: 9383404 - DNA, 22 bp, Homo sapiens
ctggagccagccagggccctct

SEQ ID NO: 9383405 - DNA, 22 bp, Homo sapiens
ctggagccatgtatagcctatg

SEQ ID NO: 9383406 - DNA, 22 bp, Homo sapiens
ctggagcccaggcctggtgtct

SEQ ID NO: 9383407 - DNA, 22 bp, Homo sapiens
ctggagccatgtcttgactgct

SEQ ID NO: 9383408 - DNA, 22 bp, Homo sapiens
ctggagcccaggcctggtgtct

SEQ ID NO: 9383409 - DNA, 22 bp, Homo sapiens
ctggagcccaggcctggtgtct

SEQ ID NO: 9383410 - DNA, 22 bp, Homo sapiens
ctggagccccagacagggagag

SEQ ID NO: 9383411 - DNA, 22 bp, Homo sapiens
ctggagccccagacagggagag

SEQ ID NO: 9383412 - DNA, 22 bp, Homo sapiens
ctggagccccaggctgtgcaga

SEQ ID NO: 9383413 - DNA, 22 bp, Homo sapiens
atacagaattcactacagtttc

SEQ ID NO: 9383414 - DNA, 22 bp, Homo sapiens
atacagaatactaattcctgag

SEQ ID NO: 9383415 - DNA, 22 bp, Homo sapiens
atacagaatactaattcctgag

SEQ ID NO: 9383416 - DNA, 17 bp, Homo sapiens
ctggagccaagagggcc

SEQ ID NO: 9383417 - DNA, 22 bp, Homo sapiens
ctggagccactgggtcttgtat

SEQ ID NO: 9383418 - DNA, 22 bp, Homo sapiens
ctggagccactttttatccttt

SEQ ID NO: 9383419 - DNA, 22 bp, Homo sapiens
ctggagagaccgaaagaggctg

SEQ ID NO: 9383420 - DNA, 22 bp, Homo sapiens
atacaagtggccacttgaattc

SEQ ID NO: 9383421 - DNA, 22 bp, Homo sapiens
atacaagtgctgaccctgggat

SEQ ID NO: 9383422 - DNA, 22 bp, Homo sapiens
atacaagtgttgtgcctcatca

SEQ ID NO: 9383423 - DNA, 22 bp, Homo sapiens
atacaagttaaatgcagtgccc

SEQ ID NO: 9383424 - DNA, 22 bp, Homo sapiens
ctgctctggcgtactcggcatc

SEQ ID NO: 9383425 - DNA, 22 bp, Homo sapiens
ctgctctggggaagccagatgt

SEQ ID NO: 9383426 - DNA, 22 bp, Homo sapiens
ctgctctgagaggctcttccta

SEQ ID NO: 9383427 - DNA, 22 bp, Homo sapiens
ctgctctgcaaggcacagtgat

SEQ ID NO: 9383428 - DNA, 22 bp, Homo sapiens
ctgctctgctgatcagtgtctc

SEQ ID NO: 9383429 - DNA, 22 bp, Homo sapiens
ctgctctgcagcttggactccc

SEQ ID NO: 9383430 - DNA, 22 bp, Homo sapiens
ctgctctggcgtactcggcatc

SEQ ID NO: 9383431 - DNA, 22 bp, Homo sapiens
ctgcccaccccgaggcaggaag

SEQ ID NO: 9383432 - DNA, 22 bp, Homo sapiens
ctgcccacagttctctgccatg

SEQ ID NO: 9383433 - DNA, 22 bp, Homo sapiens
ataaatctattggacatgtgtg

SEQ ID NO: 9383434 - DNA, 22 bp, Homo sapiens
ataaatcagttagtgccccact

SEQ ID NO: 9383435 - DNA, 22 bp, Homo sapiens
ataaatcagttagtgccccact

SEQ ID NO: 9383436 - DNA, 22 bp, Homo sapiens
ataaatatcactgttgtccctc

SEQ ID NO: 9383437 - DNA, 22 bp, Homo sapiens
ataaatatcactgttgtccctc

SEQ ID NO: 9383438 - DNA, 22 bp, Homo sapiens
ataaatatcactgttgtccctc

SEQ ID NO: 9383439 - DNA, 22 bp, Homo sapiens
ataaatatcactgttgtccctc

SEQ ID NO: 9383440 - DNA, 22 bp, Homo sapiens
ctgctcatcagccgagcagggc

SEQ ID NO: 9383441 - DNA, 22 bp, Homo sapiens
ctgctcagtcatgttggattgt

SEQ ID NO: 9383442 - DNA, 22 bp, Homo sapiens
ctgcccagaagccagatgggca

SEQ ID NO: 9383443 - DNA, 22 bp, Homo sapiens
ctgcccagaagcttagagctta

SEQ ID NO: 9383444 - DNA, 20 bp, Homo sapiens
atacaagatgagtaatttct

SEQ ID NO: 9383445 - DNA, 18 bp, Homo sapiens
atacaagctctgttactt

SEQ ID NO: 9383446 - DNA, 22 bp, Homo sapiens
atacaagtcaatccatgtgatt

SEQ ID NO: 9383447 - DNA, 22 bp, Homo sapiens
atacaagtgatataattgtttc

SEQ ID NO: 9383448 - DNA, 22 bp, Homo sapiens
atacaagtgatataattgtttc

SEQ ID NO: 9383449 - DNA, 22 bp, Homo sapiens
atacaagtgagaaaactgaaga

SEQ ID NO: 9383450 - DNA, 19 bp, Homo sapiens
atacaagagagcagttgag

SEQ ID NO: 9383451 - DNA, 22 bp, Homo sapiens
atacaagactcagcacagacgg

SEQ ID NO: 9383452 - DNA, 22 bp, Homo sapiens
ctgctttaactctgggaagcca

SEQ ID NO: 9383453 - DNA, 22 bp, Homo sapiens
ctgcttgtcttcgaggggtgca

SEQ ID NO: 9383454 - DNA, 19 bp, Homo sapiens
atacaagactagcatttac

SEQ ID NO: 9383455 - DNA, 19 bp, Homo sapiens
atacaagactagcatttac

SEQ ID NO: 9383456 - DNA, 22 bp, Homo sapiens
ctgctttaatgtaagatatacc

SEQ ID NO: 9383457 - DNA, 18 bp, Homo sapiens
ctgcttctgtctgccagt

SEQ ID NO: 9383458 - DNA, 22 bp, Homo sapiens
ctgcttctccaaagtaggactt

SEQ ID NO: 9383459 - DNA, 22 bp, Homo sapiens
ctgcttctccaaagtaggactt

SEQ ID NO: 9383460 - DNA, 22 bp, Homo sapiens
ctgctgtgtgcttacttgggtt

SEQ ID NO: 9383461 - DNA, 22 bp, Homo sapiens
ctgcttctagcaccaagtccct

SEQ ID NO: 9383462 - DNA, 22 bp, Homo sapiens
ctgctgtgtgaccatggacagg

SEQ ID NO: 9383463 - DNA, 17 bp, Homo sapiens
ctgcttggcctctgggg

SEQ ID NO: 9383464 - DNA, 22 bp, Homo sapiens
ctgcttggcattggtaaagaat

SEQ ID NO: 9383465 - DNA, 22 bp, Homo sapiens
ctgcttgggtcctggcatgggt

SEQ ID NO: 9383466 - DNA, 18 bp, Homo sapiens
ctgcttgggagacgtcag

SEQ ID NO: 9383467 - DNA, 20 bp, Homo sapiens
ctgcttgggcccctctggcc

SEQ ID NO: 9383468 - DNA, 20 bp, Homo sapiens
ctgcttgggacactgccaga

SEQ ID NO: 9383469 - DNA, 22 bp, Homo sapiens
ataatatttgcattactgtgat

SEQ ID NO: 9383470 - DNA, 22 bp, Homo sapiens
ataatataatcctacttcccat

SEQ ID NO: 9383471 - DNA, 22 bp, Homo sapiens
ataatattgaagagccttggcc

SEQ ID NO: 9383472 - DNA, 18 bp, Homo sapiens
ctgctgtgtcgtctgggc

SEQ ID NO: 9383473 - DNA, 22 bp, Homo sapiens
ctgctgtgtgaccatggacagg

SEQ ID NO: 9383474 - DNA, 22 bp, Homo sapiens
ctgccaggcagcagagggagaa

SEQ ID NO: 9383475 - DNA, 22 bp, Homo sapiens
ctgccaggcactgggctctgca

SEQ ID NO: 9383476 - DNA, 22 bp, Homo sapiens
ctgccaggcactgggctctgca

SEQ ID NO: 9383477 - DNA, 22 bp, Homo sapiens
ctgccaggcacgtgcagcatca

SEQ ID NO: 9383478 - DNA, 22 bp, Homo sapiens
ctgccaggcactgggctctgca

SEQ ID NO: 9383479 - DNA, 22 bp, Homo sapiens
ctgccaggcacgtgcagcatca

SEQ ID NO: 9383480 - DNA, 22 bp, Homo sapiens
ctgccaggcacgtgcagcatca

SEQ ID NO: 9383481 - DNA, 21 bp, Homo sapiens
ctgccaggatagcatgcaggc

SEQ ID NO: 9383482 - DNA, 22 bp, Homo sapiens
ctgccaggactgacgtcttcag

SEQ ID NO: 9383483 - DNA, 22 bp, Homo sapiens
ctgcatttcacatttaaacttt

SEQ ID NO: 9383484 - DNA, 22 bp, Homo sapiens
ctgcatttcacatttaaacttt

SEQ ID NO: 9383485 - DNA, 22 bp, Homo sapiens
ctgccaggactgacgtcttcag

SEQ ID NO: 9383486 - DNA, 22 bp, Homo sapiens
ctgcatttccacctggccacag

SEQ ID NO: 9383487 - DNA, 22 bp, Homo sapiens
ctgccaggcagggagatggctg

SEQ ID NO: 9383488 - DNA, 22 bp, Homo sapiens
ctgccaggcagggagatggctg

SEQ ID NO: 9383489 - DNA, 22 bp, Homo sapiens
ctgccaggcagggagatggctg

SEQ ID NO: 9383490 - DNA, 22 bp, Homo sapiens
ctgccaggcagggagatggctg

SEQ ID NO: 9383491 - DNA, 22 bp, Homo sapiens
ctgccaggcctcatcccagcca

SEQ ID NO: 9383492 - DNA, 22 bp, Homo sapiens
ataaaaggaaagcctgttgtga

SEQ ID NO: 9383493 - DNA, 22 bp, Homo sapiens
ataaaagtaggaccaacttaca

SEQ ID NO: 9383494 - DNA, 20 bp, Homo sapiens
ataaaataactgccacaaga

SEQ ID NO: 9383495 - DNA, 20 bp, Homo sapiens
ataaaataactgccacaaga

SEQ ID NO: 9383496 - DNA, 20 bp, Homo sapiens
ataaaataactgccacaaga

SEQ ID NO: 9383497 - DNA, 22 bp, Homo sapiens
ataaaagttcaagagagtacag

SEQ ID NO: 9383498 - DNA, 22 bp, Homo sapiens
ataaaagtttccaatcatgcct

SEQ ID NO: 9383499 - DNA, 22 bp, Homo sapiens
ataaatatcactgttgtccctc

SEQ ID NO: 9383500 - DNA, 22 bp, Homo sapiens
ataaatagtgtgtcataaagtc

SEQ ID NO: 9383501 - DNA, 22 bp, Homo sapiens
ataaatatcactgttgtccctc

SEQ ID NO: 9383502 - DNA, 22 bp, Homo sapiens
ataaatagtgctgccatgagta

SEQ ID NO: 9383503 - DNA, 22 bp, Homo sapiens
ataaatagtgaagggagccggt

SEQ ID NO: 9383504 - DNA, 22 bp, Homo sapiens
ataaaggataatccattagact

SEQ ID NO: 9383505 - DNA, 22 bp, Homo sapiens
ataaaggataatccattagact

SEQ ID NO: 9383506 - DNA, 17 bp, Homo sapiens
ctgcagctggagggcca

SEQ ID NO: 9383507 - DNA, 22 bp, Homo sapiens
ctgcagctggagcatcttctca

SEQ ID NO: 9383508 - DNA, 22 bp, Homo sapiens
ctgcagctgctcatgttacttg

SEQ ID NO: 9383509 - DNA, 22 bp, Homo sapiens
ctgcagctgctcatgttacttg

SEQ ID NO: 9383510 - DNA, 22 bp, Homo sapiens
ctgcagctgctcatgttacttg

SEQ ID NO: 9383511 - DNA, 22 bp, Homo sapiens
ctgcagctgcgggaccggagcg

SEQ ID NO: 9383512 - DNA, 22 bp, Homo sapiens
ctgcagctgcagttctgagaga

SEQ ID NO: 9383513 - DNA, 22 bp, Homo sapiens
ctgcagctgccagtgatttcag

SEQ ID NO: 9383514 - DNA, 22 bp, Homo sapiens
ctgcagctgcagttctgagaga

SEQ ID NO: 9383515 - DNA, 22 bp, Homo sapiens
ctgcagctgcagttctgagaga

SEQ ID NO: 9383516 - DNA, 19 bp, Homo sapiens
ctgcagctgcaccatccca

SEQ ID NO: 9383517 - DNA, 22 bp, Homo sapiens
ctgcagctctagcttttgacct

SEQ ID NO: 9383518 - DNA, 22 bp, Homo sapiens
ctgcagctggctcatgggatat

SEQ ID NO: 9383519 - DNA, 20 bp, Homo sapiens
agtttgagaggaagtcagtg

SEQ ID NO: 9383520 - DNA, 21 bp, Homo sapiens
agtttgatgcaatttctgaga

SEQ ID NO: 9383521 - DNA, 19 bp, Homo sapiens
agtttgaggaagttaagaa

SEQ ID NO: 9383522 - DNA, 22 bp, Homo sapiens
agtttgatctgacagattttaa

SEQ ID NO: 9383523 - DNA, 22 bp, Homo sapiens
agtttgattgtatgggttttaa

SEQ ID NO: 9383524 - DNA, 22 bp, Homo sapiens
agtttgtaaacttgagctagcc

SEQ ID NO: 9383525 - DNA, 22 bp, Homo sapiens
agtttgtaaaatgtggcctgga

SEQ ID NO: 9383526 - DNA, 22 bp, Homo sapiens
agtttaaatcatgttttgtaac

SEQ ID NO: 9383527 - DNA, 22 bp, Homo sapiens
agtttaactttggaaaactata

SEQ ID NO: 9383528 - DNA, 22 bp, Homo sapiens
agtttaaatcatgttttgtaac

SEQ ID NO: 9383529 - DNA, 22 bp, Homo sapiens
agttgttgatgttgcagtcctg

SEQ ID NO: 9383530 - DNA, 22 bp, Homo sapiens
agttgtcacctctattcaaatc

SEQ ID NO: 9383531 - DNA, 22 bp, Homo sapiens
agtttaatatccttcaactttc

SEQ ID NO: 9383532 - DNA, 22 bp, Homo sapiens
agtttaatcctccagcccaact

SEQ ID NO: 9383533 - DNA, 22 bp, Homo sapiens
agtttacaaagtttcactgttc

SEQ ID NO: 9383534 - DNA, 22 bp, Homo sapiens
agtttacaaagtttcactgttc

SEQ ID NO: 9383535 - DNA, 22 bp, Homo sapiens
agtttaattggaggcgtggctc

SEQ ID NO: 9383536 - DNA, 22 bp, Homo sapiens
ctgcagcgagacatagaggatg

SEQ ID NO: 9383537 - DNA, 22 bp, Homo sapiens
ctgcagcctcctggggtacatg

SEQ ID NO: 9383538 - DNA, 22 bp, Homo sapiens
ctgcagctcctctctgtgcccc

SEQ ID NO: 9383539 - DNA, 22 bp, Homo sapiens
ctgcagctcctctctgtgcccc

SEQ ID NO: 9383540 - DNA, 22 bp, Homo sapiens
ctgcagctcccctgagatcaag

SEQ ID NO: 9383541 - DNA, 22 bp, Homo sapiens
ctgcagctaaggaatgtggttg

SEQ ID NO: 9383542 - DNA, 22 bp, Homo sapiens
ctgcagctatattttcccacag

SEQ ID NO: 9383543 - DNA, 22 bp, Homo sapiens
ctgcagctcccctgagatcaag

SEQ ID NO: 9383544 - DNA, 22 bp, Homo sapiens
ctgcagctccttctggcatgtg

SEQ ID NO: 9383545 - DNA, 22 bp, Homo sapiens
ctgcagctccttctggcatgtg

SEQ ID NO: 9383546 - DNA, 22 bp, Homo sapiens
ctgcagctcctgagctcagaga

SEQ ID NO: 9383547 - DNA, 22 bp, Homo sapiens
ctgcagctcctgagctcagaga

SEQ ID NO: 9383548 - DNA, 22 bp, Homo sapiens
agttgctctaggtgaggtcttt

SEQ ID NO: 9383549 - DNA, 22 bp, Homo sapiens
agttggcaaggtctggccagcg

SEQ ID NO: 9383550 - DNA, 22 bp, Homo sapiens
agttgcttctcaggaaaggagc

SEQ ID NO: 9383551 - DNA, 22 bp, Homo sapiens
agttggaagacaccctgaaatc

SEQ ID NO: 9383552 - DNA, 22 bp, Homo sapiens
agttgggaagtatttttagtgg

SEQ ID NO: 9383553 - DNA, 22 bp, Homo sapiens
agttgggacatgttctttcccc

SEQ ID NO: 9383554 - DNA, 23 bp, Homo sapiens
agttggcatattcaagcacagtc

SEQ ID NO: 9383555 - DNA, 19 bp, Homo sapiens
agttggggcagggaagaga

SEQ ID NO: 9383556 - DNA, 19 bp, Homo sapiens
agttggggcagggaagaga

SEQ ID NO: 9383557 - DNA, 22 bp, Homo sapiens
agttgggagttatagactctat

SEQ ID NO: 9383558 - DNA, 22 bp, Homo sapiens
agttgggattcttggttctggg

SEQ ID NO: 9383559 - DNA, 22 bp, Homo sapiens
ctgaggcaggagaattgctgga

SEQ ID NO: 9383560 - DNA, 22 bp, Homo sapiens
ctgaggcaggcagatcacttga

SEQ ID NO: 9383561 - DNA, 22 bp, Homo sapiens
ctgaggcaggcagatcacttga

SEQ ID NO: 9383562 - DNA, 22 bp, Homo sapiens
ctgaggcaggatggcctggctg

SEQ ID NO: 9383563 - DNA, 22 bp, Homo sapiens
ctgaggcaggggcagctggaga

SEQ ID NO: 9383564 - DNA, 22 bp, Homo sapiens
ctgaggcaggggcagctggaga

SEQ ID NO: 9383565 - DNA, 22 bp, Homo sapiens
ctgaggcaggagaattgctgga

SEQ ID NO: 9383566 - DNA, 22 bp, Homo sapiens
ctgaggcaggagagttgcttga

SEQ ID NO: 9383567 - DNA, 22 bp, Homo sapiens
ctgaggcaggagagttgcttga

SEQ ID NO: 9383568 - DNA, 22 bp, Homo sapiens
ctgaggcaggatggcctggctg

SEQ ID NO: 9383569 - DNA, 22 bp, Homo sapiens
ctgaggcatgaatgtgggcttt

SEQ ID NO: 9383570 - DNA, 21 bp, Homo sapiens
ctgaggcatgcaggcctgggc

SEQ ID NO: 9383571 - DNA, 21 bp, Homo sapiens
ctgaggcatgcaggcctgggc

SEQ ID NO: 9383572 - DNA, 22 bp, Homo sapiens
ctgaggcctaagacatgaatga

SEQ ID NO: 9383573 - DNA, 22 bp, Homo sapiens
ctgaggcctcactgtagtccct

SEQ ID NO: 9383574 - DNA, 22 bp, Homo sapiens
ctgaggcctcactgtagtccct

SEQ ID NO: 9383575 - DNA, 22 bp, Homo sapiens
ctgaggcagtttaatttttgaa

SEQ ID NO: 9383576 - DNA, 22 bp, Homo sapiens
ctgaggcagtttaatttttgaa

SEQ ID NO: 9383577 - DNA, 22 bp, Homo sapiens
ctgaggcatcatggagaacagt

SEQ ID NO: 9383578 - DNA, 22 bp, Homo sapiens
ctgaggcatgaatgtgggcttt

SEQ ID NO: 9383579 - DNA, 22 bp, Homo sapiens
ctgaggcatcatggagaacagt

SEQ ID NO: 9383580 - DNA, 22 bp, Homo sapiens
ctgaggcatcatggagaacagt

SEQ ID NO: 9383581 - DNA, 22 bp, Homo sapiens
ctgaggcatgaatgtgggcttt

SEQ ID NO: 9383582 - DNA, 22 bp, Homo sapiens
ctgaggcatgaatgtgggcttt

SEQ ID NO: 9383583 - DNA, 22 bp, Homo sapiens
ctgaggctgggctgagggtata

SEQ ID NO: 9383584 - DNA, 22 bp, Homo sapiens
ctgaggctgggctgagggtata

SEQ ID NO: 9383585 - DNA, 23 bp, Homo sapiens
ctgaggcctgctgcgttcaggtt

SEQ ID NO: 9383586 - DNA, 22 bp, Homo sapiens
ctgaggcctctttccttggctt

SEQ ID NO: 9383587 - DNA, 22 bp, Homo sapiens
ctgaggcctctgttcaccagaa

SEQ ID NO: 9383588 - DNA, 22 bp, Homo sapiens
ctgaggcctctgttcaccagaa

SEQ ID NO: 9383589 - DNA, 22 bp, Homo sapiens
ctgaggcctctgttcaccagaa

SEQ ID NO: 9383590 - DNA, 22 bp, Homo sapiens
ctgaggcctctctccttggctt

SEQ ID NO: 9383591 - DNA, 22 bp, Homo sapiens
ctgaggcctctccttggcttgt

SEQ ID NO: 9383592 - DNA, 22 bp, Homo sapiens
ctgaggcctctctcctgggctt

SEQ ID NO: 9383593 - DNA, 22 bp, Homo sapiens
ctgaggcctctctcctgggctt

SEQ ID NO: 9383594 - DNA, 22 bp, Homo sapiens
ctgaggcctcgttggctggaac

SEQ ID NO: 9383595 - DNA, 22 bp, Homo sapiens
ctgaggcctcgttggctggaac

SEQ ID NO: 9383596 - DNA, 22 bp, Homo sapiens
ctgaggcctctcccactccagc

SEQ ID NO: 9383597 - DNA, 22 bp, Homo sapiens
ctgaggcttggaggggtctggt

SEQ ID NO: 9383598 - DNA, 18 bp, Homo sapiens
ctgaggcttagagaggtt

SEQ ID NO: 9383599 - DNA, 22 bp, Homo sapiens
ctgaggctggggaagggaagtg

SEQ ID NO: 9383600 - DNA, 22 bp, Homo sapiens
ctgaggctgggcttgccttctt

SEQ ID NO: 9383601 - DNA, 22 bp, Homo sapiens
ctgaggtcaattaatcaacaac

SEQ ID NO: 9383602 - DNA, 22 bp, Homo sapiens
agttgtattagagaacacaaac

SEQ ID NO: 9383603 - DNA, 22 bp, Homo sapiens
agttgtatctgaatgcatgtag

SEQ ID NO: 9383604 - DNA, 22 bp, Homo sapiens
ctgaggtcaccccactggctgt

SEQ ID NO: 9383605 - DNA, 22 bp, Homo sapiens
ctgaggtaaaatttctattttg

SEQ ID NO: 9383606 - DNA, 22 bp, Homo sapiens
ctgaggtatgtgggactagcct

SEQ ID NO: 9383607 - DNA, 22 bp, Homo sapiens
ctgagggtcaacttgattgtat

SEQ ID NO: 9383608 - DNA, 22 bp, Homo sapiens
ctgagggtcaacttgattgtat

SEQ ID NO: 9383609 - DNA, 22 bp, Homo sapiens
ctgagggtcaacttgattgtat

SEQ ID NO: 9383610 - DNA, 22 bp, Homo sapiens
ctgagggtcaacttgattgtat

SEQ ID NO: 9383611 - DNA, 22 bp, Homo sapiens
ctgaggctttgtgtgcatgcct

SEQ ID NO: 9383612 - DNA, 22 bp, Homo sapiens
ctgaggctttgtgtgcatgcct

SEQ ID NO: 9383613 - DNA, 22 bp, Homo sapiens
ctgaggggtatccaaggggtaa

SEQ ID NO: 9383614 - DNA, 22 bp, Homo sapiens
ctgagggaacttgggcaagtct

SEQ ID NO: 9383615 - DNA, 22 bp, Homo sapiens
ctgagggaacttgggcaagtct

SEQ ID NO: 9383616 - DNA, 22 bp, Homo sapiens
atatgtgtacgtgcagtatata

SEQ ID NO: 9383617 - DNA, 22 bp, Homo sapiens
atatgtgtaaatgcatttgttt

SEQ ID NO: 9383618 - DNA, 22 bp, Homo sapiens
atatgtgtaaatgcatttgttt

SEQ ID NO: 9383619 - DNA, 22 bp, Homo sapiens
atatgtgtaaatgcatttgttt

SEQ ID NO: 9383620 - DNA, 22 bp, Homo sapiens
atatgtgaagtgggttattttg

SEQ ID NO: 9383621 - DNA, 22 bp, Homo sapiens
atatgtctctgtacaacagtct

SEQ ID NO: 9383622 - DNA, 22 bp, Homo sapiens
atatgtgaatgatatcactttg

SEQ ID NO: 9383623 - DNA, 22 bp, Homo sapiens
atatgtgatttgacttctggca

SEQ ID NO: 9383624 - DNA, 22 bp, Homo sapiens
atatgtattttaacgtgtaagg

SEQ ID NO: 9383625 - DNA, 22 bp, Homo sapiens
atatgtcaagattttgagcaga

SEQ ID NO: 9383626 - DNA, 23 bp, Homo sapiens
atatgtcatgcaccagcacttta

SEQ ID NO: 9383627 - DNA, 22 bp, Homo sapiens
atatgtgtgtatttcttactag

SEQ ID NO: 9383628 - DNA, 22 bp, Homo sapiens
atatgtgtgatgcatggactaa

SEQ ID NO: 9383629 - DNA, 22 bp, Homo sapiens
atatgtgtgcacatatgtattt

SEQ ID NO: 9383630 - DNA, 22 bp, Homo sapiens
atatgtgtatggatttctatct

SEQ ID NO: 9383631 - DNA, 22 bp, Homo sapiens
atatgtgtatggatttctatct

SEQ ID NO: 9383632 - DNA, 22 bp, Homo sapiens
atatgtgtgatgcatggactaa

SEQ ID NO: 9383633 - DNA, 20 bp, Homo sapiens
atatgtgtacgtgtatacat

SEQ ID NO: 9383634 - DNA, 20 bp, Homo sapiens
atatgtgtacgtgtatacat

SEQ ID NO: 9383635 - DNA, 22 bp, Homo sapiens
atatgtatgtgttttctttgga

SEQ ID NO: 9383636 - DNA, 22 bp, Homo sapiens
atatgtatgtacgcacatattc

SEQ ID NO: 9383637 - DNA, 22 bp, Homo sapiens
atatgtatgtacgcacatattc

SEQ ID NO: 9383638 - DNA, 22 bp, Homo sapiens
atatgtatgtgttttctttgga

SEQ ID NO: 9383639 - DNA, 22 bp, Homo sapiens
atatgtatgtgttttctttgga

SEQ ID NO: 9383640 - DNA, 22 bp, Homo sapiens
atatgtattttaacgtgtaagg

SEQ ID NO: 9383641 - DNA, 22 bp, Homo sapiens
atatgtattttaacgtgtaagg

SEQ ID NO: 9383642 - DNA, 22 bp, Homo sapiens
atatgtattgagtgccaactgt

SEQ ID NO: 9383643 - DNA, 22 bp, Homo sapiens
atatgtatgtacgcacatattc

SEQ ID NO: 9383644 - DNA, 22 bp, Homo sapiens
atatgtatagccagtctttagg

SEQ ID NO: 9383645 - DNA, 22 bp, Homo sapiens
atatgtatagccagtctttagg

SEQ ID NO: 9383646 - DNA, 22 bp, Homo sapiens
atatgtactgaaactgcttttc

SEQ ID NO: 9383647 - DNA, 22 bp, Homo sapiens
atatgtatagccagtctttagg

SEQ ID NO: 9383648 - DNA, 22 bp, Homo sapiens
atatgtatagccagtctttagg

SEQ ID NO: 9383649 - DNA, 22 bp, Homo sapiens
atatgggggggcgtgcagagga

SEQ ID NO: 9383650 - DNA, 22 bp, Homo sapiens
atatgggggggcgtgcagagga

SEQ ID NO: 9383651 - DNA, 22 bp, Homo sapiens
atatgggggggcgtgcagagga

SEQ ID NO: 9383652 - DNA, 22 bp, Homo sapiens
atatgtacacttacgttacaaa

SEQ ID NO: 9383653 - DNA, 22 bp, Homo sapiens
atatttactgctgtggtgaagg

SEQ ID NO: 9383654 - DNA, 22 bp, Homo sapiens
atatttactgctgtggtgaagg

SEQ ID NO: 9383655 - DNA, 22 bp, Homo sapiens
atatttctctcagacatggaag

SEQ ID NO: 9383656 - DNA, 22 bp, Homo sapiens
atatttataagcaagcaggact

SEQ ID NO: 9383657 - DNA, 22 bp, Homo sapiens
atatttctccaaatgttttcaa

SEQ ID NO: 9383658 - DNA, 22 bp, Homo sapiens
atatgttttgtgcttcattggt

SEQ ID NO: 9383659 - DNA, 22 bp, Homo sapiens
atatgttttgtgcttcattggt

SEQ ID NO: 9383660 - DNA, 22 bp, Homo sapiens
atatgtttcagtattcaagtca

SEQ ID NO: 9383661 - DNA, 22 bp, Homo sapiens
atatgttagggaacaatttgag

SEQ ID NO: 9383662 - DNA, 22 bp, Homo sapiens
atatgttgagcaagcatgatta

SEQ ID NO: 9383663 - DNA, 22 bp, Homo sapiens
atatgttgttttagtctgcttg

SEQ ID NO: 9383664 - DNA, 23 bp, Homo sapiens
atatgttgtgaaattttagtagc

SEQ ID NO: 9383665 - DNA, 22 bp, Homo sapiens
atatttgcaggaaactagtttt

SEQ ID NO: 9383666 - DNA, 22 bp, Homo sapiens
atatttcttgagcacctggtat

SEQ ID NO: 9383667 - DNA, 22 bp, Homo sapiens
atatttcttgagcacctggtat

SEQ ID NO: 9383668 - DNA, 22 bp, Homo sapiens
atatttgtagtgggtaagaagt

SEQ ID NO: 9383669 - DNA, 22 bp, Homo sapiens
atatttggaaagaaaatcattg

SEQ ID NO: 9383670 - DNA, 20 bp, Homo sapiens
atatttcttaagaactttca

SEQ ID NO: 9383671 - DNA, 22 bp, Homo sapiens
atatttctgggggtgtgtttct

SEQ ID NO: 9383672 - DNA, 20 bp, Homo sapiens
atatttcttaagaactttca

SEQ ID NO: 9383673 - DNA, 20 bp, Homo sapiens
atatttcttaagaactttca

SEQ ID NO: 9383674 - DNA, 20 bp, Homo sapiens
atatttcttaagaactttca

SEQ ID NO: 9383675 - DNA, 22 bp, Homo sapiens
atatttctgggggtgtgtttct

SEQ ID NO: 9383676 - DNA, 22 bp, Homo sapiens
atatttctgggggtgtgtttct

SEQ ID NO: 9383677 - DNA, 22 bp, Homo sapiens
atatttctgggggtgtgtttct

SEQ ID NO: 9383678 - DNA, 22 bp, Homo sapiens
atatttctctcagacatggaag

SEQ ID NO: 9383679 - DNA, 22 bp, Homo sapiens
atatttctctcagacatggaag

SEQ ID NO: 9383680 - DNA, 22 bp, Homo sapiens
ctgggcaggtatacaaaaaatg

SEQ ID NO: 9383681 - DNA, 22 bp, Homo sapiens
ctgggcagtatgaatattcaaa

SEQ ID NO: 9383682 - DNA, 22 bp, Homo sapiens
ctgggcagtatgaatattcaaa

SEQ ID NO: 9383683 - DNA, 22 bp, Homo sapiens
atatgatgtgctatgtcactag

SEQ ID NO: 9383684 - DNA, 22 bp, Homo sapiens
atatgattccactattgtatgg

SEQ ID NO: 9383685 - DNA, 22 bp, Homo sapiens
atatgattgtccttagcaaatt

SEQ ID NO: 9383686 - DNA, 22 bp, Homo sapiens
ctgggcaggatacttcatggga

SEQ ID NO: 9383687 - DNA, 22 bp, Homo sapiens
atatgctggagtacaggaaata

SEQ ID NO: 9383688 - DNA, 22 bp, Homo sapiens
atatggcagaccaattagaagc

SEQ ID NO: 9383689 - DNA, 22 bp, Homo sapiens
atatggcaaaggggaattaagg

SEQ ID NO: 9383690 - DNA, 22 bp, Homo sapiens
atatatattgcccaggctggtt

SEQ ID NO: 9383691 - DNA, 22 bp, Homo sapiens
atatatattgcccaggctggtt

SEQ ID NO: 9383692 - DNA, 22 bp, Homo sapiens
atatatcatgagtaaaacttga

SEQ ID NO: 9383693 - DNA, 22 bp, Homo sapiens
atatatcatgagtaaaacttga

SEQ ID NO: 9383694 - DNA, 22 bp, Homo sapiens
atatatcatgagtaaaacttga

SEQ ID NO: 9383695 - DNA, 22 bp, Homo sapiens
atatatcatgagtaaaacttga

SEQ ID NO: 9383696 - DNA, 22 bp, Homo sapiens
atatatctgcagtactgaagaa

SEQ ID NO: 9383697 - DNA, 22 bp, Homo sapiens
atatatctgcagtactgaagaa

SEQ ID NO: 9383698 - DNA, 22 bp, Homo sapiens
atatatgaagaagtcttgatta

SEQ ID NO: 9383699 - DNA, 22 bp, Homo sapiens
atatcattctgatgtatatctt

SEQ ID NO: 9383700 - DNA, 19 bp, Homo sapiens
atatatgtatacaatgtgg

SEQ ID NO: 9383701 - DNA, 22 bp, Homo sapiens
atatatgcatgtgtacttatgt

SEQ ID NO: 9383702 - DNA, 22 bp, Homo sapiens
atatgacagcggattcacatat

SEQ ID NO: 9383703 - DNA, 22 bp, Homo sapiens
atatgacataaaatcatttttg

SEQ ID NO: 9383704 - DNA, 22 bp, Homo sapiens
atatgacataaaatcatttttg

SEQ ID NO: 9383705 - DNA, 22 bp, Homo sapiens
atatgagagtaaatgccgatct

SEQ ID NO: 9383706 - DNA, 22 bp, Homo sapiens
atatgagagaggaaagatttta

SEQ ID NO: 9383707 - DNA, 22 bp, Homo sapiens
atatgagagaggaaagatttta

SEQ ID NO: 9383708 - DNA, 22 bp, Homo sapiens
atatgaatttggggaggacaca

SEQ ID NO: 9383709 - DNA, 22 bp, Homo sapiens
atatgacagcggattcacatat

SEQ ID NO: 9383710 - DNA, 22 bp, Homo sapiens
ctgggcacagcgttgggctctt

SEQ ID NO: 9383711 - DNA, 22 bp, Homo sapiens
ctgggcacactctgctccagct

SEQ ID NO: 9383712 - DNA, 22 bp, Homo sapiens
ctgggcacacagtgactctgca

SEQ ID NO: 9383713 - DNA, 22 bp, Homo sapiens
ctgggcacaagtggccctggat

SEQ ID NO: 9383714 - DNA, 19 bp, Homo sapiens
ctgggaggtgttcagagaa

SEQ ID NO: 9383715 - DNA, 22 bp, Homo sapiens
ctgggcacagtggctcacgcct

SEQ ID NO: 9383716 - DNA, 22 bp, Homo sapiens
ctgggcacaggggagcagagtc

SEQ ID NO: 9383717 - DNA, 20 bp, Homo sapiens
ctgggcacctgtctgcagtt

SEQ ID NO: 9383718 - DNA, 20 bp, Homo sapiens
ctgggcacctgtctgcagtt

SEQ ID NO: 9383719 - DNA, 22 bp, Homo sapiens
atatatatcgagttcatgtctc

SEQ ID NO: 9383720 - DNA, 22 bp, Homo sapiens
atatatatcgagttcatgtctc

SEQ ID NO: 9383721 - DNA, 20 bp, Homo sapiens
ctgggcacctgtctgcagtt

SEQ ID NO: 9383722 - DNA, 22 bp, Homo sapiens
atatatatgctgatggctgcca

SEQ ID NO: 9383723 - DNA, 22 bp, Homo sapiens
atatatatgctgatggctgcca

SEQ ID NO: 9383724 - DNA, 22 bp, Homo sapiens
atatatatcgagttcatgtctc

SEQ ID NO: 9383725 - DNA, 22 bp, Homo sapiens
ctgggagagcctttcctgagtc

SEQ ID NO: 9383726 - DNA, 22 bp, Homo sapiens
ctgggagagacacttctgatta

SEQ ID NO: 9383727 - DNA, 22 bp, Homo sapiens
ctgggagaggaacctcgagggt

SEQ ID NO: 9383728 - DNA, 22 bp, Homo sapiens
ctgggagagaagcgaagctggg

SEQ ID NO: 9383729 - DNA, 22 bp, Homo sapiens
ctgggagagaagcgaagctggg

SEQ ID NO: 9383730 - DNA, 22 bp, Homo sapiens
ctgggagacgcagctggggatc

SEQ ID NO: 9383731 - DNA, 22 bp, Homo sapiens
ctgggagacaagagagggctga

SEQ ID NO: 9383732 - DNA, 22 bp, Homo sapiens
ctgggagacgcagctggggatc

SEQ ID NO: 9383733 - DNA, 22 bp, Homo sapiens
ctgggagacaagagagggctga

SEQ ID NO: 9383734 - DNA, 22 bp, Homo sapiens
atatatagagctagatgttaaa

SEQ ID NO: 9383735 - DNA, 22 bp, Homo sapiens
atatatagagctagatgttaaa

SEQ ID NO: 9383736 - DNA, 22 bp, Homo sapiens
atatatactttgacacattctg

SEQ ID NO: 9383737 - DNA, 22 bp, Homo sapiens
atatatactttgacacattctg

SEQ ID NO: 9383738 - DNA, 22 bp, Homo sapiens
atatatacaactagattaaaag

SEQ ID NO: 9383739 - DNA, 22 bp, Homo sapiens
atatatactttgacacattctg

SEQ ID NO: 9383740 - DNA, 22 bp, Homo sapiens
atatatacaactagattaaaag

SEQ ID NO: 9383741 - DNA, 22 bp, Homo sapiens
atatatacaactagattaaaag

SEQ ID NO: 9383742 - DNA, 22 bp, Homo sapiens
ctggcttctgggccagggcaga

SEQ ID NO: 9383743 - DNA, 22 bp, Homo sapiens
ctggcagctgtgtgaagaactg

SEQ ID NO: 9383744 - DNA, 22 bp, Homo sapiens
ctggcagctgtgtgaagaactg

SEQ ID NO: 9383745 - DNA, 22 bp, Homo sapiens
ctggcagcttagcactctggtt

SEQ ID NO: 9383746 - DNA, 22 bp, Homo sapiens
ctggcagcttagcactctggtt

SEQ ID NO: 9383747 - DNA, 22 bp, Homo sapiens
ctggcagctggaggctagaggc

SEQ ID NO: 9383748 - DNA, 22 bp, Homo sapiens
ctggcagctggaggctagaggc

SEQ ID NO: 9383749 - DNA, 22 bp, Homo sapiens
ctggcagctggaggctagaggc

SEQ ID NO: 9383750 - DNA, 22 bp, Homo sapiens
ctggcagctggaggctagaggc

SEQ ID NO: 9383751 - DNA, 22 bp, Homo sapiens
ctggcagctgcccgagatgccc

SEQ ID NO: 9383752 - DNA, 22 bp, Homo sapiens
ctgggaagccacagggtgtggg

SEQ ID NO: 9383753 - DNA, 22 bp, Homo sapiens
ctgggaagccacagggtgtggg

SEQ ID NO: 9383754 - DNA, 22 bp, Homo sapiens
ctgggaagcatggtgatggtat

SEQ ID NO: 9383755 - DNA, 22 bp, Homo sapiens
ctgggaagcatggtgatggtat

SEQ ID NO: 9383756 - DNA, 22 bp, Homo sapiens
ctgggaagatggtgacagaatt

SEQ ID NO: 9383757 - DNA, 22 bp, Homo sapiens
ctggcttctgggccagggcaga

SEQ ID NO: 9383758 - DNA, 23 bp, Homo sapiens
ctggcttctggggcctctgtttc

SEQ ID NO: 9383759 - DNA, 22 bp, Homo sapiens
ctgggacaagctctgtctagct

SEQ ID NO: 9383760 - DNA, 22 bp, Homo sapiens
ctgggaaggggaaggtcctctc

SEQ ID NO: 9383761 - DNA, 22 bp, Homo sapiens
ctgggaagtagaatcagatgag

SEQ ID NO: 9383762 - DNA, 22 bp, Homo sapiens
ctgggaagcttcgagcaggaaa

SEQ ID NO: 9383763 - DNA, 22 bp, Homo sapiens
ctgggaagggacgccagtgcct

SEQ ID NO: 9383764 - DNA, 22 bp, Homo sapiens
ctgggaagggacgccagtgcct

SEQ ID NO: 9383765 - DNA, 22 bp, Homo sapiens
ctgggaagggacgccagtgcct

SEQ ID NO: 9383766 - DNA, 22 bp, Homo sapiens
ctgggacaagctctgtctagct

SEQ ID NO: 9383767 - DNA, 20 bp, Homo sapiens
atataataaattttggttac

SEQ ID NO: 9383768 - DNA, 22 bp, Homo sapiens
atataagttagtggtcatgttt

SEQ ID NO: 9383769 - DNA, 22 bp, Homo sapiens
atataactcttgttcttatagt

SEQ ID NO: 9383770 - DNA, 22 bp, Homo sapiens
atataactcttgttcttatagt

SEQ ID NO: 9383771 - DNA, 22 bp, Homo sapiens
atataactcttgttcttatagt

SEQ ID NO: 9383772 - DNA, 22 bp, Homo sapiens
atataatacaacctgctaagtg

SEQ ID NO: 9383773 - DNA, 22 bp, Homo sapiens
atatataacctggataaggctt

SEQ ID NO: 9383774 - DNA, 22 bp, Homo sapiens
atatataacctggataaggctt

SEQ ID NO: 9383775 - DNA, 22 bp, Homo sapiens
atatacttggagactatcattg

SEQ ID NO: 9383776 - DNA, 22 bp, Homo sapiens
atatataacctggataaggctt

SEQ ID NO: 9383777 - DNA, 22 bp, Homo sapiens
atatataacctggataaggctt

SEQ ID NO: 9383778 - DNA, 22 bp, Homo sapiens
atatataagctgatgagccaca

SEQ ID NO: 9383779 - DNA, 22 bp, Homo sapiens
atatataagctgatgagccaca

SEQ ID NO: 9383780 - DNA, 22 bp, Homo sapiens
atatataagctgatgagccaca

SEQ ID NO: 9383781 - DNA, 22 bp, Homo sapiens
atatatacaactagattaaaag

SEQ ID NO: 9383782 - DNA, 22 bp, Homo sapiens
atatataagctgatgagccaca

SEQ ID NO: 9383783 - DNA, 22 bp, Homo sapiens
atatataatacttgctgtgggc

SEQ ID NO: 9383784 - DNA, 22 bp, Homo sapiens
atatataatacttgctgtgggc

SEQ ID NO: 9383785 - DNA, 22 bp, Homo sapiens
atcctcagacctcagcaaagcc

SEQ ID NO: 9383786 - DNA, 23 bp, Homo sapiens
atcctatataaccttggaggctg

SEQ ID NO: 9383787 - DNA, 22 bp, Homo sapiens
atcctagaatcagcccttgctg

SEQ ID NO: 9383788 - DNA, 22 bp, Homo sapiens
atcctcagtgtttctgacatct

SEQ ID NO: 9383789 - DNA, 22 bp, Homo sapiens
atcctccagctcctgcttctgc

SEQ ID NO: 9383790 - DNA, 18 bp, Homo sapiens
atcctctagcttctcaga

SEQ ID NO: 9383791 - DNA, 20 bp, Homo sapiens
atcctctcctgattaattca

SEQ ID NO: 9383792 - DNA, 23 bp, Homo sapiens
atcctctctccatcccactgtgc

SEQ ID NO: 9383793 - DNA, 23 bp, Homo sapiens
atcctctctccatcccactgtgc

SEQ ID NO: 9383794 - DNA, 22 bp, Homo sapiens
atcctctctgtgacagggaacg

SEQ ID NO: 9383795 - DNA, 22 bp, Homo sapiens
atcctctctcccataccagtct

SEQ ID NO: 9383796 - DNA, 22 bp, Homo sapiens
atctaattttcactcatttgct

SEQ ID NO: 9383797 - DNA, 22 bp, Homo sapiens
atctaattttcactcatttgct

SEQ ID NO: 9383798 - DNA, 22 bp, Homo sapiens
atctacaacatcacatggcatt

SEQ ID NO: 9383799 - DNA, 22 bp, Homo sapiens
atcctttaagttaataaaattc

SEQ ID NO: 9383800 - DNA, 22 bp, Homo sapiens
atccacagaaggaacttgaaag

SEQ ID NO: 9383801 - DNA, 22 bp, Homo sapiens
atccatttgtaaatgttagagt

SEQ ID NO: 9383802 - DNA, 22 bp, Homo sapiens
atccccagactttagatttctc

SEQ ID NO: 9383803 - DNA, 22 bp, Homo sapiens
atccatttgacataatttcagc

SEQ ID NO: 9383804 - DNA, 22 bp, Homo sapiens
atccatttgtaaatgttagagt

SEQ ID NO: 9383805 - DNA, 23 bp, Homo sapiens
atccacattacagtatcatacaa

SEQ ID NO: 9383806 - DNA, 22 bp, Homo sapiens
atccccttcacaccctctgcat

SEQ ID NO: 9383807 - DNA, 22 bp, Homo sapiens
atccccttgtgggctggcagca

SEQ ID NO: 9383808 - DNA, 22 bp, Homo sapiens
atccctcagcagacagcaaaat

SEQ ID NO: 9383809 - DNA, 22 bp, Homo sapiens
atccctcagccacctttgagga

SEQ ID NO: 9383810 - DNA, 22 bp, Homo sapiens
atccccctcttggatggcggca

SEQ ID NO: 9383811 - DNA, 22 bp, Homo sapiens
atccccctgtatctggaagaat

SEQ ID NO: 9383812 - DNA, 23 bp, Homo sapiens
atcccctgccttgggtgagtccc

SEQ ID NO: 9383813 - DNA, 22 bp, Homo sapiens
atccccttatcccaggctgagc

SEQ ID NO: 9383814 - DNA, 22 bp, Homo sapiens
atccccagggaggcctgacctg

SEQ ID NO: 9383815 - DNA, 22 bp, Homo sapiens
atccccagggagtgagctgtct

SEQ ID NO: 9383816 - DNA, 22 bp, Homo sapiens
atccaacacgtatttgctggcc

SEQ ID NO: 9383817 - DNA, 22 bp, Homo sapiens
atccaacacgtatttgctggcc

SEQ ID NO: 9383818 - DNA, 22 bp, Homo sapiens
atccaagaatttgcactcctaa

SEQ ID NO: 9383819 - DNA, 22 bp, Homo sapiens
atccacaagaccccttttcact

SEQ ID NO: 9383820 - DNA, 22 bp, Homo sapiens
atcatttttaagagactcttct

SEQ ID NO: 9383821 - DNA, 22 bp, Homo sapiens
atcattttgtgacaatgcctgt

SEQ ID NO: 9383822 - DNA, 22 bp, Homo sapiens
atcattctagtccttatggtct

SEQ ID NO: 9383823 - DNA, 22 bp, Homo sapiens
atcattttatggctgagaggac

SEQ ID NO: 9383824 - DNA, 22 bp, Homo sapiens
atcattttgtgacaatgcctgt

SEQ ID NO: 9383825 - DNA, 22 bp, Homo sapiens
atcatttttaagagactcttct

SEQ ID NO: 9383826 - DNA, 22 bp, Homo sapiens
ctgtggagtgcttggctcagtg

SEQ ID NO: 9383827 - DNA, 22 bp, Homo sapiens
ctgtggagtgcttggctcagtg

SEQ ID NO: 9383828 - DNA, 22 bp, Homo sapiens
atcattctagctgttgtgttga

SEQ ID NO: 9383829 - DNA, 22 bp, Homo sapiens
ctgtggagtggggagtactggt

SEQ ID NO: 9383830 - DNA, 22 bp, Homo sapiens
ctgtggaggtaggagcaggaca

SEQ ID NO: 9383831 - DNA, 22 bp, Homo sapiens
ctgtggagcttgtggcagtggg

SEQ ID NO: 9383832 - DNA, 22 bp, Homo sapiens
ctgtggaggtaggagcaggaca

SEQ ID NO: 9383833 - DNA, 22 bp, Homo sapiens
ctgtggagtcctggggaatgga

SEQ ID NO: 9383834 - DNA, 22 bp, Homo sapiens
atcatgttttaattagcaaact

SEQ ID NO: 9383835 - DNA, 22 bp, Homo sapiens
atcatgtttagttttaagggct

SEQ ID NO: 9383836 - DNA, 22 bp, Homo sapiens
atcatgttgtatgtaatctttt

SEQ ID NO: 9383837 - DNA, 22 bp, Homo sapiens
atcatgttggctctgacaaaaa

SEQ ID NO: 9383838 - DNA, 22 bp, Homo sapiens
atcatgttgctcaaaattaaac

SEQ ID NO: 9383839 - DNA, 22 bp, Homo sapiens
atcatgttccagaaacagtgat

SEQ ID NO: 9383840 - DNA, 23 bp, Homo sapiens
ctgtggagccctttgttgggaga

SEQ ID NO: 9383841 - DNA, 22 bp, Homo sapiens
ctgtggagatgcagaccaggcc

SEQ ID NO: 9383842 - DNA, 22 bp, Homo sapiens
ctgtggagcagggcagggtcac

SEQ ID NO: 9383843 - DNA, 22 bp, Homo sapiens
ctgggtcccacagcctgctggg

SEQ ID NO: 9383844 - DNA, 22 bp, Homo sapiens
ctgggtcccacagcctgctggg

SEQ ID NO: 9383845 - DNA, 22 bp, Homo sapiens
ctgtcctcaacccatccttctc

SEQ ID NO: 9383846 - DNA, 22 bp, Homo sapiens
ctgtccagtctttagcaagctg

SEQ ID NO: 9383847 - DNA, 22 bp, Homo sapiens
ctgtccagtctttagcaagctg

SEQ ID NO: 9383848 - DNA, 18 bp, Homo sapiens
ctgggtctccaggctgcc

SEQ ID NO: 9383849 - DNA, 18 bp, Homo sapiens
ctgggtctccaggctgcc

SEQ ID NO: 9383850 - DNA, 22 bp, Homo sapiens
ctgggtcacccaaaagggccag

SEQ ID NO: 9383851 - DNA, 22 bp, Homo sapiens
ctgggtcaggagcggctgcccg

SEQ ID NO: 9383852 - DNA, 22 bp, Homo sapiens
atatttgtcaattcactgttca

SEQ ID NO: 9383853 - DNA, 22 bp, Homo sapiens
ctgggtagaagattcctcagga

SEQ ID NO: 9383854 - DNA, 22 bp, Homo sapiens
ctgggtagaagattcctcagga

SEQ ID NO: 9383855 - DNA, 22 bp, Homo sapiens
ctgggtacctcaccgctgctgc

SEQ ID NO: 9383856 - DNA, 22 bp, Homo sapiens
ctgggtagctgctgctccttca

SEQ ID NO: 9383857 - DNA, 22 bp, Homo sapiens
ctgggtagctgctgctccttca

SEQ ID NO: 9383858 - DNA, 22 bp, Homo sapiens
ctgggtagggcaaggaactggc

SEQ ID NO: 9383859 - DNA, 22 bp, Homo sapiens
ctgtcctcaccttggcaggggg

SEQ ID NO: 9383860 - DNA, 22 bp, Homo sapiens
ctgtcctcaacccatccttctc

SEQ ID NO: 9383861 - DNA, 22 bp, Homo sapiens
ctgtcctcaacccatccttctc

SEQ ID NO: 9383862 - DNA, 21 bp, Homo sapiens
ctgtcctcagatgtggacgag

SEQ ID NO: 9383863 - DNA, 22 bp, Homo sapiens
ctgtcctcatctgccccaaggg

SEQ ID NO: 9383864 - DNA, 22 bp, Homo sapiens
ctgtcctccagacgacagtccc

SEQ ID NO: 9383865 - DNA, 22 bp, Homo sapiens
ctgtcctccggccacctacagt

SEQ ID NO: 9383866 - DNA, 22 bp, Homo sapiens
ctgtcctctgtcctcagcagga

SEQ ID NO: 9383867 - DNA, 22 bp, Homo sapiens
ctgtcctccggccacctacagt

SEQ ID NO: 9383868 - DNA, 22 bp, Homo sapiens
atcacatatttaagaaacatgt

SEQ ID NO: 9383869 - DNA, 22 bp, Homo sapiens
atcacatatttaagaaacatgt

SEQ ID NO: 9383870 - DNA, 22 bp, Homo sapiens
atcacatcacaggttgagctag

SEQ ID NO: 9383871 - DNA, 22 bp, Homo sapiens
atcatgttcatcgtatttaggc

SEQ ID NO: 9383872 - DNA, 22 bp, Homo sapiens
atcatgtgtaatttcaagctac

SEQ ID NO: 9383873 - DNA, 22 bp, Homo sapiens
atcatgtgaagtggggggttga

SEQ ID NO: 9383874 - DNA, 22 bp, Homo sapiens
atcatggaagcctatcttgaga

SEQ ID NO: 9383875 - DNA, 22 bp, Homo sapiens
atcatgacagagtctgccatcc

SEQ ID NO: 9383876 - DNA, 22 bp, Homo sapiens
atcatcatgcccacttgagact

SEQ ID NO: 9383877 - DNA, 22 bp, Homo sapiens
atcatcatgctacaatcagcaa

SEQ ID NO: 9383878 - DNA, 22 bp, Homo sapiens
atcatcatgcactctcaggttt

SEQ ID NO: 9383879 - DNA, 22 bp, Homo sapiens
atcatcatgcccacttgagact

SEQ ID NO: 9383880 - DNA, 22 bp, Homo sapiens
atcatcatgcactctcaggttt

SEQ ID NO: 9383881 - DNA, 22 bp, Homo sapiens
atcatgcatggtactcttgtgc

SEQ ID NO: 9383882 - DNA, 22 bp, Homo sapiens
atcatgcagcaacaagcaaggc

SEQ ID NO: 9383883 - DNA, 22 bp, Homo sapiens
atcatcatctaaattgtgtcgc

SEQ ID NO: 9383884 - DNA, 22 bp, Homo sapiens
atcatcatcattgctaacatct

SEQ ID NO: 9383885 - DNA, 19 bp, Homo sapiens
ctgtgcaggccgggctgag

SEQ ID NO: 9383886 - DNA, 22 bp, Homo sapiens
ctgtgcactaaccacacccacg

SEQ ID NO: 9383887 - DNA, 22 bp, Homo sapiens
ctgtgcacacgtgcccaacagt

SEQ ID NO: 9383888 - DNA, 18 bp, Homo sapiens
ctgtgcagcaaactgagc

SEQ ID NO: 9383889 - DNA, 22 bp, Homo sapiens
ctgtgcaatgcctaatcacaaa

SEQ ID NO: 9383890 - DNA, 22 bp, Homo sapiens
ctgtgatgttagctctgtgtta

SEQ ID NO: 9383891 - DNA, 22 bp, Homo sapiens
ctgtgatggtcaggccctatct

SEQ ID NO: 9383892 - DNA, 22 bp, Homo sapiens
ctgtgatgatggaaactttctt

SEQ ID NO: 9383893 - DNA, 22 bp, Homo sapiens
ctgtgcaaaggccttatgtttt

SEQ ID NO: 9383894 - DNA, 22 bp, Homo sapiens
ctgtgcaaaggccttatgtttt

SEQ ID NO: 9383895 - DNA, 22 bp, Homo sapiens
ctgtgattgttagttcctatac

SEQ ID NO: 9383896 - DNA, 22 bp, Homo sapiens
ctgtgcaagacttactttaata

SEQ ID NO: 9383897 - DNA, 22 bp, Homo sapiens
ctgtgcaaaggccttatgtttt

SEQ ID NO: 9383898 - DNA, 22 bp, Homo sapiens
ctgtgcaaataaagagcaacat

SEQ ID NO: 9383899 - DNA, 22 bp, Homo sapiens
ctgtgcaaataaagagcaacat

SEQ ID NO: 9383900 - DNA, 22 bp, Homo sapiens
ctgtgcaagacttactttaata

SEQ ID NO: 9383901 - DNA, 23 bp, Homo sapiens
ctgtgcaatatcccatggtatga

SEQ ID NO: 9383902 - DNA, 23 bp, Homo sapiens
ctgtgcaatatcccatggtatga

SEQ ID NO: 9383903 - DNA, 22 bp, Homo sapiens
ctgtgcaatattataaaggcca

SEQ ID NO: 9383904 - DNA, 22 bp, Homo sapiens
ctgtgcaaggcccatgctcaga

SEQ ID NO: 9383905 - DNA, 22 bp, Homo sapiens
ctgtgcaagcccaagataaaac

SEQ ID NO: 9383906 - DNA, 22 bp, Homo sapiens
ctgtgcaagcccaagataaaac

SEQ ID NO: 9383907 - DNA, 22 bp, Homo sapiens
ctgtctttggtcctgtctgtta

SEQ ID NO: 9383908 - DNA, 22 bp, Homo sapiens
ctgtcttttactatcatttact

SEQ ID NO: 9383909 - DNA, 22 bp, Homo sapiens
ctgtcttttactatcatttact

SEQ ID NO: 9383910 - DNA, 22 bp, Homo sapiens
ctgtcttttcttctcattgatg

SEQ ID NO: 9383911 - DNA, 22 bp, Homo sapiens
ctgtgagttcattgtgccacct

SEQ ID NO: 9383912 - DNA, 22 bp, Homo sapiens
ctgtgatgacaggcagggccaa

SEQ ID NO: 9383913 - DNA, 22 bp, Homo sapiens
ctgtgagttcattgtgccacct

SEQ ID NO: 9383914 - DNA, 22 bp, Homo sapiens
ctgtgagtgaccctggtcagca

SEQ ID NO: 9383915 - DNA, 22 bp, Homo sapiens
ctgtgagtgaccctggtcagca

SEQ ID NO: 9383916 - DNA, 18 bp, Homo sapiens
ctgtcttttttctctcca

SEQ ID NO: 9383917 - DNA, 22 bp, Homo sapiens
ctgtctctgtcttaactcccag

SEQ ID NO: 9383918 - DNA, 22 bp, Homo sapiens
ctgtctctgttgcctgtaggtg

SEQ ID NO: 9383919 - DNA, 22 bp, Homo sapiens
ctgtctgtttctgattcaacct

SEQ ID NO: 9383920 - DNA, 22 bp, Homo sapiens
ctgtctctgttgcctgtaggtg

SEQ ID NO: 9383921 - DNA, 22 bp, Homo sapiens
ctgtcttctaccttcaacctcc

SEQ ID NO: 9383922 - DNA, 22 bp, Homo sapiens
ctgtctgttttaccttctccag

SEQ ID NO: 9383923 - DNA, 22 bp, Homo sapiens
ctgtcttctcctttgtttcagg

SEQ ID NO: 9383924 - DNA, 22 bp, Homo sapiens
cctctgcagcagagagccagag

SEQ ID NO: 9383925 - DNA, 22 bp, Homo sapiens
cctctgcagcagagagccagag

SEQ ID NO: 9383926 - DNA, 22 bp, Homo sapiens
cctctgcagcagagagccagag

SEQ ID NO: 9383927 - DNA, 22 bp, Homo sapiens
cctctgcacttcaccttagctc

SEQ ID NO: 9383928 - DNA, 22 bp, Homo sapiens
cctctgcatctggctgctgcag

SEQ ID NO: 9383929 - DNA, 22 bp, Homo sapiens
cctctgccacctcccacgaggc

SEQ ID NO: 9383930 - DNA, 22 bp, Homo sapiens
cctctgagtgacagcctcctct

SEQ ID NO: 9383931 - DNA, 22 bp, Homo sapiens
cctctgcaccatagccttcagc

SEQ ID NO: 9383932 - DNA, 22 bp, Homo sapiens
cctctgcaccatagccttcagc

SEQ ID NO: 9383933 - DNA, 22 bp, Homo sapiens
cctctgagttggcctgtcttgt

SEQ ID NO: 9383934 - DNA, 22 bp, Homo sapiens
cctctgagttagagatctagat

SEQ ID NO: 9383935 - DNA, 22 bp, Homo sapiens
cctctctctgcatctggagggc

SEQ ID NO: 9383936 - DNA, 22 bp, Homo sapiens
cctctctctgcatctggagggc

SEQ ID NO: 9383937 - DNA, 22 bp, Homo sapiens
cctctctcttgtagtccctgcc

SEQ ID NO: 9383938 - DNA, 22 bp, Homo sapiens
cctctctcttgtagtccctgcc

SEQ ID NO: 9383939 - DNA, 22 bp, Homo sapiens
cctctctctcctgcacacacac

SEQ ID NO: 9383940 - DNA, 22 bp, Homo sapiens
cctctctccttcctttgccaaa

SEQ ID NO: 9383941 - DNA, 22 bp, Homo sapiens
cctctctctcctgcacacacac

SEQ ID NO: 9383942 - DNA, 22 bp, Homo sapiens
cctctctctcctgcacacacac

SEQ ID NO: 9383943 - DNA, 22 bp, Homo sapiens
cctctctccaattttcacctca

SEQ ID NO: 9383944 - DNA, 22 bp, Homo sapiens
cctctctccaattttcacctca

SEQ ID NO: 9383945 - DNA, 22 bp, Homo sapiens
cctctctccaattttcacctca

SEQ ID NO: 9383946 - DNA, 22 bp, Homo sapiens
cctctctccttcctttgccaaa

SEQ ID NO: 9383947 - DNA, 22 bp, Homo sapiens
cctctctccttcctttgccaaa

SEQ ID NO: 9383948 - DNA, 23 bp, Homo sapiens
cctctctccctgtttggcaaata

SEQ ID NO: 9383949 - DNA, 23 bp, Homo sapiens
cctctctccctgtttggcaaata

SEQ ID NO: 9383950 - DNA, 19 bp, Homo sapiens
cctctgccagcccgcctct

SEQ ID NO: 9383951 - DNA, 22 bp, Homo sapiens
cctgcccagcttcacctcaggc

SEQ ID NO: 9383952 - DNA, 22 bp, Homo sapiens
cctgcccagcttcacctcaggc

SEQ ID NO: 9383953 - DNA, 22 bp, Homo sapiens
cctgccaggacattgcttgaag

SEQ ID NO: 9383954 - DNA, 22 bp, Homo sapiens
cctgccaggacattgcttgaag

SEQ ID NO: 9383955 - DNA, 22 bp, Homo sapiens
cctgcccaggagtctctctgtg

SEQ ID NO: 9383956 - DNA, 22 bp, Homo sapiens
cctgcccaggagtctctctgtg

SEQ ID NO: 9383957 - DNA, 22 bp, Homo sapiens
cctgcccagcttcccgagtgca

SEQ ID NO: 9383958 - DNA, 22 bp, Homo sapiens
cctgccctatgaccagcttcac

SEQ ID NO: 9383959 - DNA, 22 bp, Homo sapiens
cctgccctatgaccagcttcac

SEQ ID NO: 9383960 - DNA, 22 bp, Homo sapiens
cctgcccatactgacctctaat

SEQ ID NO: 9383961 - DNA, 22 bp, Homo sapiens
cctgcccatcccgtccttggcc

SEQ ID NO: 9383962 - DNA, 22 bp, Homo sapiens
cctgcccagggtcaccacagag

SEQ ID NO: 9383963 - DNA, 22 bp, Homo sapiens
cctgcccagggtcaccacagag

SEQ ID NO: 9383964 - DNA, 22 bp, Homo sapiens
cctgcccccgtcagaggtgatg

SEQ ID NO: 9383965 - DNA, 22 bp, Homo sapiens
agggtctcttgccatgcctcag

SEQ ID NO: 9383966 - DNA, 22 bp, Homo sapiens
agggtctctggagagctgagga

SEQ ID NO: 9383967 - DNA, 22 bp, Homo sapiens
agggtctctggagagctgagga

SEQ ID NO: 9383968 - DNA, 22 bp, Homo sapiens
agggtctctacgcactagaggg

SEQ ID NO: 9383969 - DNA, 22 bp, Homo sapiens
agggtctgaccaccagtaggga

SEQ ID NO: 9383970 - DNA, 22 bp, Homo sapiens
agggtctcttgccatgcctcag

SEQ ID NO: 9383971 - DNA, 20 bp, Homo sapiens
agggtctgctgggtaggaca

SEQ ID NO: 9383972 - DNA, 20 bp, Homo sapiens
agggtctggccctgttcctt

SEQ ID NO: 9383973 - DNA, 22 bp, Homo sapiens
agggtctgactgaatggaaaag

SEQ ID NO: 9383974 - DNA, 22 bp, Homo sapiens
agggtctgtggatgcatctggg

SEQ ID NO: 9383975 - DNA, 20 bp, Homo sapiens
agggtgagacatgagcctcc

SEQ ID NO: 9383976 - DNA, 20 bp, Homo sapiens
agggtgagacatgagcctcc

SEQ ID NO: 9383977 - DNA, 22 bp, Homo sapiens
agggtgaatctcacaactctta

SEQ ID NO: 9383978 - DNA, 22 bp, Homo sapiens
agggtgaatctcacaactctta

SEQ ID NO: 9383979 - DNA, 22 bp, Homo sapiens
agggtcagagatcggccatgtg

SEQ ID NO: 9383980 - DNA, 20 bp, Homo sapiens
agggtcagagagcgtgagtg

SEQ ID NO: 9383981 - DNA, 22 bp, Homo sapiens
agggtcagagatcggccatgtg

SEQ ID NO: 9383982 - DNA, 19 bp, Homo sapiens
agggtcaggacaaggactt

SEQ ID NO: 9383983 - DNA, 21 bp, Homo sapiens
agggtcaggaaccagggtacc

SEQ ID NO: 9383984 - DNA, 21 bp, Homo sapiens
agggtcaggaaccagggtacc

SEQ ID NO: 9383985 - DNA, 22 bp, Homo sapiens
agggtcagctggctgtcagggg

SEQ ID NO: 9383986 - DNA, 22 bp, Homo sapiens
agggtcagagtcaggtgcagta

SEQ ID NO: 9383987 - DNA, 22 bp, Homo sapiens
agggtcagagtcaggtgcagta

SEQ ID NO: 9383988 - DNA, 22 bp, Homo sapiens
agggtccttctgttcctgagca

SEQ ID NO: 9383989 - DNA, 22 bp, Homo sapiens
agggtccttctgttcctgagca

SEQ ID NO: 9383990 - DNA, 22 bp, Homo sapiens
agggtccttctgttcctgagca

SEQ ID NO: 9383991 - DNA, 22 bp, Homo sapiens
agggtccttctgttcctgagca

SEQ ID NO: 9383992 - DNA, 22 bp, Homo sapiens
agggtcctgagcctggggcgca

SEQ ID NO: 9383993 - DNA, 21 bp, Homo sapiens
agggtcctacagggctcagga

SEQ ID NO: 9383994 - DNA, 21 bp, Homo sapiens
agggtcctacagggctcagga

SEQ ID NO: 9383995 - DNA, 22 bp, Homo sapiens
agggtcaggagacactggcaac

SEQ ID NO: 9383996 - DNA, 19 bp, Homo sapiens
agggtcaggacaaggactt

SEQ ID NO: 9383997 - DNA, 22 bp, Homo sapiens
agggtcaggagacactggcaac

SEQ ID NO: 9383998 - DNA, 19 bp, Homo sapiens
agggtcaggacaaggactt

SEQ ID NO: 9383999 - DNA, 19 bp, Homo sapiens
agggtcaggacaaggactt

SEQ ID NO: 9384000 - DNA, 22 bp, Homo sapiens
agggtcagggagtgagtattta

SEQ ID NO: 9384001 - DNA, 20 bp, Homo sapiens
agggtcagtagcacagagct

SEQ ID NO: 9384002 - DNA, 22 bp, Homo sapiens
cctggcacagagcggtggtcac

SEQ ID NO: 9384003 - DNA, 22 bp, Homo sapiens
cctggcacataatagtggctca

SEQ ID NO: 9384004 - DNA, 22 bp, Homo sapiens
cctggcacataatagtggctca

SEQ ID NO: 9384005 - DNA, 22 bp, Homo sapiens
cctggcagcccagagcgccgct

SEQ ID NO: 9384006 - DNA, 22 bp, Homo sapiens
cctggcagcccagagcgccgct

SEQ ID NO: 9384007 - DNA, 22 bp, Homo sapiens
cctggcagcccagagcgccgct

SEQ ID NO: 9384008 - DNA, 22 bp, Homo sapiens
cctggcagcctcagccaattct

SEQ ID NO: 9384009 - DNA, 22 bp, Homo sapiens
cctggcagcctcagccaattct

SEQ ID NO: 9384010 - DNA, 22 bp, Homo sapiens
cctggcagcgccgaagctggcc

SEQ ID NO: 9384011 - DNA, 22 bp, Homo sapiens
cctggcagcgccgaagctggcc

SEQ ID NO: 9384012 - DNA, 22 bp, Homo sapiens
cctggcagcgccgaagctggcc

SEQ ID NO: 9384013 - DNA, 22 bp, Homo sapiens
cctggcagcgccgaagctggcc

SEQ ID NO: 9384014 - DNA, 22 bp, Homo sapiens
cctggcagctaagtgctttgag

SEQ ID NO: 9384015 - DNA, 22 bp, Homo sapiens
cctggcagcgtgccgagctgcg

SEQ ID NO: 9384016 - DNA, 22 bp, Homo sapiens
cctggcagcgtgccgagctgcg

SEQ ID NO: 9384017 - DNA, 22 bp, Homo sapiens
cctggcagcgtgccgagctgcg

SEQ ID NO: 9384018 - DNA, 22 bp, Homo sapiens
cctggcagcgtgccgagctgcg

SEQ ID NO: 9384019 - DNA, 22 bp, Homo sapiens
cctggaaggacaatagatagtg

SEQ ID NO: 9384020 - DNA, 22 bp, Homo sapiens
cctggaagctgatgtttaggac

SEQ ID NO: 9384021 - DNA, 22 bp, Homo sapiens
cctggaagattcaccactacca

SEQ ID NO: 9384022 - DNA, 20 bp, Homo sapiens
cctggaagagctccccaggc

SEQ ID NO: 9384023 - DNA, 22 bp, Homo sapiens
cctggaagagctgaatcaggca

SEQ ID NO: 9384024 - DNA, 22 bp, Homo sapiens
cctggaagagctgaatcaggca

SEQ ID NO: 9384025 - DNA, 22 bp, Homo sapiens
cctggaagttggaggttgcagt

SEQ ID NO: 9384026 - DNA, 22 bp, Homo sapiens
cctggaagtcattcctcgttcc

SEQ ID NO: 9384027 - DNA, 22 bp, Homo sapiens
cctggaaggtgatggtacagca

SEQ ID NO: 9384028 - DNA, 22 bp, Homo sapiens
cctggaaggcaggcatggattg

SEQ ID NO: 9384029 - DNA, 22 bp, Homo sapiens
cctggaaggtgatggtacagca

SEQ ID NO: 9384030 - DNA, 22 bp, Homo sapiens
cctggaaggcaggcatggattg

SEQ ID NO: 9384031 - DNA, 22 bp, Homo sapiens
cctggaaggcaggcatggattg

SEQ ID NO: 9384032 - DNA, 22 bp, Homo sapiens
cctggaaggcaggcatggattg

SEQ ID NO: 9384033 - DNA, 22 bp, Homo sapiens
cctggacagagggcagcggcca

SEQ ID NO: 9384034 - DNA, 22 bp, Homo sapiens
cctggacagggccaggccatgc

SEQ ID NO: 9384035 - DNA, 22 bp, Homo sapiens
cctggacagggccaggccatgc

SEQ ID NO: 9384036 - DNA, 22 bp, Homo sapiens
cctggacaagtggcttacttgg

SEQ ID NO: 9384037 - DNA, 22 bp, Homo sapiens
cctggacaatgagatgtcaggg

SEQ ID NO: 9384038 - DNA, 22 bp, Homo sapiens
cctggacacccattccttggct

SEQ ID NO: 9384039 - DNA, 22 bp, Homo sapiens
cctggacaatgagatgtcaggg

SEQ ID NO: 9384040 - DNA, 22 bp, Homo sapiens
cctgctgagaccctgaggtggg

SEQ ID NO: 9384041 - DNA, 22 bp, Homo sapiens
cctgctcttatagctgtttcca

SEQ ID NO: 9384042 - DNA, 22 bp, Homo sapiens
cctgctcttatagctgtttcca

SEQ ID NO: 9384043 - DNA, 22 bp, Homo sapiens
cctgctcttatagctgtttcca

SEQ ID NO: 9384044 - DNA, 19 bp, Homo sapiens
cctgctgaagtgatgcagc

SEQ ID NO: 9384045 - DNA, 22 bp, Homo sapiens
cctgctgctatgaaggtgacag

SEQ ID NO: 9384046 - DNA, 22 bp, Homo sapiens
cctggaaagaggaaggaagcct

SEQ ID NO: 9384047 - DNA, 22 bp, Homo sapiens
cctggaaatgtcgcgtgtagaa

SEQ ID NO: 9384048 - DNA, 22 bp, Homo sapiens
cctggaaatgcaaaagccatga

SEQ ID NO: 9384049 - DNA, 22 bp, Homo sapiens
cctggaaagattgcagttgctg

SEQ ID NO: 9384050 - DNA, 22 bp, Homo sapiens
cctggaaatgcaaaagccatga

SEQ ID NO: 9384051 - DNA, 22 bp, Homo sapiens
cctgctctgccaagtcctcttt

SEQ ID NO: 9384052 - DNA, 22 bp, Homo sapiens
cctgctctgccaagtcctcttt

SEQ ID NO: 9384053 - DNA, 22 bp, Homo sapiens
cctgctctgccaagtcctcttt

SEQ ID NO: 9384054 - DNA, 22 bp, Homo sapiens
cctgctctggtttagtcagtct

SEQ ID NO: 9384055 - DNA, 22 bp, Homo sapiens
cctgctctccatacactttcta

SEQ ID NO: 9384056 - DNA, 22 bp, Homo sapiens
cctgctctccatacactttcta

SEQ ID NO: 9384057 - DNA, 22 bp, Homo sapiens
cctgctctccatacactttcta

SEQ ID NO: 9384058 - DNA, 22 bp, Homo sapiens
cctgctctagactctgggaagg

SEQ ID NO: 9384059 - DNA, 22 bp, Homo sapiens
cctgctctccatacactttcta

SEQ ID NO: 9384060 - DNA, 22 bp, Homo sapiens
cctgcctggcttccagaagaga

SEQ ID NO: 9384061 - DNA, 22 bp, Homo sapiens
cctgctctagactctgggaagg

SEQ ID NO: 9384062 - DNA, 22 bp, Homo sapiens
cctgctctaaatctcatggaac

SEQ ID NO: 9384063 - DNA, 19 bp, Homo sapiens
cctggccagacttctgccc

SEQ ID NO: 9384064 - DNA, 22 bp, Homo sapiens
cctggccagaggcgtgcctgtg

SEQ ID NO: 9384065 - DNA, 22 bp, Homo sapiens
cctggccacagggctctgcatt

SEQ ID NO: 9384066 - DNA, 22 bp, Homo sapiens
cctggccacagggctctgcatt

SEQ ID NO: 9384067 - DNA, 20 bp, Homo sapiens
cctggccaatgagataggaa

SEQ ID NO: 9384068 - DNA, 20 bp, Homo sapiens
cctggccaatgagataggaa

SEQ ID NO: 9384069 - DNA, 20 bp, Homo sapiens
cctggccaatgagataggaa

SEQ ID NO: 9384070 - DNA, 22 bp, Homo sapiens
cctggcagctgtttggcttggc

SEQ ID NO: 9384071 - DNA, 22 bp, Homo sapiens
cctggcagctcctccccggcgg

SEQ ID NO: 9384072 - DNA, 22 bp, Homo sapiens
cctggcagctgtttggcttggc

SEQ ID NO: 9384073 - DNA, 22 bp, Homo sapiens
cctggcagctgtttggcttggc

SEQ ID NO: 9384074 - DNA, 21 bp, Homo sapiens
cctggccaatctgatagggtt

SEQ ID NO: 9384075 - DNA, 22 bp, Homo sapiens
cctggcagctccgtggccttcc

SEQ ID NO: 9384076 - DNA, 22 bp, Homo sapiens
cctggcagctaagtgctttgag

SEQ ID NO: 9384077 - DNA, 22 bp, Homo sapiens
cctggcagctccgtggccttcc

SEQ ID NO: 9384078 - DNA, 22 bp, Homo sapiens
cctggcagctcctccccggcgg

SEQ ID NO: 9384079 - DNA, 22 bp, Homo sapiens
cctggcagctcctccccggcgg

SEQ ID NO: 9384080 - DNA, 22 bp, Homo sapiens
cctggcagctccgtggccttcc

SEQ ID NO: 9384081 - DNA, 19 bp, Homo sapiens
cctggctgctgtgggatgc

SEQ ID NO: 9384082 - DNA, 19 bp, Homo sapiens
cctggctgctgtgggatgc

SEQ ID NO: 9384083 - DNA, 22 bp, Homo sapiens
cctggctctgtcctcgcgcaaa

SEQ ID NO: 9384084 - DNA, 22 bp, Homo sapiens
cctggctgctgtcactgaccat

SEQ ID NO: 9384085 - DNA, 22 bp, Homo sapiens
cctggctgctttcactatggag

SEQ ID NO: 9384086 - DNA, 22 bp, Homo sapiens
cctggctgcttcctctgccatg

SEQ ID NO: 9384087 - DNA, 22 bp, Homo sapiens
cctggctgctttcactatggag

SEQ ID NO: 9384088 - DNA, 22 bp, Homo sapiens
cctggctgctttcactatggag

SEQ ID NO: 9384089 - DNA, 22 bp, Homo sapiens
cctggctggactggaccgtggc

SEQ ID NO: 9384090 - DNA, 22 bp, Homo sapiens
cctggctggactggaccgtggc

SEQ ID NO: 9384091 - DNA, 22 bp, Homo sapiens
cctggctggactggaccgtggc

SEQ ID NO: 9384092 - DNA, 22 bp, Homo sapiens
cctggctggatggagcccctgg

SEQ ID NO: 9384093 - DNA, 22 bp, Homo sapiens
cctggctggatggagcccctgg

SEQ ID NO: 9384094 - DNA, 23 bp, Homo sapiens
cctggctggattctctgcattca

SEQ ID NO: 9384095 - DNA, 23 bp, Homo sapiens
cctggctggattctctgcattca

SEQ ID NO: 9384096 - DNA, 22 bp, Homo sapiens
cctggctggatggagcccctgg

SEQ ID NO: 9384097 - DNA, 22 bp, Homo sapiens
cctggctggcaagatcgtgaag

SEQ ID NO: 9384098 - DNA, 22 bp, Homo sapiens
cctggctgggcctgatttctca

SEQ ID NO: 9384099 - DNA, 17 bp, Homo sapiens
cctggctgggaatctga

SEQ ID NO: 9384100 - DNA, 17 bp, Homo sapiens
cctggctgggaatctga

SEQ ID NO: 9384101 - DNA, 22 bp, Homo sapiens
cctggctggggtagaagtgagg

SEQ ID NO: 9384102 - DNA, 22 bp, Homo sapiens
cctggctggtggcagcgacaag

SEQ ID NO: 9384103 - DNA, 22 bp, Homo sapiens
cctggctggtggcagcgacaag

SEQ ID NO: 9384104 - DNA, 22 bp, Homo sapiens
cctggctggtggcagcgacaag

SEQ ID NO: 9384105 - DNA, 22 bp, Homo sapiens
cctgggaaggggaagagaattc

SEQ ID NO: 9384106 - DNA, 22 bp, Homo sapiens
cctgggaaggggaagagaattc

SEQ ID NO: 9384107 - DNA, 20 bp, Homo sapiens
cctggctggtggaggaaagg

SEQ ID NO: 9384108 - DNA, 22 bp, Homo sapiens
cctgggaaggtgaggccctgga

SEQ ID NO: 9384109 - DNA, 22 bp, Homo sapiens
cctgggaagtcagccaaggacg

SEQ ID NO: 9384110 - DNA, 22 bp, Homo sapiens
cctgggaaggtgaggccctgga

SEQ ID NO: 9384111 - DNA, 22 bp, Homo sapiens
aggtgggaacccagcagggccc

SEQ ID NO: 9384112 - DNA, 22 bp, Homo sapiens
aggtgggacccgtggggtgcga

SEQ ID NO: 9384113 - DNA, 22 bp, Homo sapiens
aggtgggacccgtggggtgcga

SEQ ID NO: 9384114 - DNA, 22 bp, Homo sapiens
aggtggcttctggccaggtgtg

SEQ ID NO: 9384115 - DNA, 22 bp, Homo sapiens
aggtggcttctggccaggtgtg

SEQ ID NO: 9384116 - DNA, 22 bp, Homo sapiens
aggtggctttactgtttcttac

SEQ ID NO: 9384117 - DNA, 22 bp, Homo sapiens
aggtgggaacccagcagggccc

SEQ ID NO: 9384118 - DNA, 22 bp, Homo sapiens
aggtgggacccgtggggtgcga

SEQ ID NO: 9384119 - DNA, 21 bp, Homo sapiens
aggtgggagaccatgtaggtc

SEQ ID NO: 9384120 - DNA, 22 bp, Homo sapiens
aggtgggacccgtggggtgcga

SEQ ID NO: 9384121 - DNA, 22 bp, Homo sapiens
ccttctctgcaggtagttggct

SEQ ID NO: 9384122 - DNA, 22 bp, Homo sapiens
ccttctctctgaagaccccaaa

SEQ ID NO: 9384123 - DNA, 22 bp, Homo sapiens
aggtgggcaatgaggcctgagt

SEQ ID NO: 9384124 - DNA, 22 bp, Homo sapiens
ccttctctctgaagaccccaaa

SEQ ID NO: 9384125 - DNA, 21 bp, Homo sapiens
aggtgggagaccatgtaggtc

SEQ ID NO: 9384126 - DNA, 21 bp, Homo sapiens
aggtgggagaccatgtaggtc

SEQ ID NO: 9384127 - DNA, 22 bp, Homo sapiens
aggtggctgtggcttcccttgt

SEQ ID NO: 9384128 - DNA, 22 bp, Homo sapiens
aggtggctgtattcagctgtaa

SEQ ID NO: 9384129 - DNA, 22 bp, Homo sapiens
aggtggctgtattcagctgtaa

SEQ ID NO: 9384130 - DNA, 22 bp, Homo sapiens
aggtggctgtattcagctgtaa

SEQ ID NO: 9384131 - DNA, 22 bp, Homo sapiens
aggtggcttctggccaggtgtg

SEQ ID NO: 9384132 - DNA, 22 bp, Homo sapiens
aggtggcttctggccaggtgtg

SEQ ID NO: 9384133 - DNA, 22 bp, Homo sapiens
aggtggcttctggccaggtgtg

SEQ ID NO: 9384134 - DNA, 22 bp, Homo sapiens
aggtggcttctggccaggtgtg

SEQ ID NO: 9384135 - DNA, 22 bp, Homo sapiens
aggtggctgtggcttcccttgt

SEQ ID NO: 9384136 - DNA, 22 bp, Homo sapiens
aggtggctgtattcagctgtaa

SEQ ID NO: 9384137 - DNA, 22 bp, Homo sapiens
aggtggctggtccaggctgcag

SEQ ID NO: 9384138 - DNA, 22 bp, Homo sapiens
aggtggctggtccaggctgcag

SEQ ID NO: 9384139 - DNA, 22 bp, Homo sapiens
aggtggctggtccaggctgcag

SEQ ID NO: 9384140 - DNA, 21 bp, Homo sapiens
aggtggctgcatcctcagaag

SEQ ID NO: 9384141 - DNA, 22 bp, Homo sapiens
aggtggctgagctgtgcccctg

SEQ ID NO: 9384142 - DNA, 22 bp, Homo sapiens
aggtggctgagctgtgcccctg

SEQ ID NO: 9384143 - DNA, 22 bp, Homo sapiens
aggtggctgaagagtgggtgag

SEQ ID NO: 9384144 - DNA, 22 bp, Homo sapiens
aggtggctgaagagtgggtgag

SEQ ID NO: 9384145 - DNA, 19 bp, Homo sapiens
aggtggctgaaactacaga

SEQ ID NO: 9384146 - DNA, 21 bp, Homo sapiens
aggtggctgcatcctcagaag

SEQ ID NO: 9384147 - DNA, 17 bp, Homo sapiens
aggtggctgctgcgcct

SEQ ID NO: 9384148 - DNA, 17 bp, Homo sapiens
aggtggctgctgcgcct

SEQ ID NO: 9384149 - DNA, 22 bp, Homo sapiens
aggtggctgcctccccgcgcgg

SEQ ID NO: 9384150 - DNA, 17 bp, Homo sapiens
aggtggctgctgcgcct

SEQ ID NO: 9384151 - DNA, 22 bp, Homo sapiens
aggtggctgcctccccgcgcgg

SEQ ID NO: 9384152 - DNA, 22 bp, Homo sapiens
aggtgggggctgtgtccttgac

SEQ ID NO: 9384153 - DNA, 22 bp, Homo sapiens
aggtggggctgggaaagattcc

SEQ ID NO: 9384154 - DNA, 22 bp, Homo sapiens
ccttggcaaaccagggcagctg

SEQ ID NO: 9384155 - DNA, 22 bp, Homo sapiens
ccttggcaaaccagggcagctg

SEQ ID NO: 9384156 - DNA, 22 bp, Homo sapiens
ccttggattttgtgcccacgcc

SEQ ID NO: 9384157 - DNA, 20 bp, Homo sapiens
ccttctctggaattgcctcc

SEQ ID NO: 9384158 - DNA, 22 bp, Homo sapiens
ccttgcgttttacagcttctag

SEQ ID NO: 9384159 - DNA, 22 bp, Homo sapiens
ccttgctcatcccccagtgcct

SEQ ID NO: 9384160 - DNA, 22 bp, Homo sapiens
ccttgctgaccatcacctttga

SEQ ID NO: 9384161 - DNA, 22 bp, Homo sapiens
ccttgctgcgtgctagcacaga

SEQ ID NO: 9384162 - DNA, 19 bp, Homo sapiens
ccttggagttccaggtgga

SEQ ID NO: 9384163 - DNA, 22 bp, Homo sapiens
ccttggagacctgggtctgtgc

SEQ ID NO: 9384164 - DNA, 22 bp, Homo sapiens
ccttggagcggtcagcactggt

SEQ ID NO: 9384165 - DNA, 22 bp, Homo sapiens
aggtgccattgcttgccagttt

SEQ ID NO: 9384166 - DNA, 22 bp, Homo sapiens
aggtgccagctctcaggcagga

SEQ ID NO: 9384167 - DNA, 18 bp, Homo sapiens
aggtgccctccttacact

SEQ ID NO: 9384168 - DNA, 22 bp, Homo sapiens
aggtgcccatgagctccatggc

SEQ ID NO: 9384169 - DNA, 22 bp, Homo sapiens
aggtgcccatcacctcacagtc

SEQ ID NO: 9384170 - DNA, 22 bp, Homo sapiens
aggtgcctatctggtctctgca

SEQ ID NO: 9384171 - DNA, 22 bp, Homo sapiens
aggtgcctatctggtctctgca

SEQ ID NO: 9384172 - DNA, 22 bp, Homo sapiens
aggtgcctatctggtctctgca

SEQ ID NO: 9384173 - DNA, 22 bp, Homo sapiens
aggtgcctgggagctccctgag

SEQ ID NO: 9384174 - DNA, 22 bp, Homo sapiens
aggtgcctgtcgtctctggtta

SEQ ID NO: 9384175 - DNA, 22 bp, Homo sapiens
aggtgctctaggtatctacttt

SEQ ID NO: 9384176 - DNA, 22 bp, Homo sapiens
cctgggagaactgctgggttgg

SEQ ID NO: 9384177 - DNA, 22 bp, Homo sapiens
aggtgcaggagctgtgcaggga

SEQ ID NO: 9384178 - DNA, 19 bp, Homo sapiens
cctgggacttaggctgggt

SEQ ID NO: 9384179 - DNA, 22 bp, Homo sapiens
cctgggactcggccaggacaga

SEQ ID NO: 9384180 - DNA, 22 bp, Homo sapiens
cctgggacgactctgtaccctt

SEQ ID NO: 9384181 - DNA, 22 bp, Homo sapiens
cctgggacctcgcgggaagcgg

SEQ ID NO: 9384182 - DNA, 22 bp, Homo sapiens
cctgggaagttgtggctgcagt

SEQ ID NO: 9384183 - DNA, 22 bp, Homo sapiens
cctgggaagtcagccaaggacg

SEQ ID NO: 9384184 - DNA, 22 bp, Homo sapiens
cctgggaagttgtggctgcagt

SEQ ID NO: 9384185 - DNA, 22 bp, Homo sapiens
cctgggaagttgtggctgcagt

SEQ ID NO: 9384186 - DNA, 22 bp, Homo sapiens
cctgggaagttgtggctgcagt

SEQ ID NO: 9384187 - DNA, 22 bp, Homo sapiens
aggtggctctgacagctctggt

SEQ ID NO: 9384188 - DNA, 22 bp, Homo sapiens
aggtggcagttgtggaaccatc

SEQ ID NO: 9384189 - DNA, 22 bp, Homo sapiens
aggtggctctgacagctctggt

SEQ ID NO: 9384190 - DNA, 22 bp, Homo sapiens
aggtggctctgacagctctggt

SEQ ID NO: 9384191 - DNA, 22 bp, Homo sapiens
aggtggctctgacagctctggt

SEQ ID NO: 9384192 - DNA, 20 bp, Homo sapiens
aggtggctcttcctgggctt

SEQ ID NO: 9384193 - DNA, 20 bp, Homo sapiens
aggtggctcttcctgggctt

SEQ ID NO: 9384194 - DNA, 20 bp, Homo sapiens
aggtggctcttcctgggctt

SEQ ID NO: 9384195 - DNA, 20 bp, Homo sapiens
aggtggctcttcctgggctt

SEQ ID NO: 9384196 - DNA, 20 bp, Homo sapiens
aggtggctcttcctgggctt

SEQ ID NO: 9384197 - DNA, 20 bp, Homo sapiens
aggtggctcttcctgggctt

SEQ ID NO: 9384198 - DNA, 22 bp, Homo sapiens
aggtgctgggcagcagtcattg

SEQ ID NO: 9384199 - DNA, 22 bp, Homo sapiens
aggtgctgtgctatgcacttgt

SEQ ID NO: 9384200 - DNA, 22 bp, Homo sapiens
aggtgctgtttgtcagcagttt

SEQ ID NO: 9384201 - DNA, 22 bp, Homo sapiens
aggtgctgttggcagcgggcag

SEQ ID NO: 9384202 - DNA, 22 bp, Homo sapiens
aggtgctgtgctatgcacttgt

SEQ ID NO: 9384203 - DNA, 22 bp, Homo sapiens
aggtgctggagtctgggcagga

SEQ ID NO: 9384204 - DNA, 22 bp, Homo sapiens
aggtgctggagtctgggcagga

SEQ ID NO: 9384205 - DNA, 22 bp, Homo sapiens
aggtgctgggcagcagtcattg

SEQ ID NO: 9384206 - DNA, 22 bp, Homo sapiens
aggtgctggcgccccaggagac

SEQ ID NO: 9384207 - DNA, 22 bp, Homo sapiens
aggtgctggcgccccaggagac

SEQ ID NO: 9384208 - DNA, 22 bp, Homo sapiens
aggtgctggagtagaagaaaaa

SEQ ID NO: 9384209 - DNA, 22 bp, Homo sapiens
aggtgctggagtctgggcagga

SEQ ID NO: 9384210 - DNA, 22 bp, Homo sapiens
aggtgctggagtagaagaaaaa

SEQ ID NO: 9384211 - DNA, 17 bp, Homo sapiens
aggtgctggagcatcag

SEQ ID NO: 9384212 - DNA, 22 bp, Homo sapiens
aggtgctgccccgagaaggatg

SEQ ID NO: 9384213 - DNA, 22 bp, Homo sapiens
aggtggggtgagctgcagacta

SEQ ID NO: 9384214 - DNA, 22 bp, Homo sapiens
aggtggggtgagctgcagacta

SEQ ID NO: 9384215 - DNA, 22 bp, Homo sapiens
aggtggggtgagctgcagacta

SEQ ID NO: 9384216 - DNA, 22 bp, Homo sapiens
cctttattcaattagtcctaat

SEQ ID NO: 9384217 - DNA, 22 bp, Homo sapiens
aggtggggtgttggatgtttat

SEQ ID NO: 9384218 - DNA, 22 bp, Homo sapiens
aggtggggtgagctgcagacta

SEQ ID NO: 9384219 - DNA, 22 bp, Homo sapiens
cctttggtcttgatgaactgtt

SEQ ID NO: 9384220 - DNA, 22 bp, Homo sapiens
cctttggtcacctccactctta

SEQ ID NO: 9384221 - DNA, 22 bp, Homo sapiens
cctttggtcacctccactctta

SEQ ID NO: 9384222 - DNA, 19 bp, Homo sapiens
cctttggtttccatgacat

SEQ ID NO: 9384223 - DNA, 22 bp, Homo sapiens
cctttggtggttttcagagatc

SEQ ID NO: 9384224 - DNA, 22 bp, Homo sapiens
cctttggtgttattgggagaca

SEQ ID NO: 9384225 - DNA, 22 bp, Homo sapiens
cgaggaagaagtttgagtcaag

SEQ ID NO: 9384226 - DNA, 22 bp, Homo sapiens
cgaggaaaggcgatggctctcg

SEQ ID NO: 9384227 - DNA, 22 bp, Homo sapiens
cgaggaaatatttacaactgat

SEQ ID NO: 9384228 - DNA, 22 bp, Homo sapiens
cgagcatgatgacggctgtggc

SEQ ID NO: 9384229 - DNA, 22 bp, Homo sapiens
ccttttatgaacttgagcaggt

SEQ ID NO: 9384230 - DNA, 22 bp, Homo sapiens
ccttttataaagttgtattgaa

SEQ ID NO: 9384231 - DNA, 22 bp, Homo sapiens
ccttttatactcagtgatatca

SEQ ID NO: 9384232 - DNA, 22 bp, Homo sapiens
ccttttataaagttgtattgaa

SEQ ID NO: 9384233 - DNA, 22 bp, Homo sapiens
ccttttatactctgtcctctgg

SEQ ID NO: 9384234 - DNA, 22 bp, Homo sapiens
ccttttatactctgtcctctgg

SEQ ID NO: 9384235 - DNA, 22 bp, Homo sapiens
ccttttatactcagtgatatca

SEQ ID NO: 9384236 - DNA, 22 bp, Homo sapiens
ccttttatagatcagtgtgtta

SEQ ID NO: 9384237 - DNA, 22 bp, Homo sapiens
ccttttatatggctcatcacag

SEQ ID NO: 9384238 - DNA, 22 bp, Homo sapiens
ccttttatagatcagtgtgtta

SEQ ID NO: 9384239 - DNA, 22 bp, Homo sapiens
ccttttatatggctcatcacag

SEQ ID NO: 9384240 - DNA, 22 bp, Homo sapiens
ccttttatgaacttgagcaggt

SEQ ID NO: 9384241 - DNA, 22 bp, Homo sapiens
cgaggaggaaacgcggagaact

SEQ ID NO: 9384242 - DNA, 23 bp, Homo sapiens
cgctcagaggttctgtccttggt

SEQ ID NO: 9384243 - DNA, 22 bp, Homo sapiens
cgctcagactcatgatatgctg

SEQ ID NO: 9384244 - DNA, 22 bp, Homo sapiens
cgaggccagctctaagccctac

SEQ ID NO: 9384245 - DNA, 22 bp, Homo sapiens
cgaggccaccgtggtttccgag

SEQ ID NO: 9384246 - DNA, 20 bp, Homo sapiens
cgaggccaaggggctgggcc

SEQ ID NO: 9384247 - DNA, 22 bp, Homo sapiens
agtatattgctcttaatcatag

SEQ ID NO: 9384248 - DNA, 22 bp, Homo sapiens
agtatatttgttaagattattc

SEQ ID NO: 9384249 - DNA, 22 bp, Homo sapiens
agtatatttgttaagattattc

SEQ ID NO: 9384250 - DNA, 22 bp, Homo sapiens
agtatatgtgcacatatgcatg

SEQ ID NO: 9384251 - DNA, 22 bp, Homo sapiens
agtatattgctcttaatcatag

SEQ ID NO: 9384252 - DNA, 22 bp, Homo sapiens
agtatatgtgcacatatgcatg

SEQ ID NO: 9384253 - DNA, 22 bp, Homo sapiens
agtatatggggaattgcataat

SEQ ID NO: 9384254 - DNA, 22 bp, Homo sapiens
agtatatagtggcgctgtatgc

SEQ ID NO: 9384255 - DNA, 22 bp, Homo sapiens
agtatatatgaggaaccacaaa

SEQ ID NO: 9384256 - DNA, 22 bp, Homo sapiens
agtatatagtggcgctgtatgc

SEQ ID NO: 9384257 - DNA, 22 bp, Homo sapiens
agtatatagtggcgctgtatgc

SEQ ID NO: 9384258 - DNA, 22 bp, Homo sapiens
cggctcactgcagctccgcctc

SEQ ID NO: 9384259 - DNA, 22 bp, Homo sapiens
cggctcactgcagctccgcctc

SEQ ID NO: 9384260 - DNA, 22 bp, Homo sapiens
cggctcactgcagctccgcctc

SEQ ID NO: 9384261 - DNA, 22 bp, Homo sapiens
cggctcactgcagctccgcctc

SEQ ID NO: 9384262 - DNA, 22 bp, Homo sapiens
cggctcagacttcccaagaaca

SEQ ID NO: 9384263 - DNA, 20 bp, Homo sapiens
cggctcagcctctccctccc

SEQ ID NO: 9384264 - DNA, 22 bp, Homo sapiens
cggccgcagcagtgtcggccca

SEQ ID NO: 9384265 - DNA, 22 bp, Homo sapiens
cggagcctgcttgttgcagctg

SEQ ID NO: 9384266 - DNA, 22 bp, Homo sapiens
cggagcagagccactcgggccg

SEQ ID NO: 9384267 - DNA, 22 bp, Homo sapiens
cggagaggtgggggcagcatct

SEQ ID NO: 9384268 - DNA, 22 bp, Homo sapiens
cggagcagaaggcgccgccggc

SEQ ID NO: 9384269 - DNA, 22 bp, Homo sapiens
cggagaggtgggggcagcatct

SEQ ID NO: 9384270 - DNA, 22 bp, Homo sapiens
cggagaggtgggggcagcatct

SEQ ID NO: 9384271 - DNA, 21 bp, Homo sapiens
cggagctgggcagggcatccc

SEQ ID NO: 9384272 - DNA, 22 bp, Homo sapiens
cggaggcaaactcacctggctc

SEQ ID NO: 9384273 - DNA, 22 bp, Homo sapiens
cggagctggcgtctgtgtggac

SEQ ID NO: 9384274 - DNA, 23 bp, Homo sapiens
cggaggcaaatcggccatttaag

SEQ ID NO: 9384275 - DNA, 22 bp, Homo sapiens
cggagctggcgtctgtgtggac

SEQ ID NO: 9384276 - DNA, 22 bp, Homo sapiens
cggaggggtttgaacagaggag

SEQ ID NO: 9384277 - DNA, 22 bp, Homo sapiens
cggaggggtttgaacagaggag

SEQ ID NO: 9384278 - DNA, 22 bp, Homo sapiens
cggccaagccggggccccgaag

SEQ ID NO: 9384279 - DNA, 22 bp, Homo sapiens
cggccagtgccgctctcgcctc

SEQ ID NO: 9384280 - DNA, 22 bp, Homo sapiens
cggcccgctgcgagtgcaccgt

SEQ ID NO: 9384281 - DNA, 22 bp, Homo sapiens
ctctccattccctacagttttc

SEQ ID NO: 9384282 - DNA, 20 bp, Homo sapiens
ctctcccagcacagcttcct

SEQ ID NO: 9384283 - DNA, 22 bp, Homo sapiens
ctctccattccctacagttttc

SEQ ID NO: 9384284 - DNA, 22 bp, Homo sapiens
ctctccattccctacagttttc

SEQ ID NO: 9384285 - DNA, 22 bp, Homo sapiens
ctctccatctgtgtgacctccc

SEQ ID NO: 9384286 - DNA, 22 bp, Homo sapiens
ctctccatctgtgtgacctccc

SEQ ID NO: 9384287 - DNA, 22 bp, Homo sapiens
ctctccagttatagctgatttg

SEQ ID NO: 9384288 - DNA, 22 bp, Homo sapiens
agtgctgggattgcaggcatga

SEQ ID NO: 9384289 - DNA, 22 bp, Homo sapiens
agtgctgggattgcaggcatga

SEQ ID NO: 9384290 - DNA, 22 bp, Homo sapiens
agtgctgggctatctactgcta

SEQ ID NO: 9384291 - DNA, 22 bp, Homo sapiens
agtgctgggattgcaggcatga

SEQ ID NO: 9384292 - DNA, 23 bp, Homo sapiens
ctctccaccttcccacccaggga

SEQ ID NO: 9384293 - DNA, 22 bp, Homo sapiens
ctctccaagttatcaagatgaa

SEQ ID NO: 9384294 - DNA, 22 bp, Homo sapiens
agtgctgggctatctactgcta

SEQ ID NO: 9384295 - DNA, 22 bp, Homo sapiens
agtgctgggattacaggcataa

SEQ ID NO: 9384296 - DNA, 22 bp, Homo sapiens
agtgctgggattacaggcataa

SEQ ID NO: 9384297 - DNA, 22 bp, Homo sapiens
agtgctgggattgcaggcatga

SEQ ID NO: 9384298 - DNA, 22 bp, Homo sapiens
agtgctgggattacaggcataa

SEQ ID NO: 9384299 - DNA, 22 bp, Homo sapiens
agtgctgggattacaggcataa

SEQ ID NO: 9384300 - DNA, 22 bp, Homo sapiens
agtgctggcccatagctgctgg

SEQ ID NO: 9384301 - DNA, 22 bp, Homo sapiens
ctcggcaggtggaggttgtagt

SEQ ID NO: 9384302 - DNA, 22 bp, Homo sapiens
ctcggcaggtggaggttgtagt

SEQ ID NO: 9384303 - DNA, 22 bp, Homo sapiens
ctcggcaggtggaggttgtagt

SEQ ID NO: 9384304 - DNA, 22 bp, Homo sapiens
ctcggctctccatttttgtttg

SEQ ID NO: 9384305 - DNA, 22 bp, Homo sapiens
ctcgggcaccctggttctggtg

SEQ ID NO: 9384306 - DNA, 22 bp, Homo sapiens
ctctccccacaccctctgcatg

SEQ ID NO: 9384307 - DNA, 22 bp, Homo sapiens
ctctccccacaccctctgcatg

SEQ ID NO: 9384308 - DNA, 22 bp, Homo sapiens
ctctccccacaccctctgcatg

SEQ ID NO: 9384309 - DNA, 22 bp, Homo sapiens
ctctcccagtcaggctcaggat

SEQ ID NO: 9384310 - DNA, 22 bp, Homo sapiens
ctctcccagtcaggctcaggat

SEQ ID NO: 9384311 - DNA, 22 bp, Homo sapiens
ctctcccagtcaggctcaggat

SEQ ID NO: 9384312 - DNA, 22 bp, Homo sapiens
ctctcccagtcaggctcaggat

SEQ ID NO: 9384313 - DNA, 20 bp, Homo sapiens
ctctcccagcacagcttcct

SEQ ID NO: 9384314 - DNA, 22 bp, Homo sapiens
ctctcccagtcaggctcaggat

SEQ ID NO: 9384315 - DNA, 20 bp, Homo sapiens
ctctcccagcacagcttcct

SEQ ID NO: 9384316 - DNA, 20 bp, Homo sapiens
ctctcccagcacagcttcct

SEQ ID NO: 9384317 - DNA, 22 bp, Homo sapiens
ctctcctttactgcagagagcg

SEQ ID NO: 9384318 - DNA, 22 bp, Homo sapiens
ctctcgaagagacttcccagct

SEQ ID NO: 9384319 - DNA, 22 bp, Homo sapiens
ctctcctttgaagcaactgtat

SEQ ID NO: 9384320 - DNA, 22 bp, Homo sapiens
ctctccttgcagatggctgcct

SEQ ID NO: 9384321 - DNA, 17 bp, Homo sapiens
ctctccttcctctgagg

SEQ ID NO: 9384322 - DNA, 17 bp, Homo sapiens
ctctccttcctctgagg

SEQ ID NO: 9384323 - DNA, 22 bp, Homo sapiens
ctctccttgcagatggctgcct

SEQ ID NO: 9384324 - DNA, 22 bp, Homo sapiens
ctctcgccagcggggctgcgct

SEQ ID NO: 9384325 - DNA, 22 bp, Homo sapiens
ctctcgccagcggggctgcgct

SEQ ID NO: 9384326 - DNA, 21 bp, Homo sapiens
ctctctagatggcttccagcc

SEQ ID NO: 9384327 - DNA, 22 bp, Homo sapiens
ctctctatggatgcagtttttc

SEQ ID NO: 9384328 - DNA, 19 bp, Homo sapiens
ctctctccagtggctggct

SEQ ID NO: 9384329 - DNA, 19 bp, Homo sapiens
ctctctccagtggctggct

SEQ ID NO: 9384330 - DNA, 22 bp, Homo sapiens
ctccttggtgtagtactgagca

SEQ ID NO: 9384331 - DNA, 22 bp, Homo sapiens
ctccttggtgtagtactgagca

SEQ ID NO: 9384332 - DNA, 22 bp, Homo sapiens
ctccttggtgtagtactgagca

SEQ ID NO: 9384333 - DNA, 22 bp, Homo sapiens
ctccttctgggcctggcagtgg

SEQ ID NO: 9384334 - DNA, 18 bp, Homo sapiens
ctccttggagaagaggcc

SEQ ID NO: 9384335 - DNA, 18 bp, Homo sapiens
ctccttggagaagaggcc

SEQ ID NO: 9384336 - DNA, 23 bp, Homo sapiens
ctccttggtatgccatgcccagc

SEQ ID NO: 9384337 - DNA, 22 bp, Homo sapiens
ctcggagatgctggctgagatc

SEQ ID NO: 9384338 - DNA, 22 bp, Homo sapiens
ctcgcgttccagctgcgggccg

SEQ ID NO: 9384339 - DNA, 22 bp, Homo sapiens
ctcgcctgcctgtgtctctccc

SEQ ID NO: 9384340 - DNA, 22 bp, Homo sapiens
ctcggaagaagcgttctcagag

SEQ ID NO: 9384341 - DNA, 22 bp, Homo sapiens
ctccttttcctactcatactat

SEQ ID NO: 9384342 - DNA, 22 bp, Homo sapiens
ctcctgagtagtagcattgtca

SEQ ID NO: 9384343 - DNA, 22 bp, Homo sapiens
ctcctgaggggacaggactcat

SEQ ID NO: 9384344 - DNA, 22 bp, Homo sapiens
ctcctgaggggacaggactcat

SEQ ID NO: 9384345 - DNA, 22 bp, Homo sapiens
ctcctgaggggacaggactcat

SEQ ID NO: 9384346 - DNA, 22 bp, Homo sapiens
ctcctgaggggacaggactcat

SEQ ID NO: 9384347 - DNA, 22 bp, Homo sapiens
ctccttctgaggctctgggttc

SEQ ID NO: 9384348 - DNA, 22 bp, Homo sapiens
ctcctggtgctggggctgccgc

SEQ ID NO: 9384349 - DNA, 22 bp, Homo sapiens
ctcctgcatgctcacatatgcc

SEQ ID NO: 9384350 - DNA, 22 bp, Homo sapiens
agtgctaccctgggaggagctc

SEQ ID NO: 9384351 - DNA, 22 bp, Homo sapiens
ctccagagagtccagctctggg

SEQ ID NO: 9384352 - DNA, 22 bp, Homo sapiens
ctccagagagtccagctctggg

SEQ ID NO: 9384353 - DNA, 22 bp, Homo sapiens
agtgctatcgagttctaatgct

SEQ ID NO: 9384354 - DNA, 22 bp, Homo sapiens
agtgctgactctgggcacagtg

SEQ ID NO: 9384355 - DNA, 22 bp, Homo sapiens
agtgctgaggccatactccata

SEQ ID NO: 9384356 - DNA, 22 bp, Homo sapiens
agtgctgaggagaggtactcca

SEQ ID NO: 9384357 - DNA, 22 bp, Homo sapiens
agtgctggaaagggacggagga

SEQ ID NO: 9384358 - DNA, 23 bp, Homo sapiens
agtgctggagaagcttctggctt

SEQ ID NO: 9384359 - DNA, 22 bp, Homo sapiens
agtgctggagggaggcaggttc

SEQ ID NO: 9384360 - DNA, 23 bp, Homo sapiens
agtgctggagaagcttctggctt

SEQ ID NO: 9384361 - DNA, 23 bp, Homo sapiens
agtgctggagaagcttctggctt

SEQ ID NO: 9384362 - DNA, 22 bp, Homo sapiens
agtgctggattacaggcgtgag

SEQ ID NO: 9384363 - DNA, 22 bp, Homo sapiens
agtgctggattacaggcgtgag

SEQ ID NO: 9384364 - DNA, 22 bp, Homo sapiens
agtgctggattacaggcgtgag

SEQ ID NO: 9384365 - DNA, 22 bp, Homo sapiens
agtgctggattacaggcgtgag

SEQ ID NO: 9384366 - DNA, 22 bp, Homo sapiens
agtgctggattacaggcgtgag

SEQ ID NO: 9384367 - DNA, 22 bp, Homo sapiens
agtgctggattacaggcgtgag

SEQ ID NO: 9384368 - DNA, 22 bp, Homo sapiens
agtgctggagggaggcaggttc

SEQ ID NO: 9384369 - DNA, 22 bp, Homo sapiens
agtgctggagggaggcaggttc

SEQ ID NO: 9384370 - DNA, 22 bp, Homo sapiens
agtgctggagggaggcaggttc

SEQ ID NO: 9384371 - DNA, 22 bp, Homo sapiens
agtgctggagggaggcaggttc

SEQ ID NO: 9384372 - DNA, 22 bp, Homo sapiens
agtgctggagggaggcaggttc

SEQ ID NO: 9384373 - DNA, 22 bp, Homo sapiens
ctcctgaggaaaagcttggtca

SEQ ID NO: 9384374 - DNA, 22 bp, Homo sapiens
ctcctgaggaaaagcttggtca

SEQ ID NO: 9384375 - DNA, 22 bp, Homo sapiens
ctcctgaggaaaagcttggtca

SEQ ID NO: 9384376 - DNA, 22 bp, Homo sapiens
ctcctgagctgcagccttgtgt

SEQ ID NO: 9384377 - DNA, 22 bp, Homo sapiens
ctcctgagggatgcttaggctt

SEQ ID NO: 9384378 - DNA, 22 bp, Homo sapiens
ctcctgagggatgcttaggctt

SEQ ID NO: 9384379 - DNA, 22 bp, Homo sapiens
ctcctgagggatgcttaggctt

SEQ ID NO: 9384380 - DNA, 22 bp, Homo sapiens
ctcctgaggacttctattgggt

SEQ ID NO: 9384381 - DNA, 22 bp, Homo sapiens
ctcctgagggatgcttaggctt

SEQ ID NO: 9384382 - DNA, 22 bp, Homo sapiens
ctcctgagggatgcttaggctt

SEQ ID NO: 9384383 - DNA, 22 bp, Homo sapiens
agtgggaaactggagagacttc

SEQ ID NO: 9384384 - DNA, 22 bp, Homo sapiens
agtggcttgctctgcctcagcc

SEQ ID NO: 9384385 - DNA, 22 bp, Homo sapiens
agtggcttggctgcactacagg

SEQ ID NO: 9384386 - DNA, 22 bp, Homo sapiens
agtggctgtttataggtgggta

SEQ ID NO: 9384387 - DNA, 22 bp, Homo sapiens
agtggctgtgaaatacatggga

SEQ ID NO: 9384388 - DNA, 22 bp, Homo sapiens
agtggctgttcattttacacaa

SEQ ID NO: 9384389 - DNA, 22 bp, Homo sapiens
agtggctgttccaggtgaggac

SEQ ID NO: 9384390 - DNA, 22 bp, Homo sapiens
agtggctgttccaggtgaggac

SEQ ID NO: 9384391 - DNA, 22 bp, Homo sapiens
agtggctgtttataggtgggta

SEQ ID NO: 9384392 - DNA, 22 bp, Homo sapiens
agtggctgtttataggtgggta

SEQ ID NO: 9384393 - DNA, 22 bp, Homo sapiens
ctctggggttagatctgatgct

SEQ ID NO: 9384394 - DNA, 22 bp, Homo sapiens
ctctggggttagatctgatgct

SEQ ID NO: 9384395 - DNA, 22 bp, Homo sapiens
ctctggtttctgacctgaattt

SEQ ID NO: 9384396 - DNA, 21 bp, Homo sapiens
ctctggtttgcattggattat

SEQ ID NO: 9384397 - DNA, 15 bp, Homo sapiens
ctctggtttttcttc

SEQ ID NO: 9384398 - DNA, 22 bp, Homo sapiens
ctctgtacaggagacatctcta

SEQ ID NO: 9384399 - DNA, 22 bp, Homo sapiens
ctctggtttttcttccattaag

SEQ ID NO: 9384400 - DNA, 22 bp, Homo sapiens
ctctgtcaggctgcagatgctc

SEQ ID NO: 9384401 - DNA, 22 bp, Homo sapiens
ctctggagatggttctcaattg

SEQ ID NO: 9384402 - DNA, 23 bp, Homo sapiens
ctctggagatcctctgcctgggt

SEQ ID NO: 9384403 - DNA, 22 bp, Homo sapiens
ctctggagatggttctcaattg

SEQ ID NO: 9384404 - DNA, 22 bp, Homo sapiens
ctctggagcaccgggctatcca

SEQ ID NO: 9384405 - DNA, 22 bp, Homo sapiens
ctctggagcaccgggctatcca

SEQ ID NO: 9384406 - DNA, 22 bp, Homo sapiens
agtggctgtgaaatacatggga

SEQ ID NO: 9384407 - DNA, 19 bp, Homo sapiens
ctctggagcagacactgga

SEQ ID NO: 9384408 - DNA, 22 bp, Homo sapiens
ctctggagaggttcccatggga

SEQ ID NO: 9384409 - DNA, 22 bp, Homo sapiens
ctctggagaggttcccatggga

SEQ ID NO: 9384410 - DNA, 23 bp, Homo sapiens
ctctggagatcctctgcctgggt

SEQ ID NO: 9384411 - DNA, 22 bp, Homo sapiens
ctctggagaggttcccatggga

SEQ ID NO: 9384412 - DNA, 19 bp, Homo sapiens
ctctggagaacaatagtgc

SEQ ID NO: 9384413 - DNA, 19 bp, Homo sapiens
ctctctccagtggctggct

SEQ ID NO: 9384414 - DNA, 20 bp, Homo sapiens
ctctctccatctcagtggcc

SEQ ID NO: 9384415 - DNA, 20 bp, Homo sapiens
ctctctccatctcagtggcc

SEQ ID NO: 9384416 - DNA, 17 bp, Homo sapiens
ctctggaattggtgaag

SEQ ID NO: 9384417 - DNA, 17 bp, Homo sapiens
ctctggaattggtgaag

SEQ ID NO: 9384418 - DNA, 17 bp, Homo sapiens
ctctggaattggtgaag

SEQ ID NO: 9384419 - DNA, 22 bp, Homo sapiens
ctctgctgcaggaaggcgtgca

SEQ ID NO: 9384420 - DNA, 22 bp, Homo sapiens
ctctctccttagctgcagacca

SEQ ID NO: 9384421 - DNA, 22 bp, Homo sapiens
ctctggaccctcctgctgagag

SEQ ID NO: 9384422 - DNA, 22 bp, Homo sapiens
ctctggacctcagctacagact

SEQ ID NO: 9384423 - DNA, 22 bp, Homo sapiens
ctctggacctcagtctactaat

SEQ ID NO: 9384424 - DNA, 22 bp, Homo sapiens
ctctggacttgtacatactcag

SEQ ID NO: 9384425 - DNA, 22 bp, Homo sapiens
ctctggactttttgtggattct

SEQ ID NO: 9384426 - DNA, 22 bp, Homo sapiens
ctctggacactggcatggggtc

SEQ ID NO: 9384427 - DNA, 22 bp, Homo sapiens
ctctggacccagacaaacctgg

SEQ ID NO: 9384428 - DNA, 22 bp, Homo sapiens
ctctggacccagacaaacctgg

SEQ ID NO: 9384429 - DNA, 22 bp, Homo sapiens
ctctggacccagacaaacctgg

SEQ ID NO: 9384430 - DNA, 22 bp, Homo sapiens
agtggtgctgcgcgcggagctc

SEQ ID NO: 9384431 - DNA, 22 bp, Homo sapiens
agtggtggagagatgaggacac

SEQ ID NO: 9384432 - DNA, 22 bp, Homo sapiens
agtggtggagagatgaggacac

SEQ ID NO: 9384433 - DNA, 22 bp, Homo sapiens
agtggtgcaaactggggcagct

SEQ ID NO: 9384434 - DNA, 22 bp, Homo sapiens
agtggtcttagcttgctgggct

SEQ ID NO: 9384435 - DNA, 22 bp, Homo sapiens
agtggtcttcaattccctttgt

SEQ ID NO: 9384436 - DNA, 21 bp, Homo sapiens
agtggtctttttcacccagtg

SEQ ID NO: 9384437 - DNA, 22 bp, Homo sapiens
agtggtgtcgtgggagtggaag

SEQ ID NO: 9384438 - DNA, 22 bp, Homo sapiens
agtggtggagccaggaaatgtg

SEQ ID NO: 9384439 - DNA, 22 bp, Homo sapiens
agtggtggagccaggaaatgtg

SEQ ID NO: 9384440 - DNA, 22 bp, Homo sapiens
agtggtggagccaggaaatgtg

SEQ ID NO: 9384441 - DNA, 22 bp, Homo sapiens
agtgtaaacttaagagaatatc

SEQ ID NO: 9384442 - DNA, 22 bp, Homo sapiens
agtgtaaagctgtatatgtgcc

SEQ ID NO: 9384443 - DNA, 22 bp, Homo sapiens
ctcttagatatggagaattacc

SEQ ID NO: 9384444 - DNA, 22 bp, Homo sapiens
ctctgtcctccacctgctttca

SEQ ID NO: 9384445 - DNA, 22 bp, Homo sapiens
ctctgtcctccacctgctttca

SEQ ID NO: 9384446 - DNA, 22 bp, Homo sapiens
ctctgtcctccacctgctttca

SEQ ID NO: 9384447 - DNA, 22 bp, Homo sapiens
ctctgtcccagacccacctctc

SEQ ID NO: 9384448 - DNA, 22 bp, Homo sapiens
ctctgtctatcccattctgtgc

SEQ ID NO: 9384449 - DNA, 22 bp, Homo sapiens
ctctgtgaacccctcctttctt

SEQ ID NO: 9384450 - DNA, 22 bp, Homo sapiens
agtggtctgggctaaatgaggt

SEQ ID NO: 9384451 - DNA, 22 bp, Homo sapiens
agtggtctgcctgcctcagcct

SEQ ID NO: 9384452 - DNA, 22 bp, Homo sapiens
agtggtctgggctaaatgaggt

SEQ ID NO: 9384453 - DNA, 18 bp, Homo sapiens
agtggtctgttatatcat

SEQ ID NO: 9384454 - DNA, 22 bp, Homo sapiens
agtggtctccccagtagaataa

SEQ ID NO: 9384455 - DNA, 22 bp, Homo sapiens
agtggtctctaaatgtttaaat

SEQ ID NO: 9384456 - DNA, 22 bp, Homo sapiens
agtggtctccccagtagaataa

SEQ ID NO: 9384457 - DNA, 22 bp, Homo sapiens
ctcttctttccatccctagcca

SEQ ID NO: 9384458 - DNA, 22 bp, Homo sapiens
ctcttctttagtccagaccatc

SEQ ID NO: 9384459 - DNA, 22 bp, Homo sapiens
ctcttcttggcccccatgaggg

SEQ ID NO: 9384460 - DNA, 22 bp, Homo sapiens
ctcttagtaatgccatgaagca

SEQ ID NO: 9384461 - DNA, 22 bp, Homo sapiens
ctcttgcatgagatccaggagt

SEQ ID NO: 9384462 - DNA, 22 bp, Homo sapiens
ctcttgccagagatgagactct

SEQ ID NO: 9384463 - DNA, 22 bp, Homo sapiens
ctcttgaactttctagtttcat

SEQ ID NO: 9384464 - DNA, 22 bp, Homo sapiens
ctcttgaagggcatctgagtta

SEQ ID NO: 9384465 - DNA, 22 bp, Homo sapiens
ctcttgaagggcatctgagtta

SEQ ID NO: 9384466 - DNA, 22 bp, Homo sapiens
ctcttgcagataccttgaagga

SEQ ID NO: 9384467 - DNA, 21 bp, Homo sapiens
ctcttggtcctccctgtgacc

SEQ ID NO: 9384468 - DNA, 21 bp, Homo sapiens
ctcttgtctttgctcagtagc

SEQ ID NO: 9384469 - DNA, 22 bp, Homo sapiens
ctcttggccagacacagaggca

SEQ ID NO: 9384470 - DNA, 22 bp, Homo sapiens
ctcttgggagtgctctggagaa

SEQ ID NO: 9384471 - DNA, 22 bp, Homo sapiens
ctcttgggagtgctctggagaa

SEQ ID NO: 9384472 - DNA, 19 bp, Homo sapiens
ctcttgggtggcagaggcc

SEQ ID NO: 9384473 - DNA, 19 bp, Homo sapiens
ctcttgggtggcagaggcc

SEQ ID NO: 9384474 - DNA, 19 bp, Homo sapiens
ctcttgggtggcagaggcc

SEQ ID NO: 9384475 - DNA, 22 bp, Homo sapiens
ctcttgggatttgcaggctcag

SEQ ID NO: 9384476 - DNA, 22 bp, Homo sapiens
ctcttgggatttgcaggctcag

SEQ ID NO: 9384477 - DNA, 22 bp, Homo sapiens
agtcccagcccagtcctgtaag

SEQ ID NO: 9384478 - DNA, 22 bp, Homo sapiens
agtcccagatgacccagctact

SEQ ID NO: 9384479 - DNA, 22 bp, Homo sapiens
ctcaccagatgtcgggctgagt

SEQ ID NO: 9384480 - DNA, 22 bp, Homo sapiens
agtcccagcctaggctgtgctg

SEQ ID NO: 9384481 - DNA, 22 bp, Homo sapiens
agtcccagatgacccagctact

SEQ ID NO: 9384482 - DNA, 22 bp, Homo sapiens
agtcccagatctacaggaggga

SEQ ID NO: 9384483 - DNA, 22 bp, Homo sapiens
agtcccagatctacaggaggga

SEQ ID NO: 9384484 - DNA, 22 bp, Homo sapiens
ctcagaagaacaaaggctctac

SEQ ID NO: 9384485 - DNA, 22 bp, Homo sapiens
ctcagaagaacaaaggctctac

SEQ ID NO: 9384486 - DNA, 22 bp, Homo sapiens
ctcagaagaatcagcagctatt

SEQ ID NO: 9384487 - DNA, 22 bp, Homo sapiens
ctcagaagccttcagtcttggc

SEQ ID NO: 9384488 - DNA, 22 bp, Homo sapiens
ctcagacaaatgattaaggtta

SEQ ID NO: 9384489 - DNA, 22 bp, Homo sapiens
ctcagaggtcaagagcagagct

SEQ ID NO: 9384490 - DNA, 22 bp, Homo sapiens
ctcagaggggatgcttggagaa

SEQ ID NO: 9384491 - DNA, 22 bp, Homo sapiens
ctcagagggtacaggtgaaccc

SEQ ID NO: 9384492 - DNA, 21 bp, Homo sapiens
ctcagacagggaggctctggg

SEQ ID NO: 9384493 - DNA, 21 bp, Homo sapiens
ctcagaccacagctcacaccc

SEQ ID NO: 9384494 - DNA, 22 bp, Homo sapiens
ctcagactggagccccaaggac

SEQ ID NO: 9384495 - DNA, 22 bp, Homo sapiens
ctcagactaaaatgggaatgta

SEQ ID NO: 9384496 - DNA, 22 bp, Homo sapiens
ctcagactaaaatgggaatgta

SEQ ID NO: 9384497 - DNA, 22 bp, Homo sapiens
ctcagactaaaatgggaatgta

SEQ ID NO: 9384498 - DNA, 22 bp, Homo sapiens
ctcagactggagccccaaggac

SEQ ID NO: 9384499 - DNA, 23 bp, Homo sapiens
ctcagaggtgtttttcacttact

SEQ ID NO: 9384500 - DNA, 22 bp, Homo sapiens
ctcagataatctttgagtcttc

SEQ ID NO: 9384501 - DNA, 22 bp, Homo sapiens
ctcagattctgaataataaaca

SEQ ID NO: 9384502 - DNA, 22 bp, Homo sapiens
ctcagcaagattaagcagcttg

SEQ ID NO: 9384503 - DNA, 22 bp, Homo sapiens
ctatttatgtccaagtgtttta

SEQ ID NO: 9384504 - DNA, 22 bp, Homo sapiens
ctcaaaatggttaattttaata

SEQ ID NO: 9384505 - DNA, 22 bp, Homo sapiens
ctatttatgtccaagtgtttta

SEQ ID NO: 9384506 - DNA, 21 bp, Homo sapiens
ctcaaaattctttctgttgga

SEQ ID NO: 9384507 - DNA, 22 bp, Homo sapiens
ctatttatgtgctattttgtat

SEQ ID NO: 9384508 - DNA, 21 bp, Homo sapiens
ctcaaagaccaaaagtgtaga

SEQ ID NO: 9384509 - DNA, 22 bp, Homo sapiens
ctcaaatagaactgatctataa

SEQ ID NO: 9384510 - DNA, 22 bp, Homo sapiens
ctcaaatagaactgatctataa

SEQ ID NO: 9384511 - DNA, 22 bp, Homo sapiens
ctcaaatatgtggtcagaaagc

SEQ ID NO: 9384512 - DNA, 22 bp, Homo sapiens
ctcaaatataagctaaatgtgg

SEQ ID NO: 9384513 - DNA, 22 bp, Homo sapiens
agtcccagagaggtcggggcca

SEQ ID NO: 9384514 - DNA, 20 bp, Homo sapiens
agtcccaacattcagctctg

SEQ ID NO: 9384515 - DNA, 23 bp, Homo sapiens
ctcaacatccattcttgcccttc

SEQ ID NO: 9384516 - DNA, 22 bp, Homo sapiens
ctcaaatccccgttcctcattc

SEQ ID NO: 9384517 - DNA, 22 bp, Homo sapiens
ctcaaatatgtggtcagaaagc

SEQ ID NO: 9384518 - DNA, 22 bp, Homo sapiens
cggggtggcactctaaatagaa

SEQ ID NO: 9384519 - DNA, 22 bp, Homo sapiens
cggggtgggaatagacctgtct

SEQ ID NO: 9384520 - DNA, 22 bp, Homo sapiens
cgggtaggaacaaagagctgca

SEQ ID NO: 9384521 - DNA, 22 bp, Homo sapiens
cgggttcacgccattctcctgc

SEQ ID NO: 9384522 - DNA, 22 bp, Homo sapiens
cgggttcacgccattctcctgc

SEQ ID NO: 9384523 - DNA, 23 bp, Homo sapiens
cgggtaggaacatcaggatgtga

SEQ ID NO: 9384524 - DNA, 22 bp, Homo sapiens
cgggtaggaacaaagagctgca

SEQ ID NO: 9384525 - DNA, 22 bp, Homo sapiens
agtatctgcatgattttgagaa

SEQ ID NO: 9384526 - DNA, 22 bp, Homo sapiens
agtatcaatcaccctttgaagt

SEQ ID NO: 9384527 - DNA, 22 bp, Homo sapiens
agtatgaagaatacatagatga

SEQ ID NO: 9384528 - DNA, 22 bp, Homo sapiens
agtatgaagaatacatagatga

SEQ ID NO: 9384529 - DNA, 22 bp, Homo sapiens
agtatgaatacagattttctct

SEQ ID NO: 9384530 - DNA, 22 bp, Homo sapiens
agtatgaatggaaactacctat

SEQ ID NO: 9384531 - DNA, 22 bp, Homo sapiens
ctcagccccagcccagatagca

SEQ ID NO: 9384532 - DNA, 22 bp, Homo sapiens
ctcagccccagcccagatagca

SEQ ID NO: 9384533 - DNA, 22 bp, Homo sapiens
ctcagcacattcctaagggatg

SEQ ID NO: 9384534 - DNA, 22 bp, Homo sapiens
ctcagcccggtgctcgtgccac

SEQ ID NO: 9384535 - DNA, 22 bp, Homo sapiens
ctcagccctccccggggaataa

SEQ ID NO: 9384536 - DNA, 22 bp, Homo sapiens
ctcagcctgtgaagagcagagg

SEQ ID NO: 9384537 - DNA, 22 bp, Homo sapiens
ctcagctcaaaattcacctttg

SEQ ID NO: 9384538 - DNA, 22 bp, Homo sapiens
ctcagctccagccctcagcagc

SEQ ID NO: 9384539 - DNA, 22 bp, Homo sapiens
ctcagctccagccctcagcagc

SEQ ID NO: 9384540 - DNA, 22 bp, Homo sapiens
ctcagctccagccctcagcagc

SEQ ID NO: 9384541 - DNA, 22 bp, Homo sapiens
ctcagctccctccacccagacc

SEQ ID NO: 9384542 - DNA, 22 bp, Homo sapiens
ctcagctccaggtgtgcatctt

SEQ ID NO: 9384543 - DNA, 22 bp, Homo sapiens
ctcagctctttatactagctgt

SEQ ID NO: 9384544 - DNA, 22 bp, Homo sapiens
ctcagctctttatactagctgt

SEQ ID NO: 9384545 - DNA, 22 bp, Homo sapiens
ctcagctctttatactagctgt

SEQ ID NO: 9384546 - DNA, 22 bp, Homo sapiens
ctcagctgcagcctggctggca

SEQ ID NO: 9384547 - DNA, 22 bp, Homo sapiens
agtctcagagtacctgagggac

SEQ ID NO: 9384548 - DNA, 22 bp, Homo sapiens
agtctcagctacttgggaggct

SEQ ID NO: 9384549 - DNA, 22 bp, Homo sapiens
agtctcagccacacagacctat

SEQ ID NO: 9384550 - DNA, 22 bp, Homo sapiens
agtctcagccacacagacctat

SEQ ID NO: 9384551 - DNA, 22 bp, Homo sapiens
ctcagggacaaggggagacccc

SEQ ID NO: 9384552 - DNA, 22 bp, Homo sapiens
ctcagggacggaggcttgcgga

SEQ ID NO: 9384553 - DNA, 22 bp, Homo sapiens
ctcagggacgttagaggacagg

SEQ ID NO: 9384554 - DNA, 22 bp, Homo sapiens
ctcagggacgttagaggacagg

SEQ ID NO: 9384555 - DNA, 22 bp, Homo sapiens
ctcagggacttggatcctggcc

SEQ ID NO: 9384556 - DNA, 22 bp, Homo sapiens
ctcagggaggccctgggaccct

SEQ ID NO: 9384557 - DNA, 22 bp, Homo sapiens
ctcagggagagccaagagttcc

SEQ ID NO: 9384558 - DNA, 22 bp, Homo sapiens
ctcagggaggagcttctgggcc

SEQ ID NO: 9384559 - DNA, 22 bp, Homo sapiens
ctcagggaggtcctgtgctgaa

SEQ ID NO: 9384560 - DNA, 22 bp, Homo sapiens
ctcagggaggtcctgtgctgaa

SEQ ID NO: 9384561 - DNA, 22 bp, Homo sapiens
ctcagggaggcctctgctggtt

SEQ ID NO: 9384562 - DNA, 22 bp, Homo sapiens
ctcagggaggcctctgctggtt

SEQ ID NO: 9384563 - DNA, 19 bp, Homo sapiens
agtctcagtgtacagaggc

SEQ ID NO: 9384564 - DNA, 22 bp, Homo sapiens
agtctcatcaggcatgtagtca

SEQ ID NO: 9384565 - DNA, 22 bp, Homo sapiens
agtctccacccatgacagtaca

SEQ ID NO: 9384566 - DNA, 21 bp, Homo sapiens
ctcaggcatttgaggagagtc

SEQ ID NO: 9384567 - DNA, 22 bp, Homo sapiens
ctcaggccaataagctccagcc

SEQ ID NO: 9384568 - DNA, 22 bp, Homo sapiens
ctccagagacacttctcatgat

SEQ ID NO: 9384569 - DNA, 22 bp, Homo sapiens
ctccagagacacttctcatgat

SEQ ID NO: 9384570 - DNA, 22 bp, Homo sapiens
ctccagaattgtccattggaaa

SEQ ID NO: 9384571 - DNA, 22 bp, Homo sapiens
ctccagagagaaaggaggccgc

SEQ ID NO: 9384572 - DNA, 22 bp, Homo sapiens
ctccagagagaaaggaggccgc

SEQ ID NO: 9384573 - DNA, 22 bp, Homo sapiens
ctccagagagaaaggaggccgc

SEQ ID NO: 9384574 - DNA, 22 bp, Homo sapiens
ctccagagagaaaggaggccgc

SEQ ID NO: 9384575 - DNA, 22 bp, Homo sapiens
ctccagaactgggagagaataa

SEQ ID NO: 9384576 - DNA, 22 bp, Homo sapiens
ctccagaaggtgggggagccac

SEQ ID NO: 9384577 - DNA, 22 bp, Homo sapiens
ctccagaaatttggatgcagca

SEQ ID NO: 9384578 - DNA, 22 bp, Homo sapiens
ctccagaaattcaacagcaaat

SEQ ID NO: 9384579 - DNA, 22 bp, Homo sapiens
ctccagaaatttggatgcagca

SEQ ID NO: 9384580 - DNA, 22 bp, Homo sapiens
ctccagaaattcaacagcaaat

SEQ ID NO: 9384581 - DNA, 22 bp, Homo sapiens
ctccagaaattcaacagcaaat

SEQ ID NO: 9384582 - DNA, 22 bp, Homo sapiens
agtgacagccaaatccatccat

SEQ ID NO: 9384583 - DNA, 22 bp, Homo sapiens
agtgacagattaccggcagagc

SEQ ID NO: 9384584 - DNA, 20 bp, Homo sapiens
agtgacagagactgtgtggc

SEQ ID NO: 9384585 - DNA, 22 bp, Homo sapiens
ctcagtgggaggagtcagttgc

SEQ ID NO: 9384586 - DNA, 22 bp, Homo sapiens
ctcagggagtagcacatgtgga

SEQ ID NO: 9384587 - DNA, 22 bp, Homo sapiens
ctcagtgctttggatcctggat

SEQ ID NO: 9384588 - DNA, 22 bp, Homo sapiens
ctcagtggtggtcacttggtgg

SEQ ID NO: 9384589 - DNA, 22 bp, Homo sapiens
ctcagtggttgagagcctgggc

SEQ ID NO: 9384590 - DNA, 23 bp, Homo sapiens
ctcagtgtgtgacccatggcctc

SEQ ID NO: 9384591 - DNA, 22 bp, Homo sapiens
ctcagtgtgagtgagaagtgca

SEQ ID NO: 9384592 - DNA, 22 bp, Homo sapiens
agtgacaacatcaattggggct

SEQ ID NO: 9384593 - DNA, 22 bp, Homo sapiens
agtgacaaaacggaacatacag

SEQ ID NO: 9384594 - DNA, 22 bp, Homo sapiens
agtgacacggagagacagcatg

SEQ ID NO: 9384595 - DNA, 23 bp, Homo sapiens
agtgacaatgggccagaggtggc

SEQ ID NO: 9384596 - DNA, 17 bp, Homo sapiens
agtgaaatttacattgc

SEQ ID NO: 9384597 - DNA, 17 bp, Homo sapiens
agtgaaatttacattgc

SEQ ID NO: 9384598 - DNA, 22 bp, Homo sapiens
agtgaatttcatgtaagtgtgt

SEQ ID NO: 9384599 - DNA, 22 bp, Homo sapiens
agtgaatttaaaacactgagga

SEQ ID NO: 9384600 - DNA, 22 bp, Homo sapiens
caacatcagtcctcatgagaca

SEQ ID NO: 9384601 - DNA, 22 bp, Homo sapiens
caacatattttccaagagtgaa

SEQ ID NO: 9384602 - DNA, 22 bp, Homo sapiens
caacatattgtgggatgagaga

SEQ ID NO: 9384603 - DNA, 22 bp, Homo sapiens
caacatatgattttgtatataa

SEQ ID NO: 9384604 - DNA, 22 bp, Homo sapiens
caacatatataaggatttacta

SEQ ID NO: 9384605 - DNA, 22 bp, Homo sapiens
caacatataatatttgagttct

SEQ ID NO: 9384606 - DNA, 22 bp, Homo sapiens
caaccccactacacgttggaga

SEQ ID NO: 9384607 - DNA, 22 bp, Homo sapiens
caacatttgtgatgagcaaact

SEQ ID NO: 9384608 - DNA, 22 bp, Homo sapiens
caacattttcatggccagggag

SEQ ID NO: 9384609 - DNA, 22 bp, Homo sapiens
caacatttgtgatgagcaaact

SEQ ID NO: 9384610 - DNA, 22 bp, Homo sapiens
caacatttcaaggtctttagga

SEQ ID NO: 9384611 - DNA, 22 bp, Homo sapiens
caacatttgagtaaagaaatgg

SEQ ID NO: 9384612 - DNA, 22 bp, Homo sapiens
caacatttgagtaaagaaatgg

SEQ ID NO: 9384613 - DNA, 22 bp, Homo sapiens
caacatttcaaggtctttagga

SEQ ID NO: 9384614 - DNA, 22 bp, Homo sapiens
caacatttcaaggtctttagga

SEQ ID NO: 9384615 - DNA, 22 bp, Homo sapiens
caacattatatagccacatgcc

SEQ ID NO: 9384616 - DNA, 22 bp, Homo sapiens
caacattatatagccacatgcc

SEQ ID NO: 9384617 - DNA, 22 bp, Homo sapiens
caacatggtaaaaccccgtctc

SEQ ID NO: 9384618 - DNA, 22 bp, Homo sapiens
caacatggtgaaaccccgtctc

SEQ ID NO: 9384619 - DNA, 22 bp, Homo sapiens
caacatggcgaaaccccatctc

SEQ ID NO: 9384620 - DNA, 22 bp, Homo sapiens
gctgccacattttcaggactaa

SEQ ID NO: 9384621 - DNA, 22 bp, Homo sapiens
gctgcattgctataaaatacaa

SEQ ID NO: 9384622 - DNA, 23 bp, Homo sapiens
gctgccacagggctcaggcaggt

SEQ ID NO: 9384623 - DNA, 22 bp, Homo sapiens
gctgccacattttcaggactaa

SEQ ID NO: 9384624 - DNA, 22 bp, Homo sapiens
caacactgacaatggactgatt

SEQ ID NO: 9384625 - DNA, 22 bp, Homo sapiens
caacactgattatggctgagct

SEQ ID NO: 9384626 - DNA, 22 bp, Homo sapiens
caacagtcagaatgaagctgag

SEQ ID NO: 9384627 - DNA, 22 bp, Homo sapiens
gctgcagtgagccaagatcgtg

SEQ ID NO: 9384628 - DNA, 22 bp, Homo sapiens
gctgcagtgagccaagatcgtg

SEQ ID NO: 9384629 - DNA, 22 bp, Homo sapiens
gctgcagtgagccaagatcgtg

SEQ ID NO: 9384630 - DNA, 22 bp, Homo sapiens
gctgcagtgagccaagatcgtg

SEQ ID NO: 9384631 - DNA, 22 bp, Homo sapiens
gctgcaggtttgtctagtctgg

SEQ ID NO: 9384632 - DNA, 17 bp, Homo sapiens
gctgcagcggtaggcag

SEQ ID NO: 9384633 - DNA, 22 bp, Homo sapiens
gctgcaggtttgtctagtctgg

SEQ ID NO: 9384634 - DNA, 22 bp, Homo sapiens
gctgcagccctgcggatcactt

SEQ ID NO: 9384635 - DNA, 22 bp, Homo sapiens
gctgcagccctgcggatcactt

SEQ ID NO: 9384636 - DNA, 22 bp, Homo sapiens
gctgcagcctttgggaaggaca

SEQ ID NO: 9384637 - DNA, 22 bp, Homo sapiens
gctgcagccttcttgccattaa

SEQ ID NO: 9384638 - DNA, 22 bp, Homo sapiens
gctgcagcctttgggaaggaca

SEQ ID NO: 9384639 - DNA, 22 bp, Homo sapiens
gctcctgcagagatgttccatg

SEQ ID NO: 9384640 - DNA, 22 bp, Homo sapiens
gctcctgcaggacccaggagac

SEQ ID NO: 9384641 - DNA, 17 bp, Homo sapiens
gctcctgcaggtcagga

SEQ ID NO: 9384642 - DNA, 18 bp, Homo sapiens
gctcctggaccaggtcac

SEQ ID NO: 9384643 - DNA, 22 bp, Homo sapiens
gctcctcttctcccactgaatg

SEQ ID NO: 9384644 - DNA, 22 bp, Homo sapiens
caaaggtttcacagtagcccat

SEQ ID NO: 9384645 - DNA, 22 bp, Homo sapiens
caaaggttgttgagagtgcagg

SEQ ID NO: 9384646 - DNA, 22 bp, Homo sapiens
caaaggttatgaaccacttgta

SEQ ID NO: 9384647 - DNA, 22 bp, Homo sapiens
caaaggttggaaatgtttacca

SEQ ID NO: 9384648 - DNA, 22 bp, Homo sapiens
caaagtaattacggttttggcc

SEQ ID NO: 9384649 - DNA, 22 bp, Homo sapiens
caaagtaatttggagatatata

SEQ ID NO: 9384650 - DNA, 18 bp, Homo sapiens
gctcctggagtctgactc

SEQ ID NO: 9384651 - DNA, 18 bp, Homo sapiens
gctcctggagtctgactc

SEQ ID NO: 9384652 - DNA, 22 bp, Homo sapiens
gctcctggagagattgagaaag

SEQ ID NO: 9384653 - DNA, 18 bp, Homo sapiens
gctcctggaccaggtcac

SEQ ID NO: 9384654 - DNA, 22 bp, Homo sapiens
gctcctggagagattgagaaag

SEQ ID NO: 9384655 - DNA, 22 bp, Homo sapiens
gctgcagacttctcatctcatt

SEQ ID NO: 9384656 - DNA, 22 bp, Homo sapiens
gctgcagagacagctgccgatg

SEQ ID NO: 9384657 - DNA, 22 bp, Homo sapiens
gctgaggtggaggaaggagacc

SEQ ID NO: 9384658 - DNA, 20 bp, Homo sapiens
gctgaggtggaggaaggaga

SEQ ID NO: 9384659 - DNA, 19 bp, Homo sapiens
gctcctggatgacctgtgg

SEQ ID NO: 9384660 - DNA, 19 bp, Homo sapiens
gctcctggatgacctgtgg

SEQ ID NO: 9384661 - DNA, 19 bp, Homo sapiens
gctcctggatgacctgtgg

SEQ ID NO: 9384662 - DNA, 19 bp, Homo sapiens
gctcctggatgacctgtgg

SEQ ID NO: 9384663 - DNA, 22 bp, Homo sapiens
gctgcagagtgatgaagtgggg

SEQ ID NO: 9384664 - DNA, 22 bp, Homo sapiens
gctgcagatcccacccattccc

SEQ ID NO: 9384665 - DNA, 19 bp, Homo sapiens
gctgcagagtattcttggg

SEQ ID NO: 9384666 - DNA, 22 bp, Homo sapiens
gctgcagagtgatgaagtgggg

SEQ ID NO: 9384667 - DNA, 22 bp, Homo sapiens
gctgcagagatgggtgcccttt

SEQ ID NO: 9384668 - DNA, 22 bp, Homo sapiens
gctgcagagggaggggctcgca

SEQ ID NO: 9384669 - DNA, 22 bp, Homo sapiens
gctgcagcagctgcagggttgt

SEQ ID NO: 9384670 - DNA, 19 bp, Homo sapiens
gctgcagcagagaaactgg

SEQ ID NO: 9384671 - DNA, 22 bp, Homo sapiens
gctgcagccaaattcattgtca

SEQ ID NO: 9384672 - DNA, 22 bp, Homo sapiens
gctgcagcccggcgcgcctgag

SEQ ID NO: 9384673 - DNA, 22 bp, Homo sapiens
gctgcagcccggcgcgcctgag

SEQ ID NO: 9384674 - DNA, 22 bp, Homo sapiens
gctgcagcagaagttctcagag

SEQ ID NO: 9384675 - DNA, 22 bp, Homo sapiens
gctgcagcaagccctccagggg

SEQ ID NO: 9384676 - DNA, 22 bp, Homo sapiens
gctgcagcaagccctccagggg

SEQ ID NO: 9384677 - DNA, 22 bp, Homo sapiens
caaccccactacacgttggaga

SEQ ID NO: 9384678 - DNA, 22 bp, Homo sapiens
caaccctctcgcctcaattctg

SEQ ID NO: 9384679 - DNA, 22 bp, Homo sapiens
caaccgcggggcccagcggttc

SEQ ID NO: 9384680 - DNA, 22 bp, Homo sapiens
gctgccttccaaagagttttat

SEQ ID NO: 9384681 - DNA, 22 bp, Homo sapiens
gctgccttccataatgtacgta

SEQ ID NO: 9384682 - DNA, 22 bp, Homo sapiens
caactacaggaaaagtcattca

SEQ ID NO: 9384683 - DNA, 18 bp, Homo sapiens
gctgccttcccagtcaag

SEQ ID NO: 9384684 - DNA, 22 bp, Homo sapiens
gctgccttcccggaatgtcatc

SEQ ID NO: 9384685 - DNA, 22 bp, Homo sapiens
gctgccttccctgttctttcag

SEQ ID NO: 9384686 - DNA, 22 bp, Homo sapiens
gctgccttgaacatcctaagta

SEQ ID NO: 9384687 - DNA, 22 bp, Homo sapiens
gctgccttgaacttggcctggg

SEQ ID NO: 9384688 - DNA, 22 bp, Homo sapiens
gctgccttgaacttggcctggg

SEQ ID NO: 9384689 - DNA, 22 bp, Homo sapiens
gctgccttctggaggaagtgaa

SEQ ID NO: 9384690 - DNA, 22 bp, Homo sapiens
gctgccttctgagaagttaaat

SEQ ID NO: 9384691 - DNA, 22 bp, Homo sapiens
gctgccttcttctgactctatt

SEQ ID NO: 9384692 - DNA, 22 bp, Homo sapiens
gctgcctttgtgagccaagggg

SEQ ID NO: 9384693 - DNA, 22 bp, Homo sapiens
gctgcctttagggggtgctcag

SEQ ID NO: 9384694 - DNA, 22 bp, Homo sapiens
gctgcctttagggggtgctcag

SEQ ID NO: 9384695 - DNA, 22 bp, Homo sapiens
gctgccttgccaggggcagaaa

SEQ ID NO: 9384696 - DNA, 22 bp, Homo sapiens
gctgccttggtagtgaccatct

SEQ ID NO: 9384697 - DNA, 22 bp, Homo sapiens
gctgccttgcttactccactgc

SEQ ID NO: 9384698 - DNA, 22 bp, Homo sapiens
caagagctgaggctggagaggt

SEQ ID NO: 9384699 - DNA, 22 bp, Homo sapiens
gctgctggcactggagtgagcc

SEQ ID NO: 9384700 - DNA, 22 bp, Homo sapiens
gctgctggccccacatgctcca

SEQ ID NO: 9384701 - DNA, 22 bp, Homo sapiens
caagacaagatctaagcatgct

SEQ ID NO: 9384702 - DNA, 22 bp, Homo sapiens
gctgctggagagcgagactgtt

SEQ ID NO: 9384703 - DNA, 22 bp, Homo sapiens
gctgctggagagcgagactgtt

SEQ ID NO: 9384704 - DNA, 22 bp, Homo sapiens
gctgctggaagcatgcgatgaa

SEQ ID NO: 9384705 - DNA, 22 bp, Homo sapiens
gctgctggagctttgcagaagg

SEQ ID NO: 9384706 - DNA, 22 bp, Homo sapiens
gctgctggatgcgcttgatggt

SEQ ID NO: 9384707 - DNA, 22 bp, Homo sapiens
gctgctggcactggagtgagcc

SEQ ID NO: 9384708 - DNA, 22 bp, Homo sapiens
gctgctggcactggagtgagcc

SEQ ID NO: 9384709 - DNA, 22 bp, Homo sapiens
gctgctggcactggagtgagcc

SEQ ID NO: 9384710 - DNA, 22 bp, Homo sapiens
caaggaggaagatgcaggggac

SEQ ID NO: 9384711 - DNA, 22 bp, Homo sapiens
caaggaggcagtgggacttgaa

SEQ ID NO: 9384712 - DNA, 22 bp, Homo sapiens
caaggagagtaattgaatgaga

SEQ ID NO: 9384713 - DNA, 22 bp, Homo sapiens
caaggagataaaatgttgagct

SEQ ID NO: 9384714 - DNA, 22 bp, Homo sapiens
caaggagataaaatgttgagct

SEQ ID NO: 9384715 - DNA, 22 bp, Homo sapiens
caaggagaaaacggcttctgaa

SEQ ID NO: 9384716 - DNA, 22 bp, Homo sapiens
caaggagaaaacggcttctgaa

SEQ ID NO: 9384717 - DNA, 22 bp, Homo sapiens
caaggagaaaacggcttctgaa

SEQ ID NO: 9384718 - DNA, 22 bp, Homo sapiens
caaggacagcgtcaggtgcaac

SEQ ID NO: 9384719 - DNA, 22 bp, Homo sapiens
caaggacactccctgctgggca

SEQ ID NO: 9384720 - DNA, 22 bp, Homo sapiens
caaggaagttttaggagaggaa

SEQ ID NO: 9384721 - DNA, 22 bp, Homo sapiens
caagctgctataggttgctggg

SEQ ID NO: 9384722 - DNA, 22 bp, Homo sapiens
caagctgctataggttgctggg

SEQ ID NO: 9384723 - DNA, 21 bp, Homo sapiens
caagctgcctgagggtggttg

SEQ ID NO: 9384724 - DNA, 21 bp, Homo sapiens
caagctgcctgagggtggttg

SEQ ID NO: 9384725 - DNA, 22 bp, Homo sapiens
caagattactatccactgctgg

SEQ ID NO: 9384726 - DNA, 22 bp, Homo sapiens
caagatggagtccgggaatgtg

SEQ ID NO: 9384727 - DNA, 22 bp, Homo sapiens
caagatggagaagcagcaaggg

SEQ ID NO: 9384728 - DNA, 22 bp, Homo sapiens
caagatgatccctgaaggcagc

SEQ ID NO: 9384729 - DNA, 22 bp, Homo sapiens
caagatgaagtgaagattagaa

SEQ ID NO: 9384730 - DNA, 22 bp, Homo sapiens
caagatgaaactacagggagga

SEQ ID NO: 9384731 - DNA, 21 bp, Homo sapiens
caagatctcggcttgcttcct

SEQ ID NO: 9384732 - DNA, 22 bp, Homo sapiens
caagagcttctgctcttcatgg

SEQ ID NO: 9384733 - DNA, 22 bp, Homo sapiens
caagaggcaaattgtctagaag

SEQ ID NO: 9384734 - DNA, 22 bp, Homo sapiens
caagagttatcaatctatgtgc

SEQ ID NO: 9384735 - DNA, 22 bp, Homo sapiens
caagagtgaaactctgtctcaa

SEQ ID NO: 9384736 - DNA, 22 bp, Homo sapiens
caagaggctaaactgggctatt

SEQ ID NO: 9384737 - DNA, 22 bp, Homo sapiens
caagaggctaaactgggctatt

SEQ ID NO: 9384738 - DNA, 22 bp, Homo sapiens
cacacgagccctggagccagca

SEQ ID NO: 9384739 - DNA, 22 bp, Homo sapiens
cacacctgtaatcctagcactt

SEQ ID NO: 9384740 - DNA, 22 bp, Homo sapiens
cacacctcacacctcgcatgct

SEQ ID NO: 9384741 - DNA, 23 bp, Homo sapiens
cacacccatcactaagagctcct

SEQ ID NO: 9384742 - DNA, 23 bp, Homo sapiens
cacacccatcactaagagctcct

SEQ ID NO: 9384743 - DNA, 22 bp, Homo sapiens
cacacccaaatttctctctcag

SEQ ID NO: 9384744 - DNA, 22 bp, Homo sapiens
cacacatttcagatgctacaat

SEQ ID NO: 9384745 - DNA, 22 bp, Homo sapiens
cacacattggttttactccttt

SEQ ID NO: 9384746 - DNA, 22 bp, Homo sapiens
cacacatttcagatgctacaat

SEQ ID NO: 9384747 - DNA, 22 bp, Homo sapiens
cacacattgaattcattcttgt

SEQ ID NO: 9384748 - DNA, 22 bp, Homo sapiens
cacacattcaccatgactgaaa

SEQ ID NO: 9384749 - DNA, 22 bp, Homo sapiens
cacacattgagcagctgtttgt

SEQ ID NO: 9384750 - DNA, 22 bp, Homo sapiens
cacacattggttttactccttt

SEQ ID NO: 9384751 - DNA, 22 bp, Homo sapiens
cacaccagcatggtctcagtgt

SEQ ID NO: 9384752 - DNA, 21 bp, Homo sapiens
cacaccaggcatgtcttgagc

SEQ ID NO: 9384753 - DNA, 21 bp, Homo sapiens
cacaccaggcatgtcttgagc

SEQ ID NO: 9384754 - DNA, 23 bp, Homo sapiens
cacaccaggagccgtctgggcca

SEQ ID NO: 9384755 - DNA, 22 bp, Homo sapiens
cacaccagaggttacctgcaaa

SEQ ID NO: 9384756 - DNA, 22 bp, Homo sapiens
cacaccagatggcagcgtggga

SEQ ID NO: 9384757 - DNA, 22 bp, Homo sapiens
cacaccagaggttacctgcaaa

SEQ ID NO: 9384758 - DNA, 22 bp, Homo sapiens
cacaatttgtattttgcatcca

SEQ ID NO: 9384759 - DNA, 22 bp, Homo sapiens
cacaatttgtttgctcttagtc

SEQ ID NO: 9384760 - DNA, 22 bp, Homo sapiens
cacaatttggtgctaaagaaag

SEQ ID NO: 9384761 - DNA, 22 bp, Homo sapiens
cacaatttccttgcttcacttt

SEQ ID NO: 9384762 - DNA, 22 bp, Homo sapiens
cacaatttggacttcactggtt

SEQ ID NO: 9384763 - DNA, 22 bp, Homo sapiens
cacaatttggggtgcccactgt

SEQ ID NO: 9384764 - DNA, 22 bp, Homo sapiens
cacaatttgttttatcagtatt

SEQ ID NO: 9384765 - DNA, 22 bp, Homo sapiens
cacacatattgtccctagtgtg

SEQ ID NO: 9384766 - DNA, 22 bp, Homo sapiens
cacacatattgtccctagtgtg

SEQ ID NO: 9384767 - DNA, 22 bp, Homo sapiens
cacacatattgtccctagtgtg

SEQ ID NO: 9384768 - DNA, 22 bp, Homo sapiens
cacacatcaacctagacattgt

SEQ ID NO: 9384769 - DNA, 22 bp, Homo sapiens
cacacatattgtccctagtgtg

SEQ ID NO: 9384770 - DNA, 22 bp, Homo sapiens
cacacattagagccaatgtcag

SEQ ID NO: 9384771 - DNA, 22 bp, Homo sapiens
cacaatttcagttgcatgcaac

SEQ ID NO: 9384772 - DNA, 22 bp, Homo sapiens
cacaatttcagttgcatgcaac

SEQ ID NO: 9384773 - DNA, 22 bp, Homo sapiens
cacaatttccaagtcatgttat

SEQ ID NO: 9384774 - DNA, 22 bp, Homo sapiens
cacaatttccattgagcagcag

SEQ ID NO: 9384775 - DNA, 18 bp, Homo sapiens
cacaatttacagatgaca

SEQ ID NO: 9384776 - DNA, 22 bp, Homo sapiens
cacaattagcagctctttattt

SEQ ID NO: 9384777 - DNA, 21 bp, Homo sapiens
ggaaaactttccttgtctgaa

SEQ ID NO: 9384778 - DNA, 22 bp, Homo sapiens
ggaaaactgaggctctcagcag

SEQ ID NO: 9384779 - DNA, 17 bp, Homo sapiens
ggaaaagaagagtagga

SEQ ID NO: 9384780 - DNA, 22 bp, Homo sapiens
ggaaaagaattgcagtgaagta

SEQ ID NO: 9384781 - DNA, 22 bp, Homo sapiens
cacaaaatatcaagcactttta

SEQ ID NO: 9384782 - DNA, 22 bp, Homo sapiens
cacaaaatatcaagcactttta

SEQ ID NO: 9384783 - DNA, 22 bp, Homo sapiens
cacaaaatctttctcgattatt

SEQ ID NO: 9384784 - DNA, 22 bp, Homo sapiens
cacaaaatctttctcgattatt

SEQ ID NO: 9384785 - DNA, 22 bp, Homo sapiens
cacaaacatcaatcctgttttc

SEQ ID NO: 9384786 - DNA, 22 bp, Homo sapiens
cacaaaggagaatgtcagcata

SEQ ID NO: 9384787 - DNA, 22 bp, Homo sapiens
cacaaaggagaatgtcagcata

SEQ ID NO: 9384788 - DNA, 22 bp, Homo sapiens
cacaaaggagaatgtcagcata

SEQ ID NO: 9384789 - DNA, 23 bp, Homo sapiens
cacaaaggttccattctctcacc

SEQ ID NO: 9384790 - DNA, 23 bp, Homo sapiens
cacaaaggttccattctctcacc

SEQ ID NO: 9384791 - DNA, 22 bp, Homo sapiens
ggaaaaggccacagggacacat

SEQ ID NO: 9384792 - DNA, 22 bp, Homo sapiens
ggaaaaggccacagggacacat

SEQ ID NO: 9384793 - DNA, 22 bp, Homo sapiens
ggaaaagtgttaaggtgttgat

SEQ ID NO: 9384794 - DNA, 22 bp, Homo sapiens
cacaatattggccgggctggtc

SEQ ID NO: 9384795 - DNA, 22 bp, Homo sapiens
cacaagtgaaccatgtgtcctt

SEQ ID NO: 9384796 - DNA, 22 bp, Homo sapiens
cacaagtggctggggaaaggga

SEQ ID NO: 9384797 - DNA, 22 bp, Homo sapiens
cacaagtctgtggtctccaaca

SEQ ID NO: 9384798 - DNA, 22 bp, Homo sapiens
cacaagtcattttcagcaggct

SEQ ID NO: 9384799 - DNA, 22 bp, Homo sapiens
caaggcagctattgtctccata

SEQ ID NO: 9384800 - DNA, 22 bp, Homo sapiens
gctgtctccccgcacccgaccg

SEQ ID NO: 9384801 - DNA, 22 bp, Homo sapiens
gctgtctccatagctgtgtgtc

SEQ ID NO: 9384802 - DNA, 22 bp, Homo sapiens
gctgtctcgcctgacactggct

SEQ ID NO: 9384803 - DNA, 21 bp, Homo sapiens
gctgtctcctccttgcaccag

SEQ ID NO: 9384804 - DNA, 22 bp, Homo sapiens
caaggcagcgttcctttctgga

SEQ ID NO: 9384805 - DNA, 20 bp, Homo sapiens
caaggcagaccagagtgagt

SEQ ID NO: 9384806 - DNA, 22 bp, Homo sapiens
caaggcagaattcagactcagg

SEQ ID NO: 9384807 - DNA, 22 bp, Homo sapiens
caaggattaatagaatgaatca

SEQ ID NO: 9384808 - DNA, 22 bp, Homo sapiens
caaggattctcactagactaga

SEQ ID NO: 9384809 - DNA, 22 bp, Homo sapiens
caaggattctcactagactaga

SEQ ID NO: 9384810 - DNA, 21 bp, Homo sapiens
caaggatttgagccaggagag

SEQ ID NO: 9384811 - DNA, 22 bp, Homo sapiens
caaggatttcactggaaagcct

SEQ ID NO: 9384812 - DNA, 22 bp, Homo sapiens
gctgtctgagaacatggtggaa

SEQ ID NO: 9384813 - DNA, 22 bp, Homo sapiens
gctgtctctcccaggatccatg

SEQ ID NO: 9384814 - DNA, 21 bp, Homo sapiens
gctgtctctggctcctgggaa

SEQ ID NO: 9384815 - DNA, 20 bp, Homo sapiens
gctgtctgacagttcccaga

SEQ ID NO: 9384816 - DNA, 22 bp, Homo sapiens
gctgtctgcatctctagagctt

SEQ ID NO: 9384817 - DNA, 22 bp, Homo sapiens
gctgtctgccgcaggctgccac

SEQ ID NO: 9384818 - DNA, 19 bp, Homo sapiens
gctgtctgatgctgaggtc

SEQ ID NO: 9384819 - DNA, 19 bp, Homo sapiens
gctgtctgatgctgaggtc

SEQ ID NO: 9384820 - DNA, 19 bp, Homo sapiens
gctgtctgatgctgaggtc

SEQ ID NO: 9384821 - DNA, 22 bp, Homo sapiens
gctgtgcttgggaagaatctct

SEQ ID NO: 9384822 - DNA, 18 bp, Homo sapiens
gctgtggaagtctttata

SEQ ID NO: 9384823 - DNA, 22 bp, Homo sapiens
gctgtggatgctatggatcatc

SEQ ID NO: 9384824 - DNA, 22 bp, Homo sapiens
gcttccaggggctgtgggctga

SEQ ID NO: 9384825 - DNA, 22 bp, Homo sapiens
gctgtggcctggcgcagagctg

SEQ ID NO: 9384826 - DNA, 22 bp, Homo sapiens
gctgtggccgggcccaggccgc

SEQ ID NO: 9384827 - DNA, 22 bp, Homo sapiens
gcttctccctacagatgtcagt

SEQ ID NO: 9384828 - DNA, 22 bp, Homo sapiens
gcttctccctacagatgtcagt

SEQ ID NO: 9384829 - DNA, 22 bp, Homo sapiens
gcttctccagaccttcatcccc

SEQ ID NO: 9384830 - DNA, 15 bp, Homo sapiens
gcttctccagatgac

SEQ ID NO: 9384831 - DNA, 22 bp, Homo sapiens
gcttctccagaccttcatcccc

SEQ ID NO: 9384832 - DNA, 22 bp, Homo sapiens
gcttctccagaccttcatcccc

SEQ ID NO: 9384833 - DNA, 22 bp, Homo sapiens
gcttctcctcccgctcccaggc

SEQ ID NO: 9384834 - DNA, 22 bp, Homo sapiens
gcttctcctcccgctcccaggc

SEQ ID NO: 9384835 - DNA, 22 bp, Homo sapiens
gcttctcctcccgctcccaggc

SEQ ID NO: 9384836 - DNA, 22 bp, Homo sapiens
gcttctcttaatgcctggcttt

SEQ ID NO: 9384837 - DNA, 22 bp, Homo sapiens
gcttctcttaatgcctggcttt

SEQ ID NO: 9384838 - DNA, 22 bp, Homo sapiens
gcttctctggctggtctgccac

SEQ ID NO: 9384839 - DNA, 22 bp, Homo sapiens
gcttctctggctggtctgccac

SEQ ID NO: 9384840 - DNA, 22 bp, Homo sapiens
gcttctctcaggagcatcagcc

SEQ ID NO: 9384841 - DNA, 22 bp, Homo sapiens
gcttctctcaggagcatcagcc

SEQ ID NO: 9384842 - DNA, 22 bp, Homo sapiens
gcttctctttctcccctggcgg

SEQ ID NO: 9384843 - DNA, 22 bp, Homo sapiens
gcttggcatttgctgggagctg

SEQ ID NO: 9384844 - DNA, 22 bp, Homo sapiens
gcttggccagcagccgggatgc

SEQ ID NO: 9384845 - DNA, 22 bp, Homo sapiens
gcttggcattgaccattatcat

SEQ ID NO: 9384846 - DNA, 20 bp, Homo sapiens
gcttggcataggccacttga

SEQ ID NO: 9384847 - DNA, 22 bp, Homo sapiens
gcttggcagtgggtcctgcctt

SEQ ID NO: 9384848 - DNA, 22 bp, Homo sapiens
gcttggcccattgatcagctgg

SEQ ID NO: 9384849 - DNA, 22 bp, Homo sapiens
gcttggccagcagccgggatgc

SEQ ID NO: 9384850 - DNA, 22 bp, Homo sapiens
gcttggccagcagccgggatgc

SEQ ID NO: 9384851 - DNA, 22 bp, Homo sapiens
gcttggctggaaataggttgag

SEQ ID NO: 9384852 - DNA, 22 bp, Homo sapiens
gcttggctgcctttggatgttg

SEQ ID NO: 9384853 - DNA, 22 bp, Homo sapiens
gcttggctgcctttggatgttg

SEQ ID NO: 9384854 - DNA, 18 bp, Homo sapiens
gcttggctgcagagagag

SEQ ID NO: 9384855 - DNA, 22 bp, Homo sapiens
caatttctcgaactctaatcca

SEQ ID NO: 9384856 - DNA, 22 bp, Homo sapiens
caatttctaacattccatggat

SEQ ID NO: 9384857 - DNA, 22 bp, Homo sapiens
gcttgggaggcaagcattccat

SEQ ID NO: 9384858 - DNA, 22 bp, Homo sapiens
gcttgggatatgctgatgtaaa

SEQ ID NO: 9384859 - DNA, 22 bp, Homo sapiens
gcttgggagagggtccccagga

SEQ ID NO: 9384860 - DNA, 22 bp, Homo sapiens
cacaaaatatcaagcactttta

SEQ ID NO: 9384861 - DNA, 22 bp, Homo sapiens
caatttctctttatatctcaca

SEQ ID NO: 9384862 - DNA, 22 bp, Homo sapiens
caatttctcgaactctaatcca

SEQ ID NO: 9384863 - DNA, 22 bp, Homo sapiens
caattttttccatgctcttaca

SEQ ID NO: 9384864 - DNA, 22 bp, Homo sapiens
gcttgggaagggccctgtgtac

SEQ ID NO: 9384865 - DNA, 22 bp, Homo sapiens
gcttgggacaggcttaggtgac

SEQ ID NO: 9384866 - DNA, 22 bp, Homo sapiens
gcttgggagaggcttcctcttt

SEQ ID NO: 9384867 - DNA, 22 bp, Homo sapiens
gcttgggactggagaatagggt

SEQ ID NO: 9384868 - DNA, 22 bp, Homo sapiens
gcttgggactggagaatagggt

SEQ ID NO: 9384869 - DNA, 22 bp, Homo sapiens
gcttgggaaacgtagttcctag

SEQ ID NO: 9384870 - DNA, 22 bp, Homo sapiens
caccataaccaacatgtcagtt

SEQ ID NO: 9384871 - DNA, 22 bp, Homo sapiens
caccataaaaataagagatgcc

SEQ ID NO: 9384872 - DNA, 22 bp, Homo sapiens
caccaggttccgggcagagctg

SEQ ID NO: 9384873 - DNA, 22 bp, Homo sapiens
caccaggctggagtgcagtggc

SEQ ID NO: 9384874 - DNA, 22 bp, Homo sapiens
caccaggctggagtgcagtggc

SEQ ID NO: 9384875 - DNA, 22 bp, Homo sapiens
ggcagctgattagcatcaagga

SEQ ID NO: 9384876 - DNA, 22 bp, Homo sapiens
ggcagctgattagcatcaagga

SEQ ID NO: 9384877 - DNA, 22 bp, Homo sapiens
ggcagctgagcatggctacctt

SEQ ID NO: 9384878 - DNA, 22 bp, Homo sapiens
ggcagctgagcatggctacctt

SEQ ID NO: 9384879 - DNA, 22 bp, Homo sapiens
ggcagctgaagaggaactttgg

SEQ ID NO: 9384880 - DNA, 21 bp, Homo sapiens
ggcagctgaccgcgcggtgca

SEQ ID NO: 9384881 - DNA, 22 bp, Homo sapiens
ggcagctgacctagcaccatcc

SEQ ID NO: 9384882 - DNA, 22 bp, Homo sapiens
ggcagctgacctagcaccatcc

SEQ ID NO: 9384883 - DNA, 22 bp, Homo sapiens
ggcagctgacctagcaccatcc

SEQ ID NO: 9384884 - DNA, 22 bp, Homo sapiens
ggcagctgagatcatgctgttg

SEQ ID NO: 9384885 - DNA, 22 bp, Homo sapiens
ggcagctgagatcatgctgttg

SEQ ID NO: 9384886 - DNA, 22 bp, Homo sapiens
ggcagctgagcatggctacctt

SEQ ID NO: 9384887 - DNA, 22 bp, Homo sapiens
ggcagttgctgtggatgaggtt

SEQ ID NO: 9384888 - DNA, 22 bp, Homo sapiens
ggcagtgtggcctgagtaagtc

SEQ ID NO: 9384889 - DNA, 22 bp, Homo sapiens
ggcagtgtccagcttcctggag

SEQ ID NO: 9384890 - DNA, 22 bp, Homo sapiens
ggcagtgtcaaaataggcagaa

SEQ ID NO: 9384891 - DNA, 22 bp, Homo sapiens
caccatcagcagcaggtgtcaa

SEQ ID NO: 9384892 - DNA, 22 bp, Homo sapiens
caccatctatagaggtatttgg

SEQ ID NO: 9384893 - DNA, 22 bp, Homo sapiens
caccatcttggcaaaggttcgc

SEQ ID NO: 9384894 - DNA, 22 bp, Homo sapiens
caccatgactggttgagagagg

SEQ ID NO: 9384895 - DNA, 22 bp, Homo sapiens
cacccacatggaaattcacagt

SEQ ID NO: 9384896 - DNA, 22 bp, Homo sapiens
cacccacatggaaattcacagt

SEQ ID NO: 9384897 - DNA, 22 bp, Homo sapiens
cacccacatggaaattcacagt

SEQ ID NO: 9384898 - DNA, 22 bp, Homo sapiens
cacccacattccatcactctgc

SEQ ID NO: 9384899 - DNA, 22 bp, Homo sapiens
cacccacattccatcactctgc

SEQ ID NO: 9384900 - DNA, 22 bp, Homo sapiens
cacccacccactgctcattggc

SEQ ID NO: 9384901 - DNA, 22 bp, Homo sapiens
cacccacattcctctagtatgt

SEQ ID NO: 9384902 - DNA, 22 bp, Homo sapiens
cacccacattcctctagtatgt

SEQ ID NO: 9384903 - DNA, 22 bp, Homo sapiens
cacccacattcctctagtatgt

SEQ ID NO: 9384904 - DNA, 22 bp, Homo sapiens
cacccactgagctcatgtccca

SEQ ID NO: 9384905 - DNA, 22 bp, Homo sapiens
cacccacccagaagatcctggc

SEQ ID NO: 9384906 - DNA, 17 bp, Homo sapiens
caccctggctagtctga

SEQ ID NO: 9384907 - DNA, 22 bp, Homo sapiens
caccctggcctcgctctctgca

SEQ ID NO: 9384908 - DNA, 22 bp, Homo sapiens
caccctggctggaggtgcagtg

SEQ ID NO: 9384909 - DNA, 22 bp, Homo sapiens
cactctgagaaacactaaacca

SEQ ID NO: 9384910 - DNA, 22 bp, Homo sapiens
caccctggaaagaaggtctggg

SEQ ID NO: 9384911 - DNA, 22 bp, Homo sapiens
caccctggaatagccccgggag

SEQ ID NO: 9384912 - DNA, 22 bp, Homo sapiens
caccctggaaagaaggtctggg

SEQ ID NO: 9384913 - DNA, 22 bp, Homo sapiens
caccctgaaggctggccctgac

SEQ ID NO: 9384914 - DNA, 18 bp, Homo sapiens
caccctccgcggctgccc

SEQ ID NO: 9384915 - DNA, 22 bp, Homo sapiens
caccctgctacaaagcctcctg

SEQ ID NO: 9384916 - DNA, 22 bp, Homo sapiens
cacccctgtggagcatggtggc

SEQ ID NO: 9384917 - DNA, 22 bp, Homo sapiens
cacccctgggctgggcacacag

SEQ ID NO: 9384918 - DNA, 22 bp, Homo sapiens
caccccccaattctgccagctg

SEQ ID NO: 9384919 - DNA, 22 bp, Homo sapiens
cacccccagcagggaaaggagg

SEQ ID NO: 9384920 - DNA, 20 bp, Homo sapiens
caccctcccagcacctatgc

SEQ ID NO: 9384921 - DNA, 22 bp, Homo sapiens
caccctcccgtcagcccctggg

SEQ ID NO: 9384922 - DNA, 22 bp, Homo sapiens
caccccttgtctttggggtcgt

SEQ ID NO: 9384923 - DNA, 22 bp, Homo sapiens
ggcatagatttctttaggttta

SEQ ID NO: 9384924 - DNA, 22 bp, Homo sapiens
ggcatcagcccggtcctgggct

SEQ ID NO: 9384925 - DNA, 22 bp, Homo sapiens
ggcatcagaggtgtgttctgct

SEQ ID NO: 9384926 - DNA, 22 bp, Homo sapiens
cacccaggttggagtgcagtgg

SEQ ID NO: 9384927 - DNA, 22 bp, Homo sapiens
cacccagtgaaggagcaagagg

SEQ ID NO: 9384928 - DNA, 22 bp, Homo sapiens
cacccagttgactacaaagggg

SEQ ID NO: 9384929 - DNA, 22 bp, Homo sapiens
caccccagcttctcaggataga

SEQ ID NO: 9384930 - DNA, 19 bp, Homo sapiens
caccccagtcctctttccc

SEQ ID NO: 9384931 - DNA, 19 bp, Homo sapiens
caccccagtcctctttccc

SEQ ID NO: 9384932 - DNA, 22 bp, Homo sapiens
caccccagtctaaaaccagcct

SEQ ID NO: 9384933 - DNA, 22 bp, Homo sapiens
caccccagtctaaaaccagcct

SEQ ID NO: 9384934 - DNA, 22 bp, Homo sapiens
caccccagcttctcaggataga

SEQ ID NO: 9384935 - DNA, 20 bp, Homo sapiens
cactgccagaatacactgtc

SEQ ID NO: 9384936 - DNA, 20 bp, Homo sapiens
cactgcattgatggaaacag

SEQ ID NO: 9384937 - DNA, 22 bp, Homo sapiens
ggctagggagacagagggcatg

SEQ ID NO: 9384938 - DNA, 22 bp, Homo sapiens
ggctagggactcctcctcaggg

SEQ ID NO: 9384939 - DNA, 22 bp, Homo sapiens
cactgcccaccaagtggctggt

SEQ ID NO: 9384940 - DNA, 22 bp, Homo sapiens
cactgcccaccaagtggctggt

SEQ ID NO: 9384941 - DNA, 22 bp, Homo sapiens
cactgccatgttgatagatgtg

SEQ ID NO: 9384942 - DNA, 22 bp, Homo sapiens
ggctagggatctagaccaggac

SEQ ID NO: 9384943 - DNA, 22 bp, Homo sapiens
ggctaggggaataatctgtggt

SEQ ID NO: 9384944 - DNA, 22 bp, Homo sapiens
ggctagggatctagaccaggac

SEQ ID NO: 9384945 - DNA, 22 bp, Homo sapiens
ggctagggatctagaccaggac

SEQ ID NO: 9384946 - DNA, 22 bp, Homo sapiens
ggctcaagcagtctgcctgcct

SEQ ID NO: 9384947 - DNA, 22 bp, Homo sapiens
ggctcaatgcaacttctgcctc

SEQ ID NO: 9384948 - DNA, 19 bp, Homo sapiens
ggctcaagcatccaggtag

SEQ ID NO: 9384949 - DNA, 18 bp, Homo sapiens
ggctcaagtgatcctcct

SEQ ID NO: 9384950 - DNA, 22 bp, Homo sapiens
ggctatggaaatggcaggacat

SEQ ID NO: 9384951 - DNA, 21 bp, Homo sapiens
ggctatgattaatgactagga

SEQ ID NO: 9384952 - DNA, 22 bp, Homo sapiens
ggctatggaagataaggctgaa

SEQ ID NO: 9384953 - DNA, 22 bp, Homo sapiens
ggctatgggaagatggcagggg

SEQ ID NO: 9384954 - DNA, 22 bp, Homo sapiens
cactggaggtcagtggagcact

SEQ ID NO: 9384955 - DNA, 22 bp, Homo sapiens
cactggcattagtcacgaggca

SEQ ID NO: 9384956 - DNA, 22 bp, Homo sapiens
cactggaggtcagtggagcact

SEQ ID NO: 9384957 - DNA, 22 bp, Homo sapiens
cactggaggtcagtggagcact

SEQ ID NO: 9384958 - DNA, 18 bp, Homo sapiens
cactggacctcatgagag

SEQ ID NO: 9384959 - DNA, 22 bp, Homo sapiens
cactggaccaaggaaactcttc

SEQ ID NO: 9384960 - DNA, 22 bp, Homo sapiens
cactggaatgttgaggagacaa

SEQ ID NO: 9384961 - DNA, 22 bp, Homo sapiens
cactgcctgctggctgtcactt

SEQ ID NO: 9384962 - DNA, 22 bp, Homo sapiens
cactgcttttttggctatgtac

SEQ ID NO: 9384963 - DNA, 22 bp, Homo sapiens
cactggaatggatagagcagag

SEQ ID NO: 9384964 - DNA, 22 bp, Homo sapiens
cactggaagttcattctcagaa

SEQ ID NO: 9384965 - DNA, 22 bp, Homo sapiens
cactggaatagcattgattctt

SEQ ID NO: 9384966 - DNA, 22 bp, Homo sapiens
cactggaagagcatctgagcca

SEQ ID NO: 9384967 - DNA, 22 bp, Homo sapiens
cactggaaccaagacccagggc

SEQ ID NO: 9384968 - DNA, 21 bp, Homo sapiens
cactgcagccttgacctgggc

SEQ ID NO: 9384969 - DNA, 23 bp, Homo sapiens
cactgcagcgtggtctggcagga

SEQ ID NO: 9384970 - DNA, 23 bp, Homo sapiens
cactgcagcgtggtctggcagga

SEQ ID NO: 9384971 - DNA, 22 bp, Homo sapiens
cactgcagcaccatgcagggct

SEQ ID NO: 9384972 - DNA, 22 bp, Homo sapiens
cactgcactccatcctgggaaa

SEQ ID NO: 9384973 - DNA, 22 bp, Homo sapiens
cactgcagcaccatgcagggct

SEQ ID NO: 9384974 - DNA, 22 bp, Homo sapiens
ggcctctcgaagcttcagtcca

SEQ ID NO: 9384975 - DNA, 22 bp, Homo sapiens
ggcctctcgaagcttcagtcca

SEQ ID NO: 9384976 - DNA, 22 bp, Homo sapiens
ggcctctcatgtcctgggcttc

SEQ ID NO: 9384977 - DNA, 22 bp, Homo sapiens
ggcctctcatgtcctgggcttc

SEQ ID NO: 9384978 - DNA, 22 bp, Homo sapiens
ggcctctctagcatccagcctg

SEQ ID NO: 9384979 - DNA, 22 bp, Homo sapiens
ggcctctctagcatccagcctg

SEQ ID NO: 9384980 - DNA, 22 bp, Homo sapiens
ggcctctctagcatccagcctg

SEQ ID NO: 9384981 - DNA, 22 bp, Homo sapiens
ggcctctctagcatccagcctg

SEQ ID NO: 9384982 - DNA, 22 bp, Homo sapiens
ggcctctctagcatccagcctg

SEQ ID NO: 9384983 - DNA, 22 bp, Homo sapiens
ggcctctcatgcccagagccaa

SEQ ID NO: 9384984 - DNA, 23 bp, Homo sapiens
ggcctctcaccagggtcctttca

SEQ ID NO: 9384985 - DNA, 22 bp, Homo sapiens
cactgaggactcccacgtaggt

SEQ ID NO: 9384986 - DNA, 22 bp, Homo sapiens
cactgaggagagaggtaactag

SEQ ID NO: 9384987 - DNA, 19 bp, Homo sapiens
cactgagctctgttcacta

SEQ ID NO: 9384988 - DNA, 19 bp, Homo sapiens
cactgagctctgttcacta

SEQ ID NO: 9384989 - DNA, 22 bp, Homo sapiens
cactgagagtagggcacaagtg

SEQ ID NO: 9384990 - DNA, 22 bp, Homo sapiens
ggcctcctgttggctagtgtga

SEQ ID NO: 9384991 - DNA, 22 bp, Homo sapiens
ggcctcgcggcttctggtggct

SEQ ID NO: 9384992 - DNA, 22 bp, Homo sapiens
cactgaggctgggggagaaggt

SEQ ID NO: 9384993 - DNA, 22 bp, Homo sapiens
ggcctcctcaccctgctcaggc

SEQ ID NO: 9384994 - DNA, 23 bp, Homo sapiens
ggcctcctggtctaggctagact

SEQ ID NO: 9384995 - DNA, 23 bp, Homo sapiens
ggcctcctggtctaggctagact

SEQ ID NO: 9384996 - DNA, 23 bp, Homo sapiens
ggcctcctggtctaggctagact

SEQ ID NO: 9384997 - DNA, 22 bp, Homo sapiens
cactgagacccgaatacttcca

SEQ ID NO: 9384998 - DNA, 22 bp, Homo sapiens
cactgagagatgtgtcacagca

SEQ ID NO: 9384999 - DNA, 22 bp, Homo sapiens
cactgagagatgtgtcacagca

SEQ ID NO: 9385000 - DNA, 22 bp, Homo sapiens
cactgagaggtctcatttccaa

SEQ ID NO: 9385001 - DNA, 22 bp, Homo sapiens
cactgagaccagagtccctgac

SEQ ID NO: 9385002 - DNA, 22 bp, Homo sapiens
cactgagaaagtgacctgccaa

SEQ ID NO: 9385003 - DNA, 22 bp, Homo sapiens
cactgacagtatcagagctgtt

SEQ ID NO: 9385004 - DNA, 22 bp, Homo sapiens
ggatgttctggggttctcttgt

SEQ ID NO: 9385005 - DNA, 22 bp, Homo sapiens
ggatgttctggggttctcttgt

SEQ ID NO: 9385006 - DNA, 19 bp, Homo sapiens
ggatggtggggtgcccatc

SEQ ID NO: 9385007 - DNA, 23 bp, Homo sapiens
ggatgggcaagcctagtgcctac

SEQ ID NO: 9385008 - DNA, 22 bp, Homo sapiens
cacagggcagagacctgggtgc

SEQ ID NO: 9385009 - DNA, 22 bp, Homo sapiens
cacagggcaccagttggccatc

SEQ ID NO: 9385010 - DNA, 22 bp, Homo sapiens
cacagggcaccagttggccatc

SEQ ID NO: 9385011 - DNA, 22 bp, Homo sapiens
cacagggaggcagccatgctcc

SEQ ID NO: 9385012 - DNA, 22 bp, Homo sapiens
cacagggaggcagccatgctcc

SEQ ID NO: 9385013 - DNA, 22 bp, Homo sapiens
cacagggaggacatcaacagtg

SEQ ID NO: 9385014 - DNA, 22 bp, Homo sapiens
ggagggagggctagaccaaaga

SEQ ID NO: 9385015 - DNA, 22 bp, Homo sapiens
ggagggaggttagattcaagct

SEQ ID NO: 9385016 - DNA, 22 bp, Homo sapiens
ggagggagggctagaccaaaga

SEQ ID NO: 9385017 - DNA, 22 bp, Homo sapiens
ggaggcggaggctgcagtgagc

SEQ ID NO: 9385018 - DNA, 22 bp, Homo sapiens
ggagggagcagagaacccaacc

SEQ ID NO: 9385019 - DNA, 22 bp, Homo sapiens
ggagggagcatccccttgctga

SEQ ID NO: 9385020 - DNA, 22 bp, Homo sapiens
ggagggagtcagctgattagaa

SEQ ID NO: 9385021 - DNA, 22 bp, Homo sapiens
ggatccttctttgacctcacag

SEQ ID NO: 9385022 - DNA, 22 bp, Homo sapiens
ggatctcagggttctggtctgg

SEQ ID NO: 9385023 - DNA, 22 bp, Homo sapiens
ggatctgggctgcagtctaggc

SEQ ID NO: 9385024 - DNA, 22 bp, Homo sapiens
ggaggcggagcttgcagtgagc

SEQ ID NO: 9385025 - DNA, 22 bp, Homo sapiens
ggaggcggaggctgcagtgagc

SEQ ID NO: 9385026 - DNA, 22 bp, Homo sapiens
ggaggcggaggctgcagtgagc

SEQ ID NO: 9385027 - DNA, 22 bp, Homo sapiens
ggaggcggacacaggtagtgtt

SEQ ID NO: 9385028 - DNA, 22 bp, Homo sapiens
ggaggcggagcttgcagtgagc

SEQ ID NO: 9385029 - DNA, 22 bp, Homo sapiens
ggaggcggagcttgcagtgagc

SEQ ID NO: 9385030 - DNA, 22 bp, Homo sapiens
ggaggcggaagttgcagtgagc

SEQ ID NO: 9385031 - DNA, 22 bp, Homo sapiens
ggaggcggaagttgcagtgagc

SEQ ID NO: 9385032 - DNA, 22 bp, Homo sapiens
ggaggcggacacaggtagtgtt

SEQ ID NO: 9385033 - DNA, 22 bp, Homo sapiens
ggaggcggaagttgcagtgagc

SEQ ID NO: 9385034 - DNA, 22 bp, Homo sapiens
ggaggcgcggctcggctgtgcc

SEQ ID NO: 9385035 - DNA, 22 bp, Homo sapiens
ggaggccaaggcaggtggatca

SEQ ID NO: 9385036 - DNA, 22 bp, Homo sapiens
ggaggccaaggcaggtggatcg

SEQ ID NO: 9385037 - DNA, 22 bp, Homo sapiens
ggaggccaaggcgggcggatca

SEQ ID NO: 9385038 - DNA, 22 bp, Homo sapiens
ggaggccttgcctgcaggcaca

SEQ ID NO: 9385039 - DNA, 22 bp, Homo sapiens
ggaggccttgcctgcaggcaca

SEQ ID NO: 9385040 - DNA, 22 bp, Homo sapiens
cacactgataggcttgacaggc

SEQ ID NO: 9385041 - DNA, 22 bp, Homo sapiens
cacactgtcaggtaaataacac

SEQ ID NO: 9385042 - DNA, 22 bp, Homo sapiens
cacagctggtgcactagctctg

SEQ ID NO: 9385043 - DNA, 22 bp, Homo sapiens
cacagctgaccaccctgctccc

SEQ ID NO: 9385044 - DNA, 22 bp, Homo sapiens
cacactgtccccttctccccag

SEQ ID NO: 9385045 - DNA, 22 bp, Homo sapiens
cacagctgaagtagccatgtgg

SEQ ID NO: 9385046 - DNA, 22 bp, Homo sapiens
cacagctggtgcactagctctg

SEQ ID NO: 9385047 - DNA, 22 bp, Homo sapiens
cacagctgtgagaagggagcct

SEQ ID NO: 9385048 - DNA, 22 bp, Homo sapiens
ggcactgggagaggtgagacgg

SEQ ID NO: 9385049 - DNA, 22 bp, Homo sapiens
ggcactgggagaggtgagacgg

SEQ ID NO: 9385050 - DNA, 22 bp, Homo sapiens
ggcactgggcaccggctgaggg

SEQ ID NO: 9385051 - DNA, 22 bp, Homo sapiens
ggcagagagttctccacctctc

SEQ ID NO: 9385052 - DNA, 22 bp, Homo sapiens
ggcagagcagccccagggtttg

SEQ ID NO: 9385053 - DNA, 22 bp, Homo sapiens
ggcagagatgtgggtcagaatc

SEQ ID NO: 9385054 - DNA, 22 bp, Homo sapiens
ggcagagccttctggagctcgc

SEQ ID NO: 9385055 - DNA, 22 bp, Homo sapiens
ggcagagccttctggagctcgc

SEQ ID NO: 9385056 - DNA, 22 bp, Homo sapiens
ggcagagcctcagccctccacc

SEQ ID NO: 9385057 - DNA, 22 bp, Homo sapiens
ggcagagcctcagccctccacc

SEQ ID NO: 9385058 - DNA, 22 bp, Homo sapiens
ggcacatgtatgtgggagtgtg

SEQ ID NO: 9385059 - DNA, 22 bp, Homo sapiens
ggcacatgtatgtgggagtgtg

SEQ ID NO: 9385060 - DNA, 22 bp, Homo sapiens
ggcactggaaggatcatgtgag

SEQ ID NO: 9385061 - DNA, 22 bp, Homo sapiens
ggcactggcctggggccaagag

SEQ ID NO: 9385062 - DNA, 22 bp, Homo sapiens
cacagggcagagacctgggtgc

SEQ ID NO: 9385063 - DNA, 22 bp, Homo sapiens
cacagggcagagggtccgtggc

SEQ ID NO: 9385064 - DNA, 22 bp, Homo sapiens
ggcacaagtttgatgtgagtta

SEQ ID NO: 9385065 - DNA, 22 bp, Homo sapiens
ggcacaaggtttaaataacatc

SEQ ID NO: 9385066 - DNA, 22 bp, Homo sapiens
cacagggcaggccccaggcctc

SEQ ID NO: 9385067 - DNA, 22 bp, Homo sapiens
ggcacaggagctagtcaaagcc

SEQ ID NO: 9385068 - DNA, 22 bp, Homo sapiens
ggcacacaaaggcagcatttga

SEQ ID NO: 9385069 - DNA, 22 bp, Homo sapiens
ggcacaggagtcacagcatttc

SEQ ID NO: 9385070 - DNA, 22 bp, Homo sapiens
ggcacagggagaggcggatttt

SEQ ID NO: 9385071 - DNA, 22 bp, Homo sapiens
ggcacagggagccgcagttgca

SEQ ID NO: 9385072 - DNA, 22 bp, Homo sapiens
ggcacagggggctgaggactag

SEQ ID NO: 9385073 - DNA, 22 bp, Homo sapiens
ggcacagggggctgaggactag

SEQ ID NO: 9385074 - DNA, 22 bp, Homo sapiens
ggcacagggggctgaggactag

SEQ ID NO: 9385075 - DNA, 22 bp, Homo sapiens
ggcacagtgattaagagccagt

SEQ ID NO: 9385076 - DNA, 22 bp, Homo sapiens
ggcacagggggctgaggactag

SEQ ID NO: 9385077 - DNA, 22 bp, Homo sapiens
ggcacagggggctgaggactag

SEQ ID NO: 9385078 - DNA, 22 bp, Homo sapiens
ggcacagggtgatgttgcagtt

SEQ ID NO: 9385079 - DNA, 22 bp, Homo sapiens
ggcacagggtgatgttgcagtt

SEQ ID NO: 9385080 - DNA, 20 bp, Homo sapiens
ggcagccaatcagcgtgccg

SEQ ID NO: 9385081 - DNA, 22 bp, Homo sapiens
cacagtgtgactgaccttcagc

SEQ ID NO: 9385082 - DNA, 22 bp, Homo sapiens
cacagtgtagttaatgtgacat

SEQ ID NO: 9385083 - DNA, 22 bp, Homo sapiens
cacagtggtttccgattcagac

SEQ ID NO: 9385084 - DNA, 22 bp, Homo sapiens
ggcagcagtggctgctattgtc

SEQ ID NO: 9385085 - DNA, 22 bp, Homo sapiens
ggcagcagtggctgctattgtc

SEQ ID NO: 9385086 - DNA, 22 bp, Homo sapiens
ggcagcagtggctgctattgtc

SEQ ID NO: 9385087 - DNA, 22 bp, Homo sapiens
ggcagatggaaggacagacgga

SEQ ID NO: 9385088 - DNA, 22 bp, Homo sapiens
ggcagagccttctggagctcgc

SEQ ID NO: 9385089 - DNA, 22 bp, Homo sapiens
ggcagagcgcatgcgtcgcaga

SEQ ID NO: 9385090 - DNA, 22 bp, Homo sapiens
ggcagagcgcatgcgtcgcaga

SEQ ID NO: 9385091 - DNA, 22 bp, Homo sapiens
ggcagagctagtggcttctctt

SEQ ID NO: 9385092 - DNA, 20 bp, Homo sapiens
ggcagagctatgtctgttgc

SEQ ID NO: 9385093 - DNA, 22 bp, Homo sapiens
ggcagagctagtggcttctctt

SEQ ID NO: 9385094 - DNA, 22 bp, Homo sapiens
ggcagagctagtggcttctctt

SEQ ID NO: 9385095 - DNA, 22 bp, Homo sapiens
ggcagagctgcatgagcactca

SEQ ID NO: 9385096 - DNA, 22 bp, Homo sapiens
ggcagagctgcatgagcactca

SEQ ID NO: 9385097 - DNA, 21 bp, Homo sapiens
ggcagagctggggcctccagc

SEQ ID NO: 9385098 - DNA, 21 bp, Homo sapiens
ggcagagctggggcctccagc

SEQ ID NO: 9385099 - DNA, 17 bp, Homo sapiens
ggcagagctgacagggc

SEQ ID NO: 9385100 - DNA, 22 bp, Homo sapiens
ggcagagctctggactgagaac

SEQ ID NO: 9385101 - DNA, 17 bp, Homo sapiens
ggcagagctgacagggc

SEQ ID NO: 9385102 - DNA, 17 bp, Homo sapiens
ggcagagctgacagggc

SEQ ID NO: 9385103 - DNA, 22 bp, Homo sapiens
ggcagagcttgcagtgagccga

SEQ ID NO: 9385104 - DNA, 22 bp, Homo sapiens
ggcagagcttgcagtgagccga

SEQ ID NO: 9385105 - DNA, 22 bp, Homo sapiens
ggcagagcttgcagtgagccga

SEQ ID NO: 9385106 - DNA, 22 bp, Homo sapiens
cacagtggattgggtgatgccc

SEQ ID NO: 9385107 - DNA, 22 bp, Homo sapiens
cacagtggaaacagctaagcct

SEQ ID NO: 9385108 - DNA, 22 bp, Homo sapiens
cacagtggcaggtgtgggttgt

SEQ ID NO: 9385109 - DNA, 22 bp, Homo sapiens
cacagtggctttgctggtctcg

SEQ ID NO: 9385110 - DNA, 22 bp, Homo sapiens
cacagtggtttccgattcagac

SEQ ID NO: 9385111 - DNA, 22 bp, Homo sapiens
cactggcccagccaggcctgtt

SEQ ID NO: 9385112 - DNA, 22 bp, Homo sapiens
cactggcccagccaggcctgtt

SEQ ID NO: 9385113 - DNA, 22 bp, Homo sapiens
cactggcccagccaggcctgtt

SEQ ID NO: 9385114 - DNA, 22 bp, Homo sapiens
cactggcccataaaggcctggg

SEQ ID NO: 9385115 - DNA, 22 bp, Homo sapiens
cactggcccataaaggcctggg

SEQ ID NO: 9385116 - DNA, 22 bp, Homo sapiens
cactggcccataaaggcctggg

SEQ ID NO: 9385117 - DNA, 22 bp, Homo sapiens
cactggctaaaaaagaggcaga

SEQ ID NO: 9385118 - DNA, 22 bp, Homo sapiens
cactggctaaagataagctcaa

SEQ ID NO: 9385119 - DNA, 22 bp, Homo sapiens
cactggcccattcctgtctggc

SEQ ID NO: 9385120 - DNA, 22 bp, Homo sapiens
cactggctatgagggagatggg

SEQ ID NO: 9385121 - DNA, 22 bp, Homo sapiens
cactggctgagcttctctaggg

SEQ ID NO: 9385122 - DNA, 22 bp, Homo sapiens
cactggctccctgatttgaagc

SEQ ID NO: 9385123 - DNA, 22 bp, Homo sapiens
cactggctgggccagcactcct

SEQ ID NO: 9385124 - DNA, 22 bp, Homo sapiens
cactggctgagcttctctaggg

SEQ ID NO: 9385125 - DNA, 22 bp, Homo sapiens
cactggcttgatgggtaatgcc

SEQ ID NO: 9385126 - DNA, 22 bp, Homo sapiens
cagaaggctttgtggagtagac

SEQ ID NO: 9385127 - DNA, 22 bp, Homo sapiens
cagaaggctttgtggagtagac

SEQ ID NO: 9385128 - DNA, 22 bp, Homo sapiens
cagaaggcatagatgaaggcct

SEQ ID NO: 9385129 - DNA, 22 bp, Homo sapiens
cagaaggcatagatgaaggcct

SEQ ID NO: 9385130 - DNA, 22 bp, Homo sapiens
cagaaggcaaacaaaaggattt

SEQ ID NO: 9385131 - DNA, 22 bp, Homo sapiens
cagaagcagtgagagatgtgca

SEQ ID NO: 9385132 - DNA, 22 bp, Homo sapiens
cagaaggcaaacaaaaggattt

SEQ ID NO: 9385133 - DNA, 22 bp, Homo sapiens
gggaaactttcacaatgtccag

SEQ ID NO: 9385134 - DNA, 22 bp, Homo sapiens
gggaaacttctgctaaaaccag

SEQ ID NO: 9385135 - DNA, 22 bp, Homo sapiens
gggaaactgtccagttctcccc

SEQ ID NO: 9385136 - DNA, 22 bp, Homo sapiens
gggaaactgaattcaggactct

SEQ ID NO: 9385137 - DNA, 22 bp, Homo sapiens
gggaaactgcaactcagagagg

SEQ ID NO: 9385138 - DNA, 22 bp, Homo sapiens
gggaaactggggactgaatctg

SEQ ID NO: 9385139 - DNA, 21 bp, Homo sapiens
gggaaactctgcttaacagag

SEQ ID NO: 9385140 - DNA, 22 bp, Homo sapiens
gggaaactcaggcatttccact

SEQ ID NO: 9385141 - DNA, 22 bp, Homo sapiens
gggaaagagaggtggacgcagg

SEQ ID NO: 9385142 - DNA, 22 bp, Homo sapiens
gggaaagagaggtggacgcagg

SEQ ID NO: 9385143 - DNA, 22 bp, Homo sapiens
gggaaactcacaggtgcagggg

SEQ ID NO: 9385144 - DNA, 22 bp, Homo sapiens
gggaaactagaagcagggttat

SEQ ID NO: 9385145 - DNA, 22 bp, Homo sapiens
cagaaggtttacactggactgt

SEQ ID NO: 9385146 - DNA, 22 bp, Homo sapiens
cagaaggtattgtaattatgac

SEQ ID NO: 9385147 - DNA, 22 bp, Homo sapiens
gggactggccagggtttggaat

SEQ ID NO: 9385148 - DNA, 22 bp, Homo sapiens
gggactgggagatcctcctggc

SEQ ID NO: 9385149 - DNA, 22 bp, Homo sapiens
gggactggaactactggtgcag

SEQ ID NO: 9385150 - DNA, 22 bp, Homo sapiens
gggactggaactactggtgcag

SEQ ID NO: 9385151 - DNA, 19 bp, Homo sapiens
gggactggaggatgtggag

SEQ ID NO: 9385152 - DNA, 22 bp, Homo sapiens
gggacagacccatgggccaggt

SEQ ID NO: 9385153 - DNA, 22 bp, Homo sapiens
gggacagaggcaaactagcaga

SEQ ID NO: 9385154 - DNA, 22 bp, Homo sapiens
gggactccataagcacatggat

SEQ ID NO: 9385155 - DNA, 22 bp, Homo sapiens
gggacagaaggaagtgagcaca

SEQ ID NO: 9385156 - DNA, 22 bp, Homo sapiens
gggacagaaggaagtgagcaca

SEQ ID NO: 9385157 - DNA, 22 bp, Homo sapiens
gggacagaaggaagtgagcaca

SEQ ID NO: 9385158 - DNA, 22 bp, Homo sapiens
gggacagacccatgggccaggt

SEQ ID NO: 9385159 - DNA, 22 bp, Homo sapiens
gggacactggacccagtgtcca

SEQ ID NO: 9385160 - DNA, 22 bp, Homo sapiens
gggacacaggtatctcaaatga

SEQ ID NO: 9385161 - DNA, 22 bp, Homo sapiens
gggacacagccatctgtgtttt

SEQ ID NO: 9385162 - DNA, 22 bp, Homo sapiens
gggaatgtggcaggcagcagtt

SEQ ID NO: 9385163 - DNA, 22 bp, Homo sapiens
gggaatgtggccctggggctcc

SEQ ID NO: 9385164 - DNA, 22 bp, Homo sapiens
gggaaggaggtggcttgaagtg

SEQ ID NO: 9385165 - DNA, 22 bp, Homo sapiens
gggaatgtgcctggagtgttca

SEQ ID NO: 9385166 - DNA, 16 bp, Homo sapiens
gggaatgtgtcttctc

SEQ ID NO: 9385167 - DNA, 22 bp, Homo sapiens
gggaatgtgtctgatggaaaga

SEQ ID NO: 9385168 - DNA, 22 bp, Homo sapiens
gggaatgtggtgatagtctata

SEQ ID NO: 9385169 - DNA, 22 bp, Homo sapiens
gggaatgttgactgagagcagg

SEQ ID NO: 9385170 - DNA, 22 bp, Homo sapiens
gggaattatagctgtcacaggc

SEQ ID NO: 9385171 - DNA, 15 bp, Homo sapiens
gggaatgttttacaa

SEQ ID NO: 9385172 - DNA, 22 bp, Homo sapiens
gggaattgaggtatgctgggct

SEQ ID NO: 9385173 - DNA, 22 bp, Homo sapiens
gggacaatggaggcctctctcc

SEQ ID NO: 9385174 - DNA, 22 bp, Homo sapiens
gggacaatggaggcctctctcc

SEQ ID NO: 9385175 - DNA, 22 bp, Homo sapiens
gggaaggacattctgggctcag

SEQ ID NO: 9385176 - DNA, 22 bp, Homo sapiens
gggaaggacattctgggctcag

SEQ ID NO: 9385177 - DNA, 22 bp, Homo sapiens
gggaaggacattctgggctcag

SEQ ID NO: 9385178 - DNA, 22 bp, Homo sapiens
gggaaggagcctgcttgctaga

SEQ ID NO: 9385179 - DNA, 22 bp, Homo sapiens
gggaaggagcctgcttgctaga

SEQ ID NO: 9385180 - DNA, 22 bp, Homo sapiens
gggaaggaggtggacctgcccc

SEQ ID NO: 9385181 - DNA, 22 bp, Homo sapiens
gggaaggaggtggacctgcccc

SEQ ID NO: 9385182 - DNA, 22 bp, Homo sapiens
gggaaggaggtggcttgaagtg

SEQ ID NO: 9385183 - DNA, 22 bp, Homo sapiens
gggaaggacacagccatgactg

SEQ ID NO: 9385184 - DNA, 22 bp, Homo sapiens
gggaaggaaatcttgcttgtga

SEQ ID NO: 9385185 - DNA, 22 bp, Homo sapiens
gggaaggacacagccatgactg

SEQ ID NO: 9385186 - DNA, 22 bp, Homo sapiens
gggaaggacacagccatgactg

SEQ ID NO: 9385187 - DNA, 22 bp, Homo sapiens
gggaaggacacagccatgactg

SEQ ID NO: 9385188 - DNA, 22 bp, Homo sapiens
gggaaggacattctgggctcag

SEQ ID NO: 9385189 - DNA, 18 bp, Homo sapiens
gggaagccgggaagccgg

SEQ ID NO: 9385190 - DNA, 23 bp, Homo sapiens
gggaaaggatatgatcctagggg

SEQ ID NO: 9385191 - DNA, 23 bp, Homo sapiens
gggaaaggatatgatcctagggg

SEQ ID NO: 9385192 - DNA, 22 bp, Homo sapiens
gggaagctgcgtggtctagggc

SEQ ID NO: 9385193 - DNA, 22 bp, Homo sapiens
gggaaggaaagttattagcaga

SEQ ID NO: 9385194 - DNA, 22 bp, Homo sapiens
gggaggtgaaaggttgctgcag

SEQ ID NO: 9385195 - DNA, 22 bp, Homo sapiens
gggaggtgaaaggttgctgcag

SEQ ID NO: 9385196 - DNA, 22 bp, Homo sapiens
cagacaggctagccagactcac

SEQ ID NO: 9385197 - DNA, 22 bp, Homo sapiens
cagacaggctagccagactcac

SEQ ID NO: 9385198 - DNA, 22 bp, Homo sapiens
gggaggtcctaaaggggaccag

SEQ ID NO: 9385199 - DNA, 22 bp, Homo sapiens
gggaggtcagggtgcctgctgg

SEQ ID NO: 9385200 - DNA, 22 bp, Homo sapiens
gggaggtgaaaggtcatgtgtg

SEQ ID NO: 9385201 - DNA, 22 bp, Homo sapiens
gggaggtgaaaggtcatgtgtg

SEQ ID NO: 9385202 - DNA, 22 bp, Homo sapiens
gggagggtctgccatgctccct

SEQ ID NO: 9385203 - DNA, 22 bp, Homo sapiens
gggagggtctgagagctgcacc

SEQ ID NO: 9385204 - DNA, 22 bp, Homo sapiens
gggagggtctgagagctgcacc

SEQ ID NO: 9385205 - DNA, 22 bp, Homo sapiens
gggagggtctgagagctgcacc

SEQ ID NO: 9385206 - DNA, 22 bp, Homo sapiens
gggagggtgttctcccaagaac

SEQ ID NO: 9385207 - DNA, 22 bp, Homo sapiens
gggaggtaaagatgagctcagt

SEQ ID NO: 9385208 - DNA, 20 bp, Homo sapiens
gggaggccagcctcagagaa

SEQ ID NO: 9385209 - DNA, 22 bp, Homo sapiens
gggagggccaggctcacccagg

SEQ ID NO: 9385210 - DNA, 22 bp, Homo sapiens
gggagcagttaaaatgattcct

SEQ ID NO: 9385211 - DNA, 22 bp, Homo sapiens
gggagggcttggacccagatgt

SEQ ID NO: 9385212 - DNA, 22 bp, Homo sapiens
gggaggggttgcatgtttgagt

SEQ ID NO: 9385213 - DNA, 17 bp, Homo sapiens
cagacaggctgtcaccc

SEQ ID NO: 9385214 - DNA, 17 bp, Homo sapiens
cagacaggctgtcaccc

SEQ ID NO: 9385215 - DNA, 22 bp, Homo sapiens
cagacaggctagccagactcac

SEQ ID NO: 9385216 - DNA, 22 bp, Homo sapiens
cagacagggacctcgctccaga

SEQ ID NO: 9385217 - DNA, 20 bp, Homo sapiens
gggatgagagtcctagctct

SEQ ID NO: 9385218 - DNA, 22 bp, Homo sapiens
cagacagggccctgtgatggta

SEQ ID NO: 9385219 - DNA, 22 bp, Homo sapiens
cagacagggccctgtgatggta

SEQ ID NO: 9385220 - DNA, 22 bp, Homo sapiens
cagacaggggtaaccttcctca

SEQ ID NO: 9385221 - DNA, 22 bp, Homo sapiens
cagacaggggtaaccttcctca

SEQ ID NO: 9385222 - DNA, 22 bp, Homo sapiens
gggcaaggcagaagagttggag

SEQ ID NO: 9385223 - DNA, 22 bp, Homo sapiens
gggcaaggcagaagagttggag

SEQ ID NO: 9385224 - DNA, 20 bp, Homo sapiens
gggcaaggaaacagccccca

SEQ ID NO: 9385225 - DNA, 22 bp, Homo sapiens
gggcacaccttgtctgagcaca

SEQ ID NO: 9385226 - DNA, 22 bp, Homo sapiens
cagaagtggcctcagagggagt

SEQ ID NO: 9385227 - DNA, 22 bp, Homo sapiens
cagaagtggcctcagagggagt

SEQ ID NO: 9385228 - DNA, 22 bp, Homo sapiens
gggactgtcctacatggagagg

SEQ ID NO: 9385229 - DNA, 22 bp, Homo sapiens
gggactgggagatcctcctggc

SEQ ID NO: 9385230 - DNA, 22 bp, Homo sapiens
gggactgtccggcagaaggtac

SEQ ID NO: 9385231 - DNA, 22 bp, Homo sapiens
cagaagtgatgttgagctagtc

SEQ ID NO: 9385232 - DNA, 22 bp, Homo sapiens
gggactgtgaggcctaactggg

SEQ ID NO: 9385233 - DNA, 22 bp, Homo sapiens
cagacaggaattctggcgtggt

SEQ ID NO: 9385234 - DNA, 22 bp, Homo sapiens
cagacagaaggctccttgaggt

SEQ ID NO: 9385235 - DNA, 22 bp, Homo sapiens
cagacaggagactggatcatgg

SEQ ID NO: 9385236 - DNA, 22 bp, Homo sapiens
cagacaggaattctggcgtggt

SEQ ID NO: 9385237 - DNA, 22 bp, Homo sapiens
cagacaggaattctggcgtggt

SEQ ID NO: 9385238 - DNA, 22 bp, Homo sapiens
cagacaggcaggtgagagctcc

SEQ ID NO: 9385239 - DNA, 22 bp, Homo sapiens
cagacaggcaggtgagagctcc

SEQ ID NO: 9385240 - DNA, 22 bp, Homo sapiens
cagacaggagactggatcatgg

SEQ ID NO: 9385241 - DNA, 22 bp, Homo sapiens
gggagcaagccggaggtactgt

SEQ ID NO: 9385242 - DNA, 22 bp, Homo sapiens
cagacaggcaggtgctgctttg

SEQ ID NO: 9385243 - DNA, 22 bp, Homo sapiens
cagacaggcaggtgctgctttg

SEQ ID NO: 9385244 - DNA, 22 bp, Homo sapiens
cagacaggcaggtgagagctcc

SEQ ID NO: 9385245 - DNA, 22 bp, Homo sapiens
cagacaggcaggtgagagctcc

SEQ ID NO: 9385246 - DNA, 19 bp, Homo sapiens
gggagcaggaaagctgtgg

SEQ ID NO: 9385247 - DNA, 19 bp, Homo sapiens
gggagcaggaaagctgtgg

SEQ ID NO: 9385248 - DNA, 22 bp, Homo sapiens
gggagcagcctgcctcccacct

SEQ ID NO: 9385249 - DNA, 22 bp, Homo sapiens
gggagcactgagaggcaggtag

SEQ ID NO: 9385250 - DNA, 22 bp, Homo sapiens
gggagcaggagcctgcctgcca

SEQ ID NO: 9385251 - DNA, 22 bp, Homo sapiens
gggagcaggagcctgcctgcca

SEQ ID NO: 9385252 - DNA, 22 bp, Homo sapiens
gggagcaggacataatagcaat

SEQ ID NO: 9385253 - DNA, 22 bp, Homo sapiens
gggagcaggacataatagcaat

SEQ ID NO: 9385254 - DNA, 22 bp, Homo sapiens
cagaggccagtggacaagggcc

SEQ ID NO: 9385255 - DNA, 22 bp, Homo sapiens
cagaggccagtggacaagggcc

SEQ ID NO: 9385256 - DNA, 22 bp, Homo sapiens
cagaggccagtggacaagggcc

SEQ ID NO: 9385257 - DNA, 22 bp, Homo sapiens
cagaggccaggctgcctgactg

SEQ ID NO: 9385258 - DNA, 22 bp, Homo sapiens
cagaggccagggggctcacaaa

SEQ ID NO: 9385259 - DNA, 22 bp, Homo sapiens
cagaggccagggggctcacaaa

SEQ ID NO: 9385260 - DNA, 21 bp, Homo sapiens
cagaggcctcatgctctgtgc

SEQ ID NO: 9385261 - DNA, 22 bp, Homo sapiens
cagaggcctcacttccagccag

SEQ ID NO: 9385262 - DNA, 21 bp, Homo sapiens
cagaggcctatcacagactcc

SEQ ID NO: 9385263 - DNA, 21 bp, Homo sapiens
cagaggcctatcacagactcc

SEQ ID NO: 9385264 - DNA, 22 bp, Homo sapiens
cagaggcctatccagtgtccat

SEQ ID NO: 9385265 - DNA, 22 bp, Homo sapiens
cagaggcctatccagtgtccat

SEQ ID NO: 9385266 - DNA, 20 bp, Homo sapiens
ggggaagaaaaggatgtgat

SEQ ID NO: 9385267 - DNA, 22 bp, Homo sapiens
ggggaagaatgctctctagaga

SEQ ID NO: 9385268 - DNA, 22 bp, Homo sapiens
ggggaagaaatctgggttcttc

SEQ ID NO: 9385269 - DNA, 22 bp, Homo sapiens
cagagctggtaagtggtagagg

SEQ ID NO: 9385270 - DNA, 22 bp, Homo sapiens
cagagctggtgtgtcctggcat

SEQ ID NO: 9385271 - DNA, 22 bp, Homo sapiens
cagagctgtatttatctttcca

SEQ ID NO: 9385272 - DNA, 22 bp, Homo sapiens
cagagctggtgttacaagtcca

SEQ ID NO: 9385273 - DNA, 22 bp, Homo sapiens
cagagctggtgttacaagtcca

SEQ ID NO: 9385274 - DNA, 22 bp, Homo sapiens
cagagctggtgttacaagtcca

SEQ ID NO: 9385275 - DNA, 20 bp, Homo sapiens
cagaggcattttcagactct

SEQ ID NO: 9385276 - DNA, 22 bp, Homo sapiens
cagaggccacctgtggccactg

SEQ ID NO: 9385277 - DNA, 21 bp, Homo sapiens
cagaggcaggctctgtgtgtg

SEQ ID NO: 9385278 - DNA, 21 bp, Homo sapiens
cagaggcaggctctgtgtgtg

SEQ ID NO: 9385279 - DNA, 20 bp, Homo sapiens
cagaggcattttcagactct

SEQ ID NO: 9385280 - DNA, 22 bp, Homo sapiens
cagaggtggggagtatttcaag

SEQ ID NO: 9385281 - DNA, 21 bp, Homo sapiens
cagaggtggcctgacctctga

SEQ ID NO: 9385282 - DNA, 22 bp, Homo sapiens
cagaggtgtacagagggaggcc

SEQ ID NO: 9385283 - DNA, 23 bp, Homo sapiens
cagaggtgtcagtgcccagtgtc

SEQ ID NO: 9385284 - DNA, 22 bp, Homo sapiens
cagaggtgtacagagggaggcc

SEQ ID NO: 9385285 - DNA, 22 bp, Homo sapiens
cagaggttacctagagcaagaa

SEQ ID NO: 9385286 - DNA, 22 bp, Homo sapiens
cagaggtttgatcgagtaggtc

SEQ ID NO: 9385287 - DNA, 22 bp, Homo sapiens
cagagtaaacctgtcatcaaga

SEQ ID NO: 9385288 - DNA, 22 bp, Homo sapiens
cagaggctgtgtaggcagactg

SEQ ID NO: 9385289 - DNA, 22 bp, Homo sapiens
cagaggcttatacctgattagg

SEQ ID NO: 9385290 - DNA, 22 bp, Homo sapiens
cagaggcttcaagtcattctcc

SEQ ID NO: 9385291 - DNA, 22 bp, Homo sapiens
cagaggctttgccctggaaacc

SEQ ID NO: 9385292 - DNA, 22 bp, Homo sapiens
cagaggcttggcattatcatgc

SEQ ID NO: 9385293 - DNA, 22 bp, Homo sapiens
cagaggcttcaagtcattctcc

SEQ ID NO: 9385294 - DNA, 22 bp, Homo sapiens
cagaggctgggacctcaggcat

SEQ ID NO: 9385295 - DNA, 22 bp, Homo sapiens
cagaggctgggacctcaggcat

SEQ ID NO: 9385296 - DNA, 22 bp, Homo sapiens
cagaggctgtgtaggcagactg

SEQ ID NO: 9385297 - DNA, 22 bp, Homo sapiens
cagaggctgtgtaggcagactg

SEQ ID NO: 9385298 - DNA, 22 bp, Homo sapiens
cagaggctggcggccgccccga

SEQ ID NO: 9385299 - DNA, 22 bp, Homo sapiens
cagaggctgggacctcaggcat

SEQ ID NO: 9385300 - DNA, 22 bp, Homo sapiens
cagaggctgggacctcaggcat

SEQ ID NO: 9385301 - DNA, 22 bp, Homo sapiens
gggtcgggcaggcgccctcgtc

SEQ ID NO: 9385302 - DNA, 22 bp, Homo sapiens
gggtctaggagacatgggcaag

SEQ ID NO: 9385303 - DNA, 22 bp, Homo sapiens
cagaggcctggcttggacacct

SEQ ID NO: 9385304 - DNA, 22 bp, Homo sapiens
cagaggcctggcttggacacct

SEQ ID NO: 9385305 - DNA, 22 bp, Homo sapiens
gggtgcaggggaccctagggac

SEQ ID NO: 9385306 - DNA, 22 bp, Homo sapiens
gggtgcagggtctccagcagct

SEQ ID NO: 9385307 - DNA, 22 bp, Homo sapiens
gggtgcagggtctccagcagct

SEQ ID NO: 9385308 - DNA, 22 bp, Homo sapiens
gggtgcagtggttcacgcctgt

SEQ ID NO: 9385309 - DNA, 22 bp, Homo sapiens
gggtgcagggtctccagcagct

SEQ ID NO: 9385310 - DNA, 23 bp, Homo sapiens
gggtgctgcctgtagtcatgctg

SEQ ID NO: 9385311 - DNA, 22 bp, Homo sapiens
gggtgctgaggaagacagcagg

SEQ ID NO: 9385312 - DNA, 22 bp, Homo sapiens
cagaggctggatggacttgcct

SEQ ID NO: 9385313 - DNA, 22 bp, Homo sapiens
gggtgctgactggggcctgaaa

SEQ ID NO: 9385314 - DNA, 22 bp, Homo sapiens
gggtgctgactggggcctgaaa

SEQ ID NO: 9385315 - DNA, 22 bp, Homo sapiens
gggtgctgaggaagacagcagg

SEQ ID NO: 9385316 - DNA, 22 bp, Homo sapiens
gggtgctcctggcggcctcttt

SEQ ID NO: 9385317 - DNA, 22 bp, Homo sapiens
gggtgctcctggcggcctcttt

SEQ ID NO: 9385318 - DNA, 22 bp, Homo sapiens
gggtgctcatggataaggcgaa

SEQ ID NO: 9385319 - DNA, 22 bp, Homo sapiens
gggtgcctgagttagggcagaa

SEQ ID NO: 9385320 - DNA, 22 bp, Homo sapiens
gggtgcctgagttagggcagaa

SEQ ID NO: 9385321 - DNA, 22 bp, Homo sapiens
gggtgcctgcctcaggcagtgt

SEQ ID NO: 9385322 - DNA, 22 bp, Homo sapiens
gggtgcagtggttcacgcctgt

SEQ ID NO: 9385323 - DNA, 22 bp, Homo sapiens
gggtgccctgggtaggtcagtt

SEQ ID NO: 9385324 - DNA, 21 bp, Homo sapiens
cagagctctttctgcttgctg

SEQ ID NO: 9385325 - DNA, 21 bp, Homo sapiens
cagagctctttctgcttgctg

SEQ ID NO: 9385326 - DNA, 22 bp, Homo sapiens
cagagctgacccaaggattgaa

SEQ ID NO: 9385327 - DNA, 22 bp, Homo sapiens
cagagctgacccaaggattgaa

SEQ ID NO: 9385328 - DNA, 22 bp, Homo sapiens
gggcgcagccaatcctggccct

SEQ ID NO: 9385329 - DNA, 22 bp, Homo sapiens
gggcgcagccaatcctggccct

SEQ ID NO: 9385330 - DNA, 22 bp, Homo sapiens
gggcgccgtgggaaacagccgg

SEQ ID NO: 9385331 - DNA, 22 bp, Homo sapiens
cagagcctgctgccttctgaag

SEQ ID NO: 9385332 - DNA, 22 bp, Homo sapiens
cagagctctgacagctacagcc

SEQ ID NO: 9385333 - DNA, 22 bp, Homo sapiens
cagagctgcacattctatgatg

SEQ ID NO: 9385334 - DNA, 22 bp, Homo sapiens
cagagctgcagattgaaggcat

SEQ ID NO: 9385335 - DNA, 22 bp, Homo sapiens
cagagctgagtcttcaaggttg

SEQ ID NO: 9385336 - DNA, 22 bp, Homo sapiens
cagagctgagaatgttgatgct

SEQ ID NO: 9385337 - DNA, 23 bp, Homo sapiens
cagagctgattaaacttaatctc

SEQ ID NO: 9385338 - DNA, 19 bp, Homo sapiens
cagagctgctggcctcgtc

SEQ ID NO: 9385339 - DNA, 22 bp, Homo sapiens
cagagctgctcatggtggccag

SEQ ID NO: 9385340 - DNA, 19 bp, Homo sapiens
cagagctgctggcctcgtc

SEQ ID NO: 9385341 - DNA, 22 bp, Homo sapiens
gggctgtgtactatgaggaggg

SEQ ID NO: 9385342 - DNA, 22 bp, Homo sapiens
cagagctgcagattgaaggcat

SEQ ID NO: 9385343 - DNA, 22 bp, Homo sapiens
cagagctgcgctttttcctggt

SEQ ID NO: 9385344 - DNA, 22 bp, Homo sapiens
cagagctgcgctttttcctggt

SEQ ID NO: 9385345 - DNA, 23 bp, Homo sapiens
ggggaaagaccatgcttgaggac

SEQ ID NO: 9385346 - DNA, 22 bp, Homo sapiens
ggggaaactgaggcacagacag

SEQ ID NO: 9385347 - DNA, 22 bp, Homo sapiens
ggggaaacatgttgttcagacc

SEQ ID NO: 9385348 - DNA, 22 bp, Homo sapiens
gggctgtgtactatgaggaggg

SEQ ID NO: 9385349 - DNA, 22 bp, Homo sapiens
gggctgtgtactatgaggaggg

SEQ ID NO: 9385350 - DNA, 20 bp, Homo sapiens
ggggaagaaaaggatgtgat

SEQ ID NO: 9385351 - DNA, 22 bp, Homo sapiens
cagagcccagggcctacgtccc

SEQ ID NO: 9385352 - DNA, 22 bp, Homo sapiens
cagagcccatggcacatgtgga

SEQ ID NO: 9385353 - DNA, 22 bp, Homo sapiens
cagagccccccttctgatcaca

SEQ ID NO: 9385354 - DNA, 22 bp, Homo sapiens
cagagcccatcctatactctcc

SEQ ID NO: 9385355 - DNA, 22 bp, Homo sapiens
gggcagagaaatggacagttgg

SEQ ID NO: 9385356 - DNA, 22 bp, Homo sapiens
gggcagagaaatggacagttgg

SEQ ID NO: 9385357 - DNA, 22 bp, Homo sapiens
gggcagagaaatggacagttgg

SEQ ID NO: 9385358 - DNA, 22 bp, Homo sapiens
gggcacttgtgttcttcacttt

SEQ ID NO: 9385359 - DNA, 22 bp, Homo sapiens
gggcactttgtgcctcactgtg

SEQ ID NO: 9385360 - DNA, 22 bp, Homo sapiens
gggcacttctaagcatggggct

SEQ ID NO: 9385361 - DNA, 22 bp, Homo sapiens
gggcacttactgccaaggcgag

SEQ ID NO: 9385362 - DNA, 22 bp, Homo sapiens
gggcacttaatgggcacagaga

SEQ ID NO: 9385363 - DNA, 22 bp, Homo sapiens
gggcactgtggggcccatgctg

SEQ ID NO: 9385364 - DNA, 22 bp, Homo sapiens
gggcactgtgctgggtgcttta

SEQ ID NO: 9385365 - DNA, 22 bp, Homo sapiens
gggcactgtgttcagagtgcag

SEQ ID NO: 9385366 - DNA, 22 bp, Homo sapiens
gggcactgtgttcagagtgcag

SEQ ID NO: 9385367 - DNA, 22 bp, Homo sapiens
gggcactgtgttcagagtgcag

SEQ ID NO: 9385368 - DNA, 22 bp, Homo sapiens
gggcactgtgttcagagtgcag

SEQ ID NO: 9385369 - DNA, 22 bp, Homo sapiens
gggcacagcccagtggggtccc

SEQ ID NO: 9385370 - DNA, 22 bp, Homo sapiens
gggcacagagggtcttgaagaa

SEQ ID NO: 9385371 - DNA, 22 bp, Homo sapiens
gggcacagaagtctaagacatc

SEQ ID NO: 9385372 - DNA, 22 bp, Homo sapiens
gggcacagagggtcttgaagaa

SEQ ID NO: 9385373 - DNA, 22 bp, Homo sapiens
cagagcccctcgtctccaccac

SEQ ID NO: 9385374 - DNA, 22 bp, Homo sapiens
cagagcccctcgtctccaccac

SEQ ID NO: 9385375 - DNA, 22 bp, Homo sapiens
cagagcccctgggttgggagct

SEQ ID NO: 9385376 - DNA, 22 bp, Homo sapiens
cagagccctagtcctgatggcc

SEQ ID NO: 9385377 - DNA, 22 bp, Homo sapiens
cagagccctagtcctgatggcc

SEQ ID NO: 9385378 - DNA, 22 bp, Homo sapiens
cagagcccctcagctctctccc

SEQ ID NO: 9385379 - DNA, 22 bp, Homo sapiens
cagagcccctcagctctctccc

SEQ ID NO: 9385380 - DNA, 22 bp, Homo sapiens
cagagcccctcagctctctccc

SEQ ID NO: 9385381 - DNA, 22 bp, Homo sapiens
cagagccccccttctgatcaca

SEQ ID NO: 9385382 - DNA, 22 bp, Homo sapiens
cagagccccccttctgatcaca

SEQ ID NO: 9385383 - DNA, 22 bp, Homo sapiens
cagagccctcaaggccgatgca

SEQ ID NO: 9385384 - DNA, 22 bp, Homo sapiens
cagagccctccgctccccggct

SEQ ID NO: 9385385 - DNA, 22 bp, Homo sapiens
cagagccctgcatgctccatct

SEQ ID NO: 9385386 - DNA, 22 bp, Homo sapiens
cagagccctgcatgctccatct

SEQ ID NO: 9385387 - DNA, 22 bp, Homo sapiens
cagagccctgtgtgccatgtga

SEQ ID NO: 9385388 - DNA, 22 bp, Homo sapiens
cagagccctgcatgctccatct

SEQ ID NO: 9385389 - DNA, 22 bp, Homo sapiens
cagagccctgggcacatggtag

SEQ ID NO: 9385390 - DNA, 22 bp, Homo sapiens
gggccttgccatggagcctgag

SEQ ID NO: 9385391 - DNA, 22 bp, Homo sapiens
cagagcccttcctcccacgggg

SEQ ID NO: 9385392 - DNA, 22 bp, Homo sapiens
gggcgagggcgaaagcgagagc

SEQ ID NO: 9385393 - DNA, 21 bp, Homo sapiens
gggcgaggcctgatgtggctc

SEQ ID NO: 9385394 - DNA, 22 bp, Homo sapiens
gggcgagggcgaaagcgagagc

SEQ ID NO: 9385395 - DNA, 22 bp, Homo sapiens
cagcccagcagactgttaccac

SEQ ID NO: 9385396 - DNA, 22 bp, Homo sapiens
cagcccagcagggtctggccct

SEQ ID NO: 9385397 - DNA, 22 bp, Homo sapiens
cagcccagcagggtctggccct

SEQ ID NO: 9385398 - DNA, 22 bp, Homo sapiens
cagcccagcagtcttagcctgc

SEQ ID NO: 9385399 - DNA, 21 bp, Homo sapiens
cagcccagcccattgacagtg

SEQ ID NO: 9385400 - DNA, 18 bp, Homo sapiens
cagcattagcagcttcca

SEQ ID NO: 9385401 - DNA, 22 bp, Homo sapiens
cagcatgcctgggctgcctgcc

SEQ ID NO: 9385402 - DNA, 22 bp, Homo sapiens
cagcattgccctttttctcaga

SEQ ID NO: 9385403 - DNA, 22 bp, Homo sapiens
cagcatttagaatttgaagtgt

SEQ ID NO: 9385404 - DNA, 22 bp, Homo sapiens
cagcatttatcttgtagcagga

SEQ ID NO: 9385405 - DNA, 22 bp, Homo sapiens
cagcatttggtgatcatcttaa

SEQ ID NO: 9385406 - DNA, 22 bp, Homo sapiens
cagcattttccatagaaagaag

SEQ ID NO: 9385407 - DNA, 22 bp, Homo sapiens
cagcattttccatagaaagaag

SEQ ID NO: 9385408 - DNA, 22 bp, Homo sapiens
gtattttaagtgactactaggt

SEQ ID NO: 9385409 - DNA, 22 bp, Homo sapiens
gtattttactgctcaaagctct

SEQ ID NO: 9385410 - DNA, 22 bp, Homo sapiens
gtattttaagtgactactaggt

SEQ ID NO: 9385411 - DNA, 22 bp, Homo sapiens
gtattttactgctcaaagctct

SEQ ID NO: 9385412 - DNA, 22 bp, Homo sapiens
cagcatgcctgggctgcctgcc

SEQ ID NO: 9385413 - DNA, 22 bp, Homo sapiens
cagcatgcccagactgagctaa

SEQ ID NO: 9385414 - DNA, 22 bp, Homo sapiens
cagccactggtgccaggctgtt

SEQ ID NO: 9385415 - DNA, 22 bp, Homo sapiens
cagccactgtggaatagccccc

SEQ ID NO: 9385416 - DNA, 22 bp, Homo sapiens
cagccacttcgagcttcctgat

SEQ ID NO: 9385417 - DNA, 22 bp, Homo sapiens
cagccacttcgagcttcctgat

SEQ ID NO: 9385418 - DNA, 22 bp, Homo sapiens
cagccacttcccctctatgggt

SEQ ID NO: 9385419 - DNA, 22 bp, Homo sapiens
cagccacttgtgatgctgggga

SEQ ID NO: 9385420 - DNA, 22 bp, Homo sapiens
cagccacttcgagcttcctgat

SEQ ID NO: 9385421 - DNA, 22 bp, Homo sapiens
cagccaggttcaagtccttata

SEQ ID NO: 9385422 - DNA, 22 bp, Homo sapiens
cagcattttcttaatgtaggtg

SEQ ID NO: 9385423 - DNA, 22 bp, Homo sapiens
cagccaagaaagcagtgctcca

SEQ ID NO: 9385424 - DNA, 22 bp, Homo sapiens
cagccaagaaccacagacccag

SEQ ID NO: 9385425 - DNA, 22 bp, Homo sapiens
cagccaccatacagcagaagct

SEQ ID NO: 9385426 - DNA, 22 bp, Homo sapiens
cagccactctcagacagtccca

SEQ ID NO: 9385427 - DNA, 22 bp, Homo sapiens
cagccactgaactcctggctat

SEQ ID NO: 9385428 - DNA, 22 bp, Homo sapiens
cagccactctcagacagtccca

SEQ ID NO: 9385429 - DNA, 22 bp, Homo sapiens
cagccactgacaggaatggtcc

SEQ ID NO: 9385430 - DNA, 22 bp, Homo sapiens
gggtgggactgaagtctgaggg

SEQ ID NO: 9385431 - DNA, 22 bp, Homo sapiens
gggtgggactgaagtctgaggg

SEQ ID NO: 9385432 - DNA, 22 bp, Homo sapiens
gggtgggagaaatgagtatcta

SEQ ID NO: 9385433 - DNA, 22 bp, Homo sapiens
gggtgggagaaatgagtatcta

SEQ ID NO: 9385434 - DNA, 22 bp, Homo sapiens
gggtgggactctttggcctgag

SEQ ID NO: 9385435 - DNA, 22 bp, Homo sapiens
gggtgggactctttggcctgag

SEQ ID NO: 9385436 - DNA, 22 bp, Homo sapiens
gggtgggaaggctaagggattg

SEQ ID NO: 9385437 - DNA, 22 bp, Homo sapiens
cagagtcaatgtccaagaagct

SEQ ID NO: 9385438 - DNA, 22 bp, Homo sapiens
gggtgggatctgtggagcctca

SEQ ID NO: 9385439 - DNA, 22 bp, Homo sapiens
gggtgggagtctggccctcaaa

SEQ ID NO: 9385440 - DNA, 20 bp, Homo sapiens
gggtgggagagtctgagggt

SEQ ID NO: 9385441 - DNA, 20 bp, Homo sapiens
gggtgggagagtctgagggt

SEQ ID NO: 9385442 - DNA, 21 bp, Homo sapiens
gggtgggaggacacagcaggc

SEQ ID NO: 9385443 - DNA, 22 bp, Homo sapiens
ggtggggctgcaagcagttcgg

SEQ ID NO: 9385444 - DNA, 22 bp, Homo sapiens
ggtggggctcagcaatctgtgt

SEQ ID NO: 9385445 - DNA, 22 bp, Homo sapiens
ggtggggctcagcaatctgtgt

SEQ ID NO: 9385446 - DNA, 22 bp, Homo sapiens
ggtgggtaaaactgctggcact

SEQ ID NO: 9385447 - DNA, 22 bp, Homo sapiens
ggtggggttttaggctgctgca

SEQ ID NO: 9385448 - DNA, 22 bp, Homo sapiens
ggtggggttttaggctgctgca

SEQ ID NO: 9385449 - DNA, 22 bp, Homo sapiens
ggtggggtcacgacagagggaa

SEQ ID NO: 9385450 - DNA, 22 bp, Homo sapiens
ggtgggtatagttagggcctct

SEQ ID NO: 9385451 - DNA, 22 bp, Homo sapiens
ggtgggtgaaatctaggtgtgt

SEQ ID NO: 9385452 - DNA, 22 bp, Homo sapiens
cagcaaggccattggatgcagt

SEQ ID NO: 9385453 - DNA, 22 bp, Homo sapiens
cagcaaggccattggatgcagt

SEQ ID NO: 9385454 - DNA, 22 bp, Homo sapiens
cagcaagggataaacaaggacg

SEQ ID NO: 9385455 - DNA, 22 bp, Homo sapiens
cagcaaggccattggatgcagt

SEQ ID NO: 9385456 - DNA, 22 bp, Homo sapiens
cagcaaggccattggatgcagt

SEQ ID NO: 9385457 - DNA, 22 bp, Homo sapiens
cagcaagggttatatcaaagat

SEQ ID NO: 9385458 - DNA, 22 bp, Homo sapiens
cagcaataactcaaagccattt

SEQ ID NO: 9385459 - DNA, 22 bp, Homo sapiens
ggttccccaggcggcccttgga

SEQ ID NO: 9385460 - DNA, 22 bp, Homo sapiens
ggttcccggatctccgagtccc

SEQ ID NO: 9385461 - DNA, 22 bp, Homo sapiens
ggttcccggatctccgagtccc

SEQ ID NO: 9385462 - DNA, 23 bp, Homo sapiens
ggttcctgagcagggatctggaa

SEQ ID NO: 9385463 - DNA, 22 bp, Homo sapiens
ggttctaggattaggaggccca

SEQ ID NO: 9385464 - DNA, 22 bp, Homo sapiens
ggttctccttgagtgtcccagg

SEQ ID NO: 9385465 - DNA, 22 bp, Homo sapiens
gtaaacacctgttaaattcaga

SEQ ID NO: 9385466 - DNA, 22 bp, Homo sapiens
gtaaaattgcaattacttttgc

SEQ ID NO: 9385467 - DNA, 22 bp, Homo sapiens
gtaaaattgcaattacttttgc

SEQ ID NO: 9385468 - DNA, 22 bp, Homo sapiens
gtaaaattctagcatctgaaag

SEQ ID NO: 9385469 - DNA, 22 bp, Homo sapiens
gtaaaattctagcatctgaaag

SEQ ID NO: 9385470 - DNA, 22 bp, Homo sapiens
gtaaaatctttattgctggtga

SEQ ID NO: 9385471 - DNA, 22 bp, Homo sapiens
gtaaaatctttcctatttgcct

SEQ ID NO: 9385472 - DNA, 22 bp, Homo sapiens
gtaaaatcatttagttacttaa

SEQ ID NO: 9385473 - DNA, 20 bp, Homo sapiens
gtaaaatatggtctttgggt

SEQ ID NO: 9385474 - DNA, 20 bp, Homo sapiens
gtaaaatatggtctttgggt

SEQ ID NO: 9385475 - DNA, 20 bp, Homo sapiens
gtaaaatatggtctttgggt

SEQ ID NO: 9385476 - DNA, 22 bp, Homo sapiens
gtaaaatagaataacgtggcta

SEQ ID NO: 9385477 - DNA, 19 bp, Homo sapiens
ggttggagaagagcggccc

SEQ ID NO: 9385478 - DNA, 22 bp, Homo sapiens
ggttgcaaactcctgggatcaa

SEQ ID NO: 9385479 - DNA, 22 bp, Homo sapiens
ggttctttgtatatatcacttt

SEQ ID NO: 9385480 - DNA, 17 bp, Homo sapiens
ggttgagtaatctgagg

SEQ ID NO: 9385481 - DNA, 22 bp, Homo sapiens
gtatttctttccattatagtca

SEQ ID NO: 9385482 - DNA, 22 bp, Homo sapiens
gtatttctttccattatagtca

SEQ ID NO: 9385483 - DNA, 15 bp, Homo sapiens
gtatttcttttatat

SEQ ID NO: 9385484 - DNA, 22 bp, Homo sapiens
gtatttctttccattatagtca

SEQ ID NO: 9385485 - DNA, 22 bp, Homo sapiens
gtatttcttggaaatcctttta

SEQ ID NO: 9385486 - DNA, 22 bp, Homo sapiens
gtatttcttgtacttccttgtc

SEQ ID NO: 9385487 - DNA, 22 bp, Homo sapiens
gtatttctttacatatgctcat

SEQ ID NO: 9385488 - DNA, 22 bp, Homo sapiens
gtatttctttatctggtcagaa

SEQ ID NO: 9385489 - DNA, 22 bp, Homo sapiens
gtatttctggtaactgctgcta

SEQ ID NO: 9385490 - DNA, 22 bp, Homo sapiens
gtatttctggttaaatgtgcta

SEQ ID NO: 9385491 - DNA, 22 bp, Homo sapiens
gtatttctagaatggtagcact

SEQ ID NO: 9385492 - DNA, 22 bp, Homo sapiens
gtatttctagtttcttccacag

SEQ ID NO: 9385493 - DNA, 22 bp, Homo sapiens
gtatttctgcaaagtgtgtgac

SEQ ID NO: 9385494 - DNA, 22 bp, Homo sapiens
gtatttctggttaaatgtgcta

SEQ ID NO: 9385495 - DNA, 16 bp, Homo sapiens
gtatttcttagacttt

SEQ ID NO: 9385496 - DNA, 22 bp, Homo sapiens
gtatttcttccacggtggattt

SEQ ID NO: 9385497 - DNA, 22 bp, Homo sapiens
gtatttcttggaaatcctttta

SEQ ID NO: 9385498 - DNA, 22 bp, Homo sapiens
cagcaggcggcccgcgggcccg

SEQ ID NO: 9385499 - DNA, 22 bp, Homo sapiens
cagcaggcggcccgcgggcccg

SEQ ID NO: 9385500 - DNA, 22 bp, Homo sapiens
gtatttctagaaaatgcagatt

SEQ ID NO: 9385501 - DNA, 22 bp, Homo sapiens
gtatttctagaaaatgcagatt

SEQ ID NO: 9385502 - DNA, 22 bp, Homo sapiens
gtatttctagaaccaaaagcca

SEQ ID NO: 9385503 - DNA, 22 bp, Homo sapiens
gtatttctagaaccaaaagcca

SEQ ID NO: 9385504 - DNA, 22 bp, Homo sapiens
cagcaggcccaggtgctggtga

SEQ ID NO: 9385505 - DNA, 22 bp, Homo sapiens
cagcaggcccaggtgctggtga

SEQ ID NO: 9385506 - DNA, 22 bp, Homo sapiens
cagcaggcccaggtgctggtga

SEQ ID NO: 9385507 - DNA, 22 bp, Homo sapiens
cagcaggcaggtgggccaagtc

SEQ ID NO: 9385508 - DNA, 22 bp, Homo sapiens
cagcaggcaggtgggccaagtc

SEQ ID NO: 9385509 - DNA, 22 bp, Homo sapiens
cagcaggcaggtgggccaagtc

SEQ ID NO: 9385510 - DNA, 22 bp, Homo sapiens
cagcaggcaggtgggccaagtc

SEQ ID NO: 9385511 - DNA, 22 bp, Homo sapiens
cagcaggcccagagtttcatgg

SEQ ID NO: 9385512 - DNA, 22 bp, Homo sapiens
cagcaggccatgctgcttttca

SEQ ID NO: 9385513 - DNA, 22 bp, Homo sapiens
cagcaggcagccatttcactgt

SEQ ID NO: 9385514 - DNA, 22 bp, Homo sapiens
cagcaggcagccatttcactgt

SEQ ID NO: 9385515 - DNA, 22 bp, Homo sapiens
cagcaggcagccatttcactgt

SEQ ID NO: 9385516 - DNA, 22 bp, Homo sapiens
cagcaggattggatacatctca

SEQ ID NO: 9385517 - DNA, 22 bp, Homo sapiens
cagcaggattggatacatctca

SEQ ID NO: 9385518 - DNA, 22 bp, Homo sapiens
gtatgcatgcatgtgtatgtac

SEQ ID NO: 9385519 - DNA, 22 bp, Homo sapiens
gtatgcatttggcatattgtcc

SEQ ID NO: 9385520 - DNA, 22 bp, Homo sapiens
cagcagcctccactcgccccac

SEQ ID NO: 9385521 - DNA, 22 bp, Homo sapiens
cagcagcctgccttgggagctt

SEQ ID NO: 9385522 - DNA, 22 bp, Homo sapiens
cagcagcctcttgtgcctgtgg

SEQ ID NO: 9385523 - DNA, 22 bp, Homo sapiens
cagcagcctcttgtgcctgtgg

SEQ ID NO: 9385524 - DNA, 22 bp, Homo sapiens
gtatgaaagcatcattcctgct

SEQ ID NO: 9385525 - DNA, 22 bp, Homo sapiens
cagcagctacttggagcagcag

SEQ ID NO: 9385526 - DNA, 22 bp, Homo sapiens
cagcagctacctgctcttgtgg

SEQ ID NO: 9385527 - DNA, 22 bp, Homo sapiens
cagcagctacctgctcttgtgg

SEQ ID NO: 9385528 - DNA, 22 bp, Homo sapiens
cagcagctacctgctcttgtgg

SEQ ID NO: 9385529 - DNA, 22 bp, Homo sapiens
cagcagctacctgctcttgtgg

SEQ ID NO: 9385530 - DNA, 22 bp, Homo sapiens
cagcagctacttggagcagcag

SEQ ID NO: 9385531 - DNA, 22 bp, Homo sapiens
cagcagcctggcccctcctcgg

SEQ ID NO: 9385532 - DNA, 22 bp, Homo sapiens
cagcagcctggcccctcctcgg

SEQ ID NO: 9385533 - DNA, 22 bp, Homo sapiens
cagcagcctggcccctcctcgg

SEQ ID NO: 9385534 - DNA, 22 bp, Homo sapiens
cagcagctaaggcatgttcctg

SEQ ID NO: 9385535 - DNA, 22 bp, Homo sapiens
cagcagcctggcccctcctcgg

SEQ ID NO: 9385536 - DNA, 22 bp, Homo sapiens
cagcagctaaggcatgttcctg

SEQ ID NO: 9385537 - DNA, 22 bp, Homo sapiens
cagcagcctggagggggccacg

SEQ ID NO: 9385538 - DNA, 22 bp, Homo sapiens
cagcagcctggagggggccacg

SEQ ID NO: 9385539 - DNA, 22 bp, Homo sapiens
cagcagcctgccttgggagctt

SEQ ID NO: 9385540 - DNA, 22 bp, Homo sapiens
cagcagcaacaacggaagcctt

SEQ ID NO: 9385541 - DNA, 22 bp, Homo sapiens
cagcagcaacaacggaagcctt

SEQ ID NO: 9385542 - DNA, 22 bp, Homo sapiens
cagcagcaaggtgagggtggag

SEQ ID NO: 9385543 - DNA, 22 bp, Homo sapiens
cagcagcaacaatagcggtcac

SEQ ID NO: 9385544 - DNA, 22 bp, Homo sapiens
cagcagcaacaatagcggtcac

SEQ ID NO: 9385545 - DNA, 22 bp, Homo sapiens
cagcagcaaatctagaagagga

SEQ ID NO: 9385546 - DNA, 22 bp, Homo sapiens
cagcagcaaatctagaagagga

SEQ ID NO: 9385547 - DNA, 22 bp, Homo sapiens
cagcagagtttggcttctaatg

SEQ ID NO: 9385548 - DNA, 22 bp, Homo sapiens
cagcagcaacaacggaagcctt

SEQ ID NO: 9385549 - DNA, 22 bp, Homo sapiens
cagcagcaacaacggaagcctt

SEQ ID NO: 9385550 - DNA, 22 bp, Homo sapiens
cagcagcaaatctagaagagga

SEQ ID NO: 9385551 - DNA, 22 bp, Homo sapiens
cagcagagtaggtgctacttct

SEQ ID NO: 9385552 - DNA, 22 bp, Homo sapiens
cagcagagtatggcactcaact

SEQ ID NO: 9385553 - DNA, 21 bp, Homo sapiens
cagcagagtaatgcattcgta

SEQ ID NO: 9385554 - DNA, 22 bp, Homo sapiens
cagcagagtaattctcacctct

SEQ ID NO: 9385555 - DNA, 22 bp, Homo sapiens
cagcagagtaattctcacctct

SEQ ID NO: 9385556 - DNA, 22 bp, Homo sapiens
cagcagagctgtgtgggaaggg

SEQ ID NO: 9385557 - DNA, 19 bp, Homo sapiens
gtatatttatatggctgta

SEQ ID NO: 9385558 - DNA, 22 bp, Homo sapiens
gtatattttgatcaccctctat

SEQ ID NO: 9385559 - DNA, 22 bp, Homo sapiens
gtatcacttttgagagtgagaa

SEQ ID NO: 9385560 - DNA, 22 bp, Homo sapiens
gtatatgtgtgggcctgcatat

SEQ ID NO: 9385561 - DNA, 22 bp, Homo sapiens
gtatatgtgtgcaagtgcatgg

SEQ ID NO: 9385562 - DNA, 22 bp, Homo sapiens
gtatatgtatgcgtatacacac

SEQ ID NO: 9385563 - DNA, 22 bp, Homo sapiens
gtatatgtatgcgtatacacac

SEQ ID NO: 9385564 - DNA, 22 bp, Homo sapiens
gtatatgagctctatgtaatgg

SEQ ID NO: 9385565 - DNA, 22 bp, Homo sapiens
gtatctgtggattttggtatcc

SEQ ID NO: 9385566 - DNA, 22 bp, Homo sapiens
gtatctgtggattttggtatcc

SEQ ID NO: 9385567 - DNA, 22 bp, Homo sapiens
gtatcacttttgagagtgagaa

SEQ ID NO: 9385568 - DNA, 22 bp, Homo sapiens
cagcagcaaggtgagggtggag

SEQ ID NO: 9385569 - DNA, 22 bp, Homo sapiens
cagcagcacctattatagtgtt

SEQ ID NO: 9385570 - DNA, 22 bp, Homo sapiens
cagcagcagacatttgatcttc

SEQ ID NO: 9385571 - DNA, 22 bp, Homo sapiens
cagcagcactctgcgggtcccc

SEQ ID NO: 9385572 - DNA, 22 bp, Homo sapiens
cagcagcactctgcgggtcccc

SEQ ID NO: 9385573 - DNA, 22 bp, Homo sapiens
cagcagcacctattatagtgtt

SEQ ID NO: 9385574 - DNA, 22 bp, Homo sapiens
gtagggataggtgtccagagac

SEQ ID NO: 9385575 - DNA, 22 bp, Homo sapiens
gtagggagcccagagcccagtg

SEQ ID NO: 9385576 - DNA, 22 bp, Homo sapiens
gtagggcaacatgggcactagg

SEQ ID NO: 9385577 - DNA, 22 bp, Homo sapiens
cagcagcagagatactggtttc

SEQ ID NO: 9385578 - DNA, 22 bp, Homo sapiens
cagcagcagagatactggtttc

SEQ ID NO: 9385579 - DNA, 22 bp, Homo sapiens
cagcagcagacatttgatcttc

SEQ ID NO: 9385580 - DNA, 22 bp, Homo sapiens
atttcatgtgaagaagagataa

SEQ ID NO: 9385581 - DNA, 22 bp, Homo sapiens
atttcctagcctctcttgcagt

SEQ ID NO: 9385582 - DNA, 22 bp, Homo sapiens
atttcctagggtagatgtcaca

SEQ ID NO: 9385583 - DNA, 22 bp, Homo sapiens
atttctaggttcacatgtgttt

SEQ ID NO: 9385584 - DNA, 22 bp, Homo sapiens
atttctaggtagagaagcttag

SEQ ID NO: 9385585 - DNA, 22 bp, Homo sapiens
atttctagaggcagcttctagg

SEQ ID NO: 9385586 - DNA, 22 bp, Homo sapiens
atttcctttgcaaagactgtgc

SEQ ID NO: 9385587 - DNA, 22 bp, Homo sapiens
atttctacattgagttttagca

SEQ ID NO: 9385588 - DNA, 22 bp, Homo sapiens
atttctacattgagttttagca

SEQ ID NO: 9385589 - DNA, 18 bp, Homo sapiens
atttctactactataaag

SEQ ID NO: 9385590 - DNA, 18 bp, Homo sapiens
atttctactactataaag

SEQ ID NO: 9385591 - DNA, 22 bp, Homo sapiens
atttctactgtgagaaacatga

SEQ ID NO: 9385592 - DNA, 18 bp, Homo sapiens
atttctactactataaag

SEQ ID NO: 9385593 - DNA, 18 bp, Homo sapiens
atttctactactataaag

SEQ ID NO: 9385594 - DNA, 22 bp, Homo sapiens
atttcatatgtatcacctagcc

SEQ ID NO: 9385595 - DNA, 22 bp, Homo sapiens
atttcatactaaggctcaaaaa

SEQ ID NO: 9385596 - DNA, 22 bp, Homo sapiens
atttcagtgttttaagagttca

SEQ ID NO: 9385597 - DNA, 22 bp, Homo sapiens
atttcagtgttttaagagttca

SEQ ID NO: 9385598 - DNA, 20 bp, Homo sapiens
atttcagtgtttgcaatttc

SEQ ID NO: 9385599 - DNA, 20 bp, Homo sapiens
atttcagtgtttgcaatttc

SEQ ID NO: 9385600 - DNA, 22 bp, Homo sapiens
atttcagtagaaaatcttgatt

SEQ ID NO: 9385601 - DNA, 22 bp, Homo sapiens
atttcagtagtccttacttgta

SEQ ID NO: 9385602 - DNA, 22 bp, Homo sapiens
atttcagtattatacaactgct

SEQ ID NO: 9385603 - DNA, 22 bp, Homo sapiens
atttcagtgttggttagcaagc

SEQ ID NO: 9385604 - DNA, 22 bp, Homo sapiens
atttcagtgttggttagcaagc

SEQ ID NO: 9385605 - DNA, 22 bp, Homo sapiens
atttcagtgagaaagcaatcaa

SEQ ID NO: 9385606 - DNA, 22 bp, Homo sapiens
atttcagtgtcttcttctccct

SEQ ID NO: 9385607 - DNA, 22 bp, Homo sapiens
atttcagtgagaaagcaatcaa

SEQ ID NO: 9385608 - DNA, 22 bp, Homo sapiens
atttattgagagggaggggaat

SEQ ID NO: 9385609 - DNA, 22 bp, Homo sapiens
atttattgagagggaggggaat

SEQ ID NO: 9385610 - DNA, 22 bp, Homo sapiens
atttattgagagggaggggaat

SEQ ID NO: 9385611 - DNA, 22 bp, Homo sapiens
atttattgagagggaggggaat

SEQ ID NO: 9385612 - DNA, 22 bp, Homo sapiens
atttattgagcctttcctatgt

SEQ ID NO: 9385613 - DNA, 22 bp, Homo sapiens
atttattgagagggaggggaat

SEQ ID NO: 9385614 - DNA, 22 bp, Homo sapiens
atttattgagcctttcctatgt

SEQ ID NO: 9385615 - DNA, 22 bp, Homo sapiens
atttattgagcctttcctatgt

SEQ ID NO: 9385616 - DNA, 22 bp, Homo sapiens
atttattatgggatttggcaca

SEQ ID NO: 9385617 - DNA, 22 bp, Homo sapiens
atttattatgggatttggcaca

SEQ ID NO: 9385618 - DNA, 22 bp, Homo sapiens
atttattgagacttaacaaccc

SEQ ID NO: 9385619 - DNA, 22 bp, Homo sapiens
atttattatgggatttggctca

SEQ ID NO: 9385620 - DNA, 22 bp, Homo sapiens
atttattgagacttaacaaccc

SEQ ID NO: 9385621 - DNA, 22 bp, Homo sapiens
atttattgagacttaacaaccc

SEQ ID NO: 9385622 - DNA, 22 bp, Homo sapiens
gccaggcattctagaagtagtg

SEQ ID NO: 9385623 - DNA, 22 bp, Homo sapiens
atttattggtttgcatggtgaa

SEQ ID NO: 9385624 - DNA, 22 bp, Homo sapiens
gccaggcattctagaagtagtg

SEQ ID NO: 9385625 - DNA, 22 bp, Homo sapiens
gccaggcatttattgattgaat

SEQ ID NO: 9385626 - DNA, 22 bp, Homo sapiens
gccaggccactcccgggtcctg

SEQ ID NO: 9385627 - DNA, 22 bp, Homo sapiens
gccaggcatttgttaggtgctg

SEQ ID NO: 9385628 - DNA, 22 bp, Homo sapiens
gccaggcatttgttaggtgctg

SEQ ID NO: 9385629 - DNA, 22 bp, Homo sapiens
atttattgagcctttcctatgt

SEQ ID NO: 9385630 - DNA, 22 bp, Homo sapiens
atttattggatgcttacttggg

SEQ ID NO: 9385631 - DNA, 22 bp, Homo sapiens
atttattggatgcttacttggg

SEQ ID NO: 9385632 - DNA, 22 bp, Homo sapiens
atttattggtttgcatggtgaa

SEQ ID NO: 9385633 - DNA, 22 bp, Homo sapiens
atttattggatgcttacttggg

SEQ ID NO: 9385634 - DNA, 22 bp, Homo sapiens
atttattggatgcttacttggg

SEQ ID NO: 9385635 - DNA, 22 bp, Homo sapiens
gccaggccctgggcacttcgtg

SEQ ID NO: 9385636 - DNA, 22 bp, Homo sapiens
gccaggccactcccgggtcctg

SEQ ID NO: 9385637 - DNA, 22 bp, Homo sapiens
gccaggccactcccgggtcctg

SEQ ID NO: 9385638 - DNA, 22 bp, Homo sapiens
gccaggcctgcaagtgctggtg

SEQ ID NO: 9385639 - DNA, 22 bp, Homo sapiens
gccaggcctgcaagtgctggtg

SEQ ID NO: 9385640 - DNA, 22 bp, Homo sapiens
gccaggcctgcaagtgctggtg

SEQ ID NO: 9385641 - DNA, 22 bp, Homo sapiens
gccaggccctgggcacttcgtg

SEQ ID NO: 9385642 - DNA, 22 bp, Homo sapiens
gccaggccctgggcacttcgtg

SEQ ID NO: 9385643 - DNA, 19 bp, Homo sapiens
gccaggcctggacctgcag

SEQ ID NO: 9385644 - DNA, 22 bp, Homo sapiens
atttcacaaaccatcctgattt

SEQ ID NO: 9385645 - DNA, 22 bp, Homo sapiens
atttcacaaaccatcctgattt

SEQ ID NO: 9385646 - DNA, 22 bp, Homo sapiens
gccaggcctgcaagtgctggtg

SEQ ID NO: 9385647 - DNA, 22 bp, Homo sapiens
gccaggcctgcaagtgctggtg

SEQ ID NO: 9385648 - DNA, 19 bp, Homo sapiens
gccaggcctggacctgcag

SEQ ID NO: 9385649 - DNA, 19 bp, Homo sapiens
gccaggcctggacctgcag

SEQ ID NO: 9385650 - DNA, 22 bp, Homo sapiens
atttcagaatgtcctaatttag

SEQ ID NO: 9385651 - DNA, 21 bp, Homo sapiens
atttcagagcacacaagtaaa

SEQ ID NO: 9385652 - DNA, 22 bp, Homo sapiens
atttactaatgtcatatcgcgt

SEQ ID NO: 9385653 - DNA, 22 bp, Homo sapiens
atttactactgctatctagaag

SEQ ID NO: 9385654 - DNA, 22 bp, Homo sapiens
atttactagggctgtttaagta

SEQ ID NO: 9385655 - DNA, 22 bp, Homo sapiens
atttactagggctgtttaagta

SEQ ID NO: 9385656 - DNA, 22 bp, Homo sapiens
atttactactgctatctagaag

SEQ ID NO: 9385657 - DNA, 22 bp, Homo sapiens
gccaggagtgtgtggctatgtt

SEQ ID NO: 9385658 - DNA, 22 bp, Homo sapiens
gccaggagtgtgtggctatgtt

SEQ ID NO: 9385659 - DNA, 22 bp, Homo sapiens
gccaggagtgtcccactcattt

SEQ ID NO: 9385660 - DNA, 20 bp, Homo sapiens
gccaggagggtgtgatgagc

SEQ ID NO: 9385661 - DNA, 22 bp, Homo sapiens
atttagaagctaatttttcaga

SEQ ID NO: 9385662 - DNA, 22 bp, Homo sapiens
atttagaactttgtttgccaat

SEQ ID NO: 9385663 - DNA, 22 bp, Homo sapiens
atttagaactttgtttgccaat

SEQ ID NO: 9385664 - DNA, 22 bp, Homo sapiens
atttagaactttgtttgccaat

SEQ ID NO: 9385665 - DNA, 22 bp, Homo sapiens
atttactgaggtaaataaactg

SEQ ID NO: 9385666 - DNA, 22 bp, Homo sapiens
atttactgaggtaaataaactg

SEQ ID NO: 9385667 - DNA, 19 bp, Homo sapiens
atttactgcctaaaatctc

SEQ ID NO: 9385668 - DNA, 21 bp, Homo sapiens
atttacaaaacagtcccttcc

SEQ ID NO: 9385669 - DNA, 21 bp, Homo sapiens
atttacaaaacagtcccttcc

SEQ ID NO: 9385670 - DNA, 22 bp, Homo sapiens
atttacacattcataagatttc

SEQ ID NO: 9385671 - DNA, 22 bp, Homo sapiens
atttacacattcataagatttc

SEQ ID NO: 9385672 - DNA, 22 bp, Homo sapiens
atttacacattcataagatttc

SEQ ID NO: 9385673 - DNA, 22 bp, Homo sapiens
atttacacattcataagatttc

SEQ ID NO: 9385674 - DNA, 22 bp, Homo sapiens
atttacaccttcttcgattctc

SEQ ID NO: 9385675 - DNA, 22 bp, Homo sapiens
atttacactaaaggaaggagga

SEQ ID NO: 9385676 - DNA, 22 bp, Homo sapiens
atttacaccttcttcgattctc

SEQ ID NO: 9385677 - DNA, 22 bp, Homo sapiens
atttacactggttctcagagct

SEQ ID NO: 9385678 - DNA, 22 bp, Homo sapiens
atttacactggttctcagagct

SEQ ID NO: 9385679 - DNA, 22 bp, Homo sapiens
atttacactggttctcagagct

SEQ ID NO: 9385680 - DNA, 22 bp, Homo sapiens
atttacacttggtttactagag

SEQ ID NO: 9385681 - DNA, 22 bp, Homo sapiens
atttacacttggtttactagag

SEQ ID NO: 9385682 - DNA, 22 bp, Homo sapiens
atttacagaaacttaatcatag

SEQ ID NO: 9385683 - DNA, 22 bp, Homo sapiens
atttacacttggtttactagag

SEQ ID NO: 9385684 - DNA, 22 bp, Homo sapiens
atttacagaaacttaatcatag

SEQ ID NO: 9385685 - DNA, 22 bp, Homo sapiens
atttacagaaacttaatcatag

SEQ ID NO: 9385686 - DNA, 22 bp, Homo sapiens
atttacagaaacttaatcatag

SEQ ID NO: 9385687 - DNA, 22 bp, Homo sapiens
atttacagaagcatgtaatagc

SEQ ID NO: 9385688 - DNA, 22 bp, Homo sapiens
gccaggagggaaaggacaattt

SEQ ID NO: 9385689 - DNA, 22 bp, Homo sapiens
gccaggaggcttaactggacag

SEQ ID NO: 9385690 - DNA, 22 bp, Homo sapiens
gccaggagggaaaggacaattt

SEQ ID NO: 9385691 - DNA, 22 bp, Homo sapiens
atttacagaagcatgtaatagc

SEQ ID NO: 9385692 - DNA, 22 bp, Homo sapiens
atttacagaagcatgtaatagc

SEQ ID NO: 9385693 - DNA, 22 bp, Homo sapiens
gccagctggagtgagagtgggc

SEQ ID NO: 9385694 - DNA, 22 bp, Homo sapiens
atttacagaagcatgtaatagc

SEQ ID NO: 9385695 - DNA, 22 bp, Homo sapiens
atttacagaagcatgtaatagc

SEQ ID NO: 9385696 - DNA, 22 bp, Homo sapiens
gccaggaggcttaactggacag

SEQ ID NO: 9385697 - DNA, 22 bp, Homo sapiens
gccaggaggcttaactggacag

SEQ ID NO: 9385698 - DNA, 22 bp, Homo sapiens
gccagctggagtgagagtgggc

SEQ ID NO: 9385699 - DNA, 22 bp, Homo sapiens
attgcttttgagctagaatttt

SEQ ID NO: 9385700 - DNA, 22 bp, Homo sapiens
attggagccccagaagcaaggt

SEQ ID NO: 9385701 - DNA, 19 bp, Homo sapiens
attggagcagaaaggtggt

SEQ ID NO: 9385702 - DNA, 22 bp, Homo sapiens
attggaagtatttcatcaaaag

SEQ ID NO: 9385703 - DNA, 22 bp, Homo sapiens
attggaaatgctacaagttaga

SEQ ID NO: 9385704 - DNA, 22 bp, Homo sapiens
attggaaatgctacaagttaga

SEQ ID NO: 9385705 - DNA, 22 bp, Homo sapiens
attggaaatacagtagaaaaat

SEQ ID NO: 9385706 - DNA, 22 bp, Homo sapiens
atttaatttacatttgacagag

SEQ ID NO: 9385707 - DNA, 22 bp, Homo sapiens
atttaattgttcttctggctat

SEQ ID NO: 9385708 - DNA, 21 bp, Homo sapiens
attggcacaccttttattgga

SEQ ID NO: 9385709 - DNA, 22 bp, Homo sapiens
atttaaattttctgatggagag

SEQ ID NO: 9385710 - DNA, 22 bp, Homo sapiens
atttaattttctcaacagtgct

SEQ ID NO: 9385711 - DNA, 21 bp, Homo sapiens
atttacaaaacagtcccttcc

SEQ ID NO: 9385712 - DNA, 22 bp, Homo sapiens
atttaattttctcaacagtgct

SEQ ID NO: 9385713 - DNA, 22 bp, Homo sapiens
atttaatttggagagagaaacc

SEQ ID NO: 9385714 - DNA, 22 bp, Homo sapiens
atttaatttatagatgtggata

SEQ ID NO: 9385715 - DNA, 22 bp, Homo sapiens
atttaatttacatttgacagag

SEQ ID NO: 9385716 - DNA, 22 bp, Homo sapiens
atttaatttgtgtctttagctg

SEQ ID NO: 9385717 - DNA, 22 bp, Homo sapiens
atttaatttgtgtctttagctg

SEQ ID NO: 9385718 - DNA, 22 bp, Homo sapiens
gcctctcctggagaaggcaggg

SEQ ID NO: 9385719 - DNA, 22 bp, Homo sapiens
gcctctctccttggcttgcagt

SEQ ID NO: 9385720 - DNA, 22 bp, Homo sapiens
gcctctctccttggcttgcagt

SEQ ID NO: 9385721 - DNA, 22 bp, Homo sapiens
gcctctccgagccactgcctct

SEQ ID NO: 9385722 - DNA, 22 bp, Homo sapiens
gcctctcctcttaataccatta

SEQ ID NO: 9385723 - DNA, 22 bp, Homo sapiens
gcctctccgagccactgcctct

SEQ ID NO: 9385724 - DNA, 21 bp, Homo sapiens
gcctctccaaatcctgccttc

SEQ ID NO: 9385725 - DNA, 22 bp, Homo sapiens
gcctccatgtgtcctgagtcgc

SEQ ID NO: 9385726 - DNA, 22 bp, Homo sapiens
gcctccattgaaagctgtctat

SEQ ID NO: 9385727 - DNA, 22 bp, Homo sapiens
gcctccagtttttttctgaact

SEQ ID NO: 9385728 - DNA, 22 bp, Homo sapiens
gcctccagggtagaggaggaag

SEQ ID NO: 9385729 - DNA, 22 bp, Homo sapiens
gcctccagggatgattccttcc

SEQ ID NO: 9385730 - DNA, 22 bp, Homo sapiens
gcctccagggtagaggaggaag

SEQ ID NO: 9385731 - DNA, 22 bp, Homo sapiens
gcctccagcccacgcaggcctg

SEQ ID NO: 9385732 - DNA, 22 bp, Homo sapiens
gcctccagctggggcatttcag

SEQ ID NO: 9385733 - DNA, 22 bp, Homo sapiens
gcctccccaagcagcagggatt

SEQ ID NO: 9385734 - DNA, 22 bp, Homo sapiens
atttctcactcacagtccatgt

SEQ ID NO: 9385735 - DNA, 22 bp, Homo sapiens
atttctcacaaagttgcttatc

SEQ ID NO: 9385736 - DNA, 22 bp, Homo sapiens
atttctcaaaggaatagagtga

SEQ ID NO: 9385737 - DNA, 22 bp, Homo sapiens
atttctcagtgtacattatgtt

SEQ ID NO: 9385738 - DNA, 22 bp, Homo sapiens
atttctcagtgaaatgacaggc

SEQ ID NO: 9385739 - DNA, 22 bp, Homo sapiens
atttctcagtgaaatgacaggc

SEQ ID NO: 9385740 - DNA, 22 bp, Homo sapiens
atttctcagtaatctcagcaat

SEQ ID NO: 9385741 - DNA, 21 bp, Homo sapiens
gcctcaccatgtcaagccagg

SEQ ID NO: 9385742 - DNA, 22 bp, Homo sapiens
gcctcagaaagcttttattcat

SEQ ID NO: 9385743 - DNA, 22 bp, Homo sapiens
gcctccacttttgctggcttct

SEQ ID NO: 9385744 - DNA, 22 bp, Homo sapiens
gcctccacttttgctggcttct

SEQ ID NO: 9385745 - DNA, 21 bp, Homo sapiens
gcctccagccagatggcctcc

SEQ ID NO: 9385746 - DNA, 21 bp, Homo sapiens
gcctccagccagatggcctcc

SEQ ID NO: 9385747 - DNA, 22 bp, Homo sapiens
gcctccagcccacgcaggcctg

SEQ ID NO: 9385748 - DNA, 21 bp, Homo sapiens
gcctccagccagatggcctcc

SEQ ID NO: 9385749 - DNA, 22 bp, Homo sapiens
gcctccagcccacgcaggcctg

SEQ ID NO: 9385750 - DNA, 22 bp, Homo sapiens
gcctccagcccacgcaggcctg

SEQ ID NO: 9385751 - DNA, 22 bp, Homo sapiens
gcctggagctctccacttgggg

SEQ ID NO: 9385752 - DNA, 22 bp, Homo sapiens
gcctggagctctccacttgggg

SEQ ID NO: 9385753 - DNA, 22 bp, Homo sapiens
gcctggagctctccacttgggg

SEQ ID NO: 9385754 - DNA, 22 bp, Homo sapiens
gcctgggagcacatcggggtcc

SEQ ID NO: 9385755 - DNA, 22 bp, Homo sapiens
gcctgggagcacatcggggtcc

SEQ ID NO: 9385756 - DNA, 22 bp, Homo sapiens
gcctggagctctccacttgggg

SEQ ID NO: 9385757 - DNA, 22 bp, Homo sapiens
gcctggagctcggctgagggcg

SEQ ID NO: 9385758 - DNA, 22 bp, Homo sapiens
gcctggagctcggctgagggcg

SEQ ID NO: 9385759 - DNA, 22 bp, Homo sapiens
gcctggagctcggctgagggcg

SEQ ID NO: 9385760 - DNA, 22 bp, Homo sapiens
gcctggagctcggctgagggcg

SEQ ID NO: 9385761 - DNA, 22 bp, Homo sapiens
gcctggagctcatgtgggcatt

SEQ ID NO: 9385762 - DNA, 22 bp, Homo sapiens
gcctggagctcatgtgggcatt

SEQ ID NO: 9385763 - DNA, 22 bp, Homo sapiens
gcctggagctcatgtgggcatt

SEQ ID NO: 9385764 - DNA, 22 bp, Homo sapiens
gcctggagctcatgtgggcatt

SEQ ID NO: 9385765 - DNA, 22 bp, Homo sapiens
gcctggagctactggacactga

SEQ ID NO: 9385766 - DNA, 22 bp, Homo sapiens
gcctggagctactggacactga

SEQ ID NO: 9385767 - DNA, 22 bp, Homo sapiens
gcctggagctactggacactga

SEQ ID NO: 9385768 - DNA, 22 bp, Homo sapiens
gcctggagctcatgtgggcatt

SEQ ID NO: 9385769 - DNA, 22 bp, Homo sapiens
gcctgctgccaccctggctccg

SEQ ID NO: 9385770 - DNA, 22 bp, Homo sapiens
gcctgctgccaccctggctccg

SEQ ID NO: 9385771 - DNA, 22 bp, Homo sapiens
gcctgctgccaccctggctccg

SEQ ID NO: 9385772 - DNA, 22 bp, Homo sapiens
gcctgctggatgtggccaggcc

SEQ ID NO: 9385773 - DNA, 22 bp, Homo sapiens
gcctgctggatgtggccaggcc

SEQ ID NO: 9385774 - DNA, 22 bp, Homo sapiens
gcctgctgaacctcatgcagtc

SEQ ID NO: 9385775 - DNA, 22 bp, Homo sapiens
gcctgctgaacctcatgcagtc

SEQ ID NO: 9385776 - DNA, 22 bp, Homo sapiens
gcctctctctacccagtatgat

SEQ ID NO: 9385777 - DNA, 22 bp, Homo sapiens
gcctctctgggctgccgaggct

SEQ ID NO: 9385778 - DNA, 22 bp, Homo sapiens
gcctctctgggctgccgaggct

SEQ ID NO: 9385779 - DNA, 22 bp, Homo sapiens
gcctgtctacactttctctgca

SEQ ID NO: 9385780 - DNA, 22 bp, Homo sapiens
gcctgtccttgtgaggtcccag

SEQ ID NO: 9385781 - DNA, 22 bp, Homo sapiens
gcctgtgactcgtcttgggcca

SEQ ID NO: 9385782 - DNA, 23 bp, Homo sapiens
gcctgtgcctatgcccagctctg

SEQ ID NO: 9385783 - DNA, 22 bp, Homo sapiens
gcctgtccccaggagagtccgg

SEQ ID NO: 9385784 - DNA, 22 bp, Homo sapiens
gcctgggagggcagcagtgtgg

SEQ ID NO: 9385785 - DNA, 22 bp, Homo sapiens
gcctgggagtgcacagtgaggt

SEQ ID NO: 9385786 - DNA, 22 bp, Homo sapiens
gcctgggagtgcacagtgaggt

SEQ ID NO: 9385787 - DNA, 22 bp, Homo sapiens
gcctgggagggcagcagtgtgg

SEQ ID NO: 9385788 - DNA, 18 bp, Homo sapiens
gcctgggaggaggaaatg

SEQ ID NO: 9385789 - DNA, 22 bp, Homo sapiens
gcctgggagggcagcagtgtgg

SEQ ID NO: 9385790 - DNA, 22 bp, Homo sapiens
caaaacattcagagagctcact

SEQ ID NO: 9385791 - DNA, 19 bp, Homo sapiens
gcgaggaagtcactgtggt

SEQ ID NO: 9385792 - DNA, 19 bp, Homo sapiens
gcgaggaagtcactgtggc

SEQ ID NO: 9385793 - DNA, 22 bp, Homo sapiens
gcgagcctctggagtcctctgg

SEQ ID NO: 9385794 - DNA, 21 bp, Homo sapiens
caaaacttaggtgacttagga

SEQ ID NO: 9385795 - DNA, 22 bp, Homo sapiens
caaaaagcttaggtaacaagcc

SEQ ID NO: 9385796 - DNA, 22 bp, Homo sapiens
caaaaactgcaattacttttac

SEQ ID NO: 9385797 - DNA, 22 bp, Homo sapiens
caaaaagcttaggtaacaagcc

SEQ ID NO: 9385798 - DNA, 22 bp, Homo sapiens
caaaaaacacagatgtctgtgt

SEQ ID NO: 9385799 - DNA, 22 bp, Homo sapiens
attttttagaacctggcctgat

SEQ ID NO: 9385800 - DNA, 22 bp, Homo sapiens
attttttagaacctggcctgat

SEQ ID NO: 9385801 - DNA, 22 bp, Homo sapiens
caaactgaacacgaaagtcttt

SEQ ID NO: 9385802 - DNA, 22 bp, Homo sapiens
caaactgagcatcagaaagttt

SEQ ID NO: 9385803 - DNA, 22 bp, Homo sapiens
caaactatttacaatggaatca

SEQ ID NO: 9385804 - DNA, 22 bp, Homo sapiens
caaaccatgacatgaagcgtga

SEQ ID NO: 9385805 - DNA, 22 bp, Homo sapiens
caaaccattaagcatgttgagt

SEQ ID NO: 9385806 - DNA, 23 bp, Homo sapiens
caaacctgttctccccacatgca

SEQ ID NO: 9385807 - DNA, 22 bp, Homo sapiens
caaacctgttagaggtcatcgt

SEQ ID NO: 9385808 - DNA, 22 bp, Homo sapiens
gcgagggcacgcggttgaaggc

SEQ ID NO: 9385809 - DNA, 22 bp, Homo sapiens
gcgagtgccgagagggcagggc

SEQ ID NO: 9385810 - DNA, 22 bp, Homo sapiens
gcgagggcacgcggttgaaggc

SEQ ID NO: 9385811 - DNA, 22 bp, Homo sapiens
gcgagggcacgcggttgaaggc

SEQ ID NO: 9385812 - DNA, 22 bp, Homo sapiens
gcgaggaggggtgctgggcccc

SEQ ID NO: 9385813 - DNA, 22 bp, Homo sapiens
gcgaggctgggccctgcaggcg

SEQ ID NO: 9385814 - DNA, 22 bp, Homo sapiens
gcgcacatgttcagatgtgtga

SEQ ID NO: 9385815 - DNA, 22 bp, Homo sapiens
gcgcagctttgtaaagatctgg

SEQ ID NO: 9385816 - DNA, 22 bp, Homo sapiens
caaacattccgcttctcccagg

SEQ ID NO: 9385817 - DNA, 22 bp, Homo sapiens
gctcaggagctgacagcctcaa

SEQ ID NO: 9385818 - DNA, 22 bp, Homo sapiens
gctcaggagctgacagcctcaa

SEQ ID NO: 9385819 - DNA, 22 bp, Homo sapiens
gctcaggatcagccacctcttt

SEQ ID NO: 9385820 - DNA, 22 bp, Homo sapiens
gctcaggagctgacagcctcaa

SEQ ID NO: 9385821 - DNA, 22 bp, Homo sapiens
gctcaggcaaatttctggtgaa

SEQ ID NO: 9385822 - DNA, 22 bp, Homo sapiens
caaaggcacacatacctttctg

SEQ ID NO: 9385823 - DNA, 22 bp, Homo sapiens
caaaggcacacatacctttctg

SEQ ID NO: 9385824 - DNA, 22 bp, Homo sapiens
gctcaggcaggagtgcagtggc

SEQ ID NO: 9385825 - DNA, 22 bp, Homo sapiens
gctcaggcaggagtgcagtggc

SEQ ID NO: 9385826 - DNA, 22 bp, Homo sapiens
gctcaggcaggagtgcagtggc

SEQ ID NO: 9385827 - DNA, 22 bp, Homo sapiens
gctcaggcaccatatgatgtgt

SEQ ID NO: 9385828 - DNA, 22 bp, Homo sapiens
gctcaggcaaatttctggtgaa

SEQ ID NO: 9385829 - DNA, 22 bp, Homo sapiens
gctcaggcaccatatgatgtgt

SEQ ID NO: 9385830 - DNA, 22 bp, Homo sapiens
caaactttcagttataacatga

SEQ ID NO: 9385831 - DNA, 22 bp, Homo sapiens
gctcaggaaacagcagggcttg

SEQ ID NO: 9385832 - DNA, 22 bp, Homo sapiens
gctcaggaaaacagtctagtaa

SEQ ID NO: 9385833 - DNA, 22 bp, Homo sapiens
gctcaggaccgaggggtgggaa

SEQ ID NO: 9385834 - DNA, 22 bp, Homo sapiens
gctcaggaaggctcaaccagga

SEQ ID NO: 9385835 - DNA, 22 bp, Homo sapiens
attcagtgtcttgatctgggaa

SEQ ID NO: 9385836 - DNA, 22 bp, Homo sapiens
attcagtgtggacccatttaaa

SEQ ID NO: 9385837 - DNA, 22 bp, Homo sapiens
attcagtgtgaggttttcaagt

SEQ ID NO: 9385838 - DNA, 22 bp, Homo sapiens
attcagtgtttgcagcaacttt

SEQ ID NO: 9385839 - DNA, 22 bp, Homo sapiens
attcagtgtagttattatcttt

SEQ ID NO: 9385840 - DNA, 19 bp, Homo sapiens
attcagtgtctctgacttc

SEQ ID NO: 9385841 - DNA, 22 bp, Homo sapiens
attcagtgtatcaatgaatgct

SEQ ID NO: 9385842 - DNA, 22 bp, Homo sapiens
attcagtgtctactccattgcc

SEQ ID NO: 9385843 - DNA, 21 bp, Homo sapiens
gcagagctggaaccaggaccc

SEQ ID NO: 9385844 - DNA, 23 bp, Homo sapiens
gcagagctgccctattgccttgg

SEQ ID NO: 9385845 - DNA, 22 bp, Homo sapiens
gcagagctgggtctgtatccaa

SEQ ID NO: 9385846 - DNA, 21 bp, Homo sapiens
gcagagctggaaccaggaccc

SEQ ID NO: 9385847 - DNA, 22 bp, Homo sapiens
gcagagctgttaatggagctga

SEQ ID NO: 9385848 - DNA, 22 bp, Homo sapiens
gcagagctggtacttgagcctg

SEQ ID NO: 9385849 - DNA, 22 bp, Homo sapiens
gcagagctgtctaagtcacttc

SEQ ID NO: 9385850 - DNA, 22 bp, Homo sapiens
gcagagctgtctaagtcacttc

SEQ ID NO: 9385851 - DNA, 22 bp, Homo sapiens
attatttagaaatcgattgaaa

SEQ ID NO: 9385852 - DNA, 22 bp, Homo sapiens
attatttatcctcttggtctat

SEQ ID NO: 9385853 - DNA, 22 bp, Homo sapiens
attatttatcctcttggtctat

SEQ ID NO: 9385854 - DNA, 21 bp, Homo sapiens
attcagagtaattcatcttta

SEQ ID NO: 9385855 - DNA, 22 bp, Homo sapiens
attatttcagtcagacactggc

SEQ ID NO: 9385856 - DNA, 22 bp, Homo sapiens
attatttcagtcagacactggc

SEQ ID NO: 9385857 - DNA, 22 bp, Homo sapiens
attcagtgctgtaatacgctaa

SEQ ID NO: 9385858 - DNA, 22 bp, Homo sapiens
attcagtgccaaggagaacttg

SEQ ID NO: 9385859 - DNA, 22 bp, Homo sapiens
attcagtggatatcttcacttt

SEQ ID NO: 9385860 - DNA, 22 bp, Homo sapiens
attcagtggatatcttcacttt

SEQ ID NO: 9385861 - DNA, 22 bp, Homo sapiens
attcagtgggtgctcagcacaa

SEQ ID NO: 9385862 - DNA, 22 bp, Homo sapiens
attcagtattcttgaaaggttc

SEQ ID NO: 9385863 - DNA, 22 bp, Homo sapiens
attcagtgagtgtttaccggaa

SEQ ID NO: 9385864 - DNA, 22 bp, Homo sapiens
attcagtgattcatttgtacaa

SEQ ID NO: 9385865 - DNA, 22 bp, Homo sapiens
attcagtgacctaattacttac

SEQ ID NO: 9385866 - DNA, 22 bp, Homo sapiens
attattgctgacatggtgttga

SEQ ID NO: 9385867 - DNA, 22 bp, Homo sapiens
attattggacacttcttctgca

SEQ ID NO: 9385868 - DNA, 22 bp, Homo sapiens
attattggtacaccgtagtcat

SEQ ID NO: 9385869 - DNA, 22 bp, Homo sapiens
attattgtactttcaataaggt

SEQ ID NO: 9385870 - DNA, 22 bp, Homo sapiens
attattgtactttcaataaggt

SEQ ID NO: 9385871 - DNA, 22 bp, Homo sapiens
attattgtcatcttaatcttaa

SEQ ID NO: 9385872 - DNA, 22 bp, Homo sapiens
attattgtactttcaataaggt

SEQ ID NO: 9385873 - DNA, 22 bp, Homo sapiens
attattgttgcggctgttaccg

SEQ ID NO: 9385874 - DNA, 22 bp, Homo sapiens
attattgttagtgacagggtga

SEQ ID NO: 9385875 - DNA, 22 bp, Homo sapiens
attattgttttaatagtagaga

SEQ ID NO: 9385876 - DNA, 22 bp, Homo sapiens
attattgttttaatagtagaga

SEQ ID NO: 9385877 - DNA, 22 bp, Homo sapiens
attattgttttaatagtagaga

SEQ ID NO: 9385878 - DNA, 22 bp, Homo sapiens
attatttacagtgtgctcgaag

SEQ ID NO: 9385879 - DNA, 22 bp, Homo sapiens
attctacatttggagtgatgtc

SEQ ID NO: 9385880 - DNA, 22 bp, Homo sapiens
attctactcattgatctatata

SEQ ID NO: 9385881 - DNA, 22 bp, Homo sapiens
attctacatttggagtgatgtc

SEQ ID NO: 9385882 - DNA, 22 bp, Homo sapiens
attctagaaggcaaagcaaggg

SEQ ID NO: 9385883 - DNA, 22 bp, Homo sapiens
attctacacctctctcatttag

SEQ ID NO: 9385884 - DNA, 22 bp, Homo sapiens
attctacacaacatgatgatgg

SEQ ID NO: 9385885 - DNA, 22 bp, Homo sapiens
attctacacaacatgatgatgg

SEQ ID NO: 9385886 - DNA, 22 bp, Homo sapiens
attctacacaacatgatgatgg

SEQ ID NO: 9385887 - DNA, 22 bp, Homo sapiens
attctacatgatagaagggaga

SEQ ID NO: 9385888 - DNA, 22 bp, Homo sapiens
attctacatgatagaagggaga

SEQ ID NO: 9385889 - DNA, 22 bp, Homo sapiens
attctacagggtacgttgggga

SEQ ID NO: 9385890 - DNA, 22 bp, Homo sapiens
attctacacctctctcatttag

SEQ ID NO: 9385891 - DNA, 22 bp, Homo sapiens
attctacagatgaaagcggctg

SEQ ID NO: 9385892 - DNA, 22 bp, Homo sapiens
attctacaggactggcaatccc

SEQ ID NO: 9385893 - DNA, 22 bp, Homo sapiens
gcagcagggagcaggggtgtca

SEQ ID NO: 9385894 - DNA, 22 bp, Homo sapiens
gcagcagggagcaggggtgtca

SEQ ID NO: 9385895 - DNA, 22 bp, Homo sapiens
gcagcaggcttttcataccttg

SEQ ID NO: 9385896 - DNA, 22 bp, Homo sapiens
gcagcagggagcaggggtgtca

SEQ ID NO: 9385897 - DNA, 22 bp, Homo sapiens
gcagcagggagcaggggtgtca

SEQ ID NO: 9385898 - DNA, 22 bp, Homo sapiens
gcagcagggtgccagctttgca

SEQ ID NO: 9385899 - DNA, 22 bp, Homo sapiens
gcagcagggagcaggggtgtca

SEQ ID NO: 9385900 - DNA, 22 bp, Homo sapiens
gcagcaggtccgcatcatcatc

SEQ ID NO: 9385901 - DNA, 22 bp, Homo sapiens
gcagcagggtgccagctttgca

SEQ ID NO: 9385902 - DNA, 22 bp, Homo sapiens
gcagcagggtgccagctttgca

SEQ ID NO: 9385903 - DNA, 22 bp, Homo sapiens
attctacacaaagcaagaagac

SEQ ID NO: 9385904 - DNA, 22 bp, Homo sapiens
attctacacaaagcaagaagac

SEQ ID NO: 9385905 - DNA, 22 bp, Homo sapiens
attctacaatcatgtagatcct

SEQ ID NO: 9385906 - DNA, 22 bp, Homo sapiens
attcctggtggcagaaacatga

SEQ ID NO: 9385907 - DNA, 22 bp, Homo sapiens
gcagcaggcttttcataccttg

SEQ ID NO: 9385908 - DNA, 22 bp, Homo sapiens
gcagcaggcttttcataccttg

SEQ ID NO: 9385909 - DNA, 22 bp, Homo sapiens
gcagcaggcatggccgccctgg

SEQ ID NO: 9385910 - DNA, 22 bp, Homo sapiens
gcagcaggcatggccgccctgg

SEQ ID NO: 9385911 - DNA, 22 bp, Homo sapiens
gcagcaggcatggccgccctgg

SEQ ID NO: 9385912 - DNA, 22 bp, Homo sapiens
gcagcaggcacttaccgttgct

SEQ ID NO: 9385913 - DNA, 22 bp, Homo sapiens
attccttctattctctgtgggt

SEQ ID NO: 9385914 - DNA, 22 bp, Homo sapiens
gcagcaggcacttaccgttgct

SEQ ID NO: 9385915 - DNA, 22 bp, Homo sapiens
attccttctattctctgtgggt

SEQ ID NO: 9385916 - DNA, 22 bp, Homo sapiens
attccttctaaaacgctgccct

SEQ ID NO: 9385917 - DNA, 22 bp, Homo sapiens
gcagagcttctgtccttcagga

SEQ ID NO: 9385918 - DNA, 22 bp, Homo sapiens
gcagagcttctgtccttcagga

SEQ ID NO: 9385919 - DNA, 22 bp, Homo sapiens
attcctaaagtaatacactaga

SEQ ID NO: 9385920 - DNA, 21 bp, Homo sapiens
attccacttttccttcaggga

SEQ ID NO: 9385921 - DNA, 22 bp, Homo sapiens
attccactttatgtctgtatga

SEQ ID NO: 9385922 - DNA, 22 bp, Homo sapiens
attccactttgctaatcttctg

SEQ ID NO: 9385923 - DNA, 22 bp, Homo sapiens
attcctaaggaaggctggcaag

SEQ ID NO: 9385924 - DNA, 22 bp, Homo sapiens
attcctcatttgttgagaacca

SEQ ID NO: 9385925 - DNA, 22 bp, Homo sapiens
attctagtgtttccattacaag

SEQ ID NO: 9385926 - DNA, 22 bp, Homo sapiens
attctagacatctgcagttgtt

SEQ ID NO: 9385927 - DNA, 22 bp, Homo sapiens
attctattttttaagaagtagt

SEQ ID NO: 9385928 - DNA, 22 bp, Homo sapiens
attctattttttaagaagtagt

SEQ ID NO: 9385929 - DNA, 22 bp, Homo sapiens
attctcaaaacataacttcact

SEQ ID NO: 9385930 - DNA, 22 bp, Homo sapiens
attctagtgtttccattacaag

SEQ ID NO: 9385931 - DNA, 22 bp, Homo sapiens
attctggaagcaagcttttaaa

SEQ ID NO: 9385932 - DNA, 22 bp, Homo sapiens
attctggaagcaagcttttaaa

SEQ ID NO: 9385933 - DNA, 22 bp, Homo sapiens
attctggaattctaagattctg

SEQ ID NO: 9385934 - DNA, 22 bp, Homo sapiens
attctggaattctaagattctg

SEQ ID NO: 9385935 - DNA, 22 bp, Homo sapiens
attctggaagcaagcttttaaa

SEQ ID NO: 9385936 - DNA, 22 bp, Homo sapiens
attctgtgatagttgatcctta

SEQ ID NO: 9385937 - DNA, 22 bp, Homo sapiens
attctcaaagccagagtcaacg

SEQ ID NO: 9385938 - DNA, 22 bp, Homo sapiens
attctcaagctggctgggagca

SEQ ID NO: 9385939 - DNA, 22 bp, Homo sapiens
attctcaactactgcgagagct

SEQ ID NO: 9385940 - DNA, 22 bp, Homo sapiens
attcttcactgtttcagaatga

SEQ ID NO: 9385941 - DNA, 22 bp, Homo sapiens
attcttcacataagtgctgtac

SEQ ID NO: 9385942 - DNA, 22 bp, Homo sapiens
attcttcacaaatatatagaag

SEQ ID NO: 9385943 - DNA, 22 bp, Homo sapiens
attcttcaaagagtgtcaaagt

SEQ ID NO: 9385944 - DNA, 22 bp, Homo sapiens
attcttaattccaaagactgag

SEQ ID NO: 9385945 - DNA, 22 bp, Homo sapiens
attcttaattccaaagactgag

SEQ ID NO: 9385946 - DNA, 22 bp, Homo sapiens
attcttattatagtaaaacagt

SEQ ID NO: 9385947 - DNA, 22 bp, Homo sapiens
attgacaagcagtatgtcttag

SEQ ID NO: 9385948 - DNA, 22 bp, Homo sapiens
attgacaagtgagctgggctgc

SEQ ID NO: 9385949 - DNA, 22 bp, Homo sapiens
attgacaatctactatgttctg

SEQ ID NO: 9385950 - DNA, 22 bp, Homo sapiens
attgacaaatggatgttgacat

SEQ ID NO: 9385951 - DNA, 22 bp, Homo sapiens
attgacaaatggatgttgacat

SEQ ID NO: 9385952 - DNA, 22 bp, Homo sapiens
attgacaaccctggtatgagca

SEQ ID NO: 9385953 - DNA, 22 bp, Homo sapiens
attgacaagaaagatattttta

SEQ ID NO: 9385954 - DNA, 22 bp, Homo sapiens
attgacaagacaatggctctta

SEQ ID NO: 9385955 - DNA, 22 bp, Homo sapiens
attgacaagaaagatattttta

SEQ ID NO: 9385956 - DNA, 22 bp, Homo sapiens
attgacagcaggggctgtcact

SEQ ID NO: 9385957 - DNA, 20 bp, Homo sapiens
attgacagaaagtgttcacc

SEQ ID NO: 9385958 - DNA, 22 bp, Homo sapiens
attgacacacttccaggaccag

SEQ ID NO: 9385959 - DNA, 22 bp, Homo sapiens
attgacaattctatgcagagca

SEQ ID NO: 9385960 - DNA, 22 bp, Homo sapiens
attgacaatgtatttgtatctg

SEQ ID NO: 9385961 - DNA, 22 bp, Homo sapiens
attgacaatgtatttgtatctg

SEQ ID NO: 9385962 - DNA, 22 bp, Homo sapiens
attgctgtggaaatataagatg

SEQ ID NO: 9385963 - DNA, 22 bp, Homo sapiens
attgctgtgatgatgttctgag

SEQ ID NO: 9385964 - DNA, 22 bp, Homo sapiens
attgctgtacacttctagatct

SEQ ID NO: 9385965 - DNA, 22 bp, Homo sapiens
attgctgtaaattatcttatta

SEQ ID NO: 9385966 - DNA, 22 bp, Homo sapiens
attgctggatgagctcttggat

SEQ ID NO: 9385967 - DNA, 22 bp, Homo sapiens
attgctggcagctggatctgca

SEQ ID NO: 9385968 - DNA, 22 bp, Homo sapiens
attgctggcagctggatctgca

SEQ ID NO: 9385969 - DNA, 22 bp, Homo sapiens
attgcacttcagcctgggtgac

SEQ ID NO: 9385970 - DNA, 22 bp, Homo sapiens
attgacagtggtgttctgggga

SEQ ID NO: 9385971 - DNA, 22 bp, Homo sapiens
attcttcagcaggggacactat

SEQ ID NO: 9385972 - DNA, 22 bp, Homo sapiens
attgaaaaatgactattgctta

SEQ ID NO: 9385973 - DNA, 22 bp, Homo sapiens
attcttcagaatatctggcact

SEQ ID NO: 9385974 - DNA, 22 bp, Homo sapiens
attgaacagaaaaactcagaga

SEQ ID NO: 9385975 - DNA, 22 bp, Homo sapiens
attgaacagaaaccatcagagt

SEQ ID NO: 9385976 - DNA, 22 bp, Homo sapiens
attgaacagcccaggtttacct

SEQ ID NO: 9385977 - DNA, 23 bp, Homo sapiens
attgaacagagagaaaaacatcc

SEQ ID NO: 9385978 - DNA, 22 bp, Homo sapiens
attgaacatacatatccacacc

SEQ ID NO: 9385979 - DNA, 22 bp, Homo sapiens
attgaacattgttctaggaggc

SEQ ID NO: 9385980 - DNA, 22 bp, Homo sapiens
attgacaaaaacaggtggttga

SEQ ID NO: 9385981 - DNA, 22 bp, Homo sapiens
attgaatgtctactatgtgcaa

SEQ ID NO: 9385982 - DNA, 22 bp, Homo sapiens
attgacaaaaacaggtggttga

SEQ ID NO: 9385983 - DNA, 22 bp, Homo sapiens
attgaatgtcctttagtaaaaa

SEQ ID NO: 9385984 - DNA, 22 bp, Homo sapiens
attgaatagatgcattatacta

SEQ ID NO: 9385985 - DNA, 22 bp, Homo sapiens
attgaatagatgcattatacta

SEQ ID NO: 9385986 - DNA, 22 bp, Homo sapiens
attattcttgaggtgtttattg

SEQ ID NO: 9385987 - DNA, 22 bp, Homo sapiens
attattcttatgtcatcatggc

SEQ ID NO: 9385988 - DNA, 22 bp, Homo sapiens
attattcaatgttatttcagtg

SEQ ID NO: 9385989 - DNA, 22 bp, Homo sapiens
attattcaatcatattaaaagt

SEQ ID NO: 9385990 - DNA, 22 bp, Homo sapiens
attagagagagcatattactgg

SEQ ID NO: 9385991 - DNA, 22 bp, Homo sapiens
attagagattatgaattcctag

SEQ ID NO: 9385992 - DNA, 22 bp, Homo sapiens
gcaaggtgttttaacaggaaaa

SEQ ID NO: 9385993 - DNA, 22 bp, Homo sapiens
gcaaggtgttttataggcagga

SEQ ID NO: 9385994 - DNA, 22 bp, Homo sapiens
gcaaggtgttttaacaggaaaa

SEQ ID NO: 9385995 - DNA, 19 bp, Homo sapiens
gcaaggttcactcccagag

SEQ ID NO: 9385996 - DNA, 22 bp, Homo sapiens
gcaagtgagaggcatcattaga

SEQ ID NO: 9385997 - DNA, 22 bp, Homo sapiens
gcaagtgaatgaggttgagatt

SEQ ID NO: 9385998 - DNA, 20 bp, Homo sapiens
gcaagtgaaaactatgggtg

SEQ ID NO: 9385999 - DNA, 22 bp, Homo sapiens
gcaagtgattgtcacgtccctt

SEQ ID NO: 9386000 - DNA, 21 bp, Homo sapiens
gcaagtgtttctgacagtggc

SEQ ID NO: 9386001 - DNA, 23 bp, Homo sapiens
gcaagtgaggcgtcagcagtcaa

SEQ ID NO: 9386002 - DNA, 22 bp, Homo sapiens
gcaagtgatgatggcaacttca

SEQ ID NO: 9386003 - DNA, 23 bp, Homo sapiens
gcaagtgaggcgtcagcagtcaa

SEQ ID NO: 9386004 - DNA, 22 bp, Homo sapiens
gcaagggtgtgaaccaatgaga

SEQ ID NO: 9386005 - DNA, 17 bp, Homo sapiens
gcaagggatgggagatt

SEQ ID NO: 9386006 - DNA, 22 bp, Homo sapiens
attagaattatgcttgctaatg

SEQ ID NO: 9386007 - DNA, 22 bp, Homo sapiens
attagaattatgcttgctaatg

SEQ ID NO: 9386008 - DNA, 22 bp, Homo sapiens
gcaataaaatgtaatgattggg

SEQ ID NO: 9386009 - DNA, 22 bp, Homo sapiens
gcaagttatttccatttaaagc

SEQ ID NO: 9386010 - DNA, 21 bp, Homo sapiens
gcaagtgtttctgacagtggc

SEQ ID NO: 9386011 - DNA, 22 bp, Homo sapiens
attagaatgaagtataggattt

SEQ ID NO: 9386012 - DNA, 22 bp, Homo sapiens
attaatatcctgctggctaaat

SEQ ID NO: 9386013 - DNA, 22 bp, Homo sapiens
attaatatcctgctggctaaat

SEQ ID NO: 9386014 - DNA, 22 bp, Homo sapiens
attaagcacttggggaaaggat

SEQ ID NO: 9386015 - DNA, 22 bp, Homo sapiens
gatgatcatctgtaaagttaga

SEQ ID NO: 9386016 - DNA, 22 bp, Homo sapiens
gatgatcatctgtaaagttaga

SEQ ID NO: 9386017 - DNA, 22 bp, Homo sapiens
attaagatgtgggaaaatttaa

SEQ ID NO: 9386018 - DNA, 22 bp, Homo sapiens
gatgatgagataaggataactt

SEQ ID NO: 9386019 - DNA, 22 bp, Homo sapiens
attaatttccaggcactgtgct

SEQ ID NO: 9386020 - DNA, 22 bp, Homo sapiens
attaatttccaggcactgtgct

SEQ ID NO: 9386021 - DNA, 22 bp, Homo sapiens
attaattttacctttgtaaaca

SEQ ID NO: 9386022 - DNA, 22 bp, Homo sapiens
attaattttacctttgtaaaca

SEQ ID NO: 9386023 - DNA, 22 bp, Homo sapiens
attaatgtgtagccaacttaat

SEQ ID NO: 9386024 - DNA, 22 bp, Homo sapiens
attaattgggaacttgttgaaa

SEQ ID NO: 9386025 - DNA, 22 bp, Homo sapiens
attaatttccaggcactgtgct

SEQ ID NO: 9386026 - DNA, 22 bp, Homo sapiens
attaattgggaacttgttgaaa

SEQ ID NO: 9386027 - DNA, 22 bp, Homo sapiens
attaatattggttcattagctg

SEQ ID NO: 9386028 - DNA, 22 bp, Homo sapiens
attaatgaaactttggttaagc

SEQ ID NO: 9386029 - DNA, 22 bp, Homo sapiens
attaatgtctaccagttgtgtg

SEQ ID NO: 9386030 - DNA, 22 bp, Homo sapiens
attacaataatacatgctcatt

SEQ ID NO: 9386031 - DNA, 22 bp, Homo sapiens
attacaataatacatgctcatt

SEQ ID NO: 9386032 - DNA, 22 bp, Homo sapiens
gcaaggctgggagatgaggcct

SEQ ID NO: 9386033 - DNA, 22 bp, Homo sapiens
attacaaaagaagggagaaggt

SEQ ID NO: 9386034 - DNA, 22 bp, Homo sapiens
attaattttacctttgtaaaca

SEQ ID NO: 9386035 - DNA, 22 bp, Homo sapiens
attaatttttctgacagccaca

SEQ ID NO: 9386036 - DNA, 22 bp, Homo sapiens
attaattttacctttgtaaaca

SEQ ID NO: 9386037 - DNA, 22 bp, Homo sapiens
attacaaaagaagggagaaggt

SEQ ID NO: 9386038 - DNA, 22 bp, Homo sapiens
attacaagtttcagtgttttgc

SEQ ID NO: 9386039 - DNA, 22 bp, Homo sapiens
attacaagtagactaactttca

SEQ ID NO: 9386040 - DNA, 22 bp, Homo sapiens
attacaagtagactaactttca

SEQ ID NO: 9386041 - DNA, 22 bp, Homo sapiens
attacaagggtctgactggagg

SEQ ID NO: 9386042 - DNA, 22 bp, Homo sapiens
attacaactacataatctcaga

SEQ ID NO: 9386043 - DNA, 22 bp, Homo sapiens
attacaactggaatggtgctgg

SEQ ID NO: 9386044 - DNA, 22 bp, Homo sapiens
attacaagatgcatccatattt

SEQ ID NO: 9386045 - DNA, 22 bp, Homo sapiens
attacaagatgcatccatattt

SEQ ID NO: 9386046 - DNA, 22 bp, Homo sapiens
attacaagatgcatccatattt

SEQ ID NO: 9386047 - DNA, 22 bp, Homo sapiens
atgtgtgtgtatatacacacat

SEQ ID NO: 9386048 - DNA, 22 bp, Homo sapiens
atgtgtgtgtatatacacacat

SEQ ID NO: 9386049 - DNA, 22 bp, Homo sapiens
atgtgtgtgtgcgcgcgcagga

SEQ ID NO: 9386050 - DNA, 22 bp, Homo sapiens
atgtgttagtttgtgattatac

SEQ ID NO: 9386051 - DNA, 22 bp, Homo sapiens
atgtgttaatgtcaaccagaaa

SEQ ID NO: 9386052 - DNA, 22 bp, Homo sapiens
atgtgtgtgtttaatcctcaaa

SEQ ID NO: 9386053 - DNA, 22 bp, Homo sapiens
atgtttctcactgtttctctat

SEQ ID NO: 9386054 - DNA, 22 bp, Homo sapiens
atgttaaaaaccagtacagttg

SEQ ID NO: 9386055 - DNA, 22 bp, Homo sapiens
atgttaaaaaccagtacagttg

SEQ ID NO: 9386056 - DNA, 22 bp, Homo sapiens
atgttaaaaaccagtacagttg

SEQ ID NO: 9386057 - DNA, 22 bp, Homo sapiens
atgtgttttggtaatttctgct

SEQ ID NO: 9386058 - DNA, 22 bp, Homo sapiens
atgtgtttgtacctttaaatat

SEQ ID NO: 9386059 - DNA, 22 bp, Homo sapiens
atgtgtttgtacctttaaatat

SEQ ID NO: 9386060 - DNA, 22 bp, Homo sapiens
atgtgtttataattactcaatc

SEQ ID NO: 9386061 - DNA, 22 bp, Homo sapiens
atgtgtttggttatatggtatt

SEQ ID NO: 9386062 - DNA, 22 bp, Homo sapiens
atgttttctccatgttatgctt

SEQ ID NO: 9386063 - DNA, 22 bp, Homo sapiens
atgttttctagagtttaaaatc

SEQ ID NO: 9386064 - DNA, 22 bp, Homo sapiens
atgttttctagagtttaaaatc

SEQ ID NO: 9386065 - DNA, 22 bp, Homo sapiens
atgttttctagagtttaaaatc

SEQ ID NO: 9386066 - DNA, 22 bp, Homo sapiens
attaaaattccaaggtatgcca

SEQ ID NO: 9386067 - DNA, 22 bp, Homo sapiens
attaaaattccaaggtatgcca

SEQ ID NO: 9386068 - DNA, 22 bp, Homo sapiens
attaaatactgcaggctaagca

SEQ ID NO: 9386069 - DNA, 22 bp, Homo sapiens
attaaatggtggtcattcattt

SEQ ID NO: 9386070 - DNA, 22 bp, Homo sapiens
attaaatgttccttaaattata

SEQ ID NO: 9386071 - DNA, 22 bp, Homo sapiens
attaaatgatggcatgtcttat

SEQ ID NO: 9386072 - DNA, 22 bp, Homo sapiens
attaaatgatggcatgtcttat

SEQ ID NO: 9386073 - DNA, 22 bp, Homo sapiens
attaaatactgcaggctaagca

SEQ ID NO: 9386074 - DNA, 22 bp, Homo sapiens
attaaatactgcaggctaagca

SEQ ID NO: 9386075 - DNA, 22 bp, Homo sapiens
atgtttttaaatagacttacag

SEQ ID NO: 9386076 - DNA, 22 bp, Homo sapiens
atgtttttgagatacaaacaga

SEQ ID NO: 9386077 - DNA, 22 bp, Homo sapiens
atgtttttgagatacaaacaga

SEQ ID NO: 9386078 - DNA, 22 bp, Homo sapiens
atgtttttggaaatgggaacat

SEQ ID NO: 9386079 - DNA, 22 bp, Homo sapiens
attaaattagcaaactgtgaaa

SEQ ID NO: 9386080 - DNA, 22 bp, Homo sapiens
attaaattaagtggctaattta

SEQ ID NO: 9386081 - DNA, 22 bp, Homo sapiens
attaaatgttggcatattttgt

SEQ ID NO: 9386082 - DNA, 22 bp, Homo sapiens
attaaatgttggacgtatacat

SEQ ID NO: 9386083 - DNA, 22 bp, Homo sapiens
attaaatgttccttaaattata

SEQ ID NO: 9386084 - DNA, 22 bp, Homo sapiens
gatgaggggtcattggctggga

SEQ ID NO: 9386085 - DNA, 22 bp, Homo sapiens
gatgaggtgtgtggccactaga

SEQ ID NO: 9386086 - DNA, 22 bp, Homo sapiens
gatgaggggtcattggctggga

SEQ ID NO: 9386087 - DNA, 22 bp, Homo sapiens
gatgagggcctggtggctgtgc

SEQ ID NO: 9386088 - DNA, 22 bp, Homo sapiens
gatgagggcctggtggctgtgc

SEQ ID NO: 9386089 - DNA, 22 bp, Homo sapiens
gatgagggcctggtggctgtgc

SEQ ID NO: 9386090 - DNA, 22 bp, Homo sapiens
gatgaggggtcattggctggga

SEQ ID NO: 9386091 - DNA, 22 bp, Homo sapiens
gatgagtgaggacagggtggca

SEQ ID NO: 9386092 - DNA, 22 bp, Homo sapiens
gatgatatatatggaaagccta

SEQ ID NO: 9386093 - DNA, 22 bp, Homo sapiens
gatgaggctcatgcaccctgcg

SEQ ID NO: 9386094 - DNA, 22 bp, Homo sapiens
gatgaggctgtgtctgcacaag

SEQ ID NO: 9386095 - DNA, 22 bp, Homo sapiens
cttgtttaaataagatagcagt

SEQ ID NO: 9386096 - DNA, 22 bp, Homo sapiens
cttgttgttatggctggtggag

SEQ ID NO: 9386097 - DNA, 18 bp, Homo sapiens
cttgttcttctcttggcg

SEQ ID NO: 9386098 - DNA, 18 bp, Homo sapiens
cttgttcttctcttggcg

SEQ ID NO: 9386099 - DNA, 22 bp, Homo sapiens
cttgttctgtgcttcttacatt

SEQ ID NO: 9386100 - DNA, 23 bp, Homo sapiens
atgaaacatcacaatggtaccat

SEQ ID NO: 9386101 - DNA, 22 bp, Homo sapiens
cttgtggccaatgtttgttata

SEQ ID NO: 9386102 - DNA, 22 bp, Homo sapiens
cttgtgtatatatagtaactta

SEQ ID NO: 9386103 - DNA, 20 bp, Homo sapiens
cttgttaaatatgcaggtag

SEQ ID NO: 9386104 - DNA, 22 bp, Homo sapiens
cttgttaaattatataagcaga

SEQ ID NO: 9386105 - DNA, 22 bp, Homo sapiens
cttgttaaattatataagcaga

SEQ ID NO: 9386106 - DNA, 22 bp, Homo sapiens
cttgtgttgtacattctatggg

SEQ ID NO: 9386107 - DNA, 22 bp, Homo sapiens
cttgtgttgtacattctatggg

SEQ ID NO: 9386108 - DNA, 23 bp, Homo sapiens
cttgttataagaagactgtctgg

SEQ ID NO: 9386109 - DNA, 22 bp, Homo sapiens
atcttgctgctacaaagtgccc

SEQ ID NO: 9386110 - DNA, 22 bp, Homo sapiens
atcttgatcaaggctatcatga

SEQ ID NO: 9386111 - DNA, 22 bp, Homo sapiens
atcttgcatttgctaaaatgca

SEQ ID NO: 9386112 - DNA, 22 bp, Homo sapiens
atcttgccagtctccaaatcaa

SEQ ID NO: 9386113 - DNA, 22 bp, Homo sapiens
atctttgttgctctcatttctg

SEQ ID NO: 9386114 - DNA, 22 bp, Homo sapiens
atcttttacattactgcccaga

SEQ ID NO: 9386115 - DNA, 22 bp, Homo sapiens
atctttgttttgatgcagatct

SEQ ID NO: 9386116 - DNA, 22 bp, Homo sapiens
atcttttatgagcgttctgaca

SEQ ID NO: 9386117 - DNA, 22 bp, Homo sapiens
atcttttctgtttgctatgtct

SEQ ID NO: 9386118 - DNA, 22 bp, Homo sapiens
atcttttatgagcgttctgaca

SEQ ID NO: 9386119 - DNA, 22 bp, Homo sapiens
atcttttactacaaatcaggtg

SEQ ID NO: 9386120 - DNA, 22 bp, Homo sapiens
atcttttctgtttgctatgtct

SEQ ID NO: 9386121 - DNA, 22 bp, Homo sapiens
atctttttgacatggtgatggt

SEQ ID NO: 9386122 - DNA, 22 bp, Homo sapiens
cttttattttgaattaagggct

SEQ ID NO: 9386123 - DNA, 22 bp, Homo sapiens
cttttattttgaattaagggct

SEQ ID NO: 9386124 - DNA, 22 bp, Homo sapiens
cttttattttgaattaagggct

SEQ ID NO: 9386125 - DNA, 22 bp, Homo sapiens
cttttattttgaattaagggct

SEQ ID NO: 9386126 - DNA, 22 bp, Homo sapiens
cttttattttgaattaagggct

SEQ ID NO: 9386127 - DNA, 22 bp, Homo sapiens
cttttactgtgaaaagaaactg

SEQ ID NO: 9386128 - DNA, 22 bp, Homo sapiens
cttttacatttgttgaagagta

SEQ ID NO: 9386129 - DNA, 22 bp, Homo sapiens
ctttggtgtcatgtttctgcgg

SEQ ID NO: 9386130 - DNA, 22 bp, Homo sapiens
cttttacatttgttgaagagta

SEQ ID NO: 9386131 - DNA, 22 bp, Homo sapiens
cttttacatttgttgaagagta

SEQ ID NO: 9386132 - DNA, 20 bp, Homo sapiens
ctttggtgggggtagcccag

SEQ ID NO: 9386133 - DNA, 22 bp, Homo sapiens
atgaaattaatcaacacataca

SEQ ID NO: 9386134 - DNA, 22 bp, Homo sapiens
cttttcaggctacattatggga

SEQ ID NO: 9386135 - DNA, 22 bp, Homo sapiens
cttttcagagctgagatcaccg

SEQ ID NO: 9386136 - DNA, 22 bp, Homo sapiens
cttttcagagctgagatcaccg

SEQ ID NO: 9386137 - DNA, 22 bp, Homo sapiens
cttttattttgaattaagggct

SEQ ID NO: 9386138 - DNA, 22 bp, Homo sapiens
cttttcaggctacattatggga

SEQ ID NO: 9386139 - DNA, 22 bp, Homo sapiens
atgaaatgtatgagtctgggtt

SEQ ID NO: 9386140 - DNA, 23 bp, Homo sapiens
atgaaatgctggctcagggaggt

SEQ ID NO: 9386141 - DNA, 22 bp, Homo sapiens
atgaaatatcttgaagaaattc

SEQ ID NO: 9386142 - DNA, 22 bp, Homo sapiens
atgaaatatcttgaagaaattc

SEQ ID NO: 9386143 - DNA, 22 bp, Homo sapiens
atgaaatgagtcaatgcgacta

SEQ ID NO: 9386144 - DNA, 22 bp, Homo sapiens
atgaaatgaagttggcctggct

SEQ ID NO: 9386145 - DNA, 22 bp, Homo sapiens
atctattatgctgagaaactgt

SEQ ID NO: 9386146 - DNA, 22 bp, Homo sapiens
atctatgtgggaatcataatag

SEQ ID NO: 9386147 - DNA, 22 bp, Homo sapiens
atctatgtgcctttgtatagaa

SEQ ID NO: 9386148 - DNA, 22 bp, Homo sapiens
atctatatcatggggtaaggta

SEQ ID NO: 9386149 - DNA, 22 bp, Homo sapiens
cttgcctttgtcttcaaaggct

SEQ ID NO: 9386150 - DNA, 22 bp, Homo sapiens
cttgcctttgtcttcaaaggct

SEQ ID NO: 9386151 - DNA, 22 bp, Homo sapiens
cttgcctttgtcttcaaaggct

SEQ ID NO: 9386152 - DNA, 22 bp, Homo sapiens
cttgctcacagtacctggcttg

SEQ ID NO: 9386153 - DNA, 22 bp, Homo sapiens
cttgcggagaactgtgccctta

SEQ ID NO: 9386154 - DNA, 22 bp, Homo sapiens
atctagaaagtgttgaagatca

SEQ ID NO: 9386155 - DNA, 22 bp, Homo sapiens
atctagaagtggcatgaattac

SEQ ID NO: 9386156 - DNA, 22 bp, Homo sapiens
atctagaggagggctgctggat

SEQ ID NO: 9386157 - DNA, 22 bp, Homo sapiens
atctaggatttgaatgcacagt

SEQ ID NO: 9386158 - DNA, 22 bp, Homo sapiens
atctacagccagtctggtttgt

SEQ ID NO: 9386159 - DNA, 22 bp, Homo sapiens
atctacagccagtctggtttgt

SEQ ID NO: 9386160 - DNA, 19 bp, Homo sapiens
atctacaattattctcagt

SEQ ID NO: 9386161 - DNA, 19 bp, Homo sapiens
atctacaattattctcagt

SEQ ID NO: 9386162 - DNA, 22 bp, Homo sapiens
atctacaggatagtttaatatt

SEQ ID NO: 9386163 - DNA, 22 bp, Homo sapiens
atctacaggatagtttaatatt

SEQ ID NO: 9386164 - DNA, 22 bp, Homo sapiens
atctacaggatagtttaatatt

SEQ ID NO: 9386165 - DNA, 22 bp, Homo sapiens
atctacagctgtctgcacagta

SEQ ID NO: 9386166 - DNA, 22 bp, Homo sapiens
atctacaggattttacagagtt

SEQ ID NO: 9386167 - DNA, 22 bp, Homo sapiens
atctacaggattttacagagtt

SEQ ID NO: 9386168 - DNA, 22 bp, Homo sapiens
atctacataaaacgaatacata

SEQ ID NO: 9386169 - DNA, 22 bp, Homo sapiens
atctacatgttgatttaaagaa

SEQ ID NO: 9386170 - DNA, 22 bp, Homo sapiens
cttggcatgcagcaggcactca

SEQ ID NO: 9386171 - DNA, 22 bp, Homo sapiens
cttggcctcttctcagggtggg

SEQ ID NO: 9386172 - DNA, 22 bp, Homo sapiens
cttggcagggtggaggatgcag

SEQ ID NO: 9386173 - DNA, 22 bp, Homo sapiens
cttggcagggtggaggatgcag

SEQ ID NO: 9386174 - DNA, 22 bp, Homo sapiens
cttggcagtttcggaaggatga

SEQ ID NO: 9386175 - DNA, 22 bp, Homo sapiens
cttggcagggtggaggatgcag

SEQ ID NO: 9386176 - DNA, 22 bp, Homo sapiens
cttggctccttcacagggagat

SEQ ID NO: 9386177 - DNA, 22 bp, Homo sapiens
cttggctctgtgttgatgggac

SEQ ID NO: 9386178 - DNA, 22 bp, Homo sapiens
cttggctccaatcccagctctg

SEQ ID NO: 9386179 - DNA, 22 bp, Homo sapiens
cttggcctgtggctcaagaatt

SEQ ID NO: 9386180 - DNA, 22 bp, Homo sapiens
cttggcctgggccgcagccact

SEQ ID NO: 9386181 - DNA, 22 bp, Homo sapiens
cttggcctgcaggcagcagcgc

SEQ ID NO: 9386182 - DNA, 22 bp, Homo sapiens
cttggcctgcaggcagcagcgc

SEQ ID NO: 9386183 - DNA, 22 bp, Homo sapiens
cttggcctgacatgtggcaggg

SEQ ID NO: 9386184 - DNA, 22 bp, Homo sapiens
cttgggtgttttaaaactagat

SEQ ID NO: 9386185 - DNA, 22 bp, Homo sapiens
cttggtaaaactgtcttaaatt

SEQ ID NO: 9386186 - DNA, 22 bp, Homo sapiens
cttggtccgagggcgcctaggc

SEQ ID NO: 9386187 - DNA, 22 bp, Homo sapiens
cttggtttacctaaacaatagg

SEQ ID NO: 9386188 - DNA, 22 bp, Homo sapiens
cttggtttacctaaacaatagg

SEQ ID NO: 9386189 - DNA, 22 bp, Homo sapiens
cttggtgcattactcaatctgt

SEQ ID NO: 9386190 - DNA, 22 bp, Homo sapiens
cttggtctagtgagtgagcata

SEQ ID NO: 9386191 - DNA, 22 bp, Homo sapiens
cttggtcctgcagggtctcttg

SEQ ID NO: 9386192 - DNA, 22 bp, Homo sapiens
cttggtgccacagcagcttgcg

SEQ ID NO: 9386193 - DNA, 22 bp, Homo sapiens
cttggtgcccagcaggtggctg

SEQ ID NO: 9386194 - DNA, 22 bp, Homo sapiens
atcttctggtcaaatttttgca

SEQ ID NO: 9386195 - DNA, 22 bp, Homo sapiens
atcttctgggcagtgaaaattg

SEQ ID NO: 9386196 - DNA, 20 bp, Homo sapiens
atcttcttggccagcttgct

SEQ ID NO: 9386197 - DNA, 22 bp, Homo sapiens
atcttccttcactttctcccac

SEQ ID NO: 9386198 - DNA, 22 bp, Homo sapiens
atcttctcaagcagcatcctgt

SEQ ID NO: 9386199 - DNA, 22 bp, Homo sapiens
atcttctcaagcagcatcctgt

SEQ ID NO: 9386200 - DNA, 22 bp, Homo sapiens
atcttctactttgccaatcagg

SEQ ID NO: 9386201 - DNA, 22 bp, Homo sapiens
atcttctcaagcagcatcctgt

SEQ ID NO: 9386202 - DNA, 22 bp, Homo sapiens
atcttctcatgtgtaatgaggt

SEQ ID NO: 9386203 - DNA, 22 bp, Homo sapiens
atcttctcaagcagcatcctgt

SEQ ID NO: 9386204 - DNA, 22 bp, Homo sapiens
atgcagatttctttgctgcacc

SEQ ID NO: 9386205 - DNA, 22 bp, Homo sapiens
atgcagaattgctaagtatctg

SEQ ID NO: 9386206 - DNA, 22 bp, Homo sapiens
atgcagaaggagccatgcttgc

SEQ ID NO: 9386207 - DNA, 22 bp, Homo sapiens
atgcagaagaaaccatggcttc

SEQ ID NO: 9386208 - DNA, 22 bp, Homo sapiens
atgcacttgcgtgtttgcaaat

SEQ ID NO: 9386209 - DNA, 22 bp, Homo sapiens
atgcactttctagagattctga

SEQ ID NO: 9386210 - DNA, 22 bp, Homo sapiens
atgcactttgtaatctgttcaa

SEQ ID NO: 9386211 - DNA, 22 bp, Homo sapiens
atgcacttaaataacataactt

SEQ ID NO: 9386212 - DNA, 22 bp, Homo sapiens
atgcacagtatgtagggtctat

SEQ ID NO: 9386213 - DNA, 22 bp, Homo sapiens
atgcacttcaagcatctctctg

SEQ ID NO: 9386214 - DNA, 22 bp, Homo sapiens
atgcacttcaagcatctctctg

SEQ ID NO: 9386215 - DNA, 22 bp, Homo sapiens
atgcacagtacaaactggaaac

SEQ ID NO: 9386216 - DNA, 22 bp, Homo sapiens
atgcaaatcttaagtatgtgtg

SEQ ID NO: 9386217 - DNA, 22 bp, Homo sapiens
atgcaaagcaccacactaagat

SEQ ID NO: 9386218 - DNA, 23 bp, Homo sapiens
atgcaaagtgctgtcatgtagac

SEQ ID NO: 9386219 - DNA, 22 bp, Homo sapiens
atgcaaaataaggcagaaacat

SEQ ID NO: 9386220 - DNA, 22 bp, Homo sapiens
atgcaaaagtaattgcaatttt

SEQ ID NO: 9386221 - DNA, 22 bp, Homo sapiens
atgcaaaagtaattgcaatttt

SEQ ID NO: 9386222 - DNA, 22 bp, Homo sapiens
atgcaaaagtaattgcaatttt

SEQ ID NO: 9386223 - DNA, 22 bp, Homo sapiens
atgcaaaataaggcagaaacat

SEQ ID NO: 9386224 - DNA, 22 bp, Homo sapiens
atgcaaaattaccattctgttc

SEQ ID NO: 9386225 - DNA, 22 bp, Homo sapiens
atgcaaaattaccattctgttc

SEQ ID NO: 9386226 - DNA, 22 bp, Homo sapiens
atgcatttatgtgtgtacattg

SEQ ID NO: 9386227 - DNA, 22 bp, Homo sapiens
atgcatttatgtgtgtacattg

SEQ ID NO: 9386228 - DNA, 19 bp, Homo sapiens
atgcattgtttgaagttga

SEQ ID NO: 9386229 - DNA, 22 bp, Homo sapiens
atgcattgtctggtttcatttt

SEQ ID NO: 9386230 - DNA, 20 bp, Homo sapiens
atgcattgtgattctgtttt

SEQ ID NO: 9386231 - DNA, 22 bp, Homo sapiens
atgcatttatgtgtgtacattg

SEQ ID NO: 9386232 - DNA, 22 bp, Homo sapiens
atgcattgaggatgacatgagt

SEQ ID NO: 9386233 - DNA, 22 bp, Homo sapiens
atgcattgctcaacagaataca

SEQ ID NO: 9386234 - DNA, 22 bp, Homo sapiens
atgcattgctgctttcaaaaca

SEQ ID NO: 9386235 - DNA, 22 bp, Homo sapiens
atgcattgcttgagggtaggaa

SEQ ID NO: 9386236 - DNA, 22 bp, Homo sapiens
atgcattgtaacgatgtgcaca

SEQ ID NO: 9386237 - DNA, 22 bp, Homo sapiens
atgcattggataagaaccccat

SEQ ID NO: 9386238 - DNA, 22 bp, Homo sapiens
atgcattggtcagggtcttagg

SEQ ID NO: 9386239 - DNA, 22 bp, Homo sapiens
atgcattgtctggtttcatttt

SEQ ID NO: 9386240 - DNA, 22 bp, Homo sapiens
atgcattgtcaggcaatttcat

SEQ ID NO: 9386241 - DNA, 22 bp, Homo sapiens
atgcattgtaacgatgtgcaca

SEQ ID NO: 9386242 - DNA, 22 bp, Homo sapiens
atgcattgtatgaaaggaaata

SEQ ID NO: 9386243 - DNA, 22 bp, Homo sapiens
atgcattgtcaggcaatttcat

SEQ ID NO: 9386244 - DNA, 22 bp, Homo sapiens
atgcatgtattatctagatgag

SEQ ID NO: 9386245 - DNA, 22 bp, Homo sapiens
atgcatgtaacagtgttatgaa

SEQ ID NO: 9386246 - DNA, 21 bp, Homo sapiens
atgcatggatttcagtgagag

SEQ ID NO: 9386247 - DNA, 21 bp, Homo sapiens
atgcatggatttcagtgagag

SEQ ID NO: 9386248 - DNA, 22 bp, Homo sapiens
atgcatggtctgaagtcaacct

SEQ ID NO: 9386249 - DNA, 22 bp, Homo sapiens
atgcatgtgcatacatgcacag

SEQ ID NO: 9386250 - DNA, 22 bp, Homo sapiens
atgcatgtcagctgtgcccatg

SEQ ID NO: 9386251 - DNA, 22 bp, Homo sapiens
atgcatgtgtgaattatttgac

SEQ ID NO: 9386252 - DNA, 22 bp, Homo sapiens
atgcatgtgtgaattatttgac

SEQ ID NO: 9386253 - DNA, 22 bp, Homo sapiens
atgcatgtgtgtagcatcagca

SEQ ID NO: 9386254 - DNA, 22 bp, Homo sapiens
atgcatgttaagctcttaaaat

SEQ ID NO: 9386255 - DNA, 22 bp, Homo sapiens
atgcatgttaagcctgactgga

SEQ ID NO: 9386256 - DNA, 22 bp, Homo sapiens
atgcatgttgcttggcccactc

SEQ ID NO: 9386257 - DNA, 21 bp, Homo sapiens
atgcatgttccataaagtggg

SEQ ID NO: 9386258 - DNA, 22 bp, Homo sapiens
atgcatgagctttgtgatcctg

SEQ ID NO: 9386259 - DNA, 22 bp, Homo sapiens
atgcatgagtcactcagtgcag

SEQ ID NO: 9386260 - DNA, 22 bp, Homo sapiens
atgcatgatcctgagcaaccca

SEQ ID NO: 9386261 - DNA, 22 bp, Homo sapiens
atgcatgatgaacttgctttca

SEQ ID NO: 9386262 - DNA, 22 bp, Homo sapiens
atgcatgcaagtgcacatatgc

SEQ ID NO: 9386263 - DNA, 22 bp, Homo sapiens
atgcatcttttcaaggtatttc

SEQ ID NO: 9386264 - DNA, 22 bp, Homo sapiens
atgcatgaaagaatccaagcct

SEQ ID NO: 9386265 - DNA, 22 bp, Homo sapiens
atgcatgagaatatcccatgct

SEQ ID NO: 9386266 - DNA, 20 bp, Homo sapiens
atgcatgcatgcacatgcac

SEQ ID NO: 9386267 - DNA, 22 bp, Homo sapiens
atgcatatgccgtagaataagt

SEQ ID NO: 9386268 - DNA, 22 bp, Homo sapiens
atgcatctgtagtgttatatga

SEQ ID NO: 9386269 - DNA, 20 bp, Homo sapiens
atgcatctggtatctttcct

SEQ ID NO: 9386270 - DNA, 19 bp, Homo sapiens
atgcatctgcattgacagg

SEQ ID NO: 9386271 - DNA, 22 bp, Homo sapiens
atgcagctcatttgtttaaaag

SEQ ID NO: 9386272 - DNA, 22 bp, Homo sapiens
atgcagctgctgacagctttca

SEQ ID NO: 9386273 - DNA, 22 bp, Homo sapiens
atgagtgatacagcaagctctc

SEQ ID NO: 9386274 - DNA, 22 bp, Homo sapiens
atgaggtgttcgctggcctttt

SEQ ID NO: 9386275 - DNA, 22 bp, Homo sapiens
atgaggtgggagaatcacttga

SEQ ID NO: 9386276 - DNA, 22 bp, Homo sapiens
atgaggtgatggacatattaac

SEQ ID NO: 9386277 - DNA, 22 bp, Homo sapiens
gaaagcagtaaatgggtcccat

SEQ ID NO: 9386278 - DNA, 22 bp, Homo sapiens
atgaggccacagttatagattt

SEQ ID NO: 9386279 - DNA, 22 bp, Homo sapiens
atgagggcagctatgtaagtgt

SEQ ID NO: 9386280 - DNA, 22 bp, Homo sapiens
atgaggccaccttctacatttc

SEQ ID NO: 9386281 - DNA, 22 bp, Homo sapiens
atgaggccaccttctacatttc

SEQ ID NO: 9386282 - DNA, 22 bp, Homo sapiens
atgatacaagcaaaactaatca

SEQ ID NO: 9386283 - DNA, 22 bp, Homo sapiens
atgatacaagcaaaactaatca

SEQ ID NO: 9386284 - DNA, 22 bp, Homo sapiens
atgatacaagcaaaactaatca

SEQ ID NO: 9386285 - DNA, 20 bp, Homo sapiens
atgagtttaaacattcagag

SEQ ID NO: 9386286 - DNA, 22 bp, Homo sapiens
atgagttaggggcctgagtgga

SEQ ID NO: 9386287 - DNA, 22 bp, Homo sapiens
atgagtgtacgtgaaagtagat

SEQ ID NO: 9386288 - DNA, 22 bp, Homo sapiens
atgagtgtttagaaaacactgg

SEQ ID NO: 9386289 - DNA, 22 bp, Homo sapiens
atgagtgcctaactgtcagatt

SEQ ID NO: 9386290 - DNA, 22 bp, Homo sapiens
atgagtgatgggtacattggct

SEQ ID NO: 9386291 - DNA, 22 bp, Homo sapiens
atgagtgatacagcaagctctc

SEQ ID NO: 9386292 - DNA, 22 bp, Homo sapiens
atgatttttcagcagaggatct

SEQ ID NO: 9386293 - DNA, 22 bp, Homo sapiens
atgatttttcagcagaggatct

SEQ ID NO: 9386294 - DNA, 20 bp, Homo sapiens
atgattttgcactaacttca

SEQ ID NO: 9386295 - DNA, 20 bp, Homo sapiens
atgattttgcactaacttca

SEQ ID NO: 9386296 - DNA, 20 bp, Homo sapiens
atgattttgcactaacttca

SEQ ID NO: 9386297 - DNA, 22 bp, Homo sapiens
gaaagcacgatagtagcaaaag

SEQ ID NO: 9386298 - DNA, 18 bp, Homo sapiens
gaaagatgaacttttttc

SEQ ID NO: 9386299 - DNA, 19 bp, Homo sapiens
gaaagatttcagttgagga

SEQ ID NO: 9386300 - DNA, 22 bp, Homo sapiens
atgaggcaggagtgcagtggca

SEQ ID NO: 9386301 - DNA, 22 bp, Homo sapiens
atgaggcaggtggaggctgcca

SEQ ID NO: 9386302 - DNA, 22 bp, Homo sapiens
atgaggcaggattaagctatca

SEQ ID NO: 9386303 - DNA, 22 bp, Homo sapiens
gaaagatatttattggcaacag

SEQ ID NO: 9386304 - DNA, 22 bp, Homo sapiens
atgaagatttcccagagacatg

SEQ ID NO: 9386305 - DNA, 22 bp, Homo sapiens
atgaagcagaatttcccactct

SEQ ID NO: 9386306 - DNA, 22 bp, Homo sapiens
atgaagatgtgaaggctggatt

SEQ ID NO: 9386307 - DNA, 22 bp, Homo sapiens
atgaggcagagggctgtgccag

SEQ ID NO: 9386308 - DNA, 22 bp, Homo sapiens
atgaggcagatgttgcatgagg

SEQ ID NO: 9386309 - DNA, 22 bp, Homo sapiens
atgaggcagatgttgcatgagg

SEQ ID NO: 9386310 - DNA, 22 bp, Homo sapiens
atgaggcagctgacagctgttc

SEQ ID NO: 9386311 - DNA, 22 bp, Homo sapiens
atgaggcagcacatgggattgt

SEQ ID NO: 9386312 - DNA, 19 bp, Homo sapiens
atgaggaactgaggctcag

SEQ ID NO: 9386313 - DNA, 22 bp, Homo sapiens
atgtctttggctttgacatggc

SEQ ID NO: 9386314 - DNA, 22 bp, Homo sapiens
atgtctttgccatagttcatat

SEQ ID NO: 9386315 - DNA, 22 bp, Homo sapiens
atgtcttttatggagatgtcat

SEQ ID NO: 9386316 - DNA, 22 bp, Homo sapiens
atgtctttgccatagttcatat

SEQ ID NO: 9386317 - DNA, 22 bp, Homo sapiens
gaggctgcggggaggagcctgc

SEQ ID NO: 9386318 - DNA, 22 bp, Homo sapiens
gaggctgcggggaggagcctgc

SEQ ID NO: 9386319 - DNA, 20 bp, Homo sapiens
gaggctgcggactgctggac

SEQ ID NO: 9386320 - DNA, 22 bp, Homo sapiens
gaggctgctgagagccctgttt

SEQ ID NO: 9386321 - DNA, 22 bp, Homo sapiens
gaggctgctgccatcattaggt

SEQ ID NO: 9386322 - DNA, 20 bp, Homo sapiens
gaggctgcggactgctggac

SEQ ID NO: 9386323 - DNA, 20 bp, Homo sapiens
gaggctgcggactgctggac

SEQ ID NO: 9386324 - DNA, 22 bp, Homo sapiens
gaggctgccccttcctcagctg

SEQ ID NO: 9386325 - DNA, 22 bp, Homo sapiens
gaggctgccccttcctcagctg

SEQ ID NO: 9386326 - DNA, 22 bp, Homo sapiens
gaggctgccccttcctcagctg

SEQ ID NO: 9386327 - DNA, 22 bp, Homo sapiens
gaggctgccccttcctcagctg

SEQ ID NO: 9386328 - DNA, 22 bp, Homo sapiens
atgtctttataaatgtataatg

SEQ ID NO: 9386329 - DNA, 22 bp, Homo sapiens
atgtctttaaacttgagttgtt

SEQ ID NO: 9386330 - DNA, 22 bp, Homo sapiens
gaggcctgggttacctactcgt

SEQ ID NO: 9386331 - DNA, 19 bp, Homo sapiens
atgtctgggtaacagctgc

SEQ ID NO: 9386332 - DNA, 22 bp, Homo sapiens
gaggcctgggagcctgtcctcc

SEQ ID NO: 9386333 - DNA, 22 bp, Homo sapiens
gaggcctgggcaagggggtctg

SEQ ID NO: 9386334 - DNA, 22 bp, Homo sapiens
gaggcctgggcaagggggtctg

SEQ ID NO: 9386335 - DNA, 22 bp, Homo sapiens
gaggcctggagccgcctaggcg

SEQ ID NO: 9386336 - DNA, 22 bp, Homo sapiens
gaggcctggagccgcctaggcg

SEQ ID NO: 9386337 - DNA, 23 bp, Homo sapiens
gaggcctggccctgccacatctc

SEQ ID NO: 9386338 - DNA, 22 bp, Homo sapiens
gaggccagggtaccatcaacat

SEQ ID NO: 9386339 - DNA, 22 bp, Homo sapiens
gaggcctggagccgcctaggcg

SEQ ID NO: 9386340 - DNA, 22 bp, Homo sapiens
gaggcctggctctgccctcctg

SEQ ID NO: 9386341 - DNA, 22 bp, Homo sapiens
gaggcctggctctgccctcctg

SEQ ID NO: 9386342 - DNA, 22 bp, Homo sapiens
gaggcctggctctgccctcctg

SEQ ID NO: 9386343 - DNA, 22 bp, Homo sapiens
gaggcctggctctgccctcctg

SEQ ID NO: 9386344 - DNA, 22 bp, Homo sapiens
gaggcctggctgggaggaggtg

SEQ ID NO: 9386345 - DNA, 22 bp, Homo sapiens
gaggcctggctgggaggaggtg

SEQ ID NO: 9386346 - DNA, 22 bp, Homo sapiens
gaggcctggctgggaggaggtg

SEQ ID NO: 9386347 - DNA, 22 bp, Homo sapiens
gaggcctggctgtcagtcccca

SEQ ID NO: 9386348 - DNA, 22 bp, Homo sapiens
gaggcctggctgtcagtcccca

SEQ ID NO: 9386349 - DNA, 22 bp, Homo sapiens
gaggcctgggagcctgtcctcc

SEQ ID NO: 9386350 - DNA, 22 bp, Homo sapiens
gaggggagcatgatctagattg

SEQ ID NO: 9386351 - DNA, 22 bp, Homo sapiens
gaggggagacagggaaatcagt

SEQ ID NO: 9386352 - DNA, 22 bp, Homo sapiens
gaggggagaggcttatggatca

SEQ ID NO: 9386353 - DNA, 22 bp, Homo sapiens
atgtgtgtatgtgcctatatct

SEQ ID NO: 9386354 - DNA, 22 bp, Homo sapiens
atgtgtgtatgtgcctatatct

SEQ ID NO: 9386355 - DNA, 22 bp, Homo sapiens
atgtgtgtgcatttctctccct

SEQ ID NO: 9386356 - DNA, 22 bp, Homo sapiens
atgtgtgtgatgggcgccgcca

SEQ ID NO: 9386357 - DNA, 22 bp, Homo sapiens
atgtgtgtatatatagtcattt

SEQ ID NO: 9386358 - DNA, 22 bp, Homo sapiens
atgtgtcttgagggggatggag

SEQ ID NO: 9386359 - DNA, 22 bp, Homo sapiens
gaggctgctttgatgacaggag

SEQ ID NO: 9386360 - DNA, 22 bp, Homo sapiens
gaggctgctttgatgacaggag

SEQ ID NO: 9386361 - DNA, 22 bp, Homo sapiens
atgtggcttggcagggaatatg

SEQ ID NO: 9386362 - DNA, 22 bp, Homo sapiens
gaggctgctttgatgacaggag

SEQ ID NO: 9386363 - DNA, 22 bp, Homo sapiens
atgtgtatgagtgtgcttcttt

SEQ ID NO: 9386364 - DNA, 22 bp, Homo sapiens
atgtgtatgagtgtgcttcttt

SEQ ID NO: 9386365 - DNA, 22 bp, Homo sapiens
atgtggcttttcctgggttcct

SEQ ID NO: 9386366 - DNA, 22 bp, Homo sapiens
atgtgtatgatacctttgctga

SEQ ID NO: 9386367 - DNA, 22 bp, Homo sapiens
atgtgtatgatacctttgctga

SEQ ID NO: 9386368 - DNA, 22 bp, Homo sapiens
atgtgtatgcatgcactaagat

SEQ ID NO: 9386369 - DNA, 22 bp, Homo sapiens
atgtgtatgtcttattcaaaga

SEQ ID NO: 9386370 - DNA, 22 bp, Homo sapiens
atgtgtatgtcttattcaaaga

SEQ ID NO: 9386371 - DNA, 22 bp, Homo sapiens
atgtgtattaccctttcattcc

SEQ ID NO: 9386372 - DNA, 22 bp, Homo sapiens
atgtgtatgtgtatacacacag

SEQ ID NO: 9386373 - DNA, 22 bp, Homo sapiens
atgtgtattaccctttcattcc

SEQ ID NO: 9386374 - DNA, 22 bp, Homo sapiens
atgtgtattaccctttcattcc

SEQ ID NO: 9386375 - DNA, 22 bp, Homo sapiens
atgtgtcctgctgtgtcacaca

SEQ ID NO: 9386376 - DNA, 22 bp, Homo sapiens
gaggggaagacttctggacagt

SEQ ID NO: 9386377 - DNA, 22 bp, Homo sapiens
atgtgtccaaggccacaatagc

SEQ ID NO: 9386378 - DNA, 22 bp, Homo sapiens
atgtgtcattatccagaataac

SEQ ID NO: 9386379 - DNA, 22 bp, Homo sapiens
atgtgtcatttttctgtgcata

SEQ ID NO: 9386380 - DNA, 22 bp, Homo sapiens
atgtgtccattatcagttctgg

SEQ ID NO: 9386381 - DNA, 22 bp, Homo sapiens
atgtgtcctctggcaggtttag

SEQ ID NO: 9386382 - DNA, 22 bp, Homo sapiens
atgtgtccacaggtgtgagaga

SEQ ID NO: 9386383 - DNA, 22 bp, Homo sapiens
atgtgtatttccatcgatcagc

SEQ ID NO: 9386384 - DNA, 22 bp, Homo sapiens
atgtgtatttccatcgatcagc

SEQ ID NO: 9386385 - DNA, 22 bp, Homo sapiens
atgtgtattgagcacctactgc

SEQ ID NO: 9386386 - DNA, 22 bp, Homo sapiens
atgtgtattagttagtttaatg

SEQ ID NO: 9386387 - DNA, 22 bp, Homo sapiens
atgtgtattagttagtttaatg

SEQ ID NO: 9386388 - DNA, 22 bp, Homo sapiens
atgtgtattacctcgattgtga

SEQ ID NO: 9386389 - DNA, 22 bp, Homo sapiens
atgtgtattttgtactattggg

SEQ ID NO: 9386390 - DNA, 22 bp, Homo sapiens
atgtgtcaggtacactcattag

SEQ ID NO: 9386391 - DNA, 22 bp, Homo sapiens
atgtgtcaggcaatagaagcta

SEQ ID NO: 9386392 - DNA, 22 bp, Homo sapiens
atgtgtcaggcaatagaagcta

SEQ ID NO: 9386393 - DNA, 22 bp, Homo sapiens
atgtgtcaattttcaaatgctt

SEQ ID NO: 9386394 - DNA, 22 bp, Homo sapiens
gagctgggcctgcgagtgctgc

SEQ ID NO: 9386395 - DNA, 22 bp, Homo sapiens
gagctgggcctgcgagtgctgc

SEQ ID NO: 9386396 - DNA, 22 bp, Homo sapiens
gagctgggcctgcgagtgctgc

SEQ ID NO: 9386397 - DNA, 22 bp, Homo sapiens
gagctgggcctgcgagtgctgc

SEQ ID NO: 9386398 - DNA, 22 bp, Homo sapiens
gagctgggcctgcgagtgctgc

SEQ ID NO: 9386399 - DNA, 22 bp, Homo sapiens
gagctgggcctgcgagtgctgc

SEQ ID NO: 9386400 - DNA, 22 bp, Homo sapiens
gagctgggcctcagaacacagt

SEQ ID NO: 9386401 - DNA, 22 bp, Homo sapiens
gagctgggcctcagaacacagt

SEQ ID NO: 9386402 - DNA, 22 bp, Homo sapiens
atggtcaggcaaggagggctgg

SEQ ID NO: 9386403 - DNA, 22 bp, Homo sapiens
atggtcagggcaccctggcccc

SEQ ID NO: 9386404 - DNA, 22 bp, Homo sapiens
gagctgggctggcttcctccct

SEQ ID NO: 9386405 - DNA, 22 bp, Homo sapiens
gagctggggcagcttaggagtg

SEQ ID NO: 9386406 - DNA, 22 bp, Homo sapiens
gagctggggcagcttaggagtg

SEQ ID NO: 9386407 - DNA, 22 bp, Homo sapiens
gagctgggcgagccggggaagt

SEQ ID NO: 9386408 - DNA, 22 bp, Homo sapiens
gagctgggcgagccggggaagt

SEQ ID NO: 9386409 - DNA, 21 bp, Homo sapiens
gagctgggcgaggctccgggg

SEQ ID NO: 9386410 - DNA, 22 bp, Homo sapiens
gagctgggcgagccggggaagt

SEQ ID NO: 9386411 - DNA, 22 bp, Homo sapiens
gagctgggcgagccggggaagt

SEQ ID NO: 9386412 - DNA, 21 bp, Homo sapiens
gagctgggcgaggctccgggg

SEQ ID NO: 9386413 - DNA, 21 bp, Homo sapiens
gagctgggcgaggctccgggg

SEQ ID NO: 9386414 - DNA, 22 bp, Homo sapiens
atggctggatttgatccatggg

SEQ ID NO: 9386415 - DNA, 22 bp, Homo sapiens
atggctggcactggcctgggtt

SEQ ID NO: 9386416 - DNA, 22 bp, Homo sapiens
atggctggcactggcctgggtt

SEQ ID NO: 9386417 - DNA, 22 bp, Homo sapiens
atggctggatagttgaagctct

SEQ ID NO: 9386418 - DNA, 22 bp, Homo sapiens
atggctggatttgatccatggg

SEQ ID NO: 9386419 - DNA, 22 bp, Homo sapiens
atggctggaggccgggcttcct

SEQ ID NO: 9386420 - DNA, 22 bp, Homo sapiens
atgggtgtgaaaatggtcatct

SEQ ID NO: 9386421 - DNA, 22 bp, Homo sapiens
atggggctgaaacatggaagag

SEQ ID NO: 9386422 - DNA, 22 bp, Homo sapiens
atggtcaaggagaaacctggga

SEQ ID NO: 9386423 - DNA, 22 bp, Homo sapiens
atggtatagagccacatgtatt

SEQ ID NO: 9386424 - DNA, 22 bp, Homo sapiens
atggtataggccattgggggca

SEQ ID NO: 9386425 - DNA, 22 bp, Homo sapiens
atggtatagagccacatgtatt

SEQ ID NO: 9386426 - DNA, 22 bp, Homo sapiens
atggtatacaattatggactgt

SEQ ID NO: 9386427 - DNA, 22 bp, Homo sapiens
atggtactggggtcccggagtt

SEQ ID NO: 9386428 - DNA, 22 bp, Homo sapiens
atggtacaatgtgtgtatcttt

SEQ ID NO: 9386429 - DNA, 22 bp, Homo sapiens
atggtacagataatacatgctg

SEQ ID NO: 9386430 - DNA, 19 bp, Homo sapiens
atggtacagtgtacacttg

SEQ ID NO: 9386431 - DNA, 21 bp, Homo sapiens
atgtacattcggcaacagata

SEQ ID NO: 9386432 - DNA, 21 bp, Homo sapiens
atgtacattcggcaacagata

SEQ ID NO: 9386433 - DNA, 22 bp, Homo sapiens
atgtacattctaagtatgtgta

SEQ ID NO: 9386434 - DNA, 22 bp, Homo sapiens
atgtacattcttctcaccgaag

SEQ ID NO: 9386435 - DNA, 22 bp, Homo sapiens
atgtacattctaagtatgtgta

SEQ ID NO: 9386436 - DNA, 22 bp, Homo sapiens
atgtacatgtttaagtgaagga

SEQ ID NO: 9386437 - DNA, 22 bp, Homo sapiens
atgtacattattcgagtgatgg

SEQ ID NO: 9386438 - DNA, 22 bp, Homo sapiens
atgtacattattcgagtgatgg

SEQ ID NO: 9386439 - DNA, 22 bp, Homo sapiens
atgtacatctttataacaagct

SEQ ID NO: 9386440 - DNA, 18 bp, Homo sapiens
atgtacatgtactcacac

SEQ ID NO: 9386441 - DNA, 22 bp, Homo sapiens
atgtacatgtgaatttaggcaa

SEQ ID NO: 9386442 - DNA, 22 bp, Homo sapiens
atgtacatttagatcatttctg

SEQ ID NO: 9386443 - DNA, 18 bp, Homo sapiens
atgtacatttgctaaagc

SEQ ID NO: 9386444 - DNA, 22 bp, Homo sapiens
atgtacatttgtagtaatatca

SEQ ID NO: 9386445 - DNA, 18 bp, Homo sapiens
atgtacatttgctaaagc

SEQ ID NO: 9386446 - DNA, 22 bp, Homo sapiens
atgtacattttcctaatgtttt

SEQ ID NO: 9386447 - DNA, 22 bp, Homo sapiens
atgtacattttcctaatgtttt

SEQ ID NO: 9386448 - DNA, 22 bp, Homo sapiens
atgtacatttgtagtaatatca

SEQ ID NO: 9386449 - DNA, 22 bp, Homo sapiens
atgtacatttgtagtaatatca

SEQ ID NO: 9386450 - DNA, 22 bp, Homo sapiens
gaggagctgaggctgaggcctc

SEQ ID NO: 9386451 - DNA, 22 bp, Homo sapiens
gaggagctgcagggggagtcta

SEQ ID NO: 9386452 - DNA, 17 bp, Homo sapiens
gaggagctccagtaggt

SEQ ID NO: 9386453 - DNA, 17 bp, Homo sapiens
gaggagctccagtaggt

SEQ ID NO: 9386454 - DNA, 22 bp, Homo sapiens
gaggagctcatgaaagcggtgt

SEQ ID NO: 9386455 - DNA, 17 bp, Homo sapiens
gaggagctccagtaggt

SEQ ID NO: 9386456 - DNA, 19 bp, Homo sapiens
atgtacccagtgtcaatcc

SEQ ID NO: 9386457 - DNA, 19 bp, Homo sapiens
atgtacccagtgtcaatcc

SEQ ID NO: 9386458 - DNA, 22 bp, Homo sapiens
atgtactactacttgagtgagc

SEQ ID NO: 9386459 - DNA, 20 bp, Homo sapiens
atgtactacaggtgataaag

SEQ ID NO: 9386460 - DNA, 22 bp, Homo sapiens
atgtactaaagaaatttgcagg

SEQ ID NO: 9386461 - DNA, 22 bp, Homo sapiens
gaggccaggggagtcagcgtcc

SEQ ID NO: 9386462 - DNA, 22 bp, Homo sapiens
gaggccaggggagtcagcgtcc

SEQ ID NO: 9386463 - DNA, 22 bp, Homo sapiens
gaggccaggggagtcagcgtcc

SEQ ID NO: 9386464 - DNA, 22 bp, Homo sapiens
gaggccaggggagtcagcgtcc

SEQ ID NO: 9386465 - DNA, 22 bp, Homo sapiens
gaggccaggggcctggagatga

SEQ ID NO: 9386466 - DNA, 22 bp, Homo sapiens
gaggccagggatgcaatgagag

SEQ ID NO: 9386467 - DNA, 22 bp, Homo sapiens
gaggccagggatgcaatgagag

SEQ ID NO: 9386468 - DNA, 22 bp, Homo sapiens
gaggccagggatgcaatgagag

SEQ ID NO: 9386469 - DNA, 15 bp, Homo sapiens
gaggccaggcatgtg

SEQ ID NO: 9386470 - DNA, 22 bp, Homo sapiens
gaggccaggggcctggagatga

SEQ ID NO: 9386471 - DNA, 22 bp, Homo sapiens
gaggccaggggcctggagatga

SEQ ID NO: 9386472 - DNA, 22 bp, Homo sapiens
gaggccaggggcctggagatga

SEQ ID NO: 9386473 - DNA, 22 bp, Homo sapiens
gaggccaggggcctggagatga

SEQ ID NO: 9386474 - DNA, 22 bp, Homo sapiens
gaggccaggggcctggagatga

SEQ ID NO: 9386475 - DNA, 22 bp, Homo sapiens
gaggccaggggtcagcaattgg

SEQ ID NO: 9386476 - DNA, 22 bp, Homo sapiens
gaggccaggggtcagcaattgg

SEQ ID NO: 9386477 - DNA, 22 bp, Homo sapiens
gaggccaggggtcagcaattgg

SEQ ID NO: 9386478 - DNA, 22 bp, Homo sapiens
gaggccagggtaccatcaacat

SEQ ID NO: 9386479 - DNA, 22 bp, Homo sapiens
gaggccagggtaccatcaacat

SEQ ID NO: 9386480 - DNA, 22 bp, Homo sapiens
gaggccaggagtgctgtaagtt

SEQ ID NO: 9386481 - DNA, 22 bp, Homo sapiens
gaggccaggagtgctgtaagtt

SEQ ID NO: 9386482 - DNA, 22 bp, Homo sapiens
gaggccaggagtgctgtaagtt

SEQ ID NO: 9386483 - DNA, 22 bp, Homo sapiens
gaggccaggagtgctgtaagtt

SEQ ID NO: 9386484 - DNA, 23 bp, Homo sapiens
gaggccacattcccctgcttgag

SEQ ID NO: 9386485 - DNA, 22 bp, Homo sapiens
gaggccaccctatgggtcccag

SEQ ID NO: 9386486 - DNA, 22 bp, Homo sapiens
gaggccaggaggatctctctaa

SEQ ID NO: 9386487 - DNA, 22 bp, Homo sapiens
gaggagctgggaccctgtcatc

SEQ ID NO: 9386488 - DNA, 22 bp, Homo sapiens
gaggagctgggctgagagggtc

SEQ ID NO: 9386489 - DNA, 22 bp, Homo sapiens
gaggagctgggctgagagggtc

SEQ ID NO: 9386490 - DNA, 22 bp, Homo sapiens
gaggagctggctgtcgggaggc

SEQ ID NO: 9386491 - DNA, 22 bp, Homo sapiens
gaggagctgcccgtgtgtctgc

SEQ ID NO: 9386492 - DNA, 22 bp, Homo sapiens
gagaggaagccagggggtgttg

SEQ ID NO: 9386493 - DNA, 22 bp, Homo sapiens
gagaggaagccagggggtgttg

SEQ ID NO: 9386494 - DNA, 22 bp, Homo sapiens
gagaggaactcccagtgcctgg

SEQ ID NO: 9386495 - DNA, 22 bp, Homo sapiens
gagaggaactcccagtgcctgg

SEQ ID NO: 9386496 - DNA, 22 bp, Homo sapiens
gagaggaaagatatatacttct

SEQ ID NO: 9386497 - DNA, 22 bp, Homo sapiens
gagaggaaagatatatacttct

SEQ ID NO: 9386498 - DNA, 22 bp, Homo sapiens
gagaggaaagaaccaatgaccc

SEQ ID NO: 9386499 - DNA, 22 bp, Homo sapiens
gagaggaaagatatatacttct

SEQ ID NO: 9386500 - DNA, 22 bp, Homo sapiens
atggccagatgaaataatagag

SEQ ID NO: 9386501 - DNA, 21 bp, Homo sapiens
atggccagatctattaggtgg

SEQ ID NO: 9386502 - DNA, 22 bp, Homo sapiens
atggccagcaaggtagggcaat

SEQ ID NO: 9386503 - DNA, 22 bp, Homo sapiens
atggccagtcaagcctctggct

SEQ ID NO: 9386504 - DNA, 22 bp, Homo sapiens
atggccagattatatggttttt

SEQ ID NO: 9386505 - DNA, 22 bp, Homo sapiens
atggccagtctattcatggtta

SEQ ID NO: 9386506 - DNA, 22 bp, Homo sapiens
atggccagtctattcatggtta

SEQ ID NO: 9386507 - DNA, 22 bp, Homo sapiens
atggccagtcaagcctctggct

SEQ ID NO: 9386508 - DNA, 22 bp, Homo sapiens
atggccagtctgactagtttcc

SEQ ID NO: 9386509 - DNA, 22 bp, Homo sapiens
atggccagtctgttggacagca

SEQ ID NO: 9386510 - DNA, 22 bp, Homo sapiens
gagaggaaagaaccaatgaccc

SEQ ID NO: 9386511 - DNA, 22 bp, Homo sapiens
gagagctgtggtttgaccaggc

SEQ ID NO: 9386512 - DNA, 22 bp, Homo sapiens
gagagctgtccggctgagcagc

SEQ ID NO: 9386513 - DNA, 22 bp, Homo sapiens
gagagctgtggtttgaccaggc

SEQ ID NO: 9386514 - DNA, 22 bp, Homo sapiens
atggcagtttcactctgggatt

SEQ ID NO: 9386515 - DNA, 22 bp, Homo sapiens
atggcagctggcttgggcacct

SEQ ID NO: 9386516 - DNA, 22 bp, Homo sapiens
atggcagctggcttgggcacct

SEQ ID NO: 9386517 - DNA, 22 bp, Homo sapiens
atggcagctttcattgtccaca

SEQ ID NO: 9386518 - DNA, 22 bp, Homo sapiens
atggcagctttcattgtccaca

SEQ ID NO: 9386519 - DNA, 22 bp, Homo sapiens
atggcagctttgaatttcttga

SEQ ID NO: 9386520 - DNA, 22 bp, Homo sapiens
atggcaggatacccagtccggc

SEQ ID NO: 9386521 - DNA, 22 bp, Homo sapiens
atggcaggatacccagtccggc

SEQ ID NO: 9386522 - DNA, 22 bp, Homo sapiens
atggcaggcccaggtgttcatt

SEQ ID NO: 9386523 - DNA, 22 bp, Homo sapiens
atggcagggaccaagctgtcat

SEQ ID NO: 9386524 - DNA, 22 bp, Homo sapiens
atggcagggaccaagctgtcat

SEQ ID NO: 9386525 - DNA, 22 bp, Homo sapiens
atggcaggatgagacaacaatt

SEQ ID NO: 9386526 - DNA, 22 bp, Homo sapiens
atggcaggcccaggtgttcatt

SEQ ID NO: 9386527 - DNA, 22 bp, Homo sapiens
atggcagagggattgaacagct

SEQ ID NO: 9386528 - DNA, 22 bp, Homo sapiens
gagaacagatttttctgctgtc

SEQ ID NO: 9386529 - DNA, 22 bp, Homo sapiens
gagaacagatttttctgctgtc

SEQ ID NO: 9386530 - DNA, 22 bp, Homo sapiens
atggcagggcacagctctagtt

SEQ ID NO: 9386531 - DNA, 22 bp, Homo sapiens
atggcagggcacagctctagtt

SEQ ID NO: 9386532 - DNA, 22 bp, Homo sapiens
atggcagggcacagctctagtt

SEQ ID NO: 9386533 - DNA, 22 bp, Homo sapiens
atggcagggcacagctctagtt

SEQ ID NO: 9386534 - DNA, 22 bp, Homo sapiens
atggcagggactgtggcccttg

SEQ ID NO: 9386535 - DNA, 22 bp, Homo sapiens
atggcagggactgtggcccttg

SEQ ID NO: 9386536 - DNA, 22 bp, Homo sapiens
atggcagggcccttggctccca

SEQ ID NO: 9386537 - DNA, 22 bp, Homo sapiens
atggcagggcccttggctccca

SEQ ID NO: 9386538 - DNA, 22 bp, Homo sapiens
atggcagggcccttggctccca

SEQ ID NO: 9386539 - DNA, 22 bp, Homo sapiens
atggcagggcagcctctcagag

SEQ ID NO: 9386540 - DNA, 22 bp, Homo sapiens
atggcagggcagcctctcagag

SEQ ID NO: 9386541 - DNA, 22 bp, Homo sapiens
atggcagggtctgtcttcagct

SEQ ID NO: 9386542 - DNA, 22 bp, Homo sapiens
atggcagggtctgtcttcagct

SEQ ID NO: 9386543 - DNA, 22 bp, Homo sapiens
atggcagggtctgtcttcagct

SEQ ID NO: 9386544 - DNA, 22 bp, Homo sapiens
atggcagtgacttgaagggtag

SEQ ID NO: 9386545 - DNA, 22 bp, Homo sapiens
atggcagtgataggctagtgat

SEQ ID NO: 9386546 - DNA, 22 bp, Homo sapiens
gagccaggaagaaggccttact

SEQ ID NO: 9386547 - DNA, 22 bp, Homo sapiens
gagccaggaagaaggccttact

SEQ ID NO: 9386548 - DNA, 22 bp, Homo sapiens
gagccaggagatacctaagggg

SEQ ID NO: 9386549 - DNA, 22 bp, Homo sapiens
gagccaggagatacctaagggg

SEQ ID NO: 9386550 - DNA, 22 bp, Homo sapiens
gagccaggaggcagagactgca

SEQ ID NO: 9386551 - DNA, 22 bp, Homo sapiens
gagccaggaggcagagactgca

SEQ ID NO: 9386552 - DNA, 22 bp, Homo sapiens
gagccaggaggcagagactgca

SEQ ID NO: 9386553 - DNA, 22 bp, Homo sapiens
gagccagctatgtagcaagagg

SEQ ID NO: 9386554 - DNA, 22 bp, Homo sapiens
gagccagctgagctgcactgtc

SEQ ID NO: 9386555 - DNA, 22 bp, Homo sapiens
gagccagctacatggtctgcaa

SEQ ID NO: 9386556 - DNA, 22 bp, Homo sapiens
gagccaggcccgtacttgctgt

SEQ ID NO: 9386557 - DNA, 22 bp, Homo sapiens
gagccaggcaccttctgtgttg

SEQ ID NO: 9386558 - DNA, 22 bp, Homo sapiens
gagccaggcaccttctgtgttg

SEQ ID NO: 9386559 - DNA, 22 bp, Homo sapiens
gagccagggagggtctggtata

SEQ ID NO: 9386560 - DNA, 22 bp, Homo sapiens
atggctgccccaaattgttgct

SEQ ID NO: 9386561 - DNA, 22 bp, Homo sapiens
atggctgcccacgttggtgctt

SEQ ID NO: 9386562 - DNA, 22 bp, Homo sapiens
atggctgcccacgttggtgctt

SEQ ID NO: 9386563 - DNA, 22 bp, Homo sapiens
atggctgcatcatcctggttga

SEQ ID NO: 9386564 - DNA, 22 bp, Homo sapiens
atggctgctctggatggagtcc

SEQ ID NO: 9386565 - DNA, 19 bp, Homo sapiens
atggctgctgattggggat

SEQ ID NO: 9386566 - DNA, 22 bp, Homo sapiens
atggctgccttaattcttcagc

SEQ ID NO: 9386567 - DNA, 22 bp, Homo sapiens
atggctgcctagaggtgagatg

SEQ ID NO: 9386568 - DNA, 22 bp, Homo sapiens
atggctgcctgggcgctggccg

SEQ ID NO: 9386569 - DNA, 22 bp, Homo sapiens
atggctgcctgggcgctggccg

SEQ ID NO: 9386570 - DNA, 22 bp, Homo sapiens
atggctgcctagaggtgagatg

SEQ ID NO: 9386571 - DNA, 22 bp, Homo sapiens
atggctgcttcagtaccagttc

SEQ ID NO: 9386572 - DNA, 22 bp, Homo sapiens
atggctgcttacaaaaactgtg

SEQ ID NO: 9386573 - DNA, 22 bp, Homo sapiens
atggctgctgccttcccctgct

SEQ ID NO: 9386574 - DNA, 19 bp, Homo sapiens
atggctgctgattggggat

SEQ ID NO: 9386575 - DNA, 22 bp, Homo sapiens
atggctgctttcccttagcacc

SEQ ID NO: 9386576 - DNA, 22 bp, Homo sapiens
atggctggaagagtcgaagagt

SEQ ID NO: 9386577 - DNA, 22 bp, Homo sapiens
atggccagttagaaatcaaaaa

SEQ ID NO: 9386578 - DNA, 19 bp, Homo sapiens
atggccagtttagaggttt

SEQ ID NO: 9386579 - DNA, 19 bp, Homo sapiens
atggccagtttagaggttt

SEQ ID NO: 9386580 - DNA, 22 bp, Homo sapiens
atggccagtgtttccctcagtt

SEQ ID NO: 9386581 - DNA, 22 bp, Homo sapiens
atggccagtgtttccctcagtt

SEQ ID NO: 9386582 - DNA, 22 bp, Homo sapiens
atggccagtgtttccctcagtt

SEQ ID NO: 9386583 - DNA, 22 bp, Homo sapiens
atggccagtgttgagatcaggc

SEQ ID NO: 9386584 - DNA, 22 bp, Homo sapiens
atggccagtgttgagatcaggc

SEQ ID NO: 9386585 - DNA, 22 bp, Homo sapiens
atggccagtctgttggacagca

SEQ ID NO: 9386586 - DNA, 22 bp, Homo sapiens
atggccagtctgttggacagca

SEQ ID NO: 9386587 - DNA, 22 bp, Homo sapiens
gagcagtgactggagcatgaga

SEQ ID NO: 9386588 - DNA, 22 bp, Homo sapiens
atggccctggaaagagcttgag

SEQ ID NO: 9386589 - DNA, 22 bp, Homo sapiens
atggccctggcccagaccccac

SEQ ID NO: 9386590 - DNA, 22 bp, Homo sapiens
atggccctgctaccacttttct

SEQ ID NO: 9386591 - DNA, 22 bp, Homo sapiens
atggccctgctggtttgatcgt

SEQ ID NO: 9386592 - DNA, 22 bp, Homo sapiens
atggccctgccaggaggaacaa

SEQ ID NO: 9386593 - DNA, 22 bp, Homo sapiens
atggccctcagtccttccttgg

SEQ ID NO: 9386594 - DNA, 22 bp, Homo sapiens
atggccctctccttaggtcagc

SEQ ID NO: 9386595 - DNA, 22 bp, Homo sapiens
atggccctgaccttgatgacct

SEQ ID NO: 9386596 - DNA, 22 bp, Homo sapiens
atggccctatcacctttgcttc

SEQ ID NO: 9386597 - DNA, 22 bp, Homo sapiens
atggccctaatgagttggtgtt

SEQ ID NO: 9386598 - DNA, 22 bp, Homo sapiens
gagaacacatgcagactgggta

SEQ ID NO: 9386599 - DNA, 22 bp, Homo sapiens
gagaaatgcatgcatgtcatca

SEQ ID NO: 9386600 - DNA, 18 bp, Homo sapiens
gagaaagtttgggcagaa

SEQ ID NO: 9386601 - DNA, 18 bp, Homo sapiens
gagaaagtttgggcagaa

SEQ ID NO: 9386602 - DNA, 22 bp, Homo sapiens
atggagctctgatatatcaatt

SEQ ID NO: 9386603 - DNA, 21 bp, Homo sapiens
atggagcctaagagtggaggt

SEQ ID NO: 9386604 - DNA, 22 bp, Homo sapiens
atggagcagcagaaggggcttg

SEQ ID NO: 9386605 - DNA, 22 bp, Homo sapiens
atggagccattcctgaagactt

SEQ ID NO: 9386606 - DNA, 22 bp, Homo sapiens
atggagctgtagggagcagtgg

SEQ ID NO: 9386607 - DNA, 22 bp, Homo sapiens
atggagagtgaaagtctctcta

SEQ ID NO: 9386608 - DNA, 22 bp, Homo sapiens
atggagagagaaggcttgctgt

SEQ ID NO: 9386609 - DNA, 22 bp, Homo sapiens
atggagagagaaggcttgctgt

SEQ ID NO: 9386610 - DNA, 22 bp, Homo sapiens
atggagagtgaaagtctctcta

SEQ ID NO: 9386611 - DNA, 22 bp, Homo sapiens
atggagagttcacttctaagtt

SEQ ID NO: 9386612 - DNA, 22 bp, Homo sapiens
atggagcaaatggggctgcagg

SEQ ID NO: 9386613 - DNA, 22 bp, Homo sapiens
atggaagcagaccggaggaata

SEQ ID NO: 9386614 - DNA, 22 bp, Homo sapiens
atggaagcagacaggtaattcc

SEQ ID NO: 9386615 - DNA, 19 bp, Homo sapiens
atggaagctgggatcaatg

SEQ ID NO: 9386616 - DNA, 22 bp, Homo sapiens
atggaagctgaaaaagacacgg

SEQ ID NO: 9386617 - DNA, 20 bp, Homo sapiens
atggaagctgctcttctcct

SEQ ID NO: 9386618 - DNA, 22 bp, Homo sapiens
atggaagggacagaagggcaag

SEQ ID NO: 9386619 - DNA, 22 bp, Homo sapiens
atggaaggctttatgactcaaa

SEQ ID NO: 9386620 - DNA, 22 bp, Homo sapiens
atggaagactaacagaaacatg

SEQ ID NO: 9386621 - DNA, 22 bp, Homo sapiens
atggaagacagataaggcagaa

SEQ ID NO: 9386622 - DNA, 22 bp, Homo sapiens
atggaagacagataaggcagaa

SEQ ID NO: 9386623 - DNA, 22 bp, Homo sapiens
atggaatatttgacacataggg

SEQ ID NO: 9386624 - DNA, 22 bp, Homo sapiens
atggaatgcggtagtatgtgca

SEQ ID NO: 9386625 - DNA, 22 bp, Homo sapiens
atggaatgccaagttcactgct

SEQ ID NO: 9386626 - DNA, 22 bp, Homo sapiens
atggaatgggaagagtgtgtga

SEQ ID NO: 9386627 - DNA, 22 bp, Homo sapiens
atggaagttggaaccattcata

SEQ ID NO: 9386628 - DNA, 22 bp, Homo sapiens
atggaataattgtttcacagaa

SEQ ID NO: 9386629 - DNA, 22 bp, Homo sapiens
atggaatatagtcttatatctc

SEQ ID NO: 9386630 - DNA, 22 bp, Homo sapiens
atggactagccataagagaact

SEQ ID NO: 9386631 - DNA, 22 bp, Homo sapiens
atggactgggaggtcatcttct

SEQ ID NO: 9386632 - DNA, 22 bp, Homo sapiens
atgccacttcattccagcctcg

SEQ ID NO: 9386633 - DNA, 22 bp, Homo sapiens
atgccactgcgctctagcctgg

SEQ ID NO: 9386634 - DNA, 22 bp, Homo sapiens
atgccactgcgctctagcctgg

SEQ ID NO: 9386635 - DNA, 22 bp, Homo sapiens
atgccactgcgctctagcctgg

SEQ ID NO: 9386636 - DNA, 22 bp, Homo sapiens
atgccacttcattccagcctcg

SEQ ID NO: 9386637 - DNA, 22 bp, Homo sapiens
atgccactgcgctccagcctgg

SEQ ID NO: 9386638 - DNA, 22 bp, Homo sapiens
atgccactgcgctctagcctgg

SEQ ID NO: 9386639 - DNA, 22 bp, Homo sapiens
atgccactgcgctctagcctgg

SEQ ID NO: 9386640 - DNA, 22 bp, Homo sapiens
gacagaggcaagaccagaagcc

SEQ ID NO: 9386641 - DNA, 23 bp, Homo sapiens
gacagagtgagaccttgtcttac

SEQ ID NO: 9386642 - DNA, 23 bp, Homo sapiens
gacagagtgagaccttgtcttac

SEQ ID NO: 9386643 - DNA, 23 bp, Homo sapiens
gacagagtgagaccttgtcttac

SEQ ID NO: 9386644 - DNA, 23 bp, Homo sapiens
gacagagtgagaccttgtcttac

SEQ ID NO: 9386645 - DNA, 22 bp, Homo sapiens
atgccactgcacttcagcttgg

SEQ ID NO: 9386646 - DNA, 22 bp, Homo sapiens
atgccactgcgctccagcctgg

SEQ ID NO: 9386647 - DNA, 22 bp, Homo sapiens
atgccactgcgctccagcctgg

SEQ ID NO: 9386648 - DNA, 22 bp, Homo sapiens
atgccactgcgctccagcctgg

SEQ ID NO: 9386649 - DNA, 22 bp, Homo sapiens
gacagcaaagcagagccaaggc

SEQ ID NO: 9386650 - DNA, 22 bp, Homo sapiens
gacagatgtgggtgacagcagc

SEQ ID NO: 9386651 - DNA, 22 bp, Homo sapiens
atgccactgcacttcagcttgg

SEQ ID NO: 9386652 - DNA, 22 bp, Homo sapiens
atgccactgcacttcagcttgg

SEQ ID NO: 9386653 - DNA, 22 bp, Homo sapiens
attttctcacaatcctatgggg

SEQ ID NO: 9386654 - DNA, 22 bp, Homo sapiens
attttctctcaaaccttaaaat

SEQ ID NO: 9386655 - DNA, 22 bp, Homo sapiens
attttctctcaaaccttaaaat

SEQ ID NO: 9386656 - DNA, 22 bp, Homo sapiens
attttctctttgtatatgctag

SEQ ID NO: 9386657 - DNA, 21 bp, Homo sapiens
attttctctggatgatggtca

SEQ ID NO: 9386658 - DNA, 21 bp, Homo sapiens
attttctctggatgatggtca

SEQ ID NO: 9386659 - DNA, 21 bp, Homo sapiens
attttctctggatgatggtca

SEQ ID NO: 9386660 - DNA, 22 bp, Homo sapiens
attttctattctgctggtttag

SEQ ID NO: 9386661 - DNA, 22 bp, Homo sapiens
attttctatgttgtaattgtta

SEQ ID NO: 9386662 - DNA, 22 bp, Homo sapiens
agcaaacattcagcagattggc

SEQ ID NO: 9386663 - DNA, 22 bp, Homo sapiens
attttctatgttgtaattgtta

SEQ ID NO: 9386664 - DNA, 22 bp, Homo sapiens
agcacagagaaactaagacatt

SEQ ID NO: 9386665 - DNA, 22 bp, Homo sapiens
agcacagagaaactaagacatt

SEQ ID NO: 9386666 - DNA, 22 bp, Homo sapiens
agcacagactggtcccaggtct

SEQ ID NO: 9386667 - DNA, 23 bp, Homo sapiens
agcacagactagaaaggtctttc

SEQ ID NO: 9386668 - DNA, 21 bp, Homo sapiens
agcaatttttcctcctctgca

SEQ ID NO: 9386669 - DNA, 22 bp, Homo sapiens
agcaatttttgattttcagtgt

SEQ ID NO: 9386670 - DNA, 22 bp, Homo sapiens
agcaatttttgattttcagtgt

SEQ ID NO: 9386671 - DNA, 22 bp, Homo sapiens
attttctgtaactatttctata

SEQ ID NO: 9386672 - DNA, 22 bp, Homo sapiens
attttctgtaaaaaggcactaa

SEQ ID NO: 9386673 - DNA, 22 bp, Homo sapiens
attttctgtaactatttctata

SEQ ID NO: 9386674 - DNA, 22 bp, Homo sapiens
attttctgtaactatttctata

SEQ ID NO: 9386675 - DNA, 22 bp, Homo sapiens
attttctggttgaggtttaaca

SEQ ID NO: 9386676 - DNA, 22 bp, Homo sapiens
attttctgagtccagaatttac

SEQ ID NO: 9386677 - DNA, 22 bp, Homo sapiens
attttctgagcacgtgacagca

SEQ ID NO: 9386678 - DNA, 22 bp, Homo sapiens
agcacagatttgtcaacataga

SEQ ID NO: 9386679 - DNA, 22 bp, Homo sapiens
agcacagatttgtcaacataga

SEQ ID NO: 9386680 - DNA, 22 bp, Homo sapiens
agcacagattctgaagagtcct

SEQ ID NO: 9386681 - DNA, 22 bp, Homo sapiens
agcacagatgtgagtggaggct

SEQ ID NO: 9386682 - DNA, 22 bp, Homo sapiens
agcacagagttgctcactgccg

SEQ ID NO: 9386683 - DNA, 22 bp, Homo sapiens
agcacagataacatggagtgga

SEQ ID NO: 9386684 - DNA, 22 bp, Homo sapiens
agcacagatgtactttgagggg

SEQ ID NO: 9386685 - DNA, 22 bp, Homo sapiens
agcacagatggatgtattcatt

SEQ ID NO: 9386686 - DNA, 22 bp, Homo sapiens
agcacagagttgcagagagcgt

SEQ ID NO: 9386687 - DNA, 22 bp, Homo sapiens
agcacagagttgcagagagcgt

SEQ ID NO: 9386688 - DNA, 22 bp, Homo sapiens
agcacagagaagatttcaatta

SEQ ID NO: 9386689 - DNA, 22 bp, Homo sapiens
agcacagagagctctaggtaaa

SEQ ID NO: 9386690 - DNA, 22 bp, Homo sapiens
agcacagagagctctaggtaaa

SEQ ID NO: 9386691 - DNA, 19 bp, Homo sapiens
agcacagagagtctatagc

SEQ ID NO: 9386692 - DNA, 22 bp, Homo sapiens
agcacagagattatttacaaga

SEQ ID NO: 9386693 - DNA, 22 bp, Homo sapiens
caaatgcaggtcagcaggtgtc

SEQ ID NO: 9386694 - DNA, 22 bp, Homo sapiens
caaatgcaggtcataacctgag

SEQ ID NO: 9386695 - DNA, 22 bp, Homo sapiens
caaatgcaggtcagcaggtgtc

SEQ ID NO: 9386696 - DNA, 22 bp, Homo sapiens
caaatgcagattcaggagttct

SEQ ID NO: 9386697 - DNA, 22 bp, Homo sapiens
caaatgcatagaaagatgaaac

SEQ ID NO: 9386698 - DNA, 22 bp, Homo sapiens
caaatgttaaatgtgttaagac

SEQ ID NO: 9386699 - DNA, 22 bp, Homo sapiens
caaatgatactgtttttagtct

SEQ ID NO: 9386700 - DNA, 22 bp, Homo sapiens
caaatgatacctattactaggc

SEQ ID NO: 9386701 - DNA, 22 bp, Homo sapiens
caaatattccaggtacatccct

SEQ ID NO: 9386702 - DNA, 22 bp, Homo sapiens
caaatgatactgtttttagtct

SEQ ID NO: 9386703 - DNA, 22 bp, Homo sapiens
caaatgatactgtttttagtct

SEQ ID NO: 9386704 - DNA, 22 bp, Homo sapiens
agcacagcctctggtttctgac

SEQ ID NO: 9386705 - DNA, 22 bp, Homo sapiens
agcacagcctctggtttctgac

SEQ ID NO: 9386706 - DNA, 22 bp, Homo sapiens
agcagaagaaagccacatgact

SEQ ID NO: 9386707 - DNA, 22 bp, Homo sapiens
agcagaagaaagccacatgact

SEQ ID NO: 9386708 - DNA, 22 bp, Homo sapiens
agcagaagtgccttagcaatca

SEQ ID NO: 9386709 - DNA, 17 bp, Homo sapiens
agcagaagtcagaggga

SEQ ID NO: 9386710 - DNA, 17 bp, Homo sapiens
agcagaagtcagaggga

SEQ ID NO: 9386711 - DNA, 17 bp, Homo sapiens
agcagaagtcagaggga

SEQ ID NO: 9386712 - DNA, 22 bp, Homo sapiens
agcagaagaaagccacatgact

SEQ ID NO: 9386713 - DNA, 22 bp, Homo sapiens
agcagaagaggtcttgttgctg

SEQ ID NO: 9386714 - DNA, 22 bp, Homo sapiens
caaatgtttcttgaacaccaac

SEQ ID NO: 9386715 - DNA, 22 bp, Homo sapiens
caaatgtttgcatcacagggca

SEQ ID NO: 9386716 - DNA, 22 bp, Homo sapiens
caaatgttttttagtataagta

SEQ ID NO: 9386717 - DNA, 22 bp, Homo sapiens
caaatgtttttattctacaaca

SEQ ID NO: 9386718 - DNA, 22 bp, Homo sapiens
caaatgttagtgcccatccctc

SEQ ID NO: 9386719 - DNA, 22 bp, Homo sapiens
caaatgttaagacaggatcaag

SEQ ID NO: 9386720 - DNA, 22 bp, Homo sapiens
caaatgttgactaagagggttt

SEQ ID NO: 9386721 - DNA, 22 bp, Homo sapiens
caatcttagagagattctttta

SEQ ID NO: 9386722 - DNA, 22 bp, Homo sapiens
caatgaaattgagatccagaga

SEQ ID NO: 9386723 - DNA, 22 bp, Homo sapiens
agcagcatggatgggcctcagc

SEQ ID NO: 9386724 - DNA, 22 bp, Homo sapiens
agcagcatgttcattacattat

SEQ ID NO: 9386725 - DNA, 22 bp, Homo sapiens
agcagcattaagggaactgcag

SEQ ID NO: 9386726 - DNA, 22 bp, Homo sapiens
agcagcattcctggcttctatc

SEQ ID NO: 9386727 - DNA, 22 bp, Homo sapiens
agcagcagggtgtaattgggca

SEQ ID NO: 9386728 - DNA, 22 bp, Homo sapiens
agcagcaggtgacctcgatgcc

SEQ ID NO: 9386729 - DNA, 22 bp, Homo sapiens
agcagcatattgtgtcttcata

SEQ ID NO: 9386730 - DNA, 22 bp, Homo sapiens
agcagcatccccggcctccacc

SEQ ID NO: 9386731 - DNA, 22 bp, Homo sapiens
caaggcaggtctgaggaggttg

SEQ ID NO: 9386732 - DNA, 22 bp, Homo sapiens
caaggcaggtctgaggaggttg

SEQ ID NO: 9386733 - DNA, 22 bp, Homo sapiens
caaggcagtccctactccctgc

SEQ ID NO: 9386734 - DNA, 22 bp, Homo sapiens
caaggcaggtctgaggaggttg

SEQ ID NO: 9386735 - DNA, 22 bp, Homo sapiens
caaggcaggtctgaggaggttg

SEQ ID NO: 9386736 - DNA, 22 bp, Homo sapiens
caaggcagtgggctaggaacct

SEQ ID NO: 9386737 - DNA, 22 bp, Homo sapiens
caaggcagtccctactccctgc

SEQ ID NO: 9386738 - DNA, 22 bp, Homo sapiens
agcagcagaaagttgatggcag

SEQ ID NO: 9386739 - DNA, 22 bp, Homo sapiens
agcagcagaaagttgatggcag

SEQ ID NO: 9386740 - DNA, 22 bp, Homo sapiens
agcagcacatggggctggcaac

SEQ ID NO: 9386741 - DNA, 22 bp, Homo sapiens
agcagcacatggggctggcaac

SEQ ID NO: 9386742 - DNA, 22 bp, Homo sapiens
caaggcaggaagcctgtcttat

SEQ ID NO: 9386743 - DNA, 22 bp, Homo sapiens
agcagcagaaggtttgcaccca

SEQ ID NO: 9386744 - DNA, 22 bp, Homo sapiens
agcagcagaaggtttgcaccca

SEQ ID NO: 9386745 - DNA, 22 bp, Homo sapiens
agcagcagaaagttgatggcag

SEQ ID NO: 9386746 - DNA, 22 bp, Homo sapiens
agcagcagaagggagacccagg

SEQ ID NO: 9386747 - DNA, 22 bp, Homo sapiens
agcagcagaagggagacccagg

SEQ ID NO: 9386748 - DNA, 22 bp, Homo sapiens
agcagcagaagggagacccagg

SEQ ID NO: 9386749 - DNA, 22 bp, Homo sapiens
agcagcagaagggagacccagg

SEQ ID NO: 9386750 - DNA, 22 bp, Homo sapiens
agcagcagaagggagacccagg

SEQ ID NO: 9386751 - DNA, 22 bp, Homo sapiens
agcagcaagcagtgcacgggtt

SEQ ID NO: 9386752 - DNA, 22 bp, Homo sapiens
agcagcaatggaaagcaacaca

SEQ ID NO: 9386753 - DNA, 22 bp, Homo sapiens
caactcctccccagcatgccaa

SEQ ID NO: 9386754 - DNA, 22 bp, Homo sapiens
caactgaaaagattctacgcag

SEQ ID NO: 9386755 - DNA, 22 bp, Homo sapiens
caactcctggctgttaggcaca

SEQ ID NO: 9386756 - DNA, 22 bp, Homo sapiens
caactgagaaatattgctgacg

SEQ ID NO: 9386757 - DNA, 22 bp, Homo sapiens
caactgaactgatatcaactat

SEQ ID NO: 9386758 - DNA, 22 bp, Homo sapiens
caactgaggtctcagccaatta

SEQ ID NO: 9386759 - DNA, 22 bp, Homo sapiens
caactgagcagtagcgtctgga

SEQ ID NO: 9386760 - DNA, 22 bp, Homo sapiens
caactgccatacagctccatgg

SEQ ID NO: 9386761 - DNA, 19 bp, Homo sapiens
caactgccccctcaaacat

SEQ ID NO: 9386762 - DNA, 22 bp, Homo sapiens
caactgctgacaccatcactcc

SEQ ID NO: 9386763 - DNA, 22 bp, Homo sapiens
caactgtgaattttatgatacc

SEQ ID NO: 9386764 - DNA, 22 bp, Homo sapiens
caactgtgaattttatgatacc

SEQ ID NO: 9386765 - DNA, 22 bp, Homo sapiens
agcagacaacccagatgaccca

SEQ ID NO: 9386766 - DNA, 22 bp, Homo sapiens
agcagacaattgcctggatgga

SEQ ID NO: 9386767 - DNA, 22 bp, Homo sapiens
agcagaagtgccttagcaatca

SEQ ID NO: 9386768 - DNA, 22 bp, Homo sapiens
agcagaagtgccttagcaatca

SEQ ID NO: 9386769 - DNA, 22 bp, Homo sapiens
agcagaatctgtccttggaaga

SEQ ID NO: 9386770 - DNA, 22 bp, Homo sapiens
agcagaatggggctgggaatag

SEQ ID NO: 9386771 - DNA, 22 bp, Homo sapiens
agcagaatgtgtgtgacaagta

SEQ ID NO: 9386772 - DNA, 22 bp, Homo sapiens
agcagaatggggctgggaatag

SEQ ID NO: 9386773 - DNA, 22 bp, Homo sapiens
agcagacaattgcctggatgga

SEQ ID NO: 9386774 - DNA, 22 bp, Homo sapiens
agcagacaattgcctggatgga

SEQ ID NO: 9386775 - DNA, 21 bp, Homo sapiens
agcagacacttgtgaccttcc

SEQ ID NO: 9386776 - DNA, 22 bp, Homo sapiens
agcagacaccaggagtaaagaa

SEQ ID NO: 9386777 - DNA, 22 bp, Homo sapiens
cacaggaagctgactgctggca

SEQ ID NO: 9386778 - DNA, 22 bp, Homo sapiens
agcagcttctttcactcctgga

SEQ ID NO: 9386779 - DNA, 22 bp, Homo sapiens
cacaggaagctgactgctggca

SEQ ID NO: 9386780 - DNA, 22 bp, Homo sapiens
agcagcttcaattttctaagtg

SEQ ID NO: 9386781 - DNA, 22 bp, Homo sapiens
agcagcttcaattttctaagtg

SEQ ID NO: 9386782 - DNA, 22 bp, Homo sapiens
agcagcttcagaggcgggcgca

SEQ ID NO: 9386783 - DNA, 22 bp, Homo sapiens
agcagcttcctgctcttcgcct

SEQ ID NO: 9386784 - DNA, 22 bp, Homo sapiens
agcagcttctattttcttggtt

SEQ ID NO: 9386785 - DNA, 22 bp, Homo sapiens
agcagcttctattttcttggtt

SEQ ID NO: 9386786 - DNA, 22 bp, Homo sapiens
agcagcttcctgtttgcaggca

SEQ ID NO: 9386787 - DNA, 22 bp, Homo sapiens
agcagcttcctgtttgcaggca

SEQ ID NO: 9386788 - DNA, 22 bp, Homo sapiens
cacaggagctgtggggcagtgt

SEQ ID NO: 9386789 - DNA, 22 bp, Homo sapiens
cacaggagctgtggggcagtgt

SEQ ID NO: 9386790 - DNA, 22 bp, Homo sapiens
cacaggagccctgaggcctccc

SEQ ID NO: 9386791 - DNA, 22 bp, Homo sapiens
cacaggagccctgaggcctccc

SEQ ID NO: 9386792 - DNA, 18 bp, Homo sapiens
cacaggagccacactcac

SEQ ID NO: 9386793 - DNA, 22 bp, Homo sapiens
cacaggaaggccttctcacaat

SEQ ID NO: 9386794 - DNA, 22 bp, Homo sapiens
agcagctgtttgttgaattggt

SEQ ID NO: 9386795 - DNA, 22 bp, Homo sapiens
agcagctgtttgttgaattggt

SEQ ID NO: 9386796 - DNA, 22 bp, Homo sapiens
agcagcttacatgtggcctatc

SEQ ID NO: 9386797 - DNA, 22 bp, Homo sapiens
agcagcttacatgtggcctatc

SEQ ID NO: 9386798 - DNA, 19 bp, Homo sapiens
agcagcttaattttgtagc

SEQ ID NO: 9386799 - DNA, 22 bp, Homo sapiens
agcagcttagggaattctccct

SEQ ID NO: 9386800 - DNA, 22 bp, Homo sapiens
agcagcttatcttggagaggca

SEQ ID NO: 9386801 - DNA, 22 bp, Homo sapiens
agcagcttagggaattctccct

SEQ ID NO: 9386802 - DNA, 22 bp, Homo sapiens
agcagctgggctcagagctggg

SEQ ID NO: 9386803 - DNA, 22 bp, Homo sapiens
agcagctgggctcagagctggg

SEQ ID NO: 9386804 - DNA, 22 bp, Homo sapiens
agcagctgtactttcatctgtt

SEQ ID NO: 9386805 - DNA, 19 bp, Homo sapiens
agcagctgtagatagacac

SEQ ID NO: 9386806 - DNA, 22 bp, Homo sapiens
agcagctgtgggcaatatgtaa

SEQ ID NO: 9386807 - DNA, 22 bp, Homo sapiens
agcagctgtgggcaatatgtaa

SEQ ID NO: 9386808 - DNA, 18 bp, Homo sapiens
agcagctgtgccacactg

SEQ ID NO: 9386809 - DNA, 22 bp, Homo sapiens
agcagctgtcccttaacatcag

SEQ ID NO: 9386810 - DNA, 22 bp, Homo sapiens
agcaggagagcagtgcgtggtc

SEQ ID NO: 9386811 - DNA, 22 bp, Homo sapiens
agcaggagagcagtgcgtggtc

SEQ ID NO: 9386812 - DNA, 22 bp, Homo sapiens
agcaggagagcagtgcgtggtc

SEQ ID NO: 9386813 - DNA, 22 bp, Homo sapiens
agcaggagacatgggggtggtg

SEQ ID NO: 9386814 - DNA, 22 bp, Homo sapiens
agcaggagaacactgtggctct

SEQ ID NO: 9386815 - DNA, 22 bp, Homo sapiens
agcaggagacatgggggtggtg

SEQ ID NO: 9386816 - DNA, 22 bp, Homo sapiens
agcaggagacatgggggtggtg

SEQ ID NO: 9386817 - DNA, 22 bp, Homo sapiens
agcaggagatggggcgtgatgt

SEQ ID NO: 9386818 - DNA, 22 bp, Homo sapiens
agcaggagatggggcgtgatgt

SEQ ID NO: 9386819 - DNA, 22 bp, Homo sapiens
agcaggagatggggcgtgatgt

SEQ ID NO: 9386820 - DNA, 22 bp, Homo sapiens
agcaggagagcagtgcgtggtc

SEQ ID NO: 9386821 - DNA, 22 bp, Homo sapiens
agcaggagagcagtgcgtggtc

SEQ ID NO: 9386822 - DNA, 22 bp, Homo sapiens
agcaggagcatttccatgattc

SEQ ID NO: 9386823 - DNA, 22 bp, Homo sapiens
agcaggagatggggcgtgatgt

SEQ ID NO: 9386824 - DNA, 22 bp, Homo sapiens
agcaggagcatttccatgattc

SEQ ID NO: 9386825 - DNA, 22 bp, Homo sapiens
agcaggagatggggcgtgatgt

SEQ ID NO: 9386826 - DNA, 22 bp, Homo sapiens
cacaggctgcccgcagctggga

SEQ ID NO: 9386827 - DNA, 22 bp, Homo sapiens
agcaggagcatttccatgattc

SEQ ID NO: 9386828 - DNA, 22 bp, Homo sapiens
agcaggagcatttccatgattc

SEQ ID NO: 9386829 - DNA, 22 bp, Homo sapiens
cacaggagggagcgggcagcca

SEQ ID NO: 9386830 - DNA, 22 bp, Homo sapiens
cacaggaggttaggaagtggtc

SEQ ID NO: 9386831 - DNA, 22 bp, Homo sapiens
agcaggagaacactgtggctct

SEQ ID NO: 9386832 - DNA, 18 bp, Homo sapiens
agcaggactgtggggtgg

SEQ ID NO: 9386833 - DNA, 22 bp, Homo sapiens
agcaggagaacactgtggctct

SEQ ID NO: 9386834 - DNA, 22 bp, Homo sapiens
cacaggaggaggtgcccgggcc

SEQ ID NO: 9386835 - DNA, 22 bp, Homo sapiens
cacaggagggagcgggcagcca

SEQ ID NO: 9386836 - DNA, 22 bp, Homo sapiens
cacaggaggcaatggtaagatt

SEQ ID NO: 9386837 - DNA, 22 bp, Homo sapiens
cacaggaggaggccagagcgta

SEQ ID NO: 9386838 - DNA, 22 bp, Homo sapiens
cacagggccactttcccagtaa

SEQ ID NO: 9386839 - DNA, 22 bp, Homo sapiens
cacagggcctggggcagctgct

SEQ ID NO: 9386840 - DNA, 22 bp, Homo sapiens
cacagggcctggggcagctgct

SEQ ID NO: 9386841 - DNA, 22 bp, Homo sapiens
cacagggccttgtgtgactgca

SEQ ID NO: 9386842 - DNA, 22 bp, Homo sapiens
cacagggccttgtgtgactgca

SEQ ID NO: 9386843 - DNA, 19 bp, Homo sapiens
cacagggcaggtctcatgt

SEQ ID NO: 9386844 - DNA, 22 bp, Homo sapiens
cacagggcagtgattgtccaca

SEQ ID NO: 9386845 - DNA, 22 bp, Homo sapiens
cacagggcagtgattgtccaca

SEQ ID NO: 9386846 - DNA, 22 bp, Homo sapiens
cacagggctaaatgaagggttg

SEQ ID NO: 9386847 - DNA, 22 bp, Homo sapiens
cacagggctttgatggctgagt

SEQ ID NO: 9386848 - DNA, 22 bp, Homo sapiens
cacagggcttctcatggggtgc

SEQ ID NO: 9386849 - DNA, 22 bp, Homo sapiens
cacagggctttgatggctgagt

SEQ ID NO: 9386850 - DNA, 22 bp, Homo sapiens
cacagggctttgatggctgagt

SEQ ID NO: 9386851 - DNA, 22 bp, Homo sapiens
cacagtatgatctaaagtaagt

SEQ ID NO: 9386852 - DNA, 21 bp, Homo sapiens
agcaggtgctgttggaggaaa

SEQ ID NO: 9386853 - DNA, 18 bp, Homo sapiens
agcaggtgctgtttcttt

SEQ ID NO: 9386854 - DNA, 21 bp, Homo sapiens
agcaggtgctgttggaggaaa

SEQ ID NO: 9386855 - DNA, 22 bp, Homo sapiens
agcaggtggaaaattcttatca

SEQ ID NO: 9386856 - DNA, 18 bp, Homo sapiens
agcaggtgctgtttcttt

SEQ ID NO: 9386857 - DNA, 22 bp, Homo sapiens
agcaggtgcgttacttcactct

SEQ ID NO: 9386858 - DNA, 22 bp, Homo sapiens
agcaggtgcgttacttcactct

SEQ ID NO: 9386859 - DNA, 22 bp, Homo sapiens
agcaggtgccaggtgtacccgc

SEQ ID NO: 9386860 - DNA, 21 bp, Homo sapiens
agcaggtgctgttggaggaaa

SEQ ID NO: 9386861 - DNA, 21 bp, Homo sapiens
agcaggtgctgttggaggaaa

SEQ ID NO: 9386862 - DNA, 22 bp, Homo sapiens
agcaggtgccaggtgtacccgc

SEQ ID NO: 9386863 - DNA, 22 bp, Homo sapiens
agcaggtgcgttacttcactct

SEQ ID NO: 9386864 - DNA, 22 bp, Homo sapiens
agcaggtggacagaggaagaaa

SEQ ID NO: 9386865 - DNA, 22 bp, Homo sapiens
agcaggtggaaaattcttatca

SEQ ID NO: 9386866 - DNA, 22 bp, Homo sapiens
caccagggacaatgctaggggt

SEQ ID NO: 9386867 - DNA, 22 bp, Homo sapiens
caccagggacaatgctaggggt

SEQ ID NO: 9386868 - DNA, 22 bp, Homo sapiens
agcaggtggacagaggaagaaa

SEQ ID NO: 9386869 - DNA, 22 bp, Homo sapiens
caccaggctggagtgcagtggc

SEQ ID NO: 9386870 - DNA, 22 bp, Homo sapiens
caccagggcagcagcctagtct

SEQ ID NO: 9386871 - DNA, 22 bp, Homo sapiens
caccagggctctgagctctgaa

SEQ ID NO: 9386872 - DNA, 22 bp, Homo sapiens
caccaggtgctggaggacatca

SEQ ID NO: 9386873 - DNA, 22 bp, Homo sapiens
agcataagttggtacagccact

SEQ ID NO: 9386874 - DNA, 22 bp, Homo sapiens
agcataagttggtacagccact

SEQ ID NO: 9386875 - DNA, 22 bp, Homo sapiens
agcataagttggtacagccact

SEQ ID NO: 9386876 - DNA, 22 bp, Homo sapiens
agcataagttggtacagccact

SEQ ID NO: 9386877 - DNA, 22 bp, Homo sapiens
cactctggggatgcaaggagag

SEQ ID NO: 9386878 - DNA, 22 bp, Homo sapiens
cactctgggctcttgtttcaga

SEQ ID NO: 9386879 - DNA, 22 bp, Homo sapiens
cactctggttagtttaagcatg

SEQ ID NO: 9386880 - DNA, 22 bp, Homo sapiens
cactctggccactgctaaaggc

SEQ ID NO: 9386881 - DNA, 22 bp, Homo sapiens
cactctgcagctgaagggctgg

SEQ ID NO: 9386882 - DNA, 22 bp, Homo sapiens
agcataaactcagggacacaca

SEQ ID NO: 9386883 - DNA, 22 bp, Homo sapiens
agcagggctcacattagtggat

SEQ ID NO: 9386884 - DNA, 16 bp, Homo sapiens
agcagggcgggaagga

SEQ ID NO: 9386885 - DNA, 16 bp, Homo sapiens
agcagggcgggaagga

SEQ ID NO: 9386886 - DNA, 22 bp, Homo sapiens
agcagggcctggcactcctggg

SEQ ID NO: 9386887 - DNA, 22 bp, Homo sapiens
agcagggcctggcactcctggg

SEQ ID NO: 9386888 - DNA, 22 bp, Homo sapiens
agcagggcctggcactcctggg

SEQ ID NO: 9386889 - DNA, 22 bp, Homo sapiens
agcagggcctgagtgacctaac

SEQ ID NO: 9386890 - DNA, 22 bp, Homo sapiens
agcagggcctgagtgacctaac

SEQ ID NO: 9386891 - DNA, 22 bp, Homo sapiens
agcagggctccatttcactgcc

SEQ ID NO: 9386892 - DNA, 22 bp, Homo sapiens
agcagggctcctgaaagccgcg

SEQ ID NO: 9386893 - DNA, 22 bp, Homo sapiens
agcagggctccatttcactgcc

SEQ ID NO: 9386894 - DNA, 22 bp, Homo sapiens
agcagggctcacattagtggat

SEQ ID NO: 9386895 - DNA, 22 bp, Homo sapiens
agcagggctctgccatgggccc

SEQ ID NO: 9386896 - DNA, 22 bp, Homo sapiens
agcagggctctgccatgggccc

SEQ ID NO: 9386897 - DNA, 22 bp, Homo sapiens
agcagggcctgagtgacctaac

SEQ ID NO: 9386898 - DNA, 22 bp, Homo sapiens
agcagggcagtgcttcagctct

SEQ ID NO: 9386899 - DNA, 22 bp, Homo sapiens
cacagtcccattcgagagtaat

SEQ ID NO: 9386900 - DNA, 22 bp, Homo sapiens
cacagtcccattcgagagtaat

SEQ ID NO: 9386901 - DNA, 22 bp, Homo sapiens
cacagtccagactcctggagtt

SEQ ID NO: 9386902 - DNA, 22 bp, Homo sapiens
cacagtccagactcctggagtt

SEQ ID NO: 9386903 - DNA, 22 bp, Homo sapiens
cacagtccagactcctggagtt

SEQ ID NO: 9386904 - DNA, 22 bp, Homo sapiens
cacagtccagactcctggagtt

SEQ ID NO: 9386905 - DNA, 22 bp, Homo sapiens
cacagtcaccttatcaggatgt

SEQ ID NO: 9386906 - DNA, 22 bp, Homo sapiens
cacatctatggagacagagagt

SEQ ID NO: 9386907 - DNA, 22 bp, Homo sapiens
cacatctagcttacaaaacagg

SEQ ID NO: 9386908 - DNA, 22 bp, Homo sapiens
cacatctatggagacagagagt

SEQ ID NO: 9386909 - DNA, 22 bp, Homo sapiens
cacatctatagggacagcaaca

SEQ ID NO: 9386910 - DNA, 22 bp, Homo sapiens
cacatccttcagctgagcccag

SEQ ID NO: 9386911 - DNA, 22 bp, Homo sapiens
cacatccttcatactcagctct

SEQ ID NO: 9386912 - DNA, 22 bp, Homo sapiens
cacatctactgaatgagcagtg

SEQ ID NO: 9386913 - DNA, 22 bp, Homo sapiens
cacatccttcatactcagctct

SEQ ID NO: 9386914 - DNA, 22 bp, Homo sapiens
cacatctactgatattccagga

SEQ ID NO: 9386915 - DNA, 22 bp, Homo sapiens
cacatatttgatgaagctttgt

SEQ ID NO: 9386916 - DNA, 22 bp, Homo sapiens
cacatattgtagttcaccagga

SEQ ID NO: 9386917 - DNA, 22 bp, Homo sapiens
cacatcattcaatggtgatatt

SEQ ID NO: 9386918 - DNA, 21 bp, Homo sapiens
agcaggtctacaggttcatag

SEQ ID NO: 9386919 - DNA, 22 bp, Homo sapiens
agcaggtgatcgcgtgtgctcc

SEQ ID NO: 9386920 - DNA, 22 bp, Homo sapiens
agcaggtgatcgcgtgtgctcc

SEQ ID NO: 9386921 - DNA, 22 bp, Homo sapiens
agcaggtgatgtgagtctggaa

SEQ ID NO: 9386922 - DNA, 22 bp, Homo sapiens
agcaggtgatgtgagtctggaa

SEQ ID NO: 9386923 - DNA, 22 bp, Homo sapiens
agcaggtgcatggcgagcgcgg

SEQ ID NO: 9386924 - DNA, 22 bp, Homo sapiens
agcaggtgccaggtgtacccgc

SEQ ID NO: 9386925 - DNA, 22 bp, Homo sapiens
agcaggtgcatggcgagcgcgg

SEQ ID NO: 9386926 - DNA, 22 bp, Homo sapiens
agcaggtgatgtgagtctggaa

SEQ ID NO: 9386927 - DNA, 22 bp, Homo sapiens
agcaggtgatgtgagtctggaa

SEQ ID NO: 9386928 - DNA, 22 bp, Homo sapiens
cacatcttccagagtagctaaa

SEQ ID NO: 9386929 - DNA, 22 bp, Homo sapiens
agccaggatggtctcgatcggc

SEQ ID NO: 9386930 - DNA, 22 bp, Homo sapiens
agccaggatggtctcgatcggc

SEQ ID NO: 9386931 - DNA, 22 bp, Homo sapiens
agccaggatggtctcgatcggc

SEQ ID NO: 9386932 - DNA, 22 bp, Homo sapiens
agccaggatcacccggggctgt

SEQ ID NO: 9386933 - DNA, 22 bp, Homo sapiens
agccaggacatctctagctgct

SEQ ID NO: 9386934 - DNA, 22 bp, Homo sapiens
agccaggacatctctagctgct

SEQ ID NO: 9386935 - DNA, 22 bp, Homo sapiens
agccagctgcctttcacatctg

SEQ ID NO: 9386936 - DNA, 22 bp, Homo sapiens
cagaagctggtacaaggcctag

SEQ ID NO: 9386937 - DNA, 22 bp, Homo sapiens
cagacagacagccgtggccacc

SEQ ID NO: 9386938 - DNA, 22 bp, Homo sapiens
cagacagacagccgtggccacc

SEQ ID NO: 9386939 - DNA, 22 bp, Homo sapiens
agccaggcagggctctcgctct

SEQ ID NO: 9386940 - DNA, 22 bp, Homo sapiens
agccaggcagggctctcgctct

SEQ ID NO: 9386941 - DNA, 22 bp, Homo sapiens
agccaggcagggctctcgctct

SEQ ID NO: 9386942 - DNA, 21 bp, Homo sapiens
agccaggcaagcacccccact

SEQ ID NO: 9386943 - DNA, 22 bp, Homo sapiens
agccaggattggctgagcctta

SEQ ID NO: 9386944 - DNA, 22 bp, Homo sapiens
agccaggcagactctctttctt

SEQ ID NO: 9386945 - DNA, 22 bp, Homo sapiens
agccaggcagactctctttctt

SEQ ID NO: 9386946 - DNA, 21 bp, Homo sapiens
agccaggcaagcacccccact

SEQ ID NO: 9386947 - DNA, 22 bp, Homo sapiens
agccaggattggctgagcctta

SEQ ID NO: 9386948 - DNA, 22 bp, Homo sapiens
cagaagcattccagcaaatagt

SEQ ID NO: 9386949 - DNA, 22 bp, Homo sapiens
cagaagcattccagcaaatagt

SEQ ID NO: 9386950 - DNA, 22 bp, Homo sapiens
cagaagcagtgagagatgtgca

SEQ ID NO: 9386951 - DNA, 22 bp, Homo sapiens
cagaagcctaaatagtgcacca

SEQ ID NO: 9386952 - DNA, 22 bp, Homo sapiens
cagaagcattgactccttgctc

SEQ ID NO: 9386953 - DNA, 22 bp, Homo sapiens
cagaagctggtacaaggcctag

SEQ ID NO: 9386954 - DNA, 19 bp, Homo sapiens
cagaagctgcagtcggata

SEQ ID NO: 9386955 - DNA, 22 bp, Homo sapiens
cagaagcctgcctcagatgcac

SEQ ID NO: 9386956 - DNA, 22 bp, Homo sapiens
cagaagaatggtgtctgagctc

SEQ ID NO: 9386957 - DNA, 22 bp, Homo sapiens
cagaagacagctgtttcactcg

SEQ ID NO: 9386958 - DNA, 22 bp, Homo sapiens
cagaacttcatattgacgttag

SEQ ID NO: 9386959 - DNA, 22 bp, Homo sapiens
cagaacttggcaaagccgactg

SEQ ID NO: 9386960 - DNA, 22 bp, Homo sapiens
agccacagagagggagctgcaa

SEQ ID NO: 9386961 - DNA, 19 bp, Homo sapiens
agccacagaacttgcagga

SEQ ID NO: 9386962 - DNA, 19 bp, Homo sapiens
agccacagaacttgcagga

SEQ ID NO: 9386963 - DNA, 22 bp, Homo sapiens
agccacacttgccaggggaagg

SEQ ID NO: 9386964 - DNA, 19 bp, Homo sapiens
agccacagaacttgcagga

SEQ ID NO: 9386965 - DNA, 22 bp, Homo sapiens
agccacagagcaggagaccttt

SEQ ID NO: 9386966 - DNA, 22 bp, Homo sapiens
agccacacagcttaatgacaga

SEQ ID NO: 9386967 - DNA, 22 bp, Homo sapiens
agccacacctgtcctgccagct

SEQ ID NO: 9386968 - DNA, 22 bp, Homo sapiens
cactgaaacaggtattgctggt

SEQ ID NO: 9386969 - DNA, 22 bp, Homo sapiens
cactctggttctgaacaggatc

SEQ ID NO: 9386970 - DNA, 22 bp, Homo sapiens
cactgaaatattaatatcttat

SEQ ID NO: 9386971 - DNA, 22 bp, Homo sapiens
cactgaaatcgaaaaatgtagg

SEQ ID NO: 9386972 - DNA, 22 bp, Homo sapiens
cactgaaaggcaatgctgacag

SEQ ID NO: 9386973 - DNA, 22 bp, Homo sapiens
agccacagcctgacttaactgt

SEQ ID NO: 9386974 - DNA, 22 bp, Homo sapiens
agccacagcctgacttaactgt

SEQ ID NO: 9386975 - DNA, 22 bp, Homo sapiens
agccacagcccacaggactctt

SEQ ID NO: 9386976 - DNA, 22 bp, Homo sapiens
agccacagcatgtgtgtatgta

SEQ ID NO: 9386977 - DNA, 23 bp, Homo sapiens
agccacagccagagctatctcca

SEQ ID NO: 9386978 - DNA, 22 bp, Homo sapiens
agccacagcccacaggactctt

SEQ ID NO: 9386979 - DNA, 22 bp, Homo sapiens
agccacagcacattgtaagaaa

SEQ ID NO: 9386980 - DNA, 22 bp, Homo sapiens
agccacagcacattgtaagaaa

SEQ ID NO: 9386981 - DNA, 22 bp, Homo sapiens
agccacagcaacaagtgcaatt

SEQ ID NO: 9386982 - DNA, 22 bp, Homo sapiens
agccacagcacattgtaagaaa

SEQ ID NO: 9386983 - DNA, 22 bp, Homo sapiens
agccacagctccttggtggaga

SEQ ID NO: 9386984 - DNA, 22 bp, Homo sapiens
agccacagcctgacttaactgt

SEQ ID NO: 9386985 - DNA, 22 bp, Homo sapiens
cagaacattgttttctcatctg

SEQ ID NO: 9386986 - DNA, 22 bp, Homo sapiens
cagagatgggtcgcagagatgg

SEQ ID NO: 9386987 - DNA, 22 bp, Homo sapiens
cagagatgggtcgcagagatgg

SEQ ID NO: 9386988 - DNA, 22 bp, Homo sapiens
cagagcaacaccctttacatcg

SEQ ID NO: 9386989 - DNA, 22 bp, Homo sapiens
cagagagggcggccctggcttc

SEQ ID NO: 9386990 - DNA, 22 bp, Homo sapiens
cagagagggcggccctggcttc

SEQ ID NO: 9386991 - DNA, 22 bp, Homo sapiens
cagagaggatggattccatagc

SEQ ID NO: 9386992 - DNA, 22 bp, Homo sapiens
agccagtgattctgatgtactg

SEQ ID NO: 9386993 - DNA, 22 bp, Homo sapiens
agccagtgatgaagactctgga

SEQ ID NO: 9386994 - DNA, 22 bp, Homo sapiens
agccagtgatgaagactctgga

SEQ ID NO: 9386995 - DNA, 22 bp, Homo sapiens
cagagagggagcagtagtctct

SEQ ID NO: 9386996 - DNA, 19 bp, Homo sapiens
agccagtgagcctctgggt

SEQ ID NO: 9386997 - DNA, 22 bp, Homo sapiens
agccagtgacatacgattggga

SEQ ID NO: 9386998 - DNA, 22 bp, Homo sapiens
agccagtgacatacgattggga

SEQ ID NO: 9386999 - DNA, 19 bp, Homo sapiens
agccagtgagcctctgggt

SEQ ID NO: 9387000 - DNA, 19 bp, Homo sapiens
agccagtgagcctctgggt

SEQ ID NO: 9387001 - DNA, 22 bp, Homo sapiens
agccagtgacatacgattggga

SEQ ID NO: 9387002 - DNA, 22 bp, Homo sapiens
agccagtctctctccctggaga

SEQ ID NO: 9387003 - DNA, 21 bp, Homo sapiens
agccagtctcagtactgtact

SEQ ID NO: 9387004 - DNA, 22 bp, Homo sapiens
agccagtcttacgctcgttttt

SEQ ID NO: 9387005 - DNA, 22 bp, Homo sapiens
agccagtacagggatgtgttca

SEQ ID NO: 9387006 - DNA, 22 bp, Homo sapiens
agccagtatcactctgtgttct

SEQ ID NO: 9387007 - DNA, 21 bp, Homo sapiens
agccagtcattatgagcggga

SEQ ID NO: 9387008 - DNA, 21 bp, Homo sapiens
agccagtcattatgagcggga

SEQ ID NO: 9387009 - DNA, 22 bp, Homo sapiens
agccagtcagaggctcccccaa

SEQ ID NO: 9387010 - DNA, 22 bp, Homo sapiens
agccagtccatcactaatgggt

SEQ ID NO: 9387011 - DNA, 22 bp, Homo sapiens
agccagtcggggccatgctggg

SEQ ID NO: 9387012 - DNA, 20 bp, Homo sapiens
agccagggttctggatgcac

SEQ ID NO: 9387013 - DNA, 20 bp, Homo sapiens
agccagggttctggatgcac

SEQ ID NO: 9387014 - DNA, 22 bp, Homo sapiens
agccagggttagaagatagtca

SEQ ID NO: 9387015 - DNA, 22 bp, Homo sapiens
agccagggttagaagatagtca

SEQ ID NO: 9387016 - DNA, 22 bp, Homo sapiens
agccaggggattcatcagggac

SEQ ID NO: 9387017 - DNA, 22 bp, Homo sapiens
agccaggtcagctcaccctgct

SEQ ID NO: 9387018 - DNA, 22 bp, Homo sapiens
cagacagcgagcggaggggctt

SEQ ID NO: 9387019 - DNA, 22 bp, Homo sapiens
cagacagctgctttcttgctgt

SEQ ID NO: 9387020 - DNA, 23 bp, Homo sapiens
agccaggggatcttgggccctgg

SEQ ID NO: 9387021 - DNA, 22 bp, Homo sapiens
cagacagacctgcaagggcaca

SEQ ID NO: 9387022 - DNA, 22 bp, Homo sapiens
cagacagagctcacaagtcttt

SEQ ID NO: 9387023 - DNA, 22 bp, Homo sapiens
cagacagaggctgtatgagggc

SEQ ID NO: 9387024 - DNA, 22 bp, Homo sapiens
cagacagaggctgtatgagggc

SEQ ID NO: 9387025 - DNA, 23 bp, Homo sapiens
cagagctggctcagagctgcctg

SEQ ID NO: 9387026 - DNA, 22 bp, Homo sapiens
agccccttctgtctccaggatc

SEQ ID NO: 9387027 - DNA, 19 bp, Homo sapiens
agcccccagacagcaggcc

SEQ ID NO: 9387028 - DNA, 23 bp, Homo sapiens
cagagctggctcagagctgcctg

SEQ ID NO: 9387029 - DNA, 23 bp, Homo sapiens
cagagctggctcagagctgcctg

SEQ ID NO: 9387030 - DNA, 22 bp, Homo sapiens
cagagctggcctgtgatttttg

SEQ ID NO: 9387031 - DNA, 22 bp, Homo sapiens
agccccttgctgccctctagag

SEQ ID NO: 9387032 - DNA, 22 bp, Homo sapiens
agccccttgctgccctctagag

SEQ ID NO: 9387033 - DNA, 22 bp, Homo sapiens
agccccttggaacacagggctg

SEQ ID NO: 9387034 - DNA, 22 bp, Homo sapiens
agccccttggaacacagggctg

SEQ ID NO: 9387035 - DNA, 22 bp, Homo sapiens
agccccttgtgggcgcacagca

SEQ ID NO: 9387036 - DNA, 22 bp, Homo sapiens
agcccgcatctcgctaaagata

SEQ ID NO: 9387037 - DNA, 22 bp, Homo sapiens
agcccggcttccccggttgcta

SEQ ID NO: 9387038 - DNA, 22 bp, Homo sapiens
agccctcatggaacagctccta

SEQ ID NO: 9387039 - DNA, 22 bp, Homo sapiens
agccctcaggctttgctgggcc

SEQ ID NO: 9387040 - DNA, 22 bp, Homo sapiens
agcccaggagtttgaggctgtg

SEQ ID NO: 9387041 - DNA, 22 bp, Homo sapiens
agcccaggagtttgaggctgtg

SEQ ID NO: 9387042 - DNA, 22 bp, Homo sapiens
agcccaggagtttgaggctgtg

SEQ ID NO: 9387043 - DNA, 22 bp, Homo sapiens
agcccaggagtccttaaggacc

SEQ ID NO: 9387044 - DNA, 22 bp, Homo sapiens
agcccaggagtttgaggctgtg

SEQ ID NO: 9387045 - DNA, 22 bp, Homo sapiens
cagagctggagaagtggattta

SEQ ID NO: 9387046 - DNA, 22 bp, Homo sapiens
cagagctgcttcccagtttgtg

SEQ ID NO: 9387047 - DNA, 22 bp, Homo sapiens
cagagctggagcttgaatggag

SEQ ID NO: 9387048 - DNA, 22 bp, Homo sapiens
cagagctggagaagtggattta

SEQ ID NO: 9387049 - DNA, 22 bp, Homo sapiens
cagagctggagcttgaatggag

SEQ ID NO: 9387050 - DNA, 22 bp, Homo sapiens
cagagctggagggaaccctggc

SEQ ID NO: 9387051 - DNA, 22 bp, Homo sapiens
agcccaggaggtggaggttgca

SEQ ID NO: 9387052 - DNA, 22 bp, Homo sapiens
agcccaggagcctttggagggt

SEQ ID NO: 9387053 - DNA, 22 bp, Homo sapiens
agcccaggagcctttggagggt

SEQ ID NO: 9387054 - DNA, 22 bp, Homo sapiens
agcccaggaatctgcatcttga

SEQ ID NO: 9387055 - DNA, 22 bp, Homo sapiens
agcccaggaggtggaggttgca

SEQ ID NO: 9387056 - DNA, 22 bp, Homo sapiens
agcccaggagtccttaaggacc

SEQ ID NO: 9387057 - DNA, 22 bp, Homo sapiens
agcccaggaggtggaggttgca

SEQ ID NO: 9387058 - DNA, 22 bp, Homo sapiens
agcccaggaatctgcatcttga

SEQ ID NO: 9387059 - DNA, 22 bp, Homo sapiens
agcccaggaatctgcatcttga

SEQ ID NO: 9387060 - DNA, 22 bp, Homo sapiens
agcccaggaagttgaggcttgc

SEQ ID NO: 9387061 - DNA, 22 bp, Homo sapiens
agcccagccggattcccagttc

SEQ ID NO: 9387062 - DNA, 22 bp, Homo sapiens
agcccagcctgattctacaccc

SEQ ID NO: 9387063 - DNA, 22 bp, Homo sapiens
agctccctgagatgccacagca

SEQ ID NO: 9387064 - DNA, 22 bp, Homo sapiens
agctcccaggcagtcatgagga

SEQ ID NO: 9387065 - DNA, 22 bp, Homo sapiens
agctcccaggcagtcatgagga

SEQ ID NO: 9387066 - DNA, 22 bp, Homo sapiens
agctccagggaaagagtggatc

SEQ ID NO: 9387067 - DNA, 22 bp, Homo sapiens
cagccagctggcactgtgagta

SEQ ID NO: 9387068 - DNA, 22 bp, Homo sapiens
cagccagctcaggaaggatttt

SEQ ID NO: 9387069 - DNA, 22 bp, Homo sapiens
cagccagctggcactgtgagta

SEQ ID NO: 9387070 - DNA, 22 bp, Homo sapiens
cagccagcctctcaaccatgca

SEQ ID NO: 9387071 - DNA, 22 bp, Homo sapiens
cagccagatcaaactcagatgt

SEQ ID NO: 9387072 - DNA, 22 bp, Homo sapiens
cagccagatcagggcaggggtt

SEQ ID NO: 9387073 - DNA, 22 bp, Homo sapiens
cagccagaggggccagagtcgg

SEQ ID NO: 9387074 - DNA, 22 bp, Homo sapiens
cagccagagaggaaggaatgca

SEQ ID NO: 9387075 - DNA, 22 bp, Homo sapiens
cagccagaggctgcgaggggcc

SEQ ID NO: 9387076 - DNA, 22 bp, Homo sapiens
cagccagagaggaaggaatgca

SEQ ID NO: 9387077 - DNA, 22 bp, Homo sapiens
agctcctcctgtgccaggccag

SEQ ID NO: 9387078 - DNA, 22 bp, Homo sapiens
agctcctctagatctgccactt

SEQ ID NO: 9387079 - DNA, 22 bp, Homo sapiens
cagccctggcgcccccagatct

SEQ ID NO: 9387080 - DNA, 22 bp, Homo sapiens
cagccctggcgcccccagatct

SEQ ID NO: 9387081 - DNA, 22 bp, Homo sapiens
cagccctggccccaggtggtct

SEQ ID NO: 9387082 - DNA, 20 bp, Homo sapiens
agctcctcatcactggaggt

SEQ ID NO: 9387083 - DNA, 21 bp, Homo sapiens
agctccctgtttcctcactct

SEQ ID NO: 9387084 - DNA, 22 bp, Homo sapiens
cagccctggctagggcgagggc

SEQ ID NO: 9387085 - DNA, 22 bp, Homo sapiens
cagccctggctagggcgagggc

SEQ ID NO: 9387086 - DNA, 22 bp, Homo sapiens
cagccctgggagttggggccga

SEQ ID NO: 9387087 - DNA, 22 bp, Homo sapiens
cagccctgggtccctgccctgg

SEQ ID NO: 9387088 - DNA, 22 bp, Homo sapiens
cagccctgggagttggggccga

SEQ ID NO: 9387089 - DNA, 22 bp, Homo sapiens
cagccctgggtccctgccctgg

SEQ ID NO: 9387090 - DNA, 22 bp, Homo sapiens
agctcaatgcaacctccgcctc

SEQ ID NO: 9387091 - DNA, 22 bp, Homo sapiens
agctaggagattttgtgaggct

SEQ ID NO: 9387092 - DNA, 22 bp, Homo sapiens
cagcaggaggtgagatgtgacc

SEQ ID NO: 9387093 - DNA, 22 bp, Homo sapiens
cagcaggaggtgagtagcaggt

SEQ ID NO: 9387094 - DNA, 23 bp, Homo sapiens
cagcaggagggtgcctgggctgc

SEQ ID NO: 9387095 - DNA, 22 bp, Homo sapiens
cagcaggaggtgagtagcaggt

SEQ ID NO: 9387096 - DNA, 22 bp, Homo sapiens
cagcaggaggtgagtagcaggt

SEQ ID NO: 9387097 - DNA, 22 bp, Homo sapiens
cagcaggaggtgagtagcaggt

SEQ ID NO: 9387098 - DNA, 22 bp, Homo sapiens
agctcacagcctagcactgtga

SEQ ID NO: 9387099 - DNA, 22 bp, Homo sapiens
agctcagaaatgccagtaggta

SEQ ID NO: 9387100 - DNA, 22 bp, Homo sapiens
agctcagaactgcagacatgtg

SEQ ID NO: 9387101 - DNA, 22 bp, Homo sapiens
agctcagaacctcctcatccca

SEQ ID NO: 9387102 - DNA, 22 bp, Homo sapiens
agctcagaacctcctcatccca

SEQ ID NO: 9387103 - DNA, 22 bp, Homo sapiens
agctcagaaatgccagtaggta

SEQ ID NO: 9387104 - DNA, 22 bp, Homo sapiens
agctcagaagcctatgcatagt

SEQ ID NO: 9387105 - DNA, 22 bp, Homo sapiens
agctcagaagggaggaaatgag

SEQ ID NO: 9387106 - DNA, 22 bp, Homo sapiens
cagccagagaaagggcactgcc

SEQ ID NO: 9387107 - DNA, 22 bp, Homo sapiens
cagccagaacctaggatgagct

SEQ ID NO: 9387108 - DNA, 22 bp, Homo sapiens
agctcagaagggaggaaatgag

SEQ ID NO: 9387109 - DNA, 22 bp, Homo sapiens
agctcagaactgcagacatgtg

SEQ ID NO: 9387110 - DNA, 22 bp, Homo sapiens
agctcagaagcctatgcatagt

SEQ ID NO: 9387111 - DNA, 22 bp, Homo sapiens
cagcaggaggcatggcttccct

SEQ ID NO: 9387112 - DNA, 22 bp, Homo sapiens
cagcaggagcagtcagactcct

SEQ ID NO: 9387113 - DNA, 23 bp, Homo sapiens
cagcaggagggtgcctgggctgc

SEQ ID NO: 9387114 - DNA, 23 bp, Homo sapiens
cagcaggagggtgcctgggctgc

SEQ ID NO: 9387115 - DNA, 22 bp, Homo sapiens
cagcaggacgtccaagtgctat

SEQ ID NO: 9387116 - DNA, 22 bp, Homo sapiens
cagcaggacgtccaagtgctat

SEQ ID NO: 9387117 - DNA, 22 bp, Homo sapiens
cagcaggacgtccaagtgctat

SEQ ID NO: 9387118 - DNA, 22 bp, Homo sapiens
cagcaggagcagtcagactcct

SEQ ID NO: 9387119 - DNA, 22 bp, Homo sapiens
agccttgttgctaccagatgcc

SEQ ID NO: 9387120 - DNA, 22 bp, Homo sapiens
agccttggatgagctttatcat

SEQ ID NO: 9387121 - DNA, 23 bp, Homo sapiens
agccttggaggttgaggctgcag

SEQ ID NO: 9387122 - DNA, 22 bp, Homo sapiens
agccttggccgtaaggtatgct

SEQ ID NO: 9387123 - DNA, 22 bp, Homo sapiens
agccttggtcccgcgtcagcca

SEQ ID NO: 9387124 - DNA, 22 bp, Homo sapiens
agccttgggcaatttggacact

SEQ ID NO: 9387125 - DNA, 22 bp, Homo sapiens
agccttctctgattctcctagt

SEQ ID NO: 9387126 - DNA, 22 bp, Homo sapiens
agccttctctgaaattctgttt

SEQ ID NO: 9387127 - DNA, 22 bp, Homo sapiens
agccttctaggatgtcatctgc

SEQ ID NO: 9387128 - DNA, 22 bp, Homo sapiens
agccttctaggatgtcatctgc

SEQ ID NO: 9387129 - DNA, 22 bp, Homo sapiens
agccttccaggtagatggcaca

SEQ ID NO: 9387130 - DNA, 22 bp, Homo sapiens
agccttctctgaaattctgttt

SEQ ID NO: 9387131 - DNA, 22 bp, Homo sapiens
agccttgctttttcagtagcac

SEQ ID NO: 9387132 - DNA, 22 bp, Homo sapiens
agcctcagtgtcaccatctacc

SEQ ID NO: 9387133 - DNA, 22 bp, Homo sapiens
agcctcagtgtcaccatctacc

SEQ ID NO: 9387134 - DNA, 22 bp, Homo sapiens
agcctcagtgtcaccatctacc

SEQ ID NO: 9387135 - DNA, 22 bp, Homo sapiens
agcctcagtttcaggcctcctc

SEQ ID NO: 9387136 - DNA, 22 bp, Homo sapiens
agcctcagtttcaggcctcctc

SEQ ID NO: 9387137 - DNA, 22 bp, Homo sapiens
agcctcagtgtcaccatctacc

SEQ ID NO: 9387138 - DNA, 22 bp, Homo sapiens
agcctccatctcccatctgtga

SEQ ID NO: 9387139 - DNA, 22 bp, Homo sapiens
agcctccatcccatgcacaaag

SEQ ID NO: 9387140 - DNA, 22 bp, Homo sapiens
cagcagaaacccagcaaagcca

SEQ ID NO: 9387141 - DNA, 22 bp, Homo sapiens
cagcagaggaaagcaaatctaa

SEQ ID NO: 9387142 - DNA, 22 bp, Homo sapiens
cagcagagggagccattgaaat

SEQ ID NO: 9387143 - DNA, 22 bp, Homo sapiens
cagcagaggtggttcacattgt

SEQ ID NO: 9387144 - DNA, 22 bp, Homo sapiens
cagcagaggttggaacagttct

SEQ ID NO: 9387145 - DNA, 22 bp, Homo sapiens
cagcagcatgaattcgagccac

SEQ ID NO: 9387146 - DNA, 22 bp, Homo sapiens
cagcagcatgaattcgagccac

SEQ ID NO: 9387147 - DNA, 22 bp, Homo sapiens
cagcagcatcaggtctgtggtt

SEQ ID NO: 9387148 - DNA, 22 bp, Homo sapiens
cagcagcagtggctgcagaaca

SEQ ID NO: 9387149 - DNA, 22 bp, Homo sapiens
cagcagcatcaggtctgtggtt

SEQ ID NO: 9387150 - DNA, 22 bp, Homo sapiens
cagcagcagtgttctagaatct

SEQ ID NO: 9387151 - DNA, 22 bp, Homo sapiens
agcctgtccagaggacagggct

SEQ ID NO: 9387152 - DNA, 22 bp, Homo sapiens
cagcagcattgctctggattcc

SEQ ID NO: 9387153 - DNA, 22 bp, Homo sapiens
agccttccaggtagatggcaca

SEQ ID NO: 9387154 - DNA, 22 bp, Homo sapiens
agccttccacccagatcccctt

SEQ ID NO: 9387155 - DNA, 22 bp, Homo sapiens
agccttccaggtagatggcaca

SEQ ID NO: 9387156 - DNA, 22 bp, Homo sapiens
agccttccacccagatcccctt

SEQ ID NO: 9387157 - DNA, 22 bp, Homo sapiens
cagcagcagcttagtggtcccc

SEQ ID NO: 9387158 - DNA, 22 bp, Homo sapiens
cagcagcaggcgcacggccgtc

SEQ ID NO: 9387159 - DNA, 22 bp, Homo sapiens
cagcagcagtggctgcagaaca

SEQ ID NO: 9387160 - DNA, 22 bp, Homo sapiens
cagcagcaggcgcacggccgtc

SEQ ID NO: 9387161 - DNA, 22 bp, Homo sapiens
cagcagcagtggctgcagaaca

SEQ ID NO: 9387162 - DNA, 22 bp, Homo sapiens
cagcagcagtggctgcagaaca

SEQ ID NO: 9387163 - DNA, 22 bp, Homo sapiens
cagcagcagccccaggaaggtt

SEQ ID NO: 9387164 - DNA, 22 bp, Homo sapiens
cagcagcagcttagtggtcccc

SEQ ID NO: 9387165 - DNA, 22 bp, Homo sapiens
cagcagaggttttgctccatga

SEQ ID NO: 9387166 - DNA, 22 bp, Homo sapiens
cagcagaggttttgctccatga

SEQ ID NO: 9387167 - DNA, 22 bp, Homo sapiens
cagcagaggttttgctccatga

SEQ ID NO: 9387168 - DNA, 22 bp, Homo sapiens
cagcagaggttttgctccatga

SEQ ID NO: 9387169 - DNA, 22 bp, Homo sapiens
cagcacagggacaatagcagat

SEQ ID NO: 9387170 - DNA, 22 bp, Homo sapiens
cagcacagggacaatagcagat

SEQ ID NO: 9387171 - DNA, 22 bp, Homo sapiens
cagcacaggaagtgggccttca

SEQ ID NO: 9387172 - DNA, 22 bp, Homo sapiens
agcctcagcacgcagctctgtg

SEQ ID NO: 9387173 - DNA, 23 bp, Homo sapiens
agcctcagccggtggcagaagtg

SEQ ID NO: 9387174 - DNA, 23 bp, Homo sapiens
agcctcagccggtggcagaagtg

SEQ ID NO: 9387175 - DNA, 22 bp, Homo sapiens
agcctcagggctctgcgcagac

SEQ ID NO: 9387176 - DNA, 22 bp, Homo sapiens
agcctcagggctctgcgcagac

SEQ ID NO: 9387177 - DNA, 22 bp, Homo sapiens
agcctcagggctctgcgcagac

SEQ ID NO: 9387178 - DNA, 22 bp, Homo sapiens
agcctcagggctctgcgcagac

SEQ ID NO: 9387179 - DNA, 22 bp, Homo sapiens
cagcacagtacaaggcacggat

SEQ ID NO: 9387180 - DNA, 22 bp, Homo sapiens
cagcacagtacaaggcacggat

SEQ ID NO: 9387181 - DNA, 22 bp, Homo sapiens
agcctcagcacgcagctctgtg

SEQ ID NO: 9387182 - DNA, 22 bp, Homo sapiens
agcctcagcacgcagctctgtg

SEQ ID NO: 9387183 - DNA, 22 bp, Homo sapiens
cagaggctcaccagcctttcac

SEQ ID NO: 9387184 - DNA, 22 bp, Homo sapiens
cagaggctcaccagcctttcac

SEQ ID NO: 9387185 - DNA, 22 bp, Homo sapiens
cagaggctcagatggccctggc

SEQ ID NO: 9387186 - DNA, 22 bp, Homo sapiens
cagaggctcttcctcactgccc

SEQ ID NO: 9387187 - DNA, 22 bp, Homo sapiens
cagaggctcttcctcactgccc

SEQ ID NO: 9387188 - DNA, 22 bp, Homo sapiens
cagcaagaatcagacaacctca

SEQ ID NO: 9387189 - DNA, 22 bp, Homo sapiens
agccctccatctgtgctcaggc

SEQ ID NO: 9387190 - DNA, 22 bp, Homo sapiens
cagaggctaagagtgtccaaag

SEQ ID NO: 9387191 - DNA, 22 bp, Homo sapiens
cagaggcgaggcagctgaacct

SEQ ID NO: 9387192 - DNA, 22 bp, Homo sapiens
cagaggcgaggcagctgaacct

SEQ ID NO: 9387193 - DNA, 22 bp, Homo sapiens
cagaggctaagggtagcttggg

SEQ ID NO: 9387194 - DNA, 22 bp, Homo sapiens
cagaggctagactgtgcttcct

SEQ ID NO: 9387195 - DNA, 22 bp, Homo sapiens
cagaggctaagatgagtgggtg

SEQ ID NO: 9387196 - DNA, 22 bp, Homo sapiens
cagaggctaagatgagtgggtg

SEQ ID NO: 9387197 - DNA, 22 bp, Homo sapiens
cagaggctaagatgagtgggtg

SEQ ID NO: 9387198 - DNA, 22 bp, Homo sapiens
agagggcaagtgtagtccagta

SEQ ID NO: 9387199 - DNA, 22 bp, Homo sapiens
agagggagtgaaatggaataga

SEQ ID NO: 9387200 - DNA, 22 bp, Homo sapiens
agagggtgctggagagacattg

SEQ ID NO: 9387201 - DNA, 22 bp, Homo sapiens
agagggtagaagacagggttgc

SEQ ID NO: 9387202 - DNA, 22 bp, Homo sapiens
agagggcagcagcaacaactct

SEQ ID NO: 9387203 - DNA, 22 bp, Homo sapiens
agagggtatgagtggggctaaa

SEQ ID NO: 9387204 - DNA, 21 bp, Homo sapiens
agagggagagtggcccttcca

SEQ ID NO: 9387205 - DNA, 22 bp, Homo sapiens
attctgtcagatcttactggat

SEQ ID NO: 9387206 - DNA, 22 bp, Homo sapiens
attctgtatttggatataaggg

SEQ ID NO: 9387207 - DNA, 22 bp, Homo sapiens
attctgtatttctaataagatc

SEQ ID NO: 9387208 - DNA, 22 bp, Homo sapiens
attctgtatttggatataaggg

SEQ ID NO: 9387209 - DNA, 22 bp, Homo sapiens
attctgtatttctaataagatc

SEQ ID NO: 9387210 - DNA, 22 bp, Homo sapiens
attctgtatggggaaactagag

SEQ ID NO: 9387211 - DNA, 22 bp, Homo sapiens
attctgtagggcttgctgacac

SEQ ID NO: 9387212 - DNA, 22 bp, Homo sapiens
attctgtaattgaactgtgttg

SEQ ID NO: 9387213 - DNA, 22 bp, Homo sapiens
attctgggttcatgagtgagct

SEQ ID NO: 9387214 - DNA, 22 bp, Homo sapiens
attctgggcgcctatggctgca

SEQ ID NO: 9387215 - DNA, 22 bp, Homo sapiens
attcagctaagtgcttcatgct

SEQ ID NO: 9387216 - DNA, 22 bp, Homo sapiens
attctggaattctaagattctg

SEQ ID NO: 9387217 - DNA, 22 bp, Homo sapiens
attctggacaatgagaaactgg

SEQ ID NO: 9387218 - DNA, 22 bp, Homo sapiens
attctggacaatgagaaactgg

SEQ ID NO: 9387219 - DNA, 22 bp, Homo sapiens
attctggatattacttatctat

SEQ ID NO: 9387220 - DNA, 22 bp, Homo sapiens
attctggacaaggcaagctcct

SEQ ID NO: 9387221 - DNA, 22 bp, Homo sapiens
attctggacaaggcaagctcct

SEQ ID NO: 9387222 - DNA, 22 bp, Homo sapiens
attctggacaaggcaagctcct

SEQ ID NO: 9387223 - DNA, 22 bp, Homo sapiens
attctggattatcagtccacca

SEQ ID NO: 9387224 - DNA, 22 bp, Homo sapiens
attctggattatcagtccacca

SEQ ID NO: 9387225 - DNA, 22 bp, Homo sapiens
attctggatattacttatctat

SEQ ID NO: 9387226 - DNA, 22 bp, Homo sapiens
attctggattatcagtccacca

SEQ ID NO: 9387227 - DNA, 22 bp, Homo sapiens
attctggattatcagtccacca

SEQ ID NO: 9387228 - DNA, 22 bp, Homo sapiens
attctgggaactttgtctctca

SEQ ID NO: 9387229 - DNA, 22 bp, Homo sapiens
attctgggagtgtaggatggtt

SEQ ID NO: 9387230 - DNA, 22 bp, Homo sapiens
attcagcaagctatgggacagg

SEQ ID NO: 9387231 - DNA, 22 bp, Homo sapiens
attcagatcatatttatagctt

SEQ ID NO: 9387232 - DNA, 22 bp, Homo sapiens
attcagatcatatttatagctt

SEQ ID NO: 9387233 - DNA, 22 bp, Homo sapiens
attcagattcctaggtttcatt

SEQ ID NO: 9387234 - DNA, 22 bp, Homo sapiens
attcagattggtttaagctagt

SEQ ID NO: 9387235 - DNA, 20 bp, Homo sapiens
attcacaggcacaaaaccct

SEQ ID NO: 9387236 - DNA, 22 bp, Homo sapiens
attcacagtatggacgaaatga

SEQ ID NO: 9387237 - DNA, 21 bp, Homo sapiens
attcagagtaattcatcttta

SEQ ID NO: 9387238 - DNA, 22 bp, Homo sapiens
attcacagtttcctcatattct

SEQ ID NO: 9387239 - DNA, 22 bp, Homo sapiens
attcacagtttcctcatattct

SEQ ID NO: 9387240 - DNA, 22 bp, Homo sapiens
attcaaagcccagtaaacattg

SEQ ID NO: 9387241 - DNA, 22 bp, Homo sapiens
attcacaattagaagtagataa

SEQ ID NO: 9387242 - DNA, 22 bp, Homo sapiens
attcacaattagaagtagataa

SEQ ID NO: 9387243 - DNA, 22 bp, Homo sapiens
attcacaattagaagtagataa

SEQ ID NO: 9387244 - DNA, 22 bp, Homo sapiens
attcacagagtggttagtggta

SEQ ID NO: 9387245 - DNA, 22 bp, Homo sapiens
attcacagaatagttttaccag

SEQ ID NO: 9387246 - DNA, 22 bp, Homo sapiens
attcacacatactcatgtgtga

SEQ ID NO: 9387247 - DNA, 22 bp, Homo sapiens
attataaagaacatgtgtgtgg

SEQ ID NO: 9387248 - DNA, 22 bp, Homo sapiens
attataaagaacatgtgtgtgg

SEQ ID NO: 9387249 - DNA, 22 bp, Homo sapiens
attataaacctttgagggtggg

SEQ ID NO: 9387250 - DNA, 22 bp, Homo sapiens
attataaatattttctaggggt

SEQ ID NO: 9387251 - DNA, 22 bp, Homo sapiens
attatacattttgtgtagagat

SEQ ID NO: 9387252 - DNA, 22 bp, Homo sapiens
attatacattttgtgtagagat

SEQ ID NO: 9387253 - DNA, 22 bp, Homo sapiens
atgtgtgtaaacaagtataatt

SEQ ID NO: 9387254 - DNA, 22 bp, Homo sapiens
atgtgtgtaaacaagtataatt

SEQ ID NO: 9387255 - DNA, 22 bp, Homo sapiens
atgtgtgtacacacgtgactct

SEQ ID NO: 9387256 - DNA, 22 bp, Homo sapiens
atgtgtgctacaggtgtgggaa

SEQ ID NO: 9387257 - DNA, 18 bp, Homo sapiens
atgtgtggcttggggtcc

SEQ ID NO: 9387258 - DNA, 21 bp, Homo sapiens
atgtgtgctagaggactactg

SEQ ID NO: 9387259 - DNA, 22 bp, Homo sapiens
atgtgtatctaaggtgttctat

SEQ ID NO: 9387260 - DNA, 22 bp, Homo sapiens
atgtgtatctaaggtgttctat

SEQ ID NO: 9387261 - DNA, 22 bp, Homo sapiens
atgtgtatccatctgtctattt

SEQ ID NO: 9387262 - DNA, 22 bp, Homo sapiens
atgtgtatatttggtgtcaata

SEQ ID NO: 9387263 - DNA, 22 bp, Homo sapiens
atgtgtctttcaaggtatagaa

SEQ ID NO: 9387264 - DNA, 22 bp, Homo sapiens
atgtgtgcaatgctattttggc

SEQ ID NO: 9387265 - DNA, 22 bp, Homo sapiens
atgttacaaatcctacaggtag

SEQ ID NO: 9387266 - DNA, 22 bp, Homo sapiens
atgttaagtttagcaggctagg

SEQ ID NO: 9387267 - DNA, 22 bp, Homo sapiens
atgttaaatggtttattattaa

SEQ ID NO: 9387268 - DNA, 22 bp, Homo sapiens
atgttaagaatgcagacaaatg

SEQ ID NO: 9387269 - DNA, 20 bp, Homo sapiens
atgttaaatagcatttagag

SEQ ID NO: 9387270 - DNA, 22 bp, Homo sapiens
atgttaaatagccatttgtttg

SEQ ID NO: 9387271 - DNA, 22 bp, Homo sapiens
atgttacaatccaacaaaatta

SEQ ID NO: 9387272 - DNA, 22 bp, Homo sapiens
atgtttatgttgggctatattt

SEQ ID NO: 9387273 - DNA, 22 bp, Homo sapiens
atgtttctgaagtttacagata

SEQ ID NO: 9387274 - DNA, 22 bp, Homo sapiens
atgtttctgagtgtatatacat

SEQ ID NO: 9387275 - DNA, 20 bp, Homo sapiens
attagctcaggtgaggtcat

SEQ ID NO: 9387276 - DNA, 22 bp, Homo sapiens
attagctgacctctaaggagcc

SEQ ID NO: 9387277 - DNA, 22 bp, Homo sapiens
attagctaggaaattttgtgtc

SEQ ID NO: 9387278 - DNA, 22 bp, Homo sapiens
attagcagctttctggtctcta

SEQ ID NO: 9387279 - DNA, 22 bp, Homo sapiens
attagcatattaaatagtcatt

SEQ ID NO: 9387280 - DNA, 22 bp, Homo sapiens
attagcatattaaatagtcatt

SEQ ID NO: 9387281 - DNA, 22 bp, Homo sapiens
attagattgtaaatgttttcac

SEQ ID NO: 9387282 - DNA, 22 bp, Homo sapiens
attagattgtaaatgttttcac

SEQ ID NO: 9387283 - DNA, 22 bp, Homo sapiens
attagcaacatggtgaatatgt

SEQ ID NO: 9387284 - DNA, 22 bp, Homo sapiens
attagcaactcttatgtaagca

SEQ ID NO: 9387285 - DNA, 22 bp, Homo sapiens
attacagtagcaaaagaccgga

SEQ ID NO: 9387286 - DNA, 22 bp, Homo sapiens
attaaagtgaagttctcagatg

SEQ ID NO: 9387287 - DNA, 22 bp, Homo sapiens
attagatgtgaccttagataaa

SEQ ID NO: 9387288 - DNA, 22 bp, Homo sapiens
attacagtaggattggaaagga

SEQ ID NO: 9387289 - DNA, 22 bp, Homo sapiens
attacagtagcaaaagaccgga

SEQ ID NO: 9387290 - DNA, 22 bp, Homo sapiens
attacagtaggattggaaagga

SEQ ID NO: 9387291 - DNA, 22 bp, Homo sapiens
attacagtgccacctcgtggtc

SEQ ID NO: 9387292 - DNA, 22 bp, Homo sapiens
attacagtgccacctcgtggtc

SEQ ID NO: 9387293 - DNA, 22 bp, Homo sapiens
atgtttgtgtttgctatgcggt

SEQ ID NO: 9387294 - DNA, 22 bp, Homo sapiens
atgtttgttgaacatctactgc

SEQ ID NO: 9387295 - DNA, 22 bp, Homo sapiens
atgtttgttgatcatttatgaa

SEQ ID NO: 9387296 - DNA, 22 bp, Homo sapiens
atgtttgttgaatgaagaaagg

SEQ ID NO: 9387297 - DNA, 22 bp, Homo sapiens
atgtttgtgggataaacaaatg

SEQ ID NO: 9387298 - DNA, 22 bp, Homo sapiens
atgtttgtgggataaacaaatg

SEQ ID NO: 9387299 - DNA, 22 bp, Homo sapiens
atgtttgtcaggattgtaatta

SEQ ID NO: 9387300 - DNA, 22 bp, Homo sapiens
atgtttgtaggtaagtgacact

SEQ ID NO: 9387301 - DNA, 22 bp, Homo sapiens
atgtttgtaggtaagtgacact

SEQ ID NO: 9387302 - DNA, 22 bp, Homo sapiens
attaaagtgaagttctcagatg

SEQ ID NO: 9387303 - DNA, 22 bp, Homo sapiens
attaaagacagcagatggatgg

SEQ ID NO: 9387304 - DNA, 22 bp, Homo sapiens
attaaacaatgtaaagttcttg

SEQ ID NO: 9387305 - DNA, 22 bp, Homo sapiens
attaaacaatgtaaagttcttg

SEQ ID NO: 9387306 - DNA, 22 bp, Homo sapiens
attaaactgagcaaattaacat

SEQ ID NO: 9387307 - DNA, 22 bp, Homo sapiens
atttcattgaagttaattcttc

SEQ ID NO: 9387308 - DNA, 22 bp, Homo sapiens
atttcattgaagttaattcttc

SEQ ID NO: 9387309 - DNA, 22 bp, Homo sapiens
atttcattgaagttaattcttc

SEQ ID NO: 9387310 - DNA, 22 bp, Homo sapiens
agatgaattgatgttggacaga

SEQ ID NO: 9387311 - DNA, 22 bp, Homo sapiens
agatgaagatatctgcaggggc

SEQ ID NO: 9387312 - DNA, 22 bp, Homo sapiens
agatgaagatatctgcaggggc

SEQ ID NO: 9387313 - DNA, 22 bp, Homo sapiens
atttattgaagcttattacgtt

SEQ ID NO: 9387314 - DNA, 22 bp, Homo sapiens
atttattgaagcttattacgtt

SEQ ID NO: 9387315 - DNA, 22 bp, Homo sapiens
agatccagggttggatttgcat

SEQ ID NO: 9387316 - DNA, 22 bp, Homo sapiens
agatccaggatgtcccaaaata

SEQ ID NO: 9387317 - DNA, 21 bp, Homo sapiens
agatccagtgccataaggccc

SEQ ID NO: 9387318 - DNA, 18 bp, Homo sapiens
agatgaaagcaaatgaca

SEQ ID NO: 9387319 - DNA, 22 bp, Homo sapiens
atttccagactttttccaggaa

SEQ ID NO: 9387320 - DNA, 22 bp, Homo sapiens
atttccagaccaggtctcaccc

SEQ ID NO: 9387321 - DNA, 22 bp, Homo sapiens
atttccagaccaggtctcaccc

SEQ ID NO: 9387322 - DNA, 22 bp, Homo sapiens
atttccagaatagaaggttctc

SEQ ID NO: 9387323 - DNA, 22 bp, Homo sapiens
atttccagaatagaaggttctc

SEQ ID NO: 9387324 - DNA, 22 bp, Homo sapiens
atttccaccggctcaggaagtt

SEQ ID NO: 9387325 - DNA, 22 bp, Homo sapiens
atttccaccggctcaggaagtt

SEQ ID NO: 9387326 - DNA, 22 bp, Homo sapiens
atttccaccatctctctgggcc

SEQ ID NO: 9387327 - DNA, 21 bp, Homo sapiens
atttccacataatcataagac

SEQ ID NO: 9387328 - DNA, 22 bp, Homo sapiens
atttccacataagggaaataag

SEQ ID NO: 9387329 - DNA, 22 bp, Homo sapiens
atttccacataagggaaataag

SEQ ID NO: 9387330 - DNA, 22 bp, Homo sapiens
atttccaatttcatccatgtcc

SEQ ID NO: 9387331 - DNA, 22 bp, Homo sapiens
atttccaatttcatccatgtcc

SEQ ID NO: 9387332 - DNA, 22 bp, Homo sapiens
atttccaatctctgcatatggg

SEQ ID NO: 9387333 - DNA, 22 bp, Homo sapiens
atttccaaggtaattttgagta

SEQ ID NO: 9387334 - DNA, 19 bp, Homo sapiens
atttccaagaattggagag

SEQ ID NO: 9387335 - DNA, 22 bp, Homo sapiens
atttccaaaaccacttattgcc

SEQ ID NO: 9387336 - DNA, 22 bp, Homo sapiens
agatggtgtttccccaggtgga

SEQ ID NO: 9387337 - DNA, 20 bp, Homo sapiens
agatggtgggctggaacacc

SEQ ID NO: 9387338 - DNA, 20 bp, Homo sapiens
agatggtgggctggaacacc

SEQ ID NO: 9387339 - DNA, 22 bp, Homo sapiens
agatggtgatagagctgggatt

SEQ ID NO: 9387340 - DNA, 22 bp, Homo sapiens
agatggtgagggcagaagtaac

SEQ ID NO: 9387341 - DNA, 20 bp, Homo sapiens
agatggtgaaggccagggag

SEQ ID NO: 9387342 - DNA, 22 bp, Homo sapiens
agatgtgagaatcaagtgacca

SEQ ID NO: 9387343 - DNA, 22 bp, Homo sapiens
agatgtgatgttaggcccttgg

SEQ ID NO: 9387344 - DNA, 22 bp, Homo sapiens
agatgtgatgttaggcccttgg

SEQ ID NO: 9387345 - DNA, 22 bp, Homo sapiens
agatgtgagtggctgtacagtg

SEQ ID NO: 9387346 - DNA, 22 bp, Homo sapiens
agatgtgagtggctgtacagtg

SEQ ID NO: 9387347 - DNA, 22 bp, Homo sapiens
agatgtgatctgttcaggacaa

SEQ ID NO: 9387348 - DNA, 22 bp, Homo sapiens
agatgtgattcctgctgagctg

SEQ ID NO: 9387349 - DNA, 22 bp, Homo sapiens
atttgcttcctaatactcatat

SEQ ID NO: 9387350 - DNA, 19 bp, Homo sapiens
atttgcttgtctgctctgc

SEQ ID NO: 9387351 - DNA, 22 bp, Homo sapiens
atttgcttgtaaatgtatgcct

SEQ ID NO: 9387352 - DNA, 22 bp, Homo sapiens
atttgcttgactatggcttgca

SEQ ID NO: 9387353 - DNA, 17 bp, Homo sapiens
agcaaaagtatcaaagc

SEQ ID NO: 9387354 - DNA, 22 bp, Homo sapiens
agcaaaataaggtaatttattg

SEQ ID NO: 9387355 - DNA, 22 bp, Homo sapiens
atttgctttaaggtataaaagg

SEQ ID NO: 9387356 - DNA, 22 bp, Homo sapiens
atttgctttcaggtataaaagg

SEQ ID NO: 9387357 - DNA, 22 bp, Homo sapiens
agcaaaataaggtaatttattg

SEQ ID NO: 9387358 - DNA, 20 bp, Homo sapiens
agcaaaatgcaagattttca

SEQ ID NO: 9387359 - DNA, 20 bp, Homo sapiens
agcaaaatgcaagattttca

SEQ ID NO: 9387360 - DNA, 22 bp, Homo sapiens
agcaaacagtttctggggatct

SEQ ID NO: 9387361 - DNA, 22 bp, Homo sapiens
agagtggcccgttggcctgaac

SEQ ID NO: 9387362 - DNA, 22 bp, Homo sapiens
agagtggctctgctgggcacag

SEQ ID NO: 9387363 - DNA, 22 bp, Homo sapiens
agagtggcttctttgacatgct

SEQ ID NO: 9387364 - DNA, 22 bp, Homo sapiens
agagtggctctgctgggcacag

SEQ ID NO: 9387365 - DNA, 22 bp, Homo sapiens
agagtggctctgctgggcacag

SEQ ID NO: 9387366 - DNA, 17 bp, Homo sapiens
agagtggctaaggctca

SEQ ID NO: 9387367 - DNA, 22 bp, Homo sapiens
agagtggcctggcctggggcat

SEQ ID NO: 9387368 - DNA, 23 bp, Homo sapiens
agagtggcctactcacactcatt

SEQ ID NO: 9387369 - DNA, 22 bp, Homo sapiens
agagtggcctggcctggggcat

SEQ ID NO: 9387370 - DNA, 22 bp, Homo sapiens
atttaagattgcgtattcatgt

SEQ ID NO: 9387371 - DNA, 19 bp, Homo sapiens
attcttctcttcctgctgt

SEQ ID NO: 9387372 - DNA, 22 bp, Homo sapiens
attgttaataactattacattg

SEQ ID NO: 9387373 - DNA, 22 bp, Homo sapiens
attgttaataactattacattg

SEQ ID NO: 9387374 - DNA, 22 bp, Homo sapiens
atttaagattgcgtattcatgt

SEQ ID NO: 9387375 - DNA, 22 bp, Homo sapiens
atttaagattgcgtattcatgt

SEQ ID NO: 9387376 - DNA, 22 bp, Homo sapiens
atttaacaagacagagaactgg

SEQ ID NO: 9387377 - DNA, 22 bp, Homo sapiens
attcttcatacagacaagtcct

SEQ ID NO: 9387378 - DNA, 22 bp, Homo sapiens
attcttcatacagacaagtcct

SEQ ID NO: 9387379 - DNA, 22 bp, Homo sapiens
agaggtagaggttgcagtgagc

SEQ ID NO: 9387380 - DNA, 22 bp, Homo sapiens
agaggtatatattctccatatt

SEQ ID NO: 9387381 - DNA, 22 bp, Homo sapiens
agagggtgggcacgtgatggat

SEQ ID NO: 9387382 - DNA, 22 bp, Homo sapiens
agagggtggtgaggcctggttc

SEQ ID NO: 9387383 - DNA, 22 bp, Homo sapiens
agagggtggtgaggcctggttc

SEQ ID NO: 9387384 - DNA, 22 bp, Homo sapiens
agagggtggtgaggcctggttc

SEQ ID NO: 9387385 - DNA, 23 bp, Homo sapiens
attcttcattatcttctagaaaa

SEQ ID NO: 9387386 - DNA, 19 bp, Homo sapiens
attcttctcaaatatccat

SEQ ID NO: 9387387 - DNA, 22 bp, Homo sapiens
attcttctcccttagggcccag

SEQ ID NO: 9387388 - DNA, 22 bp, Homo sapiens
atttattcctgattcctggctt

SEQ ID NO: 9387389 - DNA, 22 bp, Homo sapiens
atttattattgtggttacttct

SEQ ID NO: 9387390 - DNA, 22 bp, Homo sapiens
atttattattgtggttacttct

SEQ ID NO: 9387391 - DNA, 22 bp, Homo sapiens
atttattattgtggttacttct

SEQ ID NO: 9387392 - DNA, 22 bp, Homo sapiens
atttattattgtggttacttct

SEQ ID NO: 9387393 - DNA, 22 bp, Homo sapiens
atttattattgtggttacttct

SEQ ID NO: 9387394 - DNA, 22 bp, Homo sapiens
atttattcctttatggctggag

SEQ ID NO: 9387395 - DNA, 22 bp, Homo sapiens
atttattctccagatggcgaga

SEQ ID NO: 9387396 - DNA, 22 bp, Homo sapiens
atttattgaacactgactatgt

SEQ ID NO: 9387397 - DNA, 22 bp, Homo sapiens
atttattgaacactgactatgt

SEQ ID NO: 9387398 - DNA, 22 bp, Homo sapiens
atttattgaacactgactatgt

SEQ ID NO: 9387399 - DNA, 22 bp, Homo sapiens
atttattgaacactgactatgt

SEQ ID NO: 9387400 - DNA, 22 bp, Homo sapiens
atttattgaacactgactatgt

SEQ ID NO: 9387401 - DNA, 22 bp, Homo sapiens
atttattatgggatttggctca

SEQ ID NO: 9387402 - DNA, 22 bp, Homo sapiens
atttagtgaaacccataaagca

SEQ ID NO: 9387403 - DNA, 22 bp, Homo sapiens
atttagtagagaaattaagaaa

SEQ ID NO: 9387404 - DNA, 17 bp, Homo sapiens
atttagcaagtagacag

SEQ ID NO: 9387405 - DNA, 22 bp, Homo sapiens
atttagcaaaaaatgatgaagc

SEQ ID NO: 9387406 - DNA, 22 bp, Homo sapiens
atttagcaagagtacaaaataa

SEQ ID NO: 9387407 - DNA, 22 bp, Homo sapiens
atttagcaagagtacaaaataa

SEQ ID NO: 9387408 - DNA, 22 bp, Homo sapiens
atttagcaagagtacaaaataa

SEQ ID NO: 9387409 - DNA, 22 bp, Homo sapiens
atttagcaagcaggcaaattca

SEQ ID NO: 9387410 - DNA, 23 bp, Homo sapiens
atttacaggttaaatgaaatcag

SEQ ID NO: 9387411 - DNA, 23 bp, Homo sapiens
atttacaggttaaatgaaatcag

SEQ ID NO: 9387412 - DNA, 23 bp, Homo sapiens
atttacaggttaaatgaaatcag

SEQ ID NO: 9387413 - DNA, 22 bp, Homo sapiens
agagtgggacacgggcgctgtc

SEQ ID NO: 9387414 - DNA, 22 bp, Homo sapiens
agagtggcttgctcagctagca

SEQ ID NO: 9387415 - DNA, 22 bp, Homo sapiens
agagtgggacacgggcgctgtc

SEQ ID NO: 9387416 - DNA, 22 bp, Homo sapiens
agagtgggcaggagcctcgact

SEQ ID NO: 9387417 - DNA, 22 bp, Homo sapiens
agagtggggaaggtgttgagaa

SEQ ID NO: 9387418 - DNA, 22 bp, Homo sapiens
agagtggggaaggtgttgagaa

SEQ ID NO: 9387419 - DNA, 19 bp, Homo sapiens
agaagcaccagtcattcct

SEQ ID NO: 9387420 - DNA, 22 bp, Homo sapiens
atcttgggacatgtgctctggg

SEQ ID NO: 9387421 - DNA, 20 bp, Homo sapiens
atcttgggattgagattgcc

SEQ ID NO: 9387422 - DNA, 22 bp, Homo sapiens
atcttgggccacaatgagccga

SEQ ID NO: 9387423 - DNA, 22 bp, Homo sapiens
agaagcacacctgacctctagc

SEQ ID NO: 9387424 - DNA, 22 bp, Homo sapiens
agaagcacaggtaaagtgattt

SEQ ID NO: 9387425 - DNA, 22 bp, Homo sapiens
atcttgttataagagataatgg

SEQ ID NO: 9387426 - DNA, 22 bp, Homo sapiens
atcttgttctcccttgttctta

SEQ ID NO: 9387427 - DNA, 22 bp, Homo sapiens
agaagaatacttgatgttcatg

SEQ ID NO: 9387428 - DNA, 22 bp, Homo sapiens
agaagaatttctctcatgattt

SEQ ID NO: 9387429 - DNA, 22 bp, Homo sapiens
agaagaaatgtgaaggccactg

SEQ ID NO: 9387430 - DNA, 22 bp, Homo sapiens
agaagaaatgtgaaggccactg

SEQ ID NO: 9387431 - DNA, 22 bp, Homo sapiens
agaagaaatgtgaaggccactg

SEQ ID NO: 9387432 - DNA, 22 bp, Homo sapiens
agaagaatttctctcatgattt

SEQ ID NO: 9387433 - DNA, 22 bp, Homo sapiens
agaagagaactgccaaacactt

SEQ ID NO: 9387434 - DNA, 22 bp, Homo sapiens
agaagagaactgccaaacactt

SEQ ID NO: 9387435 - DNA, 22 bp, Homo sapiens
agaagagcctggggaccatggc

SEQ ID NO: 9387436 - DNA, 22 bp, Homo sapiens
agaagatgttgcagttgatgcg

SEQ ID NO: 9387437 - DNA, 22 bp, Homo sapiens
agaagaggggtgtccctgtggc

SEQ ID NO: 9387438 - DNA, 22 bp, Homo sapiens
agaagagtagtaacagaaatta

SEQ ID NO: 9387439 - DNA, 22 bp, Homo sapiens
agaatacagtatgcaaaaagat

SEQ ID NO: 9387440 - DNA, 22 bp, Homo sapiens
agaatacagttcagtaatggat

SEQ ID NO: 9387441 - DNA, 22 bp, Homo sapiens
agaatacatcaatctattttct

SEQ ID NO: 9387442 - DNA, 22 bp, Homo sapiens
agaatacagttcagtaatggat

SEQ ID NO: 9387443 - DNA, 22 bp, Homo sapiens
agaatagaattctcatagaatt

SEQ ID NO: 9387444 - DNA, 22 bp, Homo sapiens
agaatactaggcttcagaaagg

SEQ ID NO: 9387445 - DNA, 22 bp, Homo sapiens
agaatagtggcaatgactgcac

SEQ ID NO: 9387446 - DNA, 22 bp, Homo sapiens
atctttgtcactctactgtcta

SEQ ID NO: 9387447 - DNA, 22 bp, Homo sapiens
atctttgtgaatctcaacttgg

SEQ ID NO: 9387448 - DNA, 22 bp, Homo sapiens
agaatacaattgttcagtaata

SEQ ID NO: 9387449 - DNA, 22 bp, Homo sapiens
agaatacaccacaggccgaaat

SEQ ID NO: 9387450 - DNA, 23 bp, Homo sapiens
agaatacaggctttgtataggca

SEQ ID NO: 9387451 - DNA, 21 bp, Homo sapiens
agaataatggtatcatttgct

SEQ ID NO: 9387452 - DNA, 22 bp, Homo sapiens
agaagtttggtccttttcaagg

SEQ ID NO: 9387453 - DNA, 22 bp, Homo sapiens
agaaggccaatagggtgcactg

SEQ ID NO: 9387454 - DNA, 22 bp, Homo sapiens
agaaggcatcagaagtgtgtag

SEQ ID NO: 9387455 - DNA, 22 bp, Homo sapiens
atctttatatatctcctctgaa

SEQ ID NO: 9387456 - DNA, 22 bp, Homo sapiens
agaaggcctaacttgggggcaa

SEQ ID NO: 9387457 - DNA, 22 bp, Homo sapiens
agaaggccagatggacggggct

SEQ ID NO: 9387458 - DNA, 22 bp, Homo sapiens
agaaggccatgtcttggtactt

SEQ ID NO: 9387459 - DNA, 22 bp, Homo sapiens
agaaggccatgtcttggtactt

SEQ ID NO: 9387460 - DNA, 22 bp, Homo sapiens
agacaatttcaaagtaatatta

SEQ ID NO: 9387461 - DNA, 22 bp, Homo sapiens
agacacagaacacaaaagcata

SEQ ID NO: 9387462 - DNA, 19 bp, Homo sapiens
agacacacttgatatgtgt

SEQ ID NO: 9387463 - DNA, 22 bp, Homo sapiens
agacacagcaataactactgtt

SEQ ID NO: 9387464 - DNA, 22 bp, Homo sapiens
agacacagattttggaaaagat

SEQ ID NO: 9387465 - DNA, 22 bp, Homo sapiens
agacacagaagttgctgttggg

SEQ ID NO: 9387466 - DNA, 22 bp, Homo sapiens
agacacagaagttgctgttggg

SEQ ID NO: 9387467 - DNA, 22 bp, Homo sapiens
agacacagatggtacctgagcc

SEQ ID NO: 9387468 - DNA, 22 bp, Homo sapiens
agaattctccacgctcagggtc

SEQ ID NO: 9387469 - DNA, 22 bp, Homo sapiens
agacaatacatttattcccttt

SEQ ID NO: 9387470 - DNA, 22 bp, Homo sapiens
agaattagccggattcttgttt

SEQ ID NO: 9387471 - DNA, 22 bp, Homo sapiens
agaattaggtaagttcatctga

SEQ ID NO: 9387472 - DNA, 22 bp, Homo sapiens
agaattagaggccatgtacttg

SEQ ID NO: 9387473 - DNA, 22 bp, Homo sapiens
agaattcagaatgcatttctaa

SEQ ID NO: 9387474 - DNA, 22 bp, Homo sapiens
agaatgaagatgacttcggaga

SEQ ID NO: 9387475 - DNA, 22 bp, Homo sapiens
agaatgaattaatcaactggaa

SEQ ID NO: 9387476 - DNA, 22 bp, Homo sapiens
agaatgattttggacaatatgg

SEQ ID NO: 9387477 - DNA, 22 bp, Homo sapiens
agaatgcaagataaactttatt

SEQ ID NO: 9387478 - DNA, 22 bp, Homo sapiens
agaatgcagcttgccagtatct

SEQ ID NO: 9387479 - DNA, 22 bp, Homo sapiens
agaatgtgaagattttgaatta

SEQ ID NO: 9387480 - DNA, 22 bp, Homo sapiens
agaatgtgatatagtgatatgt

SEQ ID NO: 9387481 - DNA, 22 bp, Homo sapiens
agaatgtgggggaaaagagtgt

SEQ ID NO: 9387482 - DNA, 21 bp, Homo sapiens
agaattaaattggatttgtgt

SEQ ID NO: 9387483 - DNA, 22 bp, Homo sapiens
agaatgggggctacaggccaca

SEQ ID NO: 9387484 - DNA, 22 bp, Homo sapiens
agaatgcattttgtgtagctat

SEQ ID NO: 9387485 - DNA, 22 bp, Homo sapiens
agacacagtctgtctggaggag

SEQ ID NO: 9387486 - DNA, 22 bp, Homo sapiens
agacacagtctgtctggaggag

SEQ ID NO: 9387487 - DNA, 22 bp, Homo sapiens
agacacagtctgtctggaggag

SEQ ID NO: 9387488 - DNA, 21 bp, Homo sapiens
agacacaggggttgctggggt

SEQ ID NO: 9387489 - DNA, 21 bp, Homo sapiens
agacacaggggttgctggggt

SEQ ID NO: 9387490 - DNA, 22 bp, Homo sapiens
agacacagctgcaggaggtggg

SEQ ID NO: 9387491 - DNA, 22 bp, Homo sapiens
agacacataggaccacactgtg

SEQ ID NO: 9387492 - DNA, 22 bp, Homo sapiens
agacacataggaccacactgtg

SEQ ID NO: 9387493 - DNA, 22 bp, Homo sapiens
agacaggcagcagatggagtgt

SEQ ID NO: 9387494 - DNA, 22 bp, Homo sapiens
agacaggcagcagatggagtgt

SEQ ID NO: 9387495 - DNA, 22 bp, Homo sapiens
agacaggcatgaggctggattg

SEQ ID NO: 9387496 - DNA, 22 bp, Homo sapiens
agacacagtctgtctggaggag

SEQ ID NO: 9387497 - DNA, 22 bp, Homo sapiens
agacacagtgctgggtgctgag

SEQ ID NO: 9387498 - DNA, 22 bp, Homo sapiens
agacacagtgctgggtgctgag

SEQ ID NO: 9387499 - DNA, 22 bp, Homo sapiens
agacacagtttgggatgggttg

SEQ ID NO: 9387500 - DNA, 22 bp, Homo sapiens
agacagtgcaagaagagcaggc

SEQ ID NO: 9387501 - DNA, 22 bp, Homo sapiens
agacagtgatgtaagcaggagt

SEQ ID NO: 9387502 - DNA, 22 bp, Homo sapiens
agacagtgatgtaagcaggagt

SEQ ID NO: 9387503 - DNA, 22 bp, Homo sapiens
agacagtgcaagaagagcaggc

SEQ ID NO: 9387504 - DNA, 22 bp, Homo sapiens
atgcaggagttcgaggctgtat

SEQ ID NO: 9387505 - DNA, 22 bp, Homo sapiens
atgcagggaggtaagaggtgcc

SEQ ID NO: 9387506 - DNA, 21 bp, Homo sapiens
atgcaggctgctcagaagcaa

SEQ ID NO: 9387507 - DNA, 22 bp, Homo sapiens
agacagtgatggacaggcagac

SEQ ID NO: 9387508 - DNA, 22 bp, Homo sapiens
agacagtgatggacaggcagac

SEQ ID NO: 9387509 - DNA, 17 bp, Homo sapiens
agacagtgagtgccttg

SEQ ID NO: 9387510 - DNA, 22 bp, Homo sapiens
agacaggtgctcgcccaagtcc

SEQ ID NO: 9387511 - DNA, 22 bp, Homo sapiens
agacaggtgttttacaacttcg

SEQ ID NO: 9387512 - DNA, 21 bp, Homo sapiens
agacaggtcagggagaggtga

SEQ ID NO: 9387513 - DNA, 17 bp, Homo sapiens
agacaggttatagttga

SEQ ID NO: 9387514 - DNA, 22 bp, Homo sapiens
agacagtaataaaataggtaag

SEQ ID NO: 9387515 - DNA, 22 bp, Homo sapiens
atgtccagtacttctaaatggt

SEQ ID NO: 9387516 - DNA, 22 bp, Homo sapiens
atgtctgtatgtggagaggggt

SEQ ID NO: 9387517 - DNA, 22 bp, Homo sapiens
atgtctgtggcattatatgttt

SEQ ID NO: 9387518 - DNA, 22 bp, Homo sapiens
atgtccagccaaccactggatt

SEQ ID NO: 9387519 - DNA, 22 bp, Homo sapiens
atgtccagctcatgatactatc

SEQ ID NO: 9387520 - DNA, 22 bp, Homo sapiens
atgtccagccaaccactggatt

SEQ ID NO: 9387521 - DNA, 22 bp, Homo sapiens
atgtccagagtaaagcacattc

SEQ ID NO: 9387522 - DNA, 22 bp, Homo sapiens
atgtccagagtaaagcacattc

SEQ ID NO: 9387523 - DNA, 22 bp, Homo sapiens
atgtccagagaacatttgcttt

SEQ ID NO: 9387524 - DNA, 22 bp, Homo sapiens
atgtacataaaatgtataatga

SEQ ID NO: 9387525 - DNA, 22 bp, Homo sapiens
atgtacataaaatgtataatga

SEQ ID NO: 9387526 - DNA, 22 bp, Homo sapiens
atgtacataaaatgtataatga

SEQ ID NO: 9387527 - DNA, 22 bp, Homo sapiens
atgtacagtttctagactcaaa

SEQ ID NO: 9387528 - DNA, 22 bp, Homo sapiens
atgtacagtttctagactcaaa

SEQ ID NO: 9387529 - DNA, 22 bp, Homo sapiens
atgtacactttggaagagtcac

SEQ ID NO: 9387530 - DNA, 22 bp, Homo sapiens
atgtacagccacttcacagtta

SEQ ID NO: 9387531 - DNA, 22 bp, Homo sapiens
atgtacagtgataagagggcag

SEQ ID NO: 9387532 - DNA, 22 bp, Homo sapiens
atgtacagtggaaactaacaaa

SEQ ID NO: 9387533 - DNA, 22 bp, Homo sapiens
atgtacaggtcttggcaaaggg

SEQ ID NO: 9387534 - DNA, 22 bp, Homo sapiens
atgtacaggatggtgctcatct

SEQ ID NO: 9387535 - DNA, 22 bp, Homo sapiens
atgtacaggatggtgctcatct

SEQ ID NO: 9387536 - DNA, 22 bp, Homo sapiens
atggctggtttgagctttagca

SEQ ID NO: 9387537 - DNA, 22 bp, Homo sapiens
atggctgtagtcatctgaaggc

SEQ ID NO: 9387538 - DNA, 22 bp, Homo sapiens
atggctgtgaaatggtaggtgg

SEQ ID NO: 9387539 - DNA, 22 bp, Homo sapiens
atggctgtcacgccactgtgag

SEQ ID NO: 9387540 - DNA, 22 bp, Homo sapiens
atgggaggatcacttgaggcca

SEQ ID NO: 9387541 - DNA, 22 bp, Homo sapiens
atgggaggaaggaggcccttga

SEQ ID NO: 9387542 - DNA, 22 bp, Homo sapiens
atgggaggaaggaggcccttga

SEQ ID NO: 9387543 - DNA, 22 bp, Homo sapiens
atgggaggaagagaagatgtct

SEQ ID NO: 9387544 - DNA, 22 bp, Homo sapiens
atgggaggcaaagatcgcagaa

SEQ ID NO: 9387545 - DNA, 22 bp, Homo sapiens
atgggaggcagacactaagttc

SEQ ID NO: 9387546 - DNA, 22 bp, Homo sapiens
atgggaggcagacactaagttc

SEQ ID NO: 9387547 - DNA, 22 bp, Homo sapiens
atgggaggcagcagagcccagc

SEQ ID NO: 9387548 - DNA, 20 bp, Homo sapiens
atgtaaaattataaggctga

SEQ ID NO: 9387549 - DNA, 22 bp, Homo sapiens
atgtaaagggcatggtattggg

SEQ ID NO: 9387550 - DNA, 22 bp, Homo sapiens
atgtaaactttaccagctctga

SEQ ID NO: 9387551 - DNA, 22 bp, Homo sapiens
atgtacacatgcatgcatgtgc

SEQ ID NO: 9387552 - DNA, 22 bp, Homo sapiens
atgggtggccccgtgtgcagtc

SEQ ID NO: 9387553 - DNA, 22 bp, Homo sapiens
atggtttagcaacttagggaaa

SEQ ID NO: 9387554 - DNA, 22 bp, Homo sapiens
atggtttcacaaacaaaaggtt

SEQ ID NO: 9387555 - DNA, 22 bp, Homo sapiens
atggtttttcaagtattcagaa

SEQ ID NO: 9387556 - DNA, 22 bp, Homo sapiens
atggtttttcaagtattcagaa

SEQ ID NO: 9387557 - DNA, 22 bp, Homo sapiens
atggttttgaagggaggtcaaa

SEQ ID NO: 9387558 - DNA, 22 bp, Homo sapiens
atggttttgtcctctttggttc

SEQ ID NO: 9387559 - DNA, 22 bp, Homo sapiens
atggttttgtcctctttggttc

SEQ ID NO: 9387560 - DNA, 22 bp, Homo sapiens
atggttttagaatcaggaaaaa

SEQ ID NO: 9387561 - DNA, 22 bp, Homo sapiens
atggttttatttctctatagct

SEQ ID NO: 9387562 - DNA, 22 bp, Homo sapiens
atggttttcctctgctgcttaa

SEQ ID NO: 9387563 - DNA, 22 bp, Homo sapiens
atgcaggggcagcagagcctgg

SEQ ID NO: 9387564 - DNA, 22 bp, Homo sapiens
atgcaggggccgcctggccagg

SEQ ID NO: 9387565 - DNA, 23 bp, Homo sapiens
atgcagggttacagggctgactt

SEQ ID NO: 9387566 - DNA, 22 bp, Homo sapiens
atgcagggtctccgtgtgacga

SEQ ID NO: 9387567 - DNA, 22 bp, Homo sapiens
atgcttgatcttcatagcattt

SEQ ID NO: 9387568 - DNA, 22 bp, Homo sapiens
agactcctcggaccaatcagcg

SEQ ID NO: 9387569 - DNA, 22 bp, Homo sapiens
agactccttctcactgcctgta

SEQ ID NO: 9387570 - DNA, 22 bp, Homo sapiens
agactctgaagtcattgcatga

SEQ ID NO: 9387571 - DNA, 22 bp, Homo sapiens
agactctgagacatgaaccatc

SEQ ID NO: 9387572 - DNA, 22 bp, Homo sapiens
agactctgaggagccctgagac

SEQ ID NO: 9387573 - DNA, 23 bp, Homo sapiens
agactctgagagtgtgctttgca

SEQ ID NO: 9387574 - DNA, 22 bp, Homo sapiens
agactacatatgccacatgaag

SEQ ID NO: 9387575 - DNA, 22 bp, Homo sapiens
agactacatatgccacatgaag

SEQ ID NO: 9387576 - DNA, 22 bp, Homo sapiens
agactacaggagaaactcactc

SEQ ID NO: 9387577 - DNA, 22 bp, Homo sapiens
agactattacctaaaagataca

SEQ ID NO: 9387578 - DNA, 22 bp, Homo sapiens
agactagtctgaaggttttttt

SEQ ID NO: 9387579 - DNA, 22 bp, Homo sapiens
agactcatgacacttcctatga

SEQ ID NO: 9387580 - DNA, 22 bp, Homo sapiens
agactcatgacacttcctatga

SEQ ID NO: 9387581 - DNA, 22 bp, Homo sapiens
atggaaatatctttagagctta

SEQ ID NO: 9387582 - DNA, 22 bp, Homo sapiens
atggctggcgtcattgtgtggg

SEQ ID NO: 9387583 - DNA, 22 bp, Homo sapiens
atggctggcgtcattgtgtggg

SEQ ID NO: 9387584 - DNA, 22 bp, Homo sapiens
atggctggctgagcctggttat

SEQ ID NO: 9387585 - DNA, 22 bp, Homo sapiens
atggctggcatgtgcataacgg

SEQ ID NO: 9387586 - DNA, 22 bp, Homo sapiens
atggcagcctgaacacttcctg

SEQ ID NO: 9387587 - DNA, 22 bp, Homo sapiens
atggcagcctgagcagaggaat

SEQ ID NO: 9387588 - DNA, 22 bp, Homo sapiens
atggcagccagtgttggaggaa

SEQ ID NO: 9387589 - DNA, 22 bp, Homo sapiens
atggcagccagtgttggaggaa

SEQ ID NO: 9387590 - DNA, 22 bp, Homo sapiens
atggcagcccacgatggcaatg

SEQ ID NO: 9387591 - DNA, 22 bp, Homo sapiens
atggcagcccacgatggcaatg

SEQ ID NO: 9387592 - DNA, 19 bp, Homo sapiens
atggcagcagcagctctcc

SEQ ID NO: 9387593 - DNA, 22 bp, Homo sapiens
atggcagcagctttagctgtgg

SEQ ID NO: 9387594 - DNA, 22 bp, Homo sapiens
atggcagcagggcttgattatg

SEQ ID NO: 9387595 - DNA, 22 bp, Homo sapiens
atggcagcagtccattgcctca

SEQ ID NO: 9387596 - DNA, 22 bp, Homo sapiens
atggcagcatagtggcaagtta

SEQ ID NO: 9387597 - DNA, 22 bp, Homo sapiens
atggcagcagtttggagtcttt

SEQ ID NO: 9387598 - DNA, 22 bp, Homo sapiens
atggcagcagtttggagtcttt

SEQ ID NO: 9387599 - DNA, 22 bp, Homo sapiens
atggcagcatgggattggtaga

SEQ ID NO: 9387600 - DNA, 22 bp, Homo sapiens
atggcagcatgggattggtaga

SEQ ID NO: 9387601 - DNA, 22 bp, Homo sapiens
atggctgggatggggtagagaa

SEQ ID NO: 9387602 - DNA, 22 bp, Homo sapiens
atggctgggatggggtagagaa

SEQ ID NO: 9387603 - DNA, 22 bp, Homo sapiens
atggctgggatggggtagagaa

SEQ ID NO: 9387604 - DNA, 22 bp, Homo sapiens
atggctggctttacttgctttg

SEQ ID NO: 9387605 - DNA, 22 bp, Homo sapiens
atggctgggaggagagtatgat

SEQ ID NO: 9387606 - DNA, 22 bp, Homo sapiens
atggctgggatgcttctagcaa

SEQ ID NO: 9387607 - DNA, 22 bp, Homo sapiens
atggctgggatttcctttgcgt

SEQ ID NO: 9387608 - DNA, 22 bp, Homo sapiens
atggctgggcttttagtcagat

SEQ ID NO: 9387609 - DNA, 22 bp, Homo sapiens
atggctgggtcaccatcagggt

SEQ ID NO: 9387610 - DNA, 22 bp, Homo sapiens
atggctgggtcaccatcagggt

SEQ ID NO: 9387611 - DNA, 22 bp, Homo sapiens
atggctgggtcaccatcagggt

SEQ ID NO: 9387612 - DNA, 22 bp, Homo sapiens
atggctgggtcaccatcagggt

SEQ ID NO: 9387613 - DNA, 21 bp, Homo sapiens
atggctggtggctcagcctcc

SEQ ID NO: 9387614 - DNA, 22 bp, Homo sapiens
atggctggtgatactggagtga

SEQ ID NO: 9387615 - DNA, 22 bp, Homo sapiens
atggctggtgatactggagtga

SEQ ID NO: 9387616 - DNA, 22 bp, Homo sapiens
atggctggtagtgaattaatct

SEQ ID NO: 9387617 - DNA, 22 bp, Homo sapiens
atggctgggttcttctataggt

SEQ ID NO: 9387618 - DNA, 22 bp, Homo sapiens
atggctggtctcccatggaaaa

SEQ ID NO: 9387619 - DNA, 20 bp, Homo sapiens
atggagtgaagagtgaaagc

SEQ ID NO: 9387620 - DNA, 22 bp, Homo sapiens
atggaggtgccaggtgtgaggg

SEQ ID NO: 9387621 - DNA, 22 bp, Homo sapiens
atggaggtggaagaatgagtta

SEQ ID NO: 9387622 - DNA, 22 bp, Homo sapiens
atggaggtctgtgactcccaaa

SEQ ID NO: 9387623 - DNA, 22 bp, Homo sapiens
atggacagtactgagtggacta

SEQ ID NO: 9387624 - DNA, 22 bp, Homo sapiens
atggagtgctgttgatcaaggt

SEQ ID NO: 9387625 - DNA, 22 bp, Homo sapiens
atggagtgggccaattttagtg

SEQ ID NO: 9387626 - DNA, 22 bp, Homo sapiens
atggagtgggccaattttagtg

SEQ ID NO: 9387627 - DNA, 22 bp, Homo sapiens
atggagtgcctgtggcagtggg

SEQ ID NO: 9387628 - DNA, 22 bp, Homo sapiens
atggagtgctgttgatcaaggt

SEQ ID NO: 9387629 - DNA, 22 bp, Homo sapiens
atggagtgctgttgatcaaggt

SEQ ID NO: 9387630 - DNA, 22 bp, Homo sapiens
atggagtgtggccaggcagtaa

SEQ ID NO: 9387631 - DNA, 22 bp, Homo sapiens
atggagtgtcaccttcctggtt

SEQ ID NO: 9387632 - DNA, 22 bp, Homo sapiens
atggagtggtacttacttggct

SEQ ID NO: 9387633 - DNA, 22 bp, Homo sapiens
atggagtggggactgcagtgga

SEQ ID NO: 9387634 - DNA, 22 bp, Homo sapiens
atggagttctgccagcgctgct

SEQ ID NO: 9387635 - DNA, 22 bp, Homo sapiens
atggataatcatgaactttgag

SEQ ID NO: 9387636 - DNA, 22 bp, Homo sapiens
atggcagatggctggagcaggt

SEQ ID NO: 9387637 - DNA, 22 bp, Homo sapiens
atggcagcaaagaggccttctt

SEQ ID NO: 9387638 - DNA, 22 bp, Homo sapiens
atggcagcaaatgtctggctgg

SEQ ID NO: 9387639 - DNA, 22 bp, Homo sapiens
atggcagatggctggagcaggt

SEQ ID NO: 9387640 - DNA, 22 bp, Homo sapiens
atggcagatggctggagcaggt

SEQ ID NO: 9387641 - DNA, 22 bp, Homo sapiens
atccacttggctggttgttcta

SEQ ID NO: 9387642 - DNA, 22 bp, Homo sapiens
atccacttgccactgtatagtt

SEQ ID NO: 9387643 - DNA, 22 bp, Homo sapiens
atccagagacccaaggacagaa

SEQ ID NO: 9387644 - DNA, 22 bp, Homo sapiens
atccacttcactggaatgtagg

SEQ ID NO: 9387645 - DNA, 22 bp, Homo sapiens
atcatttgtgcatagtaacaga

SEQ ID NO: 9387646 - DNA, 22 bp, Homo sapiens
atcatttgcctcaagtgaaagt

SEQ ID NO: 9387647 - DNA, 22 bp, Homo sapiens
atcatttccctttagatcacaa

SEQ ID NO: 9387648 - DNA, 22 bp, Homo sapiens
agaagaaatgaggccgttctgc

SEQ ID NO: 9387649 - DNA, 22 bp, Homo sapiens
agaagaaatgaggccgttctgc

SEQ ID NO: 9387650 - DNA, 22 bp, Homo sapiens
agaagaaatgaggccgttctgc

SEQ ID NO: 9387651 - DNA, 22 bp, Homo sapiens
atccagagaggttaggtgacat

SEQ ID NO: 9387652 - DNA, 22 bp, Homo sapiens
atccagagtaatacagaatgca

SEQ ID NO: 9387653 - DNA, 22 bp, Homo sapiens
atcatttacaatgaaagcctga

SEQ ID NO: 9387654 - DNA, 22 bp, Homo sapiens
atcatttacaaactcagcattg

SEQ ID NO: 9387655 - DNA, 22 bp, Homo sapiens
atcatttacaaactcagcattg

SEQ ID NO: 9387656 - DNA, 22 bp, Homo sapiens
atcatttacaaactcagcattg

SEQ ID NO: 9387657 - DNA, 22 bp, Homo sapiens
atcatttacaaactcagcattg

SEQ ID NO: 9387658 - DNA, 22 bp, Homo sapiens
atcattgggctccattactaga

SEQ ID NO: 9387659 - DNA, 22 bp, Homo sapiens
atcattggaggcactgtgcagt

SEQ ID NO: 9387660 - DNA, 21 bp, Homo sapiens
atcattctggaaaattcaagc

SEQ ID NO: 9387661 - DNA, 22 bp, Homo sapiens
atcagcaagatgtaatttctat

SEQ ID NO: 9387662 - DNA, 19 bp, Homo sapiens
atcagcaaggtaggatgtg

SEQ ID NO: 9387663 - DNA, 22 bp, Homo sapiens
atcatcttgctttctgtttact

SEQ ID NO: 9387664 - DNA, 20 bp, Homo sapiens
atcatctttacaatgtcagt

SEQ ID NO: 9387665 - DNA, 22 bp, Homo sapiens
atcattctgatggtcaatgcta

SEQ ID NO: 9387666 - DNA, 22 bp, Homo sapiens
atcacattgttagcatagactg

SEQ ID NO: 9387667 - DNA, 21 bp, Homo sapiens
atcaccagcagaagctgcaga

SEQ ID NO: 9387668 - DNA, 22 bp, Homo sapiens
atcaccaggcaaaatgtcagag

SEQ ID NO: 9387669 - DNA, 21 bp, Homo sapiens
atcaccagcagaagctgcaga

SEQ ID NO: 9387670 - DNA, 22 bp, Homo sapiens
atcaccaggcaaaatgtcagag

SEQ ID NO: 9387671 - DNA, 22 bp, Homo sapiens
atcaccattgaaaaacaggttt

SEQ ID NO: 9387672 - DNA, 22 bp, Homo sapiens
atcaccagtaagttttcagttt

SEQ ID NO: 9387673 - DNA, 20 bp, Homo sapiens
atcacctgtaggttctttgt

SEQ ID NO: 9387674 - DNA, 22 bp, Homo sapiens
atcaccattgaaaaacaggttt

SEQ ID NO: 9387675 - DNA, 22 bp, Homo sapiens
atcactgagcttcagtgctggc

SEQ ID NO: 9387676 - DNA, 22 bp, Homo sapiens
atcactgtggaaaactgtatgg

SEQ ID NO: 9387677 - DNA, 22 bp, Homo sapiens
atcactgtcgtcatctgagatt

SEQ ID NO: 9387678 - DNA, 22 bp, Homo sapiens
atcactgttatctagaagcaca

SEQ ID NO: 9387679 - DNA, 22 bp, Homo sapiens
atcactgttatctagaagcaca

SEQ ID NO: 9387680 - DNA, 22 bp, Homo sapiens
atcagaggacctagttgggcag

SEQ ID NO: 9387681 - DNA, 22 bp, Homo sapiens
atcagaggaagacgacggaatg

SEQ ID NO: 9387682 - DNA, 22 bp, Homo sapiens
atcagaggaaattaactctctc

SEQ ID NO: 9387683 - DNA, 22 bp, Homo sapiens
atcagagctgtgattcccactc

SEQ ID NO: 9387684 - DNA, 22 bp, Homo sapiens
atcagaggtgttgaaacatgac

SEQ ID NO: 9387685 - DNA, 22 bp, Homo sapiens
atcagaggttatgtggagggga

SEQ ID NO: 9387686 - DNA, 22 bp, Homo sapiens
atcagaggtgagggagagcccc

SEQ ID NO: 9387687 - DNA, 22 bp, Homo sapiens
atcagaggtggaactggggact

SEQ ID NO: 9387688 - DNA, 20 bp, Homo sapiens
atcagaggatagggaagtgg

SEQ ID NO: 9387689 - DNA, 22 bp, Homo sapiens
atcagaggtactttccattttt

SEQ ID NO: 9387690 - DNA, 22 bp, Homo sapiens
atcagagggtgagatggagaaa

SEQ ID NO: 9387691 - DNA, 22 bp, Homo sapiens
atcagagggtgagatggagaaa

SEQ ID NO: 9387692 - DNA, 21 bp, Homo sapiens
atcagagtacgcatgcgctga

SEQ ID NO: 9387693 - DNA, 22 bp, Homo sapiens
atcagagtagttgttgcccaga

SEQ ID NO: 9387694 - DNA, 22 bp, Homo sapiens
atcagagtgtaagttctttcct

SEQ ID NO: 9387695 - DNA, 22 bp, Homo sapiens
atcagatccataatgacctgtg

SEQ ID NO: 9387696 - DNA, 22 bp, Homo sapiens
agaaacatcctgctttccattt

SEQ ID NO: 9387697 - DNA, 22 bp, Homo sapiens
agaaacagaagggaaagctttt

SEQ ID NO: 9387698 - DNA, 20 bp, Homo sapiens
agaaacagcacaattctgtt

SEQ ID NO: 9387699 - DNA, 21 bp, Homo sapiens
agaaacatgatcaaaggaacc

SEQ ID NO: 9387700 - DNA, 22 bp, Homo sapiens
atcaattttgaggatacaagaa

SEQ ID NO: 9387701 - DNA, 22 bp, Homo sapiens
atcaattttgaggatacaagaa

SEQ ID NO: 9387702 - DNA, 22 bp, Homo sapiens
atatcttggccccaggatttta

SEQ ID NO: 9387703 - DNA, 22 bp, Homo sapiens
atatccagcagcaggtgagtat

SEQ ID NO: 9387704 - DNA, 22 bp, Homo sapiens
atatccagcagcaggtgagtat

SEQ ID NO: 9387705 - DNA, 22 bp, Homo sapiens
atatattttgaatagcctctgt

SEQ ID NO: 9387706 - DNA, 22 bp, Homo sapiens
atatatttactctcctgttgca

SEQ ID NO: 9387707 - DNA, 22 bp, Homo sapiens
atatatttgagaatattcatga

SEQ ID NO: 9387708 - DNA, 22 bp, Homo sapiens
atatatttgagaatattcatga

SEQ ID NO: 9387709 - DNA, 22 bp, Homo sapiens
atatatttgagaatattcatga

SEQ ID NO: 9387710 - DNA, 22 bp, Homo sapiens
atatatttgagaatattcatga

SEQ ID NO: 9387711 - DNA, 22 bp, Homo sapiens
agaaaatttaaagagacacaca

SEQ ID NO: 9387712 - DNA, 22 bp, Homo sapiens
agaaaatttaaagagacacaca

SEQ ID NO: 9387713 - DNA, 22 bp, Homo sapiens
agaaaatttaaagagacacaca

SEQ ID NO: 9387714 - DNA, 22 bp, Homo sapiens
agaaacaacttgtttctcttgc

SEQ ID NO: 9387715 - DNA, 22 bp, Homo sapiens
agaaacagaaccaggtgtcatt

SEQ ID NO: 9387716 - DNA, 22 bp, Homo sapiens
agaaaattagattttactgtgt

SEQ ID NO: 9387717 - DNA, 22 bp, Homo sapiens
agaaaataaattgatggtggaa

SEQ ID NO: 9387718 - DNA, 22 bp, Homo sapiens
agaaaataaattgatggtggaa

SEQ ID NO: 9387719 - DNA, 22 bp, Homo sapiens
atatattcttaaagaatctgac

SEQ ID NO: 9387720 - DNA, 18 bp, Homo sapiens
atatattgacaagaggga

SEQ ID NO: 9387721 - DNA, 22 bp, Homo sapiens
atatattggtgtcagaaagagt

SEQ ID NO: 9387722 - DNA, 22 bp, Homo sapiens
atatataacctggataaggctt

SEQ ID NO: 9387723 - DNA, 22 bp, Homo sapiens
actttggtgcgaagtcacttta

SEQ ID NO: 9387724 - DNA, 22 bp, Homo sapiens
actttggtgcgaagtcacttta

SEQ ID NO: 9387725 - DNA, 20 bp, Homo sapiens
actttggttattgggaccat

SEQ ID NO: 9387726 - DNA, 22 bp, Homo sapiens
actttggtcccatgtgtgtaaa

SEQ ID NO: 9387727 - DNA, 17 bp, Homo sapiens
actttggtcctgtgctc

SEQ ID NO: 9387728 - DNA, 22 bp, Homo sapiens
actttggtcttagaggaggaat

SEQ ID NO: 9387729 - DNA, 19 bp, Homo sapiens
actttggtgattagaggga

SEQ ID NO: 9387730 - DNA, 22 bp, Homo sapiens
actttggtgatacagatacggc

SEQ ID NO: 9387731 - DNA, 22 bp, Homo sapiens
atagtttacaaaaatgatgcat

SEQ ID NO: 9387732 - DNA, 22 bp, Homo sapiens
atagtttaaggaactatgcgat

SEQ ID NO: 9387733 - DNA, 22 bp, Homo sapiens
acttggtggaacgtgtatttta

SEQ ID NO: 9387734 - DNA, 22 bp, Homo sapiens
atatacacatctttttaaatat

SEQ ID NO: 9387735 - DNA, 22 bp, Homo sapiens
atatacacagagcttatggtga

SEQ ID NO: 9387736 - DNA, 22 bp, Homo sapiens
atatacaaagggcaacctcgct

SEQ ID NO: 9387737 - DNA, 22 bp, Homo sapiens
atatacaaagggcaacctcgct

SEQ ID NO: 9387738 - DNA, 22 bp, Homo sapiens
atatacaaagggcaacctcgct

SEQ ID NO: 9387739 - DNA, 22 bp, Homo sapiens
atataatagtttcataaaggct

SEQ ID NO: 9387740 - DNA, 22 bp, Homo sapiens
atataatttagaaggggaaaca

SEQ ID NO: 9387741 - DNA, 22 bp, Homo sapiens
actgtgttcacacttacaaatg

SEQ ID NO: 9387742 - DNA, 22 bp, Homo sapiens
actgtgtggaccactctgaggc

SEQ ID NO: 9387743 - DNA, 22 bp, Homo sapiens
actgttacagagcaggaaattg

SEQ ID NO: 9387744 - DNA, 21 bp, Homo sapiens
actgttaagacgtagctgggg

SEQ ID NO: 9387745 - DNA, 22 bp, Homo sapiens
actgtgtgactgttattactgt

SEQ ID NO: 9387746 - DNA, 22 bp, Homo sapiens
actgtgtctagcaccacgtgtc

SEQ ID NO: 9387747 - DNA, 18 bp, Homo sapiens
actgtgtgaattagctcc

SEQ ID NO: 9387748 - DNA, 22 bp, Homo sapiens
actgtgtctcattcatcattgt

SEQ ID NO: 9387749 - DNA, 22 bp, Homo sapiens
acttcaaattttcagaagaaat

SEQ ID NO: 9387750 - DNA, 22 bp, Homo sapiens
acttcagaaaatgttgaatgtt

SEQ ID NO: 9387751 - DNA, 22 bp, Homo sapiens
acttcagagactttatggtcca

SEQ ID NO: 9387752 - DNA, 19 bp, Homo sapiens
acttcagcagggttcctgt

SEQ ID NO: 9387753 - DNA, 22 bp, Homo sapiens
acttcaaatgtgacaatgtgaa

SEQ ID NO: 9387754 - DNA, 22 bp, Homo sapiens
acttcaaacaattaacagagaa

SEQ ID NO: 9387755 - DNA, 22 bp, Homo sapiens
actgttatgatttacacagtcc

SEQ ID NO: 9387756 - DNA, 22 bp, Homo sapiens
acttagaattaaatatttttgg

SEQ ID NO: 9387757 - DNA, 22 bp, Homo sapiens
acttatttcatggatcataatg

SEQ ID NO: 9387758 - DNA, 22 bp, Homo sapiens
acttcatgcagaagagagctgt

SEQ ID NO: 9387759 - DNA, 22 bp, Homo sapiens
acttcatgctttagagagatga

SEQ ID NO: 9387760 - DNA, 22 bp, Homo sapiens
acttcatttcatttgcacagtg

SEQ ID NO: 9387761 - DNA, 22 bp, Homo sapiens
acttcattgtaatattatagca

SEQ ID NO: 9387762 - DNA, 22 bp, Homo sapiens
acttcattgtaatattatagca

SEQ ID NO: 9387763 - DNA, 22 bp, Homo sapiens
acttctttcacaatgtttctag

SEQ ID NO: 9387764 - DNA, 22 bp, Homo sapiens
acttccagatggccccatctaa

SEQ ID NO: 9387765 - DNA, 22 bp, Homo sapiens
acttgccccagaattgctgctg

SEQ ID NO: 9387766 - DNA, 22 bp, Homo sapiens
acttgctggtggcatttacagt

SEQ ID NO: 9387767 - DNA, 20 bp, Homo sapiens
acttgctgggctttgttacc

SEQ ID NO: 9387768 - DNA, 20 bp, Homo sapiens
acttggaactcatttttctt

SEQ ID NO: 9387769 - DNA, 22 bp, Homo sapiens
acttggaatattgcgtttttgc

SEQ ID NO: 9387770 - DNA, 22 bp, Homo sapiens
acttggagagcattgctgggga

SEQ ID NO: 9387771 - DNA, 22 bp, Homo sapiens
acttgggaaagaagtttcaccg

SEQ ID NO: 9387772 - DNA, 22 bp, Homo sapiens
acttggcttttccatctctgca

SEQ ID NO: 9387773 - DNA, 22 bp, Homo sapiens
agtttacacttttgattcttat

SEQ ID NO: 9387774 - DNA, 22 bp, Homo sapiens
agtttacactatgaaaagacta

SEQ ID NO: 9387775 - DNA, 22 bp, Homo sapiens
agtttacacttttgattcttat

SEQ ID NO: 9387776 - DNA, 22 bp, Homo sapiens
agtttacactatgaaaagacta

SEQ ID NO: 9387777 - DNA, 22 bp, Homo sapiens
agtttacagatgctacaggagc

SEQ ID NO: 9387778 - DNA, 22 bp, Homo sapiens
agtttacagatgctacaggagc

SEQ ID NO: 9387779 - DNA, 22 bp, Homo sapiens
agtttacacttttgattcttat

SEQ ID NO: 9387780 - DNA, 22 bp, Homo sapiens
agtttacagatgctacaggagc

SEQ ID NO: 9387781 - DNA, 22 bp, Homo sapiens
actggcagtgtcgtttacatga

SEQ ID NO: 9387782 - DNA, 22 bp, Homo sapiens
actggcagtgtcgtttacatga

SEQ ID NO: 9387783 - DNA, 19 bp, Homo sapiens
actggcagtttctgcatgg

SEQ ID NO: 9387784 - DNA, 19 bp, Homo sapiens
actggcagtttctgcatgg

SEQ ID NO: 9387785 - DNA, 19 bp, Homo sapiens
actggcagtttctgcatgg

SEQ ID NO: 9387786 - DNA, 22 bp, Homo sapiens
actggcagtttgagaatgcatt

SEQ ID NO: 9387787 - DNA, 22 bp, Homo sapiens
actggcagtttgagaatgcatt

SEQ ID NO: 9387788 - DNA, 22 bp, Homo sapiens
agttgctcaatgtggctgtgga

SEQ ID NO: 9387789 - DNA, 20 bp, Homo sapiens
actggcagcctgcctgctgt

SEQ ID NO: 9387790 - DNA, 20 bp, Homo sapiens
actggcagcctgcctgctgt

SEQ ID NO: 9387791 - DNA, 22 bp, Homo sapiens
actggcagctgtaggatgcatg

SEQ ID NO: 9387792 - DNA, 22 bp, Homo sapiens
actggcagctgtaggatgcatg

SEQ ID NO: 9387793 - DNA, 19 bp, Homo sapiens
actggcagctgtagtctgt

SEQ ID NO: 9387794 - DNA, 22 bp, Homo sapiens
actggcaggctgctggccggcg

SEQ ID NO: 9387795 - DNA, 22 bp, Homo sapiens
actggcaggctgctggccggcg

SEQ ID NO: 9387796 - DNA, 19 bp, Homo sapiens
actggcagctgtagtctgt

SEQ ID NO: 9387797 - DNA, 22 bp, Homo sapiens
actggcaggctgctggccggcg

SEQ ID NO: 9387798 - DNA, 22 bp, Homo sapiens
actggcagggggagccccgaga

SEQ ID NO: 9387799 - DNA, 19 bp, Homo sapiens
actggcagggctgcggtgg

SEQ ID NO: 9387800 - DNA, 19 bp, Homo sapiens
actggcagggctgcggtgg

SEQ ID NO: 9387801 - DNA, 22 bp, Homo sapiens
actggcaggtccatcgcccttt

SEQ ID NO: 9387802 - DNA, 22 bp, Homo sapiens
actggcagtagagggagcgcat

SEQ ID NO: 9387803 - DNA, 22 bp, Homo sapiens
actggcaggtccatcgcccttt

SEQ ID NO: 9387804 - DNA, 22 bp, Homo sapiens
actggcagggggagccccgaga

SEQ ID NO: 9387805 - DNA, 22 bp, Homo sapiens
actggcagtagagggagcgcat

SEQ ID NO: 9387806 - DNA, 22 bp, Homo sapiens
actggcagtagagggagcgcat

SEQ ID NO: 9387807 - DNA, 22 bp, Homo sapiens
actggcagtggcagcagaaaga

SEQ ID NO: 9387808 - DNA, 22 bp, Homo sapiens
actggcagtggcagcagaaaga

SEQ ID NO: 9387809 - DNA, 22 bp, Homo sapiens
actgtaaaatgagatatgtata

SEQ ID NO: 9387810 - DNA, 22 bp, Homo sapiens
actgtaaaatacataagtattg

SEQ ID NO: 9387811 - DNA, 22 bp, Homo sapiens
actgtaaaagaaggtctttgca

SEQ ID NO: 9387812 - DNA, 22 bp, Homo sapiens
actgtaaaatacataagtattg

SEQ ID NO: 9387813 - DNA, 19 bp, Homo sapiens
agtttatgcagatactggt

SEQ ID NO: 9387814 - DNA, 22 bp, Homo sapiens
actggtttcctagaataagact

SEQ ID NO: 9387815 - DNA, 22 bp, Homo sapiens
actggtttgggacaatttgtgc

SEQ ID NO: 9387816 - DNA, 22 bp, Homo sapiens
actggtttgtctattgtcattc

SEQ ID NO: 9387817 - DNA, 22 bp, Homo sapiens
actggttttccaggttacttct

SEQ ID NO: 9387818 - DNA, 22 bp, Homo sapiens
actggtttttctcatgaaaatg

SEQ ID NO: 9387819 - DNA, 22 bp, Homo sapiens
actggttttggaaatcagtaca

SEQ ID NO: 9387820 - DNA, 22 bp, Homo sapiens
actggtttttccatatgagatg

SEQ ID NO: 9387821 - DNA, 22 bp, Homo sapiens
agtttagtataccagtacatct

SEQ ID NO: 9387822 - DNA, 22 bp, Homo sapiens
agtttatagcccagattcatgg

SEQ ID NO: 9387823 - DNA, 22 bp, Homo sapiens
agtttagaagaggaacttgtta

SEQ ID NO: 9387824 - DNA, 22 bp, Homo sapiens
agtttacatgacgtgtatttca

SEQ ID NO: 9387825 - DNA, 22 bp, Homo sapiens
agtttacatgacgtgtatttca

SEQ ID NO: 9387826 - DNA, 22 bp, Homo sapiens
agtttacatgacgtgtatttca

SEQ ID NO: 9387827 - DNA, 22 bp, Homo sapiens
agtttacatcttcaatctcatt

SEQ ID NO: 9387828 - DNA, 22 bp, Homo sapiens
actgtgtattctaatgactaaa

SEQ ID NO: 9387829 - DNA, 20 bp, Homo sapiens
actgtgtaaacatgattcat

SEQ ID NO: 9387830 - DNA, 22 bp, Homo sapiens
actgtgtatgatatgtactggg

SEQ ID NO: 9387831 - DNA, 21 bp, Homo sapiens
actgtgggtctgaccacctgg

SEQ ID NO: 9387832 - DNA, 22 bp, Homo sapiens
actgtgggtgagggcaaatcaa

SEQ ID NO: 9387833 - DNA, 22 bp, Homo sapiens
actgtggtgcacggcctgctcc

SEQ ID NO: 9387834 - DNA, 22 bp, Homo sapiens
actgtgggtcccagctgtgtct

SEQ ID NO: 9387835 - DNA, 23 bp, Homo sapiens
agtttccacccagggtagaaggg

SEQ ID NO: 9387836 - DNA, 22 bp, Homo sapiens
agtttcatttcttagtaccagt

SEQ ID NO: 9387837 - DNA, 22 bp, Homo sapiens
agtttcatgtagccatatttac

SEQ ID NO: 9387838 - DNA, 22 bp, Homo sapiens
agtttcattgagatgtttgcta

SEQ ID NO: 9387839 - DNA, 21 bp, Homo sapiens
actgtgactgggtgtatgggt

SEQ ID NO: 9387840 - DNA, 22 bp, Homo sapiens
agtttcctcatctgtaaaatga

SEQ ID NO: 9387841 - DNA, 22 bp, Homo sapiens
actgtcatcttgtaagcaatgt

SEQ ID NO: 9387842 - DNA, 22 bp, Homo sapiens
actgtcatgatcgaagatgtca

SEQ ID NO: 9387843 - DNA, 22 bp, Homo sapiens
actgtaaattacataagaacag

SEQ ID NO: 9387844 - DNA, 22 bp, Homo sapiens
actgtaaaggtttgtagcccag

SEQ ID NO: 9387845 - DNA, 22 bp, Homo sapiens
actgtcttcaaatgaatatatt

SEQ ID NO: 9387846 - DNA, 22 bp, Homo sapiens
actgtgaatcactactagtaga

SEQ ID NO: 9387847 - DNA, 22 bp, Homo sapiens
actgtgaatcactactagtaga

SEQ ID NO: 9387848 - DNA, 20 bp, Homo sapiens
actgtgaatgctgaattagc

SEQ ID NO: 9387849 - DNA, 21 bp, Homo sapiens
actgtgaagatgctataaact

SEQ ID NO: 9387850 - DNA, 22 bp, Homo sapiens
actgtcttccaggtctggaggt

SEQ ID NO: 9387851 - DNA, 22 bp, Homo sapiens
actgtcttcatatctgtgtctc

SEQ ID NO: 9387852 - DNA, 22 bp, Homo sapiens
actgtcttgtgttaaagaacca

SEQ ID NO: 9387853 - DNA, 22 bp, Homo sapiens
actgtctttgagctggaggagg

SEQ ID NO: 9387854 - DNA, 22 bp, Homo sapiens
actgtcttgttccaagactaaa

SEQ ID NO: 9387855 - DNA, 22 bp, Homo sapiens
acctggagaaagcctctccctg

SEQ ID NO: 9387856 - DNA, 22 bp, Homo sapiens
acctggagaaagcctctccctg

SEQ ID NO: 9387857 - DNA, 22 bp, Homo sapiens
acctggagaaagcctctccctg

SEQ ID NO: 9387858 - DNA, 22 bp, Homo sapiens
acctggacacctgctgtcatct

SEQ ID NO: 9387859 - DNA, 22 bp, Homo sapiens
acctggacttgaatcctgactt

SEQ ID NO: 9387860 - DNA, 22 bp, Homo sapiens
acctggacacctgctgtcatct

SEQ ID NO: 9387861 - DNA, 22 bp, Homo sapiens
acctggacacctgctgtcatct

SEQ ID NO: 9387862 - DNA, 22 bp, Homo sapiens
acctggacacctgctgtcatct

SEQ ID NO: 9387863 - DNA, 21 bp, Homo sapiens
aggtacaggtcttgtgagtct

SEQ ID NO: 9387864 - DNA, 22 bp, Homo sapiens
acctggagcttccaactcaact

SEQ ID NO: 9387865 - DNA, 22 bp, Homo sapiens
acctggagatccatggtgtcga

SEQ ID NO: 9387866 - DNA, 20 bp, Homo sapiens
acctggagacagcactctgg

SEQ ID NO: 9387867 - DNA, 20 bp, Homo sapiens
acctggagacagcactctgg

SEQ ID NO: 9387868 - DNA, 17 bp, Homo sapiens
acctggagaccaagtcc

SEQ ID NO: 9387869 - DNA, 20 bp, Homo sapiens
acctggagagattattacca

SEQ ID NO: 9387870 - DNA, 17 bp, Homo sapiens
acctggagaccaagtcc

SEQ ID NO: 9387871 - DNA, 22 bp, Homo sapiens
acctggagatccatggtgtcga

SEQ ID NO: 9387872 - DNA, 20 bp, Homo sapiens
acctggagagattattacca

SEQ ID NO: 9387873 - DNA, 22 bp, Homo sapiens
acctgcccggggacattccttt

SEQ ID NO: 9387874 - DNA, 22 bp, Homo sapiens
acctccctggccttctgattcc

SEQ ID NO: 9387875 - DNA, 22 bp, Homo sapiens
acctgcccacttcccatgacat

SEQ ID NO: 9387876 - DNA, 22 bp, Homo sapiens
acctgtggatcagattcttgta

SEQ ID NO: 9387877 - DNA, 22 bp, Homo sapiens
acctgtgcacagtcagccctgg

SEQ ID NO: 9387878 - DNA, 22 bp, Homo sapiens
acctgtctataaaagtgaatac

SEQ ID NO: 9387879 - DNA, 22 bp, Homo sapiens
acctgtcatcccggctgcaccg

SEQ ID NO: 9387880 - DNA, 22 bp, Homo sapiens
acctggtttgtctcatcaccac

SEQ ID NO: 9387881 - DNA, 22 bp, Homo sapiens
acctggttcctcctcactgctg

SEQ ID NO: 9387882 - DNA, 22 bp, Homo sapiens
acctgggttgctggcgtgaggg

SEQ ID NO: 9387883 - DNA, 22 bp, Homo sapiens
aggtagctatccagacgctgaa

SEQ ID NO: 9387884 - DNA, 23 bp, Homo sapiens
acctggctgctcaacctgcaggg

SEQ ID NO: 9387885 - DNA, 22 bp, Homo sapiens
aggtacatggggtgtgtgcacg

SEQ ID NO: 9387886 - DNA, 22 bp, Homo sapiens
aggtacatttgataaaaatagc

SEQ ID NO: 9387887 - DNA, 22 bp, Homo sapiens
aggtacatggggtgtgtgcacg

SEQ ID NO: 9387888 - DNA, 22 bp, Homo sapiens
aggtagaggcctccaggcagca

SEQ ID NO: 9387889 - DNA, 22 bp, Homo sapiens
aggtagaggcctccaggcagca

SEQ ID NO: 9387890 - DNA, 22 bp, Homo sapiens
acctcccagctctgagcttggg

SEQ ID NO: 9387891 - DNA, 22 bp, Homo sapiens
agggtgtgttctcctatgagaa

SEQ ID NO: 9387892 - DNA, 22 bp, Homo sapiens
agggtgtcagccacggaatggg

SEQ ID NO: 9387893 - DNA, 22 bp, Homo sapiens
agggtgtcagccacggaatggg

SEQ ID NO: 9387894 - DNA, 20 bp, Homo sapiens
agggtggggacgttctgact

SEQ ID NO: 9387895 - DNA, 22 bp, Homo sapiens
acctccctaagggtccagctta

SEQ ID NO: 9387896 - DNA, 22 bp, Homo sapiens
acctccccattaggtcacccac

SEQ ID NO: 9387897 - DNA, 22 bp, Homo sapiens
acctccccattaggtcacccac

SEQ ID NO: 9387898 - DNA, 22 bp, Homo sapiens
acctccccgggagcagcctcct

SEQ ID NO: 9387899 - DNA, 22 bp, Homo sapiens
acctcccctcaccaatctggtt

SEQ ID NO: 9387900 - DNA, 22 bp, Homo sapiens
acctccccgggagcagcctcct

SEQ ID NO: 9387901 - DNA, 22 bp, Homo sapiens
agggtgcctgctgcaggttcag

SEQ ID NO: 9387902 - DNA, 22 bp, Homo sapiens
agggtgcctgctgcaggttcag

SEQ ID NO: 9387903 - DNA, 22 bp, Homo sapiens
agggcttgttaacatagagatt

SEQ ID NO: 9387904 - DNA, 22 bp, Homo sapiens
agggcttgtggtcgtggctgtg

SEQ ID NO: 9387905 - DNA, 22 bp, Homo sapiens
agggcttgtggtcgtggctgtg

SEQ ID NO: 9387906 - DNA, 22 bp, Homo sapiens
agggcttgtagggtggctgtag

SEQ ID NO: 9387907 - DNA, 20 bp, Homo sapiens
agggtggggacgttctgact

SEQ ID NO: 9387908 - DNA, 22 bp, Homo sapiens
agggtgggctagactcttcccc

SEQ ID NO: 9387909 - DNA, 22 bp, Homo sapiens
agggtgcctggaagccactcac

SEQ ID NO: 9387910 - DNA, 22 bp, Homo sapiens
agggcttgacaagggctggagc

SEQ ID NO: 9387911 - DNA, 22 bp, Homo sapiens
agggcttgacaagggctggagc

SEQ ID NO: 9387912 - DNA, 22 bp, Homo sapiens
agggcttgcagaaatgagaaat

SEQ ID NO: 9387913 - DNA, 22 bp, Homo sapiens
agggctgtttttggcacctggg

SEQ ID NO: 9387914 - DNA, 22 bp, Homo sapiens
agggctgtttttggcacctggg

SEQ ID NO: 9387915 - DNA, 22 bp, Homo sapiens
agggctgtgtttgcaccctctg

SEQ ID NO: 9387916 - DNA, 22 bp, Homo sapiens
agggctgtcagactgaggaggc

SEQ ID NO: 9387917 - DNA, 22 bp, Homo sapiens
agggctggtatgtccatgaaag

SEQ ID NO: 9387918 - DNA, 22 bp, Homo sapiens
accctcagcttcttggattaat

SEQ ID NO: 9387919 - DNA, 22 bp, Homo sapiens
accctcaggcagaatgtattct

SEQ ID NO: 9387920 - DNA, 22 bp, Homo sapiens
accctcagagtaggcactgctg

SEQ ID NO: 9387921 - DNA, 22 bp, Homo sapiens
accctcagctggagattgaatt

SEQ ID NO: 9387922 - DNA, 22 bp, Homo sapiens
actaaagtcctgttgtagcata

SEQ ID NO: 9387923 - DNA, 22 bp, Homo sapiens
actaaatacacacatttgttca

SEQ ID NO: 9387924 - DNA, 22 bp, Homo sapiens
actaaatagcctctggtagttg

SEQ ID NO: 9387925 - DNA, 22 bp, Homo sapiens
actaaatagttttgacagaaca

SEQ ID NO: 9387926 - DNA, 22 bp, Homo sapiens
actatacattgaatgttaaggt

SEQ ID NO: 9387927 - DNA, 22 bp, Homo sapiens
actatactgtctcttatagata

SEQ ID NO: 9387928 - DNA, 22 bp, Homo sapiens
actagtttattacagttccact

SEQ ID NO: 9387929 - DNA, 22 bp, Homo sapiens
actagtttatgctcagatgtct

SEQ ID NO: 9387930 - DNA, 22 bp, Homo sapiens
actagtgaagaagatttgactg

SEQ ID NO: 9387931 - DNA, 22 bp, Homo sapiens
actagtgtccttatataagagg

SEQ ID NO: 9387932 - DNA, 18 bp, Homo sapiens
actagtgagcaagctagg

SEQ ID NO: 9387933 - DNA, 22 bp, Homo sapiens
actatatacacattatcttgtt

SEQ ID NO: 9387934 - DNA, 22 bp, Homo sapiens
actatatacacattatcttgtt

SEQ ID NO: 9387935 - DNA, 22 bp, Homo sapiens
actatatacacattatcttgtt

SEQ ID NO: 9387936 - DNA, 22 bp, Homo sapiens
actatatacacattatcttgtt

SEQ ID NO: 9387937 - DNA, 22 bp, Homo sapiens
actatatacacattatcttgtt

SEQ ID NO: 9387938 - DNA, 22 bp, Homo sapiens
actatatacacattatcttgtt

SEQ ID NO: 9387939 - DNA, 22 bp, Homo sapiens
actatagctcgggttataatgt

SEQ ID NO: 9387940 - DNA, 22 bp, Homo sapiens
actatagatgctggcgaggctg

SEQ ID NO: 9387941 - DNA, 22 bp, Homo sapiens
actatgtacccaaagatctgat

SEQ ID NO: 9387942 - DNA, 22 bp, Homo sapiens
actatgtatactagatgtgtaa

SEQ ID NO: 9387943 - DNA, 22 bp, Homo sapiens
actatgtattgtatgggctggt

SEQ ID NO: 9387944 - DNA, 22 bp, Homo sapiens
actattagcatatcatgaatgg

SEQ ID NO: 9387945 - DNA, 19 bp, Homo sapiens
actatgcatttatttgttt

SEQ ID NO: 9387946 - DNA, 22 bp, Homo sapiens
actatgaatccacattgatttt

SEQ ID NO: 9387947 - DNA, 22 bp, Homo sapiens
actatttctagatgctctgata

SEQ ID NO: 9387948 - DNA, 22 bp, Homo sapiens
actcaaaagaccagagagctga

SEQ ID NO: 9387949 - DNA, 23 bp, Homo sapiens
actcaaaatttggcatttgagga

SEQ ID NO: 9387950 - DNA, 22 bp, Homo sapiens
actcaaatagcaacggtgagaa

SEQ ID NO: 9387951 - DNA, 22 bp, Homo sapiens
actcaaatagctgcccctagtg

SEQ ID NO: 9387952 - DNA, 22 bp, Homo sapiens
actattcacagattcagtgttc

SEQ ID NO: 9387953 - DNA, 18 bp, Homo sapiens
actcaagggtggagagaa

SEQ ID NO: 9387954 - DNA, 22 bp, Homo sapiens
actcaagagctggctggttcct

SEQ ID NO: 9387955 - DNA, 22 bp, Homo sapiens
actcaagtcataggcttctttc

SEQ ID NO: 9387956 - DNA, 22 bp, Homo sapiens
actcaaatttgtcaactgaagc

SEQ ID NO: 9387957 - DNA, 23 bp, Homo sapiens
actcaaatttcgcttggagttca

SEQ ID NO: 9387958 - DNA, 20 bp, Homo sapiens
actcaaatcacctgcctcaa

SEQ ID NO: 9387959 - DNA, 21 bp, Homo sapiens
actcaagtggagatgccaggt

SEQ ID NO: 9387960 - DNA, 22 bp, Homo sapiens
actcaatgttctcatagcacct

SEQ ID NO: 9387961 - DNA, 22 bp, Homo sapiens
actcacagcagactatgaggga

SEQ ID NO: 9387962 - DNA, 22 bp, Homo sapiens
actcacagcagactatgaggga

SEQ ID NO: 9387963 - DNA, 22 bp, Homo sapiens
actcacagcatgagcttggcag

SEQ ID NO: 9387964 - DNA, 19 bp, Homo sapiens
actcaggcttcctctgagg

SEQ ID NO: 9387965 - DNA, 22 bp, Homo sapiens
accttatttggaaatataatta

SEQ ID NO: 9387966 - DNA, 22 bp, Homo sapiens
acgggccttctcttcaggcgag

SEQ ID NO: 9387967 - DNA, 22 bp, Homo sapiens
accttcaggtgagcacacagat

SEQ ID NO: 9387968 - DNA, 22 bp, Homo sapiens
accttagaaaatcaaaattaga

SEQ ID NO: 9387969 - DNA, 22 bp, Homo sapiens
acgggctgggacggggaagctc

SEQ ID NO: 9387970 - DNA, 20 bp, Homo sapiens
acgtgtgtgtgcacgcgcgc

SEQ ID NO: 9387971 - DNA, 22 bp, Homo sapiens
acgtgtgtgacattgggaacgt

SEQ ID NO: 9387972 - DNA, 22 bp, Homo sapiens
acgttttcagccttaatgtaga

SEQ ID NO: 9387973 - DNA, 19 bp, Homo sapiens
actaaaaatgatgtttgag

SEQ ID NO: 9387974 - DNA, 22 bp, Homo sapiens
actaaaacagtggctagtagac

SEQ ID NO: 9387975 - DNA, 22 bp, Homo sapiens
actaaaacatagccagtcagtg

SEQ ID NO: 9387976 - DNA, 22 bp, Homo sapiens
actaaactgaagcatgaaaagg

SEQ ID NO: 9387977 - DNA, 19 bp, Homo sapiens
actaaaaatgatgtttgag

SEQ ID NO: 9387978 - DNA, 22 bp, Homo sapiens
actaaagatgtctaaatatatt

SEQ ID NO: 9387979 - DNA, 22 bp, Homo sapiens
actaaactgttcatcagcatct

SEQ ID NO: 9387980 - DNA, 22 bp, Homo sapiens
agtggctgctatgatcaggaca

SEQ ID NO: 9387981 - DNA, 22 bp, Homo sapiens
agtggctgctggagtggagatg

SEQ ID NO: 9387982 - DNA, 22 bp, Homo sapiens
agtggctgctgactttaataca

SEQ ID NO: 9387983 - DNA, 22 bp, Homo sapiens
agtggctgctggagtggagatg

SEQ ID NO: 9387984 - DNA, 22 bp, Homo sapiens
agtggctgcttctggttgctcc

SEQ ID NO: 9387985 - DNA, 22 bp, Homo sapiens
actggacagaggaaatatggag

SEQ ID NO: 9387986 - DNA, 22 bp, Homo sapiens
actggagttgggtcaagattct

SEQ ID NO: 9387987 - DNA, 22 bp, Homo sapiens
actggagttgattacataaaac

SEQ ID NO: 9387988 - DNA, 22 bp, Homo sapiens
actggagttttaaaggaacttg

SEQ ID NO: 9387989 - DNA, 22 bp, Homo sapiens
actggcagaacgtgatgcgggt

SEQ ID NO: 9387990 - DNA, 22 bp, Homo sapiens
actggcagaacgtgatgcgggt

SEQ ID NO: 9387991 - DNA, 22 bp, Homo sapiens
actggcagaactggtgattgtc

SEQ ID NO: 9387992 - DNA, 22 bp, Homo sapiens
actggcagaactggtgattgtc

SEQ ID NO: 9387993 - DNA, 22 bp, Homo sapiens
actggcagaattgaatagttgt

SEQ ID NO: 9387994 - DNA, 22 bp, Homo sapiens
actggcagaattgaatagttgt

SEQ ID NO: 9387995 - DNA, 22 bp, Homo sapiens
actggcagagaccctgatggcc

SEQ ID NO: 9387996 - DNA, 22 bp, Homo sapiens
actggcagagaccctgatggcc

SEQ ID NO: 9387997 - DNA, 22 bp, Homo sapiens
actggcagagaccctgatggcc

SEQ ID NO: 9387998 - DNA, 22 bp, Homo sapiens
actggcagagggaaaaccattc

SEQ ID NO: 9387999 - DNA, 22 bp, Homo sapiens
actggcagaggttggacaccat

SEQ ID NO: 9388000 - DNA, 22 bp, Homo sapiens
actggcagaggttggacaccat

SEQ ID NO: 9388001 - DNA, 22 bp, Homo sapiens
actggcagaggatagcactaat

SEQ ID NO: 9388002 - DNA, 22 bp, Homo sapiens
actggcagagggaaaaccattc

SEQ ID NO: 9388003 - DNA, 22 bp, Homo sapiens
actggcagaggatagcactaat

SEQ ID NO: 9388004 - DNA, 22 bp, Homo sapiens
actggcagccacaactggcagg

SEQ ID NO: 9388005 - DNA, 22 bp, Homo sapiens
actggcagcagcagcccttggg

SEQ ID NO: 9388006 - DNA, 22 bp, Homo sapiens
actggcagcagcagcccttggg

SEQ ID NO: 9388007 - DNA, 22 bp, Homo sapiens
actggcagcagcagcccttggg

SEQ ID NO: 9388008 - DNA, 22 bp, Homo sapiens
actggcagccacaactggcagg

SEQ ID NO: 9388009 - DNA, 22 bp, Homo sapiens
actgctgtgttcggctccccgt

SEQ ID NO: 9388010 - DNA, 23 bp, Homo sapiens
agtggctgagagtgtttcatatg

SEQ ID NO: 9388011 - DNA, 22 bp, Homo sapiens
agtggctgagtgactgtgactc

SEQ ID NO: 9388012 - DNA, 22 bp, Homo sapiens
agtggctgatgtaggcagtggg

SEQ ID NO: 9388013 - DNA, 22 bp, Homo sapiens
agtggctgatgtaggcagtggg

SEQ ID NO: 9388014 - DNA, 22 bp, Homo sapiens
agtggctgatgtaggcagtggg

SEQ ID NO: 9388015 - DNA, 22 bp, Homo sapiens
actgctcacgcattacttgagc

SEQ ID NO: 9388016 - DNA, 22 bp, Homo sapiens
actgctctctttgcaggggcta

SEQ ID NO: 9388017 - DNA, 22 bp, Homo sapiens
actgctctgttttcatatgttt

SEQ ID NO: 9388018 - DNA, 22 bp, Homo sapiens
actgctggaaacccagaatggt

SEQ ID NO: 9388019 - DNA, 22 bp, Homo sapiens
actgaatagcccttctgtctcc

SEQ ID NO: 9388020 - DNA, 22 bp, Homo sapiens
actgaataatggtctgtgatct

SEQ ID NO: 9388021 - DNA, 22 bp, Homo sapiens
actgaatagaaatgctcatagg

SEQ ID NO: 9388022 - DNA, 22 bp, Homo sapiens
actgaagttcatacaacagact

SEQ ID NO: 9388023 - DNA, 22 bp, Homo sapiens
actgaataaggtgaatgctctg

SEQ ID NO: 9388024 - DNA, 22 bp, Homo sapiens
actgaatatattccattgcatg

SEQ ID NO: 9388025 - DNA, 22 bp, Homo sapiens
actgaatagtgctgcattgtac

SEQ ID NO: 9388026 - DNA, 21 bp, Homo sapiens
actgaatgtgtccaagctgag

SEQ ID NO: 9388027 - DNA, 22 bp, Homo sapiens
actgagggtttttatactcttt

SEQ ID NO: 9388028 - DNA, 22 bp, Homo sapiens
actgatcacatagatatattcc

SEQ ID NO: 9388029 - DNA, 22 bp, Homo sapiens
actgatctgttttcagattctg

SEQ ID NO: 9388030 - DNA, 22 bp, Homo sapiens
actgatcacatagatatattcc

SEQ ID NO: 9388031 - DNA, 22 bp, Homo sapiens
actgatgaaaactaataaatta

SEQ ID NO: 9388032 - DNA, 22 bp, Homo sapiens
actgatggcccaccttggtctc

SEQ ID NO: 9388033 - DNA, 22 bp, Homo sapiens
actgatggcccaccttggtctc

SEQ ID NO: 9388034 - DNA, 22 bp, Homo sapiens
actgcaacctccgcctgccagg

SEQ ID NO: 9388035 - DNA, 22 bp, Homo sapiens
actgcaagaatggtaatatttg

SEQ ID NO: 9388036 - DNA, 22 bp, Homo sapiens
actgcacaaggcctggacacac

SEQ ID NO: 9388037 - DNA, 22 bp, Homo sapiens
actgcaagtcacttggctatgt

SEQ ID NO: 9388038 - DNA, 20 bp, Homo sapiens
actgcaagtcacttttaggg

SEQ ID NO: 9388039 - DNA, 22 bp, Homo sapiens
actgcaaggaggtggggtatca

SEQ ID NO: 9388040 - DNA, 22 bp, Homo sapiens
actgcacagaattatggttggt

SEQ ID NO: 9388041 - DNA, 22 bp, Homo sapiens
actgcaaagggaagccctttct

SEQ ID NO: 9388042 - DNA, 22 bp, Homo sapiens
actgcaacacctcctgggttca

SEQ ID NO: 9388043 - DNA, 20 bp, Homo sapiens
actgcaaagtactctttcag

SEQ ID NO: 9388044 - DNA, 21 bp, Homo sapiens
actgcaaacagcagagactga

SEQ ID NO: 9388045 - DNA, 22 bp, Homo sapiens
actgatttcagggatgagaaga

SEQ ID NO: 9388046 - DNA, 22 bp, Homo sapiens
actgcaacctccacctcctggg

SEQ ID NO: 9388047 - DNA, 22 bp, Homo sapiens
actgcaacctccacctcctggg

SEQ ID NO: 9388048 - DNA, 22 bp, Homo sapiens
actgcaacctccacctcctggg

SEQ ID NO: 9388049 - DNA, 22 bp, Homo sapiens
actgcaacacctcctgggttca

SEQ ID NO: 9388050 - DNA, 22 bp, Homo sapiens
actgcaacacctcctgggttca

SEQ ID NO: 9388051 - DNA, 22 bp, Homo sapiens
actgcaacctccacctcctggg

SEQ ID NO: 9388052 - DNA, 22 bp, Homo sapiens
actcttcatacagtcatctaat

SEQ ID NO: 9388053 - DNA, 22 bp, Homo sapiens
agtctgggctgtctgcaggagt

SEQ ID NO: 9388054 - DNA, 22 bp, Homo sapiens
agtctgggctgtctgcaggagt

SEQ ID NO: 9388055 - DNA, 22 bp, Homo sapiens
agtctggggtctggtagaacga

SEQ ID NO: 9388056 - DNA, 22 bp, Homo sapiens
agtctgggaggcttataaacag

SEQ ID NO: 9388057 - DNA, 20 bp, Homo sapiens
agtctggcatgatgcaggca

SEQ ID NO: 9388058 - DNA, 20 bp, Homo sapiens
agtctggcacctattcctgt

SEQ ID NO: 9388059 - DNA, 22 bp, Homo sapiens
agtctgggaactgggaacgttt

SEQ ID NO: 9388060 - DNA, 22 bp, Homo sapiens
agtctcttattccctattgctg

SEQ ID NO: 9388061 - DNA, 22 bp, Homo sapiens
agtctcttagatgtggacctgc

SEQ ID NO: 9388062 - DNA, 22 bp, Homo sapiens
agtctcttattccctattgctg

SEQ ID NO: 9388063 - DNA, 22 bp, Homo sapiens
agtctcttccttcaaggctggt

SEQ ID NO: 9388064 - DNA, 22 bp, Homo sapiens
agtctggattttctacccttct

SEQ ID NO: 9388065 - DNA, 22 bp, Homo sapiens
actgaagcacatttgccatgaa

SEQ ID NO: 9388066 - DNA, 19 bp, Homo sapiens
actgaagcagggactgaaa

SEQ ID NO: 9388067 - DNA, 22 bp, Homo sapiens
actgaagctgggcgatgcctcc

SEQ ID NO: 9388068 - DNA, 22 bp, Homo sapiens
actgaagctgggcgatgcctcc

SEQ ID NO: 9388069 - DNA, 22 bp, Homo sapiens
actgaagccagagggaggacat

SEQ ID NO: 9388070 - DNA, 22 bp, Homo sapiens
actgaagcttgggtggaactta

SEQ ID NO: 9388071 - DNA, 22 bp, Homo sapiens
actgaagacctcctgtcagcgg

SEQ ID NO: 9388072 - DNA, 22 bp, Homo sapiens
actgaaatgaaatctatcatct

SEQ ID NO: 9388073 - DNA, 22 bp, Homo sapiens
actgaaatggggacagtcctta

SEQ ID NO: 9388074 - DNA, 22 bp, Homo sapiens
actgaaatatttagaagtgaag

SEQ ID NO: 9388075 - DNA, 22 bp, Homo sapiens
actgaacaccatttataacatt

SEQ ID NO: 9388076 - DNA, 22 bp, Homo sapiens
actgaaaatgaattagaaacag

SEQ ID NO: 9388077 - DNA, 22 bp, Homo sapiens
actgaaaatgaattagaaacag

SEQ ID NO: 9388078 - DNA, 22 bp, Homo sapiens
actccaggatgtagaatcagag

SEQ ID NO: 9388079 - DNA, 22 bp, Homo sapiens
actccagatgataagggacagt

SEQ ID NO: 9388080 - DNA, 22 bp, Homo sapiens
actccagacacagacactatga

SEQ ID NO: 9388081 - DNA, 19 bp, Homo sapiens
actccagggatgacagaag

SEQ ID NO: 9388082 - DNA, 22 bp, Homo sapiens
actccaggcatctgcttctgct

SEQ ID NO: 9388083 - DNA, 22 bp, Homo sapiens
actccaggcatctgcttctgct

SEQ ID NO: 9388084 - DNA, 21 bp, Homo sapiens
actcatttgtctgcatctaat

SEQ ID NO: 9388085 - DNA, 22 bp, Homo sapiens
actcattttataacactgtagt

SEQ ID NO: 9388086 - DNA, 21 bp, Homo sapiens
actccaaacaagttaagctgt

SEQ ID NO: 9388087 - DNA, 22 bp, Homo sapiens
actccacaccacgggggccgcc

SEQ ID NO: 9388088 - DNA, 22 bp, Homo sapiens
actccagaatcctagggtcagc

SEQ ID NO: 9388089 - DNA, 22 bp, Homo sapiens
actccacaccacgggggccgcc

SEQ ID NO: 9388090 - DNA, 22 bp, Homo sapiens
agtctctgccagcttgtcctct

SEQ ID NO: 9388091 - DNA, 22 bp, Homo sapiens
agtctctgccagcttgtcctct

SEQ ID NO: 9388092 - DNA, 22 bp, Homo sapiens
agtctctgctggttgtgcctat

SEQ ID NO: 9388093 - DNA, 20 bp, Homo sapiens
agtctctgtagtgcctgaga

SEQ ID NO: 9388094 - DNA, 22 bp, Homo sapiens
agtctctgttccagggcttcag

SEQ ID NO: 9388095 - DNA, 22 bp, Homo sapiens
agtctctgtgagctcccaatgg

SEQ ID NO: 9388096 - DNA, 22 bp, Homo sapiens
actccagggctgaacgaggccc

SEQ ID NO: 9388097 - DNA, 22 bp, Homo sapiens
actccagggctccaccccagat

SEQ ID NO: 9388098 - DNA, 22 bp, Homo sapiens
actccagggctgaacgaggccc

SEQ ID NO: 9388099 - DNA, 22 bp, Homo sapiens
actccagggctccatcccttgt

SEQ ID NO: 9388100 - DNA, 22 bp, Homo sapiens
actccagggctccatcccttgt

SEQ ID NO: 9388101 - DNA, 22 bp, Homo sapiens
agtctctgaggttcagatgcct

SEQ ID NO: 9388102 - DNA, 22 bp, Homo sapiens
agtctctcttgggtgtggtttg

SEQ ID NO: 9388103 - DNA, 22 bp, Homo sapiens
acagttaactggagagcgagtt

SEQ ID NO: 9388104 - DNA, 22 bp, Homo sapiens
acagtgttttgtctggcagggc

SEQ ID NO: 9388105 - DNA, 22 bp, Homo sapiens
acagtgttttagaaaagcttga

SEQ ID NO: 9388106 - DNA, 22 bp, Homo sapiens
acagtgttctgctttttaatcc

SEQ ID NO: 9388107 - DNA, 22 bp, Homo sapiens
acagtgttctgaaagttgaggg

SEQ ID NO: 9388108 - DNA, 22 bp, Homo sapiens
acagtgcaaacttttgtctcct

SEQ ID NO: 9388109 - DNA, 22 bp, Homo sapiens
acagtgatgccgggcgagaatg

SEQ ID NO: 9388110 - DNA, 22 bp, Homo sapiens
acagtgatgagccggctgaggc

SEQ ID NO: 9388111 - DNA, 22 bp, Homo sapiens
acagtgatcttttagttggaac

SEQ ID NO: 9388112 - DNA, 22 bp, Homo sapiens
acagtgataaaatttcacatgt

SEQ ID NO: 9388113 - DNA, 22 bp, Homo sapiens
acagtgataaaatttcacatgt

SEQ ID NO: 9388114 - DNA, 22 bp, Homo sapiens
acagtgaggacagggactgtgt

SEQ ID NO: 9388115 - DNA, 22 bp, Homo sapiens
acagtgattctgcaaaccatat

SEQ ID NO: 9388116 - DNA, 22 bp, Homo sapiens
acagtgattttttcgagcagaa

SEQ ID NO: 9388117 - DNA, 22 bp, Homo sapiens
acagtgcaaaccctcgggaaag

SEQ ID NO: 9388118 - DNA, 22 bp, Homo sapiens
acagtgattttaggatagatgg

SEQ ID NO: 9388119 - DNA, 22 bp, Homo sapiens
acagttagggactataatcatt

SEQ ID NO: 9388120 - DNA, 22 bp, Homo sapiens
acagttaggcacgggtacagca

SEQ ID NO: 9388121 - DNA, 22 bp, Homo sapiens
acagttagaaagtggcagaacc

SEQ ID NO: 9388122 - DNA, 22 bp, Homo sapiens
acagttaggtcctaaaattctg

SEQ ID NO: 9388123 - DNA, 22 bp, Homo sapiens
acagttcaagacatcagtatga

SEQ ID NO: 9388124 - DNA, 22 bp, Homo sapiens
acagttcaagcaagtttctgtt

SEQ ID NO: 9388125 - DNA, 22 bp, Homo sapiens
aggcaggattgctgacaacaat

SEQ ID NO: 9388126 - DNA, 22 bp, Homo sapiens
aggcaggattgctgacaacaat

SEQ ID NO: 9388127 - DNA, 22 bp, Homo sapiens
aggcaggcaaccacctgggaag

SEQ ID NO: 9388128 - DNA, 22 bp, Homo sapiens
aggcaggcaaccacctgggaag

SEQ ID NO: 9388129 - DNA, 22 bp, Homo sapiens
aggcaggcaaccacctgggaag

SEQ ID NO: 9388130 - DNA, 22 bp, Homo sapiens
aggcaggcactccggaagtgtc

SEQ ID NO: 9388131 - DNA, 22 bp, Homo sapiens
aggcaggcactccggaagtgtc

SEQ ID NO: 9388132 - DNA, 22 bp, Homo sapiens
aggcaggcacacttcctccagg

SEQ ID NO: 9388133 - DNA, 22 bp, Homo sapiens
aggcaggcaagttcatatgagg

SEQ ID NO: 9388134 - DNA, 22 bp, Homo sapiens
aggcaggcaagttcatatgagg

SEQ ID NO: 9388135 - DNA, 22 bp, Homo sapiens
aggcaggcaaccacctgggaag

SEQ ID NO: 9388136 - DNA, 22 bp, Homo sapiens
acagtttgttccttttcattgc

SEQ ID NO: 9388137 - DNA, 22 bp, Homo sapiens
acagtttgttccttttcattgc

SEQ ID NO: 9388138 - DNA, 22 bp, Homo sapiens
acagtttgtgttggccatgggc

SEQ ID NO: 9388139 - DNA, 23 bp, Homo sapiens
acataaacagaaggtgtgcttcc

SEQ ID NO: 9388140 - DNA, 22 bp, Homo sapiens
aggcagctggaggcagagacta

SEQ ID NO: 9388141 - DNA, 22 bp, Homo sapiens
acataaatagattattgggagg

SEQ ID NO: 9388142 - DNA, 22 bp, Homo sapiens
aggcagcatgctctgcttctac

SEQ ID NO: 9388143 - DNA, 22 bp, Homo sapiens
aggcagcatccagaggagaatg

SEQ ID NO: 9388144 - DNA, 19 bp, Homo sapiens
aggcagcacccagtccttg

SEQ ID NO: 9388145 - DNA, 22 bp, Homo sapiens
aggcagcagtgataagatagga

SEQ ID NO: 9388146 - DNA, 22 bp, Homo sapiens
aggcagcatccagaggagaatg

SEQ ID NO: 9388147 - DNA, 22 bp, Homo sapiens
acagtttgccctgacattctcc

SEQ ID NO: 9388148 - DNA, 22 bp, Homo sapiens
acagtttgccctgacattctcc

SEQ ID NO: 9388149 - DNA, 22 bp, Homo sapiens
acagtttggcagtttcttacta

SEQ ID NO: 9388150 - DNA, 22 bp, Homo sapiens
acagtttggcgtgattgatagt

SEQ ID NO: 9388151 - DNA, 17 bp, Homo sapiens
acagtttgtcattctaa

SEQ ID NO: 9388152 - DNA, 22 bp, Homo sapiens
aggcagcatgggccccagctcc

SEQ ID NO: 9388153 - DNA, 22 bp, Homo sapiens
aggcagcatgggccccagctcc

SEQ ID NO: 9388154 - DNA, 22 bp, Homo sapiens
aggcagcatgggcccagagtcc

SEQ ID NO: 9388155 - DNA, 22 bp, Homo sapiens
acagtaataagtgttggtgagg

SEQ ID NO: 9388156 - DNA, 22 bp, Homo sapiens
acagtaatgcatacaagttagt

SEQ ID NO: 9388157 - DNA, 22 bp, Homo sapiens
acagtaattaaacattctgatt

SEQ ID NO: 9388158 - DNA, 22 bp, Homo sapiens
acagtaaatcaacagaatatct

SEQ ID NO: 9388159 - DNA, 22 bp, Homo sapiens
aggaggaactcagaaagaaggt

SEQ ID NO: 9388160 - DNA, 22 bp, Homo sapiens
aggaggaactcagaaagaaggt

SEQ ID NO: 9388161 - DNA, 21 bp, Homo sapiens
aggaggaacccgtggctgggc

SEQ ID NO: 9388162 - DNA, 21 bp, Homo sapiens
aggaggaacccgtggctgggc

SEQ ID NO: 9388163 - DNA, 23 bp, Homo sapiens
aggaggaaaagttatctgctgag

SEQ ID NO: 9388164 - DNA, 22 bp, Homo sapiens
aggagggtgatccgggctggtc

SEQ ID NO: 9388165 - DNA, 22 bp, Homo sapiens
aggagtcactcagggcttcatc

SEQ ID NO: 9388166 - DNA, 22 bp, Homo sapiens
aggagtcagatatgggaaagtt

SEQ ID NO: 9388167 - DNA, 22 bp, Homo sapiens
aggagtcagattgtttgaatgt

SEQ ID NO: 9388168 - DNA, 22 bp, Homo sapiens
aggagtcagatatgggaaagtt

SEQ ID NO: 9388169 - DNA, 22 bp, Homo sapiens
aggagtcataaatgtgaacaaa

SEQ ID NO: 9388170 - DNA, 22 bp, Homo sapiens
aggagtcaggaattatttatga

SEQ ID NO: 9388171 - DNA, 22 bp, Homo sapiens
aggagtcaggaccaaatggaaa

SEQ ID NO: 9388172 - DNA, 22 bp, Homo sapiens
acagtacaccactgtgtacagt

SEQ ID NO: 9388173 - DNA, 22 bp, Homo sapiens
aggagggtgatccgggctggtc

SEQ ID NO: 9388174 - DNA, 22 bp, Homo sapiens
acagtacaaaacccaccagagg

SEQ ID NO: 9388175 - DNA, 22 bp, Homo sapiens
acagtacaagcaatgcattttt

SEQ ID NO: 9388176 - DNA, 22 bp, Homo sapiens
aggagtctgaactggtcccctg

SEQ ID NO: 9388177 - DNA, 22 bp, Homo sapiens
aggagtgagctttggggtcaga

SEQ ID NO: 9388178 - DNA, 22 bp, Homo sapiens
aggagtgagtgtcctcagcaga

SEQ ID NO: 9388179 - DNA, 20 bp, Homo sapiens
aggagtccctgtgctctctc

SEQ ID NO: 9388180 - DNA, 22 bp, Homo sapiens
aggagtggaattactgggttct

SEQ ID NO: 9388181 - DNA, 22 bp, Homo sapiens
aggagtggaattactgggttct

SEQ ID NO: 9388182 - DNA, 22 bp, Homo sapiens
aggagtgcaaatagtccagaga

SEQ ID NO: 9388183 - DNA, 22 bp, Homo sapiens
aggagtgagtgtcctcagcaga

SEQ ID NO: 9388184 - DNA, 22 bp, Homo sapiens
aggagtgcaaatagtccagaga

SEQ ID NO: 9388185 - DNA, 22 bp, Homo sapiens
aggagtgctgcaagttgacaga

SEQ ID NO: 9388186 - DNA, 22 bp, Homo sapiens
aggagctggagtccaggcaagt

SEQ ID NO: 9388187 - DNA, 22 bp, Homo sapiens
aggagctggagtccaggcaagt

SEQ ID NO: 9388188 - DNA, 22 bp, Homo sapiens
aggagctggagtccaggcaagt

SEQ ID NO: 9388189 - DNA, 22 bp, Homo sapiens
acaggtgtaaaacccaggatgg

SEQ ID NO: 9388190 - DNA, 22 bp, Homo sapiens
acaggtgtaaaacccaggatgg

SEQ ID NO: 9388191 - DNA, 22 bp, Homo sapiens
acaggtggtctttgctcctttt

SEQ ID NO: 9388192 - DNA, 22 bp, Homo sapiens
acaggtggtctttgctcctttt

SEQ ID NO: 9388193 - DNA, 22 bp, Homo sapiens
acaggtggtagagtggaaagag

SEQ ID NO: 9388194 - DNA, 22 bp, Homo sapiens
acaggtggtagagtggaaagag

SEQ ID NO: 9388195 - DNA, 22 bp, Homo sapiens
acaggtggtctttgctcctttt

SEQ ID NO: 9388196 - DNA, 21 bp, Homo sapiens
aggagctgtgttagctggtcg

SEQ ID NO: 9388197 - DNA, 21 bp, Homo sapiens
aggagctgtgttagctggtcg

SEQ ID NO: 9388198 - DNA, 21 bp, Homo sapiens
aggagctgtgttagctggtcg

SEQ ID NO: 9388199 - DNA, 21 bp, Homo sapiens
aggagctgtgttagctggtcg

SEQ ID NO: 9388200 - DNA, 21 bp, Homo sapiens
aggagctgtgttagctggtcg

SEQ ID NO: 9388201 - DNA, 22 bp, Homo sapiens
acaggtggccccgagggagtgg

SEQ ID NO: 9388202 - DNA, 22 bp, Homo sapiens
acaggtggcttattggctgatt

SEQ ID NO: 9388203 - DNA, 22 bp, Homo sapiens
acaggtgggcttaagagtcggc

SEQ ID NO: 9388204 - DNA, 22 bp, Homo sapiens
acaggtgggcttaagagtcggc

SEQ ID NO: 9388205 - DNA, 22 bp, Homo sapiens
acaggtggcttccattttctaa

SEQ ID NO: 9388206 - DNA, 22 bp, Homo sapiens
acaggtggcttccattttctaa

SEQ ID NO: 9388207 - DNA, 22 bp, Homo sapiens
acaggtggcttattggctgatt

SEQ ID NO: 9388208 - DNA, 22 bp, Homo sapiens
acaggtggtaaaatggactgtc

SEQ ID NO: 9388209 - DNA, 22 bp, Homo sapiens
acaggtggggcacttggagcct

SEQ ID NO: 9388210 - DNA, 22 bp, Homo sapiens
acaggtggtaaaatggactgtc

SEQ ID NO: 9388211 - DNA, 22 bp, Homo sapiens
acaggtggtagagtggaaagag

SEQ ID NO: 9388212 - DNA, 22 bp, Homo sapiens
acaggtggtaaaatggactgtc

SEQ ID NO: 9388213 - DNA, 22 bp, Homo sapiens
acaggtggggcacttggagcct

SEQ ID NO: 9388214 - DNA, 22 bp, Homo sapiens
acaggtggggaggctgaggttc

SEQ ID NO: 9388215 - DNA, 22 bp, Homo sapiens
acaggtggggaggctgaggttc

SEQ ID NO: 9388216 - DNA, 22 bp, Homo sapiens
acaggtgggcttaagagtcggc

SEQ ID NO: 9388217 - DNA, 22 bp, Homo sapiens
acaggtggaaacatggtgttgg

SEQ ID NO: 9388218 - DNA, 22 bp, Homo sapiens
acaggtggaaacatggtgttgg

SEQ ID NO: 9388219 - DNA, 22 bp, Homo sapiens
acaggtggacacagcagcagtc

SEQ ID NO: 9388220 - DNA, 22 bp, Homo sapiens
acaggtggacacagcagcagtc

SEQ ID NO: 9388221 - DNA, 22 bp, Homo sapiens
acaggtggacacagcagcagtc

SEQ ID NO: 9388222 - DNA, 22 bp, Homo sapiens
acaggtggagtggttagcaggc

SEQ ID NO: 9388223 - DNA, 22 bp, Homo sapiens
acaggtggaggctttaggaggt

SEQ ID NO: 9388224 - DNA, 22 bp, Homo sapiens
acaggtggagtggttagcaggc

SEQ ID NO: 9388225 - DNA, 22 bp, Homo sapiens
acaggtggaggctttaggaggt

SEQ ID NO: 9388226 - DNA, 22 bp, Homo sapiens
acaggtggacacagcagcagtc

SEQ ID NO: 9388227 - DNA, 22 bp, Homo sapiens
acaggtggccccgagggagtgg

SEQ ID NO: 9388228 - DNA, 22 bp, Homo sapiens
acaggtggcataggcagtttga

SEQ ID NO: 9388229 - DNA, 22 bp, Homo sapiens
acaggtggcataggcagtttga

SEQ ID NO: 9388230 - DNA, 22 bp, Homo sapiens
acaggtggcagaagcatttact

SEQ ID NO: 9388231 - DNA, 22 bp, Homo sapiens
acaggtggcagaagcatttact

SEQ ID NO: 9388232 - DNA, 22 bp, Homo sapiens
acaggtggcactgctgttactc

SEQ ID NO: 9388233 - DNA, 22 bp, Homo sapiens
acaggtggcactgctgttactc

SEQ ID NO: 9388234 - DNA, 22 bp, Homo sapiens
acagggattttccaggctaccc

SEQ ID NO: 9388235 - DNA, 22 bp, Homo sapiens
acagggcaacctctgggagact

SEQ ID NO: 9388236 - DNA, 22 bp, Homo sapiens
acagggattttccaggctaccc

SEQ ID NO: 9388237 - DNA, 18 bp, Homo sapiens
acagggatggggtaagtg

SEQ ID NO: 9388238 - DNA, 18 bp, Homo sapiens
acagggatggggtaagtg

SEQ ID NO: 9388239 - DNA, 22 bp, Homo sapiens
acagggcacctgaggtaggaag

SEQ ID NO: 9388240 - DNA, 22 bp, Homo sapiens
acagggcaacctctgggagact

SEQ ID NO: 9388241 - DNA, 22 bp, Homo sapiens
acagggcaacctctgggagact

SEQ ID NO: 9388242 - DNA, 20 bp, Homo sapiens
agctgggcaattatgactat

SEQ ID NO: 9388243 - DNA, 22 bp, Homo sapiens
agctggggctgcagagaacagg

SEQ ID NO: 9388244 - DNA, 22 bp, Homo sapiens
agctggggctgcagagaacagg

SEQ ID NO: 9388245 - DNA, 23 bp, Homo sapiens
acagctgcacctggccgcctggc

SEQ ID NO: 9388246 - DNA, 22 bp, Homo sapiens
acagctgattggatcaaggaca

SEQ ID NO: 9388247 - DNA, 22 bp, Homo sapiens
acagctgcacttgaagcaggtt

SEQ ID NO: 9388248 - DNA, 23 bp, Homo sapiens
acagctgcacctggccgcctggc

SEQ ID NO: 9388249 - DNA, 22 bp, Homo sapiens
acagctgcattcttaacaggaa

SEQ ID NO: 9388250 - DNA, 22 bp, Homo sapiens
agctgggtacagcctgtgccta

SEQ ID NO: 9388251 - DNA, 22 bp, Homo sapiens
agctgggtcaataggaaatgta

SEQ ID NO: 9388252 - DNA, 22 bp, Homo sapiens
agctgggtccctctgctgatgg

SEQ ID NO: 9388253 - DNA, 22 bp, Homo sapiens
agctgggtactgatgtcttcag

SEQ ID NO: 9388254 - DNA, 22 bp, Homo sapiens
agctggggttgcacacattttg

SEQ ID NO: 9388255 - DNA, 22 bp, Homo sapiens
agctggggttgcacacattttg

SEQ ID NO: 9388256 - DNA, 22 bp, Homo sapiens
agctgggggttggataagggta

SEQ ID NO: 9388257 - DNA, 22 bp, Homo sapiens
agctgggggttggataagggta

SEQ ID NO: 9388258 - DNA, 22 bp, Homo sapiens
agctgggggtagtgagaaataa

SEQ ID NO: 9388259 - DNA, 22 bp, Homo sapiens
agctgggggtagtgagaaataa

SEQ ID NO: 9388260 - DNA, 22 bp, Homo sapiens
agctgggggtagtgagaaataa

SEQ ID NO: 9388261 - DNA, 22 bp, Homo sapiens
agctggggctgtggttgtgatt

SEQ ID NO: 9388262 - DNA, 22 bp, Homo sapiens
agctggggctgtggttgtgatt

SEQ ID NO: 9388263 - DNA, 22 bp, Homo sapiens
acagctgaaaccagggatctgg

SEQ ID NO: 9388264 - DNA, 22 bp, Homo sapiens
acagctgaaaccagggatctgg

SEQ ID NO: 9388265 - DNA, 22 bp, Homo sapiens
acagctctgcattttgggttaa

SEQ ID NO: 9388266 - DNA, 22 bp, Homo sapiens
acagctaacagaatctggagag

SEQ ID NO: 9388267 - DNA, 22 bp, Homo sapiens
acagctacatggaatttcattt

SEQ ID NO: 9388268 - DNA, 22 bp, Homo sapiens
acagctcagacatcactgctct

SEQ ID NO: 9388269 - DNA, 22 bp, Homo sapiens
agctgccaggcccctgagaacc

SEQ ID NO: 9388270 - DNA, 17 bp, Homo sapiens
agctgccagggagtgtg

SEQ ID NO: 9388271 - DNA, 22 bp, Homo sapiens
agctgccagggactgggcatgg

SEQ ID NO: 9388272 - DNA, 22 bp, Homo sapiens
agctgccatccgaggtgtcaga

SEQ ID NO: 9388273 - DNA, 22 bp, Homo sapiens
agctgccatctgaagaactgca

SEQ ID NO: 9388274 - DNA, 22 bp, Homo sapiens
acagcacttattcagcacagtg

SEQ ID NO: 9388275 - DNA, 22 bp, Homo sapiens
acagcacttgggttttcctgtt

SEQ ID NO: 9388276 - DNA, 22 bp, Homo sapiens
acagcagaataatgagtaatag

SEQ ID NO: 9388277 - DNA, 22 bp, Homo sapiens
acagcagacacaggcacgctgt

SEQ ID NO: 9388278 - DNA, 22 bp, Homo sapiens
acagcagacagtcggcttcctg

SEQ ID NO: 9388279 - DNA, 22 bp, Homo sapiens
acagcagacagtcggcttcctg

SEQ ID NO: 9388280 - DNA, 22 bp, Homo sapiens
agctgcaggcccatgctcagtc

SEQ ID NO: 9388281 - DNA, 22 bp, Homo sapiens
agctgcaggcccatgctcagtc

SEQ ID NO: 9388282 - DNA, 22 bp, Homo sapiens
agctgccagcatcccggaaggg

SEQ ID NO: 9388283 - DNA, 22 bp, Homo sapiens
agctgccccatgagaggcaggt

SEQ ID NO: 9388284 - DNA, 22 bp, Homo sapiens
agctgcctgggcttgtacacct

SEQ ID NO: 9388285 - DNA, 22 bp, Homo sapiens
agctgcctgtcctaggccatca

SEQ ID NO: 9388286 - DNA, 22 bp, Homo sapiens
agctgcctgtaaaatgtgtgat

SEQ ID NO: 9388287 - DNA, 22 bp, Homo sapiens
agctgcctgtcctaggccatca

SEQ ID NO: 9388288 - DNA, 20 bp, Homo sapiens
agctgccttcattttctaga

SEQ ID NO: 9388289 - DNA, 22 bp, Homo sapiens
agctgcctgtcctaggccatca

SEQ ID NO: 9388290 - DNA, 22 bp, Homo sapiens
acagccttgggttctctggggg

SEQ ID NO: 9388291 - DNA, 22 bp, Homo sapiens
agctgctcacagggattcatgc

SEQ ID NO: 9388292 - DNA, 22 bp, Homo sapiens
acagcctgcagccccaggtcgc

SEQ ID NO: 9388293 - DNA, 22 bp, Homo sapiens
agctgccttccctctcattagg

SEQ ID NO: 9388294 - DNA, 17 bp, Homo sapiens
agctgccttgcttgagc

SEQ ID NO: 9388295 - DNA, 22 bp, Homo sapiens
acaggctgggcgcttcctgcgg

SEQ ID NO: 9388296 - DNA, 22 bp, Homo sapiens
acaggctgctgggctccgtgct

SEQ ID NO: 9388297 - DNA, 22 bp, Homo sapiens
acaggctggaggaggaccaaga

SEQ ID NO: 9388298 - DNA, 22 bp, Homo sapiens
acaggctgctgggctccgtgct

SEQ ID NO: 9388299 - DNA, 22 bp, Homo sapiens
acaggctgctgggctccgtgct

SEQ ID NO: 9388300 - DNA, 22 bp, Homo sapiens
acaggctgctgggctccgtgct

SEQ ID NO: 9388301 - DNA, 22 bp, Homo sapiens
acaggctgctgggctccgtgct

SEQ ID NO: 9388302 - DNA, 22 bp, Homo sapiens
acaggctgggcgcttcctgcgg

SEQ ID NO: 9388303 - DNA, 22 bp, Homo sapiens
acaggctggtggtcctggccat

SEQ ID NO: 9388304 - DNA, 22 bp, Homo sapiens
acaggctggtggtcctggccat

SEQ ID NO: 9388305 - DNA, 22 bp, Homo sapiens
acaggctggtggtcctggccat

SEQ ID NO: 9388306 - DNA, 22 bp, Homo sapiens
acaggctggtggtcctggccat

SEQ ID NO: 9388307 - DNA, 22 bp, Homo sapiens
agctttatgggagcttagataa

SEQ ID NO: 9388308 - DNA, 22 bp, Homo sapiens
agctttatgggagcttagataa

SEQ ID NO: 9388309 - DNA, 21 bp, Homo sapiens
acaggctctggggatgctggg

SEQ ID NO: 9388310 - DNA, 22 bp, Homo sapiens
agctttatgggagcttagataa

SEQ ID NO: 9388311 - DNA, 22 bp, Homo sapiens
acaggctctggggcaggatggc

SEQ ID NO: 9388312 - DNA, 22 bp, Homo sapiens
acaggctgcccgctccccacct

SEQ ID NO: 9388313 - DNA, 22 bp, Homo sapiens
acaggctgctgagccatttgct

SEQ ID NO: 9388314 - DNA, 22 bp, Homo sapiens
acaggctgcccgctccccacct

SEQ ID NO: 9388315 - DNA, 22 bp, Homo sapiens
acaggctgcctaccaagtatca

SEQ ID NO: 9388316 - DNA, 18 bp, Homo sapiens
acaggctgtgggaatggt

SEQ ID NO: 9388317 - DNA, 22 bp, Homo sapiens
aggaagggctgtttctccaaga

SEQ ID NO: 9388318 - DNA, 22 bp, Homo sapiens
aggaagggctgtttctccaaga

SEQ ID NO: 9388319 - DNA, 22 bp, Homo sapiens
aggaagggctgtttctccaaga

SEQ ID NO: 9388320 - DNA, 22 bp, Homo sapiens
aggaatgatagtaaaagagaat

SEQ ID NO: 9388321 - DNA, 22 bp, Homo sapiens
aggaatgatagtaaaagagaat

SEQ ID NO: 9388322 - DNA, 22 bp, Homo sapiens
aggaatgacttgtagctctgag

SEQ ID NO: 9388323 - DNA, 22 bp, Homo sapiens
aggaatgacatagaaaggggag

SEQ ID NO: 9388324 - DNA, 22 bp, Homo sapiens
acaggctgttggggtccagggt

SEQ ID NO: 9388325 - DNA, 18 bp, Homo sapiens
acaggctgtgggaatggt

SEQ ID NO: 9388326 - DNA, 22 bp, Homo sapiens
acaggctggtttgtaaaagatg

SEQ ID NO: 9388327 - DNA, 22 bp, Homo sapiens
acaggctgtacttctaatcatc

SEQ ID NO: 9388328 - DNA, 19 bp, Homo sapiens
aggaatggaattaattctg

SEQ ID NO: 9388329 - DNA, 21 bp, Homo sapiens
aggaatgctgaggctcacttt

SEQ ID NO: 9388330 - DNA, 19 bp, Homo sapiens
aggaatggaattaattctg

SEQ ID NO: 9388331 - DNA, 19 bp, Homo sapiens
aggaatggaattaattctg

SEQ ID NO: 9388332 - DNA, 23 bp, Homo sapiens
aggaatggctagaagtgtgaccc

SEQ ID NO: 9388333 - DNA, 23 bp, Homo sapiens
aggaatggctagaagtgtgaccc

SEQ ID NO: 9388334 - DNA, 22 bp, Homo sapiens
aggaatgtaacaggagtaaaaa

SEQ ID NO: 9388335 - DNA, 22 bp, Homo sapiens
aggaatgtaacaggagtaaaaa

SEQ ID NO: 9388336 - DNA, 22 bp, Homo sapiens
aggaatgtagtttgagtagaaa

SEQ ID NO: 9388337 - DNA, 22 bp, Homo sapiens
aggaatgtaatagtgtggctca

SEQ ID NO: 9388338 - DNA, 22 bp, Homo sapiens
aggaatgtaatagtgtggctca

SEQ ID NO: 9388339 - DNA, 22 bp, Homo sapiens
aggaatggttatggggatagta

SEQ ID NO: 9388340 - DNA, 22 bp, Homo sapiens
aggaatgtaaatctagatttta

SEQ ID NO: 9388341 - DNA, 22 bp, Homo sapiens
aggaatgtaaatctagatttta

SEQ ID NO: 9388342 - DNA, 22 bp, Homo sapiens
aggaatgtaaatctagatttta

SEQ ID NO: 9388343 - DNA, 22 bp, Homo sapiens
aggaatgtattattccttctgg

SEQ ID NO: 9388344 - DNA, 22 bp, Homo sapiens
aggaatgtagtttgagtagaaa

SEQ ID NO: 9388345 - DNA, 22 bp, Homo sapiens
aggaatgtagtttgagtagaaa

SEQ ID NO: 9388346 - DNA, 22 bp, Homo sapiens
aggaatgtattattccttctgg

SEQ ID NO: 9388347 - DNA, 22 bp, Homo sapiens
aggaatgtattgacctgttgca

SEQ ID NO: 9388348 - DNA, 22 bp, Homo sapiens
aggaatgtattgacctgttgca

SEQ ID NO: 9388349 - DNA, 22 bp, Homo sapiens
aggaatgtcatagaataatcat

SEQ ID NO: 9388350 - DNA, 22 bp, Homo sapiens
aggaatgtcatagaataatcat

SEQ ID NO: 9388351 - DNA, 22 bp, Homo sapiens
aggaatgtcaagtagatgtgcg

SEQ ID NO: 9388352 - DNA, 22 bp, Homo sapiens
aggaatgtcaagtagatgtgcg

SEQ ID NO: 9388353 - DNA, 22 bp, Homo sapiens
acaggcctagctaatgctttcc

SEQ ID NO: 9388354 - DNA, 22 bp, Homo sapiens
acaggcctagctaatgctttcc

SEQ ID NO: 9388355 - DNA, 22 bp, Homo sapiens
acaggcctagggtcaatttcct

SEQ ID NO: 9388356 - DNA, 22 bp, Homo sapiens
acaggcctcaaatagggtgcct

SEQ ID NO: 9388357 - DNA, 18 bp, Homo sapiens
acaggcctcagtcctgca

SEQ ID NO: 9388358 - DNA, 22 bp, Homo sapiens
acaggcctgacacacagagggc

SEQ ID NO: 9388359 - DNA, 22 bp, Homo sapiens
acaggcctcccatccggagccc

SEQ ID NO: 9388360 - DNA, 22 bp, Homo sapiens
acaggcctgatgccttggctgg

SEQ ID NO: 9388361 - DNA, 22 bp, Homo sapiens
acaggcctgatgccttggctgg

SEQ ID NO: 9388362 - DNA, 22 bp, Homo sapiens
acaggcctgagattttgcattt

SEQ ID NO: 9388363 - DNA, 22 bp, Homo sapiens
acaggcctggaaaggaaggagt

SEQ ID NO: 9388364 - DNA, 17 bp, Homo sapiens
acaggcctgcttgcact

SEQ ID NO: 9388365 - DNA, 22 bp, Homo sapiens
agctttatcagaggagtctcta

SEQ ID NO: 9388366 - DNA, 22 bp, Homo sapiens
agctttatcagaggagtctcta

SEQ ID NO: 9388367 - DNA, 22 bp, Homo sapiens
agctttatcacaatattggcta

SEQ ID NO: 9388368 - DNA, 22 bp, Homo sapiens
agctttatcacaatattggcta

SEQ ID NO: 9388369 - DNA, 22 bp, Homo sapiens
acaggcctgggttcaaatttgg

SEQ ID NO: 9388370 - DNA, 22 bp, Homo sapiens
agctttatatttaatgaattct

SEQ ID NO: 9388371 - DNA, 22 bp, Homo sapiens
agctttatgaggagaccttagt

SEQ ID NO: 9388372 - DNA, 22 bp, Homo sapiens
agctttatgaggagaccttagt

SEQ ID NO: 9388373 - DNA, 22 bp, Homo sapiens
agctttatgcttcctacaagct

SEQ ID NO: 9388374 - DNA, 22 bp, Homo sapiens
agctttatgcttcctacaagct

SEQ ID NO: 9388375 - DNA, 22 bp, Homo sapiens
agctttatcccttgcccatcga

SEQ ID NO: 9388376 - DNA, 22 bp, Homo sapiens
agctttatcccttgcccatcga

SEQ ID NO: 9388377 - DNA, 22 bp, Homo sapiens
agctttatcttcacctgggaat

SEQ ID NO: 9388378 - DNA, 22 bp, Homo sapiens
agctttatcttcacctgggaat

SEQ ID NO: 9388379 - DNA, 22 bp, Homo sapiens
acagcttcacccattatccctg

SEQ ID NO: 9388380 - DNA, 23 bp, Homo sapiens
acagcttcctactttgctgctgc

SEQ ID NO: 9388381 - DNA, 22 bp, Homo sapiens
acaggcaggtaatttacatatt

SEQ ID NO: 9388382 - DNA, 22 bp, Homo sapiens
acaggcaggtaatttacatatt

SEQ ID NO: 9388383 - DNA, 22 bp, Homo sapiens
acaggcctacgaagtcaggtgc

SEQ ID NO: 9388384 - DNA, 22 bp, Homo sapiens
acaggccataaaggcaggccct

SEQ ID NO: 9388385 - DNA, 22 bp, Homo sapiens
acaggccataaaggcaggccct

SEQ ID NO: 9388386 - DNA, 22 bp, Homo sapiens
agctgggtgaaggcagatggct

SEQ ID NO: 9388387 - DNA, 22 bp, Homo sapiens
agctgggtgaaggcagatggct

SEQ ID NO: 9388388 - DNA, 22 bp, Homo sapiens
agctgggtcttgggccaggaga

SEQ ID NO: 9388389 - DNA, 22 bp, Homo sapiens
acagctgtgaagcaagcactct

SEQ ID NO: 9388390 - DNA, 22 bp, Homo sapiens
acagctgtgaagcaagcactct

SEQ ID NO: 9388391 - DNA, 22 bp, Homo sapiens
acagctgtgaaaatccacagga

SEQ ID NO: 9388392 - DNA, 22 bp, Homo sapiens
acatggaagcaaagttctattt

SEQ ID NO: 9388393 - DNA, 20 bp, Homo sapiens
acatggaaggtcaaactatc

SEQ ID NO: 9388394 - DNA, 22 bp, Homo sapiens
acatggaagataaaaatactca

SEQ ID NO: 9388395 - DNA, 22 bp, Homo sapiens
acatggaaaactaactgctttt

SEQ ID NO: 9388396 - DNA, 22 bp, Homo sapiens
acatggaaagtactccacaatt

SEQ ID NO: 9388397 - DNA, 22 bp, Homo sapiens
aggcccttggactcatgctcga

SEQ ID NO: 9388398 - DNA, 22 bp, Homo sapiens
acatggaaaactaactgctttt

SEQ ID NO: 9388399 - DNA, 22 bp, Homo sapiens
aggcccttgggtcctctccaca

SEQ ID NO: 9388400 - DNA, 22 bp, Homo sapiens
aggcccttgggtcctctccaca

SEQ ID NO: 9388401 - DNA, 22 bp, Homo sapiens
aggcccttggagtagaggctga

SEQ ID NO: 9388402 - DNA, 22 bp, Homo sapiens
aggcctgcctggagcctggctg

SEQ ID NO: 9388403 - DNA, 22 bp, Homo sapiens
aggcctgcctggagcctggctg

SEQ ID NO: 9388404 - DNA, 19 bp, Homo sapiens
acatggcatcccaggaggt

SEQ ID NO: 9388405 - DNA, 22 bp, Homo sapiens
acatggcaggaatcatgtgttt

SEQ ID NO: 9388406 - DNA, 17 bp, Homo sapiens
acatggcagttcacgct

SEQ ID NO: 9388407 - DNA, 19 bp, Homo sapiens
acatggcatcccaggaggt

SEQ ID NO: 9388408 - DNA, 20 bp, Homo sapiens
acatggatcaaatgtcagtt

SEQ ID NO: 9388409 - DNA, 22 bp, Homo sapiens
acatggatgaattgtctagtgg

SEQ ID NO: 9388410 - DNA, 21 bp, Homo sapiens
acatggactgtgaatggggac

SEQ ID NO: 9388411 - DNA, 22 bp, Homo sapiens
aggccctggtcaggtctggctg

SEQ ID NO: 9388412 - DNA, 22 bp, Homo sapiens
aggccctgtaaggtgtggagat

SEQ ID NO: 9388413 - DNA, 22 bp, Homo sapiens
aggccctgcccagagctcctcg

SEQ ID NO: 9388414 - DNA, 22 bp, Homo sapiens
aggccctggtcaggtctggctg

SEQ ID NO: 9388415 - DNA, 22 bp, Homo sapiens
aggccctgtaaggtgtggagat

SEQ ID NO: 9388416 - DNA, 22 bp, Homo sapiens
aggccctgtaaggtgtggagat

SEQ ID NO: 9388417 - DNA, 22 bp, Homo sapiens
aggccctgtaaggtgtggagat

SEQ ID NO: 9388418 - DNA, 22 bp, Homo sapiens
aggccctgttatgagccactgt

SEQ ID NO: 9388419 - DNA, 22 bp, Homo sapiens
aggccctgttatgagccactgt

SEQ ID NO: 9388420 - DNA, 22 bp, Homo sapiens
aggccctgtccatggtgctgaa

SEQ ID NO: 9388421 - DNA, 22 bp, Homo sapiens
aggccctgtccatggtgctgaa

SEQ ID NO: 9388422 - DNA, 22 bp, Homo sapiens
aggccctgtccatggtgctgaa

SEQ ID NO: 9388423 - DNA, 22 bp, Homo sapiens
acatgcacccagttacactctc

SEQ ID NO: 9388424 - DNA, 20 bp, Homo sapiens
acatgcacgtgtgtatatat

SEQ ID NO: 9388425 - DNA, 20 bp, Homo sapiens
acatgcacgtgtgtatatat

SEQ ID NO: 9388426 - DNA, 22 bp, Homo sapiens
acatgcacggcaccatcttctg

SEQ ID NO: 9388427 - DNA, 22 bp, Homo sapiens
acatgcactctcactgtgctct

SEQ ID NO: 9388428 - DNA, 22 bp, Homo sapiens
acatgcactctcactgtgctct

SEQ ID NO: 9388429 - DNA, 22 bp, Homo sapiens
acatgcactggttgaggggttt

SEQ ID NO: 9388430 - DNA, 22 bp, Homo sapiens
acatgcactgctcagggttccg

SEQ ID NO: 9388431 - DNA, 22 bp, Homo sapiens
acatgcagaattcttagagagc

SEQ ID NO: 9388432 - DNA, 22 bp, Homo sapiens
acatgcataaactacttcttat

SEQ ID NO: 9388433 - DNA, 20 bp, Homo sapiens
aggccctgccagggacggag

SEQ ID NO: 9388434 - DNA, 22 bp, Homo sapiens
acatgaggaaacaagggtatat

SEQ ID NO: 9388435 - DNA, 22 bp, Homo sapiens
acatgaggaactcaggagtcac

SEQ ID NO: 9388436 - DNA, 22 bp, Homo sapiens
acatgaggaactcaggagtcac

SEQ ID NO: 9388437 - DNA, 22 bp, Homo sapiens
acatgagagaaaagtattctga

SEQ ID NO: 9388438 - DNA, 22 bp, Homo sapiens
acatgagaggctgtggagtaca

SEQ ID NO: 9388439 - DNA, 22 bp, Homo sapiens
acatgatatatgggaaatgctt

SEQ ID NO: 9388440 - DNA, 23 bp, Homo sapiens
acatgatacacaattagcaaacc

SEQ ID NO: 9388441 - DNA, 22 bp, Homo sapiens
acatgatttgcatgatttgtaa

SEQ ID NO: 9388442 - DNA, 22 bp, Homo sapiens
acatgcaaatgtgcatgcatgt

SEQ ID NO: 9388443 - DNA, 22 bp, Homo sapiens
acatgcaaatgtgcatgcatgt

SEQ ID NO: 9388444 - DNA, 22 bp, Homo sapiens
acatgcacacctatatacatgt

SEQ ID NO: 9388445 - DNA, 22 bp, Homo sapiens
acatgcacacgattcagtctgg

SEQ ID NO: 9388446 - DNA, 22 bp, Homo sapiens
acatgcacacgattcagtctgg

SEQ ID NO: 9388447 - DNA, 22 bp, Homo sapiens
acatgcacagcaagggtgagag

SEQ ID NO: 9388448 - DNA, 22 bp, Homo sapiens
acatgcacccagggcattgctt

SEQ ID NO: 9388449 - DNA, 22 bp, Homo sapiens
acatgcacccagggcattgctt

SEQ ID NO: 9388450 - DNA, 22 bp, Homo sapiens
acatgcacccagttacactctc

SEQ ID NO: 9388451 - DNA, 22 bp, Homo sapiens
acatgcacccagttacactctc

SEQ ID NO: 9388452 - DNA, 22 bp, Homo sapiens
acatgcacacctatatacatgt

SEQ ID NO: 9388453 - DNA, 22 bp, Homo sapiens
acatgcaatattgagactttct

SEQ ID NO: 9388454 - DNA, 19 bp, Homo sapiens
acatgcaaggcacctgcag

SEQ ID NO: 9388455 - DNA, 22 bp, Homo sapiens
aggcaggggagctggaagggta

SEQ ID NO: 9388456 - DNA, 22 bp, Homo sapiens
aggcaggggagctggaagggta

SEQ ID NO: 9388457 - DNA, 22 bp, Homo sapiens
aggcagggctgggattagactc

SEQ ID NO: 9388458 - DNA, 22 bp, Homo sapiens
aggcaggggagctggaagggta

SEQ ID NO: 9388459 - DNA, 22 bp, Homo sapiens
aggcaggggagctggaagggta

SEQ ID NO: 9388460 - DNA, 22 bp, Homo sapiens
aggcaggggagctggaagggta

SEQ ID NO: 9388461 - DNA, 22 bp, Homo sapiens
aggcagggctgggattagactc

SEQ ID NO: 9388462 - DNA, 22 bp, Homo sapiens
aggcagggctgggattagactc

SEQ ID NO: 9388463 - DNA, 22 bp, Homo sapiens
aggcaggcagctgtcaccactc

SEQ ID NO: 9388464 - DNA, 22 bp, Homo sapiens
aggcaggcagctgtcaccactc

SEQ ID NO: 9388465 - DNA, 17 bp, Homo sapiens
aggcaggcagagcggga

SEQ ID NO: 9388466 - DNA, 22 bp, Homo sapiens
aggcaggcactccggaagtgtc

SEQ ID NO: 9388467 - DNA, 22 bp, Homo sapiens
aggcaggcactccggaagtgtc

SEQ ID NO: 9388468 - DNA, 17 bp, Homo sapiens
aggcaggcagagcggga

SEQ ID NO: 9388469 - DNA, 22 bp, Homo sapiens
aggcagggctcatttcttaggc

SEQ ID NO: 9388470 - DNA, 22 bp, Homo sapiens
aggcagggctcatttcttaggc

SEQ ID NO: 9388471 - DNA, 23 bp, Homo sapiens
aggcaggcagttcagctgttgtt

SEQ ID NO: 9388472 - DNA, 22 bp, Homo sapiens
aggcaggctggtctgaagagtg

SEQ ID NO: 9388473 - DNA, 22 bp, Homo sapiens
aggcagggaccagttgttttct

SEQ ID NO: 9388474 - DNA, 22 bp, Homo sapiens
acatttaaccaaactgtttaat

SEQ ID NO: 9388475 - DNA, 22 bp, Homo sapiens
acattgtgcctgtgatattaca

SEQ ID NO: 9388476 - DNA, 22 bp, Homo sapiens
acatttaaccctcaggtttctg

SEQ ID NO: 9388477 - DNA, 22 bp, Homo sapiens
aggctaggcatgtgctaccaca

SEQ ID NO: 9388478 - DNA, 22 bp, Homo sapiens
aggctatggtggggccagtggc

SEQ ID NO: 9388479 - DNA, 22 bp, Homo sapiens
aggctatggtggggccagtggc

SEQ ID NO: 9388480 - DNA, 22 bp, Homo sapiens
aggccttcctcggagacaggga

SEQ ID NO: 9388481 - DNA, 22 bp, Homo sapiens
aggccttaccatagctgtagca

SEQ ID NO: 9388482 - DNA, 22 bp, Homo sapiens
aggccttgtgagaagcagagaa

SEQ ID NO: 9388483 - DNA, 22 bp, Homo sapiens
aggccttgggccatagtctcct

SEQ ID NO: 9388484 - DNA, 22 bp, Homo sapiens
aggccttgaaccttgctgggtg

SEQ ID NO: 9388485 - DNA, 22 bp, Homo sapiens
aggccttgccaatgagagaact

SEQ ID NO: 9388486 - DNA, 22 bp, Homo sapiens
aggccttgccaatgagagaact

SEQ ID NO: 9388487 - DNA, 22 bp, Homo sapiens
aggcgcagcacgtgagagttgg

SEQ ID NO: 9388488 - DNA, 22 bp, Homo sapiens
aggcgctgagtaggcaaggagg

SEQ ID NO: 9388489 - DNA, 22 bp, Homo sapiens
aggcgcctgcgggatccttgcc

SEQ ID NO: 9388490 - DNA, 22 bp, Homo sapiens
aggctagctgtttcagggctag

SEQ ID NO: 9388491 - DNA, 22 bp, Homo sapiens
aggctagctgtttcagggctag

SEQ ID NO: 9388492 - DNA, 20 bp, Homo sapiens
aggccttgtttatagtgaga

SEQ ID NO: 9388493 - DNA, 22 bp, Homo sapiens
aggcgaagggaccagacggtag

SEQ ID NO: 9388494 - DNA, 22 bp, Homo sapiens
aggcgagaggcttgggctagta

SEQ ID NO: 9388495 - DNA, 22 bp, Homo sapiens
aggcgcagaaggccaggggcct

SEQ ID NO: 9388496 - DNA, 22 bp, Homo sapiens
aggcgcagaaggccaggggcct

SEQ ID NO: 9388497 - DNA, 22 bp, Homo sapiens
aggcgcagaaggccaggggcct

SEQ ID NO: 9388498 - DNA, 22 bp, Homo sapiens
aggcgcagacatacagggtctg

SEQ ID NO: 9388499 - DNA, 18 bp, Homo sapiens
aggctgcactgtcttaaa

SEQ ID NO: 9388500 - DNA, 18 bp, Homo sapiens
aggctgcactgtcttaaa

SEQ ID NO: 9388501 - DNA, 19 bp, Homo sapiens
aggctgcaaggtggtgggc

SEQ ID NO: 9388502 - DNA, 22 bp, Homo sapiens
aggctgcaaagtgcttgggtgc

SEQ ID NO: 9388503 - DNA, 22 bp, Homo sapiens
aggctgattgaagtttttgtgg

SEQ ID NO: 9388504 - DNA, 22 bp, Homo sapiens
aggctgatgctggctgaggctg

SEQ ID NO: 9388505 - DNA, 22 bp, Homo sapiens
aggctgagtttctcattctcgc

SEQ ID NO: 9388506 - DNA, 22 bp, Homo sapiens
aggctgagtttctcattctcgc

SEQ ID NO: 9388507 - DNA, 22 bp, Homo sapiens
aggctgagtttctcattctcgc

SEQ ID NO: 9388508 - DNA, 20 bp, Homo sapiens
aggctgagttctatgcactt

SEQ ID NO: 9388509 - DNA, 20 bp, Homo sapiens
aggctgagttctatgcactt

SEQ ID NO: 9388510 - DNA, 20 bp, Homo sapiens
aggctgagttctatgcactt

SEQ ID NO: 9388511 - DNA, 22 bp, Homo sapiens
aggctgagtgctcccctagatg

SEQ ID NO: 9388512 - DNA, 22 bp, Homo sapiens
aggctgagtgctcccctagatg

SEQ ID NO: 9388513 - DNA, 22 bp, Homo sapiens
aggctgagtgctcccctagatg

SEQ ID NO: 9388514 - DNA, 22 bp, Homo sapiens
aggctgagggctcctgagggca

SEQ ID NO: 9388515 - DNA, 22 bp, Homo sapiens
aggctgagggctcctgagggca

SEQ ID NO: 9388516 - DNA, 22 bp, Homo sapiens
aggctgagggctcctgagggca

SEQ ID NO: 9388517 - DNA, 22 bp, Homo sapiens
aggctgagggctcctgagggca

SEQ ID NO: 9388518 - DNA, 22 bp, Homo sapiens
aggctgaggctttccttggaga

SEQ ID NO: 9388519 - DNA, 22 bp, Homo sapiens
aggctgaggctttccttggaga

SEQ ID NO: 9388520 - DNA, 22 bp, Homo sapiens
aggctgaggctttccttggaga

SEQ ID NO: 9388521 - DNA, 22 bp, Homo sapiens
aggctgagggctcctgagggca

SEQ ID NO: 9388522 - DNA, 22 bp, Homo sapiens
aggctgaggctggcagctccag

SEQ ID NO: 9388523 - DNA, 22 bp, Homo sapiens
aggctgaggctggcagctccag

SEQ ID NO: 9388524 - DNA, 22 bp, Homo sapiens
aggctgaggctggcagctccag

SEQ ID NO: 9388525 - DNA, 22 bp, Homo sapiens
aggctgaggctggcagctccag

SEQ ID NO: 9388526 - DNA, 22 bp, Homo sapiens
aggctgaggatccctgtgttct

SEQ ID NO: 9388527 - DNA, 22 bp, Homo sapiens
aggctgaggatccctgtgttct

SEQ ID NO: 9388528 - DNA, 22 bp, Homo sapiens
aggctgaggcgggtagatcacc

SEQ ID NO: 9388529 - DNA, 22 bp, Homo sapiens
aggctgaggctggcagctccag

SEQ ID NO: 9388530 - DNA, 22 bp, Homo sapiens
acatttaggatgttttgagaga

SEQ ID NO: 9388531 - DNA, 22 bp, Homo sapiens
acatttatataactcactagga

SEQ ID NO: 9388532 - DNA, 22 bp, Homo sapiens
acatttacagtgctagacaatc

SEQ ID NO: 9388533 - DNA, 22 bp, Homo sapiens
acatttacagtgctagacaatc

SEQ ID NO: 9388534 - DNA, 22 bp, Homo sapiens
acatttacagtgctagacaatc

SEQ ID NO: 9388535 - DNA, 22 bp, Homo sapiens
acatttacattttctctggcct

SEQ ID NO: 9388536 - DNA, 22 bp, Homo sapiens
acatttatatttagtggggaat

SEQ ID NO: 9388537 - DNA, 22 bp, Homo sapiens
acatttatatttagtggggaat

SEQ ID NO: 9388538 - DNA, 22 bp, Homo sapiens
acatttattactcaggttgttg

SEQ ID NO: 9388539 - DNA, 22 bp, Homo sapiens
acatttattactcaggttgttg

SEQ ID NO: 9388540 - DNA, 22 bp, Homo sapiens
acatttatataactcactagga

SEQ ID NO: 9388541 - DNA, 22 bp, Homo sapiens
acatttatataactcactagga

SEQ ID NO: 9388542 - DNA, 22 bp, Homo sapiens
acatttatataactcactagga

SEQ ID NO: 9388543 - DNA, 22 bp, Homo sapiens
acatttatataactcactagga

SEQ ID NO: 9388544 - DNA, 22 bp, Homo sapiens
acatttatataactcactagga

SEQ ID NO: 9388545 - DNA, 22 bp, Homo sapiens
acatttattttggcacggcaca

SEQ ID NO: 9388546 - DNA, 22 bp, Homo sapiens
acatttattttggcacggcaca

SEQ ID NO: 9388547 - DNA, 22 bp, Homo sapiens
acatttattttggcacggcaca

SEQ ID NO: 9388548 - DNA, 22 bp, Homo sapiens
acatttattactcaggttgttg

SEQ ID NO: 9388549 - DNA, 22 bp, Homo sapiens
acatttattactcaggttgttg

SEQ ID NO: 9388550 - DNA, 22 bp, Homo sapiens
acatttattactcaggttgttg

SEQ ID NO: 9388551 - DNA, 22 bp, Homo sapiens
acatttattttcagctgggaaa

SEQ ID NO: 9388552 - DNA, 22 bp, Homo sapiens
acatttattttcagctgggaaa

SEQ ID NO: 9388553 - DNA, 22 bp, Homo sapiens
acatttattttcagctgggaaa

SEQ ID NO: 9388554 - DNA, 22 bp, Homo sapiens
agggaagaggaccagagtctct

SEQ ID NO: 9388555 - DNA, 22 bp, Homo sapiens
agggaagaatcactgggatgtt

SEQ ID NO: 9388556 - DNA, 22 bp, Homo sapiens
agggaagaatcactgggatgtt

SEQ ID NO: 9388557 - DNA, 23 bp, Homo sapiens
aggctttatggtagaaagtttgc

SEQ ID NO: 9388558 - DNA, 23 bp, Homo sapiens
aggctttatggtagaaagtttgc

SEQ ID NO: 9388559 - DNA, 22 bp, Homo sapiens
agggaagaatcactgggatgtt

SEQ ID NO: 9388560 - DNA, 22 bp, Homo sapiens
aggctggcagccacctcagcag

SEQ ID NO: 9388561 - DNA, 22 bp, Homo sapiens
aggctggcagccacctcagcag

SEQ ID NO: 9388562 - DNA, 22 bp, Homo sapiens
aggctggcagccacctcagcag

SEQ ID NO: 9388563 - DNA, 22 bp, Homo sapiens
aggctggcagccacctcagcag

SEQ ID NO: 9388564 - DNA, 22 bp, Homo sapiens
aggctggcagccacctcagcag

SEQ ID NO: 9388565 - DNA, 22 bp, Homo sapiens
aggctttactggatttttcgct

SEQ ID NO: 9388566 - DNA, 22 bp, Homo sapiens
aggctggagtgtgcagtggcgc

SEQ ID NO: 9388567 - DNA, 22 bp, Homo sapiens
aggctggagtgtgcagtggcgc

SEQ ID NO: 9388568 - DNA, 22 bp, Homo sapiens
aggctggagtgtgcagtggcgc

SEQ ID NO: 9388569 - DNA, 22 bp, Homo sapiens
aggctggagtgtgcagtggcgc

SEQ ID NO: 9388570 - DNA, 22 bp, Homo sapiens
aggctggatttatggggacttc

SEQ ID NO: 9388571 - DNA, 22 bp, Homo sapiens
aggctggatctctgttgccttc

SEQ ID NO: 9388572 - DNA, 19 bp, Homo sapiens
aggctggatgcccatctta

SEQ ID NO: 9388573 - DNA, 19 bp, Homo sapiens
aggctggatgcccatctta

SEQ ID NO: 9388574 - DNA, 20 bp, Homo sapiens
aggctggcactcctggccag

SEQ ID NO: 9388575 - DNA, 20 bp, Homo sapiens
aggctggcactcctggccag

SEQ ID NO: 9388576 - DNA, 20 bp, Homo sapiens
aggctggcactcctggccag

SEQ ID NO: 9388577 - DNA, 20 bp, Homo sapiens
aggctggcactcctggccag

SEQ ID NO: 9388578 - DNA, 22 bp, Homo sapiens
aggctggcaaggcagatgtgtg

SEQ ID NO: 9388579 - DNA, 22 bp, Homo sapiens
aggctggcaaggcagatgtgtg

SEQ ID NO: 9388580 - DNA, 22 bp, Homo sapiens
aggctggatgtgcctcaccgag

SEQ ID NO: 9388581 - DNA, 22 bp, Homo sapiens
aggctggatttatggggacttc

SEQ ID NO: 9388582 - DNA, 22 bp, Homo sapiens
aggctggcaaggcagatgtgtg

SEQ ID NO: 9388583 - DNA, 22 bp, Homo sapiens
aggctggcaaggcagatgtgtg

SEQ ID NO: 9388584 - DNA, 20 bp, Homo sapiens
acattttggcatactctcaa

SEQ ID NO: 9388585 - DNA, 22 bp, Homo sapiens
acatttttactgggcatctgca

SEQ ID NO: 9388586 - DNA, 22 bp, Homo sapiens
aggctgcagaacagtcaggtgc

SEQ ID NO: 9388587 - DNA, 19 bp, Homo sapiens
accaaaggagtggggtata

SEQ ID NO: 9388588 - DNA, 22 bp, Homo sapiens
aggctggagtgtgcagtggcgc

SEQ ID NO: 9388589 - DNA, 22 bp, Homo sapiens
aggctggagtgtgcagtggcgc

SEQ ID NO: 9388590 - DNA, 22 bp, Homo sapiens
acatttttgggttgatgtctga

SEQ ID NO: 9388591 - DNA, 22 bp, Homo sapiens
accaggcccatgtggattacta

SEQ ID NO: 9388592 - DNA, 20 bp, Homo sapiens
accaggccccgggccctgca

SEQ ID NO: 9388593 - DNA, 20 bp, Homo sapiens
accaggccccgggccctgca

SEQ ID NO: 9388594 - DNA, 20 bp, Homo sapiens
accaggccccgggccctgca

SEQ ID NO: 9388595 - DNA, 20 bp, Homo sapiens
accaggccccgggccctgca

SEQ ID NO: 9388596 - DNA, 20 bp, Homo sapiens
accaggcccggtgtctcctc

SEQ ID NO: 9388597 - DNA, 22 bp, Homo sapiens
accaggcccgctgctatggtgg

SEQ ID NO: 9388598 - DNA, 22 bp, Homo sapiens
accaggcccgctgctatggtgg

SEQ ID NO: 9388599 - DNA, 22 bp, Homo sapiens
accaggcccaccgcatgctcct

SEQ ID NO: 9388600 - DNA, 22 bp, Homo sapiens
accaggcccatgtggattacta

SEQ ID NO: 9388601 - DNA, 22 bp, Homo sapiens
accaggcccaccgcatgctcct

SEQ ID NO: 9388602 - DNA, 22 bp, Homo sapiens
agggacagtatccatctcacag

SEQ ID NO: 9388603 - DNA, 22 bp, Homo sapiens
agggacagtatccatctcacag

SEQ ID NO: 9388604 - DNA, 17 bp, Homo sapiens
agggacagcagtttagg

SEQ ID NO: 9388605 - DNA, 22 bp, Homo sapiens
accaggccctccagctgcgtgg

SEQ ID NO: 9388606 - DNA, 22 bp, Homo sapiens
accaggccctccagctgcgtgg

SEQ ID NO: 9388607 - DNA, 22 bp, Homo sapiens
accaggccctccagctgcgtgg

SEQ ID NO: 9388608 - DNA, 22 bp, Homo sapiens
accaggcctagcaagtacatta

SEQ ID NO: 9388609 - DNA, 20 bp, Homo sapiens
accaggcccggtgtctcctc

SEQ ID NO: 9388610 - DNA, 19 bp, Homo sapiens
accaggcctcagaggccct

SEQ ID NO: 9388611 - DNA, 19 bp, Homo sapiens
accaggcctcagaggccct

SEQ ID NO: 9388612 - DNA, 19 bp, Homo sapiens
accaggcctcagaggccct

SEQ ID NO: 9388613 - DNA, 22 bp, Homo sapiens
accaggcctagcaagtacatta

SEQ ID NO: 9388614 - DNA, 22 bp, Homo sapiens
accaggcctagcaagtacatta

SEQ ID NO: 9388615 - DNA, 23 bp, Homo sapiens
agggagctaaaaggctggagcag

SEQ ID NO: 9388616 - DNA, 23 bp, Homo sapiens
agggagctaaaaggctggagcag

SEQ ID NO: 9388617 - DNA, 22 bp, Homo sapiens
agggagctaggatcctgaaggt

SEQ ID NO: 9388618 - DNA, 21 bp, Homo sapiens
agggagctatttatagtaagc

SEQ ID NO: 9388619 - DNA, 22 bp, Homo sapiens
agggagctattgtgttactttg

SEQ ID NO: 9388620 - DNA, 22 bp, Homo sapiens
agggaagctgctgggtccacct

SEQ ID NO: 9388621 - DNA, 22 bp, Homo sapiens
agggaatgtagcaagatgccaa

SEQ ID NO: 9388622 - DNA, 22 bp, Homo sapiens
agggaagcaggaatagctctga

SEQ ID NO: 9388623 - DNA, 22 bp, Homo sapiens
agggaagaggcaaggtttatgg

SEQ ID NO: 9388624 - DNA, 22 bp, Homo sapiens
agggaagaggaccagagtctct

SEQ ID NO: 9388625 - DNA, 22 bp, Homo sapiens
agggaagaggaccagagtctct

SEQ ID NO: 9388626 - DNA, 17 bp, Homo sapiens
agggacagcagtttagg

SEQ ID NO: 9388627 - DNA, 17 bp, Homo sapiens
agggacagcagtttagg

SEQ ID NO: 9388628 - DNA, 17 bp, Homo sapiens
agggacagcagtttagg

SEQ ID NO: 9388629 - DNA, 22 bp, Homo sapiens
agggacacttgctttcaggccc

SEQ ID NO: 9388630 - DNA, 22 bp, Homo sapiens
agggacagatgaatgactgagt

SEQ ID NO: 9388631 - DNA, 21 bp, Homo sapiens
agggacaaaacacaatgccac

SEQ ID NO: 9388632 - DNA, 20 bp, Homo sapiens
agggacacaatatttctgtg

SEQ ID NO: 9388633 - DNA, 22 bp, Homo sapiens
agggaattcactggaacgccct

SEQ ID NO: 9388634 - DNA, 22 bp, Homo sapiens
agggaatgtagcaagatgccaa

SEQ ID NO: 9388635 - DNA, 22 bp, Homo sapiens
agggaatgtgaaaacacctctc

SEQ ID NO: 9388636 - DNA, 22 bp, Homo sapiens
agggacacgaggtcctgctggg

SEQ ID NO: 9388637 - DNA, 22 bp, Homo sapiens
accatttaaggaaaatgtatca

SEQ ID NO: 9388638 - DNA, 22 bp, Homo sapiens
accattgccccctagtgtctgt

SEQ ID NO: 9388639 - DNA, 22 bp, Homo sapiens
accattgccccctagtgtctgt

SEQ ID NO: 9388640 - DNA, 21 bp, Homo sapiens
accattctgcacatgctgtca

SEQ ID NO: 9388641 - DNA, 22 bp, Homo sapiens
accatgttggccaagctggtct

SEQ ID NO: 9388642 - DNA, 22 bp, Homo sapiens
agggagctcacagtccagtaga

SEQ ID NO: 9388643 - DNA, 22 bp, Homo sapiens
agggagctatttcagggttatt

SEQ ID NO: 9388644 - DNA, 22 bp, Homo sapiens
agggagctcagttggaagcggt

SEQ ID NO: 9388645 - DNA, 22 bp, Homo sapiens
agggagctcacagtccagtaga

SEQ ID NO: 9388646 - DNA, 22 bp, Homo sapiens
agggagctcgatgcctgagtgt

SEQ ID NO: 9388647 - DNA, 22 bp, Homo sapiens
agggagctcgatgcctgagtgt

SEQ ID NO: 9388648 - DNA, 22 bp, Homo sapiens
agggagctctgggggcacacgg

SEQ ID NO: 9388649 - DNA, 22 bp, Homo sapiens
agggagctctgggggcacacgg

SEQ ID NO: 9388650 - DNA, 22 bp, Homo sapiens
agggagctctgggggcacacgg

SEQ ID NO: 9388651 - DNA, 22 bp, Homo sapiens
agggagctctgggggcacacgg

SEQ ID NO: 9388652 - DNA, 22 bp, Homo sapiens
agggagctctaagtagagggac

SEQ ID NO: 9388653 - DNA, 22 bp, Homo sapiens
accatcagtactggatgctgac

SEQ ID NO: 9388654 - DNA, 22 bp, Homo sapiens
agggagctctttggtcttgccg

SEQ ID NO: 9388655 - DNA, 22 bp, Homo sapiens
acccaggcctgagagacaggag

SEQ ID NO: 9388656 - DNA, 22 bp, Homo sapiens
acccaggcctgagagacaggag

SEQ ID NO: 9388657 - DNA, 23 bp, Homo sapiens
agggcatgaagcagaggacgtgg

SEQ ID NO: 9388658 - DNA, 23 bp, Homo sapiens
agggcatgaagcagaggacgtgg

SEQ ID NO: 9388659 - DNA, 23 bp, Homo sapiens
agggcatgaagcagaggacgtgg

SEQ ID NO: 9388660 - DNA, 22 bp, Homo sapiens
agggcatgaagcagtggacagc

SEQ ID NO: 9388661 - DNA, 22 bp, Homo sapiens
agggcatgaagcagtggacagc

SEQ ID NO: 9388662 - DNA, 22 bp, Homo sapiens
agggcatgaagcagtggacagc

SEQ ID NO: 9388663 - DNA, 22 bp, Homo sapiens
agggcatgaaatgggcagaagc

SEQ ID NO: 9388664 - DNA, 22 bp, Homo sapiens
agggcatgaaatgggcagaagc

SEQ ID NO: 9388665 - DNA, 23 bp, Homo sapiens
agggcatgaagcagaggacgtgg

SEQ ID NO: 9388666 - DNA, 22 bp, Homo sapiens
agggcagttcagccacaggctc

SEQ ID NO: 9388667 - DNA, 22 bp, Homo sapiens
agggcagttcaacttcatagtg

SEQ ID NO: 9388668 - DNA, 22 bp, Homo sapiens
accattttgggtattttcagag

SEQ ID NO: 9388669 - DNA, 22 bp, Homo sapiens
acccacacatctctaattcagt

SEQ ID NO: 9388670 - DNA, 22 bp, Homo sapiens
acccaatacctgtgcagggctt

SEQ ID NO: 9388671 - DNA, 22 bp, Homo sapiens
acccaataatgcaactccactt

SEQ ID NO: 9388672 - DNA, 22 bp, Homo sapiens
acccacacctccgtatatcact

SEQ ID NO: 9388673 - DNA, 20 bp, Homo sapiens
agggcagcttgaggagccgg

SEQ ID NO: 9388674 - DNA, 22 bp, Homo sapiens
agggcagcttccatagtctggc

SEQ ID NO: 9388675 - DNA, 20 bp, Homo sapiens
agggcagcttgaggagccgg

SEQ ID NO: 9388676 - DNA, 22 bp, Homo sapiens
agggcctgggccagcacccttt

SEQ ID NO: 9388677 - DNA, 22 bp, Homo sapiens
agggcctgggatgtcctcctag

SEQ ID NO: 9388678 - DNA, 22 bp, Homo sapiens
agggcctggggtagcttactgc

SEQ ID NO: 9388679 - DNA, 22 bp, Homo sapiens
agggcctgggccagcacccttt

SEQ ID NO: 9388680 - DNA, 22 bp, Homo sapiens
acccaggctggagtgcagtagc

SEQ ID NO: 9388681 - DNA, 22 bp, Homo sapiens
acccaggctggagtgcagtgac

SEQ ID NO: 9388682 - DNA, 22 bp, Homo sapiens
agggcctgggaagaggaaccct

SEQ ID NO: 9388683 - DNA, 22 bp, Homo sapiens
agggcctgggaagaggaaccct

SEQ ID NO: 9388684 - DNA, 22 bp, Homo sapiens
acccaggctgcttctcagtggc

SEQ ID NO: 9388685 - DNA, 22 bp, Homo sapiens
acccaggctggagtgcagtagc

SEQ ID NO: 9388686 - DNA, 22 bp, Homo sapiens
acccaggctagggtgcagtggc

SEQ ID NO: 9388687 - DNA, 22 bp, Homo sapiens
acccaggctagggtgcagtggc

SEQ ID NO: 9388688 - DNA, 17 bp, Homo sapiens
acccaggctctatcttg

SEQ ID NO: 9388689 - DNA, 18 bp, Homo sapiens
acccaggctcatggtcct

SEQ ID NO: 9388690 - DNA, 22 bp, Homo sapiens
acccaggctagagtgcagtggt

SEQ ID NO: 9388691 - DNA, 22 bp, Homo sapiens
acccaggctagagtgcagtggt

SEQ ID NO: 9388692 - DNA, 22 bp, Homo sapiens
acccaggctagaagtgaattat

SEQ ID NO: 9388693 - DNA, 22 bp, Homo sapiens
acccaggcgggagtgcagtgtc

SEQ ID NO: 9388694 - DNA, 22 bp, Homo sapiens
acccaggcgggagtgcagtgtc

SEQ ID NO: 9388695 - DNA, 22 bp, Homo sapiens
acccaggcctgagagacaggag

SEQ ID NO: 9388696 - DNA, 22 bp, Homo sapiens
acccaggcctgagagacaggag

SEQ ID NO: 9388697 - DNA, 22 bp, Homo sapiens
agggcctggtgacctgggtcct

SEQ ID NO: 9388698 - DNA, 22 bp, Homo sapiens
agggcctgggtctgtactcctc

SEQ ID NO: 9388699 - DNA, 22 bp, Homo sapiens
agggcctggggtagcttactgc

SEQ ID NO: 9388700 - DNA, 22 bp, Homo sapiens
agggcctggtgacctgggtcct

SEQ ID NO: 9388701 - DNA, 22 bp, Homo sapiens
agggcctggttctgtgtaggga

SEQ ID NO: 9388702 - DNA, 22 bp, Homo sapiens
accctaataatcacagactagt

SEQ ID NO: 9388703 - DNA, 22 bp, Homo sapiens
accctaataatcacagactagt

SEQ ID NO: 9388704 - DNA, 22 bp, Homo sapiens
acccggagtcggaggttgcagt

SEQ ID NO: 9388705 - DNA, 19 bp, Homo sapiens
accctaggaggtctggtga

SEQ ID NO: 9388706 - DNA, 22 bp, Homo sapiens
accctcaacaaattcactctat

SEQ ID NO: 9388707 - DNA, 22 bp, Homo sapiens
accctcaacaaattcactctat

SEQ ID NO: 9388708 - DNA, 22 bp, Homo sapiens
accctcaagatggaagcagttt

SEQ ID NO: 9388709 - DNA, 22 bp, Homo sapiens
accctcaagatggaagcagttt

SEQ ID NO: 9388710 - DNA, 16 bp, Homo sapiens
accctcagaaactgct

SEQ ID NO: 9388711 - DNA, 22 bp, Homo sapiens
accctcagacatattccatcat

SEQ ID NO: 9388712 - DNA, 22 bp, Homo sapiens
accctcagacagctgtggccag

SEQ ID NO: 9388713 - DNA, 22 bp, Homo sapiens
agaaatgacacacatgagacat

SEQ ID NO: 9388714 - DNA, 22 bp, Homo sapiens
agaaatgacacacatgagacat

SEQ ID NO: 9388715 - DNA, 22 bp, Homo sapiens
agaaatgacacacatgagacat

SEQ ID NO: 9388716 - DNA, 23 bp, Homo sapiens
aatgagttgggcagcatacaggc

SEQ ID NO: 9388717 - DNA, 22 bp, Homo sapiens
agaagcagaaggaagcagggcc

SEQ ID NO: 9388718 - DNA, 22 bp, Homo sapiens
agaagcagaaggaagcagggcc

SEQ ID NO: 9388719 - DNA, 22 bp, Homo sapiens
agaagcagaaaagggcactttt

SEQ ID NO: 9388720 - DNA, 22 bp, Homo sapiens
agaagcagaaactgggcttgtg

SEQ ID NO: 9388721 - DNA, 22 bp, Homo sapiens
aatgatttggcaaaggaatcca

SEQ ID NO: 9388722 - DNA, 23 bp, Homo sapiens
aatgatttcatgatgatagcagc

SEQ ID NO: 9388723 - DNA, 22 bp, Homo sapiens
aatgatttcccctacacagaag

SEQ ID NO: 9388724 - DNA, 22 bp, Homo sapiens
aatgatttcccctacacagaag

SEQ ID NO: 9388725 - DNA, 22 bp, Homo sapiens
aatgattctatttgcagcttgg

SEQ ID NO: 9388726 - DNA, 22 bp, Homo sapiens
aatgattgtcattccaaaaagt

SEQ ID NO: 9388727 - DNA, 23 bp, Homo sapiens
aatgatttcatgatgatagcagc

SEQ ID NO: 9388728 - DNA, 23 bp, Homo sapiens
aatcagtgcagttttatgccaag

SEQ ID NO: 9388729 - DNA, 22 bp, Homo sapiens
agaaatactttgtaaatctcac

SEQ ID NO: 9388730 - DNA, 22 bp, Homo sapiens
agaaatactttgtaaatctcac

SEQ ID NO: 9388731 - DNA, 22 bp, Homo sapiens
agaaatagcagagtcaggcggg

SEQ ID NO: 9388732 - DNA, 22 bp, Homo sapiens
agaaatgaaaccaaagcctaga

SEQ ID NO: 9388733 - DNA, 22 bp, Homo sapiens
agaaatgaaaccaaagcctaga

SEQ ID NO: 9388734 - DNA, 22 bp, Homo sapiens
agaaatgaagagagtcaaggtt

SEQ ID NO: 9388735 - DNA, 22 bp, Homo sapiens
agaaatgacaagactgatcagg

SEQ ID NO: 9388736 - DNA, 22 bp, Homo sapiens
agaaatgacaagactgatcagg

SEQ ID NO: 9388737 - DNA, 22 bp, Homo sapiens
agaaatgaagcaggagttatta

SEQ ID NO: 9388738 - DNA, 22 bp, Homo sapiens
agaaatgaagcaggagttatta

SEQ ID NO: 9388739 - DNA, 22 bp, Homo sapiens
agaaatgaatatgtagtggtta

SEQ ID NO: 9388740 - DNA, 22 bp, Homo sapiens
aatcaggatgactgtcatttca

SEQ ID NO: 9388741 - DNA, 22 bp, Homo sapiens
aatcaggacccactctacagtt

SEQ ID NO: 9388742 - DNA, 22 bp, Homo sapiens
aatcagccatttttccaaggag

SEQ ID NO: 9388743 - DNA, 22 bp, Homo sapiens
aatcagcaaatgcttactcagg

SEQ ID NO: 9388744 - DNA, 22 bp, Homo sapiens
aatcagcaggcttctaaatttt

SEQ ID NO: 9388745 - DNA, 22 bp, Homo sapiens
aatcagaccgttctggctgtcc

SEQ ID NO: 9388746 - DNA, 22 bp, Homo sapiens
aatcagagccctctgagcttca

SEQ ID NO: 9388747 - DNA, 22 bp, Homo sapiens
aatcacatctcattcaacagcc

SEQ ID NO: 9388748 - DNA, 22 bp, Homo sapiens
aatcagaaagaggtcatgttgc

SEQ ID NO: 9388749 - DNA, 22 bp, Homo sapiens
actttcttcttatgcattaagg

SEQ ID NO: 9388750 - DNA, 22 bp, Homo sapiens
actttcttcttatgcattaagg

SEQ ID NO: 9388751 - DNA, 22 bp, Homo sapiens
actttcttggtcccatgtttga

SEQ ID NO: 9388752 - DNA, 22 bp, Homo sapiens
actttcttggtcccatgtttga

SEQ ID NO: 9388753 - DNA, 22 bp, Homo sapiens
actttcttatccatgatctcac

SEQ ID NO: 9388754 - DNA, 22 bp, Homo sapiens
actttcttctactacttggaga

SEQ ID NO: 9388755 - DNA, 22 bp, Homo sapiens
actttcttctactacttggaga

SEQ ID NO: 9388756 - DNA, 22 bp, Homo sapiens
actttctgttagatgaatggat

SEQ ID NO: 9388757 - DNA, 22 bp, Homo sapiens
actttcttaggctgtataaatg

SEQ ID NO: 9388758 - DNA, 22 bp, Homo sapiens
actttctgttagatgaatggat

SEQ ID NO: 9388759 - DNA, 22 bp, Homo sapiens
actttcttaggctgtataaatg

SEQ ID NO: 9388760 - DNA, 22 bp, Homo sapiens
actttcttaggctgtataaatg

SEQ ID NO: 9388761 - DNA, 23 bp, Homo sapiens
actttattgaccccaggtcagtt

SEQ ID NO: 9388762 - DNA, 22 bp, Homo sapiens
actttatttcctattgcatcca

SEQ ID NO: 9388763 - DNA, 22 bp, Homo sapiens
actttatttcctattgcatcca

SEQ ID NO: 9388764 - DNA, 23 bp, Homo sapiens
actttattgaccccaggtcagtt

SEQ ID NO: 9388765 - DNA, 23 bp, Homo sapiens
actttattgaccccaggtcagtt

SEQ ID NO: 9388766 - DNA, 23 bp, Homo sapiens
actttattgaccccaggtcagtt

SEQ ID NO: 9388767 - DNA, 23 bp, Homo sapiens
actttattgaccccaggtcagtt

SEQ ID NO: 9388768 - DNA, 22 bp, Homo sapiens
actttaaaactgatcatcagag

SEQ ID NO: 9388769 - DNA, 22 bp, Homo sapiens
actgttgaagtgccagcttgat

SEQ ID NO: 9388770 - DNA, 22 bp, Homo sapiens
actgttgaagtgccagcttgat

SEQ ID NO: 9388771 - DNA, 22 bp, Homo sapiens
actgttcttcccatttatattg

SEQ ID NO: 9388772 - DNA, 22 bp, Homo sapiens
actgttcttcatttagcaaaga

SEQ ID NO: 9388773 - DNA, 19 bp, Homo sapiens
actgttctgtatgttgatt

SEQ ID NO: 9388774 - DNA, 22 bp, Homo sapiens
actgttctgcatgctgtgaggg

SEQ ID NO: 9388775 - DNA, 22 bp, Homo sapiens
actgttctgcatgtacctgagg

SEQ ID NO: 9388776 - DNA, 22 bp, Homo sapiens
actgttctcctttggctatatc

SEQ ID NO: 9388777 - DNA, 22 bp, Homo sapiens
aatactatgtagccaaaataat

SEQ ID NO: 9388778 - DNA, 20 bp, Homo sapiens
aatactaaacacaaagcagt

SEQ ID NO: 9388779 - DNA, 22 bp, Homo sapiens
aatactagttattaaagctttt

SEQ ID NO: 9388780 - DNA, 22 bp, Homo sapiens
aatactgcctgtgaggtaactc

SEQ ID NO: 9388781 - DNA, 22 bp, Homo sapiens
aatactgcctgtgaggtaactc

SEQ ID NO: 9388782 - DNA, 22 bp, Homo sapiens
actgggctgcctggttcttcta

SEQ ID NO: 9388783 - DNA, 22 bp, Homo sapiens
aatactgaattagttgagacaa

SEQ ID NO: 9388784 - DNA, 22 bp, Homo sapiens
actgggcttcacttggcacatc

SEQ ID NO: 9388785 - DNA, 22 bp, Homo sapiens
actgggcttatttcttgtgaac

SEQ ID NO: 9388786 - DNA, 22 bp, Homo sapiens
actgggcttatgctgtggagta

SEQ ID NO: 9388787 - DNA, 22 bp, Homo sapiens
actgggcttatgctgtggagta

SEQ ID NO: 9388788 - DNA, 22 bp, Homo sapiens
actgggctgttccttatttcta

SEQ ID NO: 9388789 - DNA, 22 bp, Homo sapiens
actgggctgttttttgagtgga

SEQ ID NO: 9388790 - DNA, 22 bp, Homo sapiens
actgggctgttttttgagtgga

SEQ ID NO: 9388791 - DNA, 22 bp, Homo sapiens
actgggctgttttttgagtgga

SEQ ID NO: 9388792 - DNA, 22 bp, Homo sapiens
actgggctgttttttgagtgga

SEQ ID NO: 9388793 - DNA, 22 bp, Homo sapiens
actgggcttatgctgtggagta

SEQ ID NO: 9388794 - DNA, 23 bp, Homo sapiens
actgggcttatgaggaggcttgt

SEQ ID NO: 9388795 - DNA, 23 bp, Homo sapiens
actgggcttatgaggaggcttgt

SEQ ID NO: 9388796 - DNA, 22 bp, Homo sapiens
actgggctgtggacacccagcg

SEQ ID NO: 9388797 - DNA, 22 bp, Homo sapiens
actgggctgtaaagagaggcaa

SEQ ID NO: 9388798 - DNA, 22 bp, Homo sapiens
actgggctgtaaagagaggcaa

SEQ ID NO: 9388799 - DNA, 22 bp, Homo sapiens
actgggctgtaaagagaggcaa

SEQ ID NO: 9388800 - DNA, 22 bp, Homo sapiens
actgggctgcttgagtgccttc

SEQ ID NO: 9388801 - DNA, 22 bp, Homo sapiens
actgggctgcttgagtgccttc

SEQ ID NO: 9388802 - DNA, 22 bp, Homo sapiens
actgggctggggctcattctcc

SEQ ID NO: 9388803 - DNA, 22 bp, Homo sapiens
actgggctgtaaagagaggcaa

SEQ ID NO: 9388804 - DNA, 22 bp, Homo sapiens
actgggctggttagttttacta

SEQ ID NO: 9388805 - DNA, 22 bp, Homo sapiens
aatatagaatcactttccttca

SEQ ID NO: 9388806 - DNA, 22 bp, Homo sapiens
aatatagatttactcaagagaa

SEQ ID NO: 9388807 - DNA, 22 bp, Homo sapiens
aatatactatactactttctgg

SEQ ID NO: 9388808 - DNA, 22 bp, Homo sapiens
aatatactatactactttctgg

SEQ ID NO: 9388809 - DNA, 22 bp, Homo sapiens
aatatactatactactttctgg

SEQ ID NO: 9388810 - DNA, 22 bp, Homo sapiens
aatatactatactactttctgg

SEQ ID NO: 9388811 - DNA, 22 bp, Homo sapiens
actgggcttcacttggcacatc

SEQ ID NO: 9388812 - DNA, 22 bp, Homo sapiens
actgggcttcacttggcacatc

SEQ ID NO: 9388813 - DNA, 22 bp, Homo sapiens
aatataattttattcctagagt

SEQ ID NO: 9388814 - DNA, 22 bp, Homo sapiens
aatataattttattcctagagt

SEQ ID NO: 9388815 - DNA, 22 bp, Homo sapiens
aatatagctcactataccatgg

SEQ ID NO: 9388816 - DNA, 22 bp, Homo sapiens
aatatagtgttagctcatttga

SEQ ID NO: 9388817 - DNA, 22 bp, Homo sapiens
aatatagtgttagctcatttga

SEQ ID NO: 9388818 - DNA, 22 bp, Homo sapiens
aatatagttctagaaatatttt

SEQ ID NO: 9388819 - DNA, 22 bp, Homo sapiens
aatatagttctagaaatatttt

SEQ ID NO: 9388820 - DNA, 22 bp, Homo sapiens
aatatagttctagaaatatttt

SEQ ID NO: 9388821 - DNA, 22 bp, Homo sapiens
aatatagttctggtattgttaa

SEQ ID NO: 9388822 - DNA, 22 bp, Homo sapiens
aatatagttctggtattgttaa

SEQ ID NO: 9388823 - DNA, 22 bp, Homo sapiens
aatatagttctggtattgttaa

SEQ ID NO: 9388824 - DNA, 22 bp, Homo sapiens
aatatagttctggtattgttaa

SEQ ID NO: 9388825 - DNA, 22 bp, Homo sapiens
actgatcaagggtttaatttta

SEQ ID NO: 9388826 - DNA, 22 bp, Homo sapiens
actgcactccaacctgggtgac

SEQ ID NO: 9388827 - DNA, 22 bp, Homo sapiens
actgataagttgcttgctctca

SEQ ID NO: 9388828 - DNA, 22 bp, Homo sapiens
actgagtgtccactatgagcca

SEQ ID NO: 9388829 - DNA, 22 bp, Homo sapiens
actgagtgggaggtttgtgtga

SEQ ID NO: 9388830 - DNA, 22 bp, Homo sapiens
actgagtggctggggagtggca

SEQ ID NO: 9388831 - DNA, 22 bp, Homo sapiens
actgcactccagcctgggtaac

SEQ ID NO: 9388832 - DNA, 22 bp, Homo sapiens
actgcactccagcctgggtaac

SEQ ID NO: 9388833 - DNA, 22 bp, Homo sapiens
actgcactccagcctgggtgac

SEQ ID NO: 9388834 - DNA, 22 bp, Homo sapiens
actgcactccaacctgggtgac

SEQ ID NO: 9388835 - DNA, 22 bp, Homo sapiens
actgcactccaacctgggtgac

SEQ ID NO: 9388836 - DNA, 22 bp, Homo sapiens
actctgctgtttactctctata

SEQ ID NO: 9388837 - DNA, 22 bp, Homo sapiens
actctccctgctatccacttcc

SEQ ID NO: 9388838 - DNA, 22 bp, Homo sapiens
actctcccttatctaactttac

SEQ ID NO: 9388839 - DNA, 22 bp, Homo sapiens
actctgctctgtatttcactgt

SEQ ID NO: 9388840 - DNA, 22 bp, Homo sapiens
actctgctcttatagtgttata

SEQ ID NO: 9388841 - DNA, 22 bp, Homo sapiens
actctgcttgggccatatctgg

SEQ ID NO: 9388842 - DNA, 22 bp, Homo sapiens
actctgcttgggccatatctgg

SEQ ID NO: 9388843 - DNA, 22 bp, Homo sapiens
actctggagatggatgtcagga

SEQ ID NO: 9388844 - DNA, 22 bp, Homo sapiens
actctggagatggatgtcagga

SEQ ID NO: 9388845 - DNA, 22 bp, Homo sapiens
actgaggtctatcatgagccag

SEQ ID NO: 9388846 - DNA, 22 bp, Homo sapiens
actgagagaacgggctgctccc

SEQ ID NO: 9388847 - DNA, 22 bp, Homo sapiens
actgagactttgttgagttctt

SEQ ID NO: 9388848 - DNA, 22 bp, Homo sapiens
actctggcgggcgggcgagcca

SEQ ID NO: 9388849 - DNA, 22 bp, Homo sapiens
actggctgaaagtaaagaacac

SEQ ID NO: 9388850 - DNA, 22 bp, Homo sapiens
actggctgaagtttactttttg

SEQ ID NO: 9388851 - DNA, 22 bp, Homo sapiens
actggctgaggaagttgccact

SEQ ID NO: 9388852 - DNA, 22 bp, Homo sapiens
aatacagaggaaacatttaata

SEQ ID NO: 9388853 - DNA, 22 bp, Homo sapiens
actggccaggcacagctgtggg

SEQ ID NO: 9388854 - DNA, 22 bp, Homo sapiens
actggccaggcacagctgtggg

SEQ ID NO: 9388855 - DNA, 22 bp, Homo sapiens
actggccagaactaagtcacat

SEQ ID NO: 9388856 - DNA, 22 bp, Homo sapiens
actggccatgaacttgggatct

SEQ ID NO: 9388857 - DNA, 22 bp, Homo sapiens
actggccaggcagcagtagctt

SEQ ID NO: 9388858 - DNA, 22 bp, Homo sapiens
actggctgaaagtaaagaacac

SEQ ID NO: 9388859 - DNA, 22 bp, Homo sapiens
actggccctggctgctaggctg

SEQ ID NO: 9388860 - DNA, 22 bp, Homo sapiens
actggcccttgattgcatcagc

SEQ ID NO: 9388861 - DNA, 22 bp, Homo sapiens
actgcactccagcctgggtgac

SEQ ID NO: 9388862 - DNA, 22 bp, Homo sapiens
actggagactgtgtcttttgat

SEQ ID NO: 9388863 - DNA, 22 bp, Homo sapiens
actggagactgtgtcttttgat

SEQ ID NO: 9388864 - DNA, 19 bp, Homo sapiens
actggagcctgatggagga

SEQ ID NO: 9388865 - DNA, 22 bp, Homo sapiens
actggactcacgtattcctgag

SEQ ID NO: 9388866 - DNA, 22 bp, Homo sapiens
actggagcttctaaggaggagt

SEQ ID NO: 9388867 - DNA, 22 bp, Homo sapiens
actggagctgagagcatgggta

SEQ ID NO: 9388868 - DNA, 22 bp, Homo sapiens
actggaggcccctcccagtgaa

SEQ ID NO: 9388869 - DNA, 22 bp, Homo sapiens
actggagtaaaggtcacttgtg

SEQ ID NO: 9388870 - DNA, 22 bp, Homo sapiens
actggagtaaaggtcacttgtg

SEQ ID NO: 9388871 - DNA, 22 bp, Homo sapiens
actggaggggaaaatggtagta

SEQ ID NO: 9388872 - DNA, 22 bp, Homo sapiens
actggaggggaaaatggtagta

SEQ ID NO: 9388873 - DNA, 20 bp, Homo sapiens
actggagtaccctagagaag

SEQ ID NO: 9388874 - DNA, 22 bp, Homo sapiens
actggagtacagtggcgtgaac

SEQ ID NO: 9388875 - DNA, 20 bp, Homo sapiens
actggagtaccctagagaag

SEQ ID NO: 9388876 - DNA, 22 bp, Homo sapiens
actggagtattgtttaatacca

SEQ ID NO: 9388877 - DNA, 22 bp, Homo sapiens
actggagtagatctgactgagt

SEQ ID NO: 9388878 - DNA, 22 bp, Homo sapiens
actggagtcagggaaaaagtgt

SEQ ID NO: 9388879 - DNA, 22 bp, Homo sapiens
actggagtccagacccaagagg

SEQ ID NO: 9388880 - DNA, 22 bp, Homo sapiens
actggagtgagtatcgatgaac

SEQ ID NO: 9388881 - DNA, 16 bp, Homo sapiens
actggagtggggatgc

SEQ ID NO: 9388882 - DNA, 22 bp, Homo sapiens
actggagtgtttggaggatgca

SEQ ID NO: 9388883 - DNA, 21 bp, Homo sapiens
actggccaccactggcagggg

SEQ ID NO: 9388884 - DNA, 22 bp, Homo sapiens
actggagttcatggtaaagtca

SEQ ID NO: 9388885 - DNA, 22 bp, Homo sapiens
actggagttattatttgcagct

SEQ ID NO: 9388886 - DNA, 20 bp, Homo sapiens
actggagttcatgctaagag

SEQ ID NO: 9388887 - DNA, 22 bp, Homo sapiens
acctaacttacctaggtccaca

SEQ ID NO: 9388888 - DNA, 22 bp, Homo sapiens
acgggtggctgaggaggcctct

SEQ ID NO: 9388889 - DNA, 22 bp, Homo sapiens
acggggctagagaaggtttctt

SEQ ID NO: 9388890 - DNA, 22 bp, Homo sapiens
acgtgcaggatctggttggcga

SEQ ID NO: 9388891 - DNA, 22 bp, Homo sapiens
acgtatattgaaatatcatgag

SEQ ID NO: 9388892 - DNA, 22 bp, Homo sapiens
acgtagcactgagagatgcagg

SEQ ID NO: 9388893 - DNA, 22 bp, Homo sapiens
aagtctctggtgatgcaggaaa

SEQ ID NO: 9388894 - DNA, 22 bp, Homo sapiens
aagtctcttagtaatatccaac

SEQ ID NO: 9388895 - DNA, 22 bp, Homo sapiens
aagtctcttcctctgccaaaga

SEQ ID NO: 9388896 - DNA, 22 bp, Homo sapiens
aagtctctttacctctccaggc

SEQ ID NO: 9388897 - DNA, 22 bp, Homo sapiens
aagtctctgatgtgtgttaggt

SEQ ID NO: 9388898 - DNA, 22 bp, Homo sapiens
aagtctctctgtgtgggataag

SEQ ID NO: 9388899 - DNA, 18 bp, Homo sapiens
aagtctctgaaagctttt

SEQ ID NO: 9388900 - DNA, 22 bp, Homo sapiens
aagtctctaagactgtgccatc

SEQ ID NO: 9388901 - DNA, 22 bp, Homo sapiens
aagtctctaagactgtgccatc

SEQ ID NO: 9388902 - DNA, 22 bp, Homo sapiens
aagtcgtggcaggcttgcacga

SEQ ID NO: 9388903 - DNA, 22 bp, Homo sapiens
aagtcgtcgaagatggaggttg

SEQ ID NO: 9388904 - DNA, 22 bp, Homo sapiens
aagtctcatccgtgtagctcca

SEQ ID NO: 9388905 - DNA, 22 bp, Homo sapiens
acgtggagagaatagggcacca

SEQ ID NO: 9388906 - DNA, 22 bp, Homo sapiens
acgtggagagaatagggcacca

SEQ ID NO: 9388907 - DNA, 20 bp, Homo sapiens
acgtggccaccagtggctta

SEQ ID NO: 9388908 - DNA, 22 bp, Homo sapiens
actctccagggatttaggatgg

SEQ ID NO: 9388909 - DNA, 22 bp, Homo sapiens
actctccacccactcactctgt

SEQ ID NO: 9388910 - DNA, 23 bp, Homo sapiens
actctcaggttctttccagcagg

SEQ ID NO: 9388911 - DNA, 21 bp, Homo sapiens
actctatttcagtttcaacaa

SEQ ID NO: 9388912 - DNA, 22 bp, Homo sapiens
actctcccacgttcgactctaa

SEQ ID NO: 9388913 - DNA, 22 bp, Homo sapiens
actctcccagctatatgtggtg

SEQ ID NO: 9388914 - DNA, 22 bp, Homo sapiens
actctcccacgttcgactctaa

SEQ ID NO: 9388915 - DNA, 22 bp, Homo sapiens
actctcccagctatatgtggtg

SEQ ID NO: 9388916 - DNA, 22 bp, Homo sapiens
actctccctgctatccacttcc

SEQ ID NO: 9388917 - DNA, 22 bp, Homo sapiens
actctccctgctatccacttcc

SEQ ID NO: 9388918 - DNA, 23 bp, Homo sapiens
actcagagaccccgggaagtgac

SEQ ID NO: 9388919 - DNA, 22 bp, Homo sapiens
actcagagaatatctagaagga

SEQ ID NO: 9388920 - DNA, 22 bp, Homo sapiens
actcagagaactggattagagg

SEQ ID NO: 9388921 - DNA, 22 bp, Homo sapiens
actcagacatgccttttacttc

SEQ ID NO: 9388922 - DNA, 22 bp, Homo sapiens
actcagacagaccaaagttctg

SEQ ID NO: 9388923 - DNA, 22 bp, Homo sapiens
actcagacgaaaacatgaacat

SEQ ID NO: 9388924 - DNA, 22 bp, Homo sapiens
actcagactataagcttatttt

SEQ ID NO: 9388925 - DNA, 22 bp, Homo sapiens
actcagagaaacagcagggtgt

SEQ ID NO: 9388926 - DNA, 22 bp, Homo sapiens
actcagagaacattcccagtct

SEQ ID NO: 9388927 - DNA, 22 bp, Homo sapiens
actcagacttgcttcctggtgc

SEQ ID NO: 9388928 - DNA, 22 bp, Homo sapiens
actcagagaaacagcagggtgt

SEQ ID NO: 9388929 - DNA, 22 bp, Homo sapiens
actcagagaaacagcagggtgt

SEQ ID NO: 9388930 - DNA, 22 bp, Homo sapiens
actccctccaaatctgcacagt

SEQ ID NO: 9388931 - DNA, 22 bp, Homo sapiens
actctaaatagcctcttaaaca

SEQ ID NO: 9388932 - DNA, 22 bp, Homo sapiens
actctaccatgccactccatag

SEQ ID NO: 9388933 - DNA, 19 bp, Homo sapiens
actctacagtgtgtacaac

SEQ ID NO: 9388934 - DNA, 22 bp, Homo sapiens
actatacattgaatgttaaggt

SEQ ID NO: 9388935 - DNA, 22 bp, Homo sapiens
actatacagtatgtacgtgcac

SEQ ID NO: 9388936 - DNA, 22 bp, Homo sapiens
actatacagtatgtacgtgcac

SEQ ID NO: 9388937 - DNA, 22 bp, Homo sapiens
actatacagtatgtacgtgcac

SEQ ID NO: 9388938 - DNA, 22 bp, Homo sapiens
actcactgcactttgaaatgtg

SEQ ID NO: 9388939 - DNA, 22 bp, Homo sapiens
actatacattgaatgttaaggt

SEQ ID NO: 9388940 - DNA, 22 bp, Homo sapiens
actcaccacagagcagggaacc

SEQ ID NO: 9388941 - DNA, 22 bp, Homo sapiens
actcagaagatataatgactca

SEQ ID NO: 9388942 - DNA, 22 bp, Homo sapiens
actcagaaccatttactctgag

SEQ ID NO: 9388943 - DNA, 22 bp, Homo sapiens
actcagaaccatttactctgag

SEQ ID NO: 9388944 - DNA, 22 bp, Homo sapiens
actcactgggtcccggaagccc

SEQ ID NO: 9388945 - DNA, 22 bp, Homo sapiens
actcactgggtcccggaagccc

SEQ ID NO: 9388946 - DNA, 22 bp, Homo sapiens
actcagaatgactgatgctgtg

SEQ ID NO: 9388947 - DNA, 22 bp, Homo sapiens
actcagacagaccaaagttctg

SEQ ID NO: 9388948 - DNA, 22 bp, Homo sapiens
actcagaagatataatgactca

SEQ ID NO: 9388949 - DNA, 22 bp, Homo sapiens
actatacaccaaaatattaagg

SEQ ID NO: 9388950 - DNA, 22 bp, Homo sapiens
actatacaccaaaatattaagg

SEQ ID NO: 9388951 - DNA, 22 bp, Homo sapiens
actatacaccaaaatattaagg

SEQ ID NO: 9388952 - DNA, 22 bp, Homo sapiens
actataacccatggaatataag

SEQ ID NO: 9388953 - DNA, 23 bp, Homo sapiens
actataaagttgttctgatttac

SEQ ID NO: 9388954 - DNA, 23 bp, Homo sapiens
actataaagttgttctgatttac

SEQ ID NO: 9388955 - DNA, 22 bp, Homo sapiens
actataaaaggataaaccagaa

SEQ ID NO: 9388956 - DNA, 22 bp, Homo sapiens
actagtttttcctctgtcctgt

SEQ ID NO: 9388957 - DNA, 22 bp, Homo sapiens
actataaaaggataaaccagaa

SEQ ID NO: 9388958 - DNA, 22 bp, Homo sapiens
actagttttcaggcatgtctgg

SEQ ID NO: 9388959 - DNA, 22 bp, Homo sapiens
actagttttccataatatagga

SEQ ID NO: 9388960 - DNA, 22 bp, Homo sapiens
actagtttgagtaattgtaatg

SEQ ID NO: 9388961 - DNA, 22 bp, Homo sapiens
actagtttgagtaattgtaatg

SEQ ID NO: 9388962 - DNA, 22 bp, Homo sapiens
actagtttgaaaatatctgatt

SEQ ID NO: 9388963 - DNA, 22 bp, Homo sapiens
aaggctcagagcctggagctgc

SEQ ID NO: 9388964 - DNA, 22 bp, Homo sapiens
aaggctccctcttctcgagtgt

SEQ ID NO: 9388965 - DNA, 22 bp, Homo sapiens
aaggctccagtgaatgctggca

SEQ ID NO: 9388966 - DNA, 22 bp, Homo sapiens
aaggctccaccctcatggatgc

SEQ ID NO: 9388967 - DNA, 22 bp, Homo sapiens
aaggctcctttgtagttctttt

SEQ ID NO: 9388968 - DNA, 22 bp, Homo sapiens
aaggctccgtgactggggctga

SEQ ID NO: 9388969 - DNA, 21 bp, Homo sapiens
aaggctcctcctctaggcctc

SEQ ID NO: 9388970 - DNA, 22 bp, Homo sapiens
aaggctctctgatggcagcagt

SEQ ID NO: 9388971 - DNA, 22 bp, Homo sapiens
aaggctctctgatggcagcagt

SEQ ID NO: 9388972 - DNA, 22 bp, Homo sapiens
aaggctctgcaaaacctccaag

SEQ ID NO: 9388973 - DNA, 22 bp, Homo sapiens
acattgttagtagaccagtggc

SEQ ID NO: 9388974 - DNA, 22 bp, Homo sapiens
acattcttgaagtgaagtttat

SEQ ID NO: 9388975 - DNA, 22 bp, Homo sapiens
acattgttccagcgatagagaa

SEQ ID NO: 9388976 - DNA, 22 bp, Homo sapiens
acattgttcctgagaacttggg

SEQ ID NO: 9388977 - DNA, 22 bp, Homo sapiens
acattgttcacaggggcttctc

SEQ ID NO: 9388978 - DNA, 23 bp, Homo sapiens
acattgttcaatgaaagttagga

SEQ ID NO: 9388979 - DNA, 22 bp, Homo sapiens
aaggctctgggtttcataggtg

SEQ ID NO: 9388980 - DNA, 22 bp, Homo sapiens
aaggctctgggtttcataggtg

SEQ ID NO: 9388981 - DNA, 22 bp, Homo sapiens
aaggccttctaccaaggctggg

SEQ ID NO: 9388982 - DNA, 22 bp, Homo sapiens
aaggcctgggaggcctctcttc

SEQ ID NO: 9388983 - DNA, 21 bp, Homo sapiens
aaggcctgcttactgctagtt

SEQ ID NO: 9388984 - DNA, 22 bp, Homo sapiens
aaggcctgaacatgaggagatg

SEQ ID NO: 9388985 - DNA, 20 bp, Homo sapiens
aaggcagagtgggttggagc

SEQ ID NO: 9388986 - DNA, 20 bp, Homo sapiens
aaggcagagtgggttggagc

SEQ ID NO: 9388987 - DNA, 20 bp, Homo sapiens
aaggcagagtgggttggagc

SEQ ID NO: 9388988 - DNA, 22 bp, Homo sapiens
aaggcagataagaattcagcaa

SEQ ID NO: 9388989 - DNA, 22 bp, Homo sapiens
aaggccagggatgccagctcgg

SEQ ID NO: 9388990 - DNA, 22 bp, Homo sapiens
aaggccagggatgccagctcgg

SEQ ID NO: 9388991 - DNA, 22 bp, Homo sapiens
aaggccaggggctggcgcctcc

SEQ ID NO: 9388992 - DNA, 22 bp, Homo sapiens
aaggccaggggctggcgcctcc

SEQ ID NO: 9388993 - DNA, 22 bp, Homo sapiens
aaggcctcttctctctggagat

SEQ ID NO: 9388994 - DNA, 22 bp, Homo sapiens
aaggcctccctctttcatggga

SEQ ID NO: 9388995 - DNA, 22 bp, Homo sapiens
acatttctcttgatgtctctat

SEQ ID NO: 9388996 - DNA, 22 bp, Homo sapiens
acatttctcttgatgtctctat

SEQ ID NO: 9388997 - DNA, 22 bp, Homo sapiens
acatttctgcatctcagagcta

SEQ ID NO: 9388998 - DNA, 22 bp, Homo sapiens
aaggctgggaaacatgcaggcc

SEQ ID NO: 9388999 - DNA, 22 bp, Homo sapiens
acatttcatgttttccagagca

SEQ ID NO: 9389000 - DNA, 22 bp, Homo sapiens
acatttcatgttttccagagca

SEQ ID NO: 9389001 - DNA, 22 bp, Homo sapiens
aaggctggcaatatatttgtta

SEQ ID NO: 9389002 - DNA, 22 bp, Homo sapiens
aaggctggcaatatatttgtta

SEQ ID NO: 9389003 - DNA, 22 bp, Homo sapiens
aaggctgggaaacatgcaggcc

SEQ ID NO: 9389004 - DNA, 22 bp, Homo sapiens
aaggctgggaaacatgcaggcc

SEQ ID NO: 9389005 - DNA, 22 bp, Homo sapiens
acatttctggagtttctcaaca

SEQ ID NO: 9389006 - DNA, 22 bp, Homo sapiens
acatttctgctagaataggtga

SEQ ID NO: 9389007 - DNA, 22 bp, Homo sapiens
acatttctggagtttctcaaca

SEQ ID NO: 9389008 - DNA, 22 bp, Homo sapiens
acatttctggagtttctcaaca

SEQ ID NO: 9389009 - DNA, 22 bp, Homo sapiens
acatttctggagtttctcaaca

SEQ ID NO: 9389010 - DNA, 22 bp, Homo sapiens
acatttcttccctttagcagaa

SEQ ID NO: 9389011 - DNA, 22 bp, Homo sapiens
acatttcttccacatgctgctg

SEQ ID NO: 9389012 - DNA, 21 bp, Homo sapiens
aaggctggagatgcaggtctg

SEQ ID NO: 9389013 - DNA, 22 bp, Homo sapiens
aaggctggagatggttggaatg

SEQ ID NO: 9389014 - DNA, 22 bp, Homo sapiens
aaggctggagatggttggaatg

SEQ ID NO: 9389015 - DNA, 22 bp, Homo sapiens
aaggctggagatggttggaatg

SEQ ID NO: 9389016 - DNA, 21 bp, Homo sapiens
aaggctggagatgcaggtctg

SEQ ID NO: 9389017 - DNA, 21 bp, Homo sapiens
aaggctggagatgcaggtctg

SEQ ID NO: 9389018 - DNA, 22 bp, Homo sapiens
aaggctggacctggatgaatct

SEQ ID NO: 9389019 - DNA, 22 bp, Homo sapiens
aaggctgcttttaacatgcata

SEQ ID NO: 9389020 - DNA, 19 bp, Homo sapiens
aaggctggagaaggcctct

SEQ ID NO: 9389021 - DNA, 22 bp, Homo sapiens
acatttaaatacctatgtttct

SEQ ID NO: 9389022 - DNA, 22 bp, Homo sapiens
acatttaaatatgccttatatt

SEQ ID NO: 9389023 - DNA, 22 bp, Homo sapiens
acatttaaatacctatgtttct

SEQ ID NO: 9389024 - DNA, 22 bp, Homo sapiens
acattgtttggaggagtgagag

SEQ ID NO: 9389025 - DNA, 22 bp, Homo sapiens
acattgtttgagaatacagatg

SEQ ID NO: 9389026 - DNA, 22 bp, Homo sapiens
acattgttgtgcaattatagtt

SEQ ID NO: 9389027 - DNA, 22 bp, Homo sapiens
acattgtttctgaccatgatga

SEQ ID NO: 9389028 - DNA, 22 bp, Homo sapiens
acattgttgtttgcagcacagg

SEQ ID NO: 9389029 - DNA, 22 bp, Homo sapiens
acattgttctacttctagttag

SEQ ID NO: 9389030 - DNA, 22 bp, Homo sapiens
acattgttgagcctcttgttca

SEQ ID NO: 9389031 - DNA, 22 bp, Homo sapiens
acattgttgcctagccatgagt

SEQ ID NO: 9389032 - DNA, 22 bp, Homo sapiens
accgggaagtcctgcactgggc

SEQ ID NO: 9389033 - DNA, 22 bp, Homo sapiens
accgggaagtcctgcactgggc

SEQ ID NO: 9389034 - DNA, 22 bp, Homo sapiens
accctgagatgccacagcatga

SEQ ID NO: 9389035 - DNA, 22 bp, Homo sapiens
accctgagaaagtcacatgcat

SEQ ID NO: 9389036 - DNA, 22 bp, Homo sapiens
accccttctcctggctgttcca

SEQ ID NO: 9389037 - DNA, 22 bp, Homo sapiens
accccttgaaggcagagaagct

SEQ ID NO: 9389038 - DNA, 22 bp, Homo sapiens
acccctcagctcttcgtgcccc

SEQ ID NO: 9389039 - DNA, 22 bp, Homo sapiens
acccctcagctcttcgtgcccc

SEQ ID NO: 9389040 - DNA, 22 bp, Homo sapiens
acccaggatagagtgctgcagt

SEQ ID NO: 9389041 - DNA, 22 bp, Homo sapiens
acccaggaggcaaggttgcagt

SEQ ID NO: 9389042 - DNA, 22 bp, Homo sapiens
acccagagtcatggcacttagc

SEQ ID NO: 9389043 - DNA, 22 bp, Homo sapiens
acccagagtgtctgtctcagtc

SEQ ID NO: 9389044 - DNA, 22 bp, Homo sapiens
acccagagtcagacagccatgg

SEQ ID NO: 9389045 - DNA, 22 bp, Homo sapiens
acccagaggcggaggttgcagt

SEQ ID NO: 9389046 - DNA, 22 bp, Homo sapiens
acccagagctgggcttggcaaa

SEQ ID NO: 9389047 - DNA, 22 bp, Homo sapiens
acccagaggtgtctagcaagct

SEQ ID NO: 9389048 - DNA, 22 bp, Homo sapiens
acattttacaccaagacttctt

SEQ ID NO: 9389049 - DNA, 22 bp, Homo sapiens
acattttacaccaagacttctt

SEQ ID NO: 9389050 - DNA, 22 bp, Homo sapiens
acattttacagttgtctggcta

SEQ ID NO: 9389051 - DNA, 21 bp, Homo sapiens
acattttctgttttaggaagt

SEQ ID NO: 9389052 - DNA, 22 bp, Homo sapiens
acatttgtttctctagagtagg

SEQ ID NO: 9389053 - DNA, 22 bp, Homo sapiens
acatttgtttctctagagtagg

SEQ ID NO: 9389054 - DNA, 21 bp, Homo sapiens
accaggccaggaggctggcac

SEQ ID NO: 9389055 - DNA, 21 bp, Homo sapiens
accaggccaggaggctggcac

SEQ ID NO: 9389056 - DNA, 22 bp, Homo sapiens
acattttgagaaatgacaagct

SEQ ID NO: 9389057 - DNA, 22 bp, Homo sapiens
accaggcccaccgcatgctcct

SEQ ID NO: 9389058 - DNA, 22 bp, Homo sapiens
acattttgaaagggaaattgtt

SEQ ID NO: 9389059 - DNA, 22 bp, Homo sapiens
acattttgagaaatgacaagct

SEQ ID NO: 9389060 - DNA, 19 bp, Homo sapiens
accaggcttatggtcagtg

SEQ ID NO: 9389061 - DNA, 22 bp, Homo sapiens
accaggcttaatcctttgctat

SEQ ID NO: 9389062 - DNA, 22 bp, Homo sapiens
accaggcttgataccaagaaat

SEQ ID NO: 9389063 - DNA, 22 bp, Homo sapiens
accatgttggccaagctggtct

SEQ ID NO: 9389064 - DNA, 22 bp, Homo sapiens
acccagagcccttagcacagac

SEQ ID NO: 9389065 - DNA, 22 bp, Homo sapiens
aagggctgtagacaagattgct

SEQ ID NO: 9389066 - DNA, 22 bp, Homo sapiens
aagggctgtagacaagattgct

SEQ ID NO: 9389067 - DNA, 22 bp, Homo sapiens
aagggctgtagtttgttgatca

SEQ ID NO: 9389068 - DNA, 22 bp, Homo sapiens
aagggctgtagtttgttgatca

SEQ ID NO: 9389069 - DNA, 22 bp, Homo sapiens
aagggctgttatgtttttatac

SEQ ID NO: 9389070 - DNA, 22 bp, Homo sapiens
aagggctgttatgtttttatac

SEQ ID NO: 9389071 - DNA, 22 bp, Homo sapiens
aaggggaaaaagtgttaggagt

SEQ ID NO: 9389072 - DNA, 22 bp, Homo sapiens
aagggctgtaagccaagtaaag

SEQ ID NO: 9389073 - DNA, 22 bp, Homo sapiens
aagggctgtaagccaagtaaag

SEQ ID NO: 9389074 - DNA, 22 bp, Homo sapiens
aagggctgtaagccaagtaaag

SEQ ID NO: 9389075 - DNA, 22 bp, Homo sapiens
aagggctggtctagaaagggag

SEQ ID NO: 9389076 - DNA, 22 bp, Homo sapiens
aagggctggtctagaaagggag

SEQ ID NO: 9389077 - DNA, 22 bp, Homo sapiens
aagggctggtctagaaagggag

SEQ ID NO: 9389078 - DNA, 22 bp, Homo sapiens
aagggctgggtctggttaaccc

SEQ ID NO: 9389079 - DNA, 22 bp, Homo sapiens
aagggctgggtctggttaaccc

SEQ ID NO: 9389080 - DNA, 22 bp, Homo sapiens
accagggcaaatgtttgtactc

SEQ ID NO: 9389081 - DNA, 22 bp, Homo sapiens
accagggcacaggagtctgaag

SEQ ID NO: 9389082 - DNA, 22 bp, Homo sapiens
accaggcttgatgatttgctta

SEQ ID NO: 9389083 - DNA, 22 bp, Homo sapiens
accaggcttgatgatttgctta

SEQ ID NO: 9389084 - DNA, 21 bp, Homo sapiens
accaggcttgtgggagggagc

SEQ ID NO: 9389085 - DNA, 21 bp, Homo sapiens
accaggcttgtgggagggagc

SEQ ID NO: 9389086 - DNA, 21 bp, Homo sapiens
acagcctgtcatctcatggtc

SEQ ID NO: 9389087 - DNA, 22 bp, Homo sapiens
acagcctggcctgagttaaggc

SEQ ID NO: 9389088 - DNA, 21 bp, Homo sapiens
acagcctgtcatctcatggtc

SEQ ID NO: 9389089 - DNA, 22 bp, Homo sapiens
acagcctgtgtaccagctggga

SEQ ID NO: 9389090 - DNA, 22 bp, Homo sapiens
acagcctgtttgatctggtgct

SEQ ID NO: 9389091 - DNA, 22 bp, Homo sapiens
aagcatttgtgaaattcagatg

SEQ ID NO: 9389092 - DNA, 22 bp, Homo sapiens
aagcattttgccacttgaagtt

SEQ ID NO: 9389093 - DNA, 22 bp, Homo sapiens
aagcattttgttttaagaatga

SEQ ID NO: 9389094 - DNA, 22 bp, Homo sapiens
aagccaagtgctggccatgggc

SEQ ID NO: 9389095 - DNA, 22 bp, Homo sapiens
aagccaaggttttggtcacagc

SEQ ID NO: 9389096 - DNA, 22 bp, Homo sapiens
aagctatacaatgcacaaatga

SEQ ID NO: 9389097 - DNA, 22 bp, Homo sapiens
aagctagattggcattcatttc

SEQ ID NO: 9389098 - DNA, 22 bp, Homo sapiens
aagctatacaatgcacaaatga

SEQ ID NO: 9389099 - DNA, 22 bp, Homo sapiens
aagctacattaagcagatttac

SEQ ID NO: 9389100 - DNA, 22 bp, Homo sapiens
aagctagataacttttatattt

SEQ ID NO: 9389101 - DNA, 23 bp, Homo sapiens
aagcgtcttttcaatgtggctgg

SEQ ID NO: 9389102 - DNA, 21 bp, Homo sapiens
aagctacagaaaataatttga

SEQ ID NO: 9389103 - DNA, 22 bp, Homo sapiens
aagctcagcagccaggccctgt

SEQ ID NO: 9389104 - DNA, 22 bp, Homo sapiens
aagctcagagtctcggagggaa

SEQ ID NO: 9389105 - DNA, 22 bp, Homo sapiens
aagctcaggaaagagtctggtt

SEQ ID NO: 9389106 - DNA, 22 bp, Homo sapiens
aagctcagcatgtctcctagaa

SEQ ID NO: 9389107 - DNA, 22 bp, Homo sapiens
aagctcagagtagctcagcgtc

SEQ ID NO: 9389108 - DNA, 22 bp, Homo sapiens
aagctcagaggtagataatgtt

SEQ ID NO: 9389109 - DNA, 22 bp, Homo sapiens
aagctattgaatttatagcata

SEQ ID NO: 9389110 - DNA, 22 bp, Homo sapiens
aagctctctgtcccctggactg

SEQ ID NO: 9389111 - DNA, 22 bp, Homo sapiens
aagctcaggctggacctggctt

SEQ ID NO: 9389112 - DNA, 22 bp, Homo sapiens
aagctcagtgatgcctccaggg

SEQ ID NO: 9389113 - DNA, 22 bp, Homo sapiens
aagctcagtgatgcctccaggg

SEQ ID NO: 9389114 - DNA, 22 bp, Homo sapiens
aagctctgtctcttgggagtta

SEQ ID NO: 9389115 - DNA, 17 bp, Homo sapiens
acagggcagaaacagct

SEQ ID NO: 9389116 - DNA, 22 bp, Homo sapiens
acagggcagaaatgttgcatct

SEQ ID NO: 9389117 - DNA, 17 bp, Homo sapiens
acagggcagaaacagct

SEQ ID NO: 9389118 - DNA, 17 bp, Homo sapiens
acagggcagaaacagct

SEQ ID NO: 9389119 - DNA, 22 bp, Homo sapiens
acagggcagagaggcaggcttg

SEQ ID NO: 9389120 - DNA, 22 bp, Homo sapiens
acagggcagaaatgttgcatct

SEQ ID NO: 9389121 - DNA, 22 bp, Homo sapiens
acagggcagagggcagttggta

SEQ ID NO: 9389122 - DNA, 22 bp, Homo sapiens
acagggcagagaggcaggcttg

SEQ ID NO: 9389123 - DNA, 22 bp, Homo sapiens
acagggcagagaggcaggcttg

SEQ ID NO: 9389124 - DNA, 19 bp, Homo sapiens
acagggcagcaataggata

SEQ ID NO: 9389125 - DNA, 22 bp, Homo sapiens
acagggcagcaactttgtgcct

SEQ ID NO: 9389126 - DNA, 22 bp, Homo sapiens
acagggcagcaactttgtgcct

SEQ ID NO: 9389127 - DNA, 22 bp, Homo sapiens
acagggcagcaactttgtgcct

SEQ ID NO: 9389128 - DNA, 22 bp, Homo sapiens
acagggcagagtgaaatgctat

SEQ ID NO: 9389129 - DNA, 22 bp, Homo sapiens
acagggcagcaactttgtgcct

SEQ ID NO: 9389130 - DNA, 22 bp, Homo sapiens
acagggcagagtgaaatgctat

SEQ ID NO: 9389131 - DNA, 22 bp, Homo sapiens
acagggcagagggcagttggta

SEQ ID NO: 9389132 - DNA, 22 bp, Homo sapiens
aagctgctggtgactgggctga

SEQ ID NO: 9389133 - DNA, 22 bp, Homo sapiens
aagctgcttggggctcctgcag

SEQ ID NO: 9389134 - DNA, 18 bp, Homo sapiens
aagctgccctcaggcagg

SEQ ID NO: 9389135 - DNA, 22 bp, Homo sapiens
aaggcagagggctggatcagag

SEQ ID NO: 9389136 - DNA, 22 bp, Homo sapiens
aaggcagagggctggatcagag

SEQ ID NO: 9389137 - DNA, 22 bp, Homo sapiens
aaggcagagggctggatcagag

SEQ ID NO: 9389138 - DNA, 22 bp, Homo sapiens
aaggcagagattagcagaatga

SEQ ID NO: 9389139 - DNA, 22 bp, Homo sapiens
aaggcagagattagcagaatga

SEQ ID NO: 9389140 - DNA, 22 bp, Homo sapiens
acatatgtgttgtacatgcatg

SEQ ID NO: 9389141 - DNA, 22 bp, Homo sapiens
acatatgtgttgtacatgcatg

SEQ ID NO: 9389142 - DNA, 22 bp, Homo sapiens
acatatgtgttgtacatgcatg

SEQ ID NO: 9389143 - DNA, 22 bp, Homo sapiens
acatatgtgttgtacatgcatg

SEQ ID NO: 9389144 - DNA, 22 bp, Homo sapiens
acatatgcgatcataggatgca

SEQ ID NO: 9389145 - DNA, 22 bp, Homo sapiens
acatatgtatatgtacacagtc

SEQ ID NO: 9389146 - DNA, 22 bp, Homo sapiens
acatatgctcatctgcattccc

SEQ ID NO: 9389147 - DNA, 22 bp, Homo sapiens
acatatgtatatgtacacagtc

SEQ ID NO: 9389148 - DNA, 19 bp, Homo sapiens
acatatgtggatatacatg

SEQ ID NO: 9389149 - DNA, 22 bp, Homo sapiens
acatatgtctatttcatgtaaa

SEQ ID NO: 9389150 - DNA, 22 bp, Homo sapiens
acatatgtgtctgcacatgccc

SEQ ID NO: 9389151 - DNA, 22 bp, Homo sapiens
acatatgtgtctgcacatgccc

SEQ ID NO: 9389152 - DNA, 19 bp, Homo sapiens
acatatgtggatatacatg

SEQ ID NO: 9389153 - DNA, 22 bp, Homo sapiens
acatatgtgttgtacatgcatg

SEQ ID NO: 9389154 - DNA, 22 bp, Homo sapiens
acatatgtgtctgcacatgccc

SEQ ID NO: 9389155 - DNA, 22 bp, Homo sapiens
acagtgtttggcaatgcatgca

SEQ ID NO: 9389156 - DNA, 22 bp, Homo sapiens
aaggaggaatgtagccagctcc

SEQ ID NO: 9389157 - DNA, 22 bp, Homo sapiens
acagtgtttatgtacagattgt

SEQ ID NO: 9389158 - DNA, 22 bp, Homo sapiens
acagtgtttatgtacagattgt

SEQ ID NO: 9389159 - DNA, 22 bp, Homo sapiens
aaggaggaattctgagttcatg

SEQ ID NO: 9389160 - DNA, 22 bp, Homo sapiens
aaggaggaattctgagttcatg

SEQ ID NO: 9389161 - DNA, 22 bp, Homo sapiens
aaggaggacacccaggactggg

SEQ ID NO: 9389162 - DNA, 22 bp, Homo sapiens
aaggaggaatttcagggtgaat

SEQ ID NO: 9389163 - DNA, 22 bp, Homo sapiens
aaggaggaatttcagggtgaat

SEQ ID NO: 9389164 - DNA, 22 bp, Homo sapiens
aaggaggaatttcagggtgaat

SEQ ID NO: 9389165 - DNA, 22 bp, Homo sapiens
aaggaggcactcgctctcaggg

SEQ ID NO: 9389166 - DNA, 22 bp, Homo sapiens
aaggaggagtggggtcctggaa

SEQ ID NO: 9389167 - DNA, 22 bp, Homo sapiens
aaggaggagtggggtcctggaa

SEQ ID NO: 9389168 - DNA, 22 bp, Homo sapiens
aaggaggagcggaggcttgttg

SEQ ID NO: 9389169 - DNA, 22 bp, Homo sapiens
aaggaggagtggggtcctggaa

SEQ ID NO: 9389170 - DNA, 22 bp, Homo sapiens
aaggaggacacccaggactggg

SEQ ID NO: 9389171 - DNA, 22 bp, Homo sapiens
aaggaggacacccaggactggg

SEQ ID NO: 9389172 - DNA, 22 bp, Homo sapiens
aaggaggacacccaggactggg

SEQ ID NO: 9389173 - DNA, 22 bp, Homo sapiens
aaggaggacacccaggactggg

SEQ ID NO: 9389174 - DNA, 22 bp, Homo sapiens
aaggaggagcggaggcttgttg

SEQ ID NO: 9389175 - DNA, 22 bp, Homo sapiens
aaggaggagattagtgtttagg

SEQ ID NO: 9389176 - DNA, 22 bp, Homo sapiens
aaggaggagattagtgtttagg

SEQ ID NO: 9389177 - DNA, 22 bp, Homo sapiens
acatatctgttagacacagcag

SEQ ID NO: 9389178 - DNA, 22 bp, Homo sapiens
acatagaacctggcacatagta

SEQ ID NO: 9389179 - DNA, 22 bp, Homo sapiens
acagtgtttaaaaatcagatct

SEQ ID NO: 9389180 - DNA, 22 bp, Homo sapiens
acagtctttaatttctttgtgg

SEQ ID NO: 9389181 - DNA, 22 bp, Homo sapiens
acagtctttagagtattgtcct

SEQ ID NO: 9389182 - DNA, 22 bp, Homo sapiens
acagtcttgcacttctatcagc

SEQ ID NO: 9389183 - DNA, 22 bp, Homo sapiens
acagtcttgctgtatggtcagg

SEQ ID NO: 9389184 - DNA, 22 bp, Homo sapiens
acagtcttgctgtatggtcagg

SEQ ID NO: 9389185 - DNA, 22 bp, Homo sapiens
acagtcttcagaagggattggg

SEQ ID NO: 9389186 - DNA, 22 bp, Homo sapiens
aaggaggaataaagaggtggtg

SEQ ID NO: 9389187 - DNA, 22 bp, Homo sapiens
aaggaggaataaagaggtggtg

SEQ ID NO: 9389188 - DNA, 22 bp, Homo sapiens
acagtctgtcccccaggtgcta

SEQ ID NO: 9389189 - DNA, 22 bp, Homo sapiens
aaggaggaataaagaggtggtg

SEQ ID NO: 9389190 - DNA, 22 bp, Homo sapiens
aaggaggaaaatattgttgctg

SEQ ID NO: 9389191 - DNA, 22 bp, Homo sapiens
aaggagacatttgcagagcacc

SEQ ID NO: 9389192 - DNA, 22 bp, Homo sapiens
aaggagacatttgcagagcacc

SEQ ID NO: 9389193 - DNA, 22 bp, Homo sapiens
aaggagacttggcatcacttaa

SEQ ID NO: 9389194 - DNA, 22 bp, Homo sapiens
aaggagctcttaaaatcagaga

SEQ ID NO: 9389195 - DNA, 22 bp, Homo sapiens
aaggagctatgcataactgatc

SEQ ID NO: 9389196 - DNA, 17 bp, Homo sapiens
aaggagctgagagatgg

SEQ ID NO: 9389197 - DNA, 22 bp, Homo sapiens
aaggagagtacaggagttggta

SEQ ID NO: 9389198 - DNA, 22 bp, Homo sapiens
aaggagagtacaggagttggta

SEQ ID NO: 9389199 - DNA, 22 bp, Homo sapiens
aaggagagagctttgctggaac

SEQ ID NO: 9389200 - DNA, 22 bp, Homo sapiens
aaggagagagctttgctggaac

SEQ ID NO: 9389201 - DNA, 22 bp, Homo sapiens
acaacacatgtgtatatgtgtg

SEQ ID NO: 9389202 - DNA, 22 bp, Homo sapiens
acaacagagctggactgagagg

SEQ ID NO: 9389203 - DNA, 22 bp, Homo sapiens
agataacatttattgaatgtaa

SEQ ID NO: 9389204 - DNA, 22 bp, Homo sapiens
acaacagagctggactgagagg

SEQ ID NO: 9389205 - DNA, 22 bp, Homo sapiens
acaacagagctggactgagagg

SEQ ID NO: 9389206 - DNA, 22 bp, Homo sapiens
acaaattgcctagtctagcatc

SEQ ID NO: 9389207 - DNA, 22 bp, Homo sapiens
agaggggtggtgctctcctgga

SEQ ID NO: 9389208 - DNA, 22 bp, Homo sapiens
agaggggtgggcacagcgccca

SEQ ID NO: 9389209 - DNA, 22 bp, Homo sapiens
agaggggttaagtgctagtccg

SEQ ID NO: 9389210 - DNA, 19 bp, Homo sapiens
acaaattggcaaaatgcaa

SEQ ID NO: 9389211 - DNA, 22 bp, Homo sapiens
acaacaatctaccctagcttct

SEQ ID NO: 9389212 - DNA, 22 bp, Homo sapiens
acaacaaagacacttgaaatga

SEQ ID NO: 9389213 - DNA, 22 bp, Homo sapiens
acaacaatctaccctagcttct

SEQ ID NO: 9389214 - DNA, 22 bp, Homo sapiens
agataatgaatttattgaatgt

SEQ ID NO: 9389215 - DNA, 22 bp, Homo sapiens
acaagagagacactaggaatgt

SEQ ID NO: 9389216 - DNA, 22 bp, Homo sapiens
acaagagattatctacagatga

SEQ ID NO: 9389217 - DNA, 22 bp, Homo sapiens
acaagatagcttagaagattca

SEQ ID NO: 9389218 - DNA, 22 bp, Homo sapiens
acaatcttattagtagtataga

SEQ ID NO: 9389219 - DNA, 22 bp, Homo sapiens
acaatcagtatttagacccagg

SEQ ID NO: 9389220 - DNA, 22 bp, Homo sapiens
acaatcattggcttcattacaa

SEQ ID NO: 9389221 - DNA, 22 bp, Homo sapiens
acaatgatgcagatgagtaaga

SEQ ID NO: 9389222 - DNA, 22 bp, Homo sapiens
acaatgattttttagagtagtt

SEQ ID NO: 9389223 - DNA, 22 bp, Homo sapiens
acaagcatcaggttcagcaata

SEQ ID NO: 9389224 - DNA, 22 bp, Homo sapiens
acaagcagtaaaggccacagtc

SEQ ID NO: 9389225 - DNA, 17 bp, Homo sapiens
acaagcagtggccatgg

SEQ ID NO: 9389226 - DNA, 22 bp, Homo sapiens
acaatcacacatgcaattatac

SEQ ID NO: 9389227 - DNA, 22 bp, Homo sapiens
acaagcgggccacagtgctggt

SEQ ID NO: 9389228 - DNA, 22 bp, Homo sapiens
acaagctcacatcagccaatga

SEQ ID NO: 9389229 - DNA, 23 bp, Homo sapiens
acaagatagggataaaaagataa

SEQ ID NO: 9389230 - DNA, 23 bp, Homo sapiens
acaagatagggataaaaagataa

SEQ ID NO: 9389231 - DNA, 23 bp, Homo sapiens
acaagatagggataaaaagataa

SEQ ID NO: 9389232 - DNA, 22 bp, Homo sapiens
acaagatggaatattgagaaaa

SEQ ID NO: 9389233 - DNA, 22 bp, Homo sapiens
acaagatgtgtttatacaagct

SEQ ID NO: 9389234 - DNA, 23 bp, Homo sapiens
acaagcagcccagtgctctgcct

SEQ ID NO: 9389235 - DNA, 22 bp, Homo sapiens
acaagcagaaggtggggtctta

SEQ ID NO: 9389236 - DNA, 22 bp, Homo sapiens
acaagattttatgactcttttt

SEQ ID NO: 9389237 - DNA, 22 bp, Homo sapiens
acaagcacttcactgtcctctg

SEQ ID NO: 9389238 - DNA, 22 bp, Homo sapiens
agaggctctggtgcagcatgca

SEQ ID NO: 9389239 - DNA, 22 bp, Homo sapiens
agaggctctggtgcagcatgca

SEQ ID NO: 9389240 - DNA, 22 bp, Homo sapiens
agaggctctggtgggagttggt

SEQ ID NO: 9389241 - DNA, 22 bp, Homo sapiens
agaggctctttgagctgggaga

SEQ ID NO: 9389242 - DNA, 22 bp, Homo sapiens
agaggctgaatgatgtcatcat

SEQ ID NO: 9389243 - DNA, 22 bp, Homo sapiens
agaggctgaatgatgtcatcat

SEQ ID NO: 9389244 - DNA, 22 bp, Homo sapiens
agaggctgagaaaccctcttct

SEQ ID NO: 9389245 - DNA, 22 bp, Homo sapiens
agaggctgaatgatgtcatcat

SEQ ID NO: 9389246 - DNA, 22 bp, Homo sapiens
agaggctgaatgatgtcatcat

SEQ ID NO: 9389247 - DNA, 17 bp, Homo sapiens
aattgcttgtactccca

SEQ ID NO: 9389248 - DNA, 22 bp, Homo sapiens
agaggccctctctctcctgatg

SEQ ID NO: 9389249 - DNA, 18 bp, Homo sapiens
agaggctcgatactagaa

SEQ ID NO: 9389250 - DNA, 22 bp, Homo sapiens
aattgctagactatactgtaat

SEQ ID NO: 9389251 - DNA, 22 bp, Homo sapiens
aattgctagactatactgtaat

SEQ ID NO: 9389252 - DNA, 22 bp, Homo sapiens
aattgcatgttaatgactaagt

SEQ ID NO: 9389253 - DNA, 22 bp, Homo sapiens
aattgcataaatttcatagcat

SEQ ID NO: 9389254 - DNA, 22 bp, Homo sapiens
aattgcaaattcagacttaaga

SEQ ID NO: 9389255 - DNA, 22 bp, Homo sapiens
aattgatggacagagatgaaga

SEQ ID NO: 9389256 - DNA, 22 bp, Homo sapiens
aattgatgggcactgaaatatt

SEQ ID NO: 9389257 - DNA, 22 bp, Homo sapiens
aattgagtgactgctgcatgtc

SEQ ID NO: 9389258 - DNA, 22 bp, Homo sapiens
aattgagtcatgctgtattgaa

SEQ ID NO: 9389259 - DNA, 22 bp, Homo sapiens
aattgatgatacccacacttat

SEQ ID NO: 9389260 - DNA, 22 bp, Homo sapiens
aattgatgattcttatgtgaaa

SEQ ID NO: 9389261 - DNA, 22 bp, Homo sapiens
aattgaaattctttgtggtcca

SEQ ID NO: 9389262 - DNA, 22 bp, Homo sapiens
aattgacaaatcatacttgtat

SEQ ID NO: 9389263 - DNA, 22 bp, Homo sapiens
aattcttaatcccataaagtga

SEQ ID NO: 9389264 - DNA, 22 bp, Homo sapiens
agaggggtgggcacagcgccca

SEQ ID NO: 9389265 - DNA, 22 bp, Homo sapiens
agagggggtgttccagaagcat

SEQ ID NO: 9389266 - DNA, 22 bp, Homo sapiens
agagggggtgtcagcactgcag

SEQ ID NO: 9389267 - DNA, 22 bp, Homo sapiens
agagggggtgtcagcactgcag

SEQ ID NO: 9389268 - DNA, 22 bp, Homo sapiens
agagggggcagcggaccagtga

SEQ ID NO: 9389269 - DNA, 22 bp, Homo sapiens
agagggggcagcggaccagtga

SEQ ID NO: 9389270 - DNA, 22 bp, Homo sapiens
agagggggcagcggaccagtga

SEQ ID NO: 9389271 - DNA, 22 bp, Homo sapiens
agagggggaaaatagaggtgtt

SEQ ID NO: 9389272 - DNA, 22 bp, Homo sapiens
agagggggaaaatagaggtgtt

SEQ ID NO: 9389273 - DNA, 22 bp, Homo sapiens
agagggggaaaatagaggtgtt

SEQ ID NO: 9389274 - DNA, 22 bp, Homo sapiens
agagggggaaaatagaggtgtt

SEQ ID NO: 9389275 - DNA, 22 bp, Homo sapiens
acaaaggttgggtcaattgtcc

SEQ ID NO: 9389276 - DNA, 22 bp, Homo sapiens
acaaaggtgagcagaagacaca

SEQ ID NO: 9389277 - DNA, 22 bp, Homo sapiens
acaaaggtgagcagaagacaca

SEQ ID NO: 9389278 - DNA, 18 bp, Homo sapiens
acaaaggtctgcaagacc

SEQ ID NO: 9389279 - DNA, 22 bp, Homo sapiens
acaaagtagtcaaagtagatga

SEQ ID NO: 9389280 - DNA, 22 bp, Homo sapiens
acaaagaaggaattggtcttta

SEQ ID NO: 9389281 - DNA, 22 bp, Homo sapiens
agaggcttcctgccacctgaga

SEQ ID NO: 9389282 - DNA, 22 bp, Homo sapiens
acaaagcttagacctaagagat

SEQ ID NO: 9389283 - DNA, 22 bp, Homo sapiens
agaggctgtgcccaccaggcaa

SEQ ID NO: 9389284 - DNA, 22 bp, Homo sapiens
agaggctgtgcccaccaggcaa

SEQ ID NO: 9389285 - DNA, 22 bp, Homo sapiens
agaggctgtgcccaccaggcaa

SEQ ID NO: 9389286 - DNA, 22 bp, Homo sapiens
agaggctgtgcagagggagtgc

SEQ ID NO: 9389287 - DNA, 22 bp, Homo sapiens
agaggctgtgcagagggagtgc

SEQ ID NO: 9389288 - DNA, 22 bp, Homo sapiens
agaggctgatggagtagtgtct

SEQ ID NO: 9389289 - DNA, 22 bp, Homo sapiens
agaggctgttacactcccagat

SEQ ID NO: 9389290 - DNA, 22 bp, Homo sapiens
agaggctgttacactcccagat

SEQ ID NO: 9389291 - DNA, 22 bp, Homo sapiens
agaggctgttacactcccagat

SEQ ID NO: 9389292 - DNA, 22 bp, Homo sapiens
agaggctgttacactcccagat

SEQ ID NO: 9389293 - DNA, 22 bp, Homo sapiens
agaggctgttacactcccagat

SEQ ID NO: 9389294 - DNA, 22 bp, Homo sapiens
agaggctgtgcccaccaggcaa

SEQ ID NO: 9389295 - DNA, 22 bp, Homo sapiens
agaggctgtgcccaccaggcaa

SEQ ID NO: 9389296 - DNA, 18 bp, Homo sapiens
aatgtgaatatttacttc

SEQ ID NO: 9389297 - DNA, 22 bp, Homo sapiens
aatgtgaactttgtcatgtaac

SEQ ID NO: 9389298 - DNA, 18 bp, Homo sapiens
aatgtgaatatttacttc

SEQ ID NO: 9389299 - DNA, 22 bp, Homo sapiens
aatgtgaactttgtcatgtaac

SEQ ID NO: 9389300 - DNA, 22 bp, Homo sapiens
aatgtgaatcttcctttttgat

SEQ ID NO: 9389301 - DNA, 22 bp, Homo sapiens
aatggtttttgcatattcaggt

SEQ ID NO: 9389302 - DNA, 22 bp, Homo sapiens
aatggttttgctttagtattct

SEQ ID NO: 9389303 - DNA, 22 bp, Homo sapiens
aatggttttgtctcatcaatgt

SEQ ID NO: 9389304 - DNA, 22 bp, Homo sapiens
aatggtttttagtgagatcgat

SEQ ID NO: 9389305 - DNA, 22 bp, Homo sapiens
aatgtgcttctggctgtggtca

SEQ ID NO: 9389306 - DNA, 22 bp, Homo sapiens
aatgtggatccttacagatacc

SEQ ID NO: 9389307 - DNA, 17 bp, Homo sapiens
aatgtggaagtacatgc

SEQ ID NO: 9389308 - DNA, 22 bp, Homo sapiens
aatgtggatgatactagtactt

SEQ ID NO: 9389309 - DNA, 22 bp, Homo sapiens
aatgtggattcacaagtgctca

SEQ ID NO: 9389310 - DNA, 22 bp, Homo sapiens
aatgtgattgaaaatcaggtcc

SEQ ID NO: 9389311 - DNA, 22 bp, Homo sapiens
aatgtgattttcccagtagaat

SEQ ID NO: 9389312 - DNA, 22 bp, Homo sapiens
aatgtgattgaaaatcaggtcc

SEQ ID NO: 9389313 - DNA, 22 bp, Homo sapiens
aatgtgatctgtcatgatggca

SEQ ID NO: 9389314 - DNA, 22 bp, Homo sapiens
aatgtgattagcctctactgga

SEQ ID NO: 9389315 - DNA, 22 bp, Homo sapiens
aatgtgagccaatgcccgtggg

SEQ ID NO: 9389316 - DNA, 22 bp, Homo sapiens
aatgtgatcgctttagaagctt

SEQ ID NO: 9389317 - DNA, 22 bp, Homo sapiens
aatgtgaggccttggtagttat

SEQ ID NO: 9389318 - DNA, 19 bp, Homo sapiens
aatggtaattagagaaatg

SEQ ID NO: 9389319 - DNA, 23 bp, Homo sapiens
aatgggtgcaactatccatgaca

SEQ ID NO: 9389320 - DNA, 23 bp, Homo sapiens
aatgggtgcaactatccatgaca

SEQ ID NO: 9389321 - DNA, 22 bp, Homo sapiens
aatgggcatttggggttgagaa

SEQ ID NO: 9389322 - DNA, 22 bp, Homo sapiens
aatgggcatttgtttgtggtac

SEQ ID NO: 9389323 - DNA, 22 bp, Homo sapiens
aatggggtagtgggcagcctgg

SEQ ID NO: 9389324 - DNA, 22 bp, Homo sapiens
aatggtttggactattcaatag

SEQ ID NO: 9389325 - DNA, 22 bp, Homo sapiens
aatggtttggactattcaatag

SEQ ID NO: 9389326 - DNA, 22 bp, Homo sapiens
aatggttttctagaacatgaaa

SEQ ID NO: 9389327 - DNA, 19 bp, Homo sapiens
aatggtttgatgaagtata

SEQ ID NO: 9389328 - DNA, 23 bp, Homo sapiens
aatggtcttcctccacccctctg

SEQ ID NO: 9389329 - DNA, 22 bp, Homo sapiens
aatggtttaacatatgcttgag

SEQ ID NO: 9389330 - DNA, 22 bp, Homo sapiens
aatggtttagttaagactgagt

SEQ ID NO: 9389331 - DNA, 22 bp, Homo sapiens
agaagcagctttcaaggtgatt

SEQ ID NO: 9389332 - DNA, 23 bp, Homo sapiens
agaagcagcttctggagtatcgg

SEQ ID NO: 9389333 - DNA, 23 bp, Homo sapiens
agaagcagcttctggagtatcgg

SEQ ID NO: 9389334 - DNA, 20 bp, Homo sapiens
agacaaaatgacttcatgca

SEQ ID NO: 9389335 - DNA, 23 bp, Homo sapiens
agacaaaagcctcagtcttaggc

SEQ ID NO: 9389336 - DNA, 22 bp, Homo sapiens
agaagcagcaagcccttcaaag

SEQ ID NO: 9389337 - DNA, 22 bp, Homo sapiens
agaagcagactctgaggcaagg

SEQ ID NO: 9389338 - DNA, 22 bp, Homo sapiens
agaagcagactctgaggcaagg

SEQ ID NO: 9389339 - DNA, 22 bp, Homo sapiens
agaagcagaaggaagcagggcc

SEQ ID NO: 9389340 - DNA, 20 bp, Homo sapiens
agacaatgagtgacagagtt

SEQ ID NO: 9389341 - DNA, 22 bp, Homo sapiens
agacaatatgtatattaagaat

SEQ ID NO: 9389342 - DNA, 22 bp, Homo sapiens
agacaatggaccaagcaccttc

SEQ ID NO: 9389343 - DNA, 19 bp, Homo sapiens
agacaatggggttggcagt

SEQ ID NO: 9389344 - DNA, 22 bp, Homo sapiens
agacaatggagagcagagtact

SEQ ID NO: 9389345 - DNA, 22 bp, Homo sapiens
aatggaggtgtctggcctggta

SEQ ID NO: 9389346 - DNA, 22 bp, Homo sapiens
aatggagatgtctagagggtgc

SEQ ID NO: 9389347 - DNA, 22 bp, Homo sapiens
aatggcaattcagtgaaattat

SEQ ID NO: 9389348 - DNA, 22 bp, Homo sapiens
aatggcactttataaatgttaa

SEQ ID NO: 9389349 - DNA, 22 bp, Homo sapiens
aatggagaggctgtgagtgaga

SEQ ID NO: 9389350 - DNA, 22 bp, Homo sapiens
agacaattaaaaaattatgctt

SEQ ID NO: 9389351 - DNA, 19 bp, Homo sapiens
aatggcagatgccatatct

SEQ ID NO: 9389352 - DNA, 22 bp, Homo sapiens
aatggcagaggcaaagatggta

SEQ ID NO: 9389353 - DNA, 22 bp, Homo sapiens
aatggccagacagatggctgct

SEQ ID NO: 9389354 - DNA, 22 bp, Homo sapiens
aatggcagtagttgcatgagag

SEQ ID NO: 9389355 - DNA, 22 bp, Homo sapiens
aatggccagcaacaggagtgaa

SEQ ID NO: 9389356 - DNA, 22 bp, Homo sapiens
aatgggaagccagaagacaagg

SEQ ID NO: 9389357 - DNA, 22 bp, Homo sapiens
aatgggaagtcactactgttac

SEQ ID NO: 9389358 - DNA, 22 bp, Homo sapiens
aatgggcacacttagagagtaa

SEQ ID NO: 9389359 - DNA, 22 bp, Homo sapiens
aatgggataatagaagtagaat

SEQ ID NO: 9389360 - DNA, 23 bp, Homo sapiens
aattaaattgctagatccagggc

SEQ ID NO: 9389361 - DNA, 22 bp, Homo sapiens
aattaaatgacaggggaagatg

SEQ ID NO: 9389362 - DNA, 22 bp, Homo sapiens
aattaaattggtttagagagga

SEQ ID NO: 9389363 - DNA, 22 bp, Homo sapiens
aattaaattggtttagagagga

SEQ ID NO: 9389364 - DNA, 23 bp, Homo sapiens
aattaaattgctagatccagggc

SEQ ID NO: 9389365 - DNA, 22 bp, Homo sapiens
aattaaaagataacccatgagt

SEQ ID NO: 9389366 - DNA, 22 bp, Homo sapiens
aattaaaaaaggagagcttgct

SEQ ID NO: 9389367 - DNA, 18 bp, Homo sapiens
agagacagcagcaaaaga

SEQ ID NO: 9389368 - DNA, 22 bp, Homo sapiens
agaccctggggaaagtcacttc

SEQ ID NO: 9389369 - DNA, 22 bp, Homo sapiens
agaccctggtaaacactccagg

SEQ ID NO: 9389370 - DNA, 22 bp, Homo sapiens
aatgtgggggtgagctgtatat

SEQ ID NO: 9389371 - DNA, 22 bp, Homo sapiens
aatgtgtaaatgaggagtcttg

SEQ ID NO: 9389372 - DNA, 22 bp, Homo sapiens
aatgtgtaaatgaggagtcttg

SEQ ID NO: 9389373 - DNA, 22 bp, Homo sapiens
aatgtttggctagatagatgga

SEQ ID NO: 9389374 - DNA, 22 bp, Homo sapiens
agacccttcatgtagttcccca

SEQ ID NO: 9389375 - DNA, 22 bp, Homo sapiens
agacccttgcatgaattaattc

SEQ ID NO: 9389376 - DNA, 22 bp, Homo sapiens
agagccaggctcccatggggca

SEQ ID NO: 9389377 - DNA, 22 bp, Homo sapiens
agagccaggctcccatggggca

SEQ ID NO: 9389378 - DNA, 22 bp, Homo sapiens
agagccaggctcccatggggca

SEQ ID NO: 9389379 - DNA, 22 bp, Homo sapiens
agagccaggcggctgggcacct

SEQ ID NO: 9389380 - DNA, 22 bp, Homo sapiens
agagccaggcggctgggcacct

SEQ ID NO: 9389381 - DNA, 22 bp, Homo sapiens
agagacagggttttgccatgtt

SEQ ID NO: 9389382 - DNA, 22 bp, Homo sapiens
agagccaggctcccatggggca

SEQ ID NO: 9389383 - DNA, 22 bp, Homo sapiens
agagccagttacaactgtggag

SEQ ID NO: 9389384 - DNA, 22 bp, Homo sapiens
agagccagttacaactgtggag

SEQ ID NO: 9389385 - DNA, 22 bp, Homo sapiens
agagccagttacaactgtggag

SEQ ID NO: 9389386 - DNA, 22 bp, Homo sapiens
agagccaggtgtagtctcggag

SEQ ID NO: 9389387 - DNA, 22 bp, Homo sapiens
agagccaggtgtagtctcggag

SEQ ID NO: 9389388 - DNA, 22 bp, Homo sapiens
aattctgctcttaacataatgt

SEQ ID NO: 9389389 - DNA, 22 bp, Homo sapiens
aattctgatgagtcagagaaag

SEQ ID NO: 9389390 - DNA, 22 bp, Homo sapiens
aattccagtaggcaccactcat

SEQ ID NO: 9389391 - DNA, 22 bp, Homo sapiens
aattctgatccagaacctgtca

SEQ ID NO: 9389392 - DNA, 22 bp, Homo sapiens
aattctgaggagggaagaggaa

SEQ ID NO: 9389393 - DNA, 22 bp, Homo sapiens
agagcctggacctgggctctga

SEQ ID NO: 9389394 - DNA, 22 bp, Homo sapiens
agagcctggacttttctgagcc

SEQ ID NO: 9389395 - DNA, 22 bp, Homo sapiens
agagcctggaggttctgctgaa

SEQ ID NO: 9389396 - DNA, 22 bp, Homo sapiens
agagcctggcaaaaggtcctgc

SEQ ID NO: 9389397 - DNA, 22 bp, Homo sapiens
agagcctgctgtgtaagtcaca

SEQ ID NO: 9389398 - DNA, 22 bp, Homo sapiens
agagcctgctacctcattccag

SEQ ID NO: 9389399 - DNA, 22 bp, Homo sapiens
agagcctgctacctcattccag

SEQ ID NO: 9389400 - DNA, 20 bp, Homo sapiens
agagcctggaaaaagacatc

SEQ ID NO: 9389401 - DNA, 22 bp, Homo sapiens
agagcctggacctgagctacaa

SEQ ID NO: 9389402 - DNA, 22 bp, Homo sapiens
agagcctggacctgggctctga

SEQ ID NO: 9389403 - DNA, 22 bp, Homo sapiens
agagcctggacctgagctacaa

SEQ ID NO: 9389404 - DNA, 20 bp, Homo sapiens
agagcctggaaaaagacatc

SEQ ID NO: 9389405 - DNA, 22 bp, Homo sapiens
agagcctgcatcaggcttgggg

SEQ ID NO: 9389406 - DNA, 22 bp, Homo sapiens
agagcctgcatcaggcttgggg

SEQ ID NO: 9389407 - DNA, 22 bp, Homo sapiens
agagcctgcatctagcctcaga

SEQ ID NO: 9389408 - DNA, 22 bp, Homo sapiens
agagcctgcatctagcctcaga

SEQ ID NO: 9389409 - DNA, 22 bp, Homo sapiens
agagccagttgttaagcactta

SEQ ID NO: 9389410 - DNA, 22 bp, Homo sapiens
agagccagttgttaagcactta

SEQ ID NO: 9389411 - DNA, 18 bp, Homo sapiens
agcagagagtgaatggga

SEQ ID NO: 9389412 - DNA, 19 bp, Homo sapiens
agcagagcaaagtggctga

SEQ ID NO: 9389413 - DNA, 21 bp, Homo sapiens
agcagagccaccattacctgc

SEQ ID NO: 9389414 - DNA, 22 bp, Homo sapiens
agcagagccagaattggaccag

SEQ ID NO: 9389415 - DNA, 22 bp, Homo sapiens
agcagagcatgctaagtgactc

SEQ ID NO: 9389416 - DNA, 22 bp, Homo sapiens
acaatgcacctattttaaaact

SEQ ID NO: 9389417 - DNA, 22 bp, Homo sapiens
acaatgcaccagcatcttcacc

SEQ ID NO: 9389418 - DNA, 22 bp, Homo sapiens
acaatgcacctattttaaaact

SEQ ID NO: 9389419 - DNA, 22 bp, Homo sapiens
agcagatgtttcagagcaggct

SEQ ID NO: 9389420 - DNA, 22 bp, Homo sapiens
agcagatgtgtctctgcactgt

SEQ ID NO: 9389421 - DNA, 22 bp, Homo sapiens
agcagatgtttcagagcaggct

SEQ ID NO: 9389422 - DNA, 22 bp, Homo sapiens
agcagatggtgtcatgggatgg

SEQ ID NO: 9389423 - DNA, 22 bp, Homo sapiens
agcagatgagcctcatgactgg

SEQ ID NO: 9389424 - DNA, 19 bp, Homo sapiens
agcagagccctgaagatcc

SEQ ID NO: 9389425 - DNA, 19 bp, Homo sapiens
agcagagccctgaagatcc

SEQ ID NO: 9389426 - DNA, 18 bp, Homo sapiens
agcagagcccatgcattc

SEQ ID NO: 9389427 - DNA, 22 bp, Homo sapiens
agcagagccaggtctctctgta

SEQ ID NO: 9389428 - DNA, 18 bp, Homo sapiens
agcagagcccatgcattc

SEQ ID NO: 9389429 - DNA, 22 bp, Homo sapiens
agcagatgagcctcatgactgg

SEQ ID NO: 9389430 - DNA, 20 bp, Homo sapiens
acacagagtgagtctgcttg

SEQ ID NO: 9389431 - DNA, 22 bp, Homo sapiens
agcagctgggctcagagctggg

SEQ ID NO: 9389432 - DNA, 22 bp, Homo sapiens
agcagctggggcctgtgacgat

SEQ ID NO: 9389433 - DNA, 22 bp, Homo sapiens
acacagatgctatttagtctct

SEQ ID NO: 9389434 - DNA, 22 bp, Homo sapiens
agcagctgagccccagctgtga

SEQ ID NO: 9389435 - DNA, 22 bp, Homo sapiens
acacagataatgctcatatagg

SEQ ID NO: 9389436 - DNA, 22 bp, Homo sapiens
acacagatattttgaatacata

SEQ ID NO: 9389437 - DNA, 22 bp, Homo sapiens
acacagatgcattacacatcta

SEQ ID NO: 9389438 - DNA, 22 bp, Homo sapiens
acacagatgcattacacatcta

SEQ ID NO: 9389439 - DNA, 17 bp, Homo sapiens
agcagctgggttgatct

SEQ ID NO: 9389440 - DNA, 22 bp, Homo sapiens
agcagctgggtccggcggagca

SEQ ID NO: 9389441 - DNA, 22 bp, Homo sapiens
agcagctgggtccggcggagca

SEQ ID NO: 9389442 - DNA, 22 bp, Homo sapiens
agcagctggtgagcaagctcag

SEQ ID NO: 9389443 - DNA, 22 bp, Homo sapiens
agcagctggtgcaactctaaga

SEQ ID NO: 9389444 - DNA, 22 bp, Homo sapiens
agcagctggtaggagtggccac

SEQ ID NO: 9389445 - DNA, 22 bp, Homo sapiens
agcagctggtaggagtggccac

SEQ ID NO: 9389446 - DNA, 22 bp, Homo sapiens
acactccagggagggagggaat

SEQ ID NO: 9389447 - DNA, 22 bp, Homo sapiens
acactgaatatacaatgaatat

SEQ ID NO: 9389448 - DNA, 22 bp, Homo sapiens
acactgaagagcactttcaaag

SEQ ID NO: 9389449 - DNA, 22 bp, Homo sapiens
acactgaagagcactttcaaag

SEQ ID NO: 9389450 - DNA, 22 bp, Homo sapiens
acactataagacagatacagca

SEQ ID NO: 9389451 - DNA, 22 bp, Homo sapiens
acacccaggctggcgtgcagtg

SEQ ID NO: 9389452 - DNA, 22 bp, Homo sapiens
acacattaggcagtgcttaaat

SEQ ID NO: 9389453 - DNA, 22 bp, Homo sapiens
acacattatagagagtataata

SEQ ID NO: 9389454 - DNA, 22 bp, Homo sapiens
acacattataggcaatcaaaag

SEQ ID NO: 9389455 - DNA, 22 bp, Homo sapiens
acactgattgtagtctgtggtg

SEQ ID NO: 9389456 - DNA, 22 bp, Homo sapiens
acactgcagatgaaagcataag

SEQ ID NO: 9389457 - DNA, 22 bp, Homo sapiens
acactttacagaatgttttgat

SEQ ID NO: 9389458 - DNA, 22 bp, Homo sapiens
acacttcagcagtatgcttggg

SEQ ID NO: 9389459 - DNA, 22 bp, Homo sapiens
acactttactcttacaccattg

SEQ ID NO: 9389460 - DNA, 22 bp, Homo sapiens
acactttagaaaaaagaatggt

SEQ ID NO: 9389461 - DNA, 22 bp, Homo sapiens
acactttagaaaaaagaatggt

SEQ ID NO: 9389462 - DNA, 22 bp, Homo sapiens
acactttagtatgaagaggtag

SEQ ID NO: 9389463 - DNA, 22 bp, Homo sapiens
acactttagaaaaaagaatggt

SEQ ID NO: 9389464 - DNA, 22 bp, Homo sapiens
acactttagaaaaaagaatggt

SEQ ID NO: 9389465 - DNA, 22 bp, Homo sapiens
acactgagctgagcattcttgt

SEQ ID NO: 9389466 - DNA, 22 bp, Homo sapiens
acactgaatgtttaagaacttg

SEQ ID NO: 9389467 - DNA, 22 bp, Homo sapiens
acactgaatgtttaagaacttg

SEQ ID NO: 9389468 - DNA, 22 bp, Homo sapiens
acactgaatgtttaagaacttg

SEQ ID NO: 9389469 - DNA, 22 bp, Homo sapiens
agcagctggttcccgagggcgt

SEQ ID NO: 9389470 - DNA, 22 bp, Homo sapiens
agcagctgtactttcatctgtt

SEQ ID NO: 9389471 - DNA, 22 bp, Homo sapiens
agcagctggttcccgagggcgt

SEQ ID NO: 9389472 - DNA, 18 bp, Homo sapiens
acacaggctgacagcacc

SEQ ID NO: 9389473 - DNA, 18 bp, Homo sapiens
acacaggctgacagcacc

SEQ ID NO: 9389474 - DNA, 22 bp, Homo sapiens
acacagggatatttcaggtggt

SEQ ID NO: 9389475 - DNA, 22 bp, Homo sapiens
acacagggatatttcaggtggt

SEQ ID NO: 9389476 - DNA, 22 bp, Homo sapiens
acacagggaggaggtgctgtgc

SEQ ID NO: 9389477 - DNA, 17 bp, Homo sapiens
acacagggagagggagc

SEQ ID NO: 9389478 - DNA, 17 bp, Homo sapiens
acacagggagagggagc

SEQ ID NO: 9389479 - DNA, 22 bp, Homo sapiens
acacagggcagagagctggctc

SEQ ID NO: 9389480 - DNA, 22 bp, Homo sapiens
acacagggcggaaagcatgaga

SEQ ID NO: 9389481 - DNA, 19 bp, Homo sapiens
acacagggatcagagggtt

SEQ ID NO: 9389482 - DNA, 22 bp, Homo sapiens
acacagggcaatgctttgacct

SEQ ID NO: 9389483 - DNA, 22 bp, Homo sapiens
acacatggtggctggactatag

SEQ ID NO: 9389484 - DNA, 22 bp, Homo sapiens
acacatggtggctggactatag

SEQ ID NO: 9389485 - DNA, 22 bp, Homo sapiens
acacatgtaaaacacttagcaa

SEQ ID NO: 9389486 - DNA, 22 bp, Homo sapiens
acacatgtaaaacacttagcaa

SEQ ID NO: 9389487 - DNA, 22 bp, Homo sapiens
acacatgggtggggagctaagt

SEQ ID NO: 9389488 - DNA, 22 bp, Homo sapiens
acacatcttagactgaaatatg

SEQ ID NO: 9389489 - DNA, 22 bp, Homo sapiens
acacatctgcaagagccagacc

SEQ ID NO: 9389490 - DNA, 22 bp, Homo sapiens
acacatctgcaagagccagacc

SEQ ID NO: 9389491 - DNA, 22 bp, Homo sapiens
acacatctccagccagcaggag

SEQ ID NO: 9389492 - DNA, 22 bp, Homo sapiens
acacatctctctttgaggagtg

SEQ ID NO: 9389493 - DNA, 20 bp, Homo sapiens
acacatgtcaagctaaaggc

SEQ ID NO: 9389494 - DNA, 22 bp, Homo sapiens
acacatgtatgttttgtatttg

SEQ ID NO: 9389495 - DNA, 22 bp, Homo sapiens
acacatgtatgttttgtatttg

SEQ ID NO: 9389496 - DNA, 22 bp, Homo sapiens
acacatgtgattctaagacagc

SEQ ID NO: 9389497 - DNA, 20 bp, Homo sapiens
acacatgtgcgtgttcagta

SEQ ID NO: 9389498 - DNA, 22 bp, Homo sapiens
acacatgtgattctaagacagc

SEQ ID NO: 9389499 - DNA, 22 bp, Homo sapiens
acacatgtatatgcttgtgtgt

SEQ ID NO: 9389500 - DNA, 22 bp, Homo sapiens
acacatgtatggcacttacatt

SEQ ID NO: 9389501 - DNA, 22 bp, Homo sapiens
acacatgtatggcacttacatt

SEQ ID NO: 9389502 - DNA, 22 bp, Homo sapiens
acacatgtacagattagtattt

SEQ ID NO: 9389503 - DNA, 22 bp, Homo sapiens
acacatgtacagattagtattt

SEQ ID NO: 9389504 - DNA, 19 bp, Homo sapiens
acacatgtaacagtttttc

SEQ ID NO: 9389505 - DNA, 22 bp, Homo sapiens
acacatgtacagattagtattt

SEQ ID NO: 9389506 - DNA, 22 bp, Homo sapiens
acacattaaaacgtctacaatg

SEQ ID NO: 9389507 - DNA, 22 bp, Homo sapiens
acacattaacctttgaaattct

SEQ ID NO: 9389508 - DNA, 22 bp, Homo sapiens
acacatgtttgtgtagtcagtt

SEQ ID NO: 9389509 - DNA, 22 bp, Homo sapiens
acacatgtttccaaaagcaccc

SEQ ID NO: 9389510 - DNA, 22 bp, Homo sapiens
acacatgtgtctgcatgcagtg

SEQ ID NO: 9389511 - DNA, 22 bp, Homo sapiens
acacatgtgtctgcatgcagtg

SEQ ID NO: 9389512 - DNA, 22 bp, Homo sapiens
acacatgtgtctgcatgcagtg

SEQ ID NO: 9389513 - DNA, 19 bp, Homo sapiens
acacatgtgtgttatgtgc

SEQ ID NO: 9389514 - DNA, 22 bp, Homo sapiens
acacatgttcaagaatgttcag

SEQ ID NO: 9389515 - DNA, 22 bp, Homo sapiens
acacatgttcaagaatgttcag

SEQ ID NO: 9389516 - DNA, 22 bp, Homo sapiens
acacatgtttacagtcttcagt

SEQ ID NO: 9389517 - DNA, 22 bp, Homo sapiens
acacatgtttacagtcttcagt

SEQ ID NO: 9389518 - DNA, 20 bp, Homo sapiens
acagaaagagagaatgtcag

SEQ ID NO: 9389519 - DNA, 22 bp, Homo sapiens
acagaattaatgaaaattacaa

SEQ ID NO: 9389520 - DNA, 22 bp, Homo sapiens
acagaaagataggcacaaggtc

SEQ ID NO: 9389521 - DNA, 22 bp, Homo sapiens
acagacaagtagttcagacaag

SEQ ID NO: 9389522 - DNA, 22 bp, Homo sapiens
acagacacaggcgtggagtcgc

SEQ ID NO: 9389523 - DNA, 22 bp, Homo sapiens
acagacacaggcgtggagtcgc

SEQ ID NO: 9389524 - DNA, 22 bp, Homo sapiens
acagacagacagagaactattc

SEQ ID NO: 9389525 - DNA, 22 bp, Homo sapiens
acagacactgcactcccacctt

SEQ ID NO: 9389526 - DNA, 22 bp, Homo sapiens
acagacagacagattgcatatg

SEQ ID NO: 9389527 - DNA, 22 bp, Homo sapiens
acagacagaggctccatgagga

SEQ ID NO: 9389528 - DNA, 22 bp, Homo sapiens
acagacagggcacctgcctcct

SEQ ID NO: 9389529 - DNA, 22 bp, Homo sapiens
acagacagattttgtctgatgt

SEQ ID NO: 9389530 - DNA, 22 bp, Homo sapiens
agccaggggattcatcagggac

SEQ ID NO: 9389531 - DNA, 22 bp, Homo sapiens
acactttatcaatattcaaaaa

SEQ ID NO: 9389532 - DNA, 22 bp, Homo sapiens
acactttatcaatattcaaaaa

SEQ ID NO: 9389533 - DNA, 22 bp, Homo sapiens
acactttatgtctagatctggg

SEQ ID NO: 9389534 - DNA, 22 bp, Homo sapiens
acactttatgtctagatctggg

SEQ ID NO: 9389535 - DNA, 23 bp, Homo sapiens
acactttcaaatatgcacagagc

SEQ ID NO: 9389536 - DNA, 22 bp, Homo sapiens
acactttgttgtggcatatacg

SEQ ID NO: 9389537 - DNA, 22 bp, Homo sapiens
acacttttaagactttaatgaa

SEQ ID NO: 9389538 - DNA, 22 bp, Homo sapiens
acacttttaagactttaatgaa

SEQ ID NO: 9389539 - DNA, 22 bp, Homo sapiens
acacttttagctatgagttaat

SEQ ID NO: 9389540 - DNA, 22 bp, Homo sapiens
acacttttatctctggaggctt

SEQ ID NO: 9389541 - DNA, 22 bp, Homo sapiens
acactttgctacatttcatatt

SEQ ID NO: 9389542 - DNA, 22 bp, Homo sapiens
acactttctggagctgcacata

SEQ ID NO: 9389543 - DNA, 22 bp, Homo sapiens
acactttgtcctttttcattgt

SEQ ID NO: 9389544 - DNA, 22 bp, Homo sapiens
acactttgctacatttcatatt

SEQ ID NO: 9389545 - DNA, 22 bp, Homo sapiens
acacttttgtttgaagtctcca

SEQ ID NO: 9389546 - DNA, 22 bp, Homo sapiens
acacttttgtgtatatccagtt

SEQ ID NO: 9389547 - DNA, 22 bp, Homo sapiens
acagaaaatgccagaagggtgg

SEQ ID NO: 9389548 - DNA, 22 bp, Homo sapiens
acagaaacccagaaaacctctc

SEQ ID NO: 9389549 - DNA, 22 bp, Homo sapiens
acagaaagaccttgtaacactt

SEQ ID NO: 9389550 - DNA, 22 bp, Homo sapiens
acagaaacccagaaaacctctc

SEQ ID NO: 9389551 - DNA, 22 bp, Homo sapiens
acagaaagaaggtgtatttgag

SEQ ID NO: 9389552 - DNA, 22 bp, Homo sapiens
acagaaagaaggtgtatttgag

SEQ ID NO: 9389553 - DNA, 22 bp, Homo sapiens
agccagggtctctcgctctgtt

SEQ ID NO: 9389554 - DNA, 19 bp, Homo sapiens
agccagggtccagacatgt

SEQ ID NO: 9389555 - DNA, 22 bp, Homo sapiens
agccagggtaaggtacttagta

SEQ ID NO: 9389556 - DNA, 19 bp, Homo sapiens
agccagggtccagacatgt

SEQ ID NO: 9389557 - DNA, 19 bp, Homo sapiens
agccagggtgagaaggagc

SEQ ID NO: 9389558 - DNA, 19 bp, Homo sapiens
agccagggtgagaaggagc

SEQ ID NO: 9389559 - DNA, 22 bp, Homo sapiens
agccagggtctctcgctctgtt

SEQ ID NO: 9389560 - DNA, 19 bp, Homo sapiens
agccagggtgagaaggagc

SEQ ID NO: 9389561 - DNA, 21 bp, Homo sapiens
acagagaaagagcagcctcct

SEQ ID NO: 9389562 - DNA, 23 bp, Homo sapiens
acagacattccataatgtacacc

SEQ ID NO: 9389563 - DNA, 22 bp, Homo sapiens
acagactgtcccaccacatgga

SEQ ID NO: 9389564 - DNA, 22 bp, Homo sapiens
acagatggagctactaggtaaa

SEQ ID NO: 9389565 - DNA, 22 bp, Homo sapiens
acagatgttgcttgtcattctc

SEQ ID NO: 9389566 - DNA, 21 bp, Homo sapiens
acagatgtgatatgcagtctt

SEQ ID NO: 9389567 - DNA, 22 bp, Homo sapiens
acagattcactgcactggccat

SEQ ID NO: 9389568 - DNA, 22 bp, Homo sapiens
acagattcactgcactggccat

SEQ ID NO: 9389569 - DNA, 22 bp, Homo sapiens
agctcccagaaggccctgcgcc

SEQ ID NO: 9389570 - DNA, 22 bp, Homo sapiens
agctcctgcacccagccttgag

SEQ ID NO: 9389571 - DNA, 22 bp, Homo sapiens
agctcctgcagactcctgctca

SEQ ID NO: 9389572 - DNA, 22 bp, Homo sapiens
agctcccagagtcctctgccca

SEQ ID NO: 9389573 - DNA, 22 bp, Homo sapiens
agctcctgcccaggaaggctct

SEQ ID NO: 9389574 - DNA, 22 bp, Homo sapiens
agctcctgccaacactgatggg

SEQ ID NO: 9389575 - DNA, 22 bp, Homo sapiens
agctcctgcgcacggtgcacac

SEQ ID NO: 9389576 - DNA, 17 bp, Homo sapiens
agctcctgcccatggct

SEQ ID NO: 9389577 - DNA, 19 bp, Homo sapiens
acagcacagaaatatttca

SEQ ID NO: 9389578 - DNA, 22 bp, Homo sapiens
acagcacagagtggtatggctg

SEQ ID NO: 9389579 - DNA, 22 bp, Homo sapiens
acagcacaatctgagtcccaga

SEQ ID NO: 9389580 - DNA, 22 bp, Homo sapiens
agctcctgctctttgtccctaa

SEQ ID NO: 9389581 - DNA, 22 bp, Homo sapiens
agctcctgctctttgtccctaa

SEQ ID NO: 9389582 - DNA, 22 bp, Homo sapiens
acagcaatgagtaactccttgg

SEQ ID NO: 9389583 - DNA, 22 bp, Homo sapiens
acagcaattgtatgcatagcat

SEQ ID NO: 9389584 - DNA, 21 bp, Homo sapiens
acagagccgggcacaaagctg

SEQ ID NO: 9389585 - DNA, 22 bp, Homo sapiens
acagagccactttggtgcctac

SEQ ID NO: 9389586 - DNA, 22 bp, Homo sapiens
acagagccactttggtgcctac

SEQ ID NO: 9389587 - DNA, 22 bp, Homo sapiens
acagagccactttggtgcctac

SEQ ID NO: 9389588 - DNA, 22 bp, Homo sapiens
agcctctcttatcccttcaaag

SEQ ID NO: 9389589 - DNA, 22 bp, Homo sapiens
agcctctctttattcccagcta

SEQ ID NO: 9389590 - DNA, 22 bp, Homo sapiens
agcctctgactgtcagcaaggt

SEQ ID NO: 9389591 - DNA, 22 bp, Homo sapiens
agcctctgatgatcacaggggg

SEQ ID NO: 9389592 - DNA, 22 bp, Homo sapiens
agcctctgatgatcacaggggg

SEQ ID NO: 9389593 - DNA, 22 bp, Homo sapiens
agcctcctgtagccctcaccca

SEQ ID NO: 9389594 - DNA, 22 bp, Homo sapiens
agcctctcactgtcaccctccc

SEQ ID NO: 9389595 - DNA, 22 bp, Homo sapiens
agcctctcactgtcaccctccc

SEQ ID NO: 9389596 - DNA, 22 bp, Homo sapiens
agcctcctgtagccctcaccca

SEQ ID NO: 9389597 - DNA, 22 bp, Homo sapiens
agcctctctgttagtcactggg

SEQ ID NO: 9389598 - DNA, 22 bp, Homo sapiens
agcctctctccagcttggcaga

SEQ ID NO: 9389599 - DNA, 22 bp, Homo sapiens
agcctctctccagcttggcaga

SEQ ID NO: 9389600 - DNA, 22 bp, Homo sapiens
agcctctcatgttctcccccag

SEQ ID NO: 9389601 - DNA, 22 bp, Homo sapiens
agcctctcagagtgctgggatt

SEQ ID NO: 9389602 - DNA, 22 bp, Homo sapiens
agcctctccagagcctggcaga

SEQ ID NO: 9389603 - DNA, 22 bp, Homo sapiens
acagatgcaaggaaatgattgc

SEQ ID NO: 9389604 - DNA, 17 bp, Homo sapiens
acagatgctgataagaa

SEQ ID NO: 9389605 - DNA, 22 bp, Homo sapiens
acagatgatgtgcacagataga

SEQ ID NO: 9389606 - DNA, 22 bp, Homo sapiens
acagatgagttagaataggcag

SEQ ID NO: 9389607 - DNA, 22 bp, Homo sapiens
acagatgagttaaagcagagtg

SEQ ID NO: 9389608 - DNA, 22 bp, Homo sapiens
acagagctcccagccatctcct

SEQ ID NO: 9389609 - DNA, 22 bp, Homo sapiens
acagagctaatgttgcataggc

SEQ ID NO: 9389610 - DNA, 22 bp, Homo sapiens
acagagctgggtgccccctgga

SEQ ID NO: 9389611 - DNA, 20 bp, Homo sapiens
acagatatttgattttcagt

SEQ ID NO: 9389612 - DNA, 21 bp, Homo sapiens
acagatatttcattgaacatt

SEQ ID NO: 9389613 - DNA, 22 bp, Homo sapiens
acagagctgtacatgtgccatg

SEQ ID NO: 9389614 - DNA, 22 bp, Homo sapiens
aagatgtgtctcatcagggtgt

SEQ ID NO: 9389615 - DNA, 22 bp, Homo sapiens
aagatgttaaatctgtagaatt

SEQ ID NO: 9389616 - DNA, 22 bp, Homo sapiens
aagcaaagacagtttgagtgga

SEQ ID NO: 9389617 - DNA, 22 bp, Homo sapiens
aagcaataaataatttttagta

SEQ ID NO: 9389618 - DNA, 22 bp, Homo sapiens
aagatgcctgtagcaggaagat

SEQ ID NO: 9389619 - DNA, 22 bp, Homo sapiens
aagatgctaattgtggaagttg

SEQ ID NO: 9389620 - DNA, 22 bp, Homo sapiens
aagatgcggttgaccatggtgt

SEQ ID NO: 9389621 - DNA, 22 bp, Homo sapiens
aagatgcatgctgaagctggct

SEQ ID NO: 9389622 - DNA, 22 bp, Homo sapiens
aagatgattaggatgaaagcaa

SEQ ID NO: 9389623 - DNA, 22 bp, Homo sapiens
aagatgcacaatgtggcaatta

SEQ ID NO: 9389624 - DNA, 21 bp, Homo sapiens
aagatgatattttatctgtag

SEQ ID NO: 9389625 - DNA, 22 bp, Homo sapiens
aagatgctggcaggaatagcta

SEQ ID NO: 9389626 - DNA, 22 bp, Homo sapiens
aagatgcttgcaaatttctgaa

SEQ ID NO: 9389627 - DNA, 22 bp, Homo sapiens
aagatgcttccactgcagtggc

SEQ ID NO: 9389628 - DNA, 23 bp, Homo sapiens
aagatgtatttttaccaaatgtc

SEQ ID NO: 9389629 - DNA, 22 bp, Homo sapiens
acacatttattacatgcatgtg

SEQ ID NO: 9389630 - DNA, 22 bp, Homo sapiens
acacatttatggatcgcagaaa

SEQ ID NO: 9389631 - DNA, 22 bp, Homo sapiens
acacatttagcaccaggtttat

SEQ ID NO: 9389632 - DNA, 22 bp, Homo sapiens
acacatttattacatgcatgtg

SEQ ID NO: 9389633 - DNA, 22 bp, Homo sapiens
acacatttattacatgcatgtg

SEQ ID NO: 9389634 - DNA, 22 bp, Homo sapiens
acacatttctaaatttttaccg

SEQ ID NO: 9389635 - DNA, 22 bp, Homo sapiens
aagatatagataaaactatgca

SEQ ID NO: 9389636 - DNA, 22 bp, Homo sapiens
aagatatagatggtggtataaa

SEQ ID NO: 9389637 - DNA, 22 bp, Homo sapiens
aagatccttctcactgcagtgt

SEQ ID NO: 9389638 - DNA, 22 bp, Homo sapiens
aagatatagatggtggtataaa

SEQ ID NO: 9389639 - DNA, 22 bp, Homo sapiens
aagatgaagaacatgagcacac

SEQ ID NO: 9389640 - DNA, 22 bp, Homo sapiens
acacattgcagacatctcatta

SEQ ID NO: 9389641 - DNA, 22 bp, Homo sapiens
acacattgcagacatctcatta

SEQ ID NO: 9389642 - DNA, 22 bp, Homo sapiens
acacatttacatgtttacgtat

SEQ ID NO: 9389643 - DNA, 22 bp, Homo sapiens
acacatttacatgtttacgtat

SEQ ID NO: 9389644 - DNA, 21 bp, Homo sapiens
acacattatgagcatagactc

SEQ ID NO: 9389645 - DNA, 22 bp, Homo sapiens
acacattatgagcagttgtctt

SEQ ID NO: 9389646 - DNA, 22 bp, Homo sapiens
acacattatctcattaaatact

SEQ ID NO: 9389647 - DNA, 19 bp, Homo sapiens
acacatgctcctggagcct

SEQ ID NO: 9389648 - DNA, 22 bp, Homo sapiens
aagagcagcctccaggggtgga

SEQ ID NO: 9389649 - DNA, 22 bp, Homo sapiens
aagagcaggctgctgtggagta

SEQ ID NO: 9389650 - DNA, 22 bp, Homo sapiens
aagagcaggctgtcaatggggc

SEQ ID NO: 9389651 - DNA, 17 bp, Homo sapiens
acacatcttggctttgc

SEQ ID NO: 9389652 - DNA, 22 bp, Homo sapiens
acacatcttagactgaaatatg

SEQ ID NO: 9389653 - DNA, 22 bp, Homo sapiens
acacatatatgtcgaagtcctc

SEQ ID NO: 9389654 - DNA, 22 bp, Homo sapiens
acacatatatacatatttgtgc

SEQ ID NO: 9389655 - DNA, 22 bp, Homo sapiens
acacatatatacatatttgtgc

SEQ ID NO: 9389656 - DNA, 22 bp, Homo sapiens
acacatatatacatatttgtgc

SEQ ID NO: 9389657 - DNA, 22 bp, Homo sapiens
acacatgaatcactggtggaag

SEQ ID NO: 9389658 - DNA, 22 bp, Homo sapiens
acacatgaaagacattaaggtg

SEQ ID NO: 9389659 - DNA, 22 bp, Homo sapiens
acacatgagaaacatcagttgt

SEQ ID NO: 9389660 - DNA, 22 bp, Homo sapiens
acacatgagaaacatcagttgt

SEQ ID NO: 9389661 - DNA, 22 bp, Homo sapiens
acacatgagaaacatcagttgt

SEQ ID NO: 9389662 - DNA, 22 bp, Homo sapiens
acacatgagttctcatcttgtg

SEQ ID NO: 9389663 - DNA, 22 bp, Homo sapiens
acacatgataagaaagtttaaa

SEQ ID NO: 9389664 - DNA, 22 bp, Homo sapiens
acacatgataagaaagtttaaa

SEQ ID NO: 9389665 - DNA, 22 bp, Homo sapiens
acacatgcaggtatacatgttc

SEQ ID NO: 9389666 - DNA, 22 bp, Homo sapiens
acagccagggcattgtcgccga

SEQ ID NO: 9389667 - DNA, 22 bp, Homo sapiens
acagcctggactggctctctgc

SEQ ID NO: 9389668 - DNA, 22 bp, Homo sapiens
acagccagggtctcaggaggcg

SEQ ID NO: 9389669 - DNA, 22 bp, Homo sapiens
aagcagcttccctggctcctgg

SEQ ID NO: 9389670 - DNA, 22 bp, Homo sapiens
aagcagcttttgaagagtgagg

SEQ ID NO: 9389671 - DNA, 22 bp, Homo sapiens
aagcagcttttgaagagtgagg

SEQ ID NO: 9389672 - DNA, 22 bp, Homo sapiens
aagcagctttctttcctgtgaa

SEQ ID NO: 9389673 - DNA, 22 bp, Homo sapiens
aagcagctttctttcctgtgaa

SEQ ID NO: 9389674 - DNA, 22 bp, Homo sapiens
aagcagctgtgtgacataatct

SEQ ID NO: 9389675 - DNA, 22 bp, Homo sapiens
aagcagctggaagagtaagatg

SEQ ID NO: 9389676 - DNA, 22 bp, Homo sapiens
aagcagctgcaggttcaaagga

SEQ ID NO: 9389677 - DNA, 22 bp, Homo sapiens
aagcagctggaagagtaagatg

SEQ ID NO: 9389678 - DNA, 22 bp, Homo sapiens
acagcagaggaaaagtctgata

SEQ ID NO: 9389679 - DNA, 22 bp, Homo sapiens
acagcagaggaaaagtctgata

SEQ ID NO: 9389680 - DNA, 22 bp, Homo sapiens
acagcagagcctagcttaatct

SEQ ID NO: 9389681 - DNA, 22 bp, Homo sapiens
acagcagagcctggtacttact

SEQ ID NO: 9389682 - DNA, 22 bp, Homo sapiens
aagcagaggaccgacggaggga

SEQ ID NO: 9389683 - DNA, 22 bp, Homo sapiens
aagcagaggaccgacggaggga

SEQ ID NO: 9389684 - DNA, 22 bp, Homo sapiens
aagcagaggaccgacggaggga

SEQ ID NO: 9389685 - DNA, 22 bp, Homo sapiens
aagcagaggaccgacggaggga

SEQ ID NO: 9389686 - DNA, 22 bp, Homo sapiens
acagcagaccccagtgccatgg

SEQ ID NO: 9389687 - DNA, 22 bp, Homo sapiens
acagcaaaagacaagaacttaa

SEQ ID NO: 9389688 - DNA, 22 bp, Homo sapiens
acagcagagacactcaggaggc

SEQ ID NO: 9389689 - DNA, 22 bp, Homo sapiens
acagcagagcaccagggccact

SEQ ID NO: 9389690 - DNA, 22 bp, Homo sapiens
acagcagagcaccagggccact

SEQ ID NO: 9389691 - DNA, 22 bp, Homo sapiens
acagcagagccagtggctctag

SEQ ID NO: 9389692 - DNA, 21 bp, Homo sapiens
acagcagagatcaagactaag

SEQ ID NO: 9389693 - DNA, 22 bp, Homo sapiens
acagcagagcaccagggccact

SEQ ID NO: 9389694 - DNA, 22 bp, Homo sapiens
aagcagagccaccagctttgga

SEQ ID NO: 9389695 - DNA, 22 bp, Homo sapiens
aagcagaggaccgacggaggga

SEQ ID NO: 9389696 - DNA, 22 bp, Homo sapiens
aagcagagcctgagacagggat

SEQ ID NO: 9389697 - DNA, 22 bp, Homo sapiens
aagcagagcctgagacagggat

SEQ ID NO: 9389698 - DNA, 22 bp, Homo sapiens
aagcagagaatctgggagcgag

SEQ ID NO: 9389699 - DNA, 22 bp, Homo sapiens
aagcagagaatctgggagcgag

SEQ ID NO: 9389700 - DNA, 22 bp, Homo sapiens
aagcagactgggccataaggaa

SEQ ID NO: 9389701 - DNA, 19 bp, Homo sapiens
aagcagactctgagccagg

SEQ ID NO: 9389702 - DNA, 21 bp, Homo sapiens
aagcagacctgagcacagaac

SEQ ID NO: 9389703 - DNA, 22 bp, Homo sapiens
aagcagactcccggccagctca

SEQ ID NO: 9389704 - DNA, 22 bp, Homo sapiens
aagcagacatcccatacttttg

SEQ ID NO: 9389705 - DNA, 21 bp, Homo sapiens
aagcagacctgagcacagaac

SEQ ID NO: 9389706 - DNA, 22 bp, Homo sapiens
aagcagacagagaatgggtttg

SEQ ID NO: 9389707 - DNA, 22 bp, Homo sapiens
aagcagaatttaatagaaaggt

SEQ ID NO: 9389708 - DNA, 20 bp, Homo sapiens
aagcagaagctgctctcagc

SEQ ID NO: 9389709 - DNA, 22 bp, Homo sapiens
aagcagaaggggaataatattt

SEQ ID NO: 9389710 - DNA, 22 bp, Homo sapiens
aagcagaatttaatagaaaggt

SEQ ID NO: 9389711 - DNA, 22 bp, Homo sapiens
aagcagaatagaggcccttccc

SEQ ID NO: 9389712 - DNA, 22 bp, Homo sapiens
aagcaattcacagttcacttaa

SEQ ID NO: 9389713 - DNA, 22 bp, Homo sapiens
aagcacaatttaggactgaaat

SEQ ID NO: 9389714 - DNA, 22 bp, Homo sapiens
aagagattgtcagagatatgcc

SEQ ID NO: 9389715 - DNA, 22 bp, Homo sapiens
aagagcaacttggaaacactca

SEQ ID NO: 9389716 - DNA, 22 bp, Homo sapiens
acacaaattgtaggataattgc

SEQ ID NO: 9389717 - DNA, 22 bp, Homo sapiens
aagagcaacttggaaacactca

SEQ ID NO: 9389718 - DNA, 22 bp, Homo sapiens
aagagcagaagtccttggatcc

SEQ ID NO: 9389719 - DNA, 22 bp, Homo sapiens
aagagcagcctccaggggtgga

SEQ ID NO: 9389720 - DNA, 22 bp, Homo sapiens
aagagcaccttaattatgcaga

SEQ ID NO: 9389721 - DNA, 22 bp, Homo sapiens
acacaaacagtctatagcacca

SEQ ID NO: 9389722 - DNA, 22 bp, Homo sapiens
acacaaacagtctatagcacca

SEQ ID NO: 9389723 - DNA, 21 bp, Homo sapiens
acacaaacctcctcagcctgg

SEQ ID NO: 9389724 - DNA, 22 bp, Homo sapiens
acacaaactgctagaaaattgg

SEQ ID NO: 9389725 - DNA, 22 bp, Homo sapiens
acacaaagttggatgacaaaat

SEQ ID NO: 9389726 - DNA, 22 bp, Homo sapiens
acacaaaatcaaagtcctaggc

SEQ ID NO: 9389727 - DNA, 22 bp, Homo sapiens
aagagaattctggttttcctat

SEQ ID NO: 9389728 - DNA, 22 bp, Homo sapiens
aagagaatgacaaggagaacct

SEQ ID NO: 9389729 - DNA, 22 bp, Homo sapiens
aagagaaggattctgagcctgg

SEQ ID NO: 9389730 - DNA, 22 bp, Homo sapiens
aatttgttacacagcaatataa

SEQ ID NO: 9389731 - DNA, 22 bp, Homo sapiens
aatttccagaccccatccacag

SEQ ID NO: 9389732 - DNA, 22 bp, Homo sapiens
aatttccaaatttctgtcacac

SEQ ID NO: 9389733 - DNA, 22 bp, Homo sapiens
aattttaagcatatgactggtt

SEQ ID NO: 9389734 - DNA, 22 bp, Homo sapiens
aatttgttagcatactctagtt

SEQ ID NO: 9389735 - DNA, 22 bp, Homo sapiens
aattttacaaaatacctccgat

SEQ ID NO: 9389736 - DNA, 22 bp, Homo sapiens
aattttaatcagtggtgctgag

SEQ ID NO: 9389737 - DNA, 22 bp, Homo sapiens
aatttcagaacccaaattagcg

SEQ ID NO: 9389738 - DNA, 22 bp, Homo sapiens
aatttcagaactatctgggagt

SEQ ID NO: 9389739 - DNA, 22 bp, Homo sapiens
aatttcagaccatttgcaatta

SEQ ID NO: 9389740 - DNA, 21 bp, Homo sapiens
aatttcagacccattttgcct

SEQ ID NO: 9389741 - DNA, 22 bp, Homo sapiens
aatttcagtatgaagtttcaca

SEQ ID NO: 9389742 - DNA, 22 bp, Homo sapiens
aatttcagttgctaataagttc

SEQ ID NO: 9389743 - DNA, 22 bp, Homo sapiens
aatttcagttgctaataagttc

SEQ ID NO: 9389744 - DNA, 22 bp, Homo sapiens
aatttcagttgctaataagttc

SEQ ID NO: 9389745 - DNA, 22 bp, Homo sapiens
aatttcagcttaagttgtttgg

SEQ ID NO: 9389746 - DNA, 22 bp, Homo sapiens
aatttcagcaacgggagcctag

SEQ ID NO: 9389747 - DNA, 22 bp, Homo sapiens
aatttcagatgtcataaatata

SEQ ID NO: 9389748 - DNA, 22 bp, Homo sapiens
aagagaagaaagtgtctacaca

SEQ ID NO: 9389749 - DNA, 22 bp, Homo sapiens
aagagaagaaagtgtctacaca

SEQ ID NO: 9389750 - DNA, 22 bp, Homo sapiens
aagagaaggattctgagcctgg

SEQ ID NO: 9389751 - DNA, 22 bp, Homo sapiens
aagagaacagtcaccatgcaca

SEQ ID NO: 9389752 - DNA, 22 bp, Homo sapiens
aagagaaagcagactttgtcat

SEQ ID NO: 9389753 - DNA, 22 bp, Homo sapiens
aagagaaagcagactttgtcat

SEQ ID NO: 9389754 - DNA, 22 bp, Homo sapiens
aagacttgaccaggttgaaggc

SEQ ID NO: 9389755 - DNA, 22 bp, Homo sapiens
aagactttccctcatcagaacg

SEQ ID NO: 9389756 - DNA, 22 bp, Homo sapiens
aattttatctctaagcaggctt

SEQ ID NO: 9389757 - DNA, 20 bp, Homo sapiens
aattttatctccatcctttg

SEQ ID NO: 9389758 - DNA, 20 bp, Homo sapiens
aattttatctccatcctttg

SEQ ID NO: 9389759 - DNA, 20 bp, Homo sapiens
aattttatctccatcctttg

SEQ ID NO: 9389760 - DNA, 22 bp, Homo sapiens
aagaaattaaggaatgcaacga

SEQ ID NO: 9389761 - DNA, 22 bp, Homo sapiens
aagaacaactgctttaaaagca

SEQ ID NO: 9389762 - DNA, 22 bp, Homo sapiens
aatttcactggaaaagataatt

SEQ ID NO: 9389763 - DNA, 22 bp, Homo sapiens
aatttcactggaaaagataatt

SEQ ID NO: 9389764 - DNA, 22 bp, Homo sapiens
aatttcactgtggagcacattt

SEQ ID NO: 9389765 - DNA, 22 bp, Homo sapiens
aatttcactgtggagcacattt

SEQ ID NO: 9389766 - DNA, 22 bp, Homo sapiens
aatttcacagtgaactttgagg

SEQ ID NO: 9389767 - DNA, 22 bp, Homo sapiens
aatttcacataaggctcattgg

SEQ ID NO: 9389768 - DNA, 22 bp, Homo sapiens
aatttcacctgcactacatcgc

SEQ ID NO: 9389769 - DNA, 22 bp, Homo sapiens
aatttcactgataaagactcca

SEQ ID NO: 9389770 - DNA, 22 bp, Homo sapiens
aatttcacctatcacttaagcc

SEQ ID NO: 9389771 - DNA, 22 bp, Homo sapiens
aagaacaactgctttaaaagca

SEQ ID NO: 9389772 - DNA, 22 bp, Homo sapiens
aattcctctatctttcttcaag

SEQ ID NO: 9389773 - DNA, 22 bp, Homo sapiens
aattctagcattgtgaaaatat

SEQ ID NO: 9389774 - DNA, 22 bp, Homo sapiens
aattctataggcaagctatttt

SEQ ID NO: 9389775 - DNA, 22 bp, Homo sapiens
aattctcaggtaaaagttaagt

SEQ ID NO: 9389776 - DNA, 22 bp, Homo sapiens
aattctgaaagattccttattc

SEQ ID NO: 9389777 - DNA, 22 bp, Homo sapiens
aagaaagataaggtttgcttgg

SEQ ID NO: 9389778 - DNA, 22 bp, Homo sapiens
aagaaagagatcactcctccat

SEQ ID NO: 9389779 - DNA, 20 bp, Homo sapiens
aagaaacttgaaagtacaag

SEQ ID NO: 9389780 - DNA, 22 bp, Homo sapiens
aattcccatttgcagaaaatca

SEQ ID NO: 9389781 - DNA, 22 bp, Homo sapiens
aattcccactatatgccaagca

SEQ ID NO: 9389782 - DNA, 21 bp, Homo sapiens
aattcccagaaacagcacaag

SEQ ID NO: 9389783 - DNA, 22 bp, Homo sapiens
aattcccaccttctctcttttg

SEQ ID NO: 9389784 - DNA, 22 bp, Homo sapiens
aactttctgtctgagctgcaga

SEQ ID NO: 9389785 - DNA, 22 bp, Homo sapiens
aatggcttttgcacttaaatcg

SEQ ID NO: 9389786 - DNA, 22 bp, Homo sapiens
aatggctttgagtattttctgg

SEQ ID NO: 9389787 - DNA, 22 bp, Homo sapiens
aatgggaaagagactagatgct

SEQ ID NO: 9389788 - DNA, 22 bp, Homo sapiens
aactggaaagatcagtaggaag

SEQ ID NO: 9389789 - DNA, 22 bp, Homo sapiens
aactggaaggattgcagatgtc

SEQ ID NO: 9389790 - DNA, 22 bp, Homo sapiens
aactggaatagcacaggaaaag

SEQ ID NO: 9389791 - DNA, 22 bp, Homo sapiens
aagaaaacaatgacttgccagc

SEQ ID NO: 9389792 - DNA, 22 bp, Homo sapiens
aagaaaacaatgacttgccagc

SEQ ID NO: 9389793 - DNA, 22 bp, Homo sapiens
aagaaaacaatgacttgccagc

SEQ ID NO: 9389794 - DNA, 22 bp, Homo sapiens
aagaaaacatgatctaatttaa

SEQ ID NO: 9389795 - DNA, 22 bp, Homo sapiens
aagaaaatcagttctggtcagt

SEQ ID NO: 9389796 - DNA, 22 bp, Homo sapiens
aagaaaagaaacctgaggcttt

SEQ ID NO: 9389797 - DNA, 22 bp, Homo sapiens
aagaaaagaaacctgaggcttt

SEQ ID NO: 9389798 - DNA, 22 bp, Homo sapiens
aagaaaagaaacctgaggcttt

SEQ ID NO: 9389799 - DNA, 22 bp, Homo sapiens
aagaaacaaccactgctctcct

SEQ ID NO: 9389800 - DNA, 22 bp, Homo sapiens
aagaaacaaccactgctctcct

SEQ ID NO: 9389801 - DNA, 22 bp, Homo sapiens
aagaaacaaccactgctctcct

SEQ ID NO: 9389802 - DNA, 22 bp, Homo sapiens
aagaaactgttgcgtgacagcg

SEQ ID NO: 9389803 - DNA, 22 bp, Homo sapiens
aagtgcttcgttctgtattggg

SEQ ID NO: 9389804 - DNA, 22 bp, Homo sapiens
aagtgcttccatgtttgagtgt

SEQ ID NO: 9389805 - DNA, 22 bp, Homo sapiens
aacagacatatttttaatatgc

SEQ ID NO: 9389806 - DNA, 22 bp, Homo sapiens
aacagacagaaaaatgtgatct

SEQ ID NO: 9389807 - DNA, 22 bp, Homo sapiens
aacagacaactcctgtggctca

SEQ ID NO: 9389808 - DNA, 22 bp, Homo sapiens
aacagaaaaggtaggtggcttt

SEQ ID NO: 9389809 - DNA, 22 bp, Homo sapiens
aacagaaaaggtaggtggcttt

SEQ ID NO: 9389810 - DNA, 22 bp, Homo sapiens
aacagaaatcatttagggctct

SEQ ID NO: 9389811 - DNA, 22 bp, Homo sapiens
aacagaagggggtatttacatt

SEQ ID NO: 9389812 - DNA, 22 bp, Homo sapiens
aacagaactgttgttctggagg

SEQ ID NO: 9389813 - DNA, 22 bp, Homo sapiens
aacagaagggggtatttacatt

SEQ ID NO: 9389814 - DNA, 22 bp, Homo sapiens
aacacagtcagttcctggatca

SEQ ID NO: 9389815 - DNA, 22 bp, Homo sapiens
aacacagtcctgctcacttatt

SEQ ID NO: 9389816 - DNA, 22 bp, Homo sapiens
aacacaggttcattctgtgagg

SEQ ID NO: 9389817 - DNA, 22 bp, Homo sapiens
aacacaggttcattctgtgagg

SEQ ID NO: 9389818 - DNA, 22 bp, Homo sapiens
aacacaggttgctgggcctcac

SEQ ID NO: 9389819 - DNA, 22 bp, Homo sapiens
aacacagtttctgcattggtag

SEQ ID NO: 9389820 - DNA, 22 bp, Homo sapiens
aacacagtttctctatgagagt

SEQ ID NO: 9389821 - DNA, 22 bp, Homo sapiens
aacactgtatcagtcttcaata

SEQ ID NO: 9389822 - DNA, 22 bp, Homo sapiens
aacactgtactggaagatggac

SEQ ID NO: 9389823 - DNA, 22 bp, Homo sapiens
aacacagttttccaaaatagag

SEQ ID NO: 9389824 - DNA, 22 bp, Homo sapiens
aacactttttagtaaagattga

SEQ ID NO: 9389825 - DNA, 22 bp, Homo sapiens
aacactttttagtaaagattga

SEQ ID NO: 9389826 - DNA, 22 bp, Homo sapiens
aacactttgttgcctatgaacg

SEQ ID NO: 9389827 - DNA, 22 bp, Homo sapiens
aacactttttcctcctgtctgg

SEQ ID NO: 9389828 - DNA, 22 bp, Homo sapiens
aacactttggaatagagatagg

SEQ ID NO: 9389829 - DNA, 22 bp, Homo sapiens
aacactttggatgcagaaccaa

SEQ ID NO: 9389830 - DNA, 22 bp, Homo sapiens
aacactttggaatagagatagg

SEQ ID NO: 9389831 - DNA, 22 bp, Homo sapiens
aacactttcttccttgctcagg

SEQ ID NO: 9389832 - DNA, 22 bp, Homo sapiens
aacacagagtatttgaagcatt

SEQ ID NO: 9389833 - DNA, 22 bp, Homo sapiens
aacacagacatagtgattacag

SEQ ID NO: 9389834 - DNA, 22 bp, Homo sapiens
aacacaggaggctatgttttct

SEQ ID NO: 9389835 - DNA, 22 bp, Homo sapiens
aacacagctaatttctgtcaat

SEQ ID NO: 9389836 - DNA, 22 bp, Homo sapiens
aacacaggcatactggctccag

SEQ ID NO: 9389837 - DNA, 22 bp, Homo sapiens
aacacagggactcccaggagaa

SEQ ID NO: 9389838 - DNA, 22 bp, Homo sapiens
aacacagggactcccaggagaa

SEQ ID NO: 9389839 - DNA, 22 bp, Homo sapiens
aacacagggggttacaaattgt

SEQ ID NO: 9389840 - DNA, 22 bp, Homo sapiens
aaatttctaagtcaagaagaac

SEQ ID NO: 9389841 - DNA, 22 bp, Homo sapiens
aaggctggttccatccctggtg

SEQ ID NO: 9389842 - DNA, 22 bp, Homo sapiens
aaatttctaagtcaagaagaac

SEQ ID NO: 9389843 - DNA, 22 bp, Homo sapiens
aaatttctaagtcaagaagaac

SEQ ID NO: 9389844 - DNA, 22 bp, Homo sapiens
aaatttctggaagtgtcagagt

SEQ ID NO: 9389845 - DNA, 22 bp, Homo sapiens
aaatttctggaagtgtcagagt

SEQ ID NO: 9389846 - DNA, 21 bp, Homo sapiens
aaatttctgcaagcctcaact

SEQ ID NO: 9389847 - DNA, 22 bp, Homo sapiens
aaggctggtcagatgtggtgaa

SEQ ID NO: 9389848 - DNA, 22 bp, Homo sapiens
aaggctggtggattatgaggtc

SEQ ID NO: 9389849 - DNA, 22 bp, Homo sapiens
aaggctggtggattatgaggtc

SEQ ID NO: 9389850 - DNA, 22 bp, Homo sapiens
aaggctggtggattatgaggtc

SEQ ID NO: 9389851 - DNA, 22 bp, Homo sapiens
aaggctggttccatccctggtg

SEQ ID NO: 9389852 - DNA, 22 bp, Homo sapiens
aaatttgataagccattgttac

SEQ ID NO: 9389853 - DNA, 22 bp, Homo sapiens
aaatttgataagccattgttac

SEQ ID NO: 9389854 - DNA, 22 bp, Homo sapiens
aaatttcttgaggctctctagc

SEQ ID NO: 9389855 - DNA, 22 bp, Homo sapiens
aaatttctgttgttttgagcca

SEQ ID NO: 9389856 - DNA, 22 bp, Homo sapiens
aaatttctgttgttttgagcca

SEQ ID NO: 9389857 - DNA, 22 bp, Homo sapiens
aaatttctgttgttttgagcca

SEQ ID NO: 9389858 - DNA, 22 bp, Homo sapiens
aaattttaaggctggaacttaa

SEQ ID NO: 9389859 - DNA, 22 bp, Homo sapiens
aaatttgttcaatgtctatttg

SEQ ID NO: 9389860 - DNA, 22 bp, Homo sapiens
aacaatgcttgccaagtgtgat

SEQ ID NO: 9389861 - DNA, 22 bp, Homo sapiens
aaggcagccctggctcagcctg

SEQ ID NO: 9389862 - DNA, 22 bp, Homo sapiens
aaattattcaaaaagctgtgtt

SEQ ID NO: 9389863 - DNA, 22 bp, Homo sapiens
aaattattcaaaaagctgtgtt

SEQ ID NO: 9389864 - DNA, 22 bp, Homo sapiens
aaggcagatataaagactagag

SEQ ID NO: 9389865 - DNA, 22 bp, Homo sapiens
aaggcacttaacgtgggaggat

SEQ ID NO: 9389866 - DNA, 22 bp, Homo sapiens
aaggcagatataaagactagag

SEQ ID NO: 9389867 - DNA, 22 bp, Homo sapiens
aaggcagcaggatttggtgact

SEQ ID NO: 9389868 - DNA, 22 bp, Homo sapiens
aaggctgggtttgggatgtgat

SEQ ID NO: 9389869 - DNA, 22 bp, Homo sapiens
aaggctgggtttgggatgtgat

SEQ ID NO: 9389870 - DNA, 22 bp, Homo sapiens
aaggctgggtttgggatgtgat

SEQ ID NO: 9389871 - DNA, 22 bp, Homo sapiens
aaggctgggtttgggatgtgat

SEQ ID NO: 9389872 - DNA, 22 bp, Homo sapiens
aaggctggtcagatgtggtgaa

SEQ ID NO: 9389873 - DNA, 19 bp, Homo sapiens
aaggctggtaccataggtt

SEQ ID NO: 9389874 - DNA, 22 bp, Homo sapiens
aaggctggggtgcagacggcct

SEQ ID NO: 9389875 - DNA, 22 bp, Homo sapiens
aaggctgggtaacctgtccact

SEQ ID NO: 9389876 - DNA, 22 bp, Homo sapiens
aaggctgggtaacctgtccact

SEQ ID NO: 9389877 - DNA, 22 bp, Homo sapiens
aaattattctcatgtgtttctt

SEQ ID NO: 9389878 - DNA, 18 bp, Homo sapiens
aaattattcttccttttc

SEQ ID NO: 9389879 - DNA, 22 bp, Homo sapiens
aaattattttcagaatggagaa

SEQ ID NO: 9389880 - DNA, 22 bp, Homo sapiens
aaattcacaagagcattgcctg

SEQ ID NO: 9389881 - DNA, 22 bp, Homo sapiens
aaggaagatatatcaagcttaa

SEQ ID NO: 9389882 - DNA, 22 bp, Homo sapiens
aaatgtcaaggtgatagatgca

SEQ ID NO: 9389883 - DNA, 22 bp, Homo sapiens
aaatgtcaaggtgatagatgca

SEQ ID NO: 9389884 - DNA, 22 bp, Homo sapiens
aaggaagagtctagaacaggca

SEQ ID NO: 9389885 - DNA, 22 bp, Homo sapiens
aaggaagagtctagaacaggca

SEQ ID NO: 9389886 - DNA, 22 bp, Homo sapiens
aaggaagagtctagaacaggca

SEQ ID NO: 9389887 - DNA, 22 bp, Homo sapiens
aaatgcattggtttctacttgt

SEQ ID NO: 9389888 - DNA, 22 bp, Homo sapiens
aaatgcattggtttctacttgt

SEQ ID NO: 9389889 - DNA, 22 bp, Homo sapiens
aaatgcatttcactaatgtttc

SEQ ID NO: 9389890 - DNA, 22 bp, Homo sapiens
aaatgcatgtatgtaatatgct

SEQ ID NO: 9389891 - DNA, 22 bp, Homo sapiens
aaatgcatgtatgtaatatgct

SEQ ID NO: 9389892 - DNA, 22 bp, Homo sapiens
aaatgcattctgttttcactag

SEQ ID NO: 9389893 - DNA, 22 bp, Homo sapiens
aaatgcattaagtcagaacaat

SEQ ID NO: 9389894 - DNA, 22 bp, Homo sapiens
aaggaagagaatccttctcaga

SEQ ID NO: 9389895 - DNA, 22 bp, Homo sapiens
aaggaagagaatccttctcaga

SEQ ID NO: 9389896 - DNA, 22 bp, Homo sapiens
aaggaagacttgagaaggttcc

SEQ ID NO: 9389897 - DNA, 22 bp, Homo sapiens
aaggaagactcgcaggtctatg

SEQ ID NO: 9389898 - DNA, 22 bp, Homo sapiens
aaggaagacacagatgaagtga

SEQ ID NO: 9389899 - DNA, 22 bp, Homo sapiens
aaggaaagacaggacggaattc

SEQ ID NO: 9389900 - DNA, 22 bp, Homo sapiens
aactagtttagctttttaagac

SEQ ID NO: 9389901 - DNA, 22 bp, Homo sapiens
aactagtcagtgattctcagaa

SEQ ID NO: 9389902 - DNA, 22 bp, Homo sapiens
aactagctttagttttggaagg

SEQ ID NO: 9389903 - DNA, 22 bp, Homo sapiens
aactagctggattagtgttttc

SEQ ID NO: 9389904 - DNA, 22 bp, Homo sapiens
aactagaacgtctagttgctgg

SEQ ID NO: 9389905 - DNA, 22 bp, Homo sapiens
aactagagcttccagcttcttg

SEQ ID NO: 9389906 - DNA, 18 bp, Homo sapiens
aactagagggctgtcaat

SEQ ID NO: 9389907 - DNA, 22 bp, Homo sapiens
aatggccatatcattgcagagc

SEQ ID NO: 9389908 - DNA, 22 bp, Homo sapiens
aatggccagctgggagagttga

SEQ ID NO: 9389909 - DNA, 22 bp, Homo sapiens
aactagttttagctctagcaac

SEQ ID NO: 9389910 - DNA, 22 bp, Homo sapiens
aatgctttctcagagtccttca

SEQ ID NO: 9389911 - DNA, 22 bp, Homo sapiens
aatggcttctttttggtataat

SEQ ID NO: 9389912 - DNA, 22 bp, Homo sapiens
aatggctgttctctgtgattgg

SEQ ID NO: 9389913 - DNA, 22 bp, Homo sapiens
aatggctgggtttcattttgta

SEQ ID NO: 9389914 - DNA, 18 bp, Homo sapiens
aatggctgggttgttgcc

SEQ ID NO: 9389915 - DNA, 22 bp, Homo sapiens
aatggctgttatttcagcagat

SEQ ID NO: 9389916 - DNA, 22 bp, Homo sapiens
aatggctgccagggcaggaggt

SEQ ID NO: 9389917 - DNA, 22 bp, Homo sapiens
aatggctgccagggcaggaggt

SEQ ID NO: 9389918 - DNA, 22 bp, Homo sapiens
aatggctgatgccaggtctagg

SEQ ID NO: 9389919 - DNA, 22 bp, Homo sapiens
aatggctgatgtttctgatgac

SEQ ID NO: 9389920 - DNA, 22 bp, Homo sapiens
aatggctgaatgagtgaactag

SEQ ID NO: 9389921 - DNA, 21 bp, Homo sapiens
aatggctgggcaaggtctctc

SEQ ID NO: 9389922 - DNA, 22 bp, Homo sapiens
aatggctgccagggcaggaggt

SEQ ID NO: 9389923 - DNA, 22 bp, Homo sapiens
aatggctgggagtgtattttgg

SEQ ID NO: 9389924 - DNA, 21 bp, Homo sapiens
aatggctgggcaaggtctctc

SEQ ID NO: 9389925 - DNA, 22 bp, Homo sapiens
aatggctgaaacataatagaag

SEQ ID NO: 9389926 - DNA, 22 bp, Homo sapiens
aatggctgaatgagtgaactag

SEQ ID NO: 9389927 - DNA, 22 bp, Homo sapiens
aatggctgaagaagtgtggcca

SEQ ID NO: 9389928 - DNA, 22 bp, Homo sapiens
aatgacatgctttttaattata

SEQ ID NO: 9389929 - DNA, 23 bp, Homo sapiens
aatgacagtgtgtgattgaagaa

SEQ ID NO: 9389930 - DNA, 22 bp, Homo sapiens
aatgacagagcactgaacttgg

SEQ ID NO: 9389931 - DNA, 22 bp, Homo sapiens
aatgacagagatagaagggatg

SEQ ID NO: 9389932 - DNA, 22 bp, Homo sapiens
aatgacaatattaatttggagg

SEQ ID NO: 9389933 - DNA, 21 bp, Homo sapiens
aatgacagccagatcctttta

SEQ ID NO: 9389934 - DNA, 22 bp, Homo sapiens
aatgacagagcactgaacttgg

SEQ ID NO: 9389935 - DNA, 23 bp, Homo sapiens
aatgacaggcaatgtaattgtgt

SEQ ID NO: 9389936 - DNA, 22 bp, Homo sapiens
aatgacagccctctagtctggg

SEQ ID NO: 9389937 - DNA, 22 bp, Homo sapiens
aacctcaggctctctggacaat

SEQ ID NO: 9389938 - DNA, 22 bp, Homo sapiens
aacctgaaactacattcttgat

SEQ ID NO: 9389939 - DNA, 22 bp, Homo sapiens
aacctcaaactcttgggcttaa

SEQ ID NO: 9389940 - DNA, 22 bp, Homo sapiens
aacctagggcatgaggatggtt

SEQ ID NO: 9389941 - DNA, 22 bp, Homo sapiens
aaccctggggctgctctgcctg

SEQ ID NO: 9389942 - DNA, 22 bp, Homo sapiens
aaccctgggtcggcaccatttt

SEQ ID NO: 9389943 - DNA, 22 bp, Homo sapiens
aaccctaggtggcagaggttgc

SEQ ID NO: 9389944 - DNA, 22 bp, Homo sapiens
aaccctctcttattctttgcca

SEQ ID NO: 9389945 - DNA, 22 bp, Homo sapiens
aaccctgggaggcagctcagtt

SEQ ID NO: 9389946 - DNA, 22 bp, Homo sapiens
aacccgggaggcggaggttgtg

SEQ ID NO: 9389947 - DNA, 22 bp, Homo sapiens
aacccgggaggcggaggttgtg

SEQ ID NO: 9389948 - DNA, 22 bp, Homo sapiens
aacccgggaggtggaggttatg

SEQ ID NO: 9389949 - DNA, 22 bp, Homo sapiens
aacccgggaggtggaggttatg

SEQ ID NO: 9389950 - DNA, 22 bp, Homo sapiens
aacccacaaaggatttcagctc

SEQ ID NO: 9389951 - DNA, 22 bp, Homo sapiens
aacatgtgtcttgcatttcttg

SEQ ID NO: 9389952 - DNA, 22 bp, Homo sapiens
aacatgtgtctggctagattgt

SEQ ID NO: 9389953 - DNA, 22 bp, Homo sapiens
aacatgtgtctggctagattgt

SEQ ID NO: 9389954 - DNA, 22 bp, Homo sapiens
aacatgtgtcttgcatttcttg

SEQ ID NO: 9389955 - DNA, 22 bp, Homo sapiens
aacctttgaggggagctctttc

SEQ ID NO: 9389956 - DNA, 22 bp, Homo sapiens
aatgaattcgagtgaaggaaag

SEQ ID NO: 9389957 - DNA, 22 bp, Homo sapiens
aatgaattcgagtgaaggaaag

SEQ ID NO: 9389958 - DNA, 22 bp, Homo sapiens
aatgaattcgagtgaaggaaag

SEQ ID NO: 9389959 - DNA, 22 bp, Homo sapiens
aacctgctttctcagagaaggg

SEQ ID NO: 9389960 - DNA, 22 bp, Homo sapiens
aacctgaatttaattgaaatga

SEQ ID NO: 9389961 - DNA, 22 bp, Homo sapiens
aacctggagcaccctcatatct

SEQ ID NO: 9389962 - DNA, 22 bp, Homo sapiens
aacctggaggctgtgtagtctt

SEQ ID NO: 9389963 - DNA, 22 bp, Homo sapiens
aacctgttttcttctcatctag

SEQ ID NO: 9389964 - DNA, 22 bp, Homo sapiens
aacatcagcacacaatagcaag

SEQ ID NO: 9389965 - DNA, 22 bp, Homo sapiens
aacatcagcacacaatagcaag

SEQ ID NO: 9389966 - DNA, 22 bp, Homo sapiens
aacatcatcctttgagtattta

SEQ ID NO: 9389967 - DNA, 22 bp, Homo sapiens
aacatcatcctttgagtattta

SEQ ID NO: 9389968 - DNA, 22 bp, Homo sapiens
aacatcatcctttgagtattta

SEQ ID NO: 9389969 - DNA, 22 bp, Homo sapiens
aacatatttggctgatattccc

SEQ ID NO: 9389970 - DNA, 22 bp, Homo sapiens
aacatatcataggatgtcattg

SEQ ID NO: 9389971 - DNA, 22 bp, Homo sapiens
aacataaatttgaagtggcaaa

SEQ ID NO: 9389972 - DNA, 22 bp, Homo sapiens
aacataaatttgaagtggcaaa

SEQ ID NO: 9389973 - DNA, 22 bp, Homo sapiens
aacatataaactcttaagttca

SEQ ID NO: 9389974 - DNA, 22 bp, Homo sapiens
aacagctgttcgcagatgtagg

SEQ ID NO: 9389975 - DNA, 22 bp, Homo sapiens
aagtgcttgatcatagttctca

SEQ ID NO: 9389976 - DNA, 22 bp, Homo sapiens
aagtgcttctgggattaggagt

SEQ ID NO: 9389977 - DNA, 22 bp, Homo sapiens
aagtgcttggattgcaggtatg

SEQ ID NO: 9389978 - DNA, 22 bp, Homo sapiens
aagtgggtttgaaatgctttca

SEQ ID NO: 9389979 - DNA, 20 bp, Homo sapiens
aagtgggtttattctttttc

SEQ ID NO: 9389980 - DNA, 22 bp, Homo sapiens
aagtgggttggacaaatgaccc

SEQ ID NO: 9389981 - DNA, 23 bp, Homo sapiens
aagtgggtttagacagtcatttt

SEQ ID NO: 9389982 - DNA, 22 bp, Homo sapiens
aagtggttattttgatctagaa

SEQ ID NO: 9389983 - DNA, 22 bp, Homo sapiens
aagtggtagagagagcataagc

SEQ ID NO: 9389984 - DNA, 20 bp, Homo sapiens
aagtggtcacagtccttggc

SEQ ID NO: 9389985 - DNA, 22 bp, Homo sapiens
aagtggtaggaagagagcactg

SEQ ID NO: 9389986 - DNA, 22 bp, Homo sapiens
aagtggtttgattcagtttatg

SEQ ID NO: 9389987 - DNA, 23 bp, Homo sapiens
aagtggttttgaacccggaccct

SEQ ID NO: 9389988 - DNA, 22 bp, Homo sapiens
aagtggttttaagaggttcctt

SEQ ID NO: 9389989 - DNA, 21 bp, Homo sapiens
aagtggtttacatccagctgt

SEQ ID NO: 9389990 - DNA, 21 bp, Homo sapiens
aagtggtttaggttaccgggg

SEQ ID NO: 9389991 - DNA, 22 bp, Homo sapiens
aagtggtttgagcacagtgctg

SEQ ID NO: 9389992 - DNA, 22 bp, Homo sapiens
aagtggtttgattcagtttatg

SEQ ID NO: 9389993 - DNA, 21 bp, Homo sapiens
aagtggtttacatccagctgt

SEQ ID NO: 9389994 - DNA, 22 bp, Homo sapiens
aagtggttgcttgtgagtcccc

SEQ ID NO: 9389995 - DNA, 22 bp, Homo sapiens
aacagctgcttcagtacttgaa

SEQ ID NO: 9389996 - DNA, 22 bp, Homo sapiens
aacagctattcactactatggg

SEQ ID NO: 9389997 - DNA, 22 bp, Homo sapiens
aacagctagtggtctagacttt

SEQ ID NO: 9389998 - DNA, 22 bp, Homo sapiens
aacagctagtaccaatccacta

SEQ ID NO: 9389999 - DNA, 22 bp, Homo sapiens
aacagctattagaacttcatgg

SEQ ID NO: 9390000 - DNA, 22 bp, Homo sapiens
aacagctagtggtctagacttt

SEQ ID NO: 9390001 - DNA, 22 bp, Homo sapiens
aagtgtcctcattcaacatgca

SEQ ID NO: 9390002 - DNA, 22 bp, Homo sapiens
aagtgtataacgacctacagga

SEQ ID NO: 9390003 - DNA, 22 bp, Homo sapiens
aagtgtctagcacctggatgca

SEQ ID NO: 9390004 - DNA, 22 bp, Homo sapiens
aagtgtctaactggttacttct

SEQ ID NO: 9390005 - DNA, 22 bp, Homo sapiens
aagtgtctacatttgctaacca

SEQ ID NO: 9390006 - DNA, 22 bp, Homo sapiens
aacatgtaaccagcattcatct

SEQ ID NO: 9390007 - DNA, 22 bp, Homo sapiens
aacatgtacctacaatcagaat

SEQ ID NO: 9390008 - DNA, 22 bp, Homo sapiens
aacatgtacctacaatcagaat

SEQ ID NO: 9390009 - DNA, 22 bp, Homo sapiens
aacatgtgtctggctagattgt

SEQ ID NO: 9390010 - DNA, 22 bp, Homo sapiens
aacatgtgagcaggttttttat

SEQ ID NO: 9390011 - DNA, 22 bp, Homo sapiens
aacatgtcttactttgctttct

SEQ ID NO: 9390012 - DNA, 22 bp, Homo sapiens
aacatgtctgggtattcacaag

SEQ ID NO: 9390013 - DNA, 22 bp, Homo sapiens
aatagactccagggtctatttt

SEQ ID NO: 9390014 - DNA, 22 bp, Homo sapiens
aatagactttctttttagaaca

SEQ ID NO: 9390015 - DNA, 22 bp, Homo sapiens
aatagatactacttagatgtag

SEQ ID NO: 9390016 - DNA, 22 bp, Homo sapiens
aatagatactacttagatgtag

SEQ ID NO: 9390017 - DNA, 22 bp, Homo sapiens
aacatgaaaacctccacagcaa

SEQ ID NO: 9390018 - DNA, 22 bp, Homo sapiens
aacatgaaaactacctgtgatt

SEQ ID NO: 9390019 - DNA, 22 bp, Homo sapiens
aacatgaaaactacctgtgatt

SEQ ID NO: 9390020 - DNA, 22 bp, Homo sapiens
aacatctttgtagtgttctcct

SEQ ID NO: 9390021 - DNA, 22 bp, Homo sapiens
aacatctttttgtttgctgaaa

SEQ ID NO: 9390022 - DNA, 19 bp, Homo sapiens
aacatctttccagtagagg

SEQ ID NO: 9390023 - DNA, 22 bp, Homo sapiens
aatacatatggaattccatgtt

SEQ ID NO: 9390024 - DNA, 20 bp, Homo sapiens
aatacatgagcacactttca

SEQ ID NO: 9390025 - DNA, 22 bp, Homo sapiens
aacatgaaaagcccagagaggt

SEQ ID NO: 9390026 - DNA, 22 bp, Homo sapiens
aatacatgttttctactattct

SEQ ID NO: 9390027 - DNA, 22 bp, Homo sapiens
aatacatgttttctactattct

SEQ ID NO: 9390028 - DNA, 22 bp, Homo sapiens
aatacatgttttctactattct

SEQ ID NO: 9390029 - DNA, 22 bp, Homo sapiens
aacatctagttcctatataata

SEQ ID NO: 9390030 - DNA, 22 bp, Homo sapiens
aacatctaggttctcatcgata

SEQ ID NO: 9390031 - DNA, 22 bp, Homo sapiens
aacatctagttcctatataata

SEQ ID NO: 9390032 - DNA, 22 bp, Homo sapiens
aacatcttgtcaaatgtccaca

SEQ ID NO: 9390033 - DNA, 22 bp, Homo sapiens
aacatcttgtctaatgtcagct

SEQ ID NO: 9390034 - DNA, 22 bp, Homo sapiens
aagagggctgcaatcttattgc

SEQ ID NO: 9390035 - DNA, 22 bp, Homo sapiens
aagagggaggtgcgggtgcaga

SEQ ID NO: 9390036 - DNA, 22 bp, Homo sapiens
aagagggaggtgcgggtgcaga

SEQ ID NO: 9390037 - DNA, 22 bp, Homo sapiens
aagagggagggcaaaggcactg

SEQ ID NO: 9390038 - DNA, 22 bp, Homo sapiens
aagagggaaattgttggctgct

SEQ ID NO: 9390039 - DNA, 22 bp, Homo sapiens
aagagggaagtcacctggaggt

SEQ ID NO: 9390040 - DNA, 18 bp, Homo sapiens
aagaggaggagcaggttg

SEQ ID NO: 9390041 - DNA, 19 bp, Homo sapiens
aagagggaaagtgctatgc

SEQ ID NO: 9390042 - DNA, 22 bp, Homo sapiens
aagaggggtggtctgtgaggat

SEQ ID NO: 9390043 - DNA, 22 bp, Homo sapiens
aagaggggtggtctgtgaggat

SEQ ID NO: 9390044 - DNA, 17 bp, Homo sapiens
aagaggtaactgtacta

SEQ ID NO: 9390045 - DNA, 22 bp, Homo sapiens
aaatacattagacggagagtta

SEQ ID NO: 9390046 - DNA, 22 bp, Homo sapiens
aaatacattagacggagagtta

SEQ ID NO: 9390047 - DNA, 22 bp, Homo sapiens
aaatacatttacagtcgtggct

SEQ ID NO: 9390048 - DNA, 22 bp, Homo sapiens
aaatacatttacagtcgtggct

SEQ ID NO: 9390049 - DNA, 22 bp, Homo sapiens
aaatactagaattcagagttga

SEQ ID NO: 9390050 - DNA, 22 bp, Homo sapiens
aaatactagaattcagagttga

SEQ ID NO: 9390051 - DNA, 22 bp, Homo sapiens
aaatactagaattcagagttga

SEQ ID NO: 9390052 - DNA, 22 bp, Homo sapiens
aaatactgctgctattcctttt

SEQ ID NO: 9390053 - DNA, 22 bp, Homo sapiens
aaatactgctgctattcctttt

SEQ ID NO: 9390054 - DNA, 22 bp, Homo sapiens
aagatatagatggtggtataaa

SEQ ID NO: 9390055 - DNA, 22 bp, Homo sapiens
aagataaactcttgatttctga

SEQ ID NO: 9390056 - DNA, 22 bp, Homo sapiens
aaatactgggctcaaaagggtt

SEQ ID NO: 9390057 - DNA, 22 bp, Homo sapiens
aagaacatggtaggataacaaa

SEQ ID NO: 9390058 - DNA, 22 bp, Homo sapiens
aagaacatgctataattatctt

SEQ ID NO: 9390059 - DNA, 22 bp, Homo sapiens
aaagtgatgaactctgtgacct

SEQ ID NO: 9390060 - DNA, 22 bp, Homo sapiens
aaagtgatgccaggagtctggt

SEQ ID NO: 9390061 - DNA, 22 bp, Homo sapiens
aaagtgatgccaggagtctggt

SEQ ID NO: 9390062 - DNA, 23 bp, Homo sapiens
aaagtgattagcatttctgcaga

SEQ ID NO: 9390063 - DNA, 23 bp, Homo sapiens
aaagtgattagcatttctgcaga

SEQ ID NO: 9390064 - DNA, 22 bp, Homo sapiens
aaagtgcactctcagtgctgct

SEQ ID NO: 9390065 - DNA, 22 bp, Homo sapiens
aaagtgatttaagtacctcagg

SEQ ID NO: 9390066 - DNA, 22 bp, Homo sapiens
aaagtgatttaagtacctcagg

SEQ ID NO: 9390067 - DNA, 22 bp, Homo sapiens
aaagtgattatgctgtcaaaga

SEQ ID NO: 9390068 - DNA, 19 bp, Homo sapiens
aaagtgattttttctggca

SEQ ID NO: 9390069 - DNA, 22 bp, Homo sapiens
aagactgtacattttccagtct

SEQ ID NO: 9390070 - DNA, 22 bp, Homo sapiens
aagactgagttcaaatcacagc

SEQ ID NO: 9390071 - DNA, 22 bp, Homo sapiens
aaagtttacagtgcacatgggt

SEQ ID NO: 9390072 - DNA, 22 bp, Homo sapiens
aagactgtgtctatggctactc

SEQ ID NO: 9390073 - DNA, 22 bp, Homo sapiens
aagactgtcttttctgagtgac

SEQ ID NO: 9390074 - DNA, 17 bp, Homo sapiens
aagaccctagtctaccc

SEQ ID NO: 9390075 - DNA, 22 bp, Homo sapiens
aagacctgcagtttctctacct

SEQ ID NO: 9390076 - DNA, 22 bp, Homo sapiens
aagacctgcatgcggactaaca

SEQ ID NO: 9390077 - DNA, 22 bp, Homo sapiens
aagaccctatactcagtgaccc

SEQ ID NO: 9390078 - DNA, 22 bp, Homo sapiens
aagactagaccagtgaatagga

SEQ ID NO: 9390079 - DNA, 22 bp, Homo sapiens
aagactagggtgtgtttaatct

SEQ ID NO: 9390080 - DNA, 22 bp, Homo sapiens
aagacctgcgttatcctgcctg

SEQ ID NO: 9390081 - DNA, 22 bp, Homo sapiens
aagacctgggagagattgggtt

SEQ ID NO: 9390082 - DNA, 22 bp, Homo sapiens
aagcccagatgggagcatttca

SEQ ID NO: 9390083 - DNA, 22 bp, Homo sapiens
aaatctctgcaggcaaatgtga

SEQ ID NO: 9390084 - DNA, 22 bp, Homo sapiens
aaatctctgaacttaataatgc

SEQ ID NO: 9390085 - DNA, 22 bp, Homo sapiens
aaatctctggtcacagaactta

SEQ ID NO: 9390086 - DNA, 22 bp, Homo sapiens
aaatctctggcagaaataaact

SEQ ID NO: 9390087 - DNA, 22 bp, Homo sapiens
aaatctgagaaatattgtccag

SEQ ID NO: 9390088 - DNA, 22 bp, Homo sapiens
aaatctctgaacttaataatgc

SEQ ID NO: 9390089 - DNA, 22 bp, Homo sapiens
aagcaggcgagggcctggagca

SEQ ID NO: 9390090 - DNA, 22 bp, Homo sapiens
aagcaggcgagggcctggagca

SEQ ID NO: 9390091 - DNA, 22 bp, Homo sapiens
aagcaggccctgggccagggga

SEQ ID NO: 9390092 - DNA, 22 bp, Homo sapiens
aagcaggcattccagagacaat

SEQ ID NO: 9390093 - DNA, 22 bp, Homo sapiens
aaatgcatggtaaatgattgcc

SEQ ID NO: 9390094 - DNA, 22 bp, Homo sapiens
aaatgcatggtaaatgattgcc

SEQ ID NO: 9390095 - DNA, 22 bp, Homo sapiens
aaatgcatggtaaatgattgcc

SEQ ID NO: 9390096 - DNA, 22 bp, Homo sapiens
aaatgcatggctgttttaaagc

SEQ ID NO: 9390097 - DNA, 22 bp, Homo sapiens
aaatgcatgtagaataatagag

SEQ ID NO: 9390098 - DNA, 22 bp, Homo sapiens
aaatgcatgtagaataatagag

SEQ ID NO: 9390099 - DNA, 22 bp, Homo sapiens
aaatgcatgtagaataatagag

SEQ ID NO: 9390100 - DNA, 22 bp, Homo sapiens
aagcctctggggcctcatctgt

SEQ ID NO: 9390101 - DNA, 22 bp, Homo sapiens
aagcctggcacattggagtctg

SEQ ID NO: 9390102 - DNA, 22 bp, Homo sapiens
aagcctggcacattggagtctg

SEQ ID NO: 9390103 - DNA, 22 bp, Homo sapiens
aagcctggcacattggagtctg

SEQ ID NO: 9390104 - DNA, 22 bp, Homo sapiens
aagcccttggcgcacaccgggc

SEQ ID NO: 9390105 - DNA, 22 bp, Homo sapiens
aagcccttggcagagttcccca

SEQ ID NO: 9390106 - DNA, 22 bp, Homo sapiens
aagcccttccgtgctgctggat

SEQ ID NO: 9390107 - DNA, 22 bp, Homo sapiens
aagccggctgggccgaggctgc

SEQ ID NO: 9390108 - DNA, 22 bp, Homo sapiens
aagatcataatatttatctcat

SEQ ID NO: 9390109 - DNA, 22 bp, Homo sapiens
aagatccatgagggcagagatt

SEQ ID NO: 9390110 - DNA, 22 bp, Homo sapiens
aagatcctgcttttgcttctgt

SEQ ID NO: 9390111 - DNA, 22 bp, Homo sapiens
aagatgtttaggtaaaaagttt

SEQ ID NO: 9390112 - DNA, 22 bp, Homo sapiens
aagatgttgcattagaatacct

SEQ ID NO: 9390113 - DNA, 22 bp, Homo sapiens
aagatatattttggtgatttca

SEQ ID NO: 9390114 - DNA, 22 bp, Homo sapiens
aagatatattttggtgatttca

SEQ ID NO: 9390115 - DNA, 22 bp, Homo sapiens
aagatattcaaagatttattag

SEQ ID NO: 9390116 - DNA, 22 bp, Homo sapiens
aagatattttagaacattcact

SEQ ID NO: 9390117 - DNA, 22 bp, Homo sapiens
aagatattcaaagatttattag

SEQ ID NO: 9390118 - DNA, 22 bp, Homo sapiens
aagatattcaaagatttattag

SEQ ID NO: 9390119 - DNA, 22 bp, Homo sapiens
aagatcaccttgacatgaaaag

SEQ ID NO: 9390120 - DNA, 22 bp, Homo sapiens
aagatcaagatcagagaacagc

SEQ ID NO: 9390121 - DNA, 22 bp, Homo sapiens
aagattatggcagataacaatt

SEQ ID NO: 9390122 - DNA, 22 bp, Homo sapiens
aagattagacaggattatgcat

SEQ ID NO: 9390123 - DNA, 22 bp, Homo sapiens
aagattatggcagataacaatt

SEQ ID NO: 9390124 - DNA, 22 bp, Homo sapiens
aagcagcatagctcccttagtt

SEQ ID NO: 9390125 - DNA, 22 bp, Homo sapiens
aagcagcatatgacagcatcca

SEQ ID NO: 9390126 - DNA, 22 bp, Homo sapiens
aagcaggatggatctagtgttc

SEQ ID NO: 9390127 - DNA, 22 bp, Homo sapiens
aagcaggcaaggttgtggggca

SEQ ID NO: 9390128 - DNA, 22 bp, Homo sapiens
aagcaggcaaggttgtggggca

SEQ ID NO: 9390129 - DNA, 22 bp, Homo sapiens
aagcaggcagggtggagagttt

SEQ ID NO: 9390130 - DNA, 22 bp, Homo sapiens
aagcaggcaaggttgtggggca

SEQ ID NO: 9390131 - DNA, 22 bp, Homo sapiens
aagcaggcatcttggaggtcaa

SEQ ID NO: 9390132 - DNA, 22 bp, Homo sapiens
aagcaggcatcttggaggtcaa

SEQ ID NO: 9390133 - DNA, 22 bp, Homo sapiens
aagcaggcatgggaggccatcc

SEQ ID NO: 9390134 - DNA, 22 bp, Homo sapiens
aagcaggcatgggaggccatcc

SEQ ID NO: 9390135 - DNA, 22 bp, Homo sapiens
aagcaggcatcttggaggtcaa

SEQ ID NO: 9390136 - DNA, 22 bp, Homo sapiens
aactgtaatgaattgttcatga

SEQ ID NO: 9390137 - DNA, 22 bp, Homo sapiens
aactgtaatttttacatagtaa

SEQ ID NO: 9390138 - DNA, 22 bp, Homo sapiens
aactgtagaagggacacaaaag

SEQ ID NO: 9390139 - DNA, 22 bp, Homo sapiens
aactgtaagaaataaaattctg

SEQ ID NO: 9390140 - DNA, 22 bp, Homo sapiens
aactgtaaggcttagaacagca

SEQ ID NO: 9390141 - DNA, 22 bp, Homo sapiens
aactgtctaaggagaatatgaa

SEQ ID NO: 9390142 - DNA, 23 bp, Homo sapiens
aactgtcttgcaagtgtgatacc

SEQ ID NO: 9390143 - DNA, 22 bp, Homo sapiens
aactgtcttgcctactcagcat

SEQ ID NO: 9390144 - DNA, 22 bp, Homo sapiens
aaaggttttggtaaggctttaa

SEQ ID NO: 9390145 - DNA, 22 bp, Homo sapiens
aaaggttttggtaaggctttaa

SEQ ID NO: 9390146 - DNA, 22 bp, Homo sapiens
aaaggttttctgacccttagta

SEQ ID NO: 9390147 - DNA, 22 bp, Homo sapiens
aaaggttttctgacccttagta

SEQ ID NO: 9390148 - DNA, 22 bp, Homo sapiens
aaaggttttgccctgggtattc

SEQ ID NO: 9390149 - DNA, 22 bp, Homo sapiens
aaaggttttgccctgggtattc

SEQ ID NO: 9390150 - DNA, 22 bp, Homo sapiens
aaaggttttctagggttgaggg

SEQ ID NO: 9390151 - DNA, 22 bp, Homo sapiens
aaaggttttctagggttgaggg

SEQ ID NO: 9390152 - DNA, 22 bp, Homo sapiens
aactgtggcatgttgaatttgt

SEQ ID NO: 9390153 - DNA, 22 bp, Homo sapiens
aaaggtttttcagcagggagat

SEQ ID NO: 9390154 - DNA, 22 bp, Homo sapiens
aaagtaacctagtaatagtgtc

SEQ ID NO: 9390155 - DNA, 22 bp, Homo sapiens
aaaggttttgttcatcgatttt

SEQ ID NO: 9390156 - DNA, 22 bp, Homo sapiens
aaaggtttttatttatcctgga

SEQ ID NO: 9390157 - DNA, 22 bp, Homo sapiens
aaaggttttgttcatcgatttt

SEQ ID NO: 9390158 - DNA, 22 bp, Homo sapiens
aaaggtttttcagcagggagat

SEQ ID NO: 9390159 - DNA, 22 bp, Homo sapiens
aaaggtttttatttatcctgga

SEQ ID NO: 9390160 - DNA, 22 bp, Homo sapiens
aagaaataagacttctctgtcc

SEQ ID NO: 9390161 - DNA, 22 bp, Homo sapiens
aagaaataagacttctctgtcc

SEQ ID NO: 9390162 - DNA, 22 bp, Homo sapiens
aaagtaattgcagtttctgcca

SEQ ID NO: 9390163 - DNA, 22 bp, Homo sapiens
aaagtaagggttaatctacttt

SEQ ID NO: 9390164 - DNA, 22 bp, Homo sapiens
aaagtaagaccaagtgatcatt

SEQ ID NO: 9390165 - DNA, 22 bp, Homo sapiens
aaagtaagatttgcatttcaga

SEQ ID NO: 9390166 - DNA, 22 bp, Homo sapiens
aaagtaattaagaagctggaca

SEQ ID NO: 9390167 - DNA, 22 bp, Homo sapiens
aaagtaattgcagtttctgcca

SEQ ID NO: 9390168 - DNA, 22 bp, Homo sapiens
aagaacatgaacacaatgttta

SEQ ID NO: 9390169 - DNA, 22 bp, Homo sapiens
aagaacatgaacctcttctaac

SEQ ID NO: 9390170 - DNA, 22 bp, Homo sapiens
aagaacatgaacctcttctaac

SEQ ID NO: 9390171 - DNA, 22 bp, Homo sapiens
aagaacatgaagtcacaaatgc

SEQ ID NO: 9390172 - DNA, 22 bp, Homo sapiens
aagaacagttgggaggtgagcc

SEQ ID NO: 9390173 - DNA, 22 bp, Homo sapiens
aagaacataacagaagctgtgt

SEQ ID NO: 9390174 - DNA, 22 bp, Homo sapiens
aagaacataaacagaaggacag

SEQ ID NO: 9390175 - DNA, 18 bp, Homo sapiens
aaaggcatatatagaagt

SEQ ID NO: 9390176 - DNA, 19 bp, Homo sapiens
aaaggcagtgggtggcgtg

SEQ ID NO: 9390177 - DNA, 22 bp, Homo sapiens
aaaggcaggctttcacatctca

SEQ ID NO: 9390178 - DNA, 23 bp, Homo sapiens
aaaggcaggcctaggacatattg

SEQ ID NO: 9390179 - DNA, 22 bp, Homo sapiens
aaaggcagtgggtatgtggatc

SEQ ID NO: 9390180 - DNA, 22 bp, Homo sapiens
aaaggcagtgggtatgtggatc

SEQ ID NO: 9390181 - DNA, 22 bp, Homo sapiens
aaaggcagagttgttggaggca

SEQ ID NO: 9390182 - DNA, 22 bp, Homo sapiens
aacccgggaggcagaggttgtg

SEQ ID NO: 9390183 - DNA, 22 bp, Homo sapiens
aacccgggaggcagaggttgtg

SEQ ID NO: 9390184 - DNA, 22 bp, Homo sapiens
aaccccgctcaggctgggtgag

SEQ ID NO: 9390185 - DNA, 22 bp, Homo sapiens
aaccccaacacaggaaatatct

SEQ ID NO: 9390186 - DNA, 22 bp, Homo sapiens
aacccagagctggaggagagta

SEQ ID NO: 9390187 - DNA, 22 bp, Homo sapiens
aacccaggacagagctttgtgg

SEQ ID NO: 9390188 - DNA, 22 bp, Homo sapiens
aacccaggagacggagtttgtg

SEQ ID NO: 9390189 - DNA, 22 bp, Homo sapiens
aacccaggagatggaggttgtg

SEQ ID NO: 9390190 - DNA, 22 bp, Homo sapiens
aacccaggaggcagaggctgca

SEQ ID NO: 9390191 - DNA, 22 bp, Homo sapiens
aacccaggagccggaggttgtg

SEQ ID NO: 9390192 - DNA, 22 bp, Homo sapiens
aacccatgttggaagcttatca

SEQ ID NO: 9390193 - DNA, 22 bp, Homo sapiens
aacccaggtctttggcttccag

SEQ ID NO: 9390194 - DNA, 22 bp, Homo sapiens
aacccagggtgaggggagtcta

SEQ ID NO: 9390195 - DNA, 22 bp, Homo sapiens
aacccagggtgaggggagtcta

SEQ ID NO: 9390196 - DNA, 22 bp, Homo sapiens
aacccaggaggcagatgttgtg

SEQ ID NO: 9390197 - DNA, 22 bp, Homo sapiens
aacccaggaggcggaggttgtg

SEQ ID NO: 9390198 - DNA, 22 bp, Homo sapiens
aacccaggaggtggaggttgtg

SEQ ID NO: 9390199 - DNA, 22 bp, Homo sapiens
aacccaggagttggaggctgtg

SEQ ID NO: 9390200 - DNA, 22 bp, Homo sapiens
aaagcctcccaggttatgagta

SEQ ID NO: 9390201 - DNA, 22 bp, Homo sapiens
aaagcctgggttcctcactatc

SEQ ID NO: 9390202 - DNA, 22 bp, Homo sapiens
aacatttgtttcgttatgtgaa

SEQ ID NO: 9390203 - DNA, 22 bp, Homo sapiens
aacccacaagcagctgtagccc

SEQ ID NO: 9390204 - DNA, 16 bp, Homo sapiens
aacccacagctcccga

SEQ ID NO: 9390205 - DNA, 22 bp, Homo sapiens
aacatacagtgagcagtggact

SEQ ID NO: 9390206 - DNA, 22 bp, Homo sapiens
aacatacagtgagcagtggact

SEQ ID NO: 9390207 - DNA, 22 bp, Homo sapiens
aacatacttatactaaataatg

SEQ ID NO: 9390208 - DNA, 22 bp, Homo sapiens
aaagcctcccaggttatgagta

SEQ ID NO: 9390209 - DNA, 22 bp, Homo sapiens
aaagccattacaaaatttcata

SEQ ID NO: 9390210 - DNA, 22 bp, Homo sapiens
aaagccattgcagagcaggatt

SEQ ID NO: 9390211 - DNA, 22 bp, Homo sapiens
aacatataaactcttaagttca

SEQ ID NO: 9390212 - DNA, 22 bp, Homo sapiens
aacatataaactcttaagttca

SEQ ID NO: 9390213 - DNA, 22 bp, Homo sapiens
aacatagacccagttcaacaaa

SEQ ID NO: 9390214 - DNA, 22 bp, Homo sapiens
aacatagcgagacactgtgtct

SEQ ID NO: 9390215 - DNA, 22 bp, Homo sapiens
aaagcagaggttgcagtgagct

SEQ ID NO: 9390216 - DNA, 19 bp, Homo sapiens
aaagcagaggagcatctga

SEQ ID NO: 9390217 - DNA, 22 bp, Homo sapiens
aaagcagaggtgatatgactta

SEQ ID NO: 9390218 - DNA, 22 bp, Homo sapiens
aaagcagattctgatgcagtag

SEQ ID NO: 9390219 - DNA, 22 bp, Homo sapiens
aacataagggagcttcaaaact

SEQ ID NO: 9390220 - DNA, 22 bp, Homo sapiens
aacactttcctgcctttctgat

SEQ ID NO: 9390221 - DNA, 22 bp, Homo sapiens
aaagcactttgagactgacagg

SEQ ID NO: 9390222 - DNA, 22 bp, Homo sapiens
aaagcacttgaaatctggcagt

SEQ ID NO: 9390223 - DNA, 22 bp, Homo sapiens
aaagcagaactgagagagctgg

SEQ ID NO: 9390224 - DNA, 22 bp, Homo sapiens
aaagcagagcagggcacttatg

SEQ ID NO: 9390225 - DNA, 22 bp, Homo sapiens
aaagcagagatcatggcttgta

SEQ ID NO: 9390226 - DNA, 22 bp, Homo sapiens
aaagcagactgatttgcatcac

SEQ ID NO: 9390227 - DNA, 22 bp, Homo sapiens
aaagcaagtctctacaaagtac

SEQ ID NO: 9390228 - DNA, 23 bp, Homo sapiens
aacaccaaggctcagagagataa

SEQ ID NO: 9390229 - DNA, 22 bp, Homo sapiens
aacactgtcagcctttgatgga

SEQ ID NO: 9390230 - DNA, 22 bp, Homo sapiens
aacactgtatcagtcttcaata

SEQ ID NO: 9390231 - DNA, 22 bp, Homo sapiens
aacactgtcttatacttcaatg

SEQ ID NO: 9390232 - DNA, 23 bp, Homo sapiens
aaagcaaggaattggcaacagag

SEQ ID NO: 9390233 - DNA, 22 bp, Homo sapiens
aaagcaaacagaaccccaagct

SEQ ID NO: 9390234 - DNA, 22 bp, Homo sapiens
aacactgtgctccccaggctgt

SEQ ID NO: 9390235 - DNA, 22 bp, Homo sapiens
aacactgtggtcttttcagtaa

SEQ ID NO: 9390236 - DNA, 22 bp, Homo sapiens
aacactgtggtcttttcagtaa

SEQ ID NO: 9390237 - DNA, 20 bp, Homo sapiens
aacactgtgcgtggtaggtg

SEQ ID NO: 9390238 - DNA, 22 bp, Homo sapiens
aacactgtcttatacttcaatg

SEQ ID NO: 9390239 - DNA, 22 bp, Homo sapiens
aacactgtgcccaccctagtcc

SEQ ID NO: 9390240 - DNA, 22 bp, Homo sapiens
aacactgtgcagtgtaatgctg

SEQ ID NO: 9390241 - DNA, 22 bp, Homo sapiens
aacactgtgcccaccctagtcc

SEQ ID NO: 9390242 - DNA, 22 bp, Homo sapiens
aacactgtgaggtaatgaccta

SEQ ID NO: 9390243 - DNA, 22 bp, Homo sapiens
aaagatttaagaataatttgtg

SEQ ID NO: 9390244 - DNA, 22 bp, Homo sapiens
aaagatttcagaagcctgtgcc

SEQ ID NO: 9390245 - DNA, 22 bp, Homo sapiens
aaagatttgaaattaggcatca

SEQ ID NO: 9390246 - DNA, 22 bp, Homo sapiens
aaagatttatgaagttcaatta

SEQ ID NO: 9390247 - DNA, 22 bp, Homo sapiens
aaagatttcacatcccaagcct

SEQ ID NO: 9390248 - DNA, 22 bp, Homo sapiens
aaagatttgagttctgcttata

SEQ ID NO: 9390249 - DNA, 22 bp, Homo sapiens
aaagatgtttgttccaaaattc

SEQ ID NO: 9390250 - DNA, 22 bp, Homo sapiens
aaactgcatgaagctgatttta

SEQ ID NO: 9390251 - DNA, 23 bp, Homo sapiens
aaactgcttccaattcctgccat

SEQ ID NO: 9390252 - DNA, 22 bp, Homo sapiens
aaactgctggttgctggccagc

SEQ ID NO: 9390253 - DNA, 22 bp, Homo sapiens
aaactgcatgaagctgatttta

SEQ ID NO: 9390254 - DNA, 17 bp, Homo sapiens
aaactggggtcaggagc

SEQ ID NO: 9390255 - DNA, 22 bp, Homo sapiens
aaactgctttccacagtggcta

SEQ ID NO: 9390256 - DNA, 22 bp, Homo sapiens
aaactggattaccaggctggtg

SEQ ID NO: 9390257 - DNA, 18 bp, Homo sapiens
aaactggcttggcctgtg

SEQ ID NO: 9390258 - DNA, 22 bp, Homo sapiens
aaaatatgtataactcttctgc

SEQ ID NO: 9390259 - DNA, 20 bp, Homo sapiens
aaaatatgtataactcttct

SEQ ID NO: 9390260 - DNA, 22 bp, Homo sapiens
aaaatatgtataactcttctgc

SEQ ID NO: 9390261 - DNA, 22 bp, Homo sapiens
aaaatattttagggccaggaga

SEQ ID NO: 9390262 - DNA, 22 bp, Homo sapiens
aaaatattttagggccaggaga

SEQ ID NO: 9390263 - DNA, 22 bp, Homo sapiens
aaaatattttagggccaggaga

SEQ ID NO: 9390264 - DNA, 22 bp, Homo sapiens
aaaatattttagggccaggaga

SEQ ID NO: 9390265 - DNA, 22 bp, Homo sapiens
aaaatattttagggccaggaga

SEQ ID NO: 9390266 - DNA, 22 bp, Homo sapiens
aaacagtattatcaatatattt

SEQ ID NO: 9390267 - DNA, 22 bp, Homo sapiens
aaacacatcattcatgtcgtca

SEQ ID NO: 9390268 - DNA, 22 bp, Homo sapiens
aaacacaagaggcagggtacag

SEQ ID NO: 9390269 - DNA, 22 bp, Homo sapiens
aaagagctggcatttatagtct

SEQ ID NO: 9390270 - DNA, 22 bp, Homo sapiens
aaagagctgggacttaaagtgc

SEQ ID NO: 9390271 - DNA, 22 bp, Homo sapiens
aaagagctgatagcatctgttt

SEQ ID NO: 9390272 - DNA, 22 bp, Homo sapiens
aaagagctcttactctagtgta

SEQ ID NO: 9390273 - DNA, 22 bp, Homo sapiens
aaagagctcttactctagtgta

SEQ ID NO: 9390274 - DNA, 22 bp, Homo sapiens
aaacaccagtcccagtatacac

SEQ ID NO: 9390275 - DNA, 22 bp, Homo sapiens
aaacaccaagagctagctatta

SEQ ID NO: 9390276 - DNA, 22 bp, Homo sapiens
aaacactcatgtgttactctcc

SEQ ID NO: 9390277 - DNA, 22 bp, Homo sapiens
aaacaccaagagctagctatta

SEQ ID NO: 9390278 - DNA, 22 bp, Homo sapiens
aaacacattttaggaaaatcta

SEQ ID NO: 9390279 - DNA, 22 bp, Homo sapiens
aaaattctcttgatcttgacag

SEQ ID NO: 9390280 - DNA, 22 bp, Homo sapiens
aaaattctcttgatcttgacag

SEQ ID NO: 9390281 - DNA, 22 bp, Homo sapiens
aaaattctcttgatcttgacag

SEQ ID NO: 9390282 - DNA, 22 bp, Homo sapiens
aaaattctaacatgcagccaag

SEQ ID NO: 9390283 - DNA, 17 bp, Homo sapiens
aaaattctgtaaagagg

SEQ ID NO: 9390284 - DNA, 17 bp, Homo sapiens
aaaattctgtaaagagg

SEQ ID NO: 9390285 - DNA, 22 bp, Homo sapiens
aaaattgagagtcttgtgcaag

SEQ ID NO: 9390286 - DNA, 22 bp, Homo sapiens
aaaattgaagtgatcaggaact

SEQ ID NO: 9390287 - DNA, 22 bp, Homo sapiens
aaaattgaagtgatcaggaact

SEQ ID NO: 9390288 - DNA, 22 bp, Homo sapiens
aaaattgagagttatagatggt

SEQ ID NO: 9390289 - DNA, 19 bp, Homo sapiens
aaaattgcgtattttgagg

SEQ ID NO: 9390290 - DNA, 22 bp, Homo sapiens
aaaattgaggctcatgttaaat

SEQ ID NO: 9390291 - DNA, 22 bp, Homo sapiens
aaagagcccttccatgactctt

SEQ ID NO: 9390292 - DNA, 22 bp, Homo sapiens
aaagagccagggcattaggtga

SEQ ID NO: 9390293 - DNA, 22 bp, Homo sapiens
aaagagcatggaaagttcagga

SEQ ID NO: 9390294 - DNA, 18 bp, Homo sapiens
aaagagccacccagggcc

SEQ ID NO: 9390295 - DNA, 22 bp, Homo sapiens
aaagagccagctacctcagttt

SEQ ID NO: 9390296 - DNA, 22 bp, Homo sapiens
aaagagcctatattcagctgca

SEQ ID NO: 9390297 - DNA, 22 bp, Homo sapiens
aaagagctatacaaccatgtcc

SEQ ID NO: 9390298 - DNA, 22 bp, Homo sapiens
aaaaggttttgagtacaaatat

SEQ ID NO: 9390299 - DNA, 22 bp, Homo sapiens
aaaaggaggacatggttacaga

SEQ ID NO: 9390300 - DNA, 19 bp, Homo sapiens
aaaaggagagatcagagtt

SEQ ID NO: 9390301 - DNA, 19 bp, Homo sapiens
aaaaggagagatcagagtt

SEQ ID NO: 9390302 - DNA, 22 bp, Homo sapiens
aaaaggtagttgccaaataagg

SEQ ID NO: 9390303 - DNA, 22 bp, Homo sapiens
aaaaggtagattctccttctat

SEQ ID NO: 9390304 - DNA, 22 bp, Homo sapiens
aaaagtaattgcagttttgtca

SEQ ID NO: 9390305 - DNA, 22 bp, Homo sapiens
aaaagtaattgcagttttgcca

SEQ ID NO: 9390306 - DNA, 22 bp, Homo sapiens
aaaagtaattgcagttttcgcc

SEQ ID NO: 9390307 - DNA, 22 bp, Homo sapiens
aaaagtaattgcaattttgtag

SEQ ID NO: 9390308 - DNA, 22 bp, Homo sapiens
aaacagctttcagaatctctca

SEQ ID NO: 9390309 - DNA, 22 bp, Homo sapiens
aaaactgaaccttgagatcttt

SEQ ID NO: 9390310 - DNA, 22 bp, Homo sapiens
aaaactgaggtttcctgaagaa

SEQ ID NO: 9390311 - DNA, 22 bp, Homo sapiens
aaaactgtatcttcttgggact

SEQ ID NO: 9390312 - DNA, 22 bp, Homo sapiens
aaaattaagtgtctgggaagcc

SEQ ID NO: 9390313 - DNA, 22 bp, Homo sapiens
aaaattcatagaactgtacgct

SEQ ID NO: 9390314 - DNA, 22 bp, Homo sapiens
aaaattatggagtatcccaaag

SEQ ID NO: 9390315 - DNA, 22 bp, Homo sapiens
aaaaagcttaaatgagcagttc

SEQ ID NO: 9390316 - DNA, 21 bp, Homo sapiens
aaaaagctggggcatgcatgc

SEQ ID NO: 9390317 - DNA, 22 bp, Homo sapiens
aaaaactgcaattacttttgtc

SEQ ID NO: 9390318 - DNA, 22 bp, Homo sapiens
aaaaagggatttgtgatccagg

SEQ ID NO: 9390319 - DNA, 22 bp, Homo sapiens
aaaaagtttcaactgccaactc

SEQ ID NO: 9390320 - DNA, 22 bp, Homo sapiens
aaaaggaggacatggttacaga

SEQ ID NO: 9390321 - DNA, 22 bp, Homo sapiens
aaaaggaggcaaacagcctaga

SEQ ID NO: 9390322 - DNA, 22 bp, Homo sapiens
aaaaatacttcacttctgggtg

SEQ ID NO: 9390323 - DNA, 22 bp, Homo sapiens
aaaaggaggtcactttattcct

SEQ ID NO: 9390324 - DNA, 22 bp, Homo sapiens
aaaaggatcagattttgagcag

SEQ ID NO: 9390325 - DNA, 22 bp, Homo sapiens
aaaaggaggtcactttattcct

SEQ ID NO: 9390326 - DNA, 22 bp, Homo sapiens
aaaactgaaccttgagatcttt

SEQ ID NO: 9390327 - DNA, 22 bp, Homo sapiens
aaaactcaaacattttggcata

SEQ ID NO: 9390328 - DNA, 22 bp, Homo sapiens
aaaacctgattgaattctattt

SEQ ID NO: 9390329 - DNA, 22 bp, Homo sapiens
aaaaggctaatccagagcaact

SEQ ID NO: 9390330 - DNA, 22 bp, Homo sapiens
aaaaggctaattaagttttgga

SEQ ID NO: 9390331 - DNA, 22 bp, Homo sapiens
aaaaggcagtgcaagagagggt

SEQ ID NO: 9390332 - DNA, 22 bp, Homo sapiens
aaaaggcagtgcaagagagggt

SEQ ID NO: 9390333 - DNA, 22 bp, Homo sapiens
aaaaggcatggaggttgatagt

SEQ ID NO: 9390334 - DNA, 22 bp, Homo sapiens
aaaaggcatggaggttgatagt

SEQ ID NO: 9390335 - DNA, 22 bp, Homo sapiens
aaaaggcagtgcaagagagggt

SEQ ID NO: 9390336 - DNA, 22 bp, Homo sapiens
aaaaggatgttttcatgaaaca

SEQ ID NO: 9390337 - DNA, 22 bp, Homo sapiens
aaactgtatagggaaaagtaga

SEQ ID NO: 9390338 - DNA, 22 bp, Homo sapiens
aaactgtattccatcctcatca

SEQ ID NO: 9390339 - DNA, 22 bp, Homo sapiens
aaactgtaagtgcctcaaggtc

SEQ ID NO: 9390340 - DNA, 22 bp, Homo sapiens
aaactgcaatgacaggtaggag

SEQ ID NO: 9390341 - DNA, 22 bp, Homo sapiens
aaacattgctaaataatgctgc

SEQ ID NO: 9390342 - DNA, 22 bp, Homo sapiens
aaacatgcattcaagaaaatct

SEQ ID NO: 9390343 - DNA, 23 bp, Homo sapiens
aaacatgcagcacatgaatgcta

SEQ ID NO: 9390344 - DNA, 22 bp, Homo sapiens
aaacatgatgtcatatatgcca

SEQ ID NO: 9390345 - DNA, 22 bp, Homo sapiens
aaacatgctggatttagaatat

SEQ ID NO: 9390346 - DNA, 22 bp, Homo sapiens
aaacatggccattcagactgtg

SEQ ID NO: 9390347 - DNA, 22 bp, Homo sapiens
aaacatgggcttcctgatgcga

SEQ ID NO: 9390348 - DNA, 18 bp, Homo sapiens
aaacatggcttaaaggct

SEQ ID NO: 9390349 - DNA, 22 bp, Homo sapiens
aaacatgggcttcctgatgcga

SEQ ID NO: 9390350 - DNA, 22 bp, Homo sapiens
aaacatgtaattctgcttaaga

SEQ ID NO: 9390351 - DNA, 22 bp, Homo sapiens
aaacatgtttagaaagcagctg

SEQ ID NO: 9390352 - DNA, 22 bp, Homo sapiens
aaacatgttttctgaatatttt

SEQ ID NO: 9390353 - DNA, 22 bp, Homo sapiens
aaacattagacaccatatgctc

SEQ ID NO: 9390354 - DNA, 22 bp, Homo sapiens
aaacattagacaccatatgctc

SEQ ID NO: 9390355 - DNA, 22 bp, Homo sapiens
aaacattagacaccatatgctc

SEQ ID NO: 9390356 - DNA, 22 bp, Homo sapiens
aaacattcactctcaattttag

SEQ ID NO: 9390357 - DNA, 22 bp, Homo sapiens
aaacactgaagacctatctggt

SEQ ID NO: 9390358 - DNA, 22 bp, Homo sapiens
aaagccactgcatgtgtagtat

SEQ ID NO: 9390359 - DNA, 22 bp, Homo sapiens
aaacactgaagacctatctggt

SEQ ID NO: 9390360 - DNA, 22 bp, Homo sapiens
aaagccagagtgtgttagagac

SEQ ID NO: 9390361 - DNA, 22 bp, Homo sapiens
aaagccagctctgagctgcacc

SEQ ID NO: 9390362 - DNA, 22 bp, Homo sapiens
aaagccagcaaggtgagtttca

SEQ ID NO: 9390363 - DNA, 22 bp, Homo sapiens
aaagccagaattcgtccagcct

SEQ ID NO: 9390364 - DNA, 22 bp, Homo sapiens
aaagccagagcaagctgtcaca

SEQ ID NO: 9390365 - DNA, 22 bp, Homo sapiens
aaagccagagcaagctgtcaca

SEQ ID NO: 9390366 - DNA, 22 bp, Homo sapiens
aaacactgtgggacatcttact

SEQ ID NO: 9390367 - DNA, 22 bp, Homo sapiens
aaacagagtttggtaaatagcc

SEQ ID NO: 9390368 - DNA, 22 bp, Homo sapiens
aaacatgatgtcatatatgcca

SEQ ID NO: 9390369 - DNA, 22 bp, Homo sapiens
aaacagcaatggagaagccagg

SEQ ID NO: 9390370 - DNA, 22 bp, Homo sapiens
aaacagcaggaacatcttgcca

SEQ ID NO: 9390371 - DNA, 22 bp, Homo sapiens
aaacagcaggaacatcttgcca

SEQ ID NO: 9390372 - DNA, 22 bp, Homo sapiens
aaacagctacttctgtataatg

SEQ ID NO: 9390373 - DNA, 22 bp, Homo sapiens
aaatagttcagcttgtaaaccc

SEQ ID NO: 9390374 - DNA, 22 bp, Homo sapiens
aaatagttcagcttgtaaaccc

SEQ ID NO: 9390375 - DNA, 22 bp, Homo sapiens
aaatagttcagcttgtaaaccc

SEQ ID NO: 9390376 - DNA, 22 bp, Homo sapiens
aaatagttgtttggatcaataa

SEQ ID NO: 9390377 - DNA, 22 bp, Homo sapiens
aaatagttagccctgcatatat

SEQ ID NO: 9390378 - DNA, 22 bp, Homo sapiens
aaatagttcagccacggtgact

SEQ ID NO: 9390379 - DNA, 22 bp, Homo sapiens
aaatagttcagccacggtgact

SEQ ID NO: 9390380 - DNA, 22 bp, Homo sapiens
aaactgtgaagcaagtacaagg

SEQ ID NO: 9390381 - DNA, 22 bp, Homo sapiens
aaatagttacttctgctgtctt

SEQ ID NO: 9390382 - DNA, 22 bp, Homo sapiens
aaatagtttagctctcatttca

SEQ ID NO: 9390383 - DNA, 17 bp, Homo sapiens
aaacttcattctcagga

SEQ ID NO: 9390384 - DNA, 22 bp, Homo sapiens
aaactttggattgtgattgtgc

SEQ ID NO: 9390385 - DNA, 22 bp, Homo sapiens
aaacttttcctgctcttgtcct

SEQ ID NO: 9390386 - DNA, 22 bp, Homo sapiens
aaagaaatagatggcatttaaa

SEQ ID NO: 9390387 - DNA, 22 bp, Homo sapiens
aaagaaatacctttctcagctt

SEQ ID NO: 9390388 - DNA, 22 bp, Homo sapiens
aaagaacaaattagctgtttta

SEQ ID NO: 9390389 - DNA, 22 bp, Homo sapiens
aaagaacaaattagctgtttta

SEQ ID NO: 9390390 - DNA, 22 bp, Homo sapiens
aaacttttggtcctcatgggtt

SEQ ID NO: 9390391 - DNA, 22 bp, Homo sapiens
aaactttttattctaatgtcta

SEQ ID NO: 9390392 - DNA, 22 bp, Homo sapiens
aaacttttttaggttcataggc

SEQ ID NO: 9390393 - DNA, 22 bp, Homo sapiens
aaagaaacctatcagccacatg

SEQ ID NO: 9390394 - DNA, 22 bp, Homo sapiens
aaagaaacctatcagccacatg

SEQ ID NO: 9390395 - DNA, 22 bp, Homo sapiens
aaagaacaatgtggaatctcct

SEQ ID NO: 9390396 - DNA, 22 bp, Homo sapiens
aaagactcttaactccctagcg

SEQ ID NO: 9390397 - DNA, 22 bp, Homo sapiens
aaagactagcatttatatgtac

SEQ ID NO: 9390398 - DNA, 22 bp, Homo sapiens
aaagactgcaaaaacgcacaga

SEQ ID NO: 9390399 - DNA, 22 bp, Homo sapiens
aaagactgaggggaaagtgatg

SEQ ID NO: 9390400 - DNA, 22 bp, Homo sapiens
aaagactggttggggtgggcag

SEQ ID NO: 9390401 - DNA, 22 bp, Homo sapiens
aaagactgggactgcagcaggc

SEQ ID NO: 9390402 - DNA, 21 bp, Homo sapiens
aaagacttgcctgaaagtgag

SEQ ID NO: 9390403 - DNA, 20 bp, Homo sapiens
aaagagaagcctcaccttgt

SEQ ID NO: 9390404 - DNA, 21 bp, Homo sapiens
aaagagacaaatggcatatac

SEQ ID NO: 9390405 - DNA, 22 bp, Homo sapiens
aaagagaaacttagaagcctga

SEQ ID NO: 9390406 - DNA, 22 bp, Homo sapiens
aaagagaaacttagaagcctga

SEQ ID NO: 9390407 - DNA, 22 bp, Homo sapiens
aaagagaaaatgatctgtacat

SEQ ID NO: 9390408 - DNA, 22 bp, Homo sapiens
gtgggctgcccttgaggtcagc

SEQ ID NO: 9390409 - DNA, 22 bp, Homo sapiens
gtgggctgcccttgaggtcagc

SEQ ID NO: 9390410 - DNA, 22 bp, Homo sapiens
gtgggccttgcagggtgcaggg

SEQ ID NO: 9390411 - DNA, 22 bp, Homo sapiens
gtgggctcaggcctctgtgggg

SEQ ID NO: 9390412 - DNA, 22 bp, Homo sapiens
gtgggctcccctggcatgtcca

SEQ ID NO: 9390413 - DNA, 22 bp, Homo sapiens
gtgggccttgcagggtgcaggg

SEQ ID NO: 9390414 - DNA, 22 bp, Homo sapiens
gtgggccttgcagggtgcaggg

SEQ ID NO: 9390415 - DNA, 22 bp, Homo sapiens
gtgggcctgatgctgccatgag

SEQ ID NO: 9390416 - DNA, 22 bp, Homo sapiens
gtgggcctgatgctgccatgag

SEQ ID NO: 9390417 - DNA, 22 bp, Homo sapiens
gtgggccagttcctcacaggta

SEQ ID NO: 9390418 - DNA, 22 bp, Homo sapiens
gtgggccaggcgtctaggccct

SEQ ID NO: 9390419 - DNA, 22 bp, Homo sapiens
gtgggctgcttcctccttccac

SEQ ID NO: 9390420 - DNA, 22 bp, Homo sapiens
gtgggctgcccttgaggtcagc

SEQ ID NO: 9390421 - DNA, 22 bp, Homo sapiens
gtgggctgcccttgaggtcagc

SEQ ID NO: 9390422 - DNA, 22 bp, Homo sapiens
gtgggctggaccctcctgctcc

SEQ ID NO: 9390423 - DNA, 22 bp, Homo sapiens
gtgggctgcttcctccttccac

SEQ ID NO: 9390424 - DNA, 22 bp, Homo sapiens
gtgggctggaccctcctgctcc

SEQ ID NO: 9390425 - DNA, 22 bp, Homo sapiens
gtgggctggagcaatgatttca

SEQ ID NO: 9390426 - DNA, 22 bp, Homo sapiens
gtgggcttcccttaagccagag

SEQ ID NO: 9390427 - DNA, 22 bp, Homo sapiens
gtgggctttggcctctttctcc

SEQ ID NO: 9390428 - DNA, 22 bp, Homo sapiens
gtgggctttgctggatccttcc

SEQ ID NO: 9390429 - DNA, 22 bp, Homo sapiens
gtgggcttgttttgatgagatc

SEQ ID NO: 9390430 - DNA, 22 bp, Homo sapiens
gtgggcttctgttagggaggct

SEQ ID NO: 9390431 - DNA, 22 bp, Homo sapiens
gtgggggctggaaatcttgcca

SEQ ID NO: 9390432 - DNA, 22 bp, Homo sapiens
gtgggggcagtgggcttcgagc

SEQ ID NO: 9390433 - DNA, 22 bp, Homo sapiens
gtggggcttcctggggcaagtt

SEQ ID NO: 9390434 - DNA, 22 bp, Homo sapiens
gtgggggacccaggtgctgtcc

SEQ ID NO: 9390435 - DNA, 22 bp, Homo sapiens
gtgggggatgctgagttggaaa

SEQ ID NO: 9390436 - DNA, 22 bp, Homo sapiens
gtgggggagatgcttaggtccg

SEQ ID NO: 9390437 - DNA, 22 bp, Homo sapiens
gtggggaaaggagtggggctca

SEQ ID NO: 9390438 - DNA, 22 bp, Homo sapiens
gtggggaaaggagtggggctca

SEQ ID NO: 9390439 - DNA, 22 bp, Homo sapiens
gtggggaaaggagtggggctca

SEQ ID NO: 9390440 - DNA, 22 bp, Homo sapiens
gtgggcttttgacagtgcctgg

SEQ ID NO: 9390441 - DNA, 22 bp, Homo sapiens
gtggggaggcctaagcaagttg

SEQ ID NO: 9390442 - DNA, 22 bp, Homo sapiens
gtggggaggcctaagcaagttg

SEQ ID NO: 9390443 - DNA, 22 bp, Homo sapiens
gtgggcagacatgatagaagga

SEQ ID NO: 9390444 - DNA, 22 bp, Homo sapiens
gtgggcagagcaagggaactca

SEQ ID NO: 9390445 - DNA, 22 bp, Homo sapiens
gtgggcagagcaagggaactca

SEQ ID NO: 9390446 - DNA, 22 bp, Homo sapiens
gtgggcagagcaagggaactca

SEQ ID NO: 9390447 - DNA, 22 bp, Homo sapiens
gtgggcagaacatttgtaggct

SEQ ID NO: 9390448 - DNA, 22 bp, Homo sapiens
gtgggcagacagtgctttgcag

SEQ ID NO: 9390449 - DNA, 22 bp, Homo sapiens
gtgggcagacagtgctttgcag

SEQ ID NO: 9390450 - DNA, 20 bp, Homo sapiens
gtgggcagatgtgtgcatgg

SEQ ID NO: 9390451 - DNA, 22 bp, Homo sapiens
gtgggcagattaatttctcaat

SEQ ID NO: 9390452 - DNA, 22 bp, Homo sapiens
gtgggcagcaccagggaagtgt

SEQ ID NO: 9390453 - DNA, 20 bp, Homo sapiens
gtgggcagcaggcatactgg

SEQ ID NO: 9390454 - DNA, 20 bp, Homo sapiens
gtgggcagcaggcatactgg

SEQ ID NO: 9390455 - DNA, 22 bp, Homo sapiens
gtgggcagccccttcaaggcca

SEQ ID NO: 9390456 - DNA, 22 bp, Homo sapiens
gtgggcagtggtttgcgcggtc

SEQ ID NO: 9390457 - DNA, 22 bp, Homo sapiens
gtgggcagtggtttgcgcggtc

SEQ ID NO: 9390458 - DNA, 22 bp, Homo sapiens
gtgggcagttcaattctgggag

SEQ ID NO: 9390459 - DNA, 22 bp, Homo sapiens
gtgggcagttcaattctgggag

SEQ ID NO: 9390460 - DNA, 22 bp, Homo sapiens
gtgggcagttcaattctgggag

SEQ ID NO: 9390461 - DNA, 22 bp, Homo sapiens
gtgggcagcctcctttattttc

SEQ ID NO: 9390462 - DNA, 22 bp, Homo sapiens
gtgggcagccccttcaaggcca

SEQ ID NO: 9390463 - DNA, 22 bp, Homo sapiens
gtgggcaggaggccctgccctg

SEQ ID NO: 9390464 - DNA, 22 bp, Homo sapiens
gtgggcagcctgtccggagacc

SEQ ID NO: 9390465 - DNA, 22 bp, Homo sapiens
gtgggcagttggtgattctcgt

SEQ ID NO: 9390466 - DNA, 22 bp, Homo sapiens
gtgggcagttggtgattctcgt

SEQ ID NO: 9390467 - DNA, 22 bp, Homo sapiens
gtgggccactgggaggcaaggg

SEQ ID NO: 9390468 - DNA, 22 bp, Homo sapiens
gtgggccacatcccagggctct

SEQ ID NO: 9390469 - DNA, 22 bp, Homo sapiens
gtgggccaggccggagtgcaga

SEQ ID NO: 9390470 - DNA, 22 bp, Homo sapiens
gtgggccaggccggagtgcaga

SEQ ID NO: 9390471 - DNA, 22 bp, Homo sapiens
gtgggccagcttttctcctggg

SEQ ID NO: 9390472 - DNA, 22 bp, Homo sapiens
gtgggccaggacccgctgtccg

SEQ ID NO: 9390473 - DNA, 22 bp, Homo sapiens
gtggttagcgccccattcttct

SEQ ID NO: 9390474 - DNA, 22 bp, Homo sapiens
gtggttgtttccaggtttgaaa

SEQ ID NO: 9390475 - DNA, 22 bp, Homo sapiens
gtggttgtatagttaaggttca

SEQ ID NO: 9390476 - DNA, 22 bp, Homo sapiens
gtggtgtaggtcacagttagga

SEQ ID NO: 9390477 - DNA, 22 bp, Homo sapiens
gtggtgtaggtcacagttagga

SEQ ID NO: 9390478 - DNA, 22 bp, Homo sapiens
gtggtgcatgcatgcatatgta

SEQ ID NO: 9390479 - DNA, 22 bp, Homo sapiens
gtggtgcaggaagcatctggct

SEQ ID NO: 9390480 - DNA, 22 bp, Homo sapiens
gtggtgaagcattgagaagtca

SEQ ID NO: 9390481 - DNA, 22 bp, Homo sapiens
gtggtgaagccccatctctgct

SEQ ID NO: 9390482 - DNA, 22 bp, Homo sapiens
gtggtgaagccccatctctgct

SEQ ID NO: 9390483 - DNA, 22 bp, Homo sapiens
gtggtgagttcaggctggggtg

SEQ ID NO: 9390484 - DNA, 22 bp, Homo sapiens
gtggtgagattgctggatcaaa

SEQ ID NO: 9390485 - DNA, 22 bp, Homo sapiens
gtggtctggggtcaggcctgag

SEQ ID NO: 9390486 - DNA, 22 bp, Homo sapiens
gtggtcctttagaggatgtaat

SEQ ID NO: 9390487 - DNA, 22 bp, Homo sapiens
gtggtccccagagctgtgtaca

SEQ ID NO: 9390488 - DNA, 22 bp, Homo sapiens
gtggtccatcatgcagagctcc

SEQ ID NO: 9390489 - DNA, 22 bp, Homo sapiens
gtggtccaaggagtttccagca

SEQ ID NO: 9390490 - DNA, 22 bp, Homo sapiens
gtgtaaatgccccattcattga

SEQ ID NO: 9390491 - DNA, 22 bp, Homo sapiens
gtgtaaatgccccattcattga

SEQ ID NO: 9390492 - DNA, 17 bp, Homo sapiens
gtgtaaatgctagaaac

SEQ ID NO: 9390493 - DNA, 22 bp, Homo sapiens
gtgtaaaaacatactatttcta

SEQ ID NO: 9390494 - DNA, 22 bp, Homo sapiens
gtgtaaaaacatactatttcta

SEQ ID NO: 9390495 - DNA, 22 bp, Homo sapiens
gtggttttgccattacaagtaa

SEQ ID NO: 9390496 - DNA, 22 bp, Homo sapiens
gtggtttgtgcatagctcctat

SEQ ID NO: 9390497 - DNA, 22 bp, Homo sapiens
gtggtttaggggaaagaactgt

SEQ ID NO: 9390498 - DNA, 22 bp, Homo sapiens
gtggtttgttttattcctggaa

SEQ ID NO: 9390499 - DNA, 22 bp, Homo sapiens
gtggttttacaaagagaaagat

SEQ ID NO: 9390500 - DNA, 22 bp, Homo sapiens
gtggttttctccaacccagaac

SEQ ID NO: 9390501 - DNA, 22 bp, Homo sapiens
gtggttttctccaacccagaac

SEQ ID NO: 9390502 - DNA, 19 bp, Homo sapiens
gtggttttctgaggagtct

SEQ ID NO: 9390503 - DNA, 22 bp, Homo sapiens
gtgtaagtatctttgtatcttt

SEQ ID NO: 9390504 - DNA, 22 bp, Homo sapiens
gtgtaagtatctttgtatcttt

SEQ ID NO: 9390505 - DNA, 22 bp, Homo sapiens
gtgggtggaggcgtcgagggca

SEQ ID NO: 9390506 - DNA, 22 bp, Homo sapiens
gtgggtggaggcgtcgagggca

SEQ ID NO: 9390507 - DNA, 22 bp, Homo sapiens
gtgggtggagactgggtgcaag

SEQ ID NO: 9390508 - DNA, 22 bp, Homo sapiens
gtgggtggacggtgcttttgtt

SEQ ID NO: 9390509 - DNA, 22 bp, Homo sapiens
gtgggtggacggtgcttttgtt

SEQ ID NO: 9390510 - DNA, 22 bp, Homo sapiens
gtgggtggagactgggtgcaag

SEQ ID NO: 9390511 - DNA, 22 bp, Homo sapiens
gtgggtggacggtgcttttgtt

SEQ ID NO: 9390512 - DNA, 22 bp, Homo sapiens
gtgggtgcggggagccgaggcg

SEQ ID NO: 9390513 - DNA, 22 bp, Homo sapiens
gtgggtgcggggagccgaggcg

SEQ ID NO: 9390514 - DNA, 22 bp, Homo sapiens
gtgggtgatgtactggaggcca

SEQ ID NO: 9390515 - DNA, 22 bp, Homo sapiens
gtgggtaattggagggctgcct

SEQ ID NO: 9390516 - DNA, 18 bp, Homo sapiens
gtggggtgttgtgaggat

SEQ ID NO: 9390517 - DNA, 22 bp, Homo sapiens
gtgggtcagcaagccaggagta

SEQ ID NO: 9390518 - DNA, 22 bp, Homo sapiens
gtgggtctggctttgagggtca

SEQ ID NO: 9390519 - DNA, 22 bp, Homo sapiens
gtggtcagttaggcaatcatgt

SEQ ID NO: 9390520 - DNA, 22 bp, Homo sapiens
gtggtcaggttatcagatcata

SEQ ID NO: 9390521 - DNA, 22 bp, Homo sapiens
gtggtatctgtctcccccactg

SEQ ID NO: 9390522 - DNA, 22 bp, Homo sapiens
gtggtcagaatggagcccagga

SEQ ID NO: 9390523 - DNA, 22 bp, Homo sapiens
gtggggtgcagcagtactgtgt

SEQ ID NO: 9390524 - DNA, 22 bp, Homo sapiens
gtggggtctctctgtacctccc

SEQ ID NO: 9390525 - DNA, 22 bp, Homo sapiens
gtggggtgggctgagttaggcc

SEQ ID NO: 9390526 - DNA, 22 bp, Homo sapiens
gtggggtgggctgagttaggcc

SEQ ID NO: 9390527 - DNA, 22 bp, Homo sapiens
gtggggtgggctgagttaggcc

SEQ ID NO: 9390528 - DNA, 22 bp, Homo sapiens
gtggggtgtccagcagcgagct

SEQ ID NO: 9390529 - DNA, 22 bp, Homo sapiens
gtggggtgggctgagttaggcc

SEQ ID NO: 9390530 - DNA, 18 bp, Homo sapiens
gtggggtgttgtgaggat

SEQ ID NO: 9390531 - DNA, 22 bp, Homo sapiens
gtggggtgtccagcagcgagct

SEQ ID NO: 9390532 - DNA, 18 bp, Homo sapiens
gtggggtgttgtgaggat

SEQ ID NO: 9390533 - DNA, 18 bp, Homo sapiens
gtggggtgttgtgaggat

SEQ ID NO: 9390534 - DNA, 18 bp, Homo sapiens
gtggggtgttgtgaggat

SEQ ID NO: 9390535 - DNA, 22 bp, Homo sapiens
gtggggggacgttggtcacttt

SEQ ID NO: 9390536 - DNA, 22 bp, Homo sapiens
gtgggggctggctcgtcctgtg

SEQ ID NO: 9390537 - DNA, 22 bp, Homo sapiens
gtggggggagctgcaagctgga

SEQ ID NO: 9390538 - DNA, 22 bp, Homo sapiens
gtggggggagctgcaagctgga

SEQ ID NO: 9390539 - DNA, 22 bp, Homo sapiens
gtggggtagatctttctcagga

SEQ ID NO: 9390540 - DNA, 22 bp, Homo sapiens
gtggggtagatctttctcagga

SEQ ID NO: 9390541 - DNA, 22 bp, Homo sapiens
gtgggggtggaaaggcaagttg

SEQ ID NO: 9390542 - DNA, 22 bp, Homo sapiens
gtgggggtggaaaggcaagttg

SEQ ID NO: 9390543 - DNA, 22 bp, Homo sapiens
gttcaagaccagcctggccaac

SEQ ID NO: 9390544 - DNA, 22 bp, Homo sapiens
gttcaagaccagcctggccaac

SEQ ID NO: 9390545 - DNA, 22 bp, Homo sapiens
gttcaagaccagcctggccaac

SEQ ID NO: 9390546 - DNA, 22 bp, Homo sapiens
gttcaagaccagcctggccaac

SEQ ID NO: 9390547 - DNA, 22 bp, Homo sapiens
gttcaagaccagcctggccaac

SEQ ID NO: 9390548 - DNA, 22 bp, Homo sapiens
gttcaaatggctgcagttacca

SEQ ID NO: 9390549 - DNA, 21 bp, Homo sapiens
gttcaaatcctgacactacac

SEQ ID NO: 9390550 - DNA, 22 bp, Homo sapiens
gttcaaattctatgaaatatgt

SEQ ID NO: 9390551 - DNA, 21 bp, Homo sapiens
gttcaaatgggtagattcaca

SEQ ID NO: 9390552 - DNA, 18 bp, Homo sapiens
gttcaaggtcaagagaga

SEQ ID NO: 9390553 - DNA, 22 bp, Homo sapiens
gttcaaggaagggaggaaagcc

SEQ ID NO: 9390554 - DNA, 22 bp, Homo sapiens
gttcaagaccagcctggccaac

SEQ ID NO: 9390555 - DNA, 22 bp, Homo sapiens
gttcaaggttttacagagtgta

SEQ ID NO: 9390556 - DNA, 21 bp, Homo sapiens
gttcaagtatttttttcgctg

SEQ ID NO: 9390557 - DNA, 22 bp, Homo sapiens
gttctacagttcctattactta

SEQ ID NO: 9390558 - DNA, 21 bp, Homo sapiens
gttctacagttttagaattcc

SEQ ID NO: 9390559 - DNA, 22 bp, Homo sapiens
gttctacatgacactcaacatt

SEQ ID NO: 9390560 - DNA, 22 bp, Homo sapiens
gtgtgtccctacaacagcttca

SEQ ID NO: 9390561 - DNA, 22 bp, Homo sapiens
gtgtgtccctcctctcctgagt

SEQ ID NO: 9390562 - DNA, 22 bp, Homo sapiens
gtgtgtccctacaacagcttca

SEQ ID NO: 9390563 - DNA, 22 bp, Homo sapiens
gtgtgtcccttggaacctcagc

SEQ ID NO: 9390564 - DNA, 22 bp, Homo sapiens
gtgtgtcctcagtagtggcatg

SEQ ID NO: 9390565 - DNA, 22 bp, Homo sapiens
gtgtgtccaaggccacaatagc

SEQ ID NO: 9390566 - DNA, 22 bp, Homo sapiens
gtgtgtccacacatacatacat

SEQ ID NO: 9390567 - DNA, 22 bp, Homo sapiens
gtgtgtccaaggcacggatgac

SEQ ID NO: 9390568 - DNA, 22 bp, Homo sapiens
gtgtgtcaggtactgtgctagg

SEQ ID NO: 9390569 - DNA, 23 bp, Homo sapiens
gtgtgtccattcgcactcttagg

SEQ ID NO: 9390570 - DNA, 22 bp, Homo sapiens
gtgtgtccaaggccacaatagc

SEQ ID NO: 9390571 - DNA, 22 bp, Homo sapiens
gtgtgtccaggcgggagtcaag

SEQ ID NO: 9390572 - DNA, 22 bp, Homo sapiens
gttattttaacttctcagtaat

SEQ ID NO: 9390573 - DNA, 22 bp, Homo sapiens
gtgtgtcctcagtagtggcatg

SEQ ID NO: 9390574 - DNA, 22 bp, Homo sapiens
gttattttaacttctcagtaat

SEQ ID NO: 9390575 - DNA, 21 bp, Homo sapiens
gttattttaagtgagctttgc

SEQ ID NO: 9390576 - DNA, 22 bp, Homo sapiens
gttattttcattggctcagact

SEQ ID NO: 9390577 - DNA, 22 bp, Homo sapiens
gttattttcattggctcagact

SEQ ID NO: 9390578 - DNA, 22 bp, Homo sapiens
gttattttcattggctcagact

SEQ ID NO: 9390579 - DNA, 22 bp, Homo sapiens
gttcaaaattcaaatggtatac

SEQ ID NO: 9390580 - DNA, 22 bp, Homo sapiens
gttcaaaattcaaatggtatac

SEQ ID NO: 9390581 - DNA, 21 bp, Homo sapiens
gttattttaagtgagctttgc

SEQ ID NO: 9390582 - DNA, 21 bp, Homo sapiens
gttattttaagtgagctttgc

SEQ ID NO: 9390583 - DNA, 22 bp, Homo sapiens
gttattttatctctgagaggtt

SEQ ID NO: 9390584 - DNA, 22 bp, Homo sapiens
gttattttatctctgagaggtt

SEQ ID NO: 9390585 - DNA, 22 bp, Homo sapiens
gttgttcttctcatccagcttg

SEQ ID NO: 9390586 - DNA, 22 bp, Homo sapiens
gttgttcttctcatccagcttg

SEQ ID NO: 9390587 - DNA, 22 bp, Homo sapiens
gttgttgctatgttattgttat

SEQ ID NO: 9390588 - DNA, 22 bp, Homo sapiens
gttgtcttagtcagaaatatgc

SEQ ID NO: 9390589 - DNA, 22 bp, Homo sapiens
gttgtccttcttatttgtagtg

SEQ ID NO: 9390590 - DNA, 22 bp, Homo sapiens
gttgtcctgaatttggagactt

SEQ ID NO: 9390591 - DNA, 22 bp, Homo sapiens
gttgtcatcaccgttgttatca

SEQ ID NO: 9390592 - DNA, 22 bp, Homo sapiens
gttgtcttagtcagaaatatgc

SEQ ID NO: 9390593 - DNA, 22 bp, Homo sapiens
gttgtctgtgtcagttagcgtc

SEQ ID NO: 9390594 - DNA, 22 bp, Homo sapiens
gttgtgcagtcagactgcctgg

SEQ ID NO: 9390595 - DNA, 22 bp, Homo sapiens
gttgtgcatttatgaagaagtt

SEQ ID NO: 9390596 - DNA, 22 bp, Homo sapiens
gttgtgcagggcgaggacctga

SEQ ID NO: 9390597 - DNA, 21 bp, Homo sapiens
gttgtggttggggctgcagct

SEQ ID NO: 9390598 - DNA, 22 bp, Homo sapiens
gttgtgcagaagtgcctcagta

SEQ ID NO: 9390599 - DNA, 22 bp, Homo sapiens
gttgtgcaccactgttgattga

SEQ ID NO: 9390600 - DNA, 22 bp, Homo sapiens
gttgtgcaaccatcaccaccat

SEQ ID NO: 9390601 - DNA, 22 bp, Homo sapiens
gttgtgcaaacactggggtctg

SEQ ID NO: 9390602 - DNA, 22 bp, Homo sapiens
gttgtcaggtaaaacagtatgg

SEQ ID NO: 9390603 - DNA, 22 bp, Homo sapiens
gttgtattcttcaatatcagag

SEQ ID NO: 9390604 - DNA, 22 bp, Homo sapiens
gttgtataaggaatgttgttta

SEQ ID NO: 9390605 - DNA, 22 bp, Homo sapiens
gttgtacatatgaggataagtt

SEQ ID NO: 9390606 - DNA, 22 bp, Homo sapiens
gttctgcctgtggcttctgtgg

SEQ ID NO: 9390607 - DNA, 22 bp, Homo sapiens
gttctgcagacttggaaggtgg

SEQ ID NO: 9390608 - DNA, 22 bp, Homo sapiens
gttgtacaggcagggaaactga

SEQ ID NO: 9390609 - DNA, 22 bp, Homo sapiens
gttctctctcttgcctgggtgg

SEQ ID NO: 9390610 - DNA, 22 bp, Homo sapiens
gttctctctcttgcctgggtgg

SEQ ID NO: 9390611 - DNA, 22 bp, Homo sapiens
gttctctcagcgatagtgatgg

SEQ ID NO: 9390612 - DNA, 22 bp, Homo sapiens
gttctctcagcgatagtgatgg

SEQ ID NO: 9390613 - DNA, 22 bp, Homo sapiens
gttctgagtcctcctttgaagg

SEQ ID NO: 9390614 - DNA, 22 bp, Homo sapiens
gttctctcaaactttgtgtttg

SEQ ID NO: 9390615 - DNA, 22 bp, Homo sapiens
gttctctcagcctttgttatta

SEQ ID NO: 9390616 - DNA, 22 bp, Homo sapiens
gttctctcagcctttgttatta

SEQ ID NO: 9390617 - DNA, 22 bp, Homo sapiens
gttctctcaaactttgtgtttg

SEQ ID NO: 9390618 - DNA, 22 bp, Homo sapiens
gttctccttgtggctgcagcag

SEQ ID NO: 9390619 - DNA, 22 bp, Homo sapiens
gttctctagggctgtagactgg

SEQ ID NO: 9390620 - DNA, 22 bp, Homo sapiens
gttctccttgtggctgcagcag

SEQ ID NO: 9390621 - DNA, 22 bp, Homo sapiens
gttctcctcttgtcccaggctg

SEQ ID NO: 9390622 - DNA, 22 bp, Homo sapiens
gttctattctccagttacatat

SEQ ID NO: 9390623 - DNA, 22 bp, Homo sapiens
gttctattccccttatctgtga

SEQ ID NO: 9390624 - DNA, 22 bp, Homo sapiens
gttctcagggataacttccccc

SEQ ID NO: 9390625 - DNA, 22 bp, Homo sapiens
gttctccactgcagagtctctc

SEQ ID NO: 9390626 - DNA, 22 bp, Homo sapiens
gttctccctgtcccctgagctt

SEQ ID NO: 9390627 - DNA, 22 bp, Homo sapiens
gttctcctcttagctgtgccac

SEQ ID NO: 9390628 - DNA, 22 bp, Homo sapiens
gtgtccagagaaactcacagct

SEQ ID NO: 9390629 - DNA, 22 bp, Homo sapiens
gtgtccagtcatagcccagggc

SEQ ID NO: 9390630 - DNA, 22 bp, Homo sapiens
gtgtcccactctggaggtgaag

SEQ ID NO: 9390631 - DNA, 22 bp, Homo sapiens
gtgtcccaaagattagaaatca

SEQ ID NO: 9390632 - DNA, 22 bp, Homo sapiens
gtgtcccaatgttcaggacggc

SEQ ID NO: 9390633 - DNA, 22 bp, Homo sapiens
gtgtccagttttttctctgctg

SEQ ID NO: 9390634 - DNA, 22 bp, Homo sapiens
gtgtccatctctgtatgctgct

SEQ ID NO: 9390635 - DNA, 22 bp, Homo sapiens
gtgtcatgcacactcagtgttg

SEQ ID NO: 9390636 - DNA, 22 bp, Homo sapiens
gtgtcatggaaaattgcaatgg

SEQ ID NO: 9390637 - DNA, 22 bp, Homo sapiens
gtgtcatggggtttgttataca

SEQ ID NO: 9390638 - DNA, 22 bp, Homo sapiens
gtgtcatgtagaaattgatgaa

SEQ ID NO: 9390639 - DNA, 22 bp, Homo sapiens
gtgtcatggggtttgttataca

SEQ ID NO: 9390640 - DNA, 23 bp, Homo sapiens
gtgtcattactgtaattattgtg

SEQ ID NO: 9390641 - DNA, 22 bp, Homo sapiens
gtgtcattaaccaccatgcaaa

SEQ ID NO: 9390642 - DNA, 22 bp, Homo sapiens
gtgtccagagaaactcacagct

SEQ ID NO: 9390643 - DNA, 22 bp, Homo sapiens
gtgtcagatgtccagggcagca

SEQ ID NO: 9390644 - DNA, 22 bp, Homo sapiens
gtgtcagatgtccagggcagca

SEQ ID NO: 9390645 - DNA, 22 bp, Homo sapiens
gtgtcaggagaattagggcttt

SEQ ID NO: 9390646 - DNA, 22 bp, Homo sapiens
gtgtcaggagaattagggcttt

SEQ ID NO: 9390647 - DNA, 22 bp, Homo sapiens
gtgtcaggagccttccatgggc

SEQ ID NO: 9390648 - DNA, 22 bp, Homo sapiens
gtgtcaggagccttccatgggc

SEQ ID NO: 9390649 - DNA, 19 bp, Homo sapiens
gtgtcaggatgtgcagggg

SEQ ID NO: 9390650 - DNA, 19 bp, Homo sapiens
gtgtcaggatgtgcagggg

SEQ ID NO: 9390651 - DNA, 19 bp, Homo sapiens
gtgtcaggatgtgcagggg

SEQ ID NO: 9390652 - DNA, 22 bp, Homo sapiens
gtgtcaggggcagccaggaaat

SEQ ID NO: 9390653 - DNA, 22 bp, Homo sapiens
gtgtcaggggcagccaggaaat

SEQ ID NO: 9390654 - DNA, 20 bp, Homo sapiens
gtgtcagtaaatattatgtg

SEQ ID NO: 9390655 - DNA, 22 bp, Homo sapiens
gtgtcaggcagtcagcatggag

SEQ ID NO: 9390656 - DNA, 22 bp, Homo sapiens
gtgtcaggccctgcattatgtg

SEQ ID NO: 9390657 - DNA, 22 bp, Homo sapiens
gtgtcaggcagtcagcatggag

SEQ ID NO: 9390658 - DNA, 22 bp, Homo sapiens
gtgtccttttgagggtccacag

SEQ ID NO: 9390659 - DNA, 22 bp, Homo sapiens
gtgtctcttttcagactcttca

SEQ ID NO: 9390660 - DNA, 22 bp, Homo sapiens
gtgtctcttcctttcaagtggg

SEQ ID NO: 9390661 - DNA, 22 bp, Homo sapiens
gtgtcctgggggacttcaggtt

SEQ ID NO: 9390662 - DNA, 22 bp, Homo sapiens
gtgtcctgggctggtagagctg

SEQ ID NO: 9390663 - DNA, 22 bp, Homo sapiens
gtgtcctgtttccctgtctata

SEQ ID NO: 9390664 - DNA, 22 bp, Homo sapiens
gtgtcctgttcagaagcttggg

SEQ ID NO: 9390665 - DNA, 22 bp, Homo sapiens
gtgtcctggttccttgtggctg

SEQ ID NO: 9390666 - DNA, 22 bp, Homo sapiens
gtgtcctgggtctctgattctt

SEQ ID NO: 9390667 - DNA, 22 bp, Homo sapiens
gtgtccttatgcataccagagt

SEQ ID NO: 9390668 - DNA, 22 bp, Homo sapiens
gtgtcctgtttccctgtctata

SEQ ID NO: 9390669 - DNA, 22 bp, Homo sapiens
gtgtccttatgcataccagagt

SEQ ID NO: 9390670 - DNA, 22 bp, Homo sapiens
gtgtcctgatcaattgagctgg

SEQ ID NO: 9390671 - DNA, 22 bp, Homo sapiens
gtgtcctgagtgaggcctggcc

SEQ ID NO: 9390672 - DNA, 22 bp, Homo sapiens
gtgtcctgagtgaggcctggcc

SEQ ID NO: 9390673 - DNA, 22 bp, Homo sapiens
gtgtcctcttattgctcttggc

SEQ ID NO: 9390674 - DNA, 22 bp, Homo sapiens
gtgtcctcttattgctcttggc

SEQ ID NO: 9390675 - DNA, 22 bp, Homo sapiens
gtgtcccagccccacaggcctg

SEQ ID NO: 9390676 - DNA, 22 bp, Homo sapiens
gtgtcccagccccacaggcctg

SEQ ID NO: 9390677 - DNA, 22 bp, Homo sapiens
gtgtcccagcagcacattggct

SEQ ID NO: 9390678 - DNA, 22 bp, Homo sapiens
gtgtcccaggagaggagacaat

SEQ ID NO: 9390679 - DNA, 22 bp, Homo sapiens
gtgtcctgccaccctgggcttt

SEQ ID NO: 9390680 - DNA, 22 bp, Homo sapiens
gtgtcctggagcccccagttca

SEQ ID NO: 9390681 - DNA, 18 bp, Homo sapiens
gtgtcctggctgcggcgc

SEQ ID NO: 9390682 - DNA, 18 bp, Homo sapiens
gtgtcctggctgcggcgc

SEQ ID NO: 9390683 - DNA, 18 bp, Homo sapiens
gtgtcctggctgcggcgc

SEQ ID NO: 9390684 - DNA, 22 bp, Homo sapiens
gtgtcctgggcattaggcttag

SEQ ID NO: 9390685 - DNA, 22 bp, Homo sapiens
gtgtcctgcaggccaggaatgg

SEQ ID NO: 9390686 - DNA, 22 bp, Homo sapiens
gtgtcctgcacagcaccttgca

SEQ ID NO: 9390687 - DNA, 22 bp, Homo sapiens
gtgtcctgatcaattgagctgg

SEQ ID NO: 9390688 - DNA, 22 bp, Homo sapiens
gtgtcctgcacagcaccttgca

SEQ ID NO: 9390689 - DNA, 22 bp, Homo sapiens
gtgtcctgcattggctctgccc

SEQ ID NO: 9390690 - DNA, 22 bp, Homo sapiens
gtgtcctgcaggccaggaatgg

SEQ ID NO: 9390691 - DNA, 22 bp, Homo sapiens
gtgtcctgcattggctctgccc

SEQ ID NO: 9390692 - DNA, 22 bp, Homo sapiens
gtgtcctgccaccctgggcttt

SEQ ID NO: 9390693 - DNA, 22 bp, Homo sapiens
gtgtggggccaggatcagggct

SEQ ID NO: 9390694 - DNA, 22 bp, Homo sapiens
gtgtgggaggaaggtgaacaga

SEQ ID NO: 9390695 - DNA, 22 bp, Homo sapiens
gtgtgggaggaaggtgaacaga

SEQ ID NO: 9390696 - DNA, 22 bp, Homo sapiens
gtgtgggacgggtgagtggcca

SEQ ID NO: 9390697 - DNA, 22 bp, Homo sapiens
gtgtgcagtctgctaggcaggg

SEQ ID NO: 9390698 - DNA, 22 bp, Homo sapiens
gtgtgggctgcagaggcacagc

SEQ ID NO: 9390699 - DNA, 22 bp, Homo sapiens
gtgtggtcgaagttctcccgga

SEQ ID NO: 9390700 - DNA, 22 bp, Homo sapiens
gtgtgtatgtagaactatgtat

SEQ ID NO: 9390701 - DNA, 22 bp, Homo sapiens
gtgtgtatttaaaggatagttg

SEQ ID NO: 9390702 - DNA, 22 bp, Homo sapiens
gtgtgtatgtagaactatgtat

SEQ ID NO: 9390703 - DNA, 22 bp, Homo sapiens
gtgtgtatgtagaactatgtat

SEQ ID NO: 9390704 - DNA, 22 bp, Homo sapiens
gtgtgtattattgcatacacat

SEQ ID NO: 9390705 - DNA, 22 bp, Homo sapiens
gtgtggggtcttctcttggcct

SEQ ID NO: 9390706 - DNA, 22 bp, Homo sapiens
gtgtggggtcttctcttggcct

SEQ ID NO: 9390707 - DNA, 22 bp, Homo sapiens
gtgtggggctcagtgggaatgt

SEQ ID NO: 9390708 - DNA, 22 bp, Homo sapiens
gtgtggggctcagtgggaatgt

SEQ ID NO: 9390709 - DNA, 22 bp, Homo sapiens
gtgtggggctcagtgggaatgt

SEQ ID NO: 9390710 - DNA, 22 bp, Homo sapiens
gtgtgggggcagctctgatatg

SEQ ID NO: 9390711 - DNA, 22 bp, Homo sapiens
gtgtgagtgaaagtagtttgat

SEQ ID NO: 9390712 - DNA, 22 bp, Homo sapiens
gtgtgagctcagccttgggaga

SEQ ID NO: 9390713 - DNA, 22 bp, Homo sapiens
gtgtgagggcaacacagcaaac

SEQ ID NO: 9390714 - DNA, 21 bp, Homo sapiens
gtgtgagtagcatgtgtctca

SEQ ID NO: 9390715 - DNA, 22 bp, Homo sapiens
gtgtgcagcagagacaggactc

SEQ ID NO: 9390716 - DNA, 22 bp, Homo sapiens
gtgtgcaggtgtcagtgcagct

SEQ ID NO: 9390717 - DNA, 22 bp, Homo sapiens
gtgtgcaggtgtcagtgcagct

SEQ ID NO: 9390718 - DNA, 22 bp, Homo sapiens
gtgtgcagggggccagcgcagc

SEQ ID NO: 9390719 - DNA, 22 bp, Homo sapiens
gtgtgcagggggccagcgcagc

SEQ ID NO: 9390720 - DNA, 22 bp, Homo sapiens
gtgtgcaggccacaggccaggg

SEQ ID NO: 9390721 - DNA, 22 bp, Homo sapiens
gtgtgcagggctgcctgtgccg

SEQ ID NO: 9390722 - DNA, 22 bp, Homo sapiens
gtgtgcagggatgagtgcaggt

SEQ ID NO: 9390723 - DNA, 22 bp, Homo sapiens
gtgtgcagggatgagtgcaggt

SEQ ID NO: 9390724 - DNA, 22 bp, Homo sapiens
gttttttgggtgtatatcttct

SEQ ID NO: 9390725 - DNA, 22 bp, Homo sapiens
taaaacacataaactctctatt

SEQ ID NO: 9390726 - DNA, 22 bp, Homo sapiens
taaaacacataaactctctatt

SEQ ID NO: 9390727 - DNA, 22 bp, Homo sapiens
gtttttctttgtgtgaagacaa

SEQ ID NO: 9390728 - DNA, 22 bp, Homo sapiens
gtttttgtccatggaggcaaac

SEQ ID NO: 9390729 - DNA, 22 bp, Homo sapiens
gttttttcatgagtagttatct

SEQ ID NO: 9390730 - DNA, 22 bp, Homo sapiens
gtttttctctgaaatagttgac

SEQ ID NO: 9390731 - DNA, 22 bp, Homo sapiens
gtttttctctgaaatagttgac

SEQ ID NO: 9390732 - DNA, 20 bp, Homo sapiens
gtttttctctcttgccacta

SEQ ID NO: 9390733 - DNA, 22 bp, Homo sapiens
gtttttctaggaccatgtgatt

SEQ ID NO: 9390734 - DNA, 22 bp, Homo sapiens
gtttaataatgttgaattacta

SEQ ID NO: 9390735 - DNA, 22 bp, Homo sapiens
gtttaagaaaattcatgttgtt

SEQ ID NO: 9390736 - DNA, 22 bp, Homo sapiens
gtttttccttgctgaggacccg

SEQ ID NO: 9390737 - DNA, 19 bp, Homo sapiens
gtttttcccagacgaggca

SEQ ID NO: 9390738 - DNA, 22 bp, Homo sapiens
gtttttcctgctgacttgggtc

SEQ ID NO: 9390739 - DNA, 22 bp, Homo sapiens
gttgttttgcaggatccttaca

SEQ ID NO: 9390740 - DNA, 22 bp, Homo sapiens
gttgttttcagcagtttatgac

SEQ ID NO: 9390741 - DNA, 19 bp, Homo sapiens
gttgtttttcttattatgg

SEQ ID NO: 9390742 - DNA, 22 bp, Homo sapiens
gttgtttttgaacggtggtggc

SEQ ID NO: 9390743 - DNA, 22 bp, Homo sapiens
gtttaaataattaggggcctgt

SEQ ID NO: 9390744 - DNA, 22 bp, Homo sapiens
gtttaaagtagcttccttttgg

SEQ ID NO: 9390745 - DNA, 22 bp, Homo sapiens
gtttaaataattaggggcctgt

SEQ ID NO: 9390746 - DNA, 22 bp, Homo sapiens
gttgtttttgttctctatagct

SEQ ID NO: 9390747 - DNA, 22 bp, Homo sapiens
gttgtttttgttctctatagct

SEQ ID NO: 9390748 - DNA, 22 bp, Homo sapiens
gtttaaagtcttggaaggagga

SEQ ID NO: 9390749 - DNA, 22 bp, Homo sapiens
taaagcagtatgatggaaggat

SEQ ID NO: 9390750 - DNA, 22 bp, Homo sapiens
taaaggaacagaggactcattt

SEQ ID NO: 9390751 - DNA, 22 bp, Homo sapiens
taaagctgttagagtagtaaga

SEQ ID NO: 9390752 - DNA, 22 bp, Homo sapiens
taaaaccattcctgctttcatg

SEQ ID NO: 9390753 - DNA, 22 bp, Homo sapiens
taaaaccataaggctggaagga

SEQ ID NO: 9390754 - DNA, 22 bp, Homo sapiens
taaaaccataaggctggaagga

SEQ ID NO: 9390755 - DNA, 22 bp, Homo sapiens
taaaaccaggtcttgggattta

SEQ ID NO: 9390756 - DNA, 22 bp, Homo sapiens
taaaacagcagggcagagaagt

SEQ ID NO: 9390757 - DNA, 22 bp, Homo sapiens
taaaacagcagggcagagaagt

SEQ ID NO: 9390758 - DNA, 22 bp, Homo sapiens
taaagcagcgtgggtggggcag

SEQ ID NO: 9390759 - DNA, 18 bp, Homo sapiens
taaaggaagtgggagagg

SEQ ID NO: 9390760 - DNA, 22 bp, Homo sapiens
taaaggaatcagttttagagat

SEQ ID NO: 9390761 - DNA, 22 bp, Homo sapiens
taaaggaggagttaatgagact

SEQ ID NO: 9390762 - DNA, 22 bp, Homo sapiens
taaaggaggagttaatgagact

SEQ ID NO: 9390763 - DNA, 22 bp, Homo sapiens
taaaggaggagttaatgagact

SEQ ID NO: 9390764 - DNA, 22 bp, Homo sapiens
taaaggagtgtgatgaaaggga

SEQ ID NO: 9390765 - DNA, 22 bp, Homo sapiens
taaaggataactttcaagaatt

SEQ ID NO: 9390766 - DNA, 22 bp, Homo sapiens
taaaggattttgtataatataa

SEQ ID NO: 9390767 - DNA, 22 bp, Homo sapiens
taaaggcacggagttgttatgg

SEQ ID NO: 9390768 - DNA, 22 bp, Homo sapiens
taaatactttacaggatgtctc

SEQ ID NO: 9390769 - DNA, 22 bp, Homo sapiens
taaatactttacaggatgtctc

SEQ ID NO: 9390770 - DNA, 22 bp, Homo sapiens
taaatcagcctttgctatttta

SEQ ID NO: 9390771 - DNA, 22 bp, Homo sapiens
taaatcactcctaataatcagt

SEQ ID NO: 9390772 - DNA, 22 bp, Homo sapiens
taaatcactgttcattccacac

SEQ ID NO: 9390773 - DNA, 22 bp, Homo sapiens
taaatgagggctgacatgattg

SEQ ID NO: 9390774 - DNA, 22 bp, Homo sapiens
taaatgagggctgacatgattg

SEQ ID NO: 9390775 - DNA, 22 bp, Homo sapiens
taaatgagggctgacatgattg

SEQ ID NO: 9390776 - DNA, 22 bp, Homo sapiens
taaatgaagaaatggagattgt

SEQ ID NO: 9390777 - DNA, 22 bp, Homo sapiens
taaatgagatttgttcttttgt

SEQ ID NO: 9390778 - DNA, 22 bp, Homo sapiens
taaatgacattcttaagtcttg

SEQ ID NO: 9390779 - DNA, 22 bp, Homo sapiens
taacactgatttgttctcaggg

SEQ ID NO: 9390780 - DNA, 22 bp, Homo sapiens
taacactgtaaacctagatgtt

SEQ ID NO: 9390781 - DNA, 22 bp, Homo sapiens
taacactgtaaacctagatgtt

SEQ ID NO: 9390782 - DNA, 22 bp, Homo sapiens
taacactgtccaaagaattcca

SEQ ID NO: 9390783 - DNA, 22 bp, Homo sapiens
taacagaatagcagaaacagaa

SEQ ID NO: 9390784 - DNA, 22 bp, Homo sapiens
taacagaatcctgttattgcca

SEQ ID NO: 9390785 - DNA, 22 bp, Homo sapiens
taacagaatttgctaaactccg

SEQ ID NO: 9390786 - DNA, 22 bp, Homo sapiens
taacagaatttgctaaactccg

SEQ ID NO: 9390787 - DNA, 22 bp, Homo sapiens
taacagcaaccacagtgctggt

SEQ ID NO: 9390788 - DNA, 22 bp, Homo sapiens
taacagcactggcaggcactgt

SEQ ID NO: 9390789 - DNA, 22 bp, Homo sapiens
taacagcagggttacaggcatt

SEQ ID NO: 9390790 - DNA, 22 bp, Homo sapiens
taagaaatttagttatagaatg

SEQ ID NO: 9390791 - DNA, 22 bp, Homo sapiens
taagaacaagatgttcctgttt

SEQ ID NO: 9390792 - DNA, 22 bp, Homo sapiens
gtaaagaaggcaacctggttat

SEQ ID NO: 9390793 - DNA, 22 bp, Homo sapiens
gtaaagaagtttttgaatgcat

SEQ ID NO: 9390794 - DNA, 22 bp, Homo sapiens
gtaaagaagtttttgaatgcat

SEQ ID NO: 9390795 - DNA, 23 bp, Homo sapiens
gtaaaatacgcagtgcagtgtga

SEQ ID NO: 9390796 - DNA, 23 bp, Homo sapiens
gtaaaatacgcagtgcagtgtga

SEQ ID NO: 9390797 - DNA, 22 bp, Homo sapiens
gtaaacatgctgtgtactcagc

SEQ ID NO: 9390798 - DNA, 22 bp, Homo sapiens
gtaaacattactgtgctgtata

SEQ ID NO: 9390799 - DNA, 22 bp, Homo sapiens
gtaaacattttcatctgtgccc

SEQ ID NO: 9390800 - DNA, 21 bp, Homo sapiens
ggtgtcctgagggataggtag

SEQ ID NO: 9390801 - DNA, 21 bp, Homo sapiens
ggtgtcctgagggataggtag

SEQ ID NO: 9390802 - DNA, 22 bp, Homo sapiens
ggtgtcctcggattcagggcag

SEQ ID NO: 9390803 - DNA, 22 bp, Homo sapiens
ggtgtcctcggattcagggcag

SEQ ID NO: 9390804 - DNA, 22 bp, Homo sapiens
ggtgtcctcatgattttctaga

SEQ ID NO: 9390805 - DNA, 22 bp, Homo sapiens
ggtgtcctcactatagcaagtc

SEQ ID NO: 9390806 - DNA, 19 bp, Homo sapiens
ggtgtcctagagataagag

SEQ ID NO: 9390807 - DNA, 22 bp, Homo sapiens
ggtgtcctactgcttggttgct

SEQ ID NO: 9390808 - DNA, 22 bp, Homo sapiens
ggtgtcctcactatagcaagtc

SEQ ID NO: 9390809 - DNA, 22 bp, Homo sapiens
ggtgtcctcatgattttctaga

SEQ ID NO: 9390810 - DNA, 22 bp, Homo sapiens
ggtgtcctcatgattttctaga

SEQ ID NO: 9390811 - DNA, 22 bp, Homo sapiens
ggtgtcctgtcagctagagtga

SEQ ID NO: 9390812 - DNA, 22 bp, Homo sapiens
ggtgtcctgtcagctagagtga

SEQ ID NO: 9390813 - DNA, 22 bp, Homo sapiens
ggtgtcctgggcaggcagctga

SEQ ID NO: 9390814 - DNA, 22 bp, Homo sapiens
ggtgtcctgggcaggcagctga

SEQ ID NO: 9390815 - DNA, 23 bp, Homo sapiens
gtaaaatacgcagtgcagtgtga

SEQ ID NO: 9390816 - DNA, 22 bp, Homo sapiens
gtacacacaatctctggtcagt

SEQ ID NO: 9390817 - DNA, 21 bp, Homo sapiens
gtacacacaggtggatgggct

SEQ ID NO: 9390818 - DNA, 22 bp, Homo sapiens
gtacagaatgcttggtaaggca

SEQ ID NO: 9390819 - DNA, 22 bp, Homo sapiens
gtacaggaaggagggagtttca

SEQ ID NO: 9390820 - DNA, 22 bp, Homo sapiens
gtacagaggttgctggaggctc

SEQ ID NO: 9390821 - DNA, 22 bp, Homo sapiens
gtacagattaataatatactga

SEQ ID NO: 9390822 - DNA, 22 bp, Homo sapiens
gtacagattaataatatactga

SEQ ID NO: 9390823 - DNA, 22 bp, Homo sapiens
gtacagcatttgaaattactgg

SEQ ID NO: 9390824 - DNA, 22 bp, Homo sapiens
gtaaatataaatgctagctgcc

SEQ ID NO: 9390825 - DNA, 22 bp, Homo sapiens
gtaaatataaatgctagctgcc

SEQ ID NO: 9390826 - DNA, 22 bp, Homo sapiens
gtaaatattaaaggctgctaga

SEQ ID NO: 9390827 - DNA, 22 bp, Homo sapiens
gtatatattggataaaccagag

SEQ ID NO: 9390828 - DNA, 22 bp, Homo sapiens
gtatatattggataaaccagag

SEQ ID NO: 9390829 - DNA, 22 bp, Homo sapiens
gtatatatgtgtgaacatgtat

SEQ ID NO: 9390830 - DNA, 22 bp, Homo sapiens
gtatatatgtgtgaacatgtat

SEQ ID NO: 9390831 - DNA, 22 bp, Homo sapiens
gtatatctcttacatacacaca

SEQ ID NO: 9390832 - DNA, 21 bp, Homo sapiens
gtatggcattgattagttact

SEQ ID NO: 9390833 - DNA, 21 bp, Homo sapiens
gtatgtatggataatgagagg

SEQ ID NO: 9390834 - DNA, 22 bp, Homo sapiens
gtatgtatgtatatgtttaaga

SEQ ID NO: 9390835 - DNA, 22 bp, Homo sapiens
gtatgtatgtatatgtttaaga

SEQ ID NO: 9390836 - DNA, 22 bp, Homo sapiens
gtatgtatatatgtgtacacac

SEQ ID NO: 9390837 - DNA, 22 bp, Homo sapiens
gtatgtatacattgtggaatgg

SEQ ID NO: 9390838 - DNA, 22 bp, Homo sapiens
gtatgtatacattgtggaatgg

SEQ ID NO: 9390839 - DNA, 22 bp, Homo sapiens
gtatgtatatatgtgtacacac

SEQ ID NO: 9390840 - DNA, 22 bp, Homo sapiens
gtatggcactatcctctctgat

SEQ ID NO: 9390841 - DNA, 22 bp, Homo sapiens
gtatatcttcagaaattatagg

SEQ ID NO: 9390842 - DNA, 18 bp, Homo sapiens
gtatatctgcacatatac

SEQ ID NO: 9390843 - DNA, 22 bp, Homo sapiens
gtatataaggtaaagcgattgt

SEQ ID NO: 9390844 - DNA, 22 bp, Homo sapiens
gtatataaggtaaagcgattgt

SEQ ID NO: 9390845 - DNA, 22 bp, Homo sapiens
gtatatatcggcactattttaa

SEQ ID NO: 9390846 - DNA, 22 bp, Homo sapiens
gtatatatcggcactattttaa

SEQ ID NO: 9390847 - DNA, 22 bp, Homo sapiens
gtatactagatagacagtatca

SEQ ID NO: 9390848 - DNA, 20 bp, Homo sapiens
gtatataaccatagtgacta

SEQ ID NO: 9390849 - DNA, 20 bp, Homo sapiens
gtatataaccatagtgacta

SEQ ID NO: 9390850 - DNA, 19 bp, Homo sapiens
gtacagtggtaagctatga

SEQ ID NO: 9390851 - DNA, 22 bp, Homo sapiens
gtacagtgtgactttggagtga

SEQ ID NO: 9390852 - DNA, 22 bp, Homo sapiens
gtacagtggaggtctgtgttca

SEQ ID NO: 9390853 - DNA, 22 bp, Homo sapiens
gtacagtaatcccgttcttctg

SEQ ID NO: 9390854 - DNA, 22 bp, Homo sapiens
gtacatattaaaggtctataaa

SEQ ID NO: 9390855 - DNA, 22 bp, Homo sapiens
gtacatatggcacatgctattt

SEQ ID NO: 9390856 - DNA, 22 bp, Homo sapiens
gtacataagaaattactacaga

SEQ ID NO: 9390857 - DNA, 22 bp, Homo sapiens
gtacatttactgatgaaaagta

SEQ ID NO: 9390858 - DNA, 22 bp, Homo sapiens
gtacattggcaactctcttaga

SEQ ID NO: 9390859 - DNA, 22 bp, Homo sapiens
gtacatgcagattatagctaat

SEQ ID NO: 9390860 - DNA, 22 bp, Homo sapiens
gtacatgtgcacaatgtgcagg

SEQ ID NO: 9390861 - DNA, 22 bp, Homo sapiens
gtacatctttaaattgttcagt

SEQ ID NO: 9390862 - DNA, 22 bp, Homo sapiens
gtacatctgtcttgttctgttg

SEQ ID NO: 9390863 - DNA, 22 bp, Homo sapiens
gtacatattataaaatacagct

SEQ ID NO: 9390864 - DNA, 22 bp, Homo sapiens
gggtggggtgtatcggatccta

SEQ ID NO: 9390865 - DNA, 21 bp, Homo sapiens
gggtggggttccagccttttc

SEQ ID NO: 9390866 - DNA, 22 bp, Homo sapiens
gggtggggttcaggaatcttca

SEQ ID NO: 9390867 - DNA, 22 bp, Homo sapiens
gggtggggttcaggaatcttca

SEQ ID NO: 9390868 - DNA, 22 bp, Homo sapiens
gggtggggcccaggaaatctat

SEQ ID NO: 9390869 - DNA, 22 bp, Homo sapiens
gggtggggtgtatcggatccta

SEQ ID NO: 9390870 - DNA, 22 bp, Homo sapiens
gggtggggcccaggaaatctat

SEQ ID NO: 9390871 - DNA, 22 bp, Homo sapiens
gggtggggccaggcaatttgca

SEQ ID NO: 9390872 - DNA, 22 bp, Homo sapiens
gggtggggccaggcaatttgca

SEQ ID NO: 9390873 - DNA, 22 bp, Homo sapiens
ggtgagggtaaatataggcaaa

SEQ ID NO: 9390874 - DNA, 22 bp, Homo sapiens
ggtgagggtaaatataggcaaa

SEQ ID NO: 9390875 - DNA, 22 bp, Homo sapiens
ggtgagggtaaatataggcaaa

SEQ ID NO: 9390876 - DNA, 22 bp, Homo sapiens
ggtgaggggctcctctgcccgg

SEQ ID NO: 9390877 - DNA, 22 bp, Homo sapiens
ggtgagggtaaactaaaacatc

SEQ ID NO: 9390878 - DNA, 22 bp, Homo sapiens
ggtgaggggcgcctctgcccgg

SEQ ID NO: 9390879 - DNA, 22 bp, Homo sapiens
ggtgaggggcgcctctgcccag

SEQ ID NO: 9390880 - DNA, 22 bp, Homo sapiens
ggtgaggggcacctctgcccgg

SEQ ID NO: 9390881 - DNA, 22 bp, Homo sapiens
ggtgaggggagagtgaaagaaa

SEQ ID NO: 9390882 - DNA, 22 bp, Homo sapiens
ggtgcaggagcggggtgctcgg

SEQ ID NO: 9390883 - DNA, 22 bp, Homo sapiens
ggtgcaggagcggggtgctcgg

SEQ ID NO: 9390884 - DNA, 22 bp, Homo sapiens
ggtgcaggcggtggggcaagta

SEQ ID NO: 9390885 - DNA, 22 bp, Homo sapiens
ggtgcaggcggtggggcaagta

SEQ ID NO: 9390886 - DNA, 22 bp, Homo sapiens
ggtggcagcatggtcccagtgt

SEQ ID NO: 9390887 - DNA, 22 bp, Homo sapiens
ggtggcagaggtgcatcagccc

SEQ ID NO: 9390888 - DNA, 22 bp, Homo sapiens
ggtggcagaggtgcatcagccc

SEQ ID NO: 9390889 - DNA, 22 bp, Homo sapiens
ggtggcagaggtgcatcagccc

SEQ ID NO: 9390890 - DNA, 22 bp, Homo sapiens
ggtggcagagaggaggtagttt

SEQ ID NO: 9390891 - DNA, 22 bp, Homo sapiens
ggtgcaggaatctgcaattgaa

SEQ ID NO: 9390892 - DNA, 22 bp, Homo sapiens
ggtgcaggaatctgcaattgaa

SEQ ID NO: 9390893 - DNA, 22 bp, Homo sapiens
ggtgcaggaaaattacctggag

SEQ ID NO: 9390894 - DNA, 22 bp, Homo sapiens
ggtgcaggaaaattacctggag

SEQ ID NO: 9390895 - DNA, 22 bp, Homo sapiens
ggtgcaggacgaagtgggggtt

SEQ ID NO: 9390896 - DNA, 22 bp, Homo sapiens
ggtgcaggagcggggtgctcgg

SEQ ID NO: 9390897 - DNA, 22 bp, Homo sapiens
ggtgcaggagcggggtgctcgg

SEQ ID NO: 9390898 - DNA, 22 bp, Homo sapiens
ggtgcaggacgaagtgggggtt

SEQ ID NO: 9390899 - DNA, 22 bp, Homo sapiens
ggtgagttctcagcttattgca

SEQ ID NO: 9390900 - DNA, 22 bp, Homo sapiens
ggtgagtgcctggcctggccac

SEQ ID NO: 9390901 - DNA, 22 bp, Homo sapiens
ggtgatttatccattttctggt

SEQ ID NO: 9390902 - DNA, 22 bp, Homo sapiens
ggtgcaaaaatctatcaccagc

SEQ ID NO: 9390903 - DNA, 22 bp, Homo sapiens
ggtgattttcgagtttcatgtt

SEQ ID NO: 9390904 - DNA, 22 bp, Homo sapiens
ggtgatttccttttgcaaagtc

SEQ ID NO: 9390905 - DNA, 21 bp, Homo sapiens
ggtgattttagagaattgctg

SEQ ID NO: 9390906 - DNA, 22 bp, Homo sapiens
ggtgatcagccttctgatttct

SEQ ID NO: 9390907 - DNA, 22 bp, Homo sapiens
ggtggttcatgcctggaatccc

SEQ ID NO: 9390908 - DNA, 22 bp, Homo sapiens
ggtggttgcataggccagcagc

SEQ ID NO: 9390909 - DNA, 18 bp, Homo sapiens
ggtggtttggaagcaggt

SEQ ID NO: 9390910 - DNA, 22 bp, Homo sapiens
ggtgtagctctgtgtcccactg

SEQ ID NO: 9390911 - DNA, 22 bp, Homo sapiens
ggtgtagctctgtgtcccactg

SEQ ID NO: 9390912 - DNA, 22 bp, Homo sapiens
ggtgtcagactttgcatatcct

SEQ ID NO: 9390913 - DNA, 23 bp, Homo sapiens
ggtggtggtgagtcacgggctca

SEQ ID NO: 9390914 - DNA, 22 bp, Homo sapiens
ggtggccatggtcaggtagcgg

SEQ ID NO: 9390915 - DNA, 22 bp, Homo sapiens
ggtggccattctaccgccttct

SEQ ID NO: 9390916 - DNA, 22 bp, Homo sapiens
ggtggccctaaccgcagcctcc

SEQ ID NO: 9390917 - DNA, 22 bp, Homo sapiens
ggtggtggtcccgacttgggag

SEQ ID NO: 9390918 - DNA, 22 bp, Homo sapiens
ggtgtcccaggccagctgtgtg

SEQ ID NO: 9390919 - DNA, 22 bp, Homo sapiens
ggtgtccgcgctgtagaaggtc

SEQ ID NO: 9390920 - DNA, 22 bp, Homo sapiens
ggtgtcctactgcttggttgct

SEQ ID NO: 9390921 - DNA, 19 bp, Homo sapiens
ggtgtcctagagataagag

SEQ ID NO: 9390922 - DNA, 22 bp, Homo sapiens
ggtgtcctacagggccgcaggc

SEQ ID NO: 9390923 - DNA, 22 bp, Homo sapiens
ggtgtcctacagggccgcaggc

SEQ ID NO: 9390924 - DNA, 22 bp, Homo sapiens
ggtgtccatcaggctgtgcttc

SEQ ID NO: 9390925 - DNA, 22 bp, Homo sapiens
ggtgtcatccaacaggacaggg

SEQ ID NO: 9390926 - DNA, 22 bp, Homo sapiens
ggtgtccacattccctggcagg

SEQ ID NO: 9390927 - DNA, 22 bp, Homo sapiens
ggtgtcagtgagagcacagtac

SEQ ID NO: 9390928 - DNA, 22 bp, Homo sapiens
ggtgtcagtgagagcacagtac

SEQ ID NO: 9390929 - DNA, 22 bp, Homo sapiens
ggtgtcagttgctcatcagagt

SEQ ID NO: 9390930 - DNA, 22 bp, Homo sapiens
ggtgtcagttgctcatcagagt

SEQ ID NO: 9390931 - DNA, 20 bp, Homo sapiens
ggtgtcagggccatgcctgg

SEQ ID NO: 9390932 - DNA, 20 bp, Homo sapiens
ggtgtcagggccatgcctgg

SEQ ID NO: 9390933 - DNA, 22 bp, Homo sapiens
ggtgtcagcctgggagcctagc

SEQ ID NO: 9390934 - DNA, 16 bp, Homo sapiens
ggtgtcagatgtccag

SEQ ID NO: 9390935 - DNA, 22 bp, Homo sapiens
ggtgtcagatacataggaagta

SEQ ID NO: 9390936 - DNA, 22 bp, Homo sapiens
ggtgtcagatttgacatccaga

SEQ ID NO: 9390937 - DNA, 22 bp, Homo sapiens
ggtgtcagcctgggagcctagc

SEQ ID NO: 9390938 - DNA, 22 bp, Homo sapiens
ggtgtcaggaaaatctcagtgt

SEQ ID NO: 9390939 - DNA, 22 bp, Homo sapiens
ggtgtcaggaaaatctcagtgt

SEQ ID NO: 9390940 - DNA, 19 bp, Homo sapiens
ggtgtcaggcctctctcct

SEQ ID NO: 9390941 - DNA, 20 bp, Homo sapiens
ggtgtcagggccatgcctgg

SEQ ID NO: 9390942 - DNA, 20 bp, Homo sapiens
ggtgtcagggccatgcctgg

SEQ ID NO: 9390943 - DNA, 20 bp, Homo sapiens
ggtgtcagggccatgcctgg

SEQ ID NO: 9390944 - DNA, 22 bp, Homo sapiens
ggtggcaggctggcattggcaa

SEQ ID NO: 9390945 - DNA, 22 bp, Homo sapiens
ggtggcaggctggcattggcaa

SEQ ID NO: 9390946 - DNA, 22 bp, Homo sapiens
ggtggcaggctggcattggcaa

SEQ ID NO: 9390947 - DNA, 22 bp, Homo sapiens
ggtggcaggctggcattggcaa

SEQ ID NO: 9390948 - DNA, 22 bp, Homo sapiens
ggtggcaggctggcattggcaa

SEQ ID NO: 9390949 - DNA, 22 bp, Homo sapiens
ggtggcaggccctgagcatccc

SEQ ID NO: 9390950 - DNA, 22 bp, Homo sapiens
ggtggcaggccctgagcatccc

SEQ ID NO: 9390951 - DNA, 22 bp, Homo sapiens
ggtggcaggccctgagcatccc

SEQ ID NO: 9390952 - DNA, 23 bp, Homo sapiens
ggtggcaggagtggatgctgagc

SEQ ID NO: 9390953 - DNA, 23 bp, Homo sapiens
ggtggcaggagtggatgctgagc

SEQ ID NO: 9390954 - DNA, 23 bp, Homo sapiens
ggtggcaggagtggatgctgagc

SEQ ID NO: 9390955 - DNA, 22 bp, Homo sapiens
ggtggcaggccctgagcatccc

SEQ ID NO: 9390956 - DNA, 23 bp, Homo sapiens
ggtggcaggagtggatgctgagc

SEQ ID NO: 9390957 - DNA, 22 bp, Homo sapiens
ggtggcagcgtctatctgacat

SEQ ID NO: 9390958 - DNA, 22 bp, Homo sapiens
ggtggcagttacaggggcaaat

SEQ ID NO: 9390959 - DNA, 22 bp, Homo sapiens
ggtggcatcacagtactggggg

SEQ ID NO: 9390960 - DNA, 22 bp, Homo sapiens
ggtggcatacatttctgtcttg

SEQ ID NO: 9390961 - DNA, 22 bp, Homo sapiens
ggtggcatctcagttcatgggc

SEQ ID NO: 9390962 - DNA, 22 bp, Homo sapiens
ggtggcatctctttccagattt

SEQ ID NO: 9390963 - DNA, 22 bp, Homo sapiens
ggtggcatggcagttgatgtaa

SEQ ID NO: 9390964 - DNA, 22 bp, Homo sapiens
ggtggccaggccagctctggcc

SEQ ID NO: 9390965 - DNA, 22 bp, Homo sapiens
ggtggccataggaccagcctgg

SEQ ID NO: 9390966 - DNA, 22 bp, Homo sapiens
ggtggccataggaccagcctgg

SEQ ID NO: 9390967 - DNA, 22 bp, Homo sapiens
ggtggcattcagaagagctggc

SEQ ID NO: 9390968 - DNA, 22 bp, Homo sapiens
ggtggccaggccagctctggcc

SEQ ID NO: 9390969 - DNA, 22 bp, Homo sapiens
ggtggccaggagacatttgtca

SEQ ID NO: 9390970 - DNA, 22 bp, Homo sapiens
gtcccaggtgggctccacctct

SEQ ID NO: 9390971 - DNA, 22 bp, Homo sapiens
gtcccaggtgcccagtgggcag

SEQ ID NO: 9390972 - DNA, 22 bp, Homo sapiens
gtcccaggtcccagcacatctg

SEQ ID NO: 9390973 - DNA, 22 bp, Homo sapiens
gtcccagggatgcagacatgag

SEQ ID NO: 9390974 - DNA, 22 bp, Homo sapiens
gtcccagggatgcagacatgag

SEQ ID NO: 9390975 - DNA, 22 bp, Homo sapiens
gtcccagggaggttcagggctt

SEQ ID NO: 9390976 - DNA, 22 bp, Homo sapiens
gtcccagggatgcagacatgag

SEQ ID NO: 9390977 - DNA, 22 bp, Homo sapiens
gtcccagggatgcagacatgag

SEQ ID NO: 9390978 - DNA, 22 bp, Homo sapiens
gtcctgtgtgttgccggctgaa

SEQ ID NO: 9390979 - DNA, 22 bp, Homo sapiens
gtcctgtgtgagtgcaccacct

SEQ ID NO: 9390980 - DNA, 22 bp, Homo sapiens
gtccttcaaggtccttggtgtg

SEQ ID NO: 9390981 - DNA, 22 bp, Homo sapiens
gtcctgggtccccgcaggtcag

SEQ ID NO: 9390982 - DNA, 22 bp, Homo sapiens
gtcctgggtccccgcaggtcag

SEQ ID NO: 9390983 - DNA, 22 bp, Homo sapiens
gtcctgggtccccgcaggtcag

SEQ ID NO: 9390984 - DNA, 22 bp, Homo sapiens
gtcctgtgtcccagagaaagag

SEQ ID NO: 9390985 - DNA, 22 bp, Homo sapiens
gtcccagggaagaaggcagcac

SEQ ID NO: 9390986 - DNA, 22 bp, Homo sapiens
gtcccagaaacatattgctggt

SEQ ID NO: 9390987 - DNA, 22 bp, Homo sapiens
gtccattttattcagagacttt

SEQ ID NO: 9390988 - DNA, 22 bp, Homo sapiens
gtcccacaccttgaggggtctt

SEQ ID NO: 9390989 - DNA, 22 bp, Homo sapiens
gtcccacaggaactcggtggag

SEQ ID NO: 9390990 - DNA, 22 bp, Homo sapiens
gtccatctaagtatccagcctg

SEQ ID NO: 9390991 - DNA, 22 bp, Homo sapiens
gtccatctcttattgatcctaa

SEQ ID NO: 9390992 - DNA, 22 bp, Homo sapiens
gtccatctgtaggagggacaca

SEQ ID NO: 9390993 - DNA, 22 bp, Homo sapiens
gtccaggtctggaccctgagcc

SEQ ID NO: 9390994 - DNA, 22 bp, Homo sapiens
gtccagggccccgagcaccagg

SEQ ID NO: 9390995 - DNA, 22 bp, Homo sapiens
gtccagggccccgagcaccagg

SEQ ID NO: 9390996 - DNA, 22 bp, Homo sapiens
gtccagtgacaagtagctggcc

SEQ ID NO: 9390997 - DNA, 22 bp, Homo sapiens
gtccagtgacaagtagctggcc

SEQ ID NO: 9390998 - DNA, 22 bp, Homo sapiens
gtccatccagaggccaccatgg

SEQ ID NO: 9390999 - DNA, 22 bp, Homo sapiens
gtccatccagggtcaccatgac

SEQ ID NO: 9391000 - DNA, 22 bp, Homo sapiens
gtccatccgtggtagcatggat

SEQ ID NO: 9391001 - DNA, 22 bp, Homo sapiens
gtccagtgtgtttatcttggat

SEQ ID NO: 9391002 - DNA, 21 bp, Homo sapiens
gtcagctgtgtgtgaggaccc

SEQ ID NO: 9391003 - DNA, 22 bp, Homo sapiens
gtcagctgcagtgggcacagcc

SEQ ID NO: 9391004 - DNA, 22 bp, Homo sapiens
gtcagctgcacaggtgggagct

SEQ ID NO: 9391005 - DNA, 22 bp, Homo sapiens
gtcagaggggacaagacacaga

SEQ ID NO: 9391006 - DNA, 22 bp, Homo sapiens
gtattacaaataaatgttactg

SEQ ID NO: 9391007 - DNA, 22 bp, Homo sapiens
gtattacatttagtaattaggc

SEQ ID NO: 9391008 - DNA, 22 bp, Homo sapiens
gtattacatttagtaattaggc

SEQ ID NO: 9391009 - DNA, 22 bp, Homo sapiens
gtatgtctatttcaaatagctg

SEQ ID NO: 9391010 - DNA, 22 bp, Homo sapiens
gtatgtctgagtaataatgtgt

SEQ ID NO: 9391011 - DNA, 22 bp, Homo sapiens
gtatgtgaggttggtttccagg

SEQ ID NO: 9391012 - DNA, 22 bp, Homo sapiens
gtatgtgaggttggtttccagg

SEQ ID NO: 9391013 - DNA, 22 bp, Homo sapiens
gtatgtgtaagtatgccacctt

SEQ ID NO: 9391014 - DNA, 22 bp, Homo sapiens
gtatgtgtaagtatgccacctt

SEQ ID NO: 9391015 - DNA, 22 bp, Homo sapiens
gtatgtgtgcaaatgtaaatat

SEQ ID NO: 9391016 - DNA, 22 bp, Homo sapiens
gtatgtgtgcaaatgtaaatat

SEQ ID NO: 9391017 - DNA, 22 bp, Homo sapiens
gtccagggaaatagcgacaggg

SEQ ID NO: 9391018 - DNA, 22 bp, Homo sapiens
gtcaggctgctggagcttgggt

SEQ ID NO: 9391019 - DNA, 22 bp, Homo sapiens
gtccagggaaatagcgacaggg

SEQ ID NO: 9391020 - DNA, 22 bp, Homo sapiens
gtccagggaaatagcgacaggg

SEQ ID NO: 9391021 - DNA, 21 bp, Homo sapiens
gtcaggcccatagcagtgcct

SEQ ID NO: 9391022 - DNA, 22 bp, Homo sapiens
gtcaggactctgacccgtcccg

SEQ ID NO: 9391023 - DNA, 22 bp, Homo sapiens
gtcaggagagatcaggacagca

SEQ ID NO: 9391024 - DNA, 22 bp, Homo sapiens
gtcaggagatagggcaagcttc

SEQ ID NO: 9391025 - DNA, 22 bp, Homo sapiens
gtcaggagaggccatcagcttt

SEQ ID NO: 9391026 - DNA, 22 bp, Homo sapiens
gtcaggagagatcaggacagca

SEQ ID NO: 9391027 - DNA, 22 bp, Homo sapiens
gtcaggagatagggcaagcttc

SEQ ID NO: 9391028 - DNA, 22 bp, Homo sapiens
gtcaggacaggctctggactga

SEQ ID NO: 9391029 - DNA, 22 bp, Homo sapiens
gtcaggaaaacccgggttgact

SEQ ID NO: 9391030 - DNA, 19 bp, Homo sapiens
gtcaggaagtactttccgg

SEQ ID NO: 9391031 - DNA, 21 bp, Homo sapiens
gtctgatgcttgatgcagttg

SEQ ID NO: 9391032 - DNA, 22 bp, Homo sapiens
gtctgagggttgtgctggagga

SEQ ID NO: 9391033 - DNA, 22 bp, Homo sapiens
gtctggcacataagaggagctc

SEQ ID NO: 9391034 - DNA, 22 bp, Homo sapiens
gtctgcatacaggacatgcaca

SEQ ID NO: 9391035 - DNA, 22 bp, Homo sapiens
gtctggctccgaggagtggcag

SEQ ID NO: 9391036 - DNA, 22 bp, Homo sapiens
gtctggctctggaaggcaaagg

SEQ ID NO: 9391037 - DNA, 22 bp, Homo sapiens
gtctggctcccactcttacaaa

SEQ ID NO: 9391038 - DNA, 22 bp, Homo sapiens
gtctggctgttcctgcctgtga

SEQ ID NO: 9391039 - DNA, 22 bp, Homo sapiens
gtctggctgataaaatgctctt

SEQ ID NO: 9391040 - DNA, 22 bp, Homo sapiens
gtctggcagatcgagcagccca

SEQ ID NO: 9391041 - DNA, 22 bp, Homo sapiens
gtctggcagatcgagcagccca

SEQ ID NO: 9391042 - DNA, 22 bp, Homo sapiens
gtctggcattcttcctggagaa

SEQ ID NO: 9391043 - DNA, 22 bp, Homo sapiens
gtctggcattcttcctggagaa

SEQ ID NO: 9391044 - DNA, 22 bp, Homo sapiens
gtctggccatttgcccattgtg

SEQ ID NO: 9391045 - DNA, 22 bp, Homo sapiens
gtctggctccaggatctcatga

SEQ ID NO: 9391046 - DNA, 22 bp, Homo sapiens
gtctggctaattttggtaattt

SEQ ID NO: 9391047 - DNA, 22 bp, Homo sapiens
gtctgggctcccagggtcggcg

SEQ ID NO: 9391048 - DNA, 22 bp, Homo sapiens
gtctgggctcccagggtcggcg

SEQ ID NO: 9391049 - DNA, 22 bp, Homo sapiens
gtctgggccaggcgagccgagg

SEQ ID NO: 9391050 - DNA, 22 bp, Homo sapiens
gtctgggctcctggcaggcagc

SEQ ID NO: 9391051 - DNA, 22 bp, Homo sapiens
gtctgggctcctggcaggcagc

SEQ ID NO: 9391052 - DNA, 22 bp, Homo sapiens
gtctgggcttagggacatggca

SEQ ID NO: 9391053 - DNA, 17 bp, Homo sapiens
gtctgggctttagagac

SEQ ID NO: 9391054 - DNA, 22 bp, Homo sapiens
gtctgggcaagggagatggcgc

SEQ ID NO: 9391055 - DNA, 22 bp, Homo sapiens
gtctgggcaagggagatggcgc

SEQ ID NO: 9391056 - DNA, 22 bp, Homo sapiens
gtctgggccaggcgagccgagg

SEQ ID NO: 9391057 - DNA, 22 bp, Homo sapiens
gtctggctttcatggctctgca

SEQ ID NO: 9391058 - DNA, 22 bp, Homo sapiens
gtctggctttgctcagatgctg

SEQ ID NO: 9391059 - DNA, 22 bp, Homo sapiens
gtctggctttatatttgctatt

SEQ ID NO: 9391060 - DNA, 20 bp, Homo sapiens
gtctggcttcgtgattctgg

SEQ ID NO: 9391061 - DNA, 22 bp, Homo sapiens
gtctgggcaagggagatggcgc

SEQ ID NO: 9391062 - DNA, 22 bp, Homo sapiens
gtctgggagtttggtgctgccg

SEQ ID NO: 9391063 - DNA, 22 bp, Homo sapiens
gtcggccacgcaggtgcggtag

SEQ ID NO: 9391064 - DNA, 22 bp, Homo sapiens
gtcgctgaggagatgtgcaagg

SEQ ID NO: 9391065 - DNA, 22 bp, Homo sapiens
gtccttggcttcttgttgactg

SEQ ID NO: 9391066 - DNA, 22 bp, Homo sapiens
gtccttggctgtggctgtaatg

SEQ ID NO: 9391067 - DNA, 22 bp, Homo sapiens
gtccttggaggtgtggaatctg

SEQ ID NO: 9391068 - DNA, 22 bp, Homo sapiens
gtccttgcttgagacaggcagt

SEQ ID NO: 9391069 - DNA, 22 bp, Homo sapiens
gtccttggagtcaggcaaggct

SEQ ID NO: 9391070 - DNA, 22 bp, Homo sapiens
gtccttggcacccatgtgattc

SEQ ID NO: 9391071 - DNA, 22 bp, Homo sapiens
gtccttggcctgggtagagtgg

SEQ ID NO: 9391072 - DNA, 22 bp, Homo sapiens
gtccttctcaaatcctgtgttt

SEQ ID NO: 9391073 - DNA, 22 bp, Homo sapiens
gtccttcttttcatccctggtt

SEQ ID NO: 9391074 - DNA, 22 bp, Homo sapiens
gtccttgagtaagtcatggtgg

SEQ ID NO: 9391075 - DNA, 22 bp, Homo sapiens
gtccttctcaaatcctgtgttt

SEQ ID NO: 9391076 - DNA, 22 bp, Homo sapiens
gtccttcatctggagcctggtc

SEQ ID NO: 9391077 - DNA, 22 bp, Homo sapiens
gtccttcatttcctgatctcta

SEQ ID NO: 9391078 - DNA, 22 bp, Homo sapiens
gtccttcagcacctccctcggc

SEQ ID NO: 9391079 - DNA, 22 bp, Homo sapiens
gtccttcaagtaacctgggacc

SEQ ID NO: 9391080 - DNA, 22 bp, Homo sapiens
gtctgagggagaaggatctggg

SEQ ID NO: 9391081 - DNA, 22 bp, Homo sapiens
gtctgagggagaaggatctggg

SEQ ID NO: 9391082 - DNA, 22 bp, Homo sapiens
gtctgagggacagagtcctggc

SEQ ID NO: 9391083 - DNA, 22 bp, Homo sapiens
gtctgaggcctgaggccctggg

SEQ ID NO: 9391084 - DNA, 20 bp, Homo sapiens
gtctgaggagcagtgggaaa

SEQ ID NO: 9391085 - DNA, 22 bp, Homo sapiens
gtctgaggaagatgcaggggga

SEQ ID NO: 9391086 - DNA, 22 bp, Homo sapiens
gtctctgagctctgagctggct

SEQ ID NO: 9391087 - DNA, 22 bp, Homo sapiens
gtctctgagctctgagctggct

SEQ ID NO: 9391088 - DNA, 22 bp, Homo sapiens
gtctcttttatggtgagttgat

SEQ ID NO: 9391089 - DNA, 22 bp, Homo sapiens
gtctcttttatggtgagttgat

SEQ ID NO: 9391090 - DNA, 22 bp, Homo sapiens
gtctgacacctagagtccagga

SEQ ID NO: 9391091 - DNA, 22 bp, Homo sapiens
gtctgaatacgtacttgtgaag

SEQ ID NO: 9391092 - DNA, 22 bp, Homo sapiens
gtctgaatgatgagtgggactc

SEQ ID NO: 9391093 - DNA, 22 bp, Homo sapiens
gtctgagaatcttgcatatcat

SEQ ID NO: 9391094 - DNA, 22 bp, Homo sapiens
gtggcagctggtatgcagacag

SEQ ID NO: 9391095 - DNA, 22 bp, Homo sapiens
gtggcagctgtgggacactggt

SEQ ID NO: 9391096 - DNA, 22 bp, Homo sapiens
gtggcagctggtatgcagacag

SEQ ID NO: 9391097 - DNA, 22 bp, Homo sapiens
gtggcaggagactggaagatgg

SEQ ID NO: 9391098 - DNA, 22 bp, Homo sapiens
gtggcaggagactggaagatgg

SEQ ID NO: 9391099 - DNA, 22 bp, Homo sapiens
gtggcaggagagacacagccat

SEQ ID NO: 9391100 - DNA, 22 bp, Homo sapiens
gtggcaggagactggaagatgg

SEQ ID NO: 9391101 - DNA, 22 bp, Homo sapiens
gtggcagctgtgttgcagtttt

SEQ ID NO: 9391102 - DNA, 22 bp, Homo sapiens
gtggcaggatcacggctcactg

SEQ ID NO: 9391103 - DNA, 22 bp, Homo sapiens
gtggcaggatcacggctcactg

SEQ ID NO: 9391104 - DNA, 22 bp, Homo sapiens
gtggcaggagtgggccttgaag

SEQ ID NO: 9391105 - DNA, 22 bp, Homo sapiens
gtggcaggagggcatcacttgg

SEQ ID NO: 9391106 - DNA, 22 bp, Homo sapiens
gtggcaggagagacacagccat

SEQ ID NO: 9391107 - DNA, 22 bp, Homo sapiens
gtggcaggagagacacagccat

SEQ ID NO: 9391108 - DNA, 22 bp, Homo sapiens
gtggcaggagagacacagccat

SEQ ID NO: 9391109 - DNA, 20 bp, Homo sapiens
gtggcaggcagtgaaggagc

SEQ ID NO: 9391110 - DNA, 20 bp, Homo sapiens
gtggcaggcagtgaaggagc

SEQ ID NO: 9391111 - DNA, 20 bp, Homo sapiens
gtggcaggcagtgaaggagc

SEQ ID NO: 9391112 - DNA, 20 bp, Homo sapiens
gtggcaggcagtgaaggagc

SEQ ID NO: 9391113 - DNA, 22 bp, Homo sapiens
gtggcaggatcacggctcactg

SEQ ID NO: 9391114 - DNA, 20 bp, Homo sapiens
gtggcaggcagtgaaggagc

SEQ ID NO: 9391115 - DNA, 22 bp, Homo sapiens
gtggcaggatcacggctcactg

SEQ ID NO: 9391116 - DNA, 22 bp, Homo sapiens
gtggcaggatcacggctcactg

SEQ ID NO: 9391117 - DNA, 22 bp, Homo sapiens
gtggcaggatcacggctcactg

SEQ ID NO: 9391118 - DNA, 22 bp, Homo sapiens
gtggcaggatcacggctcactg

SEQ ID NO: 9391119 - DNA, 22 bp, Homo sapiens
gtggcagggcaatgctccctct

SEQ ID NO: 9391120 - DNA, 22 bp, Homo sapiens
gtggcagggcaatgctccctct

SEQ ID NO: 9391121 - DNA, 22 bp, Homo sapiens
gtggcagggagaagccattggg

SEQ ID NO: 9391122 - DNA, 22 bp, Homo sapiens
gtggcagggagaagccattggg

SEQ ID NO: 9391123 - DNA, 22 bp, Homo sapiens
gtggcagggagaagccattggg

SEQ ID NO: 9391124 - DNA, 22 bp, Homo sapiens
gtggcaggggcgggctgttccg

SEQ ID NO: 9391125 - DNA, 22 bp, Homo sapiens
gtggcagggctttgctgttctt

SEQ ID NO: 9391126 - DNA, 22 bp, Homo sapiens
gtggcagggctttgctgttctt

SEQ ID NO: 9391127 - DNA, 22 bp, Homo sapiens
gtggcagggctttgctgttctt

SEQ ID NO: 9391128 - DNA, 22 bp, Homo sapiens
gtggcagggcaatgctccctct

SEQ ID NO: 9391129 - DNA, 22 bp, Homo sapiens
gtggccaaaaggaagaaggtta

SEQ ID NO: 9391130 - DNA, 22 bp, Homo sapiens
gtggcattttagaacagctgac

SEQ ID NO: 9391131 - DNA, 22 bp, Homo sapiens
gtggcatttgggagatgcgtgg

SEQ ID NO: 9391132 - DNA, 22 bp, Homo sapiens
gtggcatttggaaagagcacta

SEQ ID NO: 9391133 - DNA, 22 bp, Homo sapiens
gtggccaataggagcagctatc

SEQ ID NO: 9391134 - DNA, 22 bp, Homo sapiens
gtggccaaggtgcagagcagct

SEQ ID NO: 9391135 - DNA, 22 bp, Homo sapiens
gtggccaagaggggactggata

SEQ ID NO: 9391136 - DNA, 22 bp, Homo sapiens
gtggcattgacagcttcagtgg

SEQ ID NO: 9391137 - DNA, 22 bp, Homo sapiens
gtggcattatcttaagacgatt

SEQ ID NO: 9391138 - DNA, 22 bp, Homo sapiens
gtggcattctcggcaccatctg

SEQ ID NO: 9391139 - DNA, 22 bp, Homo sapiens
gtggcatttgctgaagagcggt

SEQ ID NO: 9391140 - DNA, 22 bp, Homo sapiens
gtggcatttgaacaatcacata

SEQ ID NO: 9391141 - DNA, 22 bp, Homo sapiens
gtggcatttactctgactgaaa

SEQ ID NO: 9391142 - DNA, 22 bp, Homo sapiens
gtggcatttactctgactgaaa

SEQ ID NO: 9391143 - DNA, 22 bp, Homo sapiens
gtggcattgccttctgcaggaa

SEQ ID NO: 9391144 - DNA, 22 bp, Homo sapiens
gtggcattgccttctgcaggaa

SEQ ID NO: 9391145 - DNA, 22 bp, Homo sapiens
gtggcattgacatgtaaacagt

SEQ ID NO: 9391146 - DNA, 22 bp, Homo sapiens
gtggcattgaggtatttggttg

SEQ ID NO: 9391147 - DNA, 22 bp, Homo sapiens
gtggcattaggccaggtgcata

SEQ ID NO: 9391148 - DNA, 22 bp, Homo sapiens
gtggcatgtgcctgtaatctca

SEQ ID NO: 9391149 - DNA, 22 bp, Homo sapiens
gtggcaggggtattccagctga

SEQ ID NO: 9391150 - DNA, 22 bp, Homo sapiens
gtggcaggggtattccagctga

SEQ ID NO: 9391151 - DNA, 22 bp, Homo sapiens
gtggcaggggtattccagctga

SEQ ID NO: 9391152 - DNA, 22 bp, Homo sapiens
gtggcaggggtattccagctga

SEQ ID NO: 9391153 - DNA, 22 bp, Homo sapiens
gtggcaggggcgggctgttccg

SEQ ID NO: 9391154 - DNA, 22 bp, Homo sapiens
gtggcaggggcgggctgttccg

SEQ ID NO: 9391155 - DNA, 22 bp, Homo sapiens
gtggcagggtgctcatcatgca

SEQ ID NO: 9391156 - DNA, 22 bp, Homo sapiens
gtggcagggtgctcatcatgca

SEQ ID NO: 9391157 - DNA, 22 bp, Homo sapiens
gtggcaggggtattccagctga

SEQ ID NO: 9391158 - DNA, 22 bp, Homo sapiens
gtggcatcgtctgaggtggggt

SEQ ID NO: 9391159 - DNA, 22 bp, Homo sapiens
gtggcatcagagctccctccag

SEQ ID NO: 9391160 - DNA, 22 bp, Homo sapiens
gtggcccaggctggagtgcagt

SEQ ID NO: 9391161 - DNA, 22 bp, Homo sapiens
gtggcccaggttggagtgcagt

SEQ ID NO: 9391162 - DNA, 22 bp, Homo sapiens
gtggcccaggcttggcgctggc

SEQ ID NO: 9391163 - DNA, 21 bp, Homo sapiens
gtggccctgccgcagtgtcca

SEQ ID NO: 9391164 - DNA, 22 bp, Homo sapiens
gtggccctctgatagggtcagg

SEQ ID NO: 9391165 - DNA, 22 bp, Homo sapiens
gtggccctgagccctttgacag

SEQ ID NO: 9391166 - DNA, 22 bp, Homo sapiens
gtggccctctgatagggtcagg

SEQ ID NO: 9391167 - DNA, 22 bp, Homo sapiens
gtggccctcagcagttgccaag

SEQ ID NO: 9391168 - DNA, 22 bp, Homo sapiens
gtggccctctgatagggtcagg

SEQ ID NO: 9391169 - DNA, 22 bp, Homo sapiens
gtggccctcagcagttgccaag

SEQ ID NO: 9391170 - DNA, 22 bp, Homo sapiens
gtggccctatttgaggacccca

SEQ ID NO: 9391171 - DNA, 22 bp, Homo sapiens
gtggccctaacaccgtttctca

SEQ ID NO: 9391172 - DNA, 22 bp, Homo sapiens
gtggccaggagagggtgggaca

SEQ ID NO: 9391173 - DNA, 22 bp, Homo sapiens
gtggccaggagagggtgggaca

SEQ ID NO: 9391174 - DNA, 22 bp, Homo sapiens
gtggccaggccgactgccaggc

SEQ ID NO: 9391175 - DNA, 22 bp, Homo sapiens
gtggccaggagagggtgggaca

SEQ ID NO: 9391176 - DNA, 22 bp, Homo sapiens
gtggccaggccgactgccaggc

SEQ ID NO: 9391177 - DNA, 22 bp, Homo sapiens
gtggccagctgtcagcaccctt

SEQ ID NO: 9391178 - DNA, 22 bp, Homo sapiens
gtggccagctgtcagcaccctt

SEQ ID NO: 9391179 - DNA, 22 bp, Homo sapiens
gtggccaggacattgccaggca

SEQ ID NO: 9391180 - DNA, 22 bp, Homo sapiens
gtggccaggagaccttgggcat

SEQ ID NO: 9391181 - DNA, 22 bp, Homo sapiens
gtggccaggagaccttgggcat

SEQ ID NO: 9391182 - DNA, 22 bp, Homo sapiens
gtggccaggacattgccaggca

SEQ ID NO: 9391183 - DNA, 22 bp, Homo sapiens
gtggccaggacattgccaggca

SEQ ID NO: 9391184 - DNA, 22 bp, Homo sapiens
gtggccagccccatggacagtt

SEQ ID NO: 9391185 - DNA, 18 bp, Homo sapiens
gtggccagcctggtcttg

SEQ ID NO: 9391186 - DNA, 18 bp, Homo sapiens
gtggccagcctggtcttg

SEQ ID NO: 9391187 - DNA, 18 bp, Homo sapiens
gtggccagcctggtcttg

SEQ ID NO: 9391188 - DNA, 18 bp, Homo sapiens
gtggccagcctggtcttg

SEQ ID NO: 9391189 - DNA, 22 bp, Homo sapiens
gtggccagccagggtgctgatg

SEQ ID NO: 9391190 - DNA, 22 bp, Homo sapiens
gtggccagccccatggacagtt

SEQ ID NO: 9391191 - DNA, 22 bp, Homo sapiens
gtggccagccccatggacagtt

SEQ ID NO: 9391192 - DNA, 22 bp, Homo sapiens
gtggccagccccatggacagtt

SEQ ID NO: 9391193 - DNA, 22 bp, Homo sapiens
gtggccagccagggtgctgatg

SEQ ID NO: 9391194 - DNA, 22 bp, Homo sapiens
gtggccagccagggtgctgatg

SEQ ID NO: 9391195 - DNA, 22 bp, Homo sapiens
gtggccagccagggtgctgatg

SEQ ID NO: 9391196 - DNA, 22 bp, Homo sapiens
gtggccagcaagtgctgcctct

SEQ ID NO: 9391197 - DNA, 22 bp, Homo sapiens
gtggccagagtgtcattttatt

SEQ ID NO: 9391198 - DNA, 22 bp, Homo sapiens
gtggccagagtgtcattttatt

SEQ ID NO: 9391199 - DNA, 22 bp, Homo sapiens
gtggccagcaagtgctgcctct

SEQ ID NO: 9391200 - DNA, 22 bp, Homo sapiens
gtggccagcaagtgctgcctct

SEQ ID NO: 9391201 - DNA, 22 bp, Homo sapiens
gtggccagaggtcccatgtgtc

SEQ ID NO: 9391202 - DNA, 22 bp, Homo sapiens
gtggccagaggtcccatgtgtc

SEQ ID NO: 9391203 - DNA, 22 bp, Homo sapiens
gtggccagaggtcccatgtgtc

SEQ ID NO: 9391204 - DNA, 22 bp, Homo sapiens
gtggccagaggatttgttcagt

SEQ ID NO: 9391205 - DNA, 22 bp, Homo sapiens
gtggccagagattaaatagagt

SEQ ID NO: 9391206 - DNA, 22 bp, Homo sapiens
gtggccagaatcttgaggcctt

SEQ ID NO: 9391207 - DNA, 22 bp, Homo sapiens
gtggccagaatcttgaggcctt

SEQ ID NO: 9391208 - DNA, 22 bp, Homo sapiens
gtggccagaatcttgaggcctt

SEQ ID NO: 9391209 - DNA, 22 bp, Homo sapiens
gtggccagaaccaggagaatga

SEQ ID NO: 9391210 - DNA, 22 bp, Homo sapiens
gtggccagaaccaggagaatga

SEQ ID NO: 9391211 - DNA, 22 bp, Homo sapiens
gtggccagaaccaggagaatga

SEQ ID NO: 9391212 - DNA, 22 bp, Homo sapiens
gtggccagaagttaagtggtta

SEQ ID NO: 9391213 - DNA, 22 bp, Homo sapiens
gtggccagaagttaagtggtta

SEQ ID NO: 9391214 - DNA, 22 bp, Homo sapiens
gtggccagaagttaagtggtta

SEQ ID NO: 9391215 - DNA, 22 bp, Homo sapiens
gtggccagaagactgcaatgct

SEQ ID NO: 9391216 - DNA, 22 bp, Homo sapiens
gtggccagaagactgcaatgct

SEQ ID NO: 9391217 - DNA, 22 bp, Homo sapiens
gtggctggtttcctgcatgcaa

SEQ ID NO: 9391218 - DNA, 22 bp, Homo sapiens
gtggctggtttcctgcatgcaa

SEQ ID NO: 9391219 - DNA, 22 bp, Homo sapiens
gtggctggtttcctgcatgcaa

SEQ ID NO: 9391220 - DNA, 22 bp, Homo sapiens
gtggcttcatcaactgtgctta

SEQ ID NO: 9391221 - DNA, 22 bp, Homo sapiens
gtggctggccctggaccctaag

SEQ ID NO: 9391222 - DNA, 22 bp, Homo sapiens
gtggctggagtatgaggaaagg

SEQ ID NO: 9391223 - DNA, 22 bp, Homo sapiens
gtggctggagtatgaggaaagg

SEQ ID NO: 9391224 - DNA, 22 bp, Homo sapiens
gtggctggagtatgaggaaagg

SEQ ID NO: 9391225 - DNA, 22 bp, Homo sapiens
gtggctgggctccgagcggctt

SEQ ID NO: 9391226 - DNA, 22 bp, Homo sapiens
gtggctgggctccgagcggctt

SEQ ID NO: 9391227 - DNA, 22 bp, Homo sapiens
gtggctgcagcggctgtggaga

SEQ ID NO: 9391228 - DNA, 22 bp, Homo sapiens
gtggctgcagctctgaacggac

SEQ ID NO: 9391229 - DNA, 22 bp, Homo sapiens
gtggctgcagtagtgtagggtc

SEQ ID NO: 9391230 - DNA, 22 bp, Homo sapiens
gtggctgcatcggggtgaccag

SEQ ID NO: 9391231 - DNA, 22 bp, Homo sapiens
gtggctgcagagggcacagcat

SEQ ID NO: 9391232 - DNA, 22 bp, Homo sapiens
gtggctgcagagggcacagcat

SEQ ID NO: 9391233 - DNA, 22 bp, Homo sapiens
gtggctgcagcccagcggcacg

SEQ ID NO: 9391234 - DNA, 22 bp, Homo sapiens
gtggctgcagcccagcggcacg

SEQ ID NO: 9391235 - DNA, 22 bp, Homo sapiens
gtggctgcagcccagcggcacg

SEQ ID NO: 9391236 - DNA, 22 bp, Homo sapiens
gtggctgctgtcctctctggtt

SEQ ID NO: 9391237 - DNA, 22 bp, Homo sapiens
gtggctgctgtcctctctggtt

SEQ ID NO: 9391238 - DNA, 22 bp, Homo sapiens
gtggctgctcgggctccggccc

SEQ ID NO: 9391239 - DNA, 22 bp, Homo sapiens
gtggctgctggtactctgggaa

SEQ ID NO: 9391240 - DNA, 22 bp, Homo sapiens
gtggctgctggtactctgggaa

SEQ ID NO: 9391241 - DNA, 22 bp, Homo sapiens
gtggctgctaagtctccttcct

SEQ ID NO: 9391242 - DNA, 22 bp, Homo sapiens
gtggctgctaagtctccttcct

SEQ ID NO: 9391243 - DNA, 19 bp, Homo sapiens
gtggctgccgatcgcggct

SEQ ID NO: 9391244 - DNA, 19 bp, Homo sapiens
gtggctgccgatcgcggct

SEQ ID NO: 9391245 - DNA, 22 bp, Homo sapiens
gtggctgctacagagctggagg

SEQ ID NO: 9391246 - DNA, 22 bp, Homo sapiens
gtggctgctcgggctccggccc

SEQ ID NO: 9391247 - DNA, 22 bp, Homo sapiens
gtgggagcttcatcaagcagtt

SEQ ID NO: 9391248 - DNA, 22 bp, Homo sapiens
gtgggagtttgaacttcatgtt

SEQ ID NO: 9391249 - DNA, 22 bp, Homo sapiens
gtgggagtggggaagcagagtg

SEQ ID NO: 9391250 - DNA, 22 bp, Homo sapiens
gtgggagtggagctcagcatgt

SEQ ID NO: 9391251 - DNA, 22 bp, Homo sapiens
gtgggatgcttaggatcttgcc

SEQ ID NO: 9391252 - DNA, 22 bp, Homo sapiens
gtgggatgcagtggtgagtggc

SEQ ID NO: 9391253 - DNA, 22 bp, Homo sapiens
gtgggatgcagtggtgagtggc

SEQ ID NO: 9391254 - DNA, 22 bp, Homo sapiens
gtgggagtttgaacttcatgtt

SEQ ID NO: 9391255 - DNA, 22 bp, Homo sapiens
gtgggagagaccccgcttaggg

SEQ ID NO: 9391256 - DNA, 22 bp, Homo sapiens
gtgggagaagccctgttcgtag

SEQ ID NO: 9391257 - DNA, 22 bp, Homo sapiens
gtgggagaagccctgttcgtag

SEQ ID NO: 9391258 - DNA, 22 bp, Homo sapiens
gtgggagaatggccttgcaaac

SEQ ID NO: 9391259 - DNA, 22 bp, Homo sapiens
gtgggagaatggccttgcaaac

SEQ ID NO: 9391260 - DNA, 22 bp, Homo sapiens
gtgggagaagatttggtcatct

SEQ ID NO: 9391261 - DNA, 22 bp, Homo sapiens
gtgggagaagatttggtcatct

SEQ ID NO: 9391262 - DNA, 22 bp, Homo sapiens
gtgggagaaattagctctagtt

SEQ ID NO: 9391263 - DNA, 22 bp, Homo sapiens
gtgggactcttctttggcagtg

SEQ ID NO: 9391264 - DNA, 22 bp, Homo sapiens
gtgggagaaattagctctagtt

SEQ ID NO: 9391265 - DNA, 22 bp, Homo sapiens
gtggcttccatgtgcatctgac

SEQ ID NO: 9391266 - DNA, 22 bp, Homo sapiens
gtggcttccaagactaagtcac

SEQ ID NO: 9391267 - DNA, 22 bp, Homo sapiens
gtggcttcatgaacactgatga

SEQ ID NO: 9391268 - DNA, 22 bp, Homo sapiens
gtggcttcatcaactgtgctta

SEQ ID NO: 9391269 - DNA, 22 bp, Homo sapiens
gtggcctgccgtgtggtatggg

SEQ ID NO: 9391270 - DNA, 19 bp, Homo sapiens
gtggcctgcgctgggtgcg

SEQ ID NO: 9391271 - DNA, 19 bp, Homo sapiens
gtggcctgcgctgggtgcg

SEQ ID NO: 9391272 - DNA, 22 bp, Homo sapiens
gtggcctgatgccagccctgtg

SEQ ID NO: 9391273 - DNA, 21 bp, Homo sapiens
gtggcctgattatgaatgggt

SEQ ID NO: 9391274 - DNA, 21 bp, Homo sapiens
gtggcctgattatgaatgggt

SEQ ID NO: 9391275 - DNA, 22 bp, Homo sapiens
gtggcctgagcttcagagttgg

SEQ ID NO: 9391276 - DNA, 22 bp, Homo sapiens
gtggcctgccagcagatggcgc

SEQ ID NO: 9391277 - DNA, 22 bp, Homo sapiens
gtggcctgccagcagatggcgc

SEQ ID NO: 9391278 - DNA, 22 bp, Homo sapiens
gtggcctgcaggcaccttgggg

SEQ ID NO: 9391279 - DNA, 22 bp, Homo sapiens
gtggcctagaggtgcaaggaac

SEQ ID NO: 9391280 - DNA, 22 bp, Homo sapiens
gtggccctttgttttgatacct

SEQ ID NO: 9391281 - DNA, 22 bp, Homo sapiens
gtggcctcctccgtccgcctct

SEQ ID NO: 9391282 - DNA, 21 bp, Homo sapiens
gtggccctggtgtggctgcac

SEQ ID NO: 9391283 - DNA, 22 bp, Homo sapiens
gtggccctgtcccaggcctcct

SEQ ID NO: 9391284 - DNA, 22 bp, Homo sapiens
gtggccctgtcccaggcctcct

SEQ ID NO: 9391285 - DNA, 22 bp, Homo sapiens
gtggccctggagttgtgacact

SEQ ID NO: 9391286 - DNA, 22 bp, Homo sapiens
gtggcccttggagttgtgacct

SEQ ID NO: 9391287 - DNA, 22 bp, Homo sapiens
gtggcccttgaagcagcttcat

SEQ ID NO: 9391288 - DNA, 20 bp, Homo sapiens
gtggcccttaaagagggaag

SEQ ID NO: 9391289 - DNA, 20 bp, Homo sapiens
gtggcccttaaagagggaag

SEQ ID NO: 9391290 - DNA, 22 bp, Homo sapiens
gtggccctgtgaacagcgcagt

SEQ ID NO: 9391291 - DNA, 22 bp, Homo sapiens
gtggccctgtgaacagcgcagt

SEQ ID NO: 9391292 - DNA, 22 bp, Homo sapiens
gtggcctggcgagctggcgcgg

SEQ ID NO: 9391293 - DNA, 22 bp, Homo sapiens
gtggcctggggtttgttctgag

SEQ ID NO: 9391294 - DNA, 22 bp, Homo sapiens
gtggctcagcggagctctgcac

SEQ ID NO: 9391295 - DNA, 22 bp, Homo sapiens
gtggctccttttcaggaggctg

SEQ ID NO: 9391296 - DNA, 22 bp, Homo sapiens
gtggctctaggtgagcatggag

SEQ ID NO: 9391297 - DNA, 22 bp, Homo sapiens
gtggctgacaaccactggagga

SEQ ID NO: 9391298 - DNA, 22 bp, Homo sapiens
gtggctgacaaccactggagga

SEQ ID NO: 9391299 - DNA, 22 bp, Homo sapiens
gtggctgagcagcagagagctg

SEQ ID NO: 9391300 - DNA, 22 bp, Homo sapiens
gtggctgagcagcagagagctg

SEQ ID NO: 9391301 - DNA, 22 bp, Homo sapiens
gtggctgagtggtcgagtcaga

SEQ ID NO: 9391302 - DNA, 22 bp, Homo sapiens
gtggctgagcagcagagagctg

SEQ ID NO: 9391303 - DNA, 17 bp, Homo sapiens
gtggctgcacacacatg

SEQ ID NO: 9391304 - DNA, 17 bp, Homo sapiens
gtggctgcacacacatg

SEQ ID NO: 9391305 - DNA, 17 bp, Homo sapiens
gtggctgcacacacatg

SEQ ID NO: 9391306 - DNA, 22 bp, Homo sapiens
gtggctgcagagccagcaagct

SEQ ID NO: 9391307 - DNA, 22 bp, Homo sapiens
gtggctgcagagggcacagcat

SEQ ID NO: 9391308 - DNA, 22 bp, Homo sapiens
gtggctgcagagccagcaagct

SEQ ID NO: 9391309 - DNA, 22 bp, Homo sapiens
gtggctgcagagccagcaagct

SEQ ID NO: 9391310 - DNA, 22 bp, Homo sapiens
gtggctctctggtcccctgcca

SEQ ID NO: 9391311 - DNA, 22 bp, Homo sapiens
gtggctctctggtcccctgcca

SEQ ID NO: 9391312 - DNA, 22 bp, Homo sapiens
gtggagtggtgatggataggtt

SEQ ID NO: 9391313 - DNA, 22 bp, Homo sapiens
gtggagtggtgatggataggtt

SEQ ID NO: 9391314 - DNA, 22 bp, Homo sapiens
gtggatctggctgtgtcctggc

SEQ ID NO: 9391315 - DNA, 22 bp, Homo sapiens
gtggatgcttaggcagcctggg

SEQ ID NO: 9391316 - DNA, 18 bp, Homo sapiens
gtggatgcattgggaggg

SEQ ID NO: 9391317 - DNA, 22 bp, Homo sapiens
gtggagtggcctggccctgaga

SEQ ID NO: 9391318 - DNA, 22 bp, Homo sapiens
gtggagtggcctggccctgaga

SEQ ID NO: 9391319 - DNA, 22 bp, Homo sapiens
gtggagtggcctggccctgaga

SEQ ID NO: 9391320 - DNA, 22 bp, Homo sapiens
gtggagtgcaacggttggagtt

SEQ ID NO: 9391321 - DNA, 22 bp, Homo sapiens
gtggagtgcaacggttggagtt

SEQ ID NO: 9391322 - DNA, 22 bp, Homo sapiens
gtggaggtcccgggcaggagca

SEQ ID NO: 9391323 - DNA, 22 bp, Homo sapiens
gtggagggtttgcaatgtgcag

SEQ ID NO: 9391324 - DNA, 22 bp, Homo sapiens
gtggagggtgattgccggctgt

SEQ ID NO: 9391325 - DNA, 22 bp, Homo sapiens
gtggagggtgattgccggctgt

SEQ ID NO: 9391326 - DNA, 22 bp, Homo sapiens
gtggagggtttgcaatgtgcag

SEQ ID NO: 9391327 - DNA, 18 bp, Homo sapiens
gtggagggttctcagaat

SEQ ID NO: 9391328 - DNA, 22 bp, Homo sapiens
gtggagggtgagctcatgtttg

SEQ ID NO: 9391329 - DNA, 22 bp, Homo sapiens
gtggagggaatgaatcttctct

SEQ ID NO: 9391330 - DNA, 22 bp, Homo sapiens
gtggagggaatgaatcttctct

SEQ ID NO: 9391331 - DNA, 22 bp, Homo sapiens
gtggaggacaaaagaagccttt

SEQ ID NO: 9391332 - DNA, 22 bp, Homo sapiens
gtggaggacaaaagaagccttt

SEQ ID NO: 9391333 - DNA, 22 bp, Homo sapiens
gtggaggaagggattcagacca

SEQ ID NO: 9391334 - DNA, 22 bp, Homo sapiens
gtggagccctggtagggacccc

SEQ ID NO: 9391335 - DNA, 22 bp, Homo sapiens
gtggagagagataagcctggtc

SEQ ID NO: 9391336 - DNA, 22 bp, Homo sapiens
gtggagagagtgacagcatctt

SEQ ID NO: 9391337 - DNA, 22 bp, Homo sapiens
gtggagagagtgacagcatctt

SEQ ID NO: 9391338 - DNA, 22 bp, Homo sapiens
gtggagagcaaataattggaat

SEQ ID NO: 9391339 - DNA, 23 bp, Homo sapiens
gtggagagattagtaattcaccc

SEQ ID NO: 9391340 - DNA, 23 bp, Homo sapiens
gtggagagattagtaattcaccc

SEQ ID NO: 9391341 - DNA, 23 bp, Homo sapiens
gtggagagattagtaattcaccc

SEQ ID NO: 9391342 - DNA, 22 bp, Homo sapiens
gtggagagagtgacagcatctt

SEQ ID NO: 9391343 - DNA, 22 bp, Homo sapiens
gtggagaggaacccagctctgt

SEQ ID NO: 9391344 - DNA, 22 bp, Homo sapiens
gtggagagcaaataattggaat

SEQ ID NO: 9391345 - DNA, 22 bp, Homo sapiens
gtggagaggaacccagctctgt

SEQ ID NO: 9391346 - DNA, 22 bp, Homo sapiens
gtggagaggaacccagctctgt

SEQ ID NO: 9391347 - DNA, 22 bp, Homo sapiens
gtggagaggaacccagctctgt

SEQ ID NO: 9391348 - DNA, 22 bp, Homo sapiens
gtggacaggcaggctgtcgggg

SEQ ID NO: 9391349 - DNA, 22 bp, Homo sapiens
gtggacagcttctaggtgccag

SEQ ID NO: 9391350 - DNA, 22 bp, Homo sapiens
gtggacagacataatcctaatt

SEQ ID NO: 9391351 - DNA, 22 bp, Homo sapiens
gtggaattgctggataatatca

SEQ ID NO: 9391352 - DNA, 22 bp, Homo sapiens
gtggacagagataataaactga

SEQ ID NO: 9391353 - DNA, 22 bp, Homo sapiens
gtggagagagataagcctggtc

SEQ ID NO: 9391354 - DNA, 22 bp, Homo sapiens
gtggagagagataagcctggtc

SEQ ID NO: 9391355 - DNA, 22 bp, Homo sapiens
gtggagagagataagcctggtc

SEQ ID NO: 9391356 - DNA, 22 bp, Homo sapiens
gtggacaggcaggctgtcgggg

SEQ ID NO: 9391357 - DNA, 22 bp, Homo sapiens
gtggcacagggtgtggcacaca

SEQ ID NO: 9391358 - DNA, 22 bp, Homo sapiens
gtggcacagggtgtggcacaca

SEQ ID NO: 9391359 - DNA, 22 bp, Homo sapiens
gtggcacagggttgttggtcat

SEQ ID NO: 9391360 - DNA, 22 bp, Homo sapiens
gtggcacagccaagcctcactc

SEQ ID NO: 9391361 - DNA, 22 bp, Homo sapiens
gtggcacagagatggggcatga

SEQ ID NO: 9391362 - DNA, 22 bp, Homo sapiens
gtggcaagtgttccaagaggcg

SEQ ID NO: 9391363 - DNA, 22 bp, Homo sapiens
gtggcacagagatggggcatga

SEQ ID NO: 9391364 - DNA, 22 bp, Homo sapiens
gtggcacacaggagagagctca

SEQ ID NO: 9391365 - DNA, 22 bp, Homo sapiens
gtggcactaaatacagcatttc

SEQ ID NO: 9391366 - DNA, 22 bp, Homo sapiens
gtggcacagtgggagagcccca

SEQ ID NO: 9391367 - DNA, 22 bp, Homo sapiens
gtggcacagtgggagagcccca

SEQ ID NO: 9391368 - DNA, 22 bp, Homo sapiens
gtggcacataggatcctgtggc

SEQ ID NO: 9391369 - DNA, 22 bp, Homo sapiens
gtggcacagtgggagagcccca

SEQ ID NO: 9391370 - DNA, 22 bp, Homo sapiens
gtggcacattggtagggtctgt

SEQ ID NO: 9391371 - DNA, 22 bp, Homo sapiens
gtggcacattggtagggtctgt

SEQ ID NO: 9391372 - DNA, 22 bp, Homo sapiens
gtggatggagctggaagccatt

SEQ ID NO: 9391373 - DNA, 22 bp, Homo sapiens
gtggatggagctggaagccatt

SEQ ID NO: 9391374 - DNA, 22 bp, Homo sapiens
gtggatggattgaggcagtggg

SEQ ID NO: 9391375 - DNA, 22 bp, Homo sapiens
gtggcagcaaatgcctggacta

SEQ ID NO: 9391376 - DNA, 22 bp, Homo sapiens
gtggcagcagaggggtggtatg

SEQ ID NO: 9391377 - DNA, 22 bp, Homo sapiens
gtggcagcaaatgcctggacta

SEQ ID NO: 9391378 - DNA, 22 bp, Homo sapiens
gtggcagcaaatgcctggacta

SEQ ID NO: 9391379 - DNA, 22 bp, Homo sapiens
gtggcagcaggtactcacgcac

SEQ ID NO: 9391380 - DNA, 16 bp, Homo sapiens
gtggcagccccttctc

SEQ ID NO: 9391381 - DNA, 22 bp, Homo sapiens
gtggcagcatggcttttagctg

SEQ ID NO: 9391382 - DNA, 22 bp, Homo sapiens
gtggcagccatgagaatataac

SEQ ID NO: 9391383 - DNA, 19 bp, Homo sapiens
gtggcagcagatttggtgt

SEQ ID NO: 9391384 - DNA, 19 bp, Homo sapiens
gtggcagcagatttggtgt

SEQ ID NO: 9391385 - DNA, 19 bp, Homo sapiens
gtggcagcagatttggtgt

SEQ ID NO: 9391386 - DNA, 22 bp, Homo sapiens
gtggcagcggcccaggccgtct

SEQ ID NO: 9391387 - DNA, 22 bp, Homo sapiens
gtggcagcggcccaggccgtct

SEQ ID NO: 9391388 - DNA, 22 bp, Homo sapiens
gtggcagccgcaggccctgtgt

SEQ ID NO: 9391389 - DNA, 18 bp, Homo sapiens
gtggcagcctttggcttt

SEQ ID NO: 9391390 - DNA, 22 bp, Homo sapiens
gtggcagccgcaggccctgtgt

SEQ ID NO: 9391391 - DNA, 22 bp, Homo sapiens
gtggcagctctcttgatttccc

SEQ ID NO: 9391392 - DNA, 22 bp, Homo sapiens
gtggcagctcatgttgttttaa

SEQ ID NO: 9391393 - DNA, 22 bp, Homo sapiens
gtggcagctacatttaatgcaa

SEQ ID NO: 9391394 - DNA, 22 bp, Homo sapiens
gtggcagcggtgtgcaaggagg

SEQ ID NO: 9391395 - DNA, 22 bp, Homo sapiens
gtggcagcggtgtgcaaggagg

SEQ ID NO: 9391396 - DNA, 22 bp, Homo sapiens
gtggcagcggtgtgcaaggagg

SEQ ID NO: 9391397 - DNA, 22 bp, Homo sapiens
gtggcagcggtgtgcaaggagg

SEQ ID NO: 9391398 - DNA, 22 bp, Homo sapiens
gtggcagattgctcaccatggt

SEQ ID NO: 9391399 - DNA, 22 bp, Homo sapiens
gtggcagcaaaatcctgcattc

SEQ ID NO: 9391400 - DNA, 22 bp, Homo sapiens
gtggcagcaaaatcctgcattc

SEQ ID NO: 9391401 - DNA, 22 bp, Homo sapiens
gtggcagagccgtgcaggtagg

SEQ ID NO: 9391402 - DNA, 22 bp, Homo sapiens
gtggcagaggctctgggaccag

SEQ ID NO: 9391403 - DNA, 22 bp, Homo sapiens
gtggcagagccttgcggctttg

SEQ ID NO: 9391404 - DNA, 22 bp, Homo sapiens
gtggcagaggctctgggaccag

SEQ ID NO: 9391405 - DNA, 22 bp, Homo sapiens
gtggcagagggtgagctggact

SEQ ID NO: 9391406 - DNA, 22 bp, Homo sapiens
gtgcctggaccctctttccgga

SEQ ID NO: 9391407 - DNA, 22 bp, Homo sapiens
gtgcctggaatgcgcctcggcg

SEQ ID NO: 9391408 - DNA, 22 bp, Homo sapiens
gtgcctggaatgcgcctcggcg

SEQ ID NO: 9391409 - DNA, 22 bp, Homo sapiens
gtgcctggaatgcgcctcggcg

SEQ ID NO: 9391410 - DNA, 22 bp, Homo sapiens
gtgcctggaactgggtaggctg

SEQ ID NO: 9391411 - DNA, 22 bp, Homo sapiens
gtgcctggaactgggtaggctg

SEQ ID NO: 9391412 - DNA, 22 bp, Homo sapiens
gtgcctgcagcaatccatggca

SEQ ID NO: 9391413 - DNA, 22 bp, Homo sapiens
gtgcctgagccagctgcagctc

SEQ ID NO: 9391414 - DNA, 22 bp, Homo sapiens
gtgcctgctgcagagtcgctgt

SEQ ID NO: 9391415 - DNA, 22 bp, Homo sapiens
gtgcctgctgcagctgagcagt

SEQ ID NO: 9391416 - DNA, 22 bp, Homo sapiens
gtgacatttcccatcagtatcc

SEQ ID NO: 9391417 - DNA, 22 bp, Homo sapiens
gtgacatttacgaatcttatcc

SEQ ID NO: 9391418 - DNA, 22 bp, Homo sapiens
gtgacattcaggatatcaatgg

SEQ ID NO: 9391419 - DNA, 22 bp, Homo sapiens
gtgacaggtatactcaccattg

SEQ ID NO: 9391420 - DNA, 22 bp, Homo sapiens
gtgacagtcaaagacatgactt

SEQ ID NO: 9391421 - DNA, 22 bp, Homo sapiens
gtgacagtggtcacttgtagtt

SEQ ID NO: 9391422 - DNA, 22 bp, Homo sapiens
gtgacagtggtcacttgtagtt

SEQ ID NO: 9391423 - DNA, 20 bp, Homo sapiens
gtgaccagaagacagtgggt

SEQ ID NO: 9391424 - DNA, 22 bp, Homo sapiens
gtgaccagtgatgctgaggagt

SEQ ID NO: 9391425 - DNA, 22 bp, Homo sapiens
gtgaccagccagtgctgtctgt

SEQ ID NO: 9391426 - DNA, 22 bp, Homo sapiens
gtgaccagcccatagagaggcg

SEQ ID NO: 9391427 - DNA, 22 bp, Homo sapiens
gtgaccagccagtgctgtctgt

SEQ ID NO: 9391428 - DNA, 22 bp, Homo sapiens
gtgaccagagcgggagattggg

SEQ ID NO: 9391429 - DNA, 20 bp, Homo sapiens
gtgaaggctaagcacagagg

SEQ ID NO: 9391430 - DNA, 20 bp, Homo sapiens
gtgaagggagtcaggtgtgc

SEQ ID NO: 9391431 - DNA, 20 bp, Homo sapiens
gtgaagggagtcaggtgtgc

SEQ ID NO: 9391432 - DNA, 22 bp, Homo sapiens
gtgacaggccactgcggctctg

SEQ ID NO: 9391433 - DNA, 22 bp, Homo sapiens
gtgacagggggcttggtttcta

SEQ ID NO: 9391434 - DNA, 22 bp, Homo sapiens
gtgacaggccactgcggctctg

SEQ ID NO: 9391435 - DNA, 22 bp, Homo sapiens
gtgacagagttttagatctcat

SEQ ID NO: 9391436 - DNA, 22 bp, Homo sapiens
gtgacagattatagggagcgtt

SEQ ID NO: 9391437 - DNA, 22 bp, Homo sapiens
gtgacagatttgctgcgcatgg

SEQ ID NO: 9391438 - DNA, 22 bp, Homo sapiens
gtgacagagtgagaccttgtct

SEQ ID NO: 9391439 - DNA, 22 bp, Homo sapiens
gtggaaattttaggatcatctt

SEQ ID NO: 9391440 - DNA, 22 bp, Homo sapiens
gtggaaatgcccccaaatagtg

SEQ ID NO: 9391441 - DNA, 22 bp, Homo sapiens
gtggaaatagtttggttataga

SEQ ID NO: 9391442 - DNA, 22 bp, Homo sapiens
gtgctacatggtagtgtagtta

SEQ ID NO: 9391443 - DNA, 19 bp, Homo sapiens
gtgctttttaagagctcag

SEQ ID NO: 9391444 - DNA, 22 bp, Homo sapiens
gtggaagctgatgggagacagg

SEQ ID NO: 9391445 - DNA, 22 bp, Homo sapiens
gtggaagcctaagagtagggag

SEQ ID NO: 9391446 - DNA, 22 bp, Homo sapiens
gtggaagcctactcttgtggtt

SEQ ID NO: 9391447 - DNA, 22 bp, Homo sapiens
gtggaagcaaccctggcaggag

SEQ ID NO: 9391448 - DNA, 22 bp, Homo sapiens
gtggaagcaggttgctaacagg

SEQ ID NO: 9391449 - DNA, 22 bp, Homo sapiens
gtggaagcagtaaggcaagttt

SEQ ID NO: 9391450 - DNA, 22 bp, Homo sapiens
gtggaagcaaccctggcaggag

SEQ ID NO: 9391451 - DNA, 22 bp, Homo sapiens
gtggaaggtgaaggagcagcga

SEQ ID NO: 9391452 - DNA, 22 bp, Homo sapiens
gtggaatgtccttgatcataag

SEQ ID NO: 9391453 - DNA, 22 bp, Homo sapiens
gtggaatggccatgggatcctt

SEQ ID NO: 9391454 - DNA, 20 bp, Homo sapiens
gtggaatgcactctgtgctg

SEQ ID NO: 9391455 - DNA, 22 bp, Homo sapiens
gtggaaggaattaacagactag

SEQ ID NO: 9391456 - DNA, 22 bp, Homo sapiens
gtggaaggaagagatggcccca

SEQ ID NO: 9391457 - DNA, 22 bp, Homo sapiens
gtgcctggcagggtcagctgct

SEQ ID NO: 9391458 - DNA, 22 bp, Homo sapiens
gtgcctggcatgcgccggtgct

SEQ ID NO: 9391459 - DNA, 22 bp, Homo sapiens
gtgcctggcacacagaaggcaa

SEQ ID NO: 9391460 - DNA, 20 bp, Homo sapiens
gtgcctggagaagaggctgt

SEQ ID NO: 9391461 - DNA, 20 bp, Homo sapiens
gtgcctggagaagaggctgt

SEQ ID NO: 9391462 - DNA, 21 bp, Homo sapiens
gtgcggatgccgtcattgtca

SEQ ID NO: 9391463 - DNA, 22 bp, Homo sapiens
gtgcggatcggtgtcctccaaa

SEQ ID NO: 9391464 - DNA, 22 bp, Homo sapiens
gtgcgcttcttcctgagccagg

SEQ ID NO: 9391465 - DNA, 22 bp, Homo sapiens
gtgcggtcaacatcagcagttg

SEQ ID NO: 9391466 - DNA, 22 bp, Homo sapiens
gtgcgggggttcccagcagccg

SEQ ID NO: 9391467 - DNA, 22 bp, Homo sapiens
gtgctaattgaccatttgatat

SEQ ID NO: 9391468 - DNA, 22 bp, Homo sapiens
gtgctaagtgcaggatattgaa

SEQ ID NO: 9391469 - DNA, 22 bp, Homo sapiens
gtgcgtttctttcccagcttcg

SEQ ID NO: 9391470 - DNA, 22 bp, Homo sapiens
gggacgagccccaggctggagg

SEQ ID NO: 9391471 - DNA, 22 bp, Homo sapiens
gggacgacaggctctgtggtag

SEQ ID NO: 9391472 - DNA, 22 bp, Homo sapiens
gggacgagatcttggcagtgtg

SEQ ID NO: 9391473 - DNA, 22 bp, Homo sapiens
gggacgtgagtgaagaaggtct

SEQ ID NO: 9391474 - DNA, 22 bp, Homo sapiens
gggagaagaatgtgtcaattgt

SEQ ID NO: 9391475 - DNA, 22 bp, Homo sapiens
gggagaaggagctagttcttga

SEQ ID NO: 9391476 - DNA, 22 bp, Homo sapiens
gggagaagaatgtgtcaattgt

SEQ ID NO: 9391477 - DNA, 22 bp, Homo sapiens
gggagaactgggtggagcatct

SEQ ID NO: 9391478 - DNA, 22 bp, Homo sapiens
gggagaaatgtctggcctgctg

SEQ ID NO: 9391479 - DNA, 22 bp, Homo sapiens
gggacttcatagctaggcactt

SEQ ID NO: 9391480 - DNA, 22 bp, Homo sapiens
gggacctgccaaggccacccag

SEQ ID NO: 9391481 - DNA, 22 bp, Homo sapiens
gggacctgccattgctcacagg

SEQ ID NO: 9391482 - DNA, 22 bp, Homo sapiens
gggacctgccaaggccacccag

SEQ ID NO: 9391483 - DNA, 22 bp, Homo sapiens
gggacctgcgccactcactgtc

SEQ ID NO: 9391484 - DNA, 22 bp, Homo sapiens
gggacctgcgccactcactgtc

SEQ ID NO: 9391485 - DNA, 22 bp, Homo sapiens
gggacctggcgagggtcacaca

SEQ ID NO: 9391486 - DNA, 22 bp, Homo sapiens
gggacctgggccagaggacagt

SEQ ID NO: 9391487 - DNA, 22 bp, Homo sapiens
gggacctggcgagggtcacaca

SEQ ID NO: 9391488 - DNA, 22 bp, Homo sapiens
gggacctggtctagcactgagc

SEQ ID NO: 9391489 - DNA, 22 bp, Homo sapiens
gggaggaggaatgttttgtgta

SEQ ID NO: 9391490 - DNA, 22 bp, Homo sapiens
gggaggagggtgctggctaaac

SEQ ID NO: 9391491 - DNA, 20 bp, Homo sapiens
gggaggccccagagtccagg

SEQ ID NO: 9391492 - DNA, 22 bp, Homo sapiens
gggagaaggaggactgtgctgt

SEQ ID NO: 9391493 - DNA, 22 bp, Homo sapiens
gggagaaggaggactgtgctgt

SEQ ID NO: 9391494 - DNA, 20 bp, Homo sapiens
gggagaagggctgatgagag

SEQ ID NO: 9391495 - DNA, 22 bp, Homo sapiens
gggaggctcagtggtgtcctct

SEQ ID NO: 9391496 - DNA, 22 bp, Homo sapiens
gggaggctctgctcagcccccg

SEQ ID NO: 9391497 - DNA, 22 bp, Homo sapiens
gggaggctctgctcagcccccg

SEQ ID NO: 9391498 - DNA, 22 bp, Homo sapiens
gggaggctgccatccttcagga

SEQ ID NO: 9391499 - DNA, 22 bp, Homo sapiens
gggaggctgccatccttcagga

SEQ ID NO: 9391500 - DNA, 22 bp, Homo sapiens
gggaggcgccgagggtagctaa

SEQ ID NO: 9391501 - DNA, 22 bp, Homo sapiens
gggaggcgccgagggtagctaa

SEQ ID NO: 9391502 - DNA, 18 bp, Homo sapiens
gggaggccccagcaggag

SEQ ID NO: 9391503 - DNA, 20 bp, Homo sapiens
gggaggcgagggctgagcag

SEQ ID NO: 9391504 - DNA, 17 bp, Homo sapiens
gggaggccttggtttcc

SEQ ID NO: 9391505 - DNA, 20 bp, Homo sapiens
gggaggcgagggctgagcag

SEQ ID NO: 9391506 - DNA, 22 bp, Homo sapiens
gggagggaaggaccttatgaat

SEQ ID NO: 9391507 - DNA, 22 bp, Homo sapiens
gggagggaaagcttgatctgtc

SEQ ID NO: 9391508 - DNA, 22 bp, Homo sapiens
gggagggaaggtacctgtgtga

SEQ ID NO: 9391509 - DNA, 22 bp, Homo sapiens
gggaggctggctctggccacag

SEQ ID NO: 9391510 - DNA, 22 bp, Homo sapiens
gggaggctggctctggccacag

SEQ ID NO: 9391511 - DNA, 22 bp, Homo sapiens
gggaggcttgagccatactgcc

SEQ ID NO: 9391512 - DNA, 22 bp, Homo sapiens
gggaggcttgagccatactgcc

SEQ ID NO: 9391513 - DNA, 22 bp, Homo sapiens
gggagggaaagcttgatctgtc

SEQ ID NO: 9391514 - DNA, 22 bp, Homo sapiens
gggatgaggatcaatcagggag

SEQ ID NO: 9391515 - DNA, 22 bp, Homo sapiens
gggatctgagtaggcagaagct

SEQ ID NO: 9391516 - DNA, 22 bp, Homo sapiens
gggagggaaggtacctgtgtga

SEQ ID NO: 9391517 - DNA, 22 bp, Homo sapiens
gggatgataatgccagagttaa

SEQ ID NO: 9391518 - DNA, 22 bp, Homo sapiens
gggatgaggatcaatcagggag

SEQ ID NO: 9391519 - DNA, 22 bp, Homo sapiens
gggatggatcttggctgaggct

SEQ ID NO: 9391520 - DNA, 22 bp, Homo sapiens
gggatggcctagactagcttgg

SEQ ID NO: 9391521 - DNA, 22 bp, Homo sapiens
gggatggctcaaaggagtcagg

SEQ ID NO: 9391522 - DNA, 22 bp, Homo sapiens
gggatggctcaaaggagtcagg

SEQ ID NO: 9391523 - DNA, 22 bp, Homo sapiens
gggatggagggtagagcaagtg

SEQ ID NO: 9391524 - DNA, 22 bp, Homo sapiens
gggatggatcttggctgaggct

SEQ ID NO: 9391525 - DNA, 22 bp, Homo sapiens
gggatggatcttggctgaggct

SEQ ID NO: 9391526 - DNA, 22 bp, Homo sapiens
gggatggatcttggctgaggct

SEQ ID NO: 9391527 - DNA, 22 bp, Homo sapiens
gggatggactgacggtagcgcg

SEQ ID NO: 9391528 - DNA, 22 bp, Homo sapiens
gggatggactgacggtagcgcg

SEQ ID NO: 9391529 - DNA, 22 bp, Homo sapiens
gggatggagggtagagcaagtg

SEQ ID NO: 9391530 - DNA, 22 bp, Homo sapiens
gggatggacttggggactccag

SEQ ID NO: 9391531 - DNA, 22 bp, Homo sapiens
gggatggagggtagagcaagtg

SEQ ID NO: 9391532 - DNA, 19 bp, Homo sapiens
gggatgggccctcaccctc

SEQ ID NO: 9391533 - DNA, 22 bp, Homo sapiens
gggatgggagagcatttagaga

SEQ ID NO: 9391534 - DNA, 22 bp, Homo sapiens
gggatggctttgtggctgactc

SEQ ID NO: 9391535 - DNA, 22 bp, Homo sapiens
gggatggggagctggaaagggg

SEQ ID NO: 9391536 - DNA, 22 bp, Homo sapiens
gggatggggagctggaaagggg

SEQ ID NO: 9391537 - DNA, 22 bp, Homo sapiens
gggcagaggggcgcttccctct

SEQ ID NO: 9391538 - DNA, 22 bp, Homo sapiens
gggcagaggggcgcttccctct

SEQ ID NO: 9391539 - DNA, 22 bp, Homo sapiens
gggatggggagctggaaagggg

SEQ ID NO: 9391540 - DNA, 19 bp, Homo sapiens
gggcccagcatggagggtt

SEQ ID NO: 9391541 - DNA, 22 bp, Homo sapiens
gggcccagccctctgctcactg

SEQ ID NO: 9391542 - DNA, 22 bp, Homo sapiens
gggcctgttcatgccaccggga

SEQ ID NO: 9391543 - DNA, 22 bp, Homo sapiens
gggcctgtctcactccctggtt

SEQ ID NO: 9391544 - DNA, 22 bp, Homo sapiens
gggccatgagaggttcatcaac

SEQ ID NO: 9391545 - DNA, 22 bp, Homo sapiens
gggccagttctccgcctctttt

SEQ ID NO: 9391546 - DNA, 22 bp, Homo sapiens
gggccagtgggacctgggtctc

SEQ ID NO: 9391547 - DNA, 22 bp, Homo sapiens
gggccagtgagtcgggagagct

SEQ ID NO: 9391548 - DNA, 22 bp, Homo sapiens
gggccagtgagtcgggagagct

SEQ ID NO: 9391549 - DNA, 22 bp, Homo sapiens
gggccagtgaacaatgagggaa

SEQ ID NO: 9391550 - DNA, 22 bp, Homo sapiens
gggccagtgaacaatgagggaa

SEQ ID NO: 9391551 - DNA, 23 bp, Homo sapiens
gggcccagcacaggacctggcag

SEQ ID NO: 9391552 - DNA, 23 bp, Homo sapiens
gggcccagcacaggacctggcag

SEQ ID NO: 9391553 - DNA, 22 bp, Homo sapiens
gggcccagcactggctgggatc

SEQ ID NO: 9391554 - DNA, 22 bp, Homo sapiens
gggctagaagttagctagagaa

SEQ ID NO: 9391555 - DNA, 22 bp, Homo sapiens
gggctagaagttagctagagaa

SEQ ID NO: 9391556 - DNA, 22 bp, Homo sapiens
gggctagaaattctgcagtgga

SEQ ID NO: 9391557 - DNA, 22 bp, Homo sapiens
gggcgtggatggtcagtgcagg

SEQ ID NO: 9391558 - DNA, 22 bp, Homo sapiens
gggcgtggatggtcagtgcagg

SEQ ID NO: 9391559 - DNA, 22 bp, Homo sapiens
gggcgtcctggaccctcccctg

SEQ ID NO: 9391560 - DNA, 22 bp, Homo sapiens
gggcggatcatttgaggtcagg

SEQ ID NO: 9391561 - DNA, 22 bp, Homo sapiens
gggcggatcacctgaggtcagg

SEQ ID NO: 9391562 - DNA, 22 bp, Homo sapiens
gggcggggggagctggaatgaa

SEQ ID NO: 9391563 - DNA, 22 bp, Homo sapiens
gggcagcctcggtgcctgctgc

SEQ ID NO: 9391564 - DNA, 22 bp, Homo sapiens
gggcagcctcggtgcctgctgc

SEQ ID NO: 9391565 - DNA, 22 bp, Homo sapiens
gggcagcctgctttctgatcca

SEQ ID NO: 9391566 - DNA, 22 bp, Homo sapiens
gggcagctcggaagtgggaaag

SEQ ID NO: 9391567 - DNA, 22 bp, Homo sapiens
gggcagctcctgtggaatccac

SEQ ID NO: 9391568 - DNA, 21 bp, Homo sapiens
gggccacaccttctgcagacc

SEQ ID NO: 9391569 - DNA, 22 bp, Homo sapiens
gggccacaggagaggctgtcag

SEQ ID NO: 9391570 - DNA, 22 bp, Homo sapiens
gggccaggtggaccccagcctc

SEQ ID NO: 9391571 - DNA, 22 bp, Homo sapiens
gggccagtctgactctgctggt

SEQ ID NO: 9391572 - DNA, 22 bp, Homo sapiens
gggccagtagcacctgtgtgga

SEQ ID NO: 9391573 - DNA, 22 bp, Homo sapiens
gggccaggtggaccccagcctc

SEQ ID NO: 9391574 - DNA, 22 bp, Homo sapiens
gggccaggagtggagatatggg

SEQ ID NO: 9391575 - DNA, 22 bp, Homo sapiens
gggccacaggccttgcccgcag

SEQ ID NO: 9391576 - DNA, 22 bp, Homo sapiens
gggcagaggttcaacttcaaca

SEQ ID NO: 9391577 - DNA, 18 bp, Homo sapiens
gggcagcacagcagcctc

SEQ ID NO: 9391578 - DNA, 20 bp, Homo sapiens
gggcagcaagacatttgaca

SEQ ID NO: 9391579 - DNA, 20 bp, Homo sapiens
gggcagcctcgggagtgggt

SEQ ID NO: 9391580 - DNA, 22 bp, Homo sapiens
gggcagccgcgtgacctgccag

SEQ ID NO: 9391581 - DNA, 22 bp, Homo sapiens
gggcagccgcgtgacctgccag

SEQ ID NO: 9391582 - DNA, 22 bp, Homo sapiens
gggcagccccagcgcgttggct

SEQ ID NO: 9391583 - DNA, 20 bp, Homo sapiens
gggcagcctcgggagtgggt

SEQ ID NO: 9391584 - DNA, 20 bp, Homo sapiens
gggcagcctcgggagtgggt

SEQ ID NO: 9391585 - DNA, 20 bp, Homo sapiens
gggcagcctcgggagtgggt

SEQ ID NO: 9391586 - DNA, 20 bp, Homo sapiens
gggcagcctcgggagtgggt

SEQ ID NO: 9391587 - DNA, 22 bp, Homo sapiens
gggcagcagaattggacagaaa

SEQ ID NO: 9391588 - DNA, 22 bp, Homo sapiens
gggcagcccagaactgctgcag

SEQ ID NO: 9391589 - DNA, 22 bp, Homo sapiens
gggcagcacgtttcaggaggat

SEQ ID NO: 9391590 - DNA, 22 bp, Homo sapiens
gggcagcacgtttcaggaggat

SEQ ID NO: 9391591 - DNA, 21 bp, Homo sapiens
gggcagcacgtcattcctgtg

SEQ ID NO: 9391592 - DNA, 22 bp, Homo sapiens
gggcagcacgtttcaggaggat

SEQ ID NO: 9391593 - DNA, 22 bp, Homo sapiens
gggggtggttctaagtcctata

SEQ ID NO: 9391594 - DNA, 22 bp, Homo sapiens
gggtccaggcgtggcccagatg

SEQ ID NO: 9391595 - DNA, 22 bp, Homo sapiens
gggtccagggccagtggctgag

SEQ ID NO: 9391596 - DNA, 20 bp, Homo sapiens
gggtccaggactctgaattt

SEQ ID NO: 9391597 - DNA, 22 bp, Homo sapiens
ggggtaggaagagaaaatagtg

SEQ ID NO: 9391598 - DNA, 22 bp, Homo sapiens
ggggtaggcaggtgatctgatc

SEQ ID NO: 9391599 - DNA, 22 bp, Homo sapiens
ggggggctgttctggacaggaa

SEQ ID NO: 9391600 - DNA, 22 bp, Homo sapiens
ggggggtgacaagtagaggttg

SEQ ID NO: 9391601 - DNA, 22 bp, Homo sapiens
ggggggtgacaagtagaggttg

SEQ ID NO: 9391602 - DNA, 22 bp, Homo sapiens
gggggtaggcagacaaggacat

SEQ ID NO: 9391603 - DNA, 22 bp, Homo sapiens
gggggtgacgatggcagctggt

SEQ ID NO: 9391604 - DNA, 22 bp, Homo sapiens
ggggggtgctgatcagtggagc

SEQ ID NO: 9391605 - DNA, 23 bp, Homo sapiens
gggggctggttgactctctgcag

SEQ ID NO: 9391606 - DNA, 22 bp, Homo sapiens
gggggctggactttcccacaca

SEQ ID NO: 9391607 - DNA, 22 bp, Homo sapiens
gggggctggactttcccacaca

SEQ ID NO: 9391608 - DNA, 22 bp, Homo sapiens
gggggctggaatatccatcaac

SEQ ID NO: 9391609 - DNA, 22 bp, Homo sapiens
gggggctgatcatttactgggc

SEQ ID NO: 9391610 - DNA, 22 bp, Homo sapiens
ggggaccctcaggactgcgtct

SEQ ID NO: 9391611 - DNA, 22 bp, Homo sapiens
ggggaccctcaggactgcgtct

SEQ ID NO: 9391612 - DNA, 22 bp, Homo sapiens
ggggactgaggcactgaaggtg

SEQ ID NO: 9391613 - DNA, 22 bp, Homo sapiens
ggggactgccttccacagacac

SEQ ID NO: 9391614 - DNA, 22 bp, Homo sapiens
gggggctccaggcgagaatgtg

SEQ ID NO: 9391615 - DNA, 22 bp, Homo sapiens
gggtgggatgccgctgtctcca

SEQ ID NO: 9391616 - DNA, 22 bp, Homo sapiens
gggtgggatgccgctgtctcca

SEQ ID NO: 9391617 - DNA, 22 bp, Homo sapiens
gggtggctgagaacaggacccc

SEQ ID NO: 9391618 - DNA, 22 bp, Homo sapiens
gggtgggaacaggatgccagga

SEQ ID NO: 9391619 - DNA, 22 bp, Homo sapiens
gggtgggaacaggatgccagga

SEQ ID NO: 9391620 - DNA, 22 bp, Homo sapiens
gggtgaggagctgccagtcatg

SEQ ID NO: 9391621 - DNA, 22 bp, Homo sapiens
gggtgaggagctgccagtcatg

SEQ ID NO: 9391622 - DNA, 22 bp, Homo sapiens
gggtggctgagaacaggacccc

SEQ ID NO: 9391623 - DNA, 19 bp, Homo sapiens
gggtgaggaagagcgttgc

SEQ ID NO: 9391624 - DNA, 22 bp, Homo sapiens
gggtgggcctgtctggccatgt

SEQ ID NO: 9391625 - DNA, 22 bp, Homo sapiens
gggtgggccccaggtatctgta

SEQ ID NO: 9391626 - DNA, 22 bp, Homo sapiens
gggtgggcccagcccagagaag

SEQ ID NO: 9391627 - DNA, 22 bp, Homo sapiens
gggtgggcccagcccagagaag

SEQ ID NO: 9391628 - DNA, 22 bp, Homo sapiens
gggtgggatggcaggagccgct

SEQ ID NO: 9391629 - DNA, 17 bp, Homo sapiens
gggtgggcactgctggc

SEQ ID NO: 9391630 - DNA, 17 bp, Homo sapiens
gggtgggcactgctggc

SEQ ID NO: 9391631 - DNA, 23 bp, Homo sapiens
gggtgggccaaattaggtagcct

SEQ ID NO: 9391632 - DNA, 23 bp, Homo sapiens
gggtgggccaaattaggtagcct

SEQ ID NO: 9391633 - DNA, 23 bp, Homo sapiens
gggtgggccaaattaggtagcct

SEQ ID NO: 9391634 - DNA, 22 bp, Homo sapiens
gggtgacattaggaagatagac

SEQ ID NO: 9391635 - DNA, 22 bp, Homo sapiens
gggtgaagctcctgcaggggcc

SEQ ID NO: 9391636 - DNA, 22 bp, Homo sapiens
gggtctggcatgctgagatgga

SEQ ID NO: 9391637 - DNA, 22 bp, Homo sapiens
gggtctggcatgctgagatgga

SEQ ID NO: 9391638 - DNA, 22 bp, Homo sapiens
gggtctggcatgctgagatgga

SEQ ID NO: 9391639 - DNA, 22 bp, Homo sapiens
gggtctggagggcagcccttct

SEQ ID NO: 9391640 - DNA, 22 bp, Homo sapiens
gggtgaagctcctgcaggggcc

SEQ ID NO: 9391641 - DNA, 22 bp, Homo sapiens
gggtctgggcaggcgcttcctc

SEQ ID NO: 9391642 - DNA, 22 bp, Homo sapiens
gggtctgggcaggcgcttcctc

SEQ ID NO: 9391643 - DNA, 22 bp, Homo sapiens
gggtctggcatgctgagatgga

SEQ ID NO: 9391644 - DNA, 22 bp, Homo sapiens
gggtctggacggctgcaggaag

SEQ ID NO: 9391645 - DNA, 22 bp, Homo sapiens
gggtctggacggctgcaggaag

SEQ ID NO: 9391646 - DNA, 22 bp, Homo sapiens
gggtctggagggcagcccttct

SEQ ID NO: 9391647 - DNA, 22 bp, Homo sapiens
gggtctggagatccgggtgaag

SEQ ID NO: 9391648 - DNA, 22 bp, Homo sapiens
gggtctggacggctgcaggaag

SEQ ID NO: 9391649 - DNA, 22 bp, Homo sapiens
gggtctctcagaaggctgcaat

SEQ ID NO: 9391650 - DNA, 22 bp, Homo sapiens
gggtctctcatgcagttgctgt

SEQ ID NO: 9391651 - DNA, 22 bp, Homo sapiens
gggtctctcagaaggctgcaat

SEQ ID NO: 9391652 - DNA, 22 bp, Homo sapiens
gggtctctctcggctccacgcg

SEQ ID NO: 9391653 - DNA, 22 bp, Homo sapiens
gggtctctgagcttccaagata

SEQ ID NO: 9391654 - DNA, 22 bp, Homo sapiens
gggtctctgagcttccaagata

SEQ ID NO: 9391655 - DNA, 22 bp, Homo sapiens
gggtctctcctccccagctgtg

SEQ ID NO: 9391656 - DNA, 22 bp, Homo sapiens
gggtctctcctccccagctgtg

SEQ ID NO: 9391657 - DNA, 22 bp, Homo sapiens
gggtctctcctccccagctgtg

SEQ ID NO: 9391658 - DNA, 22 bp, Homo sapiens
gggtctctctcggctccacgcg

SEQ ID NO: 9391659 - DNA, 23 bp, Homo sapiens
ggggaagtggcagtgagtgaggc

SEQ ID NO: 9391660 - DNA, 22 bp, Homo sapiens
ggggaatgagtgcccagaaagc

SEQ ID NO: 9391661 - DNA, 23 bp, Homo sapiens
ggggaagtggcagtgagtgaggc

SEQ ID NO: 9391662 - DNA, 23 bp, Homo sapiens
ggggacagagggcagcccgcatc

SEQ ID NO: 9391663 - DNA, 23 bp, Homo sapiens
ggggacagagggcagcccgcatc

SEQ ID NO: 9391664 - DNA, 23 bp, Homo sapiens
ggggacagagggcagcccgcatc

SEQ ID NO: 9391665 - DNA, 23 bp, Homo sapiens
ggggacagagggcagcccgcatc

SEQ ID NO: 9391666 - DNA, 22 bp, Homo sapiens
ggggaagggagtccaagtgtta

SEQ ID NO: 9391667 - DNA, 22 bp, Homo sapiens
ggggaagggagtccaagtgtta

SEQ ID NO: 9391668 - DNA, 22 bp, Homo sapiens
ggggaagggagtccaagtgtta

SEQ ID NO: 9391669 - DNA, 22 bp, Homo sapiens
ggggaaggattgagttgaccca

SEQ ID NO: 9391670 - DNA, 22 bp, Homo sapiens
ggggacagttaaagaccaagac

SEQ ID NO: 9391671 - DNA, 22 bp, Homo sapiens
ggggacagtcgatctagtgatt

SEQ ID NO: 9391672 - DNA, 22 bp, Homo sapiens
ggggacagtcgatctagtgatt

SEQ ID NO: 9391673 - DNA, 22 bp, Homo sapiens
ggggacagtcgatctagtgatt

SEQ ID NO: 9391674 - DNA, 22 bp, Homo sapiens
ggggacagtcgatctagtgatt

SEQ ID NO: 9391675 - DNA, 23 bp, Homo sapiens
ggggacagttcccactggggtct

SEQ ID NO: 9391676 - DNA, 23 bp, Homo sapiens
ggggacagttcccactggggtct

SEQ ID NO: 9391677 - DNA, 22 bp, Homo sapiens
ggggacagttaaagaccaagac

SEQ ID NO: 9391678 - DNA, 22 bp, Homo sapiens
ggggacagttaaagaccaagac

SEQ ID NO: 9391679 - DNA, 17 bp, Homo sapiens
gggctggatggccatgg

SEQ ID NO: 9391680 - DNA, 17 bp, Homo sapiens
gggctggatggccatgg

SEQ ID NO: 9391681 - DNA, 22 bp, Homo sapiens
gggctggatgggagccttggcc

SEQ ID NO: 9391682 - DNA, 17 bp, Homo sapiens
gggctggatggccatgg

SEQ ID NO: 9391683 - DNA, 22 bp, Homo sapiens
gggctggatgggagccttggcc

SEQ ID NO: 9391684 - DNA, 22 bp, Homo sapiens
gggctggatgtttgatgacgaa

SEQ ID NO: 9391685 - DNA, 22 bp, Homo sapiens
gggctggatgtttgatgacgaa

SEQ ID NO: 9391686 - DNA, 22 bp, Homo sapiens
gggctggattactgaactgagt

SEQ ID NO: 9391687 - DNA, 22 bp, Homo sapiens
gggctggcatcggttgctgaga

SEQ ID NO: 9391688 - DNA, 22 bp, Homo sapiens
gggctggcatcagttgccgaga

SEQ ID NO: 9391689 - DNA, 22 bp, Homo sapiens
gggctggcatcagttgccgaga

SEQ ID NO: 9391690 - DNA, 22 bp, Homo sapiens
gggctggcaggacctgggctga

SEQ ID NO: 9391691 - DNA, 22 bp, Homo sapiens
gggctggcaggacctgggctga

SEQ ID NO: 9391692 - DNA, 22 bp, Homo sapiens
gggctggcaggacctgggctga

SEQ ID NO: 9391693 - DNA, 22 bp, Homo sapiens
gggctggcaggacctgggctga

SEQ ID NO: 9391694 - DNA, 22 bp, Homo sapiens
gggctggcaggacctgggctga

SEQ ID NO: 9391695 - DNA, 22 bp, Homo sapiens
gggctggcaggacctgggctga

SEQ ID NO: 9391696 - DNA, 22 bp, Homo sapiens
gggctggactgcattgcctcgc

SEQ ID NO: 9391697 - DNA, 22 bp, Homo sapiens
gggctggaccgctcgcctccct

SEQ ID NO: 9391698 - DNA, 22 bp, Homo sapiens
gggctggaccgcgacccctgag

SEQ ID NO: 9391699 - DNA, 22 bp, Homo sapiens
gggctggagacaagtgagccgc

SEQ ID NO: 9391700 - DNA, 22 bp, Homo sapiens
gggctggagacaagtgagccgc

SEQ ID NO: 9391701 - DNA, 16 bp, Homo sapiens
gggctggagatacagt

SEQ ID NO: 9391702 - DNA, 22 bp, Homo sapiens
gggctggagagtcccacgtggg

SEQ ID NO: 9391703 - DNA, 22 bp, Homo sapiens
gggctggatctcctgcaggcag

SEQ ID NO: 9391704 - DNA, 22 bp, Homo sapiens
gggctggagcctggcggtggtt

SEQ ID NO: 9391705 - DNA, 22 bp, Homo sapiens
gggctggagcctggcggtggtt

SEQ ID NO: 9391706 - DNA, 22 bp, Homo sapiens
gggctggagcctggcggtggtt

SEQ ID NO: 9391707 - DNA, 22 bp, Homo sapiens
gggctggagccagctgtggctg

SEQ ID NO: 9391708 - DNA, 22 bp, Homo sapiens
gggctggagccagctgtggctg

SEQ ID NO: 9391709 - DNA, 22 bp, Homo sapiens
gggctggagccagctgtggctg

SEQ ID NO: 9391710 - DNA, 22 bp, Homo sapiens
gggctggagatgcttatggaga

SEQ ID NO: 9391711 - DNA, 22 bp, Homo sapiens
gggctggagccagctgtggctg

SEQ ID NO: 9391712 - DNA, 22 bp, Homo sapiens
gggctgcttcctggggaatgct

SEQ ID NO: 9391713 - DNA, 22 bp, Homo sapiens
gggctgcttgctggagacagac

SEQ ID NO: 9391714 - DNA, 22 bp, Homo sapiens
gggctgcttgctggagacagac

SEQ ID NO: 9391715 - DNA, 22 bp, Homo sapiens
gggctgcttgctggagacagac

SEQ ID NO: 9391716 - DNA, 22 bp, Homo sapiens
gggctgcttgctggagacagac

SEQ ID NO: 9391717 - DNA, 22 bp, Homo sapiens
gggctgcttggaggaggcgctc

SEQ ID NO: 9391718 - DNA, 22 bp, Homo sapiens
gggctgcttggaggaggcgctc

SEQ ID NO: 9391719 - DNA, 22 bp, Homo sapiens
gggctgcttggaggaggcgctc

SEQ ID NO: 9391720 - DNA, 22 bp, Homo sapiens
gggctgcttttttcttagcaga

SEQ ID NO: 9391721 - DNA, 22 bp, Homo sapiens
gggctgcttttaagggtctcag

SEQ ID NO: 9391722 - DNA, 22 bp, Homo sapiens
gggctggaagtgcattgatgct

SEQ ID NO: 9391723 - DNA, 22 bp, Homo sapiens
gggctggacatctaaggtagct

SEQ ID NO: 9391724 - DNA, 22 bp, Homo sapiens
gggctggacatctaaggtagct

SEQ ID NO: 9391725 - DNA, 21 bp, Homo sapiens
gggctggacatggtggctcat

SEQ ID NO: 9391726 - DNA, 22 bp, Homo sapiens
gggctggaagacaggaaatgct

SEQ ID NO: 9391727 - DNA, 22 bp, Homo sapiens
gggctggaagacaggaaatgct

SEQ ID NO: 9391728 - DNA, 22 bp, Homo sapiens
gggctgcttttttcttagcaga

SEQ ID NO: 9391729 - DNA, 22 bp, Homo sapiens
gggctggaaaaacaacatacaa

SEQ ID NO: 9391730 - DNA, 22 bp, Homo sapiens
gggctctgtggttgtgctttgt

SEQ ID NO: 9391731 - DNA, 22 bp, Homo sapiens
gggctctgtggttgtgctttgt

SEQ ID NO: 9391732 - DNA, 22 bp, Homo sapiens
gggctctgtgttctagctctcg

SEQ ID NO: 9391733 - DNA, 22 bp, Homo sapiens
gggctctgtggcttccttctta

SEQ ID NO: 9391734 - DNA, 22 bp, Homo sapiens
gggctctgtggcttccttctta

SEQ ID NO: 9391735 - DNA, 22 bp, Homo sapiens
gggctctgtgttctagctctcg

SEQ ID NO: 9391736 - DNA, 22 bp, Homo sapiens
gggctctgtgttctagctctcg

SEQ ID NO: 9391737 - DNA, 22 bp, Homo sapiens
gggctgagaagttgatcccaag

SEQ ID NO: 9391738 - DNA, 22 bp, Homo sapiens
gggctgagaattcagctttcct

SEQ ID NO: 9391739 - DNA, 22 bp, Homo sapiens
gggctgagaagttgatcccaag

SEQ ID NO: 9391740 - DNA, 22 bp, Homo sapiens
gggctgagacgatggggtcttc

SEQ ID NO: 9391741 - DNA, 22 bp, Homo sapiens
gggctgagaattcagctttcct

SEQ ID NO: 9391742 - DNA, 22 bp, Homo sapiens
gggctgagacgatggggtcttc

SEQ ID NO: 9391743 - DNA, 22 bp, Homo sapiens
gggctgagaattcagctttcct

SEQ ID NO: 9391744 - DNA, 22 bp, Homo sapiens
gggctgagacgatggggtcttc

SEQ ID NO: 9391745 - DNA, 18 bp, Homo sapiens
gggctaggcaaggaccac

SEQ ID NO: 9391746 - DNA, 22 bp, Homo sapiens
gggctagcctcttccctgctcc

SEQ ID NO: 9391747 - DNA, 20 bp, Homo sapiens
gggctagaccagggcagagg

SEQ ID NO: 9391748 - DNA, 20 bp, Homo sapiens
gggctagaccagggcagagg

SEQ ID NO: 9391749 - DNA, 22 bp, Homo sapiens
gggctagcctcttccctgctcc

SEQ ID NO: 9391750 - DNA, 22 bp, Homo sapiens
gggctctggggtgccctggcat

SEQ ID NO: 9391751 - DNA, 22 bp, Homo sapiens
gggctctgggtcgtgtctccat

SEQ ID NO: 9391752 - DNA, 22 bp, Homo sapiens
gggctctgggtcgtgtctccat

SEQ ID NO: 9391753 - DNA, 22 bp, Homo sapiens
gggctctggtacttcctggctc

SEQ ID NO: 9391754 - DNA, 22 bp, Homo sapiens
gggctctggtacttcctggctc

SEQ ID NO: 9391755 - DNA, 22 bp, Homo sapiens
gggctctggtacttcctggctc

SEQ ID NO: 9391756 - DNA, 22 bp, Homo sapiens
gggctctgtggcttccttctta

SEQ ID NO: 9391757 - DNA, 22 bp, Homo sapiens
gggctctgtggcttccttctta

SEQ ID NO: 9391758 - DNA, 22 bp, Homo sapiens
gggctctgtggatgtgagagct

SEQ ID NO: 9391759 - DNA, 22 bp, Homo sapiens
gggctctgtggatgtgagagct

SEQ ID NO: 9391760 - DNA, 22 bp, Homo sapiens
gggctctgtggatgtgagagct

SEQ ID NO: 9391761 - DNA, 22 bp, Homo sapiens
gggctctgtggatgtgagagct

SEQ ID NO: 9391762 - DNA, 22 bp, Homo sapiens
gggctctgtgcaccccagcacc

SEQ ID NO: 9391763 - DNA, 22 bp, Homo sapiens
gggctctgtgcaccccagcacc

SEQ ID NO: 9391764 - DNA, 22 bp, Homo sapiens
gggctctgtgcaccccagcacc

SEQ ID NO: 9391765 - DNA, 22 bp, Homo sapiens
gggctctgtgcaccccagcacc

SEQ ID NO: 9391766 - DNA, 22 bp, Homo sapiens
gggctctgtccattccttcata

SEQ ID NO: 9391767 - DNA, 22 bp, Homo sapiens
gggctctggtgctattgacgaa

SEQ ID NO: 9391768 - DNA, 22 bp, Homo sapiens
gggctctggtgccttcacagaa

SEQ ID NO: 9391769 - DNA, 22 bp, Homo sapiens
gggctctggtgccttcacagaa

SEQ ID NO: 9391770 - DNA, 22 bp, Homo sapiens
gggctctggtgctattgacgaa

SEQ ID NO: 9391771 - DNA, 20 bp, Homo sapiens
gggctctgtaaggttgaaag

SEQ ID NO: 9391772 - DNA, 22 bp, Homo sapiens
gggctctgtccattccttcata

SEQ ID NO: 9391773 - DNA, 22 bp, Homo sapiens
gggctctgtccattccttcata

SEQ ID NO: 9391774 - DNA, 20 bp, Homo sapiens
gggctctgtaaggttgaaag

SEQ ID NO: 9391775 - DNA, 22 bp, Homo sapiens
gggctctggtcctgaactgaag

SEQ ID NO: 9391776 - DNA, 22 bp, Homo sapiens
gggctctggtcctgaactgaag

SEQ ID NO: 9391777 - DNA, 22 bp, Homo sapiens
gggctctggtcctgaactgaag

SEQ ID NO: 9391778 - DNA, 22 bp, Homo sapiens
gggctctggtacttcctggctc

SEQ ID NO: 9391779 - DNA, 22 bp, Homo sapiens
gggctctggtacttcctggctc

SEQ ID NO: 9391780 - DNA, 19 bp, Homo sapiens
ggctctcccttgagagagc

SEQ ID NO: 9391781 - DNA, 22 bp, Homo sapiens
ggctgagttgagaggattactt

SEQ ID NO: 9391782 - DNA, 22 bp, Homo sapiens
ggctgagttgagaggattactt

SEQ ID NO: 9391783 - DNA, 22 bp, Homo sapiens
ggctgagttgagaggattactt

SEQ ID NO: 9391784 - DNA, 22 bp, Homo sapiens
ggctgcagaagtacttccggat

SEQ ID NO: 9391785 - DNA, 22 bp, Homo sapiens
ggctgcacgcctctcagcttgc

SEQ ID NO: 9391786 - DNA, 22 bp, Homo sapiens
ggctgcaagcctttggggctgg

SEQ ID NO: 9391787 - DNA, 22 bp, Homo sapiens
ggctgcaagcatgcacagatac

SEQ ID NO: 9391788 - DNA, 22 bp, Homo sapiens
ggctgcaacattttcttaggta

SEQ ID NO: 9391789 - DNA, 22 bp, Homo sapiens
ggctgcaagacaaggttggttt

SEQ ID NO: 9391790 - DNA, 17 bp, Homo sapiens
ggctgcaaaggctctgg

SEQ ID NO: 9391791 - DNA, 22 bp, Homo sapiens
ggctgcaaataacaactagctt

SEQ ID NO: 9391792 - DNA, 22 bp, Homo sapiens
ggctgcaaaggaaaagtggtga

SEQ ID NO: 9391793 - DNA, 22 bp, Homo sapiens
ggctgcagagctggtgccctgg

SEQ ID NO: 9391794 - DNA, 22 bp, Homo sapiens
ggctgcagaggcccccagtggg

SEQ ID NO: 9391795 - DNA, 22 bp, Homo sapiens
ggctgcaggaacgacggagggg

SEQ ID NO: 9391796 - DNA, 22 bp, Homo sapiens
ggctgcagaggcgatctgaggt

SEQ ID NO: 9391797 - DNA, 22 bp, Homo sapiens
ggctgcagaggcgatctgaggt

SEQ ID NO: 9391798 - DNA, 22 bp, Homo sapiens
ggctgcagaggcgatctgaggt

SEQ ID NO: 9391799 - DNA, 22 bp, Homo sapiens
ggctgcagaggcccccagtggg

SEQ ID NO: 9391800 - DNA, 19 bp, Homo sapiens
ggctgcagagccccggcgc

SEQ ID NO: 9391801 - DNA, 19 bp, Homo sapiens
ggctgcagagccccggcgc

SEQ ID NO: 9391802 - DNA, 19 bp, Homo sapiens
ggctgcagagccccggcgc

SEQ ID NO: 9391803 - DNA, 22 bp, Homo sapiens
ggctgcagaagtacttccggat

SEQ ID NO: 9391804 - DNA, 22 bp, Homo sapiens
ggctgcagagctggtgccctgg

SEQ ID NO: 9391805 - DNA, 22 bp, Homo sapiens
ggctgcagagctgggtgggcct

SEQ ID NO: 9391806 - DNA, 22 bp, Homo sapiens
ggctcctggcatctggtgggta

SEQ ID NO: 9391807 - DNA, 23 bp, Homo sapiens
ggctcctggattcaaatcctgcc

SEQ ID NO: 9391808 - DNA, 22 bp, Homo sapiens
ggctcctgggagaagttttatt

SEQ ID NO: 9391809 - DNA, 22 bp, Homo sapiens
ggctcctgggatgggactgagc

SEQ ID NO: 9391810 - DNA, 22 bp, Homo sapiens
ggctcctgggcagctgctccct

SEQ ID NO: 9391811 - DNA, 22 bp, Homo sapiens
ggctcctggggaggtgagcttg

SEQ ID NO: 9391812 - DNA, 22 bp, Homo sapiens
ggctcctggggaggtgagcttg

SEQ ID NO: 9391813 - DNA, 19 bp, Homo sapiens
ggctcctggggctcagccc

SEQ ID NO: 9391814 - DNA, 22 bp, Homo sapiens
ggctcctgttttaaaaggtgaa

SEQ ID NO: 9391815 - DNA, 22 bp, Homo sapiens
ggctctagagactctagagaaa

SEQ ID NO: 9391816 - DNA, 22 bp, Homo sapiens
ggctcgtgtccagtatagaaag

SEQ ID NO: 9391817 - DNA, 22 bp, Homo sapiens
ggctctagagctgtgcacacat

SEQ ID NO: 9391818 - DNA, 22 bp, Homo sapiens
ggctctaggcggagtcccgcga

SEQ ID NO: 9391819 - DNA, 22 bp, Homo sapiens
ggctctccactatggatgagaa

SEQ ID NO: 9391820 - DNA, 22 bp, Homo sapiens
ggctctcagggaaaggcctccc

SEQ ID NO: 9391821 - DNA, 22 bp, Homo sapiens
ggctgctctgccttccagctgg

SEQ ID NO: 9391822 - DNA, 22 bp, Homo sapiens
ggctgctctgccttccagctgg

SEQ ID NO: 9391823 - DNA, 22 bp, Homo sapiens
ggctgctcttcttggcgacctc

SEQ ID NO: 9391824 - DNA, 22 bp, Homo sapiens
ggctgctcttcttggcgacctc

SEQ ID NO: 9391825 - DNA, 22 bp, Homo sapiens
ggctgctcttcttggcgacctc

SEQ ID NO: 9391826 - DNA, 22 bp, Homo sapiens
ggctgctctccatcccaggcct

SEQ ID NO: 9391827 - DNA, 22 bp, Homo sapiens
ggctgctctccatcccaggcct

SEQ ID NO: 9391828 - DNA, 22 bp, Homo sapiens
ggctgctctccatcccaggcct

SEQ ID NO: 9391829 - DNA, 22 bp, Homo sapiens
ggctgctctgccttccagctgg

SEQ ID NO: 9391830 - DNA, 22 bp, Homo sapiens
ggctgctctgcacaggggctgg

SEQ ID NO: 9391831 - DNA, 22 bp, Homo sapiens
ggctgctctgcacaggggctgg

SEQ ID NO: 9391832 - DNA, 22 bp, Homo sapiens
ggctgctctgagagtgggtttt

SEQ ID NO: 9391833 - DNA, 22 bp, Homo sapiens
ggctgctctgagagtgggtttt

SEQ ID NO: 9391834 - DNA, 22 bp, Homo sapiens
ggctgccttccctgagccccgg

SEQ ID NO: 9391835 - DNA, 19 bp, Homo sapiens
ggctgccttctgctcatct

SEQ ID NO: 9391836 - DNA, 22 bp, Homo sapiens
ggctgccttgaccctggctccg

SEQ ID NO: 9391837 - DNA, 22 bp, Homo sapiens
ggctgccttgaccctggctccg

SEQ ID NO: 9391838 - DNA, 22 bp, Homo sapiens
ggctgctcggcagctcctgagc

SEQ ID NO: 9391839 - DNA, 22 bp, Homo sapiens
ggctgctcggcagctcctgagc

SEQ ID NO: 9391840 - DNA, 22 bp, Homo sapiens
ggctgctcggagcctcctgtga

SEQ ID NO: 9391841 - DNA, 22 bp, Homo sapiens
ggctggcgggtgggtgaaagac

SEQ ID NO: 9391842 - DNA, 22 bp, Homo sapiens
ggctggctacattggaggaagg

SEQ ID NO: 9391843 - DNA, 22 bp, Homo sapiens
ggctggctacattggaggaagg

SEQ ID NO: 9391844 - DNA, 22 bp, Homo sapiens
ggctggcctctacagggaggca

SEQ ID NO: 9391845 - DNA, 22 bp, Homo sapiens
ggctggcctctacagggaggca

SEQ ID NO: 9391846 - DNA, 22 bp, Homo sapiens
ggctggcctctacagggaggca

SEQ ID NO: 9391847 - DNA, 22 bp, Homo sapiens
ggctggcctcagggtcctcgct

SEQ ID NO: 9391848 - DNA, 22 bp, Homo sapiens
ggctggcgctctcccagcgctg

SEQ ID NO: 9391849 - DNA, 22 bp, Homo sapiens
ggctggcctctacagggaggca

SEQ ID NO: 9391850 - DNA, 22 bp, Homo sapiens
ggctgctgaacaagggaaccct

SEQ ID NO: 9391851 - DNA, 22 bp, Homo sapiens
ggctgctgaacaagggaaccct

SEQ ID NO: 9391852 - DNA, 22 bp, Homo sapiens
ggctggcctcagggtcctcgct

SEQ ID NO: 9391853 - DNA, 23 bp, Homo sapiens
ggctggcccggggctgctcctga

SEQ ID NO: 9391854 - DNA, 22 bp, Homo sapiens
ggctgcctgtgcccaggcacac

SEQ ID NO: 9391855 - DNA, 22 bp, Homo sapiens
ggctgcctggtttcttgtaagg

SEQ ID NO: 9391856 - DNA, 22 bp, Homo sapiens
ggctgcctggtttcttgtaagg

SEQ ID NO: 9391857 - DNA, 22 bp, Homo sapiens
ggctgcctggtttagtgctgac

SEQ ID NO: 9391858 - DNA, 22 bp, Homo sapiens
ggctgcctggtttagtgctgac

SEQ ID NO: 9391859 - DNA, 18 bp, Homo sapiens
ggctgcctgttcctgaag

SEQ ID NO: 9391860 - DNA, 22 bp, Homo sapiens
ggctgcctgtgcccaggcacac

SEQ ID NO: 9391861 - DNA, 22 bp, Homo sapiens
ggctgccttcagactccagctt

SEQ ID NO: 9391862 - DNA, 22 bp, Homo sapiens
ggctgccttcagactccagctt

SEQ ID NO: 9391863 - DNA, 22 bp, Homo sapiens
ggctgccttcagactccagctt

SEQ ID NO: 9391864 - DNA, 22 bp, Homo sapiens
ggctgccttcatagaccatggg

SEQ ID NO: 9391865 - DNA, 22 bp, Homo sapiens
ggctgccttcatagaccatggg

SEQ ID NO: 9391866 - DNA, 22 bp, Homo sapiens
ggctgccttcagactccagctt

SEQ ID NO: 9391867 - DNA, 22 bp, Homo sapiens
ggctgcaggcagaggctgtctg

SEQ ID NO: 9391868 - DNA, 19 bp, Homo sapiens
ggctgcctggagcgagggc

SEQ ID NO: 9391869 - DNA, 19 bp, Homo sapiens
ggctgcctggagcgagggc

SEQ ID NO: 9391870 - DNA, 22 bp, Homo sapiens
ggctgcaggcagaggctgtctg

SEQ ID NO: 9391871 - DNA, 22 bp, Homo sapiens
ggctgcaggatgcccagccgtg

SEQ ID NO: 9391872 - DNA, 22 bp, Homo sapiens
ggctgcaggcagaggctgtctg

SEQ ID NO: 9391873 - DNA, 22 bp, Homo sapiens
ggctgcaggatgcccagccgtg

SEQ ID NO: 9391874 - DNA, 20 bp, Homo sapiens
ggctgcaggactcattggct

SEQ ID NO: 9391875 - DNA, 20 bp, Homo sapiens
ggctgcaggactcattggct

SEQ ID NO: 9391876 - DNA, 22 bp, Homo sapiens
ggctgcaggatgcccagccgtg

SEQ ID NO: 9391877 - DNA, 22 bp, Homo sapiens
ggctgcaggatgcccagccgtg

SEQ ID NO: 9391878 - DNA, 22 bp, Homo sapiens
gggaagagatttccacatcatt

SEQ ID NO: 9391879 - DNA, 18 bp, Homo sapiens
gggaagaggatctggccc

SEQ ID NO: 9391880 - DNA, 22 bp, Homo sapiens
gggaccaggtcagggctctgac

SEQ ID NO: 9391881 - DNA, 22 bp, Homo sapiens
gggaagagaggaggtggtttcg

SEQ ID NO: 9391882 - DNA, 22 bp, Homo sapiens
gggaagagaggaggtggtttcg

SEQ ID NO: 9391883 - DNA, 22 bp, Homo sapiens
gggaagagaggaggtggtttcg

SEQ ID NO: 9391884 - DNA, 22 bp, Homo sapiens
gggaagagaccgtaccctggcc

SEQ ID NO: 9391885 - DNA, 22 bp, Homo sapiens
gggaagagaccgtaccctggcc

SEQ ID NO: 9391886 - DNA, 22 bp, Homo sapiens
gggaagacttagtcggttcaat

SEQ ID NO: 9391887 - DNA, 22 bp, Homo sapiens
gggaagagaccgtaccctggcc

SEQ ID NO: 9391888 - DNA, 21 bp, Homo sapiens
gggaagactgtcaggattcct

SEQ ID NO: 9391889 - DNA, 22 bp, Homo sapiens
gggaagaagacatggtgaaggc

SEQ ID NO: 9391890 - DNA, 22 bp, Homo sapiens
gggaacagcttgggctctgcca

SEQ ID NO: 9391891 - DNA, 22 bp, Homo sapiens
gggaacagcatatctgaagggt

SEQ ID NO: 9391892 - DNA, 22 bp, Homo sapiens
gggaacagcatatctgaagggt

SEQ ID NO: 9391893 - DNA, 22 bp, Homo sapiens
gggaacagagtgccagactgac

SEQ ID NO: 9391894 - DNA, 22 bp, Homo sapiens
gggaacagcatatctgaagggt

SEQ ID NO: 9391895 - DNA, 22 bp, Homo sapiens
gggaactgtttaacaggggttt

SEQ ID NO: 9391896 - DNA, 22 bp, Homo sapiens
gggaactgtgtggtgctctgat

SEQ ID NO: 9391897 - DNA, 22 bp, Homo sapiens
gggaaaggatttacagtttgat

SEQ ID NO: 9391898 - DNA, 22 bp, Homo sapiens
gggaaaggatttacagtttgat

SEQ ID NO: 9391899 - DNA, 22 bp, Homo sapiens
gggaaaggatcagtgggaggct

SEQ ID NO: 9391900 - DNA, 22 bp, Homo sapiens
gggaaaggatcagtgggaggct

SEQ ID NO: 9391901 - DNA, 22 bp, Homo sapiens
ggctttgtggggtgaagtaaag

SEQ ID NO: 9391902 - DNA, 22 bp, Homo sapiens
gggaaatctcgtcctctattta

SEQ ID NO: 9391903 - DNA, 22 bp, Homo sapiens
gggaacacagacttgatgatga

SEQ ID NO: 9391904 - DNA, 22 bp, Homo sapiens
gggaacagagtgccagactgac

SEQ ID NO: 9391905 - DNA, 22 bp, Homo sapiens
gggaacagaggagggtgttgct

SEQ ID NO: 9391906 - DNA, 22 bp, Homo sapiens
ggcttcctggggcctcctgcaa

SEQ ID NO: 9391907 - DNA, 22 bp, Homo sapiens
ggcttcctccttcctgctgtca

SEQ ID NO: 9391908 - DNA, 22 bp, Homo sapiens
ggcttctcagcacactgtccac

SEQ ID NO: 9391909 - DNA, 22 bp, Homo sapiens
ggctttgggattcagcatgaga

SEQ ID NO: 9391910 - DNA, 22 bp, Homo sapiens
ggctttggggtgtgcagagatg

SEQ ID NO: 9391911 - DNA, 18 bp, Homo sapiens
ggcttctcactgacctca

SEQ ID NO: 9391912 - DNA, 18 bp, Homo sapiens
ggcttctcactgacctca

SEQ ID NO: 9391913 - DNA, 22 bp, Homo sapiens
ggctggctccacctaggtagct

SEQ ID NO: 9391914 - DNA, 22 bp, Homo sapiens
ggctggctcttaccgacagcgt

SEQ ID NO: 9391915 - DNA, 22 bp, Homo sapiens
ggctggctatctgtggttgcct

SEQ ID NO: 9391916 - DNA, 22 bp, Homo sapiens
ggctggctatctgtggttgcct

SEQ ID NO: 9391917 - DNA, 22 bp, Homo sapiens
ggctggctcagggcttgagaga

SEQ ID NO: 9391918 - DNA, 22 bp, Homo sapiens
ggctggctcagggcttgagaga

SEQ ID NO: 9391919 - DNA, 22 bp, Homo sapiens
ggctggctatctgtggttgcct

SEQ ID NO: 9391920 - DNA, 22 bp, Homo sapiens
ggctggctcttaccgacagcgt

SEQ ID NO: 9391921 - DNA, 22 bp, Homo sapiens
ggctggctgataaagggttgag

SEQ ID NO: 9391922 - DNA, 22 bp, Homo sapiens
ggctggctgataaagggttgag

SEQ ID NO: 9391923 - DNA, 22 bp, Homo sapiens
ggctggctgcatgccccctcct

SEQ ID NO: 9391924 - DNA, 22 bp, Homo sapiens
ggctggctgcatgccccctcct

SEQ ID NO: 9391925 - DNA, 22 bp, Homo sapiens
ggctggctggatgaatggatta

SEQ ID NO: 9391926 - DNA, 22 bp, Homo sapiens
ggctggctggcttagcagagga

SEQ ID NO: 9391927 - DNA, 22 bp, Homo sapiens
ggctggctgtgccctgtactct

SEQ ID NO: 9391928 - DNA, 22 bp, Homo sapiens
ggctggctggcttagcagagga

SEQ ID NO: 9391929 - DNA, 22 bp, Homo sapiens
ggctggctggctggtagacaag

SEQ ID NO: 9391930 - DNA, 22 bp, Homo sapiens
ggctggctggctggtagacaag

SEQ ID NO: 9391931 - DNA, 22 bp, Homo sapiens
ggctggcttgccaagctcaggg

SEQ ID NO: 9391932 - DNA, 22 bp, Homo sapiens
ggctggctgtgccctgtactct

SEQ ID NO: 9391933 - DNA, 22 bp, Homo sapiens
ggctggcttgccaagctcaggg

SEQ ID NO: 9391934 - DNA, 22 bp, Homo sapiens
ggctggctgtgccctgtactct

SEQ ID NO: 9391935 - DNA, 22 bp, Homo sapiens
ggctggcttgccaagctcaggg

SEQ ID NO: 9391936 - DNA, 19 bp, Homo sapiens
ggctgtggtggtgccttgc

SEQ ID NO: 9391937 - DNA, 22 bp, Homo sapiens
ggctgtggtggcatccctgagc

SEQ ID NO: 9391938 - DNA, 22 bp, Homo sapiens
ggcttccagctgggccttggag

SEQ ID NO: 9391939 - DNA, 22 bp, Homo sapiens
ggcttcccaggcggtccccaca

SEQ ID NO: 9391940 - DNA, 22 bp, Homo sapiens
ggcttcccagtccctgctctca

SEQ ID NO: 9391941 - DNA, 22 bp, Homo sapiens
ggcttcccagtccctgctctca

SEQ ID NO: 9391942 - DNA, 22 bp, Homo sapiens
ggcttcccaaggagccaggatg

SEQ ID NO: 9391943 - DNA, 22 bp, Homo sapiens
ggcttcccagcagagggcgcac

SEQ ID NO: 9391944 - DNA, 22 bp, Homo sapiens
ggcttccctttccgagaggaga

SEQ ID NO: 9391945 - DNA, 22 bp, Homo sapiens
ggcttccctgtttgctgtgcct

SEQ ID NO: 9391946 - DNA, 22 bp, Homo sapiens
ggcttccctgcctcacttattc

SEQ ID NO: 9391947 - DNA, 18 bp, Homo sapiens
ggcttccctactcacttc

SEQ ID NO: 9391948 - DNA, 22 bp, Homo sapiens
ggcttcccctccagtgctctgt

SEQ ID NO: 9391949 - DNA, 20 bp, Homo sapiens
ggcttccccgccatcttccg

SEQ ID NO: 9391950 - DNA, 22 bp, Homo sapiens
ggcttcccctccagtgctctgt

SEQ ID NO: 9391951 - DNA, 22 bp, Homo sapiens
ggcttccccacagtcctgagct

SEQ ID NO: 9391952 - DNA, 22 bp, Homo sapiens
ggcttcagtgagctgagctcac

SEQ ID NO: 9391953 - DNA, 22 bp, Homo sapiens
ggcttcagtgagctgagctcac

SEQ ID NO: 9391954 - DNA, 19 bp, Homo sapiens
ggcttcagtttagcaggct

SEQ ID NO: 9391955 - DNA, 22 bp, Homo sapiens
ggcttcaggggcccagtcagca

SEQ ID NO: 9391956 - DNA, 23 bp, Homo sapiens
ggcttcagtgagagtccctgctg

SEQ ID NO: 9391957 - DNA, 22 bp, Homo sapiens
ggccatggtgaggtcttctcag

SEQ ID NO: 9391958 - DNA, 22 bp, Homo sapiens
ggccatggtcatgggtgagctt

SEQ ID NO: 9391959 - DNA, 20 bp, Homo sapiens
ggccatgggttgcctgaggt

SEQ ID NO: 9391960 - DNA, 20 bp, Homo sapiens
ggccatgggttgcctgaggt

SEQ ID NO: 9391961 - DNA, 20 bp, Homo sapiens
ggccatgggttgcctgaggt

SEQ ID NO: 9391962 - DNA, 17 bp, Homo sapiens
ggccatggtgcaaggtt

SEQ ID NO: 9391963 - DNA, 17 bp, Homo sapiens
ggccatggtgcaaggtt

SEQ ID NO: 9391964 - DNA, 22 bp, Homo sapiens
ggccatggtggtttgagcacct

SEQ ID NO: 9391965 - DNA, 22 bp, Homo sapiens
ggccatggtggtttgagcacct

SEQ ID NO: 9391966 - DNA, 22 bp, Homo sapiens
ggccattgcaacgtcaggagga

SEQ ID NO: 9391967 - DNA, 22 bp, Homo sapiens
ggcccacactgacagctgagct

SEQ ID NO: 9391968 - DNA, 22 bp, Homo sapiens
ggcccaaggtgccaaggcctcc

SEQ ID NO: 9391969 - DNA, 22 bp, Homo sapiens
ggcccaaggcccaggtcgagct

SEQ ID NO: 9391970 - DNA, 22 bp, Homo sapiens
ggcccagaagccagaagcctcc

SEQ ID NO: 9391971 - DNA, 22 bp, Homo sapiens
ggcccacatggaagcatcgagg

SEQ ID NO: 9391972 - DNA, 22 bp, Homo sapiens
ggcccacactgacagctgagct

SEQ ID NO: 9391973 - DNA, 22 bp, Homo sapiens
ggcccacatggaagcatcgagg

SEQ ID NO: 9391974 - DNA, 22 bp, Homo sapiens
ggcccacttgaaatggagctca

SEQ ID NO: 9391975 - DNA, 22 bp, Homo sapiens
ggcccagccggcgagtctcgcg

SEQ ID NO: 9391976 - DNA, 22 bp, Homo sapiens
ggcccctcttgtggcacatacg

SEQ ID NO: 9391977 - DNA, 22 bp, Homo sapiens
ggcccctggcaccaggctgatt

SEQ ID NO: 9391978 - DNA, 22 bp, Homo sapiens
ggcccctgcggactgcctagag

SEQ ID NO: 9391979 - DNA, 22 bp, Homo sapiens
ggcccctgcggactgcctagag

SEQ ID NO: 9391980 - DNA, 19 bp, Homo sapiens
ggcccctctcacaggagtt

SEQ ID NO: 9391981 - DNA, 22 bp, Homo sapiens
ggccccagttcactcctggccg

SEQ ID NO: 9391982 - DNA, 22 bp, Homo sapiens
ggccccagttcactcctggccg

SEQ ID NO: 9391983 - DNA, 21 bp, Homo sapiens
ggccccgcagacccagcacgt

SEQ ID NO: 9391984 - DNA, 22 bp, Homo sapiens
ggccccagattctgggctgggt

SEQ ID NO: 9391985 - DNA, 22 bp, Homo sapiens
ggcccagcctggcaacaatgac

SEQ ID NO: 9391986 - DNA, 22 bp, Homo sapiens
ggcccagcctcagacatgccct

SEQ ID NO: 9391987 - DNA, 22 bp, Homo sapiens
ggcccagcgaggccacctacag

SEQ ID NO: 9391988 - DNA, 22 bp, Homo sapiens
ggccagagagcagccaggattc

SEQ ID NO: 9391989 - DNA, 22 bp, Homo sapiens
ggccagagaatatgccttacgt

SEQ ID NO: 9391990 - DNA, 22 bp, Homo sapiens
ggccagagagcagccaggattc

SEQ ID NO: 9391991 - DNA, 22 bp, Homo sapiens
ggccagagagcagccaggattc

SEQ ID NO: 9391992 - DNA, 22 bp, Homo sapiens
ggccagagagcagccaggattc

SEQ ID NO: 9391993 - DNA, 22 bp, Homo sapiens
ggccagagctgacctatcaatg

SEQ ID NO: 9391994 - DNA, 22 bp, Homo sapiens
ggccagagctcaaacagtcgca

SEQ ID NO: 9391995 - DNA, 22 bp, Homo sapiens
ggccagagagccgctgttagga

SEQ ID NO: 9391996 - DNA, 22 bp, Homo sapiens
ggccagaggacctctcatagcc

SEQ ID NO: 9391997 - DNA, 22 bp, Homo sapiens
ggccagaggacctctcatagcc

SEQ ID NO: 9391998 - DNA, 22 bp, Homo sapiens
ggccagaggccacagctgtgtc

SEQ ID NO: 9391999 - DNA, 22 bp, Homo sapiens
ggccagaggccacagctgtgtc

SEQ ID NO: 9392000 - DNA, 22 bp, Homo sapiens
ggccagaggccatcctcctgct

SEQ ID NO: 9392001 - DNA, 22 bp, Homo sapiens
ggccagaggccatcctcctgct

SEQ ID NO: 9392002 - DNA, 22 bp, Homo sapiens
ggccagaggccacagctgtgtc

SEQ ID NO: 9392003 - DNA, 17 bp, Homo sapiens
ggccagaggcggggctg

SEQ ID NO: 9392004 - DNA, 17 bp, Homo sapiens
ggccagaggcggggctg

SEQ ID NO: 9392005 - DNA, 17 bp, Homo sapiens
ggccagaggcggggctg

SEQ ID NO: 9392006 - DNA, 18 bp, Homo sapiens
ggccagagggagggtccc

SEQ ID NO: 9392007 - DNA, 18 bp, Homo sapiens
ggccagagggagggtccc

SEQ ID NO: 9392008 - DNA, 18 bp, Homo sapiens
ggccagagggagggtccc

SEQ ID NO: 9392009 - DNA, 22 bp, Homo sapiens
ggccagagggagggcacaaatc

SEQ ID NO: 9392010 - DNA, 18 bp, Homo sapiens
ggccagagggagggtccc

SEQ ID NO: 9392011 - DNA, 19 bp, Homo sapiens
ggccatggcgggggtcaca

SEQ ID NO: 9392012 - DNA, 22 bp, Homo sapiens
ggccagaggtgtcctcagttct

SEQ ID NO: 9392013 - DNA, 22 bp, Homo sapiens
ggccagaggtggtacatagctt

SEQ ID NO: 9392014 - DNA, 22 bp, Homo sapiens
ggccagaggtgtcctcagttct

SEQ ID NO: 9392015 - DNA, 22 bp, Homo sapiens
ggccatgggaagaggtggagag

SEQ ID NO: 9392016 - DNA, 22 bp, Homo sapiens
ggcaggtgctctgtgggcctgg

SEQ ID NO: 9392017 - DNA, 22 bp, Homo sapiens
ggcaggtgctctgtgggcctgg

SEQ ID NO: 9392018 - DNA, 22 bp, Homo sapiens
ggcaggtgctctgtgggcctgg

SEQ ID NO: 9392019 - DNA, 20 bp, Homo sapiens
ggcaggtgctgtcccctcct

SEQ ID NO: 9392020 - DNA, 20 bp, Homo sapiens
ggcaggtgctgtcccctcct

SEQ ID NO: 9392021 - DNA, 22 bp, Homo sapiens
ggcaggtgctgggagcatctca

SEQ ID NO: 9392022 - DNA, 22 bp, Homo sapiens
ggcaggtgctgggagcatctca

SEQ ID NO: 9392023 - DNA, 22 bp, Homo sapiens
ggcaggtgctctgtgggcctgg

SEQ ID NO: 9392024 - DNA, 22 bp, Homo sapiens
ggcaggtgctgggagcatctca

SEQ ID NO: 9392025 - DNA, 22 bp, Homo sapiens
ggcaggtgcttgtcgaaggcct

SEQ ID NO: 9392026 - DNA, 22 bp, Homo sapiens
ggcaggtgcttgtcgaaggcct

SEQ ID NO: 9392027 - DNA, 22 bp, Homo sapiens
ggcaggtgcttgtcgaaggcct

SEQ ID NO: 9392028 - DNA, 22 bp, Homo sapiens
ggcaggtgcttgtcgaaggcct

SEQ ID NO: 9392029 - DNA, 22 bp, Homo sapiens
ggcaggtgcttgtcgaaggcct

SEQ ID NO: 9392030 - DNA, 22 bp, Homo sapiens
ggcaggtggaagttggcagagc

SEQ ID NO: 9392031 - DNA, 22 bp, Homo sapiens
ggccacctctgccctactgagt

SEQ ID NO: 9392032 - DNA, 22 bp, Homo sapiens
ggcaggtggaagttggcagagc

SEQ ID NO: 9392033 - DNA, 22 bp, Homo sapiens
ggcaggtggaaggtctccattc

SEQ ID NO: 9392034 - DNA, 22 bp, Homo sapiens
ggcaggtggaaggtctccattc

SEQ ID NO: 9392035 - DNA, 22 bp, Homo sapiens
ggcaggtggaaggtctccattc

SEQ ID NO: 9392036 - DNA, 22 bp, Homo sapiens
ggccagaagttggaaaagagcc

SEQ ID NO: 9392037 - DNA, 22 bp, Homo sapiens
ggccagacatatcgctcccaaa

SEQ ID NO: 9392038 - DNA, 22 bp, Homo sapiens
ggccagaagttggaaaagagcc

SEQ ID NO: 9392039 - DNA, 22 bp, Homo sapiens
ggccagagaatatgccttacgt

SEQ ID NO: 9392040 - DNA, 22 bp, Homo sapiens
ggccagagaagtcagacccttg

SEQ ID NO: 9392041 - DNA, 22 bp, Homo sapiens
ggccagagaagtcagacccttg

SEQ ID NO: 9392042 - DNA, 22 bp, Homo sapiens
ggccagaagctggggcatagga

SEQ ID NO: 9392043 - DNA, 20 bp, Homo sapiens
ggccacctgcttcagacccc

SEQ ID NO: 9392044 - DNA, 22 bp, Homo sapiens
ggctcatgtatgaaagggtgtg

SEQ ID NO: 9392045 - DNA, 20 bp, Homo sapiens
ggctcatcttgtctgctgac

SEQ ID NO: 9392046 - DNA, 19 bp, Homo sapiens
ggctcagtgacataggtgc

SEQ ID NO: 9392047 - DNA, 22 bp, Homo sapiens
ggctcaggtttccttcccagct

SEQ ID NO: 9392048 - DNA, 22 bp, Homo sapiens
ggctcaggtttaaagtgcttta

SEQ ID NO: 9392049 - DNA, 22 bp, Homo sapiens
ggctcaggtttaaagtgcttta

SEQ ID NO: 9392050 - DNA, 22 bp, Homo sapiens
ggctcaggtttaaagtgcttta

SEQ ID NO: 9392051 - DNA, 22 bp, Homo sapiens
ggctcaggcctgtaatcctagc

SEQ ID NO: 9392052 - DNA, 22 bp, Homo sapiens
ggctcaggtttccttcccagct

SEQ ID NO: 9392053 - DNA, 22 bp, Homo sapiens
ggctcaggtttccttcccagct

SEQ ID NO: 9392054 - DNA, 22 bp, Homo sapiens
ggctcctggaaagccctcgctc

SEQ ID NO: 9392055 - DNA, 23 bp, Homo sapiens
ggctcctgcttcatgtcccacct

SEQ ID NO: 9392056 - DNA, 22 bp, Homo sapiens
ggctcctgcacctgtccctctg

SEQ ID NO: 9392057 - DNA, 22 bp, Homo sapiens
ggctcctgatttgagggggctg

SEQ ID NO: 9392058 - DNA, 22 bp, Homo sapiens
ggctcctgcacctgtccctctg

SEQ ID NO: 9392059 - DNA, 22 bp, Homo sapiens
ggctccaccctgcttccagaag

SEQ ID NO: 9392060 - DNA, 22 bp, Homo sapiens
ggctccaagtctcagagtgaag

SEQ ID NO: 9392061 - DNA, 18 bp, Homo sapiens
ggctcagcaggctctctc

SEQ ID NO: 9392062 - DNA, 22 bp, Homo sapiens
ggccttgggatgtggctgcagc

SEQ ID NO: 9392063 - DNA, 18 bp, Homo sapiens
ggctcagcaggctctctc

SEQ ID NO: 9392064 - DNA, 22 bp, Homo sapiens
ggctcagcttatctgggcaggc

SEQ ID NO: 9392065 - DNA, 22 bp, Homo sapiens
ggctcagcttatctgggcaggc

SEQ ID NO: 9392066 - DNA, 22 bp, Homo sapiens
ggctcagcttatctgggcaggc

SEQ ID NO: 9392067 - DNA, 22 bp, Homo sapiens
ggctcagcgcgctgggagggag

SEQ ID NO: 9392068 - DNA, 22 bp, Homo sapiens
ggctcagccccgtaacacagca

SEQ ID NO: 9392069 - DNA, 22 bp, Homo sapiens
ggctcagccccgtaacacagca

SEQ ID NO: 9392070 - DNA, 22 bp, Homo sapiens
ggccttggatccaagctgcggc

SEQ ID NO: 9392071 - DNA, 21 bp, Homo sapiens
ggccttggcgggggccgaatt

SEQ ID NO: 9392072 - DNA, 22 bp, Homo sapiens
ggccttgggaggagggtcagaa

SEQ ID NO: 9392073 - DNA, 22 bp, Homo sapiens
ggctcaggactgcagcgtagag

SEQ ID NO: 9392074 - DNA, 22 bp, Homo sapiens
ggctcaggatgagccttctcat

SEQ ID NO: 9392075 - DNA, 22 bp, Homo sapiens
ggctcaggagaggggctaaaag

SEQ ID NO: 9392076 - DNA, 22 bp, Homo sapiens
ggctcaggagaggggctaaaag

SEQ ID NO: 9392077 - DNA, 22 bp, Homo sapiens
ggctcaggatgagccttctcat

SEQ ID NO: 9392078 - DNA, 22 bp, Homo sapiens
ggctcaggatgagccttctcat

SEQ ID NO: 9392079 - DNA, 22 bp, Homo sapiens
ggctcaggccagaccacgactc

SEQ ID NO: 9392080 - DNA, 22 bp, Homo sapiens
ggctcaggccagaccacgactc

SEQ ID NO: 9392081 - DNA, 22 bp, Homo sapiens
ggctcagcttggtgcgcagaaa

SEQ ID NO: 9392082 - DNA, 22 bp, Homo sapiens
ggctcagcttggtgcgcagaaa

SEQ ID NO: 9392083 - DNA, 22 bp, Homo sapiens
ggctcagcttggtgcgcagaaa

SEQ ID NO: 9392084 - DNA, 22 bp, Homo sapiens
ggctcaggacacagtggtttag

SEQ ID NO: 9392085 - DNA, 22 bp, Homo sapiens
ggctcaggacctgggattgcca

SEQ ID NO: 9392086 - DNA, 22 bp, Homo sapiens
ggctcaggacctgggattgcca

SEQ ID NO: 9392087 - DNA, 22 bp, Homo sapiens
ggctcaggacacagtggtttag

SEQ ID NO: 9392088 - DNA, 22 bp, Homo sapiens
ggctcaggactgcagcgtagag

SEQ ID NO: 9392089 - DNA, 22 bp, Homo sapiens
ggctcaggactgcagcgtagag

SEQ ID NO: 9392090 - DNA, 22 bp, Homo sapiens
ggctcaggactgcagcgtagag

SEQ ID NO: 9392091 - DNA, 22 bp, Homo sapiens
ggcctgggcctttgtgttttga

SEQ ID NO: 9392092 - DNA, 23 bp, Homo sapiens
ggcctgtgttttgtctgaagtac

SEQ ID NO: 9392093 - DNA, 23 bp, Homo sapiens
ggcctgtgttttgtctgaagtac

SEQ ID NO: 9392094 - DNA, 22 bp, Homo sapiens
ggccctgcgattaggtggcagg

SEQ ID NO: 9392095 - DNA, 22 bp, Homo sapiens
ggccctgcgattaggtggcagg

SEQ ID NO: 9392096 - DNA, 22 bp, Homo sapiens
ggccctgcatgagattaaggtt

SEQ ID NO: 9392097 - DNA, 22 bp, Homo sapiens
ggccctgagtctagctgctctt

SEQ ID NO: 9392098 - DNA, 22 bp, Homo sapiens
ggccctgcaaggtacccaggcc

SEQ ID NO: 9392099 - DNA, 22 bp, Homo sapiens
ggccctgcaaggtacccaggcc

SEQ ID NO: 9392100 - DNA, 22 bp, Homo sapiens
ggccctctgtggctgccatgga

SEQ ID NO: 9392101 - DNA, 22 bp, Homo sapiens
ggccctcttgatatccagcggc

SEQ ID NO: 9392102 - DNA, 22 bp, Homo sapiens
ggccctcttttatccatcataa

SEQ ID NO: 9392103 - DNA, 22 bp, Homo sapiens
ggccctcttttggtttggatgt

SEQ ID NO: 9392104 - DNA, 22 bp, Homo sapiens
ggccctctggtgagtatcacat

SEQ ID NO: 9392105 - DNA, 22 bp, Homo sapiens
ggccctctgtggctgccatgga

SEQ ID NO: 9392106 - DNA, 22 bp, Homo sapiens
ggccctctgctctgagatgaag

SEQ ID NO: 9392107 - DNA, 22 bp, Homo sapiens
ggccctctggcttccgcatggg

SEQ ID NO: 9392108 - DNA, 22 bp, Homo sapiens
ggccctctggcttccgcatggg

SEQ ID NO: 9392109 - DNA, 22 bp, Homo sapiens
ggccctccctgagccaggtggg

SEQ ID NO: 9392110 - DNA, 22 bp, Homo sapiens
ggccctccctgagccaggtggg

SEQ ID NO: 9392111 - DNA, 17 bp, Homo sapiens
ggcccggtgacgtcact

SEQ ID NO: 9392112 - DNA, 22 bp, Homo sapiens
ggccctcccggtgatgaagagc

SEQ ID NO: 9392113 - DNA, 22 bp, Homo sapiens
ggccttcctgctgctccgggcc

SEQ ID NO: 9392114 - DNA, 22 bp, Homo sapiens
ggccttcctggcggctcagggt

SEQ ID NO: 9392115 - DNA, 22 bp, Homo sapiens
ggccttcctggcggctcagggt

SEQ ID NO: 9392116 - DNA, 21 bp, Homo sapiens
ggccttcccctgcagtctccg

SEQ ID NO: 9392117 - DNA, 22 bp, Homo sapiens
ggccttcctgctgctccgggcc

SEQ ID NO: 9392118 - DNA, 22 bp, Homo sapiens
ggccttcctgttgtgtccaccg

SEQ ID NO: 9392119 - DNA, 22 bp, Homo sapiens
ggccttcctggcggctcagggt

SEQ ID NO: 9392120 - DNA, 22 bp, Homo sapiens
ggccttcctgttgtgtccaccg

SEQ ID NO: 9392121 - DNA, 22 bp, Homo sapiens
ggccttcctgttgtgtccaccg

SEQ ID NO: 9392122 - DNA, 22 bp, Homo sapiens
ggccttccttcccagcctactg

SEQ ID NO: 9392123 - DNA, 22 bp, Homo sapiens
ggccttccttcccagcctactg

SEQ ID NO: 9392124 - DNA, 22 bp, Homo sapiens
ggccttccttcccagcctactg

SEQ ID NO: 9392125 - DNA, 21 bp, Homo sapiens
ggccttcccctgcagtctccg

SEQ ID NO: 9392126 - DNA, 22 bp, Homo sapiens
ggccttccattgctcttttcta

SEQ ID NO: 9392127 - DNA, 22 bp, Homo sapiens
ggccttccagggaagacagggc

SEQ ID NO: 9392128 - DNA, 22 bp, Homo sapiens
ggccttccagggaagacagggc

SEQ ID NO: 9392129 - DNA, 22 bp, Homo sapiens
ggccttccatctgcctctgttt

SEQ ID NO: 9392130 - DNA, 22 bp, Homo sapiens
ggccttccatctgcctctgttt

SEQ ID NO: 9392131 - DNA, 22 bp, Homo sapiens
ggccttgcggaacgctcaggcg

SEQ ID NO: 9392132 - DNA, 22 bp, Homo sapiens
ggccttggagtcctccactgga

SEQ ID NO: 9392133 - DNA, 20 bp, Homo sapiens
ggccttggaatagcacagct

SEQ ID NO: 9392134 - DNA, 22 bp, Homo sapiens
ggccttggaaagatacccagct

SEQ ID NO: 9392135 - DNA, 22 bp, Homo sapiens
ggagggggaattcagccccagc

SEQ ID NO: 9392136 - DNA, 22 bp, Homo sapiens
ggagggggaattcagccccagc

SEQ ID NO: 9392137 - DNA, 22 bp, Homo sapiens
ggagggggaagaagctaaagac

SEQ ID NO: 9392138 - DNA, 22 bp, Homo sapiens
ggagggggaagaagctaaagac

SEQ ID NO: 9392139 - DNA, 22 bp, Homo sapiens
ggagggggaaactttggctgcc

SEQ ID NO: 9392140 - DNA, 22 bp, Homo sapiens
ggagggggaaactttggctgcc

SEQ ID NO: 9392141 - DNA, 22 bp, Homo sapiens
ggagggggaaactttggctgcc

SEQ ID NO: 9392142 - DNA, 22 bp, Homo sapiens
ggagggggaaactttggctgcc

SEQ ID NO: 9392143 - DNA, 22 bp, Homo sapiens
ggaggggagatgtttgggctca

SEQ ID NO: 9392144 - DNA, 22 bp, Homo sapiens
ggaggggagatgtttgggctca

SEQ ID NO: 9392145 - DNA, 22 bp, Homo sapiens
ggaggggagatgtttgggctca

SEQ ID NO: 9392146 - DNA, 22 bp, Homo sapiens
ggaggggagatgtttgggctca

SEQ ID NO: 9392147 - DNA, 22 bp, Homo sapiens
ggaggggaggattaatgacaaa

SEQ ID NO: 9392148 - DNA, 22 bp, Homo sapiens
ggaggggaggtccagctgatct

SEQ ID NO: 9392149 - DNA, 22 bp, Homo sapiens
ggaggggaggtccagctgatct

SEQ ID NO: 9392150 - DNA, 22 bp, Homo sapiens
ggaggggaggtccagctgatct

SEQ ID NO: 9392151 - DNA, 22 bp, Homo sapiens
ggaggggaggtccagctgatct

SEQ ID NO: 9392152 - DNA, 22 bp, Homo sapiens
ggaggggagtctcccaaagccg

SEQ ID NO: 9392153 - DNA, 22 bp, Homo sapiens
ggagggtccactgtgaggcaga

SEQ ID NO: 9392154 - DNA, 22 bp, Homo sapiens
ggaggggtggtcgcgaagagca

SEQ ID NO: 9392155 - DNA, 22 bp, Homo sapiens
ggaggggtggtcacctggcagg

SEQ ID NO: 9392156 - DNA, 22 bp, Homo sapiens
ggaggggtggtcacctggcagg

SEQ ID NO: 9392157 - DNA, 22 bp, Homo sapiens
ggaggggtggtcacctggcagg

SEQ ID NO: 9392158 - DNA, 22 bp, Homo sapiens
ggaggggtggaaggagtgcctg

SEQ ID NO: 9392159 - DNA, 22 bp, Homo sapiens
ggaggggtggaaggagtgcctg

SEQ ID NO: 9392160 - DNA, 22 bp, Homo sapiens
ggaggggtggaaggagtgcctg

SEQ ID NO: 9392161 - DNA, 22 bp, Homo sapiens
ggagggtgcattttaccctgtg

SEQ ID NO: 9392162 - DNA, 22 bp, Homo sapiens
ggagggtgcttaagttgtgttt

SEQ ID NO: 9392163 - DNA, 22 bp, Homo sapiens
ggagggtgcttaagttgtgttt

SEQ ID NO: 9392164 - DNA, 22 bp, Homo sapiens
ggagggtccccagcagcatgaa

SEQ ID NO: 9392165 - DNA, 22 bp, Homo sapiens
ggaggggtctctagcgaggaga

SEQ ID NO: 9392166 - DNA, 22 bp, Homo sapiens
ggaggggtctctagcgaggaga

SEQ ID NO: 9392167 - DNA, 22 bp, Homo sapiens
ggaggggtctctagcgaggaga

SEQ ID NO: 9392168 - DNA, 22 bp, Homo sapiens
ggagggggactgacactgattt

SEQ ID NO: 9392169 - DNA, 22 bp, Homo sapiens
ggagggggactgacactgattt

SEQ ID NO: 9392170 - DNA, 22 bp, Homo sapiens
ggaggggtgctcagctgtcacg

SEQ ID NO: 9392171 - DNA, 22 bp, Homo sapiens
ggaggggtgctcagctgtcacg

SEQ ID NO: 9392172 - DNA, 22 bp, Homo sapiens
ggaggggtgagaatggctgcct

SEQ ID NO: 9392173 - DNA, 22 bp, Homo sapiens
ggaggggtgagaatggctgcct

SEQ ID NO: 9392174 - DNA, 22 bp, Homo sapiens
ggaggggtgagaatggctgcct

SEQ ID NO: 9392175 - DNA, 22 bp, Homo sapiens
ggaggtgggctaaggactctct

SEQ ID NO: 9392176 - DNA, 22 bp, Homo sapiens
ggaggtgggctaaggactctct

SEQ ID NO: 9392177 - DNA, 22 bp, Homo sapiens
ggaggtggtggcagtgacaatt

SEQ ID NO: 9392178 - DNA, 22 bp, Homo sapiens
ggagtagctgcattccgagcac

SEQ ID NO: 9392179 - DNA, 22 bp, Homo sapiens
ggaggtgggattaggacctaaa

SEQ ID NO: 9392180 - DNA, 22 bp, Homo sapiens
ggaggtgggagcctccagtggt

SEQ ID NO: 9392181 - DNA, 22 bp, Homo sapiens
ggaggtgggagacataggcggc

SEQ ID NO: 9392182 - DNA, 22 bp, Homo sapiens
ggaggtggcctgaaaatgtggc

SEQ ID NO: 9392183 - DNA, 22 bp, Homo sapiens
ggaggtggcctgaaaatgtggc

SEQ ID NO: 9392184 - DNA, 22 bp, Homo sapiens
ggaggtcaaatggagggctggg

SEQ ID NO: 9392185 - DNA, 22 bp, Homo sapiens
ggaggtcaaatggagggctggg

SEQ ID NO: 9392186 - DNA, 20 bp, Homo sapiens
ggaggtcaaatgatgagaag

SEQ ID NO: 9392187 - DNA, 22 bp, Homo sapiens
ggagggtggcagcgtcctgggc

SEQ ID NO: 9392188 - DNA, 22 bp, Homo sapiens
ggagggtggcagcgtcctgggc

SEQ ID NO: 9392189 - DNA, 22 bp, Homo sapiens
ggagggtggcagcgtcctgggc

SEQ ID NO: 9392190 - DNA, 20 bp, Homo sapiens
ggagggtggaagaaagcaag

SEQ ID NO: 9392191 - DNA, 20 bp, Homo sapiens
ggagggtggaagaaagcaag

SEQ ID NO: 9392192 - DNA, 22 bp, Homo sapiens
ggaggtggaggttgcagtgagc

SEQ ID NO: 9392193 - DNA, 22 bp, Homo sapiens
ggaggtggcagagggacattct

SEQ ID NO: 9392194 - DNA, 22 bp, Homo sapiens
ggaggtggcagagggacattct

SEQ ID NO: 9392195 - DNA, 22 bp, Homo sapiens
ggaggtggcagagggacattct

SEQ ID NO: 9392196 - DNA, 22 bp, Homo sapiens
ggaggtcatagctgtgcaggta

SEQ ID NO: 9392197 - DNA, 22 bp, Homo sapiens
ggaggtcatagctgtgcaggta

SEQ ID NO: 9392198 - DNA, 22 bp, Homo sapiens
ggaggtcataagtgtatagatg

SEQ ID NO: 9392199 - DNA, 22 bp, Homo sapiens
ggaggtggaggttgcagtgagc

SEQ ID NO: 9392200 - DNA, 22 bp, Homo sapiens
ggaggtggaggttgcagtgagc

SEQ ID NO: 9392201 - DNA, 22 bp, Homo sapiens
ggaggtcacgactgggatgcct

SEQ ID NO: 9392202 - DNA, 22 bp, Homo sapiens
ggaggtcaaatggagggctggg

SEQ ID NO: 9392203 - DNA, 22 bp, Homo sapiens
ggaggtcatagctgtgcaggta

SEQ ID NO: 9392204 - DNA, 22 bp, Homo sapiens
ggaggctcagtgaggaaatgga

SEQ ID NO: 9392205 - DNA, 22 bp, Homo sapiens
ggaggctcagtgaggaaatgga

SEQ ID NO: 9392206 - DNA, 22 bp, Homo sapiens
ggaggctccatgagctcctgca

SEQ ID NO: 9392207 - DNA, 22 bp, Homo sapiens
ggaggcggaggttgcagtgagt

SEQ ID NO: 9392208 - DNA, 22 bp, Homo sapiens
ggaggcggaggttgcagtgagt

SEQ ID NO: 9392209 - DNA, 22 bp, Homo sapiens
ggaggcggaggttgcagtgagt

SEQ ID NO: 9392210 - DNA, 22 bp, Homo sapiens
ggaggcccagaaggaagcccag

SEQ ID NO: 9392211 - DNA, 22 bp, Homo sapiens
ggaggcccagaaggaagcccag

SEQ ID NO: 9392212 - DNA, 22 bp, Homo sapiens
ggaggccatgggcagaatcttt

SEQ ID NO: 9392213 - DNA, 22 bp, Homo sapiens
ggaggccatgggcagaatcttt

SEQ ID NO: 9392214 - DNA, 22 bp, Homo sapiens
ggaggcctagccagctccagtt

SEQ ID NO: 9392215 - DNA, 22 bp, Homo sapiens
ggaggcggaggttgcagtgagc

SEQ ID NO: 9392216 - DNA, 22 bp, Homo sapiens
ggaggcggaggttgcagtgagc

SEQ ID NO: 9392217 - DNA, 22 bp, Homo sapiens
ggaggcggaggttgcagtgagc

SEQ ID NO: 9392218 - DNA, 22 bp, Homo sapiens
ggaggcctggacttcctgatgg

SEQ ID NO: 9392219 - DNA, 22 bp, Homo sapiens
ggaggccttgaggccaggagct

SEQ ID NO: 9392220 - DNA, 22 bp, Homo sapiens
ggaggctgagaggtcgcagtgg

SEQ ID NO: 9392221 - DNA, 22 bp, Homo sapiens
ggaggctgaggcaggcggatca

SEQ ID NO: 9392222 - DNA, 22 bp, Homo sapiens
ggaggctgaggcaggcggatca

SEQ ID NO: 9392223 - DNA, 22 bp, Homo sapiens
ggaggctgaggcccctcacagg

SEQ ID NO: 9392224 - DNA, 22 bp, Homo sapiens
ggaggctgaggcccctcacagg

SEQ ID NO: 9392225 - DNA, 22 bp, Homo sapiens
ggaggctgaggcccctcacagg

SEQ ID NO: 9392226 - DNA, 22 bp, Homo sapiens
ggaggctgaggcccctcacagg

SEQ ID NO: 9392227 - DNA, 22 bp, Homo sapiens
ggaggctgctgcctcacgtggg

SEQ ID NO: 9392228 - DNA, 22 bp, Homo sapiens
ggaggctgctgcctcacgtggg

SEQ ID NO: 9392229 - DNA, 19 bp, Homo sapiens
ggaggcttcttggggtcgg

SEQ ID NO: 9392230 - DNA, 22 bp, Homo sapiens
ggaggctgctgcctcacgtggg

SEQ ID NO: 9392231 - DNA, 22 bp, Homo sapiens
ggaggctgctgcctcacgtggg

SEQ ID NO: 9392232 - DNA, 22 bp, Homo sapiens
ggaggctgctgcctcacgtggg

SEQ ID NO: 9392233 - DNA, 22 bp, Homo sapiens
ggaggctgagaggtcgcagtgg

SEQ ID NO: 9392234 - DNA, 22 bp, Homo sapiens
ggaggctcttgagaggggagta

SEQ ID NO: 9392235 - DNA, 22 bp, Homo sapiens
ggaggctgagaagtccaagatc

SEQ ID NO: 9392236 - DNA, 22 bp, Homo sapiens
ggaggctcgctggtcgcacagc

SEQ ID NO: 9392237 - DNA, 22 bp, Homo sapiens
ggaggctctcctggccttgtct

SEQ ID NO: 9392238 - DNA, 22 bp, Homo sapiens
ggagggcccctccagtgggcag

SEQ ID NO: 9392239 - DNA, 22 bp, Homo sapiens
ggagggccatcttgggtgtgat

SEQ ID NO: 9392240 - DNA, 22 bp, Homo sapiens
ggagggccatcttgggtgtgat

SEQ ID NO: 9392241 - DNA, 22 bp, Homo sapiens
ggagggcccctccagtgggcag

SEQ ID NO: 9392242 - DNA, 22 bp, Homo sapiens
ggagggcatcaatcaggcctgg

SEQ ID NO: 9392243 - DNA, 20 bp, Homo sapiens
ggagggcagctgagagttgg

SEQ ID NO: 9392244 - DNA, 20 bp, Homo sapiens
ggagggcagctgagagttgg

SEQ ID NO: 9392245 - DNA, 20 bp, Homo sapiens
ggagggcagctgagagttgg

SEQ ID NO: 9392246 - DNA, 21 bp, Homo sapiens
ggagggcagcccagactggct

SEQ ID NO: 9392247 - DNA, 21 bp, Homo sapiens
ggagggcagcccagactggct

SEQ ID NO: 9392248 - DNA, 21 bp, Homo sapiens
ggagggcagcccagactggct

SEQ ID NO: 9392249 - DNA, 21 bp, Homo sapiens
ggagggcagcccagactggct

SEQ ID NO: 9392250 - DNA, 22 bp, Homo sapiens
ggagggagagtgaccctaccaa

SEQ ID NO: 9392251 - DNA, 22 bp, Homo sapiens
ggagggagagtgaccctaccaa

SEQ ID NO: 9392252 - DNA, 22 bp, Homo sapiens
ggagggacccactctagaggtg

SEQ ID NO: 9392253 - DNA, 22 bp, Homo sapiens
ggagggacccactctagaggtg

SEQ ID NO: 9392254 - DNA, 22 bp, Homo sapiens
ggagggacccactctagaggtg

SEQ ID NO: 9392255 - DNA, 22 bp, Homo sapiens
ggagggaaccttggctggattg

SEQ ID NO: 9392256 - DNA, 22 bp, Homo sapiens
ggagggaaccttggctggattg

SEQ ID NO: 9392257 - DNA, 22 bp, Homo sapiens
ggagggaatgtctagcattctt

SEQ ID NO: 9392258 - DNA, 22 bp, Homo sapiens
ggagggctgccaggtggagcgg

SEQ ID NO: 9392259 - DNA, 22 bp, Homo sapiens
ggagggctgccaggtggagcgg

SEQ ID NO: 9392260 - DNA, 22 bp, Homo sapiens
ggaggggaactaatcccgtgac

SEQ ID NO: 9392261 - DNA, 18 bp, Homo sapiens
ggagggctttggggactg

SEQ ID NO: 9392262 - DNA, 22 bp, Homo sapiens
ggagggctgtagaggagacctg

SEQ ID NO: 9392263 - DNA, 23 bp, Homo sapiens
ggagggcttcatcagacccccag

SEQ ID NO: 9392264 - DNA, 22 bp, Homo sapiens
ggagggctccctgggagtggat

SEQ ID NO: 9392265 - DNA, 22 bp, Homo sapiens
ggagggctccctgggagtggat

SEQ ID NO: 9392266 - DNA, 22 bp, Homo sapiens
ggagggctccctgggagtggat

SEQ ID NO: 9392267 - DNA, 22 bp, Homo sapiens
ggagggctcaattgactcctga

SEQ ID NO: 9392268 - DNA, 22 bp, Homo sapiens
ggagggctcaattgactcctga

SEQ ID NO: 9392269 - DNA, 22 bp, Homo sapiens
ggagggctcaattgactcctga

SEQ ID NO: 9392270 - DNA, 22 bp, Homo sapiens
ggagggccctgggtgcagctct

SEQ ID NO: 9392271 - DNA, 22 bp, Homo sapiens
ggagggctgagactggggtctg

SEQ ID NO: 9392272 - DNA, 22 bp, Homo sapiens
ggagggctgagactggggtctg

SEQ ID NO: 9392273 - DNA, 22 bp, Homo sapiens
ggagggctgccaggtggagcgg

SEQ ID NO: 9392274 - DNA, 22 bp, Homo sapiens
ggagggctgccacccgctcacg

SEQ ID NO: 9392275 - DNA, 22 bp, Homo sapiens
ggagggctgagactggggtctg

SEQ ID NO: 9392276 - DNA, 22 bp, Homo sapiens
ggagggctcgtcatccaccact

SEQ ID NO: 9392277 - DNA, 22 bp, Homo sapiens
ggcagctggttctttccattaa

SEQ ID NO: 9392278 - DNA, 22 bp, Homo sapiens
ggcagctgtctcattcacacct

SEQ ID NO: 9392279 - DNA, 22 bp, Homo sapiens
ggcagctgtaagatgagtgaat

SEQ ID NO: 9392280 - DNA, 22 bp, Homo sapiens
ggcaggcagatggctgcaccaa

SEQ ID NO: 9392281 - DNA, 22 bp, Homo sapiens
ggcagctgtctctgagttagca

SEQ ID NO: 9392282 - DNA, 22 bp, Homo sapiens
ggcagctgtgaagtgcctcaca

SEQ ID NO: 9392283 - DNA, 22 bp, Homo sapiens
ggcagctgggtcacaccgatct

SEQ ID NO: 9392284 - DNA, 22 bp, Homo sapiens
ggcagctgggttggccagaaac

SEQ ID NO: 9392285 - DNA, 22 bp, Homo sapiens
ggcagctgggttggccagaaac

SEQ ID NO: 9392286 - DNA, 22 bp, Homo sapiens
ggcagctgggttggccagaaac

SEQ ID NO: 9392287 - DNA, 22 bp, Homo sapiens
ggcagctggggcagtgccctgt

SEQ ID NO: 9392288 - DNA, 23 bp, Homo sapiens
ggcagctgggcagcactcatggg

SEQ ID NO: 9392289 - DNA, 22 bp, Homo sapiens
ggcagctggggcagtgccctgt

SEQ ID NO: 9392290 - DNA, 22 bp, Homo sapiens
ggcagctgggtcacaccgatct

SEQ ID NO: 9392291 - DNA, 22 bp, Homo sapiens
ggcagaggaagctggaagtggg

SEQ ID NO: 9392292 - DNA, 22 bp, Homo sapiens
ggcagaggaagctggaagtggg

SEQ ID NO: 9392293 - DNA, 22 bp, Homo sapiens
ggcagaggaagctggaagtggg

SEQ ID NO: 9392294 - DNA, 22 bp, Homo sapiens
ggcagaggaagctggaagtggg

SEQ ID NO: 9392295 - DNA, 22 bp, Homo sapiens
ggcagaggaagctggaagtggg

SEQ ID NO: 9392296 - DNA, 22 bp, Homo sapiens
ggcagaggaagctggaagtggg

SEQ ID NO: 9392297 - DNA, 22 bp, Homo sapiens
ggcagctggcctcctcgcccac

SEQ ID NO: 9392298 - DNA, 22 bp, Homo sapiens
ggcagctggcctcctcgcccac

SEQ ID NO: 9392299 - DNA, 23 bp, Homo sapiens
ggcagctgggcagcactcatggg

SEQ ID NO: 9392300 - DNA, 19 bp, Homo sapiens
ggcagctggacgctgttca

SEQ ID NO: 9392301 - DNA, 19 bp, Homo sapiens
ggcagctggacgctgttca

SEQ ID NO: 9392302 - DNA, 22 bp, Homo sapiens
ggcagctgcaaatctgctctgt

SEQ ID NO: 9392303 - DNA, 22 bp, Homo sapiens
ggcagctgcaaatctgctctgt

SEQ ID NO: 9392304 - DNA, 22 bp, Homo sapiens
ggcagctgcacgttgtcccgtc

SEQ ID NO: 9392305 - DNA, 17 bp, Homo sapiens
ggcaggtgcggggccgc

SEQ ID NO: 9392306 - DNA, 17 bp, Homo sapiens
ggcaggtgcggggccgc

SEQ ID NO: 9392307 - DNA, 17 bp, Homo sapiens
ggcaggtgcggggccgc

SEQ ID NO: 9392308 - DNA, 22 bp, Homo sapiens
ggcaggtgctaagagaggtaaa

SEQ ID NO: 9392309 - DNA, 22 bp, Homo sapiens
ggcaggtgctaagagaggtaaa

SEQ ID NO: 9392310 - DNA, 22 bp, Homo sapiens
ggcaggtgcgcatgttgcatta

SEQ ID NO: 9392311 - DNA, 22 bp, Homo sapiens
ggcaggtgcgcatgttgcatta

SEQ ID NO: 9392312 - DNA, 22 bp, Homo sapiens
ggcaggtgcgcatgttgcatta

SEQ ID NO: 9392313 - DNA, 17 bp, Homo sapiens
ggcaggtgcggggccgc

SEQ ID NO: 9392314 - DNA, 17 bp, Homo sapiens
ggcaggtgcggggccgc

SEQ ID NO: 9392315 - DNA, 17 bp, Homo sapiens
ggcaggtgcggggccgc

SEQ ID NO: 9392316 - DNA, 22 bp, Homo sapiens
ggcaggtgctaagagaggtaaa

SEQ ID NO: 9392317 - DNA, 22 bp, Homo sapiens
ggcaggtgctaagagaggtaaa

SEQ ID NO: 9392318 - DNA, 22 bp, Homo sapiens
ggcaggtgctcaaaaatatttg

SEQ ID NO: 9392319 - DNA, 22 bp, Homo sapiens
ggcaggtgctcaaaaatatttg

SEQ ID NO: 9392320 - DNA, 22 bp, Homo sapiens
ggcaggtgctaagagaggtaaa

SEQ ID NO: 9392321 - DNA, 22 bp, Homo sapiens
ggcaggtgctaagagaggtaaa

SEQ ID NO: 9392322 - DNA, 22 bp, Homo sapiens
ggcaggtgctctgtgggcctgg

SEQ ID NO: 9392323 - DNA, 22 bp, Homo sapiens
ggcaggtgctctgtgggcctgg

SEQ ID NO: 9392324 - DNA, 20 bp, Homo sapiens
ggcaggtgctcgcttggtct

SEQ ID NO: 9392325 - DNA, 20 bp, Homo sapiens
ggcaggtgctcgcttggtct

SEQ ID NO: 9392326 - DNA, 20 bp, Homo sapiens
ggcaggtgctcgcttggtct

SEQ ID NO: 9392327 - DNA, 20 bp, Homo sapiens
ggcaggtgctcgcttggtct

SEQ ID NO: 9392328 - DNA, 20 bp, Homo sapiens
ggcaggtgctcgcttggtct

SEQ ID NO: 9392329 - DNA, 20 bp, Homo sapiens
ggcaggtgctcgcttggtct

SEQ ID NO: 9392330 - DNA, 22 bp, Homo sapiens
ggcaggctgcttgggtcatgtc

SEQ ID NO: 9392331 - DNA, 22 bp, Homo sapiens
ggcaggctgggagtcatcagag

SEQ ID NO: 9392332 - DNA, 22 bp, Homo sapiens
ggcaggtgaggcatgtgcctgg

SEQ ID NO: 9392333 - DNA, 22 bp, Homo sapiens
ggcaggtgagttcattatctgc

SEQ ID NO: 9392334 - DNA, 22 bp, Homo sapiens
ggcaggtgagttcattatctgc

SEQ ID NO: 9392335 - DNA, 22 bp, Homo sapiens
ggcaggctgggtgtcatggagt

SEQ ID NO: 9392336 - DNA, 22 bp, Homo sapiens
ggcaggctgggtgtcatggagt

SEQ ID NO: 9392337 - DNA, 22 bp, Homo sapiens
ggcaggtgaggcatgtgcctgg

SEQ ID NO: 9392338 - DNA, 22 bp, Homo sapiens
ggcaggtgaggcatgtgcctgg

SEQ ID NO: 9392339 - DNA, 22 bp, Homo sapiens
ggcaggctccagagccctctcc

SEQ ID NO: 9392340 - DNA, 22 bp, Homo sapiens
ggcaggctcagcagccaaggag

SEQ ID NO: 9392341 - DNA, 22 bp, Homo sapiens
ggcaggctccaagcatcctatg

SEQ ID NO: 9392342 - DNA, 22 bp, Homo sapiens
ggcaggctcttggccttatgag

SEQ ID NO: 9392343 - DNA, 22 bp, Homo sapiens
ggcaggctgcttgggtcatgtc

SEQ ID NO: 9392344 - DNA, 22 bp, Homo sapiens
ggcaggctgcttgggtcatgtc

SEQ ID NO: 9392345 - DNA, 22 bp, Homo sapiens
ggcaggctgcttgggtcatgtc

SEQ ID NO: 9392346 - DNA, 22 bp, Homo sapiens
ggcaggctgcttgggtcatgtc

SEQ ID NO: 9392347 - DNA, 22 bp, Homo sapiens
ggcaggctagcactgatgtcct

SEQ ID NO: 9392348 - DNA, 22 bp, Homo sapiens
ggcaggctcagcagccaaggag

SEQ ID NO: 9392349 - DNA, 22 bp, Homo sapiens
ggcaggcctgagaggcagggct

SEQ ID NO: 9392350 - DNA, 22 bp, Homo sapiens
ggcaggcctgagaggcagggct

SEQ ID NO: 9392351 - DNA, 22 bp, Homo sapiens
ggcaggcgtggtggcctcagaa

SEQ ID NO: 9392352 - DNA, 22 bp, Homo sapiens
ggcaggcgtggtggcctcagaa

SEQ ID NO: 9392353 - DNA, 22 bp, Homo sapiens
ggcaggcagcctccatccacag

SEQ ID NO: 9392354 - DNA, 22 bp, Homo sapiens
ggcaggcagcctccatccacag

SEQ ID NO: 9392355 - DNA, 22 bp, Homo sapiens
ggcaggcagcctccatccacag

SEQ ID NO: 9392356 - DNA, 22 bp, Homo sapiens
ggcaggcaggagcgtgcttggg

SEQ ID NO: 9392357 - DNA, 22 bp, Homo sapiens
ggcaggcaggagcgtgcttggg

SEQ ID NO: 9392358 - DNA, 22 bp, Homo sapiens
ggcaggcattagagattcccag

SEQ ID NO: 9392359 - DNA, 22 bp, Homo sapiens
ggcagagactgggttggcagag

SEQ ID NO: 9392360 - DNA, 22 bp, Homo sapiens
ggcagagacaccgaatgactct

SEQ ID NO: 9392361 - DNA, 23 bp, Homo sapiens
ggcagagagcatggctggggccc

SEQ ID NO: 9392362 - DNA, 23 bp, Homo sapiens
ggcagagagcatggctggggccc

SEQ ID NO: 9392363 - DNA, 22 bp, Homo sapiens
ggcagagactgggttggcagag

SEQ ID NO: 9392364 - DNA, 22 bp, Homo sapiens
ggcagaggaagctggaagtggg

SEQ ID NO: 9392365 - DNA, 22 bp, Homo sapiens
ggcagagcttgttccttctgtt

SEQ ID NO: 9392366 - DNA, 22 bp, Homo sapiens
ggcagaggaagctggaagtggg

SEQ ID NO: 9392367 - DNA, 22 bp, Homo sapiens
ggcagagcttgttccttctgtt

SEQ ID NO: 9392368 - DNA, 22 bp, Homo sapiens
ggcagagcttgttccttctgtt

SEQ ID NO: 9392369 - DNA, 22 bp, Homo sapiens
ggcagagcttgcagtgagccga

SEQ ID NO: 9392370 - DNA, 23 bp, Homo sapiens
ggcagagagcatggctggggccc

SEQ ID NO: 9392371 - DNA, 22 bp, Homo sapiens
ggcagacctctccagccccaca

SEQ ID NO: 9392372 - DNA, 22 bp, Homo sapiens
ggcagacctctccagccccaca

SEQ ID NO: 9392373 - DNA, 22 bp, Homo sapiens
ggcagacctctccagccccaca

SEQ ID NO: 9392374 - DNA, 22 bp, Homo sapiens
ggcagacactcaaaagctggga

SEQ ID NO: 9392375 - DNA, 19 bp, Homo sapiens
ggcagacacagttgacatg

SEQ ID NO: 9392376 - DNA, 21 bp, Homo sapiens
ggcagagaagctggaagttgg

SEQ ID NO: 9392377 - DNA, 22 bp, Homo sapiens
ggcagagaatctggctgtttac

SEQ ID NO: 9392378 - DNA, 22 bp, Homo sapiens
ggcagacaatctgtctgttagg

SEQ ID NO: 9392379 - DNA, 22 bp, Homo sapiens
ggcacagcactgtaggcctggg

SEQ ID NO: 9392380 - DNA, 22 bp, Homo sapiens
ggcacagcacagtggacccagg

SEQ ID NO: 9392381 - DNA, 22 bp, Homo sapiens
ggcacagcacagagcacatgta

SEQ ID NO: 9392382 - DNA, 22 bp, Homo sapiens
ggcacagcacagagcacatgta

SEQ ID NO: 9392383 - DNA, 23 bp, Homo sapiens
ggcacagatgctgagcatgtgca

SEQ ID NO: 9392384 - DNA, 22 bp, Homo sapiens
ggcacagatagatcaagtgtct

SEQ ID NO: 9392385 - DNA, 22 bp, Homo sapiens
ggcacagagttggcagagctgc

SEQ ID NO: 9392386 - DNA, 22 bp, Homo sapiens
ggcacagagctttgtcccagtt

SEQ ID NO: 9392387 - DNA, 22 bp, Homo sapiens
ggcacagagttggcagagctgc

SEQ ID NO: 9392388 - DNA, 22 bp, Homo sapiens
ggcacagagctccagccttggc

SEQ ID NO: 9392389 - DNA, 22 bp, Homo sapiens
ggagtggtggtcaggccatggc

SEQ ID NO: 9392390 - DNA, 22 bp, Homo sapiens
ggagtgggcagcactgccctgt

SEQ ID NO: 9392391 - DNA, 22 bp, Homo sapiens
ggagtgggcagcactgccctgt

SEQ ID NO: 9392392 - DNA, 22 bp, Homo sapiens
ggagtgggaacaatgacatggt

SEQ ID NO: 9392393 - DNA, 22 bp, Homo sapiens
ggagtgggaacaatgacatggt

SEQ ID NO: 9392394 - DNA, 22 bp, Homo sapiens
ggagtgggaacaatgacatggt

SEQ ID NO: 9392395 - DNA, 22 bp, Homo sapiens
ggagtgggaacaatgacatggt

SEQ ID NO: 9392396 - DNA, 22 bp, Homo sapiens
ggagtggctatttgtgctggtt

SEQ ID NO: 9392397 - DNA, 22 bp, Homo sapiens
ggagtggctatttgtgctggtt

SEQ ID NO: 9392398 - DNA, 22 bp, Homo sapiens
ggagtggctgtttctgccccca

SEQ ID NO: 9392399 - DNA, 22 bp, Homo sapiens
ggagtggcactctgaggcgggg

SEQ ID NO: 9392400 - DNA, 22 bp, Homo sapiens
ggagtggcagagagggtatact

SEQ ID NO: 9392401 - DNA, 22 bp, Homo sapiens
ggagtggcactctgaggcgggg

SEQ ID NO: 9392402 - DNA, 22 bp, Homo sapiens
ggagtggcagctaggctgtcag

SEQ ID NO: 9392403 - DNA, 22 bp, Homo sapiens
ggagtggcagcgaggatcagat

SEQ ID NO: 9392404 - DNA, 22 bp, Homo sapiens
ggagtggcagcgaggatcagat

SEQ ID NO: 9392405 - DNA, 22 bp, Homo sapiens
ggagtggcagctaggctgtcag

SEQ ID NO: 9392406 - DNA, 22 bp, Homo sapiens
ggagtggcaggccacagtgctg

SEQ ID NO: 9392407 - DNA, 22 bp, Homo sapiens
ggagtggcaggccacagtgctg

SEQ ID NO: 9392408 - DNA, 22 bp, Homo sapiens
ggagtggccacgactgggagat

SEQ ID NO: 9392409 - DNA, 22 bp, Homo sapiens
ggagtggccacgactgggagat

SEQ ID NO: 9392410 - DNA, 22 bp, Homo sapiens
ggagtggccacgactgggagat

SEQ ID NO: 9392411 - DNA, 22 bp, Homo sapiens
ggagtggcctctcctgtgcagg

SEQ ID NO: 9392412 - DNA, 22 bp, Homo sapiens
ggagtggcctctcctgtgcagg

SEQ ID NO: 9392413 - DNA, 22 bp, Homo sapiens
ggagtggcctctcctgtgcagg

SEQ ID NO: 9392414 - DNA, 22 bp, Homo sapiens
ggagtggcctctcctgtgcagg

SEQ ID NO: 9392415 - DNA, 22 bp, Homo sapiens
ggagtggctatttgtgctggtt

SEQ ID NO: 9392416 - DNA, 22 bp, Homo sapiens
ggagtggctatttgtgctggtt

SEQ ID NO: 9392417 - DNA, 22 bp, Homo sapiens
ggcacactcacttctgccctga

SEQ ID NO: 9392418 - DNA, 22 bp, Homo sapiens
ggcacagagaggccctggaagg

SEQ ID NO: 9392419 - DNA, 22 bp, Homo sapiens
ggcacacatagatctgcactgg

SEQ ID NO: 9392420 - DNA, 22 bp, Homo sapiens
ggcacacatagatctgcactgg

SEQ ID NO: 9392421 - DNA, 22 bp, Homo sapiens
ggcacacatagatctgcactgg

SEQ ID NO: 9392422 - DNA, 22 bp, Homo sapiens
ggcacactcaccacgtggaggg

SEQ ID NO: 9392423 - DNA, 22 bp, Homo sapiens
ggcacacagcttggcaggagat

SEQ ID NO: 9392424 - DNA, 22 bp, Homo sapiens
ggcacacagcttggcaggagat

SEQ ID NO: 9392425 - DNA, 22 bp, Homo sapiens
ggcacacagatggagcactagc

SEQ ID NO: 9392426 - DNA, 22 bp, Homo sapiens
ggagtgtggagaggacatgggt

SEQ ID NO: 9392427 - DNA, 22 bp, Homo sapiens
ggagtgtcccgattttccaggt

SEQ ID NO: 9392428 - DNA, 22 bp, Homo sapiens
ggagtggtgtcactgagaggaa

SEQ ID NO: 9392429 - DNA, 22 bp, Homo sapiens
ggagtggtgtcactgagaggaa

SEQ ID NO: 9392430 - DNA, 22 bp, Homo sapiens
ggagtggtgtcactgagaggaa

SEQ ID NO: 9392431 - DNA, 22 bp, Homo sapiens
ggcaaggaagaagccatgatgt

SEQ ID NO: 9392432 - DNA, 22 bp, Homo sapiens
ggcaaggcctgcagctcagtgt

SEQ ID NO: 9392433 - DNA, 22 bp, Homo sapiens
ggcaaggccaggcctccaagac

SEQ ID NO: 9392434 - DNA, 22 bp, Homo sapiens
ggagttgacagtttagaagctt

SEQ ID NO: 9392435 - DNA, 22 bp, Homo sapiens
ggagttgatcagagtaggaggt

SEQ ID NO: 9392436 - DNA, 17 bp, Homo sapiens
ggagttctgcagtcagg

SEQ ID NO: 9392437 - DNA, 22 bp, Homo sapiens
ggaggccagcctgaggctgagg

SEQ ID NO: 9392438 - DNA, 22 bp, Homo sapiens
ggaggccagcctgaggctgagg

SEQ ID NO: 9392439 - DNA, 22 bp, Homo sapiens
ggaggccagcctgaggctgagg

SEQ ID NO: 9392440 - DNA, 22 bp, Homo sapiens
ggaggccacctgacctgctgtt

SEQ ID NO: 9392441 - DNA, 22 bp, Homo sapiens
ggaggccacctgacctgctgtt

SEQ ID NO: 9392442 - DNA, 22 bp, Homo sapiens
ggaggccacctgacctgctgtt

SEQ ID NO: 9392443 - DNA, 22 bp, Homo sapiens
ggaggccacctgacctgctgtt

SEQ ID NO: 9392444 - DNA, 22 bp, Homo sapiens
ggaggccacggtttagcaccga

SEQ ID NO: 9392445 - DNA, 22 bp, Homo sapiens
ggaggccacggtttagcaccga

SEQ ID NO: 9392446 - DNA, 22 bp, Homo sapiens
ggaggccaattttctaactgca

SEQ ID NO: 9392447 - DNA, 22 bp, Homo sapiens
ggaggccaccatggagtcactt

SEQ ID NO: 9392448 - DNA, 22 bp, Homo sapiens
ggaggccaccatggagtcactt

SEQ ID NO: 9392449 - DNA, 22 bp, Homo sapiens
ggaggccaccatggagtcactt

SEQ ID NO: 9392450 - DNA, 22 bp, Homo sapiens
ggaggccaaggtgggcggatca

SEQ ID NO: 9392451 - DNA, 22 bp, Homo sapiens
ggaggccaagtcactgacctgg

SEQ ID NO: 9392452 - DNA, 22 bp, Homo sapiens
ggaggccaagtcactgacctgg

SEQ ID NO: 9392453 - DNA, 22 bp, Homo sapiens
ggaggccaagtcactgacctgg

SEQ ID NO: 9392454 - DNA, 22 bp, Homo sapiens
ggaggcagaatagagtgtgggt

SEQ ID NO: 9392455 - DNA, 22 bp, Homo sapiens
ggaggaggcggcagaagttcct

SEQ ID NO: 9392456 - DNA, 22 bp, Homo sapiens
ggaggaggcggcagaagttcct

SEQ ID NO: 9392457 - DNA, 22 bp, Homo sapiens
ggaggaggcaagtaccagatgc

SEQ ID NO: 9392458 - DNA, 22 bp, Homo sapiens
ggaggagctgctgtgggggccc

SEQ ID NO: 9392459 - DNA, 22 bp, Homo sapiens
ggaggaggcaagtaccagatgc

SEQ ID NO: 9392460 - DNA, 22 bp, Homo sapiens
ggaggaggcaagtaccagatgc

SEQ ID NO: 9392461 - DNA, 22 bp, Homo sapiens
ggaggaggcaagtaccagatgc

SEQ ID NO: 9392462 - DNA, 22 bp, Homo sapiens
ggaggaggcaagtaccagatgc

SEQ ID NO: 9392463 - DNA, 22 bp, Homo sapiens
ggaggaggcggcagaagttcct

SEQ ID NO: 9392464 - DNA, 22 bp, Homo sapiens
ggaggccagggtgggtggatcg

SEQ ID NO: 9392465 - DNA, 22 bp, Homo sapiens
ggaggccaggtgggagtcatct

SEQ ID NO: 9392466 - DNA, 22 bp, Homo sapiens
ggaggccaggtgggagtcatct

SEQ ID NO: 9392467 - DNA, 22 bp, Homo sapiens
ggaggccaggtgggagtcatct

SEQ ID NO: 9392468 - DNA, 22 bp, Homo sapiens
ggaggccaggatgggaactcaa

SEQ ID NO: 9392469 - DNA, 22 bp, Homo sapiens
ggaggccagggacccagtcagc

SEQ ID NO: 9392470 - DNA, 22 bp, Homo sapiens
ggaggccagggacccagtcagc

SEQ ID NO: 9392471 - DNA, 22 bp, Homo sapiens
ggaggccaggaaggctcggaga

SEQ ID NO: 9392472 - DNA, 22 bp, Homo sapiens
ggaggccaggatgggaactcaa

SEQ ID NO: 9392473 - DNA, 22 bp, Homo sapiens
ggaggccaggaagagccgccct

SEQ ID NO: 9392474 - DNA, 22 bp, Homo sapiens
ggaggccaggaagagccgccct

SEQ ID NO: 9392475 - DNA, 22 bp, Homo sapiens
ggaggccaggaagagccgccct

SEQ ID NO: 9392476 - DNA, 22 bp, Homo sapiens
ggaggccagcctgaggctgagg

SEQ ID NO: 9392477 - DNA, 22 bp, Homo sapiens
ggaggccagcctgaggctgagg

SEQ ID NO: 9392478 - DNA, 22 bp, Homo sapiens
ggaggccatctggctggaggct

SEQ ID NO: 9392479 - DNA, 22 bp, Homo sapiens
ggaggccatctggctggaggct

SEQ ID NO: 9392480 - DNA, 22 bp, Homo sapiens
ggaggccatctggctggaggct

SEQ ID NO: 9392481 - DNA, 22 bp, Homo sapiens
ggaggccatctggctggaggct

SEQ ID NO: 9392482 - DNA, 22 bp, Homo sapiens
ggaggccatcagggagggcatt

SEQ ID NO: 9392483 - DNA, 22 bp, Homo sapiens
ggaggccatgaggctctaggtg

SEQ ID NO: 9392484 - DNA, 22 bp, Homo sapiens
ggaggccatgaggctctaggtg

SEQ ID NO: 9392485 - DNA, 22 bp, Homo sapiens
ggaggccatgaggctctaggtg

SEQ ID NO: 9392486 - DNA, 22 bp, Homo sapiens
ggaggccatcagggagggcatt

SEQ ID NO: 9392487 - DNA, 22 bp, Homo sapiens
ggaggccatcagggagggcatt

SEQ ID NO: 9392488 - DNA, 22 bp, Homo sapiens
ggaggccatcagggagggcatt

SEQ ID NO: 9392489 - DNA, 22 bp, Homo sapiens
ggaggccatcagggagggcatt

SEQ ID NO: 9392490 - DNA, 22 bp, Homo sapiens
ggaggccatagtttgggagtca

SEQ ID NO: 9392491 - DNA, 22 bp, Homo sapiens
ggaggccatcagggagggcatt

SEQ ID NO: 9392492 - DNA, 22 bp, Homo sapiens
ggaggccagtcctggccgggct

SEQ ID NO: 9392493 - DNA, 22 bp, Homo sapiens
ggaggccagtcctggccgggct

SEQ ID NO: 9392494 - DNA, 22 bp, Homo sapiens
ggaggccatagtttgggagtca

SEQ ID NO: 9392495 - DNA, 22 bp, Homo sapiens
ggaggccatagtttgggagtca

SEQ ID NO: 9392496 - DNA, 22 bp, Homo sapiens
ggaggaagtgcagttctactac

SEQ ID NO: 9392497 - DNA, 22 bp, Homo sapiens
ggaggaagggtagcataatgta

SEQ ID NO: 9392498 - DNA, 22 bp, Homo sapiens
ggaggaagggcccaggctttat

SEQ ID NO: 9392499 - DNA, 22 bp, Homo sapiens
ggaggaagggcccaggctttat

SEQ ID NO: 9392500 - DNA, 22 bp, Homo sapiens
ggaggaagcacacggcttgtat

SEQ ID NO: 9392501 - DNA, 22 bp, Homo sapiens
ggaggaagaggttgttctctca

SEQ ID NO: 9392502 - DNA, 22 bp, Homo sapiens
ggaggaaatgaaaggagggttt

SEQ ID NO: 9392503 - DNA, 22 bp, Homo sapiens
ggaggacactggctctgccttc

SEQ ID NO: 9392504 - DNA, 22 bp, Homo sapiens
ggaggaagtgcagttctactac

SEQ ID NO: 9392505 - DNA, 22 bp, Homo sapiens
ggaggacactggctctgccttc

SEQ ID NO: 9392506 - DNA, 22 bp, Homo sapiens
ggaggaccatcctggtttcacc

SEQ ID NO: 9392507 - DNA, 22 bp, Homo sapiens
ggaggacaggggctgcagcaca

SEQ ID NO: 9392508 - DNA, 22 bp, Homo sapiens
ggaggacaggggctgcagcaca

SEQ ID NO: 9392509 - DNA, 22 bp, Homo sapiens
ggaggagcatgagagggtagtg

SEQ ID NO: 9392510 - DNA, 22 bp, Homo sapiens
ggaggagcatgagagggtagtg

SEQ ID NO: 9392511 - DNA, 22 bp, Homo sapiens
ggaggagcatgagagggtagtg

SEQ ID NO: 9392512 - DNA, 22 bp, Homo sapiens
ggaggaccccagcagctcccca

SEQ ID NO: 9392513 - DNA, 22 bp, Homo sapiens
ggaggacctgctggccctgcaa

SEQ ID NO: 9392514 - DNA, 22 bp, Homo sapiens
ggaggagcccactcaaagggga

SEQ ID NO: 9392515 - DNA, 22 bp, Homo sapiens
ggaggagctgctgtgggggccc

SEQ ID NO: 9392516 - DNA, 22 bp, Homo sapiens
ggaggagcccactcaaagggga

SEQ ID NO: 9392517 - DNA, 22 bp, Homo sapiens
ggaggagcccactcaaagggga

SEQ ID NO: 9392518 - DNA, 17 bp, Homo sapiens
ggagctccagctactgc

SEQ ID NO: 9392519 - DNA, 22 bp, Homo sapiens
ggagctcataacaaggtagcca

SEQ ID NO: 9392520 - DNA, 22 bp, Homo sapiens
ggagctcctggcagtgacagag

SEQ ID NO: 9392521 - DNA, 22 bp, Homo sapiens
ggagctctatctgggagttctt

SEQ ID NO: 9392522 - DNA, 22 bp, Homo sapiens
ggagctctatctgggagttctt

SEQ ID NO: 9392523 - DNA, 22 bp, Homo sapiens
ggagctcagtggggggactgtg

SEQ ID NO: 9392524 - DNA, 22 bp, Homo sapiens
ggagctcaccttggagtctctg

SEQ ID NO: 9392525 - DNA, 22 bp, Homo sapiens
ggagctcagaagtgagtgagtt

SEQ ID NO: 9392526 - DNA, 22 bp, Homo sapiens
ggagctctctcagggggtccaa

SEQ ID NO: 9392527 - DNA, 22 bp, Homo sapiens
ggagctctcctgatgtgaagat

SEQ ID NO: 9392528 - DNA, 22 bp, Homo sapiens
ggagctctcctgatgtgaagat

SEQ ID NO: 9392529 - DNA, 22 bp, Homo sapiens
ggagctctgaggatgcattggt

SEQ ID NO: 9392530 - DNA, 22 bp, Homo sapiens
ggagctctgtgtctctcctgcc

SEQ ID NO: 9392531 - DNA, 20 bp, Homo sapiens
ggagctctgcatttatcttc

SEQ ID NO: 9392532 - DNA, 22 bp, Homo sapiens
ggagctctgtgtctctcctgcc

SEQ ID NO: 9392533 - DNA, 22 bp, Homo sapiens
ggagctcttccagcttgttgct

SEQ ID NO: 9392534 - DNA, 22 bp, Homo sapiens
ggagctgagacccagtggctga

SEQ ID NO: 9392535 - DNA, 22 bp, Homo sapiens
ggagctgaggctgaggcctcac

SEQ ID NO: 9392536 - DNA, 22 bp, Homo sapiens
ggaggaaatccttagtaaggca

SEQ ID NO: 9392537 - DNA, 21 bp, Homo sapiens
ggaggaaaaaggaatgacttg

SEQ ID NO: 9392538 - DNA, 21 bp, Homo sapiens
ggaggaaaaaggaatgacttg

SEQ ID NO: 9392539 - DNA, 22 bp, Homo sapiens
ggaggaaaggctccctccctct

SEQ ID NO: 9392540 - DNA, 22 bp, Homo sapiens
ggagctgcacgctctgaagcct

SEQ ID NO: 9392541 - DNA, 22 bp, Homo sapiens
ggagagggtgtggaaagttatc

SEQ ID NO: 9392542 - DNA, 22 bp, Homo sapiens
ggagagggtaggggtcctgccc

SEQ ID NO: 9392543 - DNA, 22 bp, Homo sapiens
ggagagggtaggggtcctgccc

SEQ ID NO: 9392544 - DNA, 22 bp, Homo sapiens
ggagaggtgcaggtcagtggca

SEQ ID NO: 9392545 - DNA, 22 bp, Homo sapiens
ggagaggtgagaggtacaagtt

SEQ ID NO: 9392546 - DNA, 22 bp, Homo sapiens
ggagaggtgagaggtacaagtt

SEQ ID NO: 9392547 - DNA, 17 bp, Homo sapiens
ggagatctggcagaggg

SEQ ID NO: 9392548 - DNA, 22 bp, Homo sapiens
ggagaggtgtattcagtgggtc

SEQ ID NO: 9392549 - DNA, 22 bp, Homo sapiens
ggagatctgagagctggaagtg

SEQ ID NO: 9392550 - DNA, 22 bp, Homo sapiens
ggagagggggctccctgcttgg

SEQ ID NO: 9392551 - DNA, 22 bp, Homo sapiens
ggagagggggctccctgcttgg

SEQ ID NO: 9392552 - DNA, 22 bp, Homo sapiens
ggagagggggctccctgcttgg

SEQ ID NO: 9392553 - DNA, 23 bp, Homo sapiens
ggagaggggtgtgggcatcttta

SEQ ID NO: 9392554 - DNA, 23 bp, Homo sapiens
ggagaggggtgtgggcatcttta

SEQ ID NO: 9392555 - DNA, 23 bp, Homo sapiens
ggagaggggtgtgggcatcttta

SEQ ID NO: 9392556 - DNA, 22 bp, Homo sapiens
ggagagggtaggggtcctgccc

SEQ ID NO: 9392557 - DNA, 22 bp, Homo sapiens
ggagaggggaacttgttgcttg

SEQ ID NO: 9392558 - DNA, 22 bp, Homo sapiens
ggagaggggaacttgttgcttg

SEQ ID NO: 9392559 - DNA, 22 bp, Homo sapiens
ggagaggcttggcccagcctgg

SEQ ID NO: 9392560 - DNA, 22 bp, Homo sapiens
ggagaggggcaagtttatctag

SEQ ID NO: 9392561 - DNA, 22 bp, Homo sapiens
ggagaggggcaagtttatctag

SEQ ID NO: 9392562 - DNA, 22 bp, Homo sapiens
ggagaggggaacttgttgcttg

SEQ ID NO: 9392563 - DNA, 22 bp, Homo sapiens
ggagcgtgcagcatgagctcat

SEQ ID NO: 9392564 - DNA, 22 bp, Homo sapiens
ggagcgtgcactccaggccctt

SEQ ID NO: 9392565 - DNA, 22 bp, Homo sapiens
ggagcctgtggccgtcacgact

SEQ ID NO: 9392566 - DNA, 22 bp, Homo sapiens
ggagcctgtgcccaagcccaga

SEQ ID NO: 9392567 - DNA, 22 bp, Homo sapiens
ggagcctgtggctgcttgaagc

SEQ ID NO: 9392568 - DNA, 22 bp, Homo sapiens
ggagcctgtggccgtcacgact

SEQ ID NO: 9392569 - DNA, 22 bp, Homo sapiens
ggagcctgtgggatgagatgtg

SEQ ID NO: 9392570 - DNA, 22 bp, Homo sapiens
ggagcctgtgggatgagatgtg

SEQ ID NO: 9392571 - DNA, 22 bp, Homo sapiens
ggagcctgttagttgagtgctc

SEQ ID NO: 9392572 - DNA, 22 bp, Homo sapiens
ggagcctgtgggatgagatgtg

SEQ ID NO: 9392573 - DNA, 22 bp, Homo sapiens
ggagcctgtgggatgagatgtg

SEQ ID NO: 9392574 - DNA, 22 bp, Homo sapiens
ggagatgcaatgtagaatctgg

SEQ ID NO: 9392575 - DNA, 22 bp, Homo sapiens
ggagatctttaggagttggact

SEQ ID NO: 9392576 - DNA, 22 bp, Homo sapiens
ggagatgccagaattgcaaatt

SEQ ID NO: 9392577 - DNA, 20 bp, Homo sapiens
ggagatgcagcccaggtgcc

SEQ ID NO: 9392578 - DNA, 22 bp, Homo sapiens
ggagatgctatgtagtttggtt

SEQ ID NO: 9392579 - DNA, 22 bp, Homo sapiens
ggagatgccagaattgcaaatt

SEQ ID NO: 9392580 - DNA, 22 bp, Homo sapiens
ggagatgccagaattgcaaatt

SEQ ID NO: 9392581 - DNA, 22 bp, Homo sapiens
ggagcctgtgcccaagcccaga

SEQ ID NO: 9392582 - DNA, 22 bp, Homo sapiens
ggagcctggttactagagcctg

SEQ ID NO: 9392583 - DNA, 22 bp, Homo sapiens
ggagcctggttactagagcctg

SEQ ID NO: 9392584 - DNA, 22 bp, Homo sapiens
ggagcctggtcaggttggctcc

SEQ ID NO: 9392585 - DNA, 22 bp, Homo sapiens
ggagcctggtcaggttggctcc

SEQ ID NO: 9392586 - DNA, 22 bp, Homo sapiens
ggagatggaatagattctgact

SEQ ID NO: 9392587 - DNA, 22 bp, Homo sapiens
ggagatggaatagattctgact

SEQ ID NO: 9392588 - DNA, 22 bp, Homo sapiens
ggagatgctttccagtggggat

SEQ ID NO: 9392589 - DNA, 22 bp, Homo sapiens
ggagacacccacattgctgggt

SEQ ID NO: 9392590 - DNA, 22 bp, Homo sapiens
ggagaaggtggctcagcaaagg

SEQ ID NO: 9392591 - DNA, 22 bp, Homo sapiens
ggagacagcaggaagaaatatc

SEQ ID NO: 9392592 - DNA, 22 bp, Homo sapiens
ggagaaggaagaaagctactat

SEQ ID NO: 9392593 - DNA, 22 bp, Homo sapiens
ggagaaggaatattggagtagg

SEQ ID NO: 9392594 - DNA, 22 bp, Homo sapiens
ggagaaggaatattggagtagg

SEQ ID NO: 9392595 - DNA, 22 bp, Homo sapiens
ggagaaggaatattggagtagg

SEQ ID NO: 9392596 - DNA, 22 bp, Homo sapiens
ggagaaggaatattggagtagg

SEQ ID NO: 9392597 - DNA, 21 bp, Homo sapiens
ggagaaggacaatgttgagta

SEQ ID NO: 9392598 - DNA, 21 bp, Homo sapiens
ggagaaggacaatgttgagta

SEQ ID NO: 9392599 - DNA, 22 bp, Homo sapiens
ggagaaggtggctcagcaaagg

SEQ ID NO: 9392600 - DNA, 22 bp, Homo sapiens
ggaagtgtagtccgaagttgcg

SEQ ID NO: 9392601 - DNA, 22 bp, Homo sapiens
ggaagtcctggccatctgccgg

SEQ ID NO: 9392602 - DNA, 22 bp, Homo sapiens
ggaagtgtttgtgcagatggcc

SEQ ID NO: 9392603 - DNA, 22 bp, Homo sapiens
ggaagtgtgcaatattgggctg

SEQ ID NO: 9392604 - DNA, 22 bp, Homo sapiens
ggaagtgtttccttgggcagca

SEQ ID NO: 9392605 - DNA, 18 bp, Homo sapiens
ggaaggtgctggagtgca

SEQ ID NO: 9392606 - DNA, 18 bp, Homo sapiens
ggaaggtgctggagtgca

SEQ ID NO: 9392607 - DNA, 18 bp, Homo sapiens
ggaagtaggaagaggaag

SEQ ID NO: 9392608 - DNA, 22 bp, Homo sapiens
ggaagtcctcatacctgattct

SEQ ID NO: 9392609 - DNA, 22 bp, Homo sapiens
ggaagtaatgtcttaagattct

SEQ ID NO: 9392610 - DNA, 22 bp, Homo sapiens
ggaagtagaggtcattctgaat

SEQ ID NO: 9392611 - DNA, 19 bp, Homo sapiens
ggagaagcccaggaatcct

SEQ ID NO: 9392612 - DNA, 19 bp, Homo sapiens
ggagaagcccaggaatcct

SEQ ID NO: 9392613 - DNA, 19 bp, Homo sapiens
ggagaagcccaggaatcct

SEQ ID NO: 9392614 - DNA, 19 bp, Homo sapiens
ggagaagcccaggaatcct

SEQ ID NO: 9392615 - DNA, 22 bp, Homo sapiens
ggagaagccacacattgggtgt

SEQ ID NO: 9392616 - DNA, 22 bp, Homo sapiens
ggagaagccaggtgataagcaa

SEQ ID NO: 9392617 - DNA, 22 bp, Homo sapiens
ggagaagcaggtgctttgggtc

SEQ ID NO: 9392618 - DNA, 22 bp, Homo sapiens
ggaatatagccagtaacagtca

SEQ ID NO: 9392619 - DNA, 22 bp, Homo sapiens
ggagaagcaggtgctttgggtc

SEQ ID NO: 9392620 - DNA, 22 bp, Homo sapiens
ggagaagccacacattgggtgt

SEQ ID NO: 9392621 - DNA, 19 bp, Homo sapiens
ggagaagcatctagaaata

SEQ ID NO: 9392622 - DNA, 22 bp, Homo sapiens
ggagaagcaggtgctttgggtc

SEQ ID NO: 9392623 - DNA, 19 bp, Homo sapiens
ggagaagcatctagaaata

SEQ ID NO: 9392624 - DNA, 22 bp, Homo sapiens
ggaatagtttatgtagctgaat

SEQ ID NO: 9392625 - DNA, 21 bp, Homo sapiens
ggaatagcttaaagtgagggg

SEQ ID NO: 9392626 - DNA, 22 bp, Homo sapiens
ggaagtttgtagatgtttctta

SEQ ID NO: 9392627 - DNA, 22 bp, Homo sapiens
ggaataaagaatctggttcccc

SEQ ID NO: 9392628 - DNA, 22 bp, Homo sapiens
ggaagtttgggagctggtaatc

SEQ ID NO: 9392629 - DNA, 22 bp, Homo sapiens
ggaaggggtgggtgagcctcag

SEQ ID NO: 9392630 - DNA, 22 bp, Homo sapiens
ggaagggcaaaagagatgaact

SEQ ID NO: 9392631 - DNA, 22 bp, Homo sapiens
ggaagggcaaaagagatgaact

SEQ ID NO: 9392632 - DNA, 21 bp, Homo sapiens
ggaaggggtcctcccaacagt

SEQ ID NO: 9392633 - DNA, 22 bp, Homo sapiens
ggaagggcaataaaatctcagg

SEQ ID NO: 9392634 - DNA, 22 bp, Homo sapiens
ggaagaaatgctcttctatgcg

SEQ ID NO: 9392635 - DNA, 22 bp, Homo sapiens
ggaagaaatgctcttctatgcg

SEQ ID NO: 9392636 - DNA, 22 bp, Homo sapiens
ggaagaaatctggttaagagat

SEQ ID NO: 9392637 - DNA, 22 bp, Homo sapiens
ggaagggagtagttggaatgca

SEQ ID NO: 9392638 - DNA, 22 bp, Homo sapiens
ggaagggagtagttggaatgca

SEQ ID NO: 9392639 - DNA, 22 bp, Homo sapiens
ggaagggtttaagcaggagagt

SEQ ID NO: 9392640 - DNA, 22 bp, Homo sapiens
ggaaggtgctccctggacagag

SEQ ID NO: 9392641 - DNA, 22 bp, Homo sapiens
ggaaggtgctccctggacagag

SEQ ID NO: 9392642 - DNA, 22 bp, Homo sapiens
ggaaggtgctccctggacagag

SEQ ID NO: 9392643 - DNA, 22 bp, Homo sapiens
ggaaggtgctccctggacagag

SEQ ID NO: 9392644 - DNA, 18 bp, Homo sapiens
ggaaggtgatgtgaaaag

SEQ ID NO: 9392645 - DNA, 22 bp, Homo sapiens
ggaaggtgaggtaaggtcttgt

SEQ ID NO: 9392646 - DNA, 19 bp, Homo sapiens
ggaaggtgacagtggtgaa

SEQ ID NO: 9392647 - DNA, 22 bp, Homo sapiens
ggaaggtcgagctgcatctggc

SEQ ID NO: 9392648 - DNA, 22 bp, Homo sapiens
ggaactgggttagggtctcttc

SEQ ID NO: 9392649 - DNA, 22 bp, Homo sapiens
ggaactggagaatgccctcttt

SEQ ID NO: 9392650 - DNA, 22 bp, Homo sapiens
ggaactgattaagtcatgagaa

SEQ ID NO: 9392651 - DNA, 22 bp, Homo sapiens
ggaactgagcaatggcatgaaa

SEQ ID NO: 9392652 - DNA, 17 bp, Homo sapiens
ggaagaaaaggatcatc

SEQ ID NO: 9392653 - DNA, 17 bp, Homo sapiens
ggaagaaaaggatcatc

SEQ ID NO: 9392654 - DNA, 18 bp, Homo sapiens
ggaagaaaaggaactcag

SEQ ID NO: 9392655 - DNA, 18 bp, Homo sapiens
ggaagaaaaggaactcag

SEQ ID NO: 9392656 - DNA, 22 bp, Homo sapiens
ggaagaaatctggttaagagat

SEQ ID NO: 9392657 - DNA, 22 bp, Homo sapiens
ggaagaaaggtggacaacaggt

SEQ ID NO: 9392658 - DNA, 22 bp, Homo sapiens
ggaagaaaggtggacaacaggt

SEQ ID NO: 9392659 - DNA, 22 bp, Homo sapiens
ggaagaaaatgggcaacaggtg

SEQ ID NO: 9392660 - DNA, 22 bp, Homo sapiens
ggaagaaaatgggcaacaggtg

SEQ ID NO: 9392661 - DNA, 22 bp, Homo sapiens
ggaagaaagacatttattttga

SEQ ID NO: 9392662 - DNA, 22 bp, Homo sapiens
ggaagaaaatgggcaacaggtg

SEQ ID NO: 9392663 - DNA, 23 bp, Homo sapiens
ggaaagagaggagttgtgcatag

SEQ ID NO: 9392664 - DNA, 23 bp, Homo sapiens
ggaaagagaggagttgtgcatag

SEQ ID NO: 9392665 - DNA, 22 bp, Homo sapiens
ggaaagagcccagcagtgcttg

SEQ ID NO: 9392666 - DNA, 22 bp, Homo sapiens
ggaaagagcccagcagtgcttg

SEQ ID NO: 9392667 - DNA, 22 bp, Homo sapiens
ggaaagaatagagactttatca

SEQ ID NO: 9392668 - DNA, 22 bp, Homo sapiens
ggaactcagtatcagactccag

SEQ ID NO: 9392669 - DNA, 22 bp, Homo sapiens
ggaactgaatgtctcggtataa

SEQ ID NO: 9392670 - DNA, 22 bp, Homo sapiens
ggaaagccaggtgctctggtgt

SEQ ID NO: 9392671 - DNA, 22 bp, Homo sapiens
ggaaagagggacccagcttggt

SEQ ID NO: 9392672 - DNA, 22 bp, Homo sapiens
ggaaagaggatagtgggtaggt

SEQ ID NO: 9392673 - DNA, 22 bp, Homo sapiens
ggaaagaggatagtgggtaggt

SEQ ID NO: 9392674 - DNA, 22 bp, Homo sapiens
ggaaagagctaaaagggtgaga

SEQ ID NO: 9392675 - DNA, 22 bp, Homo sapiens
ggaaagagctaaaagggtgaga

SEQ ID NO: 9392676 - DNA, 22 bp, Homo sapiens
ggaaagagctaaaagggtgaga

SEQ ID NO: 9392677 - DNA, 18 bp, Homo sapiens
ggaaaccacagggttctg

SEQ ID NO: 9392678 - DNA, 22 bp, Homo sapiens
ggaaactaaatcaagctggctt

SEQ ID NO: 9392679 - DNA, 22 bp, Homo sapiens
ggaaactaaagaggtgtttttg

SEQ ID NO: 9392680 - DNA, 22 bp, Homo sapiens
ggaaactgagtgacactccctc

SEQ ID NO: 9392681 - DNA, 22 bp, Homo sapiens
ggaaactgtagtttgctgacat

SEQ ID NO: 9392682 - DNA, 22 bp, Homo sapiens
ggaaactgtagtttgctgacat

SEQ ID NO: 9392683 - DNA, 22 bp, Homo sapiens
ggaaactgcttacactagaggg

SEQ ID NO: 9392684 - DNA, 22 bp, Homo sapiens
ggaaacattccaagagttgaaa

SEQ ID NO: 9392685 - DNA, 20 bp, Homo sapiens
ggaaacatttttatttccat

SEQ ID NO: 9392686 - DNA, 22 bp, Homo sapiens
ggaaaacagcgattggtatcat

SEQ ID NO: 9392687 - DNA, 22 bp, Homo sapiens
ggaaaacaagagaatgatgttt

SEQ ID NO: 9392688 - DNA, 22 bp, Homo sapiens
gcttctgggcacctgaacagga

SEQ ID NO: 9392689 - DNA, 22 bp, Homo sapiens
gcttctggggttctggcatgct

SEQ ID NO: 9392690 - DNA, 22 bp, Homo sapiens
gcttctggtagaattcaataga

SEQ ID NO: 9392691 - DNA, 22 bp, Homo sapiens
gcttctggagtcttcagaggaa

SEQ ID NO: 9392692 - DNA, 22 bp, Homo sapiens
gcttctggcagtgcagccacca

SEQ ID NO: 9392693 - DNA, 22 bp, Homo sapiens
gcttctggcagtgcagccacca

SEQ ID NO: 9392694 - DNA, 22 bp, Homo sapiens
gcttctggaggagctgggctga

SEQ ID NO: 9392695 - DNA, 22 bp, Homo sapiens
gctgggctctgtcatgccttcc

SEQ ID NO: 9392696 - DNA, 22 bp, Homo sapiens
gctgggctctgtcatgccttcc

SEQ ID NO: 9392697 - DNA, 22 bp, Homo sapiens
gctgggctctgtcatgccttcc

SEQ ID NO: 9392698 - DNA, 22 bp, Homo sapiens
gctgggctcgttcccacacgcg

SEQ ID NO: 9392699 - DNA, 21 bp, Homo sapiens
gctgggctccagtctgccgct

SEQ ID NO: 9392700 - DNA, 21 bp, Homo sapiens
gctgggctccagtctgccgct

SEQ ID NO: 9392701 - DNA, 21 bp, Homo sapiens
gctgggctccagtctgccgct

SEQ ID NO: 9392702 - DNA, 22 bp, Homo sapiens
gctgggctcttatcacctgtac

SEQ ID NO: 9392703 - DNA, 22 bp, Homo sapiens
gctgggctctttacccctgtac

SEQ ID NO: 9392704 - DNA, 22 bp, Homo sapiens
gctgggctgagctagacttggc

SEQ ID NO: 9392705 - DNA, 22 bp, Homo sapiens
gctgggctgagaagttaagcaa

SEQ ID NO: 9392706 - DNA, 22 bp, Homo sapiens
gctgggctgagaagttaagcaa

SEQ ID NO: 9392707 - DNA, 22 bp, Homo sapiens
gctgggctcagacctagtgaac

SEQ ID NO: 9392708 - DNA, 22 bp, Homo sapiens
gctgggctcagacctagtgaac

SEQ ID NO: 9392709 - DNA, 22 bp, Homo sapiens
gctgggccagagcagcagcact

SEQ ID NO: 9392710 - DNA, 22 bp, Homo sapiens
gctgggcatgtgaccaacagaa

SEQ ID NO: 9392711 - DNA, 22 bp, Homo sapiens
gctgggccagactttcaatgtc

SEQ ID NO: 9392712 - DNA, 22 bp, Homo sapiens
gctgggctcatttgtgtgtctg

SEQ ID NO: 9392713 - DNA, 22 bp, Homo sapiens
gctgggctcatttgtgtgtctg

SEQ ID NO: 9392714 - DNA, 22 bp, Homo sapiens
gctgggctccaccctcaactgt

SEQ ID NO: 9392715 - DNA, 22 bp, Homo sapiens
gctgggctccaggccagggtga

SEQ ID NO: 9392716 - DNA, 22 bp, Homo sapiens
gctgggctccaggccagggtga

SEQ ID NO: 9392717 - DNA, 22 bp, Homo sapiens
gctgggctccaccctcaactgt

SEQ ID NO: 9392718 - DNA, 22 bp, Homo sapiens
gctgggctccaccctcaactgt

SEQ ID NO: 9392719 - DNA, 22 bp, Homo sapiens
gctgggctccaggccagggtga

SEQ ID NO: 9392720 - DNA, 22 bp, Homo sapiens
gcttagaagtacacatgccttt

SEQ ID NO: 9392721 - DNA, 22 bp, Homo sapiens
gcttagtcaattataaataggc

SEQ ID NO: 9392722 - DNA, 22 bp, Homo sapiens
gcttaggagtttcaggctctca

SEQ ID NO: 9392723 - DNA, 22 bp, Homo sapiens
gcttaggatgaatgctgtagaa

SEQ ID NO: 9392724 - DNA, 22 bp, Homo sapiens
gcttagctgcatgcatgttctt

SEQ ID NO: 9392725 - DNA, 22 bp, Homo sapiens
gcttattttcaccttctctcag

SEQ ID NO: 9392726 - DNA, 22 bp, Homo sapiens
gcttattttatcctattcacta

SEQ ID NO: 9392727 - DNA, 22 bp, Homo sapiens
gctgggctgcgtcggggaagcc

SEQ ID NO: 9392728 - DNA, 22 bp, Homo sapiens
gctgggctggaaggccaaggca

SEQ ID NO: 9392729 - DNA, 22 bp, Homo sapiens
gctgggctgcgtcggggaagcc

SEQ ID NO: 9392730 - DNA, 22 bp, Homo sapiens
gcttaattctggctcagtttcc

SEQ ID NO: 9392731 - DNA, 22 bp, Homo sapiens
gcttacaagatcgtgctccagt

SEQ ID NO: 9392732 - DNA, 22 bp, Homo sapiens
gctgggctgcccaacctctgac

SEQ ID NO: 9392733 - DNA, 22 bp, Homo sapiens
gctgggctgcgtcggggaagcc

SEQ ID NO: 9392734 - DNA, 22 bp, Homo sapiens
gctgggctgagctagacttggc

SEQ ID NO: 9392735 - DNA, 22 bp, Homo sapiens
gctgggctgagctagacttggc

SEQ ID NO: 9392736 - DNA, 22 bp, Homo sapiens
gctgggctgagctagacttggc

SEQ ID NO: 9392737 - DNA, 22 bp, Homo sapiens
gctgggctgagctagacttggc

SEQ ID NO: 9392738 - DNA, 22 bp, Homo sapiens
gctgggctgcccaacctctgac

SEQ ID NO: 9392739 - DNA, 22 bp, Homo sapiens
gctgggctgcccaacctctgac

SEQ ID NO: 9392740 - DNA, 17 bp, Homo sapiens
gcttcctgtgctgggga

SEQ ID NO: 9392741 - DNA, 22 bp, Homo sapiens
gcttccttccttacattggtgg

SEQ ID NO: 9392742 - DNA, 22 bp, Homo sapiens
gcttcctgtaggcaggtccaag

SEQ ID NO: 9392743 - DNA, 22 bp, Homo sapiens
gcttcctgtaggcaggtccaag

SEQ ID NO: 9392744 - DNA, 17 bp, Homo sapiens
gcttcctgtgctgggga

SEQ ID NO: 9392745 - DNA, 22 bp, Homo sapiens
gcttctgcagggtcctcgctgt

SEQ ID NO: 9392746 - DNA, 23 bp, Homo sapiens
gcttctgccatttgctagctgtg

SEQ ID NO: 9392747 - DNA, 22 bp, Homo sapiens
gcttctgcagagccgtcctgag

SEQ ID NO: 9392748 - DNA, 22 bp, Homo sapiens
gcttctgcgcctagcctcaggt

SEQ ID NO: 9392749 - DNA, 22 bp, Homo sapiens
gcttctatccctccactgcact

SEQ ID NO: 9392750 - DNA, 23 bp, Homo sapiens
gcttctagtcaatttcaccagga

SEQ ID NO: 9392751 - DNA, 22 bp, Homo sapiens
gcttcagaagttgggctctgac

SEQ ID NO: 9392752 - DNA, 22 bp, Homo sapiens
gcttcagacctgaaaggaaaaa

SEQ ID NO: 9392753 - DNA, 22 bp, Homo sapiens
gcttcaggctgaattcctccta

SEQ ID NO: 9392754 - DNA, 20 bp, Homo sapiens
gcttcagtttcctcactggt

SEQ ID NO: 9392755 - DNA, 22 bp, Homo sapiens
gcttcaggaggtcggtctcctt

SEQ ID NO: 9392756 - DNA, 22 bp, Homo sapiens
gcttcaggaggtcggtctcctt

SEQ ID NO: 9392757 - DNA, 22 bp, Homo sapiens
gcttcagctttgtctccttggg

SEQ ID NO: 9392758 - DNA, 22 bp, Homo sapiens
gcttcctggagggagagagctg

SEQ ID NO: 9392759 - DNA, 22 bp, Homo sapiens
gcttcctgggacaggctatgtg

SEQ ID NO: 9392760 - DNA, 22 bp, Homo sapiens
gcttcctgggacaggctatgtg

SEQ ID NO: 9392761 - DNA, 22 bp, Homo sapiens
gcttcatttgagaacctctgtg

SEQ ID NO: 9392762 - DNA, 22 bp, Homo sapiens
gcttcctggaacaactgttgct

SEQ ID NO: 9392763 - DNA, 22 bp, Homo sapiens
gatccagcttctacacagagct

SEQ ID NO: 9392764 - DNA, 22 bp, Homo sapiens
gatccccagggcaggcctcccg

SEQ ID NO: 9392765 - DNA, 22 bp, Homo sapiens
gatcccctattcttttcctcag

SEQ ID NO: 9392766 - DNA, 22 bp, Homo sapiens
gatccctgccctcagcctggac

SEQ ID NO: 9392767 - DNA, 22 bp, Homo sapiens
gatccccaggactagggggtgg

SEQ ID NO: 9392768 - DNA, 22 bp, Homo sapiens
gatccagcttctacacagagct

SEQ ID NO: 9392769 - DNA, 22 bp, Homo sapiens
gatcatttgcaggaaacattaa

SEQ ID NO: 9392770 - DNA, 22 bp, Homo sapiens
gatcatttgactttataaggct

SEQ ID NO: 9392771 - DNA, 22 bp, Homo sapiens
gatcattttgatgcccttttag

SEQ ID NO: 9392772 - DNA, 22 bp, Homo sapiens
gatctgttataatctcttttat

SEQ ID NO: 9392773 - DNA, 22 bp, Homo sapiens
gatccgaatcattgctctttta

SEQ ID NO: 9392774 - DNA, 22 bp, Homo sapiens
gatcttctatgtaatgaagtgt

SEQ ID NO: 9392775 - DNA, 22 bp, Homo sapiens
gatctgtttcattcacagtctg

SEQ ID NO: 9392776 - DNA, 22 bp, Homo sapiens
gatcttctagcagaagtaattt

SEQ ID NO: 9392777 - DNA, 22 bp, Homo sapiens
gatgaaaaaagacgagcatata

SEQ ID NO: 9392778 - DNA, 22 bp, Homo sapiens
gatgaaattcagaattgagggg

SEQ ID NO: 9392779 - DNA, 22 bp, Homo sapiens
gatgaaattgttttgatacttt

SEQ ID NO: 9392780 - DNA, 22 bp, Homo sapiens
gatgaggaatttgaggttagaa

SEQ ID NO: 9392781 - DNA, 22 bp, Homo sapiens
gatgatggtggacagctggtta

SEQ ID NO: 9392782 - DNA, 22 bp, Homo sapiens
gatgatgggttgatgtgaaggg

SEQ ID NO: 9392783 - DNA, 22 bp, Homo sapiens
gatgagcattgtttcatgtgtt

SEQ ID NO: 9392784 - DNA, 22 bp, Homo sapiens
gatgacagttctagcatctgaa

SEQ ID NO: 9392785 - DNA, 22 bp, Homo sapiens
gatgacagttctagcatctgaa

SEQ ID NO: 9392786 - DNA, 22 bp, Homo sapiens
gatgaattctggcttggacaga

SEQ ID NO: 9392787 - DNA, 22 bp, Homo sapiens
gatgaattgaaatcattgggca

SEQ ID NO: 9392788 - DNA, 22 bp, Homo sapiens
gatgaatgtgggtcaagtacct

SEQ ID NO: 9392789 - DNA, 22 bp, Homo sapiens
gatgaatgtgtccagaagactt

SEQ ID NO: 9392790 - DNA, 22 bp, Homo sapiens
gatgaatgggtacacaggatga

SEQ ID NO: 9392791 - DNA, 21 bp, Homo sapiens
gatgaatgtcctgaccagaac

SEQ ID NO: 9392792 - DNA, 22 bp, Homo sapiens
gatgcacattgaacaatcacaa

SEQ ID NO: 9392793 - DNA, 22 bp, Homo sapiens
gatgattttgatgcagtaaaga

SEQ ID NO: 9392794 - DNA, 22 bp, Homo sapiens
gatgatttttgccagtgtgatg

SEQ ID NO: 9392795 - DNA, 22 bp, Homo sapiens
gatgattttagttgactaaact

SEQ ID NO: 9392796 - DNA, 22 bp, Homo sapiens
gatgattttctgtgttagaaga

SEQ ID NO: 9392797 - DNA, 22 bp, Homo sapiens
gatgattgttggctctcttgat

SEQ ID NO: 9392798 - DNA, 22 bp, Homo sapiens
gatacataaaaatgtgctctat

SEQ ID NO: 9392799 - DNA, 22 bp, Homo sapiens
gataccagacagggagggagaa

SEQ ID NO: 9392800 - DNA, 22 bp, Homo sapiens
gatacacattttagctttgtct

SEQ ID NO: 9392801 - DNA, 22 bp, Homo sapiens
gataacattttgaagtgctagt

SEQ ID NO: 9392802 - DNA, 20 bp, Homo sapiens
gatacacagcacagagggcc

SEQ ID NO: 9392803 - DNA, 22 bp, Homo sapiens
gatacacacccttgataggact

SEQ ID NO: 9392804 - DNA, 22 bp, Homo sapiens
gatacacaagtggaaggagacg

SEQ ID NO: 9392805 - DNA, 22 bp, Homo sapiens
gatacacatgcatgtgcatgta

SEQ ID NO: 9392806 - DNA, 15 bp, Homo sapiens
gatacacatgactgg

SEQ ID NO: 9392807 - DNA, 22 bp, Homo sapiens
gatacacagggctaagatggat

SEQ ID NO: 9392808 - DNA, 20 bp, Homo sapiens
gatacacagcttcactgttg

SEQ ID NO: 9392809 - DNA, 22 bp, Homo sapiens
gatagtcacctcccttaacttt

SEQ ID NO: 9392810 - DNA, 19 bp, Homo sapiens
gatataaagagatggtgaa

SEQ ID NO: 9392811 - DNA, 22 bp, Homo sapiens
gataggctgaaagactatggcg

SEQ ID NO: 9392812 - DNA, 22 bp, Homo sapiens
gatataaattaatcaagtgcaa

SEQ ID NO: 9392813 - DNA, 22 bp, Homo sapiens
gatataaattaatcaagtgcaa

SEQ ID NO: 9392814 - DNA, 22 bp, Homo sapiens
gatataaattaatcaagtgcaa

SEQ ID NO: 9392815 - DNA, 22 bp, Homo sapiens
gataccagacagggagggagaa

SEQ ID NO: 9392816 - DNA, 22 bp, Homo sapiens
gatactttccatccaaatgcat

SEQ ID NO: 9392817 - DNA, 22 bp, Homo sapiens
gatactttgtggaatcctggat

SEQ ID NO: 9392818 - DNA, 22 bp, Homo sapiens
gatactttccatccaaatgcat

SEQ ID NO: 9392819 - DNA, 22 bp, Homo sapiens
gatactttctcatttacccaag

SEQ ID NO: 9392820 - DNA, 22 bp, Homo sapiens
gatcagaatcttcattttcagt

SEQ ID NO: 9392821 - DNA, 22 bp, Homo sapiens
gatcacagtattttagatgtgt

SEQ ID NO: 9392822 - DNA, 22 bp, Homo sapiens
gatcaatactattaagatcata

SEQ ID NO: 9392823 - DNA, 22 bp, Homo sapiens
gatcaggacatagctataggct

SEQ ID NO: 9392824 - DNA, 22 bp, Homo sapiens
gatcagagagctctttatggcc

SEQ ID NO: 9392825 - DNA, 22 bp, Homo sapiens
gatcagagagttagaaatgtca

SEQ ID NO: 9392826 - DNA, 22 bp, Homo sapiens
gatcagaatttacttataattg

SEQ ID NO: 9392827 - DNA, 19 bp, Homo sapiens
gatcagagtgtcagcttgt

SEQ ID NO: 9392828 - DNA, 22 bp, Homo sapiens
gatcagagtggctagagccttg

SEQ ID NO: 9392829 - DNA, 22 bp, Homo sapiens
gatcagagccagagatgataac

SEQ ID NO: 9392830 - DNA, 22 bp, Homo sapiens
gatcagtttattaattttctag

SEQ ID NO: 9392831 - DNA, 22 bp, Homo sapiens
gatcatcatctttcaggcaagt

SEQ ID NO: 9392832 - DNA, 22 bp, Homo sapiens
gatcatcatggctctggagctg

SEQ ID NO: 9392833 - DNA, 22 bp, Homo sapiens
gatcatcaagcaagaacctgat

SEQ ID NO: 9392834 - DNA, 22 bp, Homo sapiens
gatcatctgggctccttgtagt

SEQ ID NO: 9392835 - DNA, 22 bp, Homo sapiens
gatcattagcttttcaaaggag

SEQ ID NO: 9392836 - DNA, 22 bp, Homo sapiens
gatcattgctgcctttttctat

SEQ ID NO: 9392837 - DNA, 22 bp, Homo sapiens
gatcattgaacaggcactggag

SEQ ID NO: 9392838 - DNA, 22 bp, Homo sapiens
gatcatttcagtccagtaaata

SEQ ID NO: 9392839 - DNA, 22 bp, Homo sapiens
gatcatttacttgttctggact

SEQ ID NO: 9392840 - DNA, 22 bp, Homo sapiens
gatcattggcctttctgcagtg

SEQ ID NO: 9392841 - DNA, 22 bp, Homo sapiens
gatattttcgcagggagaattc

SEQ ID NO: 9392842 - DNA, 22 bp, Homo sapiens
gatattttcattcggatgctca

SEQ ID NO: 9392843 - DNA, 22 bp, Homo sapiens
gatatttttaggtgatgcaggc

SEQ ID NO: 9392844 - DNA, 22 bp, Homo sapiens
gatattttgagaaatcctatga

SEQ ID NO: 9392845 - DNA, 18 bp, Homo sapiens
gatatataggaggaaagt

SEQ ID NO: 9392846 - DNA, 22 bp, Homo sapiens
gatatatgtaaaagtagacaga

SEQ ID NO: 9392847 - DNA, 18 bp, Homo sapiens
gatatataggaggaaagt

SEQ ID NO: 9392848 - DNA, 18 bp, Homo sapiens
gatatataggaggaaagt

SEQ ID NO: 9392849 - DNA, 18 bp, Homo sapiens
gatatataggaggaaagt

SEQ ID NO: 9392850 - DNA, 22 bp, Homo sapiens
gatatagtaatattcctgaact

SEQ ID NO: 9392851 - DNA, 22 bp, Homo sapiens
gatatactgtctgtattacata

SEQ ID NO: 9392852 - DNA, 22 bp, Homo sapiens
gagtgaggctggaatcatggct

SEQ ID NO: 9392853 - DNA, 22 bp, Homo sapiens
gagtgaggctggaatcatggct

SEQ ID NO: 9392854 - DNA, 22 bp, Homo sapiens
gagtgagggcagcaggggctgc

SEQ ID NO: 9392855 - DNA, 22 bp, Homo sapiens
gagtgagggcagcaggggctgc

SEQ ID NO: 9392856 - DNA, 22 bp, Homo sapiens
gagtgagggccaacatccagct

SEQ ID NO: 9392857 - DNA, 22 bp, Homo sapiens
gagtgagtgctgggctgaggct

SEQ ID NO: 9392858 - DNA, 22 bp, Homo sapiens
gagtgagtgctgggctgaggct

SEQ ID NO: 9392859 - DNA, 22 bp, Homo sapiens
gagtgagtggccaggaggcaga

SEQ ID NO: 9392860 - DNA, 18 bp, Homo sapiens
gagtgatgaccgtgccag

SEQ ID NO: 9392861 - DNA, 19 bp, Homo sapiens
gagtgatggatctccttgc

SEQ ID NO: 9392862 - DNA, 19 bp, Homo sapiens
gagtgattgcagggaccct

SEQ ID NO: 9392863 - DNA, 22 bp, Homo sapiens
gagtgattggagttagcattct

SEQ ID NO: 9392864 - DNA, 22 bp, Homo sapiens
gagtgattgctcctttaaactt

SEQ ID NO: 9392865 - DNA, 22 bp, Homo sapiens
gagtgatttaagctatttttaa

SEQ ID NO: 9392866 - DNA, 22 bp, Homo sapiens
gagtgatttccagagagacgtt

SEQ ID NO: 9392867 - DNA, 22 bp, Homo sapiens
gagtctggtcattttctctccc

SEQ ID NO: 9392868 - DNA, 22 bp, Homo sapiens
gagtctgagaactgggctcagt

SEQ ID NO: 9392869 - DNA, 22 bp, Homo sapiens
gagtctgatgtcccccaggcca

SEQ ID NO: 9392870 - DNA, 22 bp, Homo sapiens
gagtctgaggggagagctgggt

SEQ ID NO: 9392871 - DNA, 22 bp, Homo sapiens
gagtcttaggcaaaaataatgg

SEQ ID NO: 9392872 - DNA, 22 bp, Homo sapiens
gagtctgtggtattttatcata

SEQ ID NO: 9392873 - DNA, 22 bp, Homo sapiens
gagtgactctagaaagtttctt

SEQ ID NO: 9392874 - DNA, 22 bp, Homo sapiens
gagtctttggtaaagtctgctg

SEQ ID NO: 9392875 - DNA, 18 bp, Homo sapiens
gagtctttgttactgctg

SEQ ID NO: 9392876 - DNA, 22 bp, Homo sapiens
gagtctccaatccatgcctgtc

SEQ ID NO: 9392877 - DNA, 22 bp, Homo sapiens
gagtctctgctatgttttctct

SEQ ID NO: 9392878 - DNA, 22 bp, Homo sapiens
gagtctctggaggggtcagacc

SEQ ID NO: 9392879 - DNA, 22 bp, Homo sapiens
gagtctctagtctggtcctggc

SEQ ID NO: 9392880 - DNA, 22 bp, Homo sapiens
gagtctctcatgcagttacagt

SEQ ID NO: 9392881 - DNA, 22 bp, Homo sapiens
gagtctctagtctggtcctggc

SEQ ID NO: 9392882 - DNA, 22 bp, Homo sapiens
gagtctcctactggctgtcctt

SEQ ID NO: 9392883 - DNA, 22 bp, Homo sapiens
gagtcgagcagaaagccgtcgg

SEQ ID NO: 9392884 - DNA, 22 bp, Homo sapiens
gagtccttttcatagcagtggg

SEQ ID NO: 9392885 - DNA, 22 bp, Homo sapiens
gagtccttctggctggcaggat

SEQ ID NO: 9392886 - DNA, 22 bp, Homo sapiens
gagtccttccagcaggcattta

SEQ ID NO: 9392887 - DNA, 22 bp, Homo sapiens
gagtcctttgttccttgccaca

SEQ ID NO: 9392888 - DNA, 20 bp, Homo sapiens
gagtccttatgggctgaggt

SEQ ID NO: 9392889 - DNA, 22 bp, Homo sapiens
gagtccttaatacactggtgga

SEQ ID NO: 9392890 - DNA, 19 bp, Homo sapiens
gagtcctgtgctccttgtt

SEQ ID NO: 9392891 - DNA, 22 bp, Homo sapiens
gagtcctgggtcacggcctctt

SEQ ID NO: 9392892 - DNA, 21 bp, Homo sapiens
gagtcctggctagggtggcag

SEQ ID NO: 9392893 - DNA, 21 bp, Homo sapiens
gagtcctggctagggtggcag

SEQ ID NO: 9392894 - DNA, 22 bp, Homo sapiens
gagtcctggagagcccgagcgc

SEQ ID NO: 9392895 - DNA, 21 bp, Homo sapiens
gagtcctggctagggtggcag

SEQ ID NO: 9392896 - DNA, 22 bp, Homo sapiens
gagtcctggagaaacgcaggtg

SEQ ID NO: 9392897 - DNA, 22 bp, Homo sapiens
gagtcctggagaaacgcaggtg

SEQ ID NO: 9392898 - DNA, 22 bp, Homo sapiens
gagtcctggaaccctgaatgct

SEQ ID NO: 9392899 - DNA, 22 bp, Homo sapiens
gagtcctggaaccctgaatgct

SEQ ID NO: 9392900 - DNA, 22 bp, Homo sapiens
gagtcctgcccttgtgtagtcc

SEQ ID NO: 9392901 - DNA, 22 bp, Homo sapiens
gagtcctgcccttgtgtagtcc

SEQ ID NO: 9392902 - DNA, 22 bp, Homo sapiens
gagtcctggaaccctgaatgct

SEQ ID NO: 9392903 - DNA, 22 bp, Homo sapiens
gagtcctgatccttagctctcc

SEQ ID NO: 9392904 - DNA, 22 bp, Homo sapiens
gagtcctgaatcctgtggcaac

SEQ ID NO: 9392905 - DNA, 22 bp, Homo sapiens
gagtcctgaatcctgtggcaac

SEQ ID NO: 9392906 - DNA, 22 bp, Homo sapiens
gagtgggcaccgtgggcacact

SEQ ID NO: 9392907 - DNA, 22 bp, Homo sapiens
gagtggggctttaaaggctcag

SEQ ID NO: 9392908 - DNA, 21 bp, Homo sapiens
gagtgggacatgggagtggtt

SEQ ID NO: 9392909 - DNA, 22 bp, Homo sapiens
gagtggcttttttatggtaatg

SEQ ID NO: 9392910 - DNA, 22 bp, Homo sapiens
gagtggcatatgtgcctgtgaa

SEQ ID NO: 9392911 - DNA, 22 bp, Homo sapiens
gagtggcatatgtgcctgtgaa

SEQ ID NO: 9392912 - DNA, 22 bp, Homo sapiens
gagtggccagtggtggcatgtc

SEQ ID NO: 9392913 - DNA, 22 bp, Homo sapiens
gagtggccagtggtggcatgtc

SEQ ID NO: 9392914 - DNA, 22 bp, Homo sapiens
gagtggctaaagtatgtcatgg

SEQ ID NO: 9392915 - DNA, 22 bp, Homo sapiens
gagtggctccctgggtttggca

SEQ ID NO: 9392916 - DNA, 22 bp, Homo sapiens
gagtggctccttacaagttcca

SEQ ID NO: 9392917 - DNA, 22 bp, Homo sapiens
gagtggctccctgggtttggca

SEQ ID NO: 9392918 - DNA, 22 bp, Homo sapiens
gagtggctacaggcagcttaca

SEQ ID NO: 9392919 - DNA, 22 bp, Homo sapiens
gagtggctattgatccgtgatg

SEQ ID NO: 9392920 - DNA, 22 bp, Homo sapiens
gagtggctccaatttggtccta

SEQ ID NO: 9392921 - DNA, 22 bp, Homo sapiens
gagtggctattgatccgtgatg

SEQ ID NO: 9392922 - DNA, 22 bp, Homo sapiens
gagtggctgagtaagaggggag

SEQ ID NO: 9392923 - DNA, 22 bp, Homo sapiens
gagtggctgagtaagaggggag

SEQ ID NO: 9392924 - DNA, 22 bp, Homo sapiens
gagtggctgggtgtttgaatcc

SEQ ID NO: 9392925 - DNA, 15 bp, Homo sapiens
gagtggctggtgaaa

SEQ ID NO: 9392926 - DNA, 22 bp, Homo sapiens
gagtggctgtgtacatgcccag

SEQ ID NO: 9392927 - DNA, 22 bp, Homo sapiens
gagtggctttggagaagtaggg

SEQ ID NO: 9392928 - DNA, 22 bp, Homo sapiens
gagtggctttggagaagtaggg

SEQ ID NO: 9392929 - DNA, 15 bp, Homo sapiens
gagtggctttcagaa

SEQ ID NO: 9392930 - DNA, 22 bp, Homo sapiens
gagtggagcaaaagaggtagat

SEQ ID NO: 9392931 - DNA, 22 bp, Homo sapiens
gagtggagcaaaagaggtagat

SEQ ID NO: 9392932 - DNA, 22 bp, Homo sapiens
gagtggagcaaaagaggtagat

SEQ ID NO: 9392933 - DNA, 22 bp, Homo sapiens
gagtggagcaaaagaggtagat

SEQ ID NO: 9392934 - DNA, 22 bp, Homo sapiens
gagtggcatagaagcatataga

SEQ ID NO: 9392935 - DNA, 22 bp, Homo sapiens
gagtggcaggcactgtgacgga

SEQ ID NO: 9392936 - DNA, 22 bp, Homo sapiens
gagtggcaggcactgtgacgga

SEQ ID NO: 9392937 - DNA, 22 bp, Homo sapiens
gagtggagatcgtgccactgca

SEQ ID NO: 9392938 - DNA, 22 bp, Homo sapiens
gagtggagatcgtgccactgca

SEQ ID NO: 9392939 - DNA, 22 bp, Homo sapiens
gagtggagatcgtgccactgca

SEQ ID NO: 9392940 - DNA, 22 bp, Homo sapiens
gagtgctgtatctgagaaagca

SEQ ID NO: 9392941 - DNA, 22 bp, Homo sapiens
gagtggagatcgtgccactgca

SEQ ID NO: 9392942 - DNA, 21 bp, Homo sapiens
gagtggaacgctcttcacacc

SEQ ID NO: 9392943 - DNA, 21 bp, Homo sapiens
gagtggaacgctcttcacacc

SEQ ID NO: 9392944 - DNA, 22 bp, Homo sapiens
gagtgctgcttgggatagtgag

SEQ ID NO: 9392945 - DNA, 22 bp, Homo sapiens
gagtgctggaggtgtgagtggg

SEQ ID NO: 9392946 - DNA, 22 bp, Homo sapiens
gagtgctggaggtgtgagtggg

SEQ ID NO: 9392947 - DNA, 22 bp, Homo sapiens
gagtgctggaggtgtgagtggg

SEQ ID NO: 9392948 - DNA, 22 bp, Homo sapiens
gagtgctgaatgcgagaacaga

SEQ ID NO: 9392949 - DNA, 22 bp, Homo sapiens
gagtgctgaatgcgagaacaga

SEQ ID NO: 9392950 - DNA, 22 bp, Homo sapiens
gagtgctgctaatgcaagggtg

SEQ ID NO: 9392951 - DNA, 22 bp, Homo sapiens
gagtgctgctaatgcaagggtg

SEQ ID NO: 9392952 - DNA, 17 bp, Homo sapiens
gagtgctggtggagctc

SEQ ID NO: 9392953 - DNA, 22 bp, Homo sapiens
gagtgctgtatctgagaaagca

SEQ ID NO: 9392954 - DNA, 22 bp, Homo sapiens
gagtgctggggtgcagagaggt

SEQ ID NO: 9392955 - DNA, 22 bp, Homo sapiens
gagtgctggggtgcagagaggt

SEQ ID NO: 9392956 - DNA, 22 bp, Homo sapiens
gagtgcagttggggtgagggga

SEQ ID NO: 9392957 - DNA, 22 bp, Homo sapiens
gagtgctagcattagtatataa

SEQ ID NO: 9392958 - DNA, 22 bp, Homo sapiens
gagtgcagtatgagaggctgct

SEQ ID NO: 9392959 - DNA, 22 bp, Homo sapiens
gagtgcagtatgagaggctgct

SEQ ID NO: 9392960 - DNA, 22 bp, Homo sapiens
gagtgcagttggggtgagggga

SEQ ID NO: 9392961 - DNA, 22 bp, Homo sapiens
gagtgcagtatgagaggctgct

SEQ ID NO: 9392962 - DNA, 23 bp, Homo sapiens
gagtgcagaatagacatgcagtg

SEQ ID NO: 9392963 - DNA, 23 bp, Homo sapiens
gagtgcagaatagacatgcagtg

SEQ ID NO: 9392964 - DNA, 22 bp, Homo sapiens
gagtgcagtatgagaggctgct

SEQ ID NO: 9392965 - DNA, 22 bp, Homo sapiens
gagtttaaaaagcctggtttgt

SEQ ID NO: 9392966 - DNA, 22 bp, Homo sapiens
gagttggctgttcgaaggtagc

SEQ ID NO: 9392967 - DNA, 22 bp, Homo sapiens
gagttggctactctctgaggct

SEQ ID NO: 9392968 - DNA, 22 bp, Homo sapiens
gagtttaaagcatacatatttt

SEQ ID NO: 9392969 - DNA, 22 bp, Homo sapiens
gagtttaaaacgcttgtattta

SEQ ID NO: 9392970 - DNA, 22 bp, Homo sapiens
gagtttaaaacgcttgtattta

SEQ ID NO: 9392971 - DNA, 22 bp, Homo sapiens
gagttgactcctccagaggagt

SEQ ID NO: 9392972 - DNA, 22 bp, Homo sapiens
gagtttattcaggaaatagcca

SEQ ID NO: 9392973 - DNA, 22 bp, Homo sapiens
gagtttattcaggaaatagcca

SEQ ID NO: 9392974 - DNA, 22 bp, Homo sapiens
gagtttatgtctttcattgttc

SEQ ID NO: 9392975 - DNA, 19 bp, Homo sapiens
gagtttatctcctagccct

SEQ ID NO: 9392976 - DNA, 22 bp, Homo sapiens
gagtttaatcattgttctatcc

SEQ ID NO: 9392977 - DNA, 22 bp, Homo sapiens
gagtttaaagcatacatatttt

SEQ ID NO: 9392978 - DNA, 22 bp, Homo sapiens
gagtttaatcattgttctatcc

SEQ ID NO: 9392979 - DNA, 22 bp, Homo sapiens
gagtttaacacttggagaaaag

SEQ ID NO: 9392980 - DNA, 22 bp, Homo sapiens
gagtttctgattcagtctgtgt

SEQ ID NO: 9392981 - DNA, 22 bp, Homo sapiens
gagtttattgtcttccaggctt

SEQ ID NO: 9392982 - DNA, 22 bp, Homo sapiens
gagtttatttgactggattctc

SEQ ID NO: 9392983 - DNA, 22 bp, Homo sapiens
gataaaataactatggaatact

SEQ ID NO: 9392984 - DNA, 22 bp, Homo sapiens
gataaaagaggaaatttgttca

SEQ ID NO: 9392985 - DNA, 22 bp, Homo sapiens
gataaaagaggaaatttgttca

SEQ ID NO: 9392986 - DNA, 22 bp, Homo sapiens
gagtttttccaaggtcacatga

SEQ ID NO: 9392987 - DNA, 21 bp, Homo sapiens
gataaaatgggccttggtcct

SEQ ID NO: 9392988 - DNA, 22 bp, Homo sapiens
gataaaattcttattttacccg

SEQ ID NO: 9392989 - DNA, 22 bp, Homo sapiens
gataaaattcttattttacccg

SEQ ID NO: 9392990 - DNA, 21 bp, Homo sapiens
gataaaatgggccttggtcct

SEQ ID NO: 9392991 - DNA, 21 bp, Homo sapiens
gataaaatgggccttggtcct

SEQ ID NO: 9392992 - DNA, 22 bp, Homo sapiens
gataaaataactatggaatact

SEQ ID NO: 9392993 - DNA, 22 bp, Homo sapiens
gataaaataactatggaatact

SEQ ID NO: 9392994 - DNA, 22 bp, Homo sapiens
gataaaatatgtggcctttagt

SEQ ID NO: 9392995 - DNA, 22 bp, Homo sapiens
gataaaatatgtggcctttagt

SEQ ID NO: 9392996 - DNA, 22 bp, Homo sapiens
gataaacacaaggtgatttcat

SEQ ID NO: 9392997 - DNA, 22 bp, Homo sapiens
gataaattgcactttttcttac

SEQ ID NO: 9392998 - DNA, 20 bp, Homo sapiens
gataaattgtctcttaagtg

SEQ ID NO: 9392999 - DNA, 20 bp, Homo sapiens
gataaattgtctcttaagtg

SEQ ID NO: 9393000 - DNA, 21 bp, Homo sapiens
gataaagcagcttgcctaagg

SEQ ID NO: 9393001 - DNA, 22 bp, Homo sapiens
gataaagcaggtaggagaagat

SEQ ID NO: 9393002 - DNA, 20 bp, Homo sapiens
gataaagcattgagtaaatt

SEQ ID NO: 9393003 - DNA, 22 bp, Homo sapiens
gataaacttgtggagttttggt

SEQ ID NO: 9393004 - DNA, 22 bp, Homo sapiens
gagtgtgggggtgctgaggaca

SEQ ID NO: 9393005 - DNA, 22 bp, Homo sapiens
gagtgtgggggtgctgaggaca

SEQ ID NO: 9393006 - DNA, 22 bp, Homo sapiens
gagtgtggtatgctctgaggct

SEQ ID NO: 9393007 - DNA, 22 bp, Homo sapiens
gagtgtggtatgctctgaggct

SEQ ID NO: 9393008 - DNA, 18 bp, Homo sapiens
gagtgtggcactgggccc

SEQ ID NO: 9393009 - DNA, 18 bp, Homo sapiens
gagtgtggcactgggccc

SEQ ID NO: 9393010 - DNA, 22 bp, Homo sapiens
gagtgtgggcacgggggccttg

SEQ ID NO: 9393011 - DNA, 22 bp, Homo sapiens
gagtgtgggcacgggggccttg

SEQ ID NO: 9393012 - DNA, 22 bp, Homo sapiens
gagtgtgggcacgggggccttg

SEQ ID NO: 9393013 - DNA, 22 bp, Homo sapiens
gagtgtggatcccagaagcaga

SEQ ID NO: 9393014 - DNA, 22 bp, Homo sapiens
gagtgtggatcccagaagcaga

SEQ ID NO: 9393015 - DNA, 22 bp, Homo sapiens
gagtgtggatcccagaagcaga

SEQ ID NO: 9393016 - DNA, 22 bp, Homo sapiens
gagtgtctgtgacagctcatga

SEQ ID NO: 9393017 - DNA, 22 bp, Homo sapiens
gagtgtctgtggggcatggaca

SEQ ID NO: 9393018 - DNA, 22 bp, Homo sapiens
gagtgtctgtggggcatggaca

SEQ ID NO: 9393019 - DNA, 22 bp, Homo sapiens
gagttctgtagggtgaaatagt

SEQ ID NO: 9393020 - DNA, 22 bp, Homo sapiens
gagttaaagtacctttgtatgt

SEQ ID NO: 9393021 - DNA, 22 bp, Homo sapiens
gagtgtgtgcatgatctcttat

SEQ ID NO: 9393022 - DNA, 22 bp, Homo sapiens
gagtgtgtgacttcactttagc

SEQ ID NO: 9393023 - DNA, 22 bp, Homo sapiens
gagtgtggtgaacaggagcacc

SEQ ID NO: 9393024 - DNA, 22 bp, Homo sapiens
gagtgtggtgaacaggagcacc

SEQ ID NO: 9393025 - DNA, 22 bp, Homo sapiens
gagtgtgttctttatgctgtga

SEQ ID NO: 9393026 - DNA, 22 bp, Homo sapiens
gagtggggtctgggcatcagtc

SEQ ID NO: 9393027 - DNA, 22 bp, Homo sapiens
gagtggggggtccgtctcagtg

SEQ ID NO: 9393028 - DNA, 22 bp, Homo sapiens
gagtgggtaaaggtgcttggct

SEQ ID NO: 9393029 - DNA, 22 bp, Homo sapiens
gagtggggtctgggcatcagtc

SEQ ID NO: 9393030 - DNA, 22 bp, Homo sapiens
gagtgggtaccggagcaggtgc

SEQ ID NO: 9393031 - DNA, 22 bp, Homo sapiens
gagtgggtaaaggtgcttggct

SEQ ID NO: 9393032 - DNA, 22 bp, Homo sapiens
gagtgggtctcatatatctggc

SEQ ID NO: 9393033 - DNA, 22 bp, Homo sapiens
gagtgggtccacagaggtgaca

SEQ ID NO: 9393034 - DNA, 22 bp, Homo sapiens
gagtgggtccacagaggtgaca

SEQ ID NO: 9393035 - DNA, 22 bp, Homo sapiens
gagtgggtgacagaaggaggta

SEQ ID NO: 9393036 - DNA, 22 bp, Homo sapiens
gagtgggtgagagacttggcac

SEQ ID NO: 9393037 - DNA, 22 bp, Homo sapiens
gagtgggtgaatgtgctcataa

SEQ ID NO: 9393038 - DNA, 22 bp, Homo sapiens
gagtgggtgaatgtgctcataa

SEQ ID NO: 9393039 - DNA, 22 bp, Homo sapiens
gagtgggtgagagacttggcac

SEQ ID NO: 9393040 - DNA, 22 bp, Homo sapiens
gagtgtaaaaacttagtgagat

SEQ ID NO: 9393041 - DNA, 22 bp, Homo sapiens
gagtgtaatctgaaaacttgaa

SEQ ID NO: 9393042 - DNA, 22 bp, Homo sapiens
gagtgtagttcattccgtccta

SEQ ID NO: 9393043 - DNA, 22 bp, Homo sapiens
gagtgtcagtgcttggggctac

SEQ ID NO: 9393044 - DNA, 22 bp, Homo sapiens
gagtgtctaatcacgtttcaca

SEQ ID NO: 9393045 - DNA, 22 bp, Homo sapiens
gagtgtctatgtttagtctttc

SEQ ID NO: 9393046 - DNA, 22 bp, Homo sapiens
gagtgtctatgtttagtctttc

SEQ ID NO: 9393047 - DNA, 21 bp, Homo sapiens
gagtgtctaatccaggctgtc

SEQ ID NO: 9393048 - DNA, 22 bp, Homo sapiens
gagtgtctcacagtagcatttt

SEQ ID NO: 9393049 - DNA, 22 bp, Homo sapiens
gagtgtctgaattagagcacaa

SEQ ID NO: 9393050 - DNA, 22 bp, Homo sapiens
gagtgtctgtattttgggcaag

SEQ ID NO: 9393051 - DNA, 22 bp, Homo sapiens
gagctgggacatgggtcctctc

SEQ ID NO: 9393052 - DNA, 22 bp, Homo sapiens
gagctgggacatgggtcctctc

SEQ ID NO: 9393053 - DNA, 22 bp, Homo sapiens
gagctgggaagatagcttgagc

SEQ ID NO: 9393054 - DNA, 22 bp, Homo sapiens
gagctggctgtggttgagtgca

SEQ ID NO: 9393055 - DNA, 22 bp, Homo sapiens
gagctggcctcaggcacaggag

SEQ ID NO: 9393056 - DNA, 22 bp, Homo sapiens
gagctggcctcaggcacaggag

SEQ ID NO: 9393057 - DNA, 22 bp, Homo sapiens
gagctggcctcaggcacaggag

SEQ ID NO: 9393058 - DNA, 22 bp, Homo sapiens
gagctggctccgccatgctgct

SEQ ID NO: 9393059 - DNA, 22 bp, Homo sapiens
gagctggctcctccgaggatgg

SEQ ID NO: 9393060 - DNA, 22 bp, Homo sapiens
gagctggctccgccatgctgct

SEQ ID NO: 9393061 - DNA, 22 bp, Homo sapiens
gagctggctaatactgacttat

SEQ ID NO: 9393062 - DNA, 22 bp, Homo sapiens
gagctggctccgccatgctgct

SEQ ID NO: 9393063 - DNA, 22 bp, Homo sapiens
gagctggctccgccatgctgct

SEQ ID NO: 9393064 - DNA, 22 bp, Homo sapiens
gagctggccgcagagagggcag

SEQ ID NO: 9393065 - DNA, 22 bp, Homo sapiens
gagctggcaggaggctccccga

SEQ ID NO: 9393066 - DNA, 22 bp, Homo sapiens
gagctggcagtggtagacatgg

SEQ ID NO: 9393067 - DNA, 22 bp, Homo sapiens
gagctggcagtggtagacatgg

SEQ ID NO: 9393068 - DNA, 22 bp, Homo sapiens
gagctggcacagaaggatctta

SEQ ID NO: 9393069 - DNA, 22 bp, Homo sapiens
gagctggcaagtctgtccttgg

SEQ ID NO: 9393070 - DNA, 22 bp, Homo sapiens
gagctggcacagaaggatctta

SEQ ID NO: 9393071 - DNA, 22 bp, Homo sapiens
gagctggcaatgacttgtgtat

SEQ ID NO: 9393072 - DNA, 22 bp, Homo sapiens
gagctgcttctgtgtgccgggt

SEQ ID NO: 9393073 - DNA, 22 bp, Homo sapiens
gagctgcttgcccagaagcaga

SEQ ID NO: 9393074 - DNA, 22 bp, Homo sapiens
gagctggaagtctgtggtcaga

SEQ ID NO: 9393075 - DNA, 22 bp, Homo sapiens
gagctggaggaccaggactggg

SEQ ID NO: 9393076 - DNA, 22 bp, Homo sapiens
gagctggaggcagtgctgaggt

SEQ ID NO: 9393077 - DNA, 22 bp, Homo sapiens
gagagtgaggcctgggaatcta

SEQ ID NO: 9393078 - DNA, 22 bp, Homo sapiens
gagagtgaggcatcaggggcag

SEQ ID NO: 9393079 - DNA, 22 bp, Homo sapiens
gagagtgaggcatcaggggcag

SEQ ID NO: 9393080 - DNA, 22 bp, Homo sapiens
gagagtgagatcctcctgggga

SEQ ID NO: 9393081 - DNA, 22 bp, Homo sapiens
gagagtggatggagctgcgaag

SEQ ID NO: 9393082 - DNA, 22 bp, Homo sapiens
gagagtggatggagctgcgaag

SEQ ID NO: 9393083 - DNA, 22 bp, Homo sapiens
gagagtggatggagctgcgaag

SEQ ID NO: 9393084 - DNA, 22 bp, Homo sapiens
gagagtggaaagcaagctgagt

SEQ ID NO: 9393085 - DNA, 22 bp, Homo sapiens
gagagtggaaagcaagctgagt

SEQ ID NO: 9393086 - DNA, 22 bp, Homo sapiens
gagagtgatgaatggttaaaca

SEQ ID NO: 9393087 - DNA, 22 bp, Homo sapiens
gagagtgtctggaggaagctaa

SEQ ID NO: 9393088 - DNA, 22 bp, Homo sapiens
gagagtgtctggaggaagctaa

SEQ ID NO: 9393089 - DNA, 22 bp, Homo sapiens
gagatatgttggcagctggtat

SEQ ID NO: 9393090 - DNA, 19 bp, Homo sapiens
gagatatagaagtagatgt

SEQ ID NO: 9393091 - DNA, 19 bp, Homo sapiens
gagatatagaagtagatgt

SEQ ID NO: 9393092 - DNA, 22 bp, Homo sapiens
gagatatattaacattaatctt

SEQ ID NO: 9393093 - DNA, 22 bp, Homo sapiens
gagatatattaacattaatctt

SEQ ID NO: 9393094 - DNA, 19 bp, Homo sapiens
gagatactgaagtgaggaa

SEQ ID NO: 9393095 - DNA, 22 bp, Homo sapiens
gagatacagttggctgcaggct

SEQ ID NO: 9393096 - DNA, 22 bp, Homo sapiens
gaggaaggtcccatcagaattt

SEQ ID NO: 9393097 - DNA, 22 bp, Homo sapiens
gaggaagggctgcctgccgggc

SEQ ID NO: 9393098 - DNA, 22 bp, Homo sapiens
gaggaagggactttattatctg

SEQ ID NO: 9393099 - DNA, 22 bp, Homo sapiens
gaggaagatggttgagtggtcc

SEQ ID NO: 9393100 - DNA, 22 bp, Homo sapiens
gaggaagggctgcctgccgggc

SEQ ID NO: 9393101 - DNA, 22 bp, Homo sapiens
gaggaagggctgcctgccgggc

SEQ ID NO: 9393102 - DNA, 22 bp, Homo sapiens
gaggaagggactttattatctg

SEQ ID NO: 9393103 - DNA, 23 bp, Homo sapiens
gagctgggatacaggcttactgc

SEQ ID NO: 9393104 - DNA, 22 bp, Homo sapiens
gaggaagaattggttattggag

SEQ ID NO: 9393105 - DNA, 23 bp, Homo sapiens
gagctgggatacaggcttactgc

SEQ ID NO: 9393106 - DNA, 22 bp, Homo sapiens
gaggaagagagctctgccttgt

SEQ ID NO: 9393107 - DNA, 22 bp, Homo sapiens
gagctgggagttatagcatgtt

SEQ ID NO: 9393108 - DNA, 22 bp, Homo sapiens
gagctgggaggactgggaactt

SEQ ID NO: 9393109 - DNA, 22 bp, Homo sapiens
gagctgggaggactgggaactt

SEQ ID NO: 9393110 - DNA, 22 bp, Homo sapiens
gagctgggagctgggatttgga

SEQ ID NO: 9393111 - DNA, 18 bp, Homo sapiens
gagctgggagaaggaagg

SEQ ID NO: 9393112 - DNA, 18 bp, Homo sapiens
gagctgggagaaggaagg

SEQ ID NO: 9393113 - DNA, 18 bp, Homo sapiens
gagctgggagaaggaagg

SEQ ID NO: 9393114 - DNA, 22 bp, Homo sapiens
gagctgggagctgggatttgga

SEQ ID NO: 9393115 - DNA, 22 bp, Homo sapiens
gagctgggagctgggatttgga

SEQ ID NO: 9393116 - DNA, 22 bp, Homo sapiens
gagctgggacttggaatccaca

SEQ ID NO: 9393117 - DNA, 22 bp, Homo sapiens
gagctgggacttggaatccaca

SEQ ID NO: 9393118 - DNA, 22 bp, Homo sapiens
gaggacacatgactccagcagg

SEQ ID NO: 9393119 - DNA, 22 bp, Homo sapiens
gaggacagagccgcctggcaag

SEQ ID NO: 9393120 - DNA, 22 bp, Homo sapiens
gaggacagagccgcctggcaag

SEQ ID NO: 9393121 - DNA, 22 bp, Homo sapiens
gaggacagagccgcctggcaag

SEQ ID NO: 9393122 - DNA, 22 bp, Homo sapiens
gaggacagcttagggcttcctg

SEQ ID NO: 9393123 - DNA, 22 bp, Homo sapiens
gaggacagcttagggcttcctg

SEQ ID NO: 9393124 - DNA, 22 bp, Homo sapiens
gaggacagcttagggcttcctg

SEQ ID NO: 9393125 - DNA, 21 bp, Homo sapiens
gaggaatggtttgcaaagcac

SEQ ID NO: 9393126 - DNA, 22 bp, Homo sapiens
gaggaatgggtgtctcgtgatt

SEQ ID NO: 9393127 - DNA, 22 bp, Homo sapiens
gaggaatgggtgtctcgtgatt

SEQ ID NO: 9393128 - DNA, 22 bp, Homo sapiens
gaggaaggtcccatcagaattt

SEQ ID NO: 9393129 - DNA, 22 bp, Homo sapiens
gaggaaggtcccatcagaattt

SEQ ID NO: 9393130 - DNA, 22 bp, Homo sapiens
gaggaaggtcccatcagaattt

SEQ ID NO: 9393131 - DNA, 22 bp, Homo sapiens
gaggaagttctatgattacatc

SEQ ID NO: 9393132 - DNA, 22 bp, Homo sapiens
gaggaagttaggatacattggt

SEQ ID NO: 9393133 - DNA, 22 bp, Homo sapiens
gaggaatgttattaaaggagct

SEQ ID NO: 9393134 - DNA, 22 bp, Homo sapiens
gaggacaaagcccaggtgctgg

SEQ ID NO: 9393135 - DNA, 22 bp, Homo sapiens
gaggaatgtcagcacaggcctc

SEQ ID NO: 9393136 - DNA, 22 bp, Homo sapiens
gaggaatgttattaaaggagct

SEQ ID NO: 9393137 - DNA, 23 bp, Homo sapiens
gaggacacagcccagacagccgt

SEQ ID NO: 9393138 - DNA, 22 bp, Homo sapiens
gaggacacaaagtggctgagat

SEQ ID NO: 9393139 - DNA, 22 bp, Homo sapiens
gaggacaaagcccaggtgctgg

SEQ ID NO: 9393140 - DNA, 22 bp, Homo sapiens
gaggacaagctgtgagtggggt

SEQ ID NO: 9393141 - DNA, 22 bp, Homo sapiens
gaggagggttggccttaggtag

SEQ ID NO: 9393142 - DNA, 22 bp, Homo sapiens
gaggagggttggccttaggtag

SEQ ID NO: 9393143 - DNA, 22 bp, Homo sapiens
gaggaggtcgctgctgagcccc

SEQ ID NO: 9393144 - DNA, 22 bp, Homo sapiens
gaggaggtcgctgctgagcccc

SEQ ID NO: 9393145 - DNA, 22 bp, Homo sapiens
gaggaggtcccccgacatgcct

SEQ ID NO: 9393146 - DNA, 22 bp, Homo sapiens
gaggaggtcccccgacatgcct

SEQ ID NO: 9393147 - DNA, 22 bp, Homo sapiens
gaggaggtcccccgacatgcct

SEQ ID NO: 9393148 - DNA, 22 bp, Homo sapiens
gaggaggtctcctccgcagggg

SEQ ID NO: 9393149 - DNA, 22 bp, Homo sapiens
gaggaggtggaattccaggaat

SEQ ID NO: 9393150 - DNA, 22 bp, Homo sapiens
gaggaggtggagtcatgcagag

SEQ ID NO: 9393151 - DNA, 22 bp, Homo sapiens
gaggaggtggagtcatgcagag

SEQ ID NO: 9393152 - DNA, 22 bp, Homo sapiens
gaggaggtggaattccaggaat

SEQ ID NO: 9393153 - DNA, 22 bp, Homo sapiens
gaggcagaggttgcagtgagct

SEQ ID NO: 9393154 - DNA, 22 bp, Homo sapiens
gaggcagaggttgcagtgagct

SEQ ID NO: 9393155 - DNA, 22 bp, Homo sapiens
gaggcagaggttgcagtgagct

SEQ ID NO: 9393156 - DNA, 22 bp, Homo sapiens
gaggcagagtgcaccccaggag

SEQ ID NO: 9393157 - DNA, 22 bp, Homo sapiens
gaggcagagtgcaccccaggag

SEQ ID NO: 9393158 - DNA, 22 bp, Homo sapiens
gaggcagagtgcaccccaggag

SEQ ID NO: 9393159 - DNA, 22 bp, Homo sapiens
gaggcagagtcacaaagagtct

SEQ ID NO: 9393160 - DNA, 22 bp, Homo sapiens
gaggcagagtcacaaagagtct

SEQ ID NO: 9393161 - DNA, 22 bp, Homo sapiens
gaggcagcagaacatggaagag

SEQ ID NO: 9393162 - DNA, 22 bp, Homo sapiens
gaggcagcagaacatggaagag

SEQ ID NO: 9393163 - DNA, 22 bp, Homo sapiens
gaggcagaggttgttgcagtga

SEQ ID NO: 9393164 - DNA, 22 bp, Homo sapiens
gaggcagaggttgcagtgagct

SEQ ID NO: 9393165 - DNA, 22 bp, Homo sapiens
gaggcagaggttgcagtgagct

SEQ ID NO: 9393166 - DNA, 22 bp, Homo sapiens
gaggcagaggttgttgcagtga

SEQ ID NO: 9393167 - DNA, 22 bp, Homo sapiens
gaggcagaggttgttgcagtga

SEQ ID NO: 9393168 - DNA, 22 bp, Homo sapiens
gaggcagagtcacaaagagtct

SEQ ID NO: 9393169 - DNA, 22 bp, Homo sapiens
gaggcagagtcacaaagagtct

SEQ ID NO: 9393170 - DNA, 22 bp, Homo sapiens
gaggagggagctggaagctctt

SEQ ID NO: 9393171 - DNA, 22 bp, Homo sapiens
gaggagggagctggaagctctt

SEQ ID NO: 9393172 - DNA, 22 bp, Homo sapiens
gaggagggagaattaggcttaa

SEQ ID NO: 9393173 - DNA, 23 bp, Homo sapiens
gaggagggtctgacaagtgtagc

SEQ ID NO: 9393174 - DNA, 22 bp, Homo sapiens
gaggagggttggccttaggtag

SEQ ID NO: 9393175 - DNA, 23 bp, Homo sapiens
gaggagggtctgacaagtgtagc

SEQ ID NO: 9393176 - DNA, 23 bp, Homo sapiens
gaggagggtctgacaagtgtagc

SEQ ID NO: 9393177 - DNA, 22 bp, Homo sapiens
gaggaggctgtttctctgcatt

SEQ ID NO: 9393178 - DNA, 22 bp, Homo sapiens
gaggaggctgtttctctgcatt

SEQ ID NO: 9393179 - DNA, 22 bp, Homo sapiens
gaggaggctgtttctctgcatt

SEQ ID NO: 9393180 - DNA, 22 bp, Homo sapiens
gaggaggcttccgggaggcacg

SEQ ID NO: 9393181 - DNA, 22 bp, Homo sapiens
gaggaggcttccgggaggcacg

SEQ ID NO: 9393182 - DNA, 22 bp, Homo sapiens
gaggaggcttccgggaggcacg

SEQ ID NO: 9393183 - DNA, 22 bp, Homo sapiens
gaggaggcttccgggaggcacg

SEQ ID NO: 9393184 - DNA, 22 bp, Homo sapiens
gaggcctataggcaagtgctgc

SEQ ID NO: 9393185 - DNA, 21 bp, Homo sapiens
gaggcctcagcctcagctcct

SEQ ID NO: 9393186 - DNA, 22 bp, Homo sapiens
gaggccctgaagacagctgggg

SEQ ID NO: 9393187 - DNA, 22 bp, Homo sapiens
gaggccctgaagacagctgggg

SEQ ID NO: 9393188 - DNA, 22 bp, Homo sapiens
gaggccctgaagacagctgggg

SEQ ID NO: 9393189 - DNA, 22 bp, Homo sapiens
gaggccctcttgccacaatgaa

SEQ ID NO: 9393190 - DNA, 22 bp, Homo sapiens
gaggccctccagctgtcagctg

SEQ ID NO: 9393191 - DNA, 21 bp, Homo sapiens
gaggcccatgggacaggggct

SEQ ID NO: 9393192 - DNA, 22 bp, Homo sapiens
gaggccctcttgccacaatgaa

SEQ ID NO: 9393193 - DNA, 22 bp, Homo sapiens
gaggcccagtggagggccatgg

SEQ ID NO: 9393194 - DNA, 22 bp, Homo sapiens
gaggcccagtcctgcaagcacg

SEQ ID NO: 9393195 - DNA, 22 bp, Homo sapiens
gaggcccagtcctgcaagcacg

SEQ ID NO: 9393196 - DNA, 19 bp, Homo sapiens
gaggcccatgagggtgctc

SEQ ID NO: 9393197 - DNA, 22 bp, Homo sapiens
gaggcctcctctgagacatctg

SEQ ID NO: 9393198 - DNA, 21 bp, Homo sapiens
gaggcctcagcctcagctcct

SEQ ID NO: 9393199 - DNA, 22 bp, Homo sapiens
gaggcctcagcctgccctgaac

SEQ ID NO: 9393200 - DNA, 22 bp, Homo sapiens
gaggcctctgtcccaccaggga

SEQ ID NO: 9393201 - DNA, 22 bp, Homo sapiens
gaggcctctgtcccaccaggga

SEQ ID NO: 9393202 - DNA, 22 bp, Homo sapiens
gaggcctgaggctgcctggagc

SEQ ID NO: 9393203 - DNA, 18 bp, Homo sapiens
gaggcctgagaaccaggt

SEQ ID NO: 9393204 - DNA, 22 bp, Homo sapiens
gaggcctgaaaggggacctatg

SEQ ID NO: 9393205 - DNA, 18 bp, Homo sapiens
gaggcctgagaaccaggt

SEQ ID NO: 9393206 - DNA, 22 bp, Homo sapiens
gaggcctcttctttgttaacct

SEQ ID NO: 9393207 - DNA, 22 bp, Homo sapiens
gaggcctctgtcccgccaggga

SEQ ID NO: 9393208 - DNA, 17 bp, Homo sapiens
gaggcctcttggcatct

SEQ ID NO: 9393209 - DNA, 22 bp, Homo sapiens
gaggcagctgggatacaaggga

SEQ ID NO: 9393210 - DNA, 22 bp, Homo sapiens
gaggcagctgggctggtggttt

SEQ ID NO: 9393211 - DNA, 22 bp, Homo sapiens
gaggcagctgaaggagtgacag

SEQ ID NO: 9393212 - DNA, 22 bp, Homo sapiens
gaggcagctgggatacaaggga

SEQ ID NO: 9393213 - DNA, 22 bp, Homo sapiens
gaggcagctgggtccggtcggg

SEQ ID NO: 9393214 - DNA, 22 bp, Homo sapiens
gaggcccagcagcgcaggtctt

SEQ ID NO: 9393215 - DNA, 22 bp, Homo sapiens
gaggcccagcattcagggcagg

SEQ ID NO: 9393216 - DNA, 22 bp, Homo sapiens
gaggcccagggtacaggccgct

SEQ ID NO: 9393217 - DNA, 22 bp, Homo sapiens
gaggcccagcattcagggcagg

SEQ ID NO: 9393218 - DNA, 22 bp, Homo sapiens
gaggcccagcattcagggcagg

SEQ ID NO: 9393219 - DNA, 22 bp, Homo sapiens
gaggcccaggtcaagcagccac

SEQ ID NO: 9393220 - DNA, 22 bp, Homo sapiens
gaggcccagtcctgcaagcacg

SEQ ID NO: 9393221 - DNA, 22 bp, Homo sapiens
gaggcccagggtacaggccgct

SEQ ID NO: 9393222 - DNA, 22 bp, Homo sapiens
gaggcccaggtcaagcagccac

SEQ ID NO: 9393223 - DNA, 22 bp, Homo sapiens
gaggcccaggtcaagcagccac

SEQ ID NO: 9393224 - DNA, 22 bp, Homo sapiens
gaggcagctgaaggagtgacag

SEQ ID NO: 9393225 - DNA, 23 bp, Homo sapiens
gaggcagctcctgcagtgccctg

SEQ ID NO: 9393226 - DNA, 18 bp, Homo sapiens
gaggcagctagcaatttt

SEQ ID NO: 9393227 - DNA, 23 bp, Homo sapiens
gaggcagctcctgcagtgccctg

SEQ ID NO: 9393228 - DNA, 23 bp, Homo sapiens
gaggcagctcctgcagtgccctg

SEQ ID NO: 9393229 - DNA, 23 bp, Homo sapiens
gaggcagctcctgcagtgccctg

SEQ ID NO: 9393230 - DNA, 22 bp, Homo sapiens
gaggcagcgggtcaggaccgtg

SEQ ID NO: 9393231 - DNA, 22 bp, Homo sapiens
gaggcagcaggctgaggaggat

SEQ ID NO: 9393232 - DNA, 22 bp, Homo sapiens
gaggcagcagaacatggaagag

SEQ ID NO: 9393233 - DNA, 22 bp, Homo sapiens
gaggcagcaggctgaggaggat

SEQ ID NO: 9393234 - DNA, 22 bp, Homo sapiens
gagggccaaagagcaagagcct

SEQ ID NO: 9393235 - DNA, 22 bp, Homo sapiens
gagggccaaagagcaagagcct

SEQ ID NO: 9393236 - DNA, 22 bp, Homo sapiens
gagggccaaagagcaagagcct

SEQ ID NO: 9393237 - DNA, 22 bp, Homo sapiens
gagggcagtgaattttgaagct

SEQ ID NO: 9393238 - DNA, 22 bp, Homo sapiens
gagggcatagttaaataggagg

SEQ ID NO: 9393239 - DNA, 22 bp, Homo sapiens
gagggcatctagagcctaatcc

SEQ ID NO: 9393240 - DNA, 22 bp, Homo sapiens
gaggggaaagtgtgaggctgcg

SEQ ID NO: 9393241 - DNA, 22 bp, Homo sapiens
gagggcagtgaattttgaagct

SEQ ID NO: 9393242 - DNA, 22 bp, Homo sapiens
gagggcagtagcctcgtaccct

SEQ ID NO: 9393243 - DNA, 22 bp, Homo sapiens
gagggcagtagcctcgtaccct

SEQ ID NO: 9393244 - DNA, 22 bp, Homo sapiens
gagggcaggggtcttgcacggt

SEQ ID NO: 9393245 - DNA, 22 bp, Homo sapiens
gagggcaggggtcttgcacggt

SEQ ID NO: 9393246 - DNA, 22 bp, Homo sapiens
gagggcaggggtcttgcacggt

SEQ ID NO: 9393247 - DNA, 22 bp, Homo sapiens
gagggcaggggtcttgcacggt

SEQ ID NO: 9393248 - DNA, 22 bp, Homo sapiens
gagggcagtagcctcgtaccct

SEQ ID NO: 9393249 - DNA, 22 bp, Homo sapiens
gagggcagtagcctcgtaccct

SEQ ID NO: 9393250 - DNA, 22 bp, Homo sapiens
gagggcagtagcctcgtaccct

SEQ ID NO: 9393251 - DNA, 22 bp, Homo sapiens
gagggcaggggtcttgcacggt

SEQ ID NO: 9393252 - DNA, 20 bp, Homo sapiens
gagggcaggcacccatttca

SEQ ID NO: 9393253 - DNA, 22 bp, Homo sapiens
gagggcaggggtcttgcacggt

SEQ ID NO: 9393254 - DNA, 20 bp, Homo sapiens
gagggcaggcacccatttca

SEQ ID NO: 9393255 - DNA, 20 bp, Homo sapiens
gagggcaggcacccatttca

SEQ ID NO: 9393256 - DNA, 22 bp, Homo sapiens
gagggcagagtctaatgatgca

SEQ ID NO: 9393257 - DNA, 22 bp, Homo sapiens
gaggggatgcagagaggcttat

SEQ ID NO: 9393258 - DNA, 22 bp, Homo sapiens
gaggggagtgtcctccgggccc

SEQ ID NO: 9393259 - DNA, 22 bp, Homo sapiens
gaggggagtgtcctccgggccc

SEQ ID NO: 9393260 - DNA, 22 bp, Homo sapiens
gaggggagtaaagtcatgttac

SEQ ID NO: 9393261 - DNA, 22 bp, Homo sapiens
gaggggcacagtaaagggtccc

SEQ ID NO: 9393262 - DNA, 22 bp, Homo sapiens
gaggggccggcatgtgcctctc

SEQ ID NO: 9393263 - DNA, 21 bp, Homo sapiens
gaggggcagctcttagcatta

SEQ ID NO: 9393264 - DNA, 22 bp, Homo sapiens
gaggctggcagaaaagcacagg

SEQ ID NO: 9393265 - DNA, 16 bp, Homo sapiens
gaggctggcagatgtc

SEQ ID NO: 9393266 - DNA, 22 bp, Homo sapiens
gaggctggcagaaaagcacagg

SEQ ID NO: 9393267 - DNA, 22 bp, Homo sapiens
gaggctggaggtcaaagatgaa

SEQ ID NO: 9393268 - DNA, 22 bp, Homo sapiens
gaggctggaggtcaaagatgaa

SEQ ID NO: 9393269 - DNA, 22 bp, Homo sapiens
gaggctggaggtcaaagatgaa

SEQ ID NO: 9393270 - DNA, 22 bp, Homo sapiens
gaggctggaggtcaaagatgaa

SEQ ID NO: 9393271 - DNA, 22 bp, Homo sapiens
gaggctggaggtcaaagatgaa

SEQ ID NO: 9393272 - DNA, 22 bp, Homo sapiens
gaggctggacgtgcatttctac

SEQ ID NO: 9393273 - DNA, 22 bp, Homo sapiens
gaggctggagatattccaatct

SEQ ID NO: 9393274 - DNA, 22 bp, Homo sapiens
gaggctggaggtcaaagatgaa

SEQ ID NO: 9393275 - DNA, 22 bp, Homo sapiens
gaggctgcccacacctgcgccg

SEQ ID NO: 9393276 - DNA, 22 bp, Homo sapiens
gaggctggaatattagaaatgt

SEQ ID NO: 9393277 - DNA, 22 bp, Homo sapiens
gaggctggacgtgcatttctac

SEQ ID NO: 9393278 - DNA, 22 bp, Homo sapiens
gaggcctgctttggcactctgg

SEQ ID NO: 9393279 - DNA, 22 bp, Homo sapiens
gaggcctgctttggcactctgg

SEQ ID NO: 9393280 - DNA, 22 bp, Homo sapiens
gaggcctgcagcgtggtccctg

SEQ ID NO: 9393281 - DNA, 22 bp, Homo sapiens
gaggcctgcagcgtggtccctg

SEQ ID NO: 9393282 - DNA, 22 bp, Homo sapiens
gaggcctgaggctgcctggagc

SEQ ID NO: 9393283 - DNA, 22 bp, Homo sapiens
gaggcctgaggctgcctggagc

SEQ ID NO: 9393284 - DNA, 22 bp, Homo sapiens
gaggctgggggctgccttcctc

SEQ ID NO: 9393285 - DNA, 22 bp, Homo sapiens
gaggctgggggctgccttcctc

SEQ ID NO: 9393286 - DNA, 22 bp, Homo sapiens
gaggctgggggctgccttcctc

SEQ ID NO: 9393287 - DNA, 22 bp, Homo sapiens
gaggctgggaagtccaagatca

SEQ ID NO: 9393288 - DNA, 22 bp, Homo sapiens
gaggctgggaagtccaagatca

SEQ ID NO: 9393289 - DNA, 22 bp, Homo sapiens
gaggctgggaagtccaatatca

SEQ ID NO: 9393290 - DNA, 22 bp, Homo sapiens
gaggctgggaagtccaagacca

SEQ ID NO: 9393291 - DNA, 22 bp, Homo sapiens
gaggctgggaagtccaagatca

SEQ ID NO: 9393292 - DNA, 16 bp, Homo sapiens
gaggctggcagatgtc

SEQ ID NO: 9393293 - DNA, 22 bp, Homo sapiens
gaggctgggaagtccaagacca

SEQ ID NO: 9393294 - DNA, 16 bp, Homo sapiens
gagggcagaggcggaa

SEQ ID NO: 9393295 - DNA, 16 bp, Homo sapiens
gagggcagaggcggaa

SEQ ID NO: 9393296 - DNA, 16 bp, Homo sapiens
gagggcagaggcggaa

SEQ ID NO: 9393297 - DNA, 22 bp, Homo sapiens
gagggcagagtctaatgatgca

SEQ ID NO: 9393298 - DNA, 22 bp, Homo sapiens
gagggcagagtctaatgatgca

SEQ ID NO: 9393299 - DNA, 22 bp, Homo sapiens
gagggcagagacagtgattcac

SEQ ID NO: 9393300 - DNA, 22 bp, Homo sapiens
gagggatgcagaaacagaggcc

SEQ ID NO: 9393301 - DNA, 22 bp, Homo sapiens
gagggatgcagaaacagaggcc

SEQ ID NO: 9393302 - DNA, 22 bp, Homo sapiens
gagggatggtagttgacactga

SEQ ID NO: 9393303 - DNA, 22 bp, Homo sapiens
gaggctggggtctgcctttctg

SEQ ID NO: 9393304 - DNA, 22 bp, Homo sapiens
gagggatctttaggcagcctca

SEQ ID NO: 9393305 - DNA, 22 bp, Homo sapiens
gagggatctttaggcagcctca

SEQ ID NO: 9393306 - DNA, 22 bp, Homo sapiens
gagggatgcagaaacagaggcc

SEQ ID NO: 9393307 - DNA, 22 bp, Homo sapiens
gagggatgcagaaacagaggcc

SEQ ID NO: 9393308 - DNA, 22 bp, Homo sapiens
gaggtccagggtggggcctgag

SEQ ID NO: 9393309 - DNA, 22 bp, Homo sapiens
gaggtccagccaagcggcaagg

SEQ ID NO: 9393310 - DNA, 22 bp, Homo sapiens
gaggtccagagcaggttcagtg

SEQ ID NO: 9393311 - DNA, 22 bp, Homo sapiens
gaggtccatacagctattctac

SEQ ID NO: 9393312 - DNA, 22 bp, Homo sapiens
gaggtccagggtggggcctgag

SEQ ID NO: 9393313 - DNA, 22 bp, Homo sapiens
gaggtccattttcacatatgat

SEQ ID NO: 9393314 - DNA, 22 bp, Homo sapiens
gaggtcccccatggctgtgact

SEQ ID NO: 9393315 - DNA, 22 bp, Homo sapiens
gaggtggggttttgttcttgaa

SEQ ID NO: 9393316 - DNA, 22 bp, Homo sapiens
gaggtgggatgtgtgtgctact

SEQ ID NO: 9393317 - DNA, 22 bp, Homo sapiens
gaggtgggatgtgtgtgctact

SEQ ID NO: 9393318 - DNA, 22 bp, Homo sapiens
gaggtgggatgtgtgtgctact

SEQ ID NO: 9393319 - DNA, 22 bp, Homo sapiens
gaggtcaggcttgcagcagggt

SEQ ID NO: 9393320 - DNA, 22 bp, Homo sapiens
gaggtcaggcttgcagcagggt

SEQ ID NO: 9393321 - DNA, 22 bp, Homo sapiens
gaggtcaggcttgcagcagggt

SEQ ID NO: 9393322 - DNA, 22 bp, Homo sapiens
gaggtcaggctcaagctgggcc

SEQ ID NO: 9393323 - DNA, 22 bp, Homo sapiens
gaggtcaggctcaagctgggcc

SEQ ID NO: 9393324 - DNA, 22 bp, Homo sapiens
gaggtccactgaggcaacaggg

SEQ ID NO: 9393325 - DNA, 22 bp, Homo sapiens
gaggtccactgaggcaacaggg

SEQ ID NO: 9393326 - DNA, 22 bp, Homo sapiens
gaggtcaggtgaggaattaaga

SEQ ID NO: 9393327 - DNA, 22 bp, Homo sapiens
gaggtcaggggagaggctgatg

SEQ ID NO: 9393328 - DNA, 22 bp, Homo sapiens
gaggtcagtcagaccagggttt

SEQ ID NO: 9393329 - DNA, 22 bp, Homo sapiens
gaggtcagtcagaccagggttt

SEQ ID NO: 9393330 - DNA, 22 bp, Homo sapiens
gaggggcctggcactgagctgg

SEQ ID NO: 9393331 - DNA, 22 bp, Homo sapiens
gaggggcctggcactgagctgg

SEQ ID NO: 9393332 - DNA, 22 bp, Homo sapiens
gaggggccggcatgtgcctctc

SEQ ID NO: 9393333 - DNA, 22 bp, Homo sapiens
gaggggcctggcgaggacatgt

SEQ ID NO: 9393334 - DNA, 22 bp, Homo sapiens
gaggggcctggcgaggacatgt

SEQ ID NO: 9393335 - DNA, 22 bp, Homo sapiens
gaggggcctggcgaggacatgt

SEQ ID NO: 9393336 - DNA, 22 bp, Homo sapiens
gaggggctcttgggcatgaagg

SEQ ID NO: 9393337 - DNA, 22 bp, Homo sapiens
gagggtgtctggatgctagact

SEQ ID NO: 9393338 - DNA, 22 bp, Homo sapiens
gagggtgtgaacactggctgtg

SEQ ID NO: 9393339 - DNA, 22 bp, Homo sapiens
gaggggctcttgggcatgaagg

SEQ ID NO: 9393340 - DNA, 22 bp, Homo sapiens
gaggggcgtcctgagtgggcct

SEQ ID NO: 9393341 - DNA, 19 bp, Homo sapiens
gaggtcagcaagaagtatt

SEQ ID NO: 9393342 - DNA, 19 bp, Homo sapiens
gaggtcagcaagaagtatt

SEQ ID NO: 9393343 - DNA, 22 bp, Homo sapiens
gaggtcaaggtcaagagacaga

SEQ ID NO: 9393344 - DNA, 22 bp, Homo sapiens
gaggtaggtgtaggaggcctgc

SEQ ID NO: 9393345 - DNA, 22 bp, Homo sapiens
gagggttgtaagattgtagagc

SEQ ID NO: 9393346 - DNA, 22 bp, Homo sapiens
gaggtaggtgtaggaggcctgc

SEQ ID NO: 9393347 - DNA, 22 bp, Homo sapiens
gaggtaggtgtaggaggcctgc

SEQ ID NO: 9393348 - DNA, 22 bp, Homo sapiens
gaggtatagttctattagatga

SEQ ID NO: 9393349 - DNA, 22 bp, Homo sapiens
gagtcatgcactgtctttctcc

SEQ ID NO: 9393350 - DNA, 22 bp, Homo sapiens
gagtcagtaatggatatgtcat

SEQ ID NO: 9393351 - DNA, 22 bp, Homo sapiens
gagtcatttgggggcttcttga

SEQ ID NO: 9393352 - DNA, 22 bp, Homo sapiens
gagtccagacaccatacctgat

SEQ ID NO: 9393353 - DNA, 22 bp, Homo sapiens
gagtccagttctttccagcagt

SEQ ID NO: 9393354 - DNA, 22 bp, Homo sapiens
gagtccagttgttcacagaggc

SEQ ID NO: 9393355 - DNA, 22 bp, Homo sapiens
gagtccagttgttcacagaggc

SEQ ID NO: 9393356 - DNA, 22 bp, Homo sapiens
gagtcctcaacggggagaggcg

SEQ ID NO: 9393357 - DNA, 22 bp, Homo sapiens
gagtcctgaatcctgtggcaac

SEQ ID NO: 9393358 - DNA, 22 bp, Homo sapiens
gagtcagattgcagacagggct

SEQ ID NO: 9393359 - DNA, 22 bp, Homo sapiens
gagtcagaccgactgggctcat

SEQ ID NO: 9393360 - DNA, 22 bp, Homo sapiens
gagtcagaatgtcctcctgcgg

SEQ ID NO: 9393361 - DNA, 22 bp, Homo sapiens
gagtcagaccgactgggctcat

SEQ ID NO: 9393362 - DNA, 22 bp, Homo sapiens
gagtcaggagtcctgtgtgaga

SEQ ID NO: 9393363 - DNA, 22 bp, Homo sapiens
gagtcaggctagggtgacaggc

SEQ ID NO: 9393364 - DNA, 22 bp, Homo sapiens
gaggtgggtgtatcacaggtca

SEQ ID NO: 9393365 - DNA, 19 bp, Homo sapiens
gaggtgggtccccgcagcc

SEQ ID NO: 9393366 - DNA, 22 bp, Homo sapiens
gaggtggtcgaggaggggtacc

SEQ ID NO: 9393367 - DNA, 22 bp, Homo sapiens
gaggtggtcgaggaggggtacc

SEQ ID NO: 9393368 - DNA, 22 bp, Homo sapiens
gaggtggtggtggaggcatagc

SEQ ID NO: 9393369 - DNA, 22 bp, Homo sapiens
gaggtggtggtggaggcatagc

SEQ ID NO: 9393370 - DNA, 22 bp, Homo sapiens
gaggtggttcaggtagagccca

SEQ ID NO: 9393371 - DNA, 22 bp, Homo sapiens
gaggtgtcagggtagtcatgat

SEQ ID NO: 9393372 - DNA, 22 bp, Homo sapiens
gaggtgtcagggtagtcatgat

SEQ ID NO: 9393373 - DNA, 22 bp, Homo sapiens
gaggtgtcactattttgcttat

SEQ ID NO: 9393374 - DNA, 22 bp, Homo sapiens
gaggtgtcactattttgcttat

SEQ ID NO: 9393375 - DNA, 22 bp, Homo sapiens
gaggtgtcagggtagtcatgat

SEQ ID NO: 9393376 - DNA, 22 bp, Homo sapiens
gaggtggtttgtggtgactcat

SEQ ID NO: 9393377 - DNA, 22 bp, Homo sapiens
gaggtggtttgtggtgactcat

SEQ ID NO: 9393378 - DNA, 22 bp, Homo sapiens
gaggtggttcaggtagagccca

SEQ ID NO: 9393379 - DNA, 22 bp, Homo sapiens
gaggtggttcaggtagagccca

SEQ ID NO: 9393380 - DNA, 22 bp, Homo sapiens
gagtcagaaagtagtgtgccta

SEQ ID NO: 9393381 - DNA, 22 bp, Homo sapiens
gaggtgtctggcctttgtagga

SEQ ID NO: 9393382 - DNA, 22 bp, Homo sapiens
gagtcacaaaagatgcccaggg

SEQ ID NO: 9393383 - DNA, 22 bp, Homo sapiens
gaggtgtctgctgtgttcaaag

SEQ ID NO: 9393384 - DNA, 22 bp, Homo sapiens
gaggtgtcgtagattattctca

SEQ ID NO: 9393385 - DNA, 22 bp, Homo sapiens
gaggtgtcctcagccaactctg

SEQ ID NO: 9393386 - DNA, 22 bp, Homo sapiens
gaggtgtcctagaagtattcag

SEQ ID NO: 9393387 - DNA, 22 bp, Homo sapiens
gaggtgtcctcagccaactctg

SEQ ID NO: 9393388 - DNA, 22 bp, Homo sapiens
gaggtgtcctcagccaactctg

SEQ ID NO: 9393389 - DNA, 22 bp, Homo sapiens
gaggtgtccctgaccctttgca

SEQ ID NO: 9393390 - DNA, 22 bp, Homo sapiens
gaggtgtcccgcagtccccaag

SEQ ID NO: 9393391 - DNA, 22 bp, Homo sapiens
gaggtgtctgctgtgttcaaag

SEQ ID NO: 9393392 - DNA, 22 bp, Homo sapiens
gaggtgtctagatctaccagta

SEQ ID NO: 9393393 - DNA, 22 bp, Homo sapiens
gaggtgtctgagtggggacctg

SEQ ID NO: 9393394 - DNA, 22 bp, Homo sapiens
gaggtgtcgtagattattctca

SEQ ID NO: 9393395 - DNA, 22 bp, Homo sapiens
gaggtgtctagatctaccagta

SEQ ID NO: 9393396 - DNA, 22 bp, Homo sapiens
gaggtgtctgagtggggacctg

SEQ ID NO: 9393397 - DNA, 22 bp, Homo sapiens
gaggtgtcatcaggcagctctg

SEQ ID NO: 9393398 - DNA, 22 bp, Homo sapiens
gaggtgtcatgagggcctgctc

SEQ ID NO: 9393399 - DNA, 22 bp, Homo sapiens
gaggtgtcatttagttaatcag

SEQ ID NO: 9393400 - DNA, 22 bp, Homo sapiens
gaggtgtcatcaggcagctctg

SEQ ID NO: 9393401 - DNA, 22 bp, Homo sapiens
gaggtgtccctgaccctttgca

SEQ ID NO: 9393402 - DNA, 22 bp, Homo sapiens
gaggtgtcctagaagtattcag

SEQ ID NO: 9393403 - DNA, 22 bp, Homo sapiens
gaggtgtcccgcagtccccaag

SEQ ID NO: 9393404 - DNA, 22 bp, Homo sapiens
gaggtgtcatgagggcctgctc

SEQ ID NO: 9393405 - DNA, 22 bp, Homo sapiens
gaggtgtcatttagttaatcag

SEQ ID NO: 9393406 - DNA, 22 bp, Homo sapiens
gagagctccatgttcatgctgt

SEQ ID NO: 9393407 - DNA, 22 bp, Homo sapiens
gagacagatctcggctccatgc

SEQ ID NO: 9393408 - DNA, 22 bp, Homo sapiens
gagagccctgctcctatcccag

SEQ ID NO: 9393409 - DNA, 22 bp, Homo sapiens
gagacagagatcttgctgagtc

SEQ ID NO: 9393410 - DNA, 22 bp, Homo sapiens
gagacagagatcttgctgagtc

SEQ ID NO: 9393411 - DNA, 22 bp, Homo sapiens
gagacagagtttcactcttgtt

SEQ ID NO: 9393412 - DNA, 22 bp, Homo sapiens
gagacagatctcggctccatgc

SEQ ID NO: 9393413 - DNA, 17 bp, Homo sapiens
gagagctgctgcttccg

SEQ ID NO: 9393414 - DNA, 22 bp, Homo sapiens
gagagctgcaaggtagggcggg

SEQ ID NO: 9393415 - DNA, 22 bp, Homo sapiens
gagagctgaggggcctggcact

SEQ ID NO: 9393416 - DNA, 20 bp, Homo sapiens
gagagctggggatgaggctg

SEQ ID NO: 9393417 - DNA, 22 bp, Homo sapiens
gagagctgggctttgggtgaag

SEQ ID NO: 9393418 - DNA, 22 bp, Homo sapiens
gagagctgggctttgggtgaag

SEQ ID NO: 9393419 - DNA, 22 bp, Homo sapiens
gagagctgggaaagccgtggag

SEQ ID NO: 9393420 - DNA, 22 bp, Homo sapiens
gagagctgggctttgggtgaag

SEQ ID NO: 9393421 - DNA, 22 bp, Homo sapiens
gagagctggattctggataggt

SEQ ID NO: 9393422 - DNA, 22 bp, Homo sapiens
gagagctggattctggataggt

SEQ ID NO: 9393423 - DNA, 22 bp, Homo sapiens
gagagctggattctggataggt

SEQ ID NO: 9393424 - DNA, 22 bp, Homo sapiens
gagagctgggaaagccgtggag

SEQ ID NO: 9393425 - DNA, 22 bp, Homo sapiens
gagagctgggttcaagtagctg

SEQ ID NO: 9393426 - DNA, 20 bp, Homo sapiens
gagagctggggatgaggctg

SEQ ID NO: 9393427 - DNA, 22 bp, Homo sapiens
gagagctgggggactgtggatg

SEQ ID NO: 9393428 - DNA, 22 bp, Homo sapiens
gagaggtacggaaagagcgtgg

SEQ ID NO: 9393429 - DNA, 22 bp, Homo sapiens
gagaggtacggaaagagcgtgg

SEQ ID NO: 9393430 - DNA, 22 bp, Homo sapiens
gagagtccttagtttgcaggta

SEQ ID NO: 9393431 - DNA, 22 bp, Homo sapiens
gagagtctaggaacctcatata

SEQ ID NO: 9393432 - DNA, 22 bp, Homo sapiens
gagaaacaacacttgatgcctt

SEQ ID NO: 9393433 - DNA, 22 bp, Homo sapiens
gagaaacaacacttgatgcctt

SEQ ID NO: 9393434 - DNA, 22 bp, Homo sapiens
gagacacaagaagacatgcaca

SEQ ID NO: 9393435 - DNA, 22 bp, Homo sapiens
gagaaaatgtcagacttggtcg

SEQ ID NO: 9393436 - DNA, 22 bp, Homo sapiens
gagaaaagcgaaggacctggag

SEQ ID NO: 9393437 - DNA, 22 bp, Homo sapiens
gacttttctgagacaatgcttt

SEQ ID NO: 9393438 - DNA, 22 bp, Homo sapiens
gagaaaagcgaaggacctggag

SEQ ID NO: 9393439 - DNA, 22 bp, Homo sapiens
gagaaaagcgaaggacctggag

SEQ ID NO: 9393440 - DNA, 22 bp, Homo sapiens
gacttttgaataaggtaggata

SEQ ID NO: 9393441 - DNA, 22 bp, Homo sapiens
gacttttccatcatccccctta

SEQ ID NO: 9393442 - DNA, 22 bp, Homo sapiens
gacttttagaatggtgaggaat

SEQ ID NO: 9393443 - DNA, 22 bp, Homo sapiens
gagacacacccaaggttatgag

SEQ ID NO: 9393444 - DNA, 22 bp, Homo sapiens
gagacacacacaggaggtggca

SEQ ID NO: 9393445 - DNA, 22 bp, Homo sapiens
gagacacacacaggaggtggca

SEQ ID NO: 9393446 - DNA, 22 bp, Homo sapiens
gagacacaagaagacatgcaca

SEQ ID NO: 9393447 - DNA, 22 bp, Homo sapiens
gagacacaagacgcaactctgt

SEQ ID NO: 9393448 - DNA, 18 bp, Homo sapiens
gagacacaagggcctgga

SEQ ID NO: 9393449 - DNA, 22 bp, Homo sapiens
gagacagagatcttgctgagtc

SEQ ID NO: 9393450 - DNA, 22 bp, Homo sapiens
gagacacagttatcaggcatac

SEQ ID NO: 9393451 - DNA, 22 bp, Homo sapiens
gagacacagttatcaggcatac

SEQ ID NO: 9393452 - DNA, 22 bp, Homo sapiens
gagacacaggcacagaagaggc

SEQ ID NO: 9393453 - DNA, 22 bp, Homo sapiens
gacttaaaggctgaatgtagga

SEQ ID NO: 9393454 - DNA, 22 bp, Homo sapiens
gacttaaaggctgaatgtagga

SEQ ID NO: 9393455 - DNA, 22 bp, Homo sapiens
gactgttattgttaatagcatg

SEQ ID NO: 9393456 - DNA, 22 bp, Homo sapiens
gacttatctatgagtgggtttt

SEQ ID NO: 9393457 - DNA, 21 bp, Homo sapiens
gacttatctatattctattta

SEQ ID NO: 9393458 - DNA, 22 bp, Homo sapiens
gacttctgaattcctatcaggt

SEQ ID NO: 9393459 - DNA, 22 bp, Homo sapiens
gacttcataatattgagcatgt

SEQ ID NO: 9393460 - DNA, 22 bp, Homo sapiens
gacttcatgacattcaggtcag

SEQ ID NO: 9393461 - DNA, 21 bp, Homo sapiens
gacttcatgggtcaaccaatt

SEQ ID NO: 9393462 - DNA, 18 bp, Homo sapiens
gactttaaaacactgctc

SEQ ID NO: 9393463 - DNA, 18 bp, Homo sapiens
gactttaaaacactgctc

SEQ ID NO: 9393464 - DNA, 22 bp, Homo sapiens
gactttaaaatgctagaacagg

SEQ ID NO: 9393465 - DNA, 22 bp, Homo sapiens
gacttggggatttatctcacag

SEQ ID NO: 9393466 - DNA, 22 bp, Homo sapiens
gacttgcctgcactgagcctat

SEQ ID NO: 9393467 - DNA, 22 bp, Homo sapiens
gacttgcctgcactgagcctat

SEQ ID NO: 9393468 - DNA, 22 bp, Homo sapiens
gactggggtaaggtgaggaggt

SEQ ID NO: 9393469 - DNA, 22 bp, Homo sapiens
gactggttatccccagcacaca

SEQ ID NO: 9393470 - DNA, 22 bp, Homo sapiens
gactggttgctaagcacagctt

SEQ ID NO: 9393471 - DNA, 22 bp, Homo sapiens
gactggttgaactcaggacaga

SEQ ID NO: 9393472 - DNA, 22 bp, Homo sapiens
gactgggtcctctgcttatggt

SEQ ID NO: 9393473 - DNA, 22 bp, Homo sapiens
gacccagggtttctgcacaggg

SEQ ID NO: 9393474 - DNA, 22 bp, Homo sapiens
gacccagggtggtcacctgaaa

SEQ ID NO: 9393475 - DNA, 22 bp, Homo sapiens
gactggtttgccaccgacagat

SEQ ID NO: 9393476 - DNA, 22 bp, Homo sapiens
gactggtttctagcctcatagt

SEQ ID NO: 9393477 - DNA, 22 bp, Homo sapiens
gactgtctcctgtcatgaggga

SEQ ID NO: 9393478 - DNA, 22 bp, Homo sapiens
gactgtcttgtttctaagatga

SEQ ID NO: 9393479 - DNA, 18 bp, Homo sapiens
gacccaggaaagagtcct

SEQ ID NO: 9393480 - DNA, 18 bp, Homo sapiens
gacccaggaaagagtcct

SEQ ID NO: 9393481 - DNA, 22 bp, Homo sapiens
gacccaggaagctacttctggt

SEQ ID NO: 9393482 - DNA, 22 bp, Homo sapiens
gacccagctaaccaggtgggga

SEQ ID NO: 9393483 - DNA, 22 bp, Homo sapiens
gaccatttctaggaatcagact

SEQ ID NO: 9393484 - DNA, 22 bp, Homo sapiens
gacccagaggcctgacagtgtg

SEQ ID NO: 9393485 - DNA, 22 bp, Homo sapiens
gacccaggcctggggcttaagg

SEQ ID NO: 9393486 - DNA, 22 bp, Homo sapiens
gacccaggcccaaggctgccag

SEQ ID NO: 9393487 - DNA, 22 bp, Homo sapiens
gacccaggagagagggttgcat

SEQ ID NO: 9393488 - DNA, 22 bp, Homo sapiens
gacccaggagtgcagagagtgg

SEQ ID NO: 9393489 - DNA, 22 bp, Homo sapiens
gacccaggagagagggttgcat

SEQ ID NO: 9393490 - DNA, 22 bp, Homo sapiens
gacccagggtatccagagctgc

SEQ ID NO: 9393491 - DNA, 22 bp, Homo sapiens
gacccagggtatccagagctgc

SEQ ID NO: 9393492 - DNA, 22 bp, Homo sapiens
gacccagggtatccagagctgc

SEQ ID NO: 9393493 - DNA, 22 bp, Homo sapiens
gacccaggctcgtgggacggct

SEQ ID NO: 9393494 - DNA, 22 bp, Homo sapiens
gacaggaggcagagctcaggtg

SEQ ID NO: 9393495 - DNA, 22 bp, Homo sapiens
gacaggaggcagagctcaggtg

SEQ ID NO: 9393496 - DNA, 22 bp, Homo sapiens
gacaggaggcagagctcaggtg

SEQ ID NO: 9393497 - DNA, 22 bp, Homo sapiens
gacaggaggcagagctcaggtg

SEQ ID NO: 9393498 - DNA, 20 bp, Homo sapiens
gacaggagagttaggtaggt

SEQ ID NO: 9393499 - DNA, 22 bp, Homo sapiens
gacaggaggcagagctcaggtg

SEQ ID NO: 9393500 - DNA, 22 bp, Homo sapiens
gacaggcacgaaattgggctgg

SEQ ID NO: 9393501 - DNA, 22 bp, Homo sapiens
gacaggcaccttgtctgtcttg

SEQ ID NO: 9393502 - DNA, 22 bp, Homo sapiens
gacaggcacgaaattgggctgg

SEQ ID NO: 9393503 - DNA, 22 bp, Homo sapiens
gacaggcaattaccagcgccca

SEQ ID NO: 9393504 - DNA, 22 bp, Homo sapiens
gaccagggtcactcacagggct

SEQ ID NO: 9393505 - DNA, 22 bp, Homo sapiens
gaccatcctggccaacgtggta

SEQ ID NO: 9393506 - DNA, 22 bp, Homo sapiens
gacaggccagacaggagactga

SEQ ID NO: 9393507 - DNA, 22 bp, Homo sapiens
gacaggccagacaggagactga

SEQ ID NO: 9393508 - DNA, 22 bp, Homo sapiens
gacaggcatgctttcaggacta

SEQ ID NO: 9393509 - DNA, 22 bp, Homo sapiens
gacaggcatgctttcaggacta

SEQ ID NO: 9393510 - DNA, 22 bp, Homo sapiens
gacaggcatgctttcaggacta

SEQ ID NO: 9393511 - DNA, 22 bp, Homo sapiens
gacaggcaggccagggctgtgg

SEQ ID NO: 9393512 - DNA, 22 bp, Homo sapiens
gacaggcaggccagggctgtgg

SEQ ID NO: 9393513 - DNA, 22 bp, Homo sapiens
gacaggcaggccagggctgtgg

SEQ ID NO: 9393514 - DNA, 22 bp, Homo sapiens
gacaggcagttttccagatcag

SEQ ID NO: 9393515 - DNA, 22 bp, Homo sapiens
gacaggcaggccagggctgtgg

SEQ ID NO: 9393516 - DNA, 20 bp, Homo sapiens
gacaggagagttaggtaggt

SEQ ID NO: 9393517 - DNA, 19 bp, Homo sapiens
gacaggacgaagggaagtt

SEQ ID NO: 9393518 - DNA, 22 bp, Homo sapiens
gacaggaatgtgtggatgcgga

SEQ ID NO: 9393519 - DNA, 22 bp, Homo sapiens
gacaggaatgtgtggatgcgga

SEQ ID NO: 9393520 - DNA, 22 bp, Homo sapiens
gacaggaagtctgaaggaggga

SEQ ID NO: 9393521 - DNA, 22 bp, Homo sapiens
gacaggaacataaatgtaggag

SEQ ID NO: 9393522 - DNA, 22 bp, Homo sapiens
gacaggaacataaatgtaggag

SEQ ID NO: 9393523 - DNA, 19 bp, Homo sapiens
gacaggaaggctaccagta

SEQ ID NO: 9393524 - DNA, 22 bp, Homo sapiens
gacagctgtgcaggagaagggg

SEQ ID NO: 9393525 - DNA, 22 bp, Homo sapiens
gacagctgtggagaggcatgtg

SEQ ID NO: 9393526 - DNA, 22 bp, Homo sapiens
gacacagggggatgtgtggacg

SEQ ID NO: 9393527 - DNA, 22 bp, Homo sapiens
gacacagggggatgtgtggacg

SEQ ID NO: 9393528 - DNA, 22 bp, Homo sapiens
gacacagggacgtgctctgcct

SEQ ID NO: 9393529 - DNA, 22 bp, Homo sapiens
gacacagggacgtgctctgcct

SEQ ID NO: 9393530 - DNA, 22 bp, Homo sapiens
gacacaggggggcgctagaaga

SEQ ID NO: 9393531 - DNA, 22 bp, Homo sapiens
gacacaggggggcgctagaaga

SEQ ID NO: 9393532 - DNA, 22 bp, Homo sapiens
gacacaggggggcgctagaaga

SEQ ID NO: 9393533 - DNA, 22 bp, Homo sapiens
gacacaggtagaataaagtact

SEQ ID NO: 9393534 - DNA, 22 bp, Homo sapiens
gacacaggtagaataaagtact

SEQ ID NO: 9393535 - DNA, 22 bp, Homo sapiens
gacacaggaaaagctccagccc

SEQ ID NO: 9393536 - DNA, 22 bp, Homo sapiens
gacacaggaaaagctccagccc

SEQ ID NO: 9393537 - DNA, 22 bp, Homo sapiens
gacacaggaatcaccttggatg

SEQ ID NO: 9393538 - DNA, 22 bp, Homo sapiens
gacacaggaatcaccttggatg

SEQ ID NO: 9393539 - DNA, 23 bp, Homo sapiens
gacacaggagcacccagctgagc

SEQ ID NO: 9393540 - DNA, 18 bp, Homo sapiens
gacacaggagagagtccc

SEQ ID NO: 9393541 - DNA, 18 bp, Homo sapiens
gacacaggagagagtccc

SEQ ID NO: 9393542 - DNA, 23 bp, Homo sapiens
gacacaggagcacccagctgagc

SEQ ID NO: 9393543 - DNA, 23 bp, Homo sapiens
gacacaggagcacccagctgagc

SEQ ID NO: 9393544 - DNA, 22 bp, Homo sapiens
gacacaggattcctggctctgc

SEQ ID NO: 9393545 - DNA, 22 bp, Homo sapiens
gacacaggattcctggctctgc

SEQ ID NO: 9393546 - DNA, 20 bp, Homo sapiens
gacacaggcagtcctcagag

SEQ ID NO: 9393547 - DNA, 20 bp, Homo sapiens
gacacaggcagtcctcagag

SEQ ID NO: 9393548 - DNA, 20 bp, Homo sapiens
gacacaggcagtcctcagag

SEQ ID NO: 9393549 - DNA, 22 bp, Homo sapiens
gacacagatatctctgagatta

SEQ ID NO: 9393550 - DNA, 22 bp, Homo sapiens
gacacagagggcaccagatatg

SEQ ID NO: 9393551 - DNA, 22 bp, Homo sapiens
gacacagagggcaccagatatg

SEQ ID NO: 9393552 - DNA, 22 bp, Homo sapiens
gacacagagataggcctgtgtt

SEQ ID NO: 9393553 - DNA, 22 bp, Homo sapiens
gacacagagctcacagtctcct

SEQ ID NO: 9393554 - DNA, 22 bp, Homo sapiens
gaagttctcaaggatcacagaa

SEQ ID NO: 9393555 - DNA, 22 bp, Homo sapiens
gaagttcaatgtcagcatctat

SEQ ID NO: 9393556 - DNA, 22 bp, Homo sapiens
gaagttcaatgtcagcatctat

SEQ ID NO: 9393557 - DNA, 22 bp, Homo sapiens
gaagttcaactgccatgcttgg

SEQ ID NO: 9393558 - DNA, 22 bp, Homo sapiens
gaagttatagctatgatcttaa

SEQ ID NO: 9393559 - DNA, 22 bp, Homo sapiens
gaagttatttcctggtgttgga

SEQ ID NO: 9393560 - DNA, 22 bp, Homo sapiens
gaagttatttgctatctactga

SEQ ID NO: 9393561 - DNA, 22 bp, Homo sapiens
gaagttattgcctgtgatgaaa

SEQ ID NO: 9393562 - DNA, 22 bp, Homo sapiens
gaagttattttacctgttaaag

SEQ ID NO: 9393563 - DNA, 22 bp, Homo sapiens
gaattacatttgtgttactgca

SEQ ID NO: 9393564 - DNA, 22 bp, Homo sapiens
gaattacatttgtgttactgca

SEQ ID NO: 9393565 - DNA, 22 bp, Homo sapiens
gaattacattgttagccttcct

SEQ ID NO: 9393566 - DNA, 22 bp, Homo sapiens
gaattacatagtttctaggttc

SEQ ID NO: 9393567 - DNA, 22 bp, Homo sapiens
gaattagacatgctttgctttt

SEQ ID NO: 9393568 - DNA, 22 bp, Homo sapiens
gaattcattagggaagctatct

SEQ ID NO: 9393569 - DNA, 22 bp, Homo sapiens
gaattatgggcttgtttggaga

SEQ ID NO: 9393570 - DNA, 19 bp, Homo sapiens
gaattatttttatgggatg

SEQ ID NO: 9393571 - DNA, 22 bp, Homo sapiens
gaattgatttacgtggctctct

SEQ ID NO: 9393572 - DNA, 22 bp, Homo sapiens
gaattgattgatatgtactgta

SEQ ID NO: 9393573 - DNA, 22 bp, Homo sapiens
gaattgctagcgcaccaattct

SEQ ID NO: 9393574 - DNA, 22 bp, Homo sapiens
gaattgctaatccaagtgactg

SEQ ID NO: 9393575 - DNA, 22 bp, Homo sapiens
gaattctaaccattaagccaag

SEQ ID NO: 9393576 - DNA, 22 bp, Homo sapiens
gaattgcttgctgagattaaag

SEQ ID NO: 9393577 - DNA, 22 bp, Homo sapiens
gaattgtattgatttttcagag

SEQ ID NO: 9393578 - DNA, 22 bp, Homo sapiens
gaattgtatgctgtcttgatag

SEQ ID NO: 9393579 - DNA, 22 bp, Homo sapiens
gaattgtatgcagttacttgga

SEQ ID NO: 9393580 - DNA, 22 bp, Homo sapiens
gacacagagataggcctgtgtt

SEQ ID NO: 9393581 - DNA, 22 bp, Homo sapiens
gaatttaagaggatgaatctgt

SEQ ID NO: 9393582 - DNA, 22 bp, Homo sapiens
gaatttaagaggatgaatctgt

SEQ ID NO: 9393583 - DNA, 22 bp, Homo sapiens
gaatttaaatttaaatctacca

SEQ ID NO: 9393584 - DNA, 22 bp, Homo sapiens
gaagtgtagtcttgagccccca

SEQ ID NO: 9393585 - DNA, 22 bp, Homo sapiens
gaagtgggtggtgatatcactg

SEQ ID NO: 9393586 - DNA, 22 bp, Homo sapiens
gaagtggggaagcaacaggaga

SEQ ID NO: 9393587 - DNA, 22 bp, Homo sapiens
gaagtgggtggtgatatcactg

SEQ ID NO: 9393588 - DNA, 22 bp, Homo sapiens
gaagtggggaagcaacaggaga

SEQ ID NO: 9393589 - DNA, 22 bp, Homo sapiens
gaagtgggctttgtggtcagct

SEQ ID NO: 9393590 - DNA, 22 bp, Homo sapiens
gaagtggggaagcaacaggaga

SEQ ID NO: 9393591 - DNA, 22 bp, Homo sapiens
gaagtggaattactgggtcata

SEQ ID NO: 9393592 - DNA, 22 bp, Homo sapiens
gaagtggaattactgggtcata

SEQ ID NO: 9393593 - DNA, 22 bp, Homo sapiens
gaagtgggctttgtggtcagct

SEQ ID NO: 9393594 - DNA, 22 bp, Homo sapiens
gaagtgggctttgtggtcagct

SEQ ID NO: 9393595 - DNA, 22 bp, Homo sapiens
gaagttactctcgttaaatatg

SEQ ID NO: 9393596 - DNA, 20 bp, Homo sapiens
gaagtgtggagttgggaagc

SEQ ID NO: 9393597 - DNA, 22 bp, Homo sapiens
gaagtgtgaaggtgatgtggag

SEQ ID NO: 9393598 - DNA, 22 bp, Homo sapiens
gaagtgtgaaggtgatgtggag

SEQ ID NO: 9393599 - DNA, 22 bp, Homo sapiens
gaagtggaagccatcggcagtc

SEQ ID NO: 9393600 - DNA, 22 bp, Homo sapiens
gaagtgatgacgctgtgttttt

SEQ ID NO: 9393601 - DNA, 22 bp, Homo sapiens
gaagtgatcttccagaagaata

SEQ ID NO: 9393602 - DNA, 22 bp, Homo sapiens
gaagtgcaaaaccacatggtaa

SEQ ID NO: 9393603 - DNA, 22 bp, Homo sapiens
gaagtgatgctggttgagatct

SEQ ID NO: 9393604 - DNA, 22 bp, Homo sapiens
gaaggttttgattccactgaat

SEQ ID NO: 9393605 - DNA, 22 bp, Homo sapiens
gaaggttttgtttgcaaatcat

SEQ ID NO: 9393606 - DNA, 22 bp, Homo sapiens
gaaggttttgtttgcaaatcat

SEQ ID NO: 9393607 - DNA, 22 bp, Homo sapiens
gaaggttttgattccactgaat

SEQ ID NO: 9393608 - DNA, 22 bp, Homo sapiens
gaagtacaaaggacatggaaac

SEQ ID NO: 9393609 - DNA, 22 bp, Homo sapiens
gaaggttttcaggagcctagtc

SEQ ID NO: 9393610 - DNA, 22 bp, Homo sapiens
gaaggttttcaggagcctagtc

SEQ ID NO: 9393611 - DNA, 22 bp, Homo sapiens
gaaggctgagtgggtacggagg

SEQ ID NO: 9393612 - DNA, 22 bp, Homo sapiens
gaaggctgagcagacaggccaa

SEQ ID NO: 9393613 - DNA, 22 bp, Homo sapiens
gaaggctgcgaggggagtgccg

SEQ ID NO: 9393614 - DNA, 22 bp, Homo sapiens
gaaggctgcgaggggagtgccg

SEQ ID NO: 9393615 - DNA, 22 bp, Homo sapiens
gaaggctgcatggaggctgtgg

SEQ ID NO: 9393616 - DNA, 22 bp, Homo sapiens
gaaggctaaaggggcagaggtt

SEQ ID NO: 9393617 - DNA, 19 bp, Homo sapiens
gaaggctgaaatgaagcac

SEQ ID NO: 9393618 - DNA, 22 bp, Homo sapiens
gaacttaacggcaactatttaa

SEQ ID NO: 9393619 - DNA, 20 bp, Homo sapiens
gaaggaagggggcaaggtga

SEQ ID NO: 9393620 - DNA, 22 bp, Homo sapiens
gaaggaagtcattagtgcagac

SEQ ID NO: 9393621 - DNA, 20 bp, Homo sapiens
gaaggaagggggcaaggtga

SEQ ID NO: 9393622 - DNA, 22 bp, Homo sapiens
gaaggaagtcattagtgcagac

SEQ ID NO: 9393623 - DNA, 22 bp, Homo sapiens
gaaggaagtcattagtgcagac

SEQ ID NO: 9393624 - DNA, 21 bp, Homo sapiens
gaaggagaaagcaagtgctgc

SEQ ID NO: 9393625 - DNA, 22 bp, Homo sapiens
gaaggacctgtccgtggtgctg

SEQ ID NO: 9393626 - DNA, 22 bp, Homo sapiens
gaaggagagagacatcgtccct

SEQ ID NO: 9393627 - DNA, 19 bp, Homo sapiens
gaaggagagctgagttagg

SEQ ID NO: 9393628 - DNA, 19 bp, Homo sapiens
gaaggagagctgagttagg

SEQ ID NO: 9393629 - DNA, 19 bp, Homo sapiens
gaaggagagctgagttagg

SEQ ID NO: 9393630 - DNA, 22 bp, Homo sapiens
gaaggagaggattgtgaggctg

SEQ ID NO: 9393631 - DNA, 22 bp, Homo sapiens
gaaggagaggattgtgaggctg

SEQ ID NO: 9393632 - DNA, 22 bp, Homo sapiens
gaaggagaggattgtgaggctg

SEQ ID NO: 9393633 - DNA, 21 bp, Homo sapiens
gaaggagaaagcaagtgctgc

SEQ ID NO: 9393634 - DNA, 21 bp, Homo sapiens
gaaggagaaagcaagtgctgc

SEQ ID NO: 9393635 - DNA, 22 bp, Homo sapiens
gaaggagagaaaggcaattctg

SEQ ID NO: 9393636 - DNA, 22 bp, Homo sapiens
gaaggagaccctgaagatgctg

SEQ ID NO: 9393637 - DNA, 22 bp, Homo sapiens
gaaggcctaggaaggaagcctt

SEQ ID NO: 9393638 - DNA, 22 bp, Homo sapiens
gaaggagagggtcaaggataat

SEQ ID NO: 9393639 - DNA, 22 bp, Homo sapiens
gaaggagagggtcaaggataat

SEQ ID NO: 9393640 - DNA, 22 bp, Homo sapiens
gaaggagaggattgtgaggctg

SEQ ID NO: 9393641 - DNA, 22 bp, Homo sapiens
gaaggagaggattgtgaggctg

SEQ ID NO: 9393642 - DNA, 22 bp, Homo sapiens
gaaggagagggtcaaggataat

SEQ ID NO: 9393643 - DNA, 22 bp, Homo sapiens
cttctttcttttgatcacaggt

SEQ ID NO: 9393644 - DNA, 22 bp, Homo sapiens
cttctttcttttgatcacaggt

SEQ ID NO: 9393645 - DNA, 22 bp, Homo sapiens
cttcttttacaggtcttgggtt

SEQ ID NO: 9393646 - DNA, 22 bp, Homo sapiens
cttctttcccaggcatgtttta

SEQ ID NO: 9393647 - DNA, 22 bp, Homo sapiens
cttctttactttctagaaataa

SEQ ID NO: 9393648 - DNA, 22 bp, Homo sapiens
cttgaaatccagatttcagagg

SEQ ID NO: 9393649 - DNA, 21 bp, Homo sapiens
cttgaaaggtagagtctacag

SEQ ID NO: 9393650 - DNA, 19 bp, Homo sapiens
cttgaaatgagactgaagg

SEQ ID NO: 9393651 - DNA, 22 bp, Homo sapiens
cttgaagacaatggcagattcc

SEQ ID NO: 9393652 - DNA, 22 bp, Homo sapiens
cttgaaagaagggtcttttaat

SEQ ID NO: 9393653 - DNA, 22 bp, Homo sapiens
cttcttttcatggcttgggaag

SEQ ID NO: 9393654 - DNA, 22 bp, Homo sapiens
cttcttttgaagggcgttgtgt

SEQ ID NO: 9393655 - DNA, 22 bp, Homo sapiens
cttcttcttttaataaatgtct

SEQ ID NO: 9393656 - DNA, 22 bp, Homo sapiens
cttcttcttttaataaatgtct

SEQ ID NO: 9393657 - DNA, 22 bp, Homo sapiens
cttctctgtgtagagattcaga

SEQ ID NO: 9393658 - DNA, 22 bp, Homo sapiens
cttctctgtcacagggttacgt

SEQ ID NO: 9393659 - DNA, 22 bp, Homo sapiens
cttctcttcctttgtcaactga

SEQ ID NO: 9393660 - DNA, 22 bp, Homo sapiens
cttctctctgcataggcatggg

SEQ ID NO: 9393661 - DNA, 22 bp, Homo sapiens
cttctctctgcataggcatggg

SEQ ID NO: 9393662 - DNA, 22 bp, Homo sapiens
cttctctctgcataggcatggg

SEQ ID NO: 9393663 - DNA, 22 bp, Homo sapiens
cttctctctgcataggcatggg

SEQ ID NO: 9393664 - DNA, 23 bp, Homo sapiens
cttctctgagctaggaatgctct

SEQ ID NO: 9393665 - DNA, 22 bp, Homo sapiens
cttctctgcaccccacttttgc

SEQ ID NO: 9393666 - DNA, 22 bp, Homo sapiens
cttctctgcaccccacttttgc

SEQ ID NO: 9393667 - DNA, 22 bp, Homo sapiens
cttctctgcaccccacttttgc

SEQ ID NO: 9393668 - DNA, 22 bp, Homo sapiens
cttctctgacagtctgtttcac

SEQ ID NO: 9393669 - DNA, 22 bp, Homo sapiens
cttctctgacagtctgtttcac

SEQ ID NO: 9393670 - DNA, 22 bp, Homo sapiens
cttctctggcatagcaagcagg

SEQ ID NO: 9393671 - DNA, 22 bp, Homo sapiens
cttctctggctcctcagcgccc

SEQ ID NO: 9393672 - DNA, 22 bp, Homo sapiens
cttctctggcatagcaagcagg

SEQ ID NO: 9393673 - DNA, 22 bp, Homo sapiens
cttctctggctcctcagcgccc

SEQ ID NO: 9393674 - DNA, 22 bp, Homo sapiens
cttctctggctcctcagcgccc

SEQ ID NO: 9393675 - DNA, 22 bp, Homo sapiens
cttctctggctcctcagcgccc

SEQ ID NO: 9393676 - DNA, 22 bp, Homo sapiens
cttctctggctcctcagcgccc

SEQ ID NO: 9393677 - DNA, 17 bp, Homo sapiens
cttctctggcagaagat

SEQ ID NO: 9393678 - DNA, 17 bp, Homo sapiens
cttctctggcagaagat

SEQ ID NO: 9393679 - DNA, 22 bp, Homo sapiens
cttctctggcagatgtgtgtcc

SEQ ID NO: 9393680 - DNA, 22 bp, Homo sapiens
cttctctggcagatgtgtgtcc

SEQ ID NO: 9393681 - DNA, 22 bp, Homo sapiens
cttctctgcccataggaaatgc

SEQ ID NO: 9393682 - DNA, 22 bp, Homo sapiens
cttctctgcccataggaaatgc

SEQ ID NO: 9393683 - DNA, 22 bp, Homo sapiens
cttctctgcccataggaaatgc

SEQ ID NO: 9393684 - DNA, 22 bp, Homo sapiens
ctggctgtcttctgggagctgt

SEQ ID NO: 9393685 - DNA, 22 bp, Homo sapiens
ctggctgtattagtttgatcct

SEQ ID NO: 9393686 - DNA, 22 bp, Homo sapiens
ctggctgtattagtttgatcct

SEQ ID NO: 9393687 - DNA, 22 bp, Homo sapiens
ctggctggttgtctcaatccag

SEQ ID NO: 9393688 - DNA, 22 bp, Homo sapiens
ctggctggtttttaaagctagg

SEQ ID NO: 9393689 - DNA, 22 bp, Homo sapiens
ctggctggttggggagaagaca

SEQ ID NO: 9393690 - DNA, 22 bp, Homo sapiens
ctggctggttccctgctccagg

SEQ ID NO: 9393691 - DNA, 22 bp, Homo sapiens
ctggctggttactatttctggt

SEQ ID NO: 9393692 - DNA, 22 bp, Homo sapiens
ctggctggtctgagcagtcgca

SEQ ID NO: 9393693 - DNA, 22 bp, Homo sapiens
cttctctcggtgcatccctcac

SEQ ID NO: 9393694 - DNA, 22 bp, Homo sapiens
cttctctcggtgcatccctcac

SEQ ID NO: 9393695 - DNA, 22 bp, Homo sapiens
cttctctcggtgcatccctcac

SEQ ID NO: 9393696 - DNA, 22 bp, Homo sapiens
cttctctcggtgcatccctcac

SEQ ID NO: 9393697 - DNA, 22 bp, Homo sapiens
cttctctccctggcactcagac

SEQ ID NO: 9393698 - DNA, 22 bp, Homo sapiens
cttctctccctggcactcagac

SEQ ID NO: 9393699 - DNA, 22 bp, Homo sapiens
cttctctccctggcactcagac

SEQ ID NO: 9393700 - DNA, 22 bp, Homo sapiens
cttctctccctggcactcagac

SEQ ID NO: 9393701 - DNA, 22 bp, Homo sapiens
cttctccagccacgcccactcc

SEQ ID NO: 9393702 - DNA, 22 bp, Homo sapiens
cttctcattcaagcaaaacaga

SEQ ID NO: 9393703 - DNA, 22 bp, Homo sapiens
cttctcggggttcccgcgccct

SEQ ID NO: 9393704 - DNA, 22 bp, Homo sapiens
cttctcagtcacctgtgagtct

SEQ ID NO: 9393705 - DNA, 22 bp, Homo sapiens
cttctcagtcacctgtgagtct

SEQ ID NO: 9393706 - DNA, 22 bp, Homo sapiens
cttctcagttgcaagtgtcaga

SEQ ID NO: 9393707 - DNA, 22 bp, Homo sapiens
cttctcagttgcaagtgtcaga

SEQ ID NO: 9393708 - DNA, 22 bp, Homo sapiens
ctggctgggttccaggattcca

SEQ ID NO: 9393709 - DNA, 22 bp, Homo sapiens
ctggctggggtccatcctctaa

SEQ ID NO: 9393710 - DNA, 22 bp, Homo sapiens
ctggctggtcatcagcagtacg

SEQ ID NO: 9393711 - DNA, 22 bp, Homo sapiens
ctggctggtagaattgtgacct

SEQ ID NO: 9393712 - DNA, 22 bp, Homo sapiens
ctggctggtaatggaacgacag

SEQ ID NO: 9393713 - DNA, 22 bp, Homo sapiens
ctggctggtcctcggggacagc

SEQ ID NO: 9393714 - DNA, 22 bp, Homo sapiens
ctggctggtcctcggggacagc

SEQ ID NO: 9393715 - DNA, 22 bp, Homo sapiens
ctggctggtcctcggggacagc

SEQ ID NO: 9393716 - DNA, 22 bp, Homo sapiens
ctggctggtcatgtcatgagcc

SEQ ID NO: 9393717 - DNA, 22 bp, Homo sapiens
ctggctggtcatgtcatgagcc

SEQ ID NO: 9393718 - DNA, 22 bp, Homo sapiens
ctggctgggcagacagaatgct

SEQ ID NO: 9393719 - DNA, 22 bp, Homo sapiens
ctggctgggattttaaagagca

SEQ ID NO: 9393720 - DNA, 22 bp, Homo sapiens
ctggctgggccatttctttagg

SEQ ID NO: 9393721 - DNA, 22 bp, Homo sapiens
ctggctggggccttagataaga

SEQ ID NO: 9393722 - DNA, 22 bp, Homo sapiens
ctggctggggaagtcatttgat

SEQ ID NO: 9393723 - DNA, 22 bp, Homo sapiens
ctggctggggtaccagttgaac

SEQ ID NO: 9393724 - DNA, 22 bp, Homo sapiens
ctggctggagctgttgtaggct

SEQ ID NO: 9393725 - DNA, 22 bp, Homo sapiens
ctggctggagctgttgtaggct

SEQ ID NO: 9393726 - DNA, 22 bp, Homo sapiens
ctggctggaggtgagtcactga

SEQ ID NO: 9393727 - DNA, 22 bp, Homo sapiens
ctggctggaggtgagtcactga

SEQ ID NO: 9393728 - DNA, 22 bp, Homo sapiens
ctggctgggagctcgcctgcgg

SEQ ID NO: 9393729 - DNA, 22 bp, Homo sapiens
ctggctgggagctcgcctgcgg

SEQ ID NO: 9393730 - DNA, 22 bp, Homo sapiens
ctggctggagtgcaggtgagtg

SEQ ID NO: 9393731 - DNA, 22 bp, Homo sapiens
ctttacaacctaagttgaagct

SEQ ID NO: 9393732 - DNA, 22 bp, Homo sapiens
ctttacaacctaagttgaagct

SEQ ID NO: 9393733 - DNA, 22 bp, Homo sapiens
ctttacaattcaagggaactct

SEQ ID NO: 9393734 - DNA, 22 bp, Homo sapiens
ctttagatgttgctttaactat

SEQ ID NO: 9393735 - DNA, 22 bp, Homo sapiens
ctttagacatacagaatttcca

SEQ ID NO: 9393736 - DNA, 19 bp, Homo sapiens
ctttagacacacctggaca

SEQ ID NO: 9393737 - DNA, 22 bp, Homo sapiens
ctttagaatttgatataatcaa

SEQ ID NO: 9393738 - DNA, 22 bp, Homo sapiens
ctttagtttaagaacatgatga

SEQ ID NO: 9393739 - DNA, 20 bp, Homo sapiens
ctttagttattaacagcact

SEQ ID NO: 9393740 - DNA, 22 bp, Homo sapiens
ctttagatttctatgtatcact

SEQ ID NO: 9393741 - DNA, 22 bp, Homo sapiens
ctttggttcaggagtacctctc

SEQ ID NO: 9393742 - DNA, 21 bp, Homo sapiens
ctttggtttcctcctgccttc

SEQ ID NO: 9393743 - DNA, 22 bp, Homo sapiens
ctttggttctgtccttcccaga

SEQ ID NO: 9393744 - DNA, 21 bp, Homo sapiens
ctttggtttctgacttgcata

SEQ ID NO: 9393745 - DNA, 21 bp, Homo sapiens
ctttggtttctgacttgcata

SEQ ID NO: 9393746 - DNA, 22 bp, Homo sapiens
ctttggcagcctctgctattga

SEQ ID NO: 9393747 - DNA, 22 bp, Homo sapiens
ctttgtagctgcttctgattta

SEQ ID NO: 9393748 - DNA, 22 bp, Homo sapiens
ctttgtagctgcttctgattta

SEQ ID NO: 9393749 - DNA, 22 bp, Homo sapiens
ctttgtatctaaatatcttgaa

SEQ ID NO: 9393750 - DNA, 19 bp, Homo sapiens
ctttgtcagaacatgcttc

SEQ ID NO: 9393751 - DNA, 22 bp, Homo sapiens
ctttatatccagatgtttggtg

SEQ ID NO: 9393752 - DNA, 22 bp, Homo sapiens
ctttatctagggtaagaaaacc

SEQ ID NO: 9393753 - DNA, 22 bp, Homo sapiens
ctttatctgtgtcctcttgcct

SEQ ID NO: 9393754 - DNA, 22 bp, Homo sapiens
ctttggcagcctcagctgcagg

SEQ ID NO: 9393755 - DNA, 22 bp, Homo sapiens
cttggggattttaaagacctct

SEQ ID NO: 9393756 - DNA, 22 bp, Homo sapiens
cttgggctctaaatgccagtga

SEQ ID NO: 9393757 - DNA, 22 bp, Homo sapiens
cttgggctcagacttgaggaca

SEQ ID NO: 9393758 - DNA, 22 bp, Homo sapiens
cttggggctgtcactctggcat

SEQ ID NO: 9393759 - DNA, 22 bp, Homo sapiens
cttggggctgtcactctggcat

SEQ ID NO: 9393760 - DNA, 22 bp, Homo sapiens
cttggggctttgtgtgtaggat

SEQ ID NO: 9393761 - DNA, 22 bp, Homo sapiens
cttggggctgtcactctggcat

SEQ ID NO: 9393762 - DNA, 22 bp, Homo sapiens
ctttacaaattagctctcggga

SEQ ID NO: 9393763 - DNA, 22 bp, Homo sapiens
cttgggggccattaaggggcct

SEQ ID NO: 9393764 - DNA, 22 bp, Homo sapiens
cttgggagtagaggcaggagca

SEQ ID NO: 9393765 - DNA, 22 bp, Homo sapiens
cttgggaggggagcattggcct

SEQ ID NO: 9393766 - DNA, 22 bp, Homo sapiens
cttgggaggggagcattggcct

SEQ ID NO: 9393767 - DNA, 22 bp, Homo sapiens
cttgggagtagaggcaggagca

SEQ ID NO: 9393768 - DNA, 22 bp, Homo sapiens
cttgggagtagaggcaggagca

SEQ ID NO: 9393769 - DNA, 22 bp, Homo sapiens
cttgggagtagaggcaggagca

SEQ ID NO: 9393770 - DNA, 22 bp, Homo sapiens
cttgggagacacaagaagacat

SEQ ID NO: 9393771 - DNA, 22 bp, Homo sapiens
cttgggagacacaagaagacat

SEQ ID NO: 9393772 - DNA, 22 bp, Homo sapiens
cttgggaggagaacaaagctcc

SEQ ID NO: 9393773 - DNA, 22 bp, Homo sapiens
cttgggaggcagaggttgcagt

SEQ ID NO: 9393774 - DNA, 22 bp, Homo sapiens
cttgggccctccccttgtgaat

SEQ ID NO: 9393775 - DNA, 22 bp, Homo sapiens
cttgggcaagcagcattcagaa

SEQ ID NO: 9393776 - DNA, 22 bp, Homo sapiens
cttgggagtagaggcaggagca

SEQ ID NO: 9393777 - DNA, 22 bp, Homo sapiens
cttgggagtagaggcaggagca

SEQ ID NO: 9393778 - DNA, 22 bp, Homo sapiens
cttgggagtagaggcaggagca

SEQ ID NO: 9393779 - DNA, 22 bp, Homo sapiens
cttgggagtagaggcaggagca

SEQ ID NO: 9393780 - DNA, 22 bp, Homo sapiens
cttggattcctcatatgcacag

SEQ ID NO: 9393781 - DNA, 22 bp, Homo sapiens
cttggatgccagcggcctccta

SEQ ID NO: 9393782 - DNA, 22 bp, Homo sapiens
cttgaatcttctgagtatttgc

SEQ ID NO: 9393783 - DNA, 22 bp, Homo sapiens
cttgaatcttctgagtatttgc

SEQ ID NO: 9393784 - DNA, 21 bp, Homo sapiens
cttggctgcagtgacaggcat

SEQ ID NO: 9393785 - DNA, 22 bp, Homo sapiens
cttggctgcttttgtgcacatt

SEQ ID NO: 9393786 - DNA, 21 bp, Homo sapiens
cttggctgcagtgacaggcat

SEQ ID NO: 9393787 - DNA, 22 bp, Homo sapiens
cttggctgtaaaatcagaggct

SEQ ID NO: 9393788 - DNA, 22 bp, Homo sapiens
cttggctggaactcctgagaaa

SEQ ID NO: 9393789 - DNA, 22 bp, Homo sapiens
cttgggaatgctaacagatgac

SEQ ID NO: 9393790 - DNA, 22 bp, Homo sapiens
cttggctttagaacatgggagc

SEQ ID NO: 9393791 - DNA, 22 bp, Homo sapiens
gaaatacaattttgtcccagct

SEQ ID NO: 9393792 - DNA, 22 bp, Homo sapiens
gaaatacaaatgcctagatcct

SEQ ID NO: 9393793 - DNA, 22 bp, Homo sapiens
gaaatacaaatgcctagatcct

SEQ ID NO: 9393794 - DNA, 22 bp, Homo sapiens
gaaatacaaatgcctagatcct

SEQ ID NO: 9393795 - DNA, 22 bp, Homo sapiens
gaaattgtggggttaaaaggct

SEQ ID NO: 9393796 - DNA, 22 bp, Homo sapiens
gaaattgtgcatttagcaacac

SEQ ID NO: 9393797 - DNA, 22 bp, Homo sapiens
gaaattgtctgtgcccaagtct

SEQ ID NO: 9393798 - DNA, 22 bp, Homo sapiens
gaaatacagaaagggctgaatg

SEQ ID NO: 9393799 - DNA, 22 bp, Homo sapiens
gaacactcatggaagagttttt

SEQ ID NO: 9393800 - DNA, 22 bp, Homo sapiens
gaacactgagaaagtcagcttt

SEQ ID NO: 9393801 - DNA, 22 bp, Homo sapiens
gaacacatttctctgactgtag

SEQ ID NO: 9393802 - DNA, 22 bp, Homo sapiens
gaacacattagtctgagttggc

SEQ ID NO: 9393803 - DNA, 22 bp, Homo sapiens
gaacacagtgtgatcgtatgtc

SEQ ID NO: 9393804 - DNA, 22 bp, Homo sapiens
gaacacaggtggcccggcaggg

SEQ ID NO: 9393805 - DNA, 22 bp, Homo sapiens
gaaatacaaagccagccatttt

SEQ ID NO: 9393806 - DNA, 22 bp, Homo sapiens
gaaatacaaagccagccatttt

SEQ ID NO: 9393807 - DNA, 22 bp, Homo sapiens
gaaatacaaagccagccatttt

SEQ ID NO: 9393808 - DNA, 22 bp, Homo sapiens
gaaataattctgtgtctgaaca

SEQ ID NO: 9393809 - DNA, 22 bp, Homo sapiens
gaaataattctgtgtctgaaca

SEQ ID NO: 9393810 - DNA, 22 bp, Homo sapiens
gaaataatacagtgctcttctc

SEQ ID NO: 9393811 - DNA, 22 bp, Homo sapiens
gaaataatttagaaggtattcc

SEQ ID NO: 9393812 - DNA, 22 bp, Homo sapiens
gaaataatttagaaggtattcc

SEQ ID NO: 9393813 - DNA, 22 bp, Homo sapiens
gaaataattctgtgtctgaaca

SEQ ID NO: 9393814 - DNA, 22 bp, Homo sapiens
gaaagttttctcacacagtaat

SEQ ID NO: 9393815 - DNA, 22 bp, Homo sapiens
gaaataacctcatgcaccatga

SEQ ID NO: 9393816 - DNA, 22 bp, Homo sapiens
gaaataagagtccatgccaggt

SEQ ID NO: 9393817 - DNA, 22 bp, Homo sapiens
gaactgaagacttttactgtac

SEQ ID NO: 9393818 - DNA, 22 bp, Homo sapiens
gaactgagttttctgcctggac

SEQ ID NO: 9393819 - DNA, 22 bp, Homo sapiens
gaactgagatttttgtctggct

SEQ ID NO: 9393820 - DNA, 22 bp, Homo sapiens
gaactatatcttcaagaaaatg

SEQ ID NO: 9393821 - DNA, 22 bp, Homo sapiens
gaactctgagaggagcacaggc

SEQ ID NO: 9393822 - DNA, 22 bp, Homo sapiens
gaactctgagaggagcacaggc

SEQ ID NO: 9393823 - DNA, 22 bp, Homo sapiens
gaactaaaagctaacatcaggc

SEQ ID NO: 9393824 - DNA, 22 bp, Homo sapiens
gaactaaatgaaattactggtg

SEQ ID NO: 9393825 - DNA, 22 bp, Homo sapiens
gaactaaaagctaacatcaggc

SEQ ID NO: 9393826 - DNA, 22 bp, Homo sapiens
gaacgggtgcagccatgggccc

SEQ ID NO: 9393827 - DNA, 22 bp, Homo sapiens
gaactaaatttgacagacaaca

SEQ ID NO: 9393828 - DNA, 22 bp, Homo sapiens
gaactaaatttgacagacaaca

SEQ ID NO: 9393829 - DNA, 22 bp, Homo sapiens
gaactacaggtgcagcaagtga

SEQ ID NO: 9393830 - DNA, 22 bp, Homo sapiens
gaactacagtaagaattgatgt

SEQ ID NO: 9393831 - DNA, 22 bp, Homo sapiens
gaactacagtgcattttcttaa

SEQ ID NO: 9393832 - DNA, 22 bp, Homo sapiens
gaactacaggtgcagcaagtga

SEQ ID NO: 9393833 - DNA, 22 bp, Homo sapiens
gaactacagtaagaattgatgt

SEQ ID NO: 9393834 - DNA, 22 bp, Homo sapiens
gaactacagtgcattttcttaa

SEQ ID NO: 9393835 - DNA, 22 bp, Homo sapiens
gaacctggaatctattacaagg

SEQ ID NO: 9393836 - DNA, 22 bp, Homo sapiens
gaacctggaatgtggcgcccaa

SEQ ID NO: 9393837 - DNA, 22 bp, Homo sapiens
gaacctggaatgtggcgcccaa

SEQ ID NO: 9393838 - DNA, 22 bp, Homo sapiens
gaacctggcagccctatatctg

SEQ ID NO: 9393839 - DNA, 20 bp, Homo sapiens
gaacctggggaaggagtagg

SEQ ID NO: 9393840 - DNA, 22 bp, Homo sapiens
gaacagaattaccgaagatctg

SEQ ID NO: 9393841 - DNA, 22 bp, Homo sapiens
gaacactgaggacactgagaat

SEQ ID NO: 9393842 - DNA, 22 bp, Homo sapiens
gaaccccaacttataagacaga

SEQ ID NO: 9393843 - DNA, 22 bp, Homo sapiens
gaacctctatatttgtgacatc

SEQ ID NO: 9393844 - DNA, 23 bp, Homo sapiens
gaacccagctctgccacttgcca

SEQ ID NO: 9393845 - DNA, 23 bp, Homo sapiens
gaacccagctctgccacttgcca

SEQ ID NO: 9393846 - DNA, 17 bp, Homo sapiens
gaacagcagaggggaca

SEQ ID NO: 9393847 - DNA, 22 bp, Homo sapiens
gaaaatacaaatagccttgaaa

SEQ ID NO: 9393848 - DNA, 22 bp, Homo sapiens
gaaaagttcatcatatattcag

SEQ ID NO: 9393849 - DNA, 22 bp, Homo sapiens
gaaaagtatgtttattttgact

SEQ ID NO: 9393850 - DNA, 22 bp, Homo sapiens
gaaaggcagtacagctgagcct

SEQ ID NO: 9393851 - DNA, 22 bp, Homo sapiens
gaaaggcatcttcagtctctga

SEQ ID NO: 9393852 - DNA, 21 bp, Homo sapiens
gaaaatacaatgagcttgacc

SEQ ID NO: 9393853 - DNA, 18 bp, Homo sapiens
gaaaatactctgggctca

SEQ ID NO: 9393854 - DNA, 22 bp, Homo sapiens
gaaagggagtgaagatggtata

SEQ ID NO: 9393855 - DNA, 22 bp, Homo sapiens
gaaagtttctcacacatgcaga

SEQ ID NO: 9393856 - DNA, 18 bp, Homo sapiens
gaaagtgcggggcagggg

SEQ ID NO: 9393857 - DNA, 22 bp, Homo sapiens
gaaagtgcttttgagtgtgtgc

SEQ ID NO: 9393858 - DNA, 22 bp, Homo sapiens
gaaagtgcttagagtgtggtat

SEQ ID NO: 9393859 - DNA, 22 bp, Homo sapiens
gaaagggtctttgatttccctc

SEQ ID NO: 9393860 - DNA, 22 bp, Homo sapiens
gaaaggtcagttccacttccat

SEQ ID NO: 9393861 - DNA, 22 bp, Homo sapiens
gaaaggttcttgggagttcaca

SEQ ID NO: 9393862 - DNA, 22 bp, Homo sapiens
gaaaggtcttccggtcttccag

SEQ ID NO: 9393863 - DNA, 22 bp, Homo sapiens
gaaaggttgggtgaatggtgga

SEQ ID NO: 9393864 - DNA, 22 bp, Homo sapiens
gaaaggttgggtgaatggtgga

SEQ ID NO: 9393865 - DNA, 22 bp, Homo sapiens
gaaagtgcctcagtcctcttat

SEQ ID NO: 9393866 - DNA, 22 bp, Homo sapiens
gaaagtgccagaataggaggcc

SEQ ID NO: 9393867 - DNA, 22 bp, Homo sapiens
cttttacactcatctgggaggg

SEQ ID NO: 9393868 - DNA, 22 bp, Homo sapiens
gaaaacactttgatctgaaagt

SEQ ID NO: 9393869 - DNA, 23 bp, Homo sapiens
cttttaacttgatctgagaccag

SEQ ID NO: 9393870 - DNA, 23 bp, Homo sapiens
cttttaactagagtatcagctgc

SEQ ID NO: 9393871 - DNA, 22 bp, Homo sapiens
cttttaagggataataagatgt

SEQ ID NO: 9393872 - DNA, 22 bp, Homo sapiens
cttttaagggataataagatgt

SEQ ID NO: 9393873 - DNA, 22 bp, Homo sapiens
ctttgtttatatttctcctcga

SEQ ID NO: 9393874 - DNA, 22 bp, Homo sapiens
ctttgttatctgtaaatggtta

SEQ ID NO: 9393875 - DNA, 22 bp, Homo sapiens
ctttgtgtctgttaataattat

SEQ ID NO: 9393876 - DNA, 22 bp, Homo sapiens
ctttgtggctcctgcaggccat

SEQ ID NO: 9393877 - DNA, 22 bp, Homo sapiens
ctttgtgtctgttaataattat

SEQ ID NO: 9393878 - DNA, 22 bp, Homo sapiens
gaaaaggattggtaaaatatct

SEQ ID NO: 9393879 - DNA, 22 bp, Homo sapiens
gaaaaggattggtaaaatatct

SEQ ID NO: 9393880 - DNA, 22 bp, Homo sapiens
gaaaaggcctccccataggaat

SEQ ID NO: 9393881 - DNA, 22 bp, Homo sapiens
gaaaaggccactcctaggagct

SEQ ID NO: 9393882 - DNA, 21 bp, Homo sapiens
gaaaagcaagggagtagaaca

SEQ ID NO: 9393883 - DNA, 22 bp, Homo sapiens
gaaaagcttactgccacttggc

SEQ ID NO: 9393884 - DNA, 22 bp, Homo sapiens
gaaaaggaaatttatagagatc

SEQ ID NO: 9393885 - DNA, 22 bp, Homo sapiens
gaaaaggaaatttatagagatc

SEQ ID NO: 9393886 - DNA, 22 bp, Homo sapiens
gaaaaggaaatttatagagatc

SEQ ID NO: 9393887 - DNA, 22 bp, Homo sapiens
gaaaagagtcctgtgtgaggag

SEQ ID NO: 9393888 - DNA, 22 bp, Homo sapiens
gaaaagagacagggtgggtgat

SEQ ID NO: 9393889 - DNA, 19 bp, Homo sapiens
gccatgggctggcagcaga

SEQ ID NO: 9393890 - DNA, 19 bp, Homo sapiens
gccatgggctggcagcaga

SEQ ID NO: 9393891 - DNA, 23 bp, Homo sapiens
gccatggctgccccacaggcctc

SEQ ID NO: 9393892 - DNA, 23 bp, Homo sapiens
gccatggctgccccacaggcctc

SEQ ID NO: 9393893 - DNA, 22 bp, Homo sapiens
gccatgggcaaatgcagagctg

SEQ ID NO: 9393894 - DNA, 22 bp, Homo sapiens
gccatgggtctgctggctcagc

SEQ ID NO: 9393895 - DNA, 22 bp, Homo sapiens
gccatgtgggcagaggaggctg

SEQ ID NO: 9393896 - DNA, 22 bp, Homo sapiens
gccatggggagggcagcgcctg

SEQ ID NO: 9393897 - DNA, 22 bp, Homo sapiens
gccatggggctcagctgcacta

SEQ ID NO: 9393898 - DNA, 22 bp, Homo sapiens
gcccaggaggagaggctgcagt

SEQ ID NO: 9393899 - DNA, 22 bp, Homo sapiens
gcccaggagttggaggctgcag

SEQ ID NO: 9393900 - DNA, 22 bp, Homo sapiens
gcccaggagttggaggctgcag

SEQ ID NO: 9393901 - DNA, 22 bp, Homo sapiens
gccatttaggaggtggaaagga

SEQ ID NO: 9393902 - DNA, 21 bp, Homo sapiens
gccatttcacacagacatttg

SEQ ID NO: 9393903 - DNA, 22 bp, Homo sapiens
gcccaggctagcgtagagtgca

SEQ ID NO: 9393904 - DNA, 22 bp, Homo sapiens
gcccaggctagcgtagagtgca

SEQ ID NO: 9393905 - DNA, 22 bp, Homo sapiens
gcccaggattctttcttcctta

SEQ ID NO: 9393906 - DNA, 22 bp, Homo sapiens
gcccaggatggctggaggtgct

SEQ ID NO: 9393907 - DNA, 22 bp, Homo sapiens
gcccaggatggctggaggtgct

SEQ ID NO: 9393908 - DNA, 22 bp, Homo sapiens
gcccaggatggctggaggtgct

SEQ ID NO: 9393909 - DNA, 22 bp, Homo sapiens
gcccaggctggagtgcagtggc

SEQ ID NO: 9393910 - DNA, 22 bp, Homo sapiens
gcccaggctggagtgcagtggc

SEQ ID NO: 9393911 - DNA, 22 bp, Homo sapiens
gcccaggctggagtgcagtagc

SEQ ID NO: 9393912 - DNA, 22 bp, Homo sapiens
gcccaggctggagtgcagtagc

SEQ ID NO: 9393913 - DNA, 22 bp, Homo sapiens
gcccaggatctgctcagatcat

SEQ ID NO: 9393914 - DNA, 20 bp, Homo sapiens
gcccaggatctctgaggcat

SEQ ID NO: 9393915 - DNA, 22 bp, Homo sapiens
gcccaggatctgctcagatcat

SEQ ID NO: 9393916 - DNA, 22 bp, Homo sapiens
gcccaggagttggtggctgcag

SEQ ID NO: 9393917 - DNA, 20 bp, Homo sapiens
gcccaggatctctgaggcat

SEQ ID NO: 9393918 - DNA, 22 bp, Homo sapiens
gccaggctgtggggaacttgaa

SEQ ID NO: 9393919 - DNA, 22 bp, Homo sapiens
gccaggctgtttttattactgt

SEQ ID NO: 9393920 - DNA, 22 bp, Homo sapiens
gccaggctgtttttattactgt

SEQ ID NO: 9393921 - DNA, 22 bp, Homo sapiens
gccagggaaactgcagaccagc

SEQ ID NO: 9393922 - DNA, 22 bp, Homo sapiens
gccaggctgtttttattactgt

SEQ ID NO: 9393923 - DNA, 22 bp, Homo sapiens
gccagtgggacccgctgtgggc

SEQ ID NO: 9393924 - DNA, 22 bp, Homo sapiens
gccagggaaactgcagaccagc

SEQ ID NO: 9393925 - DNA, 18 bp, Homo sapiens
gccagtgggtccaggtgc

SEQ ID NO: 9393926 - DNA, 18 bp, Homo sapiens
gccagtgggtccaggtgc

SEQ ID NO: 9393927 - DNA, 22 bp, Homo sapiens
gccagtggtagaggggaggccg

SEQ ID NO: 9393928 - DNA, 22 bp, Homo sapiens
gccagtgggtagttggagctgg

SEQ ID NO: 9393929 - DNA, 22 bp, Homo sapiens
gccagtggtcactgaggaagaa

SEQ ID NO: 9393930 - DNA, 22 bp, Homo sapiens
gccagtggtcactgaggaagaa

SEQ ID NO: 9393931 - DNA, 22 bp, Homo sapiens
gccagtggtcactgaggaagaa

SEQ ID NO: 9393932 - DNA, 22 bp, Homo sapiens
gccagtggtcagctacgcttag

SEQ ID NO: 9393933 - DNA, 22 bp, Homo sapiens
gccagtggtcagtgggagggtg

SEQ ID NO: 9393934 - DNA, 22 bp, Homo sapiens
gccagtggtgagattccctggg

SEQ ID NO: 9393935 - DNA, 22 bp, Homo sapiens
gccagtgtgcaagaggccacca

SEQ ID NO: 9393936 - DNA, 22 bp, Homo sapiens
gccagtgttattcctggggctg

SEQ ID NO: 9393937 - DNA, 22 bp, Homo sapiens
gccagtgtttatagcagtgagg

SEQ ID NO: 9393938 - DNA, 22 bp, Homo sapiens
gccagtgtgtcttgcaggctcc

SEQ ID NO: 9393939 - DNA, 22 bp, Homo sapiens
gccagtgtgtcttgcaggctcc

SEQ ID NO: 9393940 - DNA, 22 bp, Homo sapiens
gccatcacatccaggctacctc

SEQ ID NO: 9393941 - DNA, 22 bp, Homo sapiens
gccatatatattttgcactagg

SEQ ID NO: 9393942 - DNA, 22 bp, Homo sapiens
gccataaattgctggtcaaaat

SEQ ID NO: 9393943 - DNA, 22 bp, Homo sapiens
gccataaattgctggtcaaaat

SEQ ID NO: 9393944 - DNA, 22 bp, Homo sapiens
gccagttggccccgggcatgca

SEQ ID NO: 9393945 - DNA, 17 bp, Homo sapiens
gccagttgtcttggcat

SEQ ID NO: 9393946 - DNA, 22 bp, Homo sapiens
gccataaatgaaggaaaggtat

SEQ ID NO: 9393947 - DNA, 22 bp, Homo sapiens
gccataaaatgtggatgaggga

SEQ ID NO: 9393948 - DNA, 22 bp, Homo sapiens
gccaggctggttatttaatgag

SEQ ID NO: 9393949 - DNA, 22 bp, Homo sapiens
gccaggctggttatttaatgag

SEQ ID NO: 9393950 - DNA, 22 bp, Homo sapiens
gccaggctgtggggaacttgaa

SEQ ID NO: 9393951 - DNA, 22 bp, Homo sapiens
gccaggctggtgtcacaactct

SEQ ID NO: 9393952 - DNA, 22 bp, Homo sapiens
gccaggctgctggctgctgtcc

SEQ ID NO: 9393953 - DNA, 22 bp, Homo sapiens
gccaggctgctggctgctgtcc

SEQ ID NO: 9393954 - DNA, 22 bp, Homo sapiens
gccaggctgctggctgctgtcc

SEQ ID NO: 9393955 - DNA, 22 bp, Homo sapiens
gccaggctgctccagggaggcc

SEQ ID NO: 9393956 - DNA, 22 bp, Homo sapiens
gccaggctgctccagggaggcc

SEQ ID NO: 9393957 - DNA, 19 bp, Homo sapiens
gccaggctcttattctgtg

SEQ ID NO: 9393958 - DNA, 19 bp, Homo sapiens
gccaggctcttattctgtg

SEQ ID NO: 9393959 - DNA, 22 bp, Homo sapiens
gccaggctcttccatttgggtc

SEQ ID NO: 9393960 - DNA, 22 bp, Homo sapiens
gccaggctcttggttatgtttt

SEQ ID NO: 9393961 - DNA, 22 bp, Homo sapiens
gccaggctcttggttatgtttt

SEQ ID NO: 9393962 - DNA, 22 bp, Homo sapiens
gccaggctgactcccccggcct

SEQ ID NO: 9393963 - DNA, 22 bp, Homo sapiens
gccaggctgccttatctctagc

SEQ ID NO: 9393964 - DNA, 22 bp, Homo sapiens
gccaggctgccttatctctagc

SEQ ID NO: 9393965 - DNA, 22 bp, Homo sapiens
gccaggctgaggctctggaaga

SEQ ID NO: 9393966 - DNA, 22 bp, Homo sapiens
gccaggctgaggctctggaaga

SEQ ID NO: 9393967 - DNA, 19 bp, Homo sapiens
gccctcaggcagctccatc

SEQ ID NO: 9393968 - DNA, 21 bp, Homo sapiens
gccctcaggggaggatggcct

SEQ ID NO: 9393969 - DNA, 21 bp, Homo sapiens
gccctcaggggaggatggcct

SEQ ID NO: 9393970 - DNA, 22 bp, Homo sapiens
gccctcaggcagggagtctttc

SEQ ID NO: 9393971 - DNA, 15 bp, Homo sapiens
gccctcaggcgacac

SEQ ID NO: 9393972 - DNA, 21 bp, Homo sapiens
gccctcaggggaggatggcct

SEQ ID NO: 9393973 - DNA, 23 bp, Homo sapiens
gccctcagtagaaaatgttagaa

SEQ ID NO: 9393974 - DNA, 20 bp, Homo sapiens
gccctcagtcttgtctttat

SEQ ID NO: 9393975 - DNA, 22 bp, Homo sapiens
gccctcagtgaccactgattca

SEQ ID NO: 9393976 - DNA, 22 bp, Homo sapiens
gccctctcttctgcagcctcca

SEQ ID NO: 9393977 - DNA, 22 bp, Homo sapiens
gccctcagtggattcttattgt

SEQ ID NO: 9393978 - DNA, 22 bp, Homo sapiens
gccctcctttgcttctcctagt

SEQ ID NO: 9393979 - DNA, 22 bp, Homo sapiens
gccctcctttgcttctcctagt

SEQ ID NO: 9393980 - DNA, 22 bp, Homo sapiens
gccctctaccttggctatagaa

SEQ ID NO: 9393981 - DNA, 22 bp, Homo sapiens
gccctcgcttcttcctaggggt

SEQ ID NO: 9393982 - DNA, 22 bp, Homo sapiens
gccctcagcatcctcagggcca

SEQ ID NO: 9393983 - DNA, 22 bp, Homo sapiens
gccctcagcaggaaagatcaac

SEQ ID NO: 9393984 - DNA, 22 bp, Homo sapiens
gccctcagcaggaaagatcaac

SEQ ID NO: 9393985 - DNA, 22 bp, Homo sapiens
gccctcagctcctggacacatg

SEQ ID NO: 9393986 - DNA, 22 bp, Homo sapiens
gccctcagcttgatgttgttct

SEQ ID NO: 9393987 - DNA, 22 bp, Homo sapiens
gccctcagctcctggacacatg

SEQ ID NO: 9393988 - DNA, 17 bp, Homo sapiens
gccctcagctttaacca

SEQ ID NO: 9393989 - DNA, 22 bp, Homo sapiens
gccctcaggacaaggttacgct

SEQ ID NO: 9393990 - DNA, 19 bp, Homo sapiens
gccctcaggcagctccatc

SEQ ID NO: 9393991 - DNA, 22 bp, Homo sapiens
gcccaggctggagtgcagtggc

SEQ ID NO: 9393992 - DNA, 22 bp, Homo sapiens
gccctcagcaggaaagatcaac

SEQ ID NO: 9393993 - DNA, 22 bp, Homo sapiens
gccctcagatgggaaaggaggg

SEQ ID NO: 9393994 - DNA, 22 bp, Homo sapiens
gccctcagatgggaaaggaggg

SEQ ID NO: 9393995 - DNA, 22 bp, Homo sapiens
gccctcagagttccccacagtg

SEQ ID NO: 9393996 - DNA, 22 bp, Homo sapiens
gcccttccttagacagcaggat

SEQ ID NO: 9393997 - DNA, 22 bp, Homo sapiens
gcccttccttagacagcaggat

SEQ ID NO: 9393998 - DNA, 22 bp, Homo sapiens
gccctttgtggtcagaggcctg

SEQ ID NO: 9393999 - DNA, 22 bp, Homo sapiens
gccgaacttgagggccaggcgg

SEQ ID NO: 9394000 - DNA, 22 bp, Homo sapiens
gcccttggggtgtctgtaataa

SEQ ID NO: 9394001 - DNA, 22 bp, Homo sapiens
gcccttgggaggttccactggg

SEQ ID NO: 9394002 - DNA, 22 bp, Homo sapiens
gcccttggcaaattctccttta

SEQ ID NO: 9394003 - DNA, 22 bp, Homo sapiens
gcccttggcctctttggcccgg

SEQ ID NO: 9394004 - DNA, 22 bp, Homo sapiens
gcccttggaacagcctcctgct

SEQ ID NO: 9394005 - DNA, 22 bp, Homo sapiens
gcccttggaaagccaaggcagc

SEQ ID NO: 9394006 - DNA, 22 bp, Homo sapiens
gccctctggcacagagatgcag

SEQ ID NO: 9394007 - DNA, 22 bp, Homo sapiens
gcccttacagggtggtcagcca

SEQ ID NO: 9394008 - DNA, 22 bp, Homo sapiens
gccctctgccacaggacgccag

SEQ ID NO: 9394009 - DNA, 22 bp, Homo sapiens
gccctctgcacagctctgagca

SEQ ID NO: 9394010 - DNA, 22 bp, Homo sapiens
gcctctgctcggactttgcctc

SEQ ID NO: 9394011 - DNA, 22 bp, Homo sapiens
gcctctgctcggactttgcctc

SEQ ID NO: 9394012 - DNA, 22 bp, Homo sapiens
gcctctgcggagctgtacatca

SEQ ID NO: 9394013 - DNA, 22 bp, Homo sapiens
gcctctgcggggcccgagcccg

SEQ ID NO: 9394014 - DNA, 22 bp, Homo sapiens
gcctctgcggggcccgagcccg

SEQ ID NO: 9394015 - DNA, 22 bp, Homo sapiens
gcctctgcggagctgtacatca

SEQ ID NO: 9394016 - DNA, 19 bp, Homo sapiens
gcctctgctggggacaggc

SEQ ID NO: 9394017 - DNA, 19 bp, Homo sapiens
gcctctgctggggacaggc

SEQ ID NO: 9394018 - DNA, 19 bp, Homo sapiens
gcctctgctggggacaggc

SEQ ID NO: 9394019 - DNA, 19 bp, Homo sapiens
gcctctgctggggacaggc

SEQ ID NO: 9394020 - DNA, 22 bp, Homo sapiens
gcctctgctgacaagatggaca

SEQ ID NO: 9394021 - DNA, 22 bp, Homo sapiens
gcctctgctgcaagcctggttg

SEQ ID NO: 9394022 - DNA, 22 bp, Homo sapiens
gcctctgctgcaagcctggttg

SEQ ID NO: 9394023 - DNA, 22 bp, Homo sapiens
gcctctgctctcaggtagcctc

SEQ ID NO: 9394024 - DNA, 22 bp, Homo sapiens
gcctctgctctcaggtagcctc

SEQ ID NO: 9394025 - DNA, 22 bp, Homo sapiens
gcctctgcccatccaccatcag

SEQ ID NO: 9394026 - DNA, 22 bp, Homo sapiens
gcctctgcccatccaccatcag

SEQ ID NO: 9394027 - DNA, 22 bp, Homo sapiens
gcctctgcccatccaccatcag

SEQ ID NO: 9394028 - DNA, 22 bp, Homo sapiens
gcctctgccaagggggctgcgg

SEQ ID NO: 9394029 - DNA, 22 bp, Homo sapiens
gcctctgccaagggggctgcgg

SEQ ID NO: 9394030 - DNA, 22 bp, Homo sapiens
gcctctgcatcttcgccgcact

SEQ ID NO: 9394031 - DNA, 22 bp, Homo sapiens
gcctctgcatcatcactccagc

SEQ ID NO: 9394032 - DNA, 22 bp, Homo sapiens
gcctctgcaactccgccttggt

SEQ ID NO: 9394033 - DNA, 22 bp, Homo sapiens
gcctctgcaccagtactgtgcc

SEQ ID NO: 9394034 - DNA, 22 bp, Homo sapiens
gcctctgcaattacattgtgcc

SEQ ID NO: 9394035 - DNA, 22 bp, Homo sapiens
gcctctgcaccagtactgtgcc

SEQ ID NO: 9394036 - DNA, 22 bp, Homo sapiens
gcctctgcactgtggcacacca

SEQ ID NO: 9394037 - DNA, 22 bp, Homo sapiens
gcctctgcactgtggcacacca

SEQ ID NO: 9394038 - DNA, 22 bp, Homo sapiens
gcctctgcactgtggcacacca

SEQ ID NO: 9394039 - DNA, 23 bp, Homo sapiens
gcctctgcagcctagttagtgtc

SEQ ID NO: 9394040 - DNA, 22 bp, Homo sapiens
gcctcctgtcccaggctgagga

SEQ ID NO: 9394041 - DNA, 22 bp, Homo sapiens
gcctcctgttatgccatgtgcc

SEQ ID NO: 9394042 - DNA, 22 bp, Homo sapiens
gcctcctgttatgccatgtgcc

SEQ ID NO: 9394043 - DNA, 22 bp, Homo sapiens
gccgtgtgggcaacatggtcat

SEQ ID NO: 9394044 - DNA, 19 bp, Homo sapiens
gcctaaatgtggaattagt

SEQ ID NO: 9394045 - DNA, 22 bp, Homo sapiens
gcctcctgtcccaggctgagga

SEQ ID NO: 9394046 - DNA, 22 bp, Homo sapiens
gccgggttcaagccattctcct

SEQ ID NO: 9394047 - DNA, 22 bp, Homo sapiens
gccgtccacctcgatggccact

SEQ ID NO: 9394048 - DNA, 22 bp, Homo sapiens
gccggggctggggagagacatg

SEQ ID NO: 9394049 - DNA, 22 bp, Homo sapiens
gccgggaccaaggccacggagc

SEQ ID NO: 9394050 - DNA, 22 bp, Homo sapiens
gccgaggctctgcccagctgct

SEQ ID NO: 9394051 - DNA, 22 bp, Homo sapiens
gccgccgctgtgcaatttagca

SEQ ID NO: 9394052 - DNA, 22 bp, Homo sapiens
gccgccctctgcaggggctgag

SEQ ID NO: 9394053 - DNA, 22 bp, Homo sapiens
gccgctggaaggtgagtgacgt

SEQ ID NO: 9394054 - DNA, 21 bp, Homo sapiens
gccgctgctgcgtgtcccttt

SEQ ID NO: 9394055 - DNA, 22 bp, Homo sapiens
gccgaggctctgcccagctgct

SEQ ID NO: 9394056 - DNA, 19 bp, Homo sapiens
gcctgggatgggcagaact

SEQ ID NO: 9394057 - DNA, 21 bp, Homo sapiens
gcctgggatagtggcctccgg

SEQ ID NO: 9394058 - DNA, 21 bp, Homo sapiens
gcctgggatagtggcctccgg

SEQ ID NO: 9394059 - DNA, 19 bp, Homo sapiens
gcctgggatgggcagaact

SEQ ID NO: 9394060 - DNA, 19 bp, Homo sapiens
gcctgggatgggcagaact

SEQ ID NO: 9394061 - DNA, 22 bp, Homo sapiens
gcctgggatagaggcaatgcat

SEQ ID NO: 9394062 - DNA, 22 bp, Homo sapiens
gcctgggatagaggcaatgcat

SEQ ID NO: 9394063 - DNA, 22 bp, Homo sapiens
gcctgggagaatgacctccaac

SEQ ID NO: 9394064 - DNA, 23 bp, Homo sapiens
gcctgggactggtagtgtgacct

SEQ ID NO: 9394065 - DNA, 22 bp, Homo sapiens
gcctgggactggatgtgtttgt

SEQ ID NO: 9394066 - DNA, 23 bp, Homo sapiens
gcctgggactcaggaggagctca

SEQ ID NO: 9394067 - DNA, 23 bp, Homo sapiens
gcctgggactcaggaggagctca

SEQ ID NO: 9394068 - DNA, 22 bp, Homo sapiens
gcctgtgtcatgtagtagcttc

SEQ ID NO: 9394069 - DNA, 22 bp, Homo sapiens
gcctgtgtctgggtggccagag

SEQ ID NO: 9394070 - DNA, 22 bp, Homo sapiens
gcctgtgtccttcccagtgggg

SEQ ID NO: 9394071 - DNA, 22 bp, Homo sapiens
gcctgtggggctgaggctgcct

SEQ ID NO: 9394072 - DNA, 22 bp, Homo sapiens
gcctgtggggctgaggctgcct

SEQ ID NO: 9394073 - DNA, 22 bp, Homo sapiens
gcctgtggggctgaggctgcct

SEQ ID NO: 9394074 - DNA, 22 bp, Homo sapiens
gcctgtgggttggagcttggcc

SEQ ID NO: 9394075 - DNA, 22 bp, Homo sapiens
gcctgttggtgactttctgttg

SEQ ID NO: 9394076 - DNA, 22 bp, Homo sapiens
gcctgtgtttttaactctagga

SEQ ID NO: 9394077 - DNA, 22 bp, Homo sapiens
gcctgtgtgtttagctctgggg

SEQ ID NO: 9394078 - DNA, 22 bp, Homo sapiens
gcctgtgtggatgggcccctgg

SEQ ID NO: 9394079 - DNA, 22 bp, Homo sapiens
gcctgtgtggatgcgccggtgc

SEQ ID NO: 9394080 - DNA, 22 bp, Homo sapiens
gcctggtgtctccccaaggaag

SEQ ID NO: 9394081 - DNA, 22 bp, Homo sapiens
gcctggtgtctccccaaggaag

SEQ ID NO: 9394082 - DNA, 21 bp, Homo sapiens
gcctgtggagcccaagggccc

SEQ ID NO: 9394083 - DNA, 22 bp, Homo sapiens
gcctggcaggcctgggccagca

SEQ ID NO: 9394084 - DNA, 22 bp, Homo sapiens
gcctggcaggcctcatgagggg

SEQ ID NO: 9394085 - DNA, 22 bp, Homo sapiens
gcctggagtagcatggcaagcc

SEQ ID NO: 9394086 - DNA, 22 bp, Homo sapiens
gcctggcaggcctgggccagca

SEQ ID NO: 9394087 - DNA, 22 bp, Homo sapiens
gcctggcaggcctgggccagca

SEQ ID NO: 9394088 - DNA, 22 bp, Homo sapiens
gcctggcaggcctgttggggct

SEQ ID NO: 9394089 - DNA, 22 bp, Homo sapiens
gcctggcaggcctgttggggct

SEQ ID NO: 9394090 - DNA, 22 bp, Homo sapiens
gcctggcaggcctgttggggct

SEQ ID NO: 9394091 - DNA, 22 bp, Homo sapiens
gcctggcagggcccggacggca

SEQ ID NO: 9394092 - DNA, 22 bp, Homo sapiens
gcctggcagggcccggacggca

SEQ ID NO: 9394093 - DNA, 22 bp, Homo sapiens
gcctggcagggagattgtaaga

SEQ ID NO: 9394094 - DNA, 22 bp, Homo sapiens
gcctggcagggagattgtaaga

SEQ ID NO: 9394095 - DNA, 22 bp, Homo sapiens
gcctggcaggcctgttggggct

SEQ ID NO: 9394096 - DNA, 22 bp, Homo sapiens
gcctggagggttgaggttttgt

SEQ ID NO: 9394097 - DNA, 22 bp, Homo sapiens
gcctggagtactccttgaagtg

SEQ ID NO: 9394098 - DNA, 22 bp, Homo sapiens
gcctggagggttgaggttttgt

SEQ ID NO: 9394099 - DNA, 22 bp, Homo sapiens
gcctggagtactccttgaagtg

SEQ ID NO: 9394100 - DNA, 22 bp, Homo sapiens
gcctggagtagcatggcaagcc

SEQ ID NO: 9394101 - DNA, 22 bp, Homo sapiens
gcctggagtagcatggcaagcc

SEQ ID NO: 9394102 - DNA, 22 bp, Homo sapiens
gcctggagtactccttgaagtg

SEQ ID NO: 9394103 - DNA, 22 bp, Homo sapiens
gcctggcagtggggccctggga

SEQ ID NO: 9394104 - DNA, 22 bp, Homo sapiens
gcctggcagtgatgtcttttgg

SEQ ID NO: 9394105 - DNA, 22 bp, Homo sapiens
gcctggcagtgatgtcttttgg

SEQ ID NO: 9394106 - DNA, 21 bp, Homo sapiens
gcctggcaggtggaagggctc

SEQ ID NO: 9394107 - DNA, 21 bp, Homo sapiens
gcctggcaggtggaagggctc

SEQ ID NO: 9394108 - DNA, 22 bp, Homo sapiens
gcctggcaggggcctgggagtg

SEQ ID NO: 9394109 - DNA, 21 bp, Homo sapiens
gcctggcaggtggaagggctc

SEQ ID NO: 9394110 - DNA, 22 bp, Homo sapiens
gcctggcaggggcctgggagtg

SEQ ID NO: 9394111 - DNA, 22 bp, Homo sapiens
gcctggcaggggcctgggagtg

SEQ ID NO: 9394112 - DNA, 22 bp, Homo sapiens
gcctggcagggcccggacggca

SEQ ID NO: 9394113 - DNA, 22 bp, Homo sapiens
gcctggcagtggggccctggga

SEQ ID NO: 9394114 - DNA, 22 bp, Homo sapiens
gcctggcagtggggccctggga

SEQ ID NO: 9394115 - DNA, 22 bp, Homo sapiens
gcctggcagtgtaattcctgtc

SEQ ID NO: 9394116 - DNA, 22 bp, Homo sapiens
gcctggcagtgtaattcctgtc

SEQ ID NO: 9394117 - DNA, 19 bp, Homo sapiens
gcctggcagtgtacaaggc

SEQ ID NO: 9394118 - DNA, 22 bp, Homo sapiens
gcctggcagttgacagtttgct

SEQ ID NO: 9394119 - DNA, 19 bp, Homo sapiens
gcctggcagtgtacaaggc

SEQ ID NO: 9394120 - DNA, 22 bp, Homo sapiens
gcctggcagttgacagtttgct

SEQ ID NO: 9394121 - DNA, 22 bp, Homo sapiens
gcctggcattggagccggggca

SEQ ID NO: 9394122 - DNA, 22 bp, Homo sapiens
gcctggcattggagccggggca

SEQ ID NO: 9394123 - DNA, 22 bp, Homo sapiens
gcctggcatatagtagttgtgc

SEQ ID NO: 9394124 - DNA, 22 bp, Homo sapiens
gcctggcatatagtagttgtgc

SEQ ID NO: 9394125 - DNA, 22 bp, Homo sapiens
gcctggcattacagcactcctg

SEQ ID NO: 9394126 - DNA, 22 bp, Homo sapiens
gcctggcattacagcactcctg

SEQ ID NO: 9394127 - DNA, 17 bp, Homo sapiens
gcctggcccagcctggc

SEQ ID NO: 9394128 - DNA, 17 bp, Homo sapiens
gcctggcccagcctggc

SEQ ID NO: 9394129 - DNA, 17 bp, Homo sapiens
gcctggcccagcctggc

SEQ ID NO: 9394130 - DNA, 17 bp, Homo sapiens
gcctggcccagcctggc

SEQ ID NO: 9394131 - DNA, 17 bp, Homo sapiens
gcctggcccagcctggc

SEQ ID NO: 9394132 - DNA, 23 bp, Homo sapiens
gcctggccaccccagggctgctt

SEQ ID NO: 9394133 - DNA, 23 bp, Homo sapiens
gcctggccaccccagggctgctt

SEQ ID NO: 9394134 - DNA, 23 bp, Homo sapiens
gcctggccaccccagggctgctt

SEQ ID NO: 9394135 - DNA, 22 bp, Homo sapiens
gcctggcccagggctccgcagg

SEQ ID NO: 9394136 - DNA, 22 bp, Homo sapiens
gcctggcccagggctccgcagg

SEQ ID NO: 9394137 - DNA, 22 bp, Homo sapiens
gcctggcccagggctcttgttg

SEQ ID NO: 9394138 - DNA, 22 bp, Homo sapiens
gcctggccgctccgagctccgc

SEQ ID NO: 9394139 - DNA, 22 bp, Homo sapiens
gcctggccgctccgagctccgc

SEQ ID NO: 9394140 - DNA, 22 bp, Homo sapiens
gcctggcctgaactaggaggtg

SEQ ID NO: 9394141 - DNA, 22 bp, Homo sapiens
gcctggccgctccgagctccgc

SEQ ID NO: 9394142 - DNA, 22 bp, Homo sapiens
gcctggccgctccgagctccgc

SEQ ID NO: 9394143 - DNA, 22 bp, Homo sapiens
gcctggcctgaactaggaggtg

SEQ ID NO: 9394144 - DNA, 22 bp, Homo sapiens
gcctgggaaatggtggggtcag

SEQ ID NO: 9394145 - DNA, 22 bp, Homo sapiens
gcctgggaactctgatctcctg

SEQ ID NO: 9394146 - DNA, 21 bp, Homo sapiens
gcctgggaaatctgggaagcc

SEQ ID NO: 9394147 - DNA, 22 bp, Homo sapiens
gcctgggaaagagtagggaaat

SEQ ID NO: 9394148 - DNA, 22 bp, Homo sapiens
gcctgggaaagagtagggaaat

SEQ ID NO: 9394149 - DNA, 20 bp, Homo sapiens
gcctgcctcagctagctgag

SEQ ID NO: 9394150 - DNA, 20 bp, Homo sapiens
gcctgcctcagctagctgag

SEQ ID NO: 9394151 - DNA, 20 bp, Homo sapiens
gcctgcctcagctagctgag

SEQ ID NO: 9394152 - DNA, 23 bp, Homo sapiens
gcctctggagccccagtgctcag

SEQ ID NO: 9394153 - DNA, 20 bp, Homo sapiens
gcctctggagccaaggacca

SEQ ID NO: 9394154 - DNA, 20 bp, Homo sapiens
gcctctggagccaaggacca

SEQ ID NO: 9394155 - DNA, 20 bp, Homo sapiens
gcctctggagccaaggacca

SEQ ID NO: 9394156 - DNA, 20 bp, Homo sapiens
gcctctggagccaaggacca

SEQ ID NO: 9394157 - DNA, 22 bp, Homo sapiens
gcctctggaagaattacatcca

SEQ ID NO: 9394158 - DNA, 22 bp, Homo sapiens
gcctctggaagtgggaaggggt

SEQ ID NO: 9394159 - DNA, 22 bp, Homo sapiens
gcctctggaagtgggaaggggt

SEQ ID NO: 9394160 - DNA, 17 bp, Homo sapiens
gcctctgcttgtgtcat

SEQ ID NO: 9394161 - DNA, 23 bp, Homo sapiens
gcctctggagccccagtgctcag

SEQ ID NO: 9394162 - DNA, 22 bp, Homo sapiens
gcctgccaaaagaagctgctgg

SEQ ID NO: 9394163 - DNA, 18 bp, Homo sapiens
gcctgccaactcctgatc

SEQ ID NO: 9394164 - DNA, 22 bp, Homo sapiens
gcctgccacgcatgcagagtca

SEQ ID NO: 9394165 - DNA, 23 bp, Homo sapiens
gcctgccatatacctggaaacag

SEQ ID NO: 9394166 - DNA, 22 bp, Homo sapiens
gcctgccagccacagtggcagc

SEQ ID NO: 9394167 - DNA, 22 bp, Homo sapiens
gcctgcctgctgtcatctgcct

SEQ ID NO: 9394168 - DNA, 22 bp, Homo sapiens
gcctgcctgctgtcatctgcct

SEQ ID NO: 9394169 - DNA, 22 bp, Homo sapiens
gcctgcctgctgtcatctgcct

SEQ ID NO: 9394170 - DNA, 22 bp, Homo sapiens
gcctgcctgctgtgtgcaagtt

SEQ ID NO: 9394171 - DNA, 22 bp, Homo sapiens
gcctgcctggagcttgaggtga

SEQ ID NO: 9394172 - DNA, 22 bp, Homo sapiens
gcctgcctgctgtgtgcaagtt

SEQ ID NO: 9394173 - DNA, 22 bp, Homo sapiens
gcctgccttcggtgcgcagcgg

SEQ ID NO: 9394174 - DNA, 22 bp, Homo sapiens
gcctgccttcggtgcgcagcgg

SEQ ID NO: 9394175 - DNA, 22 bp, Homo sapiens
gcctgccttcggtgcgcagcgg

SEQ ID NO: 9394176 - DNA, 22 bp, Homo sapiens
gcctgcctttgtgaggaagcgg

SEQ ID NO: 9394177 - DNA, 22 bp, Homo sapiens
gcctgcctgttggctgaggtgc

SEQ ID NO: 9394178 - DNA, 22 bp, Homo sapiens
gcctgccttcggtgcgcagcgg

SEQ ID NO: 9394179 - DNA, 22 bp, Homo sapiens
gcctgctgttaactgcaggaat

SEQ ID NO: 9394180 - DNA, 22 bp, Homo sapiens
gcctgctgttaactgcaggaat

SEQ ID NO: 9394181 - DNA, 21 bp, Homo sapiens
gcctgctgttcaccctgccac

SEQ ID NO: 9394182 - DNA, 21 bp, Homo sapiens
gcctgctgttcaccctgccac

SEQ ID NO: 9394183 - DNA, 22 bp, Homo sapiens
gcctgctgttgagggaagagct

SEQ ID NO: 9394184 - DNA, 22 bp, Homo sapiens
gcctgctttgtgcctgatcttt

SEQ ID NO: 9394185 - DNA, 22 bp, Homo sapiens
gcctggaaacagtgagcgaagg

SEQ ID NO: 9394186 - DNA, 22 bp, Homo sapiens
gcctgcttccttttcatagatg

SEQ ID NO: 9394187 - DNA, 22 bp, Homo sapiens
gcctgcttcctagccttccaag

SEQ ID NO: 9394188 - DNA, 22 bp, Homo sapiens
gcctggaatcatgcaggggtta

SEQ ID NO: 9394189 - DNA, 22 bp, Homo sapiens
gcctggaatgcaatgtgacgaa

SEQ ID NO: 9394190 - DNA, 22 bp, Homo sapiens
gcctggaagtgtgtcgtgggaa

SEQ ID NO: 9394191 - DNA, 22 bp, Homo sapiens
gcctggaagtccagagtacatt

SEQ ID NO: 9394192 - DNA, 22 bp, Homo sapiens
gcctggaaattgaggcacagtt

SEQ ID NO: 9394193 - DNA, 22 bp, Homo sapiens
gcctggaaattgaggcacagtt

SEQ ID NO: 9394194 - DNA, 22 bp, Homo sapiens
gcctgcctttgtgaggaagcgg

SEQ ID NO: 9394195 - DNA, 22 bp, Homo sapiens
gcctgccttttggaggcacatt

SEQ ID NO: 9394196 - DNA, 22 bp, Homo sapiens
gcctgccttttggaggcacatt

SEQ ID NO: 9394197 - DNA, 22 bp, Homo sapiens
gcctgctcagacctagcaggcc

SEQ ID NO: 9394198 - DNA, 22 bp, Homo sapiens
gcctgctctccggatccctgat

SEQ ID NO: 9394199 - DNA, 18 bp, Homo sapiens
gcctgctctgctctcccc

SEQ ID NO: 9394200 - DNA, 22 bp, Homo sapiens
gcctgctgggagacacccccag

SEQ ID NO: 9394201 - DNA, 22 bp, Homo sapiens
gcctggagggtccctctctgga

SEQ ID NO: 9394202 - DNA, 22 bp, Homo sapiens
gcctggagggtccctctctgga

SEQ ID NO: 9394203 - DNA, 22 bp, Homo sapiens
gcctggagggtccctctctgga

SEQ ID NO: 9394204 - DNA, 22 bp, Homo sapiens
gcctggagggtccctctctgga

SEQ ID NO: 9394205 - DNA, 22 bp, Homo sapiens
gcctggagggtccctctctgga

SEQ ID NO: 9394206 - DNA, 22 bp, Homo sapiens
gcctggagggtccctctctgga

SEQ ID NO: 9394207 - DNA, 22 bp, Homo sapiens
gcctggaggggccagggtggta

SEQ ID NO: 9394208 - DNA, 22 bp, Homo sapiens
gcctggaggggccagggtggta

SEQ ID NO: 9394209 - DNA, 22 bp, Homo sapiens
gcctggaggggccagggtggta

SEQ ID NO: 9394210 - DNA, 22 bp, Homo sapiens
gcctggaggggccagggtggta

SEQ ID NO: 9394211 - DNA, 22 bp, Homo sapiens
gcctggaggggacagtctctgg

SEQ ID NO: 9394212 - DNA, 22 bp, Homo sapiens
gcctggaggggccagggtggta

SEQ ID NO: 9394213 - DNA, 22 bp, Homo sapiens
gcctggaggggacagtctctgg

SEQ ID NO: 9394214 - DNA, 22 bp, Homo sapiens
gcctggaggggacagtctctgg

SEQ ID NO: 9394215 - DNA, 22 bp, Homo sapiens
gcctggaggggacagtctctgg

SEQ ID NO: 9394216 - DNA, 22 bp, Homo sapiens
gcctggaggggacagtctctgg

SEQ ID NO: 9394217 - DNA, 22 bp, Homo sapiens
gcctggagggctctagagaggc

SEQ ID NO: 9394218 - DNA, 22 bp, Homo sapiens
gcctggagggctctagagaggc

SEQ ID NO: 9394219 - DNA, 22 bp, Homo sapiens
gcctggaggggacagtctctgg

SEQ ID NO: 9394220 - DNA, 22 bp, Homo sapiens
gcctggagggctctagagaggc

SEQ ID NO: 9394221 - DNA, 22 bp, Homo sapiens
gcctggagggctctagagaggc

SEQ ID NO: 9394222 - DNA, 22 bp, Homo sapiens
gcctggagggatagaatgcaag

SEQ ID NO: 9394223 - DNA, 22 bp, Homo sapiens
gcctggagggatagaatgcaag

SEQ ID NO: 9394224 - DNA, 22 bp, Homo sapiens
gcctggaggcgagaacccaatg

SEQ ID NO: 9394225 - DNA, 22 bp, Homo sapiens
gcctggaggcgagaacccaatg

SEQ ID NO: 9394226 - DNA, 20 bp, Homo sapiens
gcctggaggcagagataaag

SEQ ID NO: 9394227 - DNA, 20 bp, Homo sapiens
gcctggaggcagagataaag

SEQ ID NO: 9394228 - DNA, 22 bp, Homo sapiens
gcctggaggcgagaacccaatg

SEQ ID NO: 9394229 - DNA, 20 bp, Homo sapiens
gcctggaggcagagataaag

SEQ ID NO: 9394230 - DNA, 20 bp, Homo sapiens
gcctggaggcagagataaag

SEQ ID NO: 9394231 - DNA, 22 bp, Homo sapiens
gcctggacaccgcccttgcaga

SEQ ID NO: 9394232 - DNA, 22 bp, Homo sapiens
gcctggagcctcagcaaggagg

SEQ ID NO: 9394233 - DNA, 22 bp, Homo sapiens
gcctggagcctcagcaaggagg

SEQ ID NO: 9394234 - DNA, 22 bp, Homo sapiens
gcctggagcctcagcaaggagg

SEQ ID NO: 9394235 - DNA, 22 bp, Homo sapiens
gcctggagcctcagcaaggagg

SEQ ID NO: 9394236 - DNA, 20 bp, Homo sapiens
gcctggaggcaatgggaaga

SEQ ID NO: 9394237 - DNA, 20 bp, Homo sapiens
gcctggaggcaatgggaaga

SEQ ID NO: 9394238 - DNA, 22 bp, Homo sapiens
gctgaggatatagcaggaacaa

SEQ ID NO: 9394239 - DNA, 22 bp, Homo sapiens
gctgagctgaggcagggctggg

SEQ ID NO: 9394240 - DNA, 22 bp, Homo sapiens
gctgagctagaaaaggaccaca

SEQ ID NO: 9394241 - DNA, 22 bp, Homo sapiens
gctgagctagaaaaggaccaca

SEQ ID NO: 9394242 - DNA, 22 bp, Homo sapiens
gctgagccacaggcagtgcact

SEQ ID NO: 9394243 - DNA, 22 bp, Homo sapiens
gctgagccacaggcagtgcact

SEQ ID NO: 9394244 - DNA, 22 bp, Homo sapiens
gctgagccctcatccctagttt

SEQ ID NO: 9394245 - DNA, 22 bp, Homo sapiens
gctgagccctcatccctagttt

SEQ ID NO: 9394246 - DNA, 22 bp, Homo sapiens
gctgaggattgaagagttgcca

SEQ ID NO: 9394247 - DNA, 20 bp, Homo sapiens
gctgaggattcctggcccct

SEQ ID NO: 9394248 - DNA, 20 bp, Homo sapiens
gctgaggattcctggcccct

SEQ ID NO: 9394249 - DNA, 22 bp, Homo sapiens
gctgaggattacttgaagtcag

SEQ ID NO: 9394250 - DNA, 22 bp, Homo sapiens
gctgaggattacttgaagtcag

SEQ ID NO: 9394251 - DNA, 22 bp, Homo sapiens
gctgaggattacttgaagtcag

SEQ ID NO: 9394252 - DNA, 22 bp, Homo sapiens
gctgaggcaaaccaagaatgta

SEQ ID NO: 9394253 - DNA, 22 bp, Homo sapiens
gctgaggcaaaccaagaatgta

SEQ ID NO: 9394254 - DNA, 22 bp, Homo sapiens
gctgaggcaaaccaagaatgta

SEQ ID NO: 9394255 - DNA, 22 bp, Homo sapiens
gctgaggcaaatagttttaagt

SEQ ID NO: 9394256 - DNA, 22 bp, Homo sapiens
gctgaggcaaatagttttaagt

SEQ ID NO: 9394257 - DNA, 22 bp, Homo sapiens
gctgaggcagtccacccttgtg

SEQ ID NO: 9394258 - DNA, 22 bp, Homo sapiens
gctgaggcaagatttgaaccca

SEQ ID NO: 9394259 - DNA, 22 bp, Homo sapiens
gctgaggcaagatttgaaccca

SEQ ID NO: 9394260 - DNA, 22 bp, Homo sapiens
gctgaggcagtccacccttgtg

SEQ ID NO: 9394261 - DNA, 22 bp, Homo sapiens
gctgcctgctcggctcctggga

SEQ ID NO: 9394262 - DNA, 22 bp, Homo sapiens
gctgcctggaataacggctggc

SEQ ID NO: 9394263 - DNA, 22 bp, Homo sapiens
gctgcctgcttcatgtgggaga

SEQ ID NO: 9394264 - DNA, 22 bp, Homo sapiens
gctgcctgctcacccggcctgg

SEQ ID NO: 9394265 - DNA, 22 bp, Homo sapiens
gctgcctgctcacccggcctgg

SEQ ID NO: 9394266 - DNA, 22 bp, Homo sapiens
gctgcctgatgtccagcaggac

SEQ ID NO: 9394267 - DNA, 22 bp, Homo sapiens
gctgcctgatcatacaccaggg

SEQ ID NO: 9394268 - DNA, 22 bp, Homo sapiens
gctgcctggagctcagcctgcc

SEQ ID NO: 9394269 - DNA, 22 bp, Homo sapiens
gctgcctggagaggcagggatg

SEQ ID NO: 9394270 - DNA, 22 bp, Homo sapiens
gctgcctggagctcagcctgcc

SEQ ID NO: 9394271 - DNA, 22 bp, Homo sapiens
gctgcctggagaggcagggatg

SEQ ID NO: 9394272 - DNA, 22 bp, Homo sapiens
gctgcctggaataacggctggc

SEQ ID NO: 9394273 - DNA, 22 bp, Homo sapiens
gctgcctggagaggcagggatg

SEQ ID NO: 9394274 - DNA, 22 bp, Homo sapiens
gctgcctggagctcagcctgcc

SEQ ID NO: 9394275 - DNA, 22 bp, Homo sapiens
gctgcctggatttgcaatcctc

SEQ ID NO: 9394276 - DNA, 22 bp, Homo sapiens
gctgcctgggcaggaggcgctg

SEQ ID NO: 9394277 - DNA, 22 bp, Homo sapiens
gctgcctgggcaggaggcgctg

SEQ ID NO: 9394278 - DNA, 22 bp, Homo sapiens
gctgcctggctttagtccactt

SEQ ID NO: 9394279 - DNA, 22 bp, Homo sapiens
gctgcctggctttagtccactt

SEQ ID NO: 9394280 - DNA, 22 bp, Homo sapiens
gctgcctggctttagtccactt

SEQ ID NO: 9394281 - DNA, 22 bp, Homo sapiens
gctggagaggggtcactctgag

SEQ ID NO: 9394282 - DNA, 22 bp, Homo sapiens
gctggagaggatcccaaagcca

SEQ ID NO: 9394283 - DNA, 21 bp, Homo sapiens
gctggagagccaggcaggggc

SEQ ID NO: 9394284 - DNA, 21 bp, Homo sapiens
gctggagagccaggcaggggc

SEQ ID NO: 9394285 - DNA, 21 bp, Homo sapiens
gctggagagccaggcaggggc

SEQ ID NO: 9394286 - DNA, 21 bp, Homo sapiens
gctggagagccaggcaggggc

SEQ ID NO: 9394287 - DNA, 21 bp, Homo sapiens
gctggagagccaggcaggggc

SEQ ID NO: 9394288 - DNA, 19 bp, Homo sapiens
gctgctgctcctccctcgc

SEQ ID NO: 9394289 - DNA, 22 bp, Homo sapiens
gctgctctgttaattgctgtaa

SEQ ID NO: 9394290 - DNA, 22 bp, Homo sapiens
gctgctcttgaggggctcactg

SEQ ID NO: 9394291 - DNA, 22 bp, Homo sapiens
gctgctcttgaggggctcactg

SEQ ID NO: 9394292 - DNA, 22 bp, Homo sapiens
gctgctctgggtctgcccagct

SEQ ID NO: 9394293 - DNA, 22 bp, Homo sapiens
gctgctctgggtctgcccagct

SEQ ID NO: 9394294 - DNA, 22 bp, Homo sapiens
gctgctctgtgacagcctccgg

SEQ ID NO: 9394295 - DNA, 22 bp, Homo sapiens
gctgctcttttcagagatgaga

SEQ ID NO: 9394296 - DNA, 22 bp, Homo sapiens
gctgctcttttcagagatgaga

SEQ ID NO: 9394297 - DNA, 20 bp, Homo sapiens
gctgctgagcttccctgggg

SEQ ID NO: 9394298 - DNA, 22 bp, Homo sapiens
gctgctgccgcggccgctggga

SEQ ID NO: 9394299 - DNA, 22 bp, Homo sapiens
gctgctgcatgaacagcggtca

SEQ ID NO: 9394300 - DNA, 22 bp, Homo sapiens
gctgctctcagagctcatgctg

SEQ ID NO: 9394301 - DNA, 22 bp, Homo sapiens
gctgctctacccatgcatctgt

SEQ ID NO: 9394302 - DNA, 20 bp, Homo sapiens
gctgctcgctgcagtcactc

SEQ ID NO: 9394303 - DNA, 22 bp, Homo sapiens
gctgctctacccatgcatctgt

SEQ ID NO: 9394304 - DNA, 22 bp, Homo sapiens
gctgcctgtcccaggatgagga

SEQ ID NO: 9394305 - DNA, 22 bp, Homo sapiens
gctgcctgtcccaggatgagga

SEQ ID NO: 9394306 - DNA, 22 bp, Homo sapiens
gctgcctgtcccaggatgagga

SEQ ID NO: 9394307 - DNA, 22 bp, Homo sapiens
gctgcctgggctggcattccca

SEQ ID NO: 9394308 - DNA, 22 bp, Homo sapiens
gctgcctggtttctcagctgca

SEQ ID NO: 9394309 - DNA, 22 bp, Homo sapiens
gctgcctgggcaggaggcgctg

SEQ ID NO: 9394310 - DNA, 22 bp, Homo sapiens
gctgctctgaaaatgactgttg

SEQ ID NO: 9394311 - DNA, 22 bp, Homo sapiens
gctgctctggctctgcagtgtc

SEQ ID NO: 9394312 - DNA, 22 bp, Homo sapiens
gctgctctggctctgcagtgtc

SEQ ID NO: 9394313 - DNA, 19 bp, Homo sapiens
gctgctctgggtctcatct

SEQ ID NO: 9394314 - DNA, 20 bp, Homo sapiens
gctgctctccacggtctgca

SEQ ID NO: 9394315 - DNA, 20 bp, Homo sapiens
gctgctctccacggtctgca

SEQ ID NO: 9394316 - DNA, 22 bp, Homo sapiens
gctgctctccaagcctccttga

SEQ ID NO: 9394317 - DNA, 22 bp, Homo sapiens
gctgctctccaagcctccttga

SEQ ID NO: 9394318 - DNA, 22 bp, Homo sapiens
gctgctctcatagatggcttca

SEQ ID NO: 9394319 - DNA, 22 bp, Homo sapiens
gctgctctcagagctcatgctg

SEQ ID NO: 9394320 - DNA, 22 bp, Homo sapiens
gctggagagtgaggggagcaag

SEQ ID NO: 9394321 - DNA, 22 bp, Homo sapiens
gctggagatactgctcagtatc

SEQ ID NO: 9394322 - DNA, 22 bp, Homo sapiens
gctggagatactgctcagtatc

SEQ ID NO: 9394323 - DNA, 22 bp, Homo sapiens
gctggagagtgaggggagcaag

SEQ ID NO: 9394324 - DNA, 22 bp, Homo sapiens
gctggagagtgaggggagcaag

SEQ ID NO: 9394325 - DNA, 22 bp, Homo sapiens
gctggagagtagtaagcagtta

SEQ ID NO: 9394326 - DNA, 22 bp, Homo sapiens
gctggagatagaatggccactg

SEQ ID NO: 9394327 - DNA, 22 bp, Homo sapiens
gctggagatactgctcagtatc

SEQ ID NO: 9394328 - DNA, 22 bp, Homo sapiens
gctggagatagaatggccactg

SEQ ID NO: 9394329 - DNA, 22 bp, Homo sapiens
gctggagatagaatggccactg

SEQ ID NO: 9394330 - DNA, 22 bp, Homo sapiens
gctggagatgctatgcagaggg

SEQ ID NO: 9394331 - DNA, 22 bp, Homo sapiens
gctggagatagtaggatccata

SEQ ID NO: 9394332 - DNA, 22 bp, Homo sapiens
gctggagatgctatgcagaggg

SEQ ID NO: 9394333 - DNA, 22 bp, Homo sapiens
gctggagatagtaggatccata

SEQ ID NO: 9394334 - DNA, 22 bp, Homo sapiens
gctggagcgggttcgggccgct

SEQ ID NO: 9394335 - DNA, 22 bp, Homo sapiens
gctggagccttctgctctgttg

SEQ ID NO: 9394336 - DNA, 22 bp, Homo sapiens
gctggagctgagttccctgggc

SEQ ID NO: 9394337 - DNA, 22 bp, Homo sapiens
gctggagctgcagcctgggcct

SEQ ID NO: 9394338 - DNA, 22 bp, Homo sapiens
gctggagctgagttccctgggc

SEQ ID NO: 9394339 - DNA, 22 bp, Homo sapiens
gctggagccttctgctctgttg

SEQ ID NO: 9394340 - DNA, 22 bp, Homo sapiens
gctggagccattggcttggcct

SEQ ID NO: 9394341 - DNA, 22 bp, Homo sapiens
gctggagccaagctgctcttgg

SEQ ID NO: 9394342 - DNA, 22 bp, Homo sapiens
gctggagatgctatgcagaggg

SEQ ID NO: 9394343 - DNA, 22 bp, Homo sapiens
gctggagatgctatgcagaggg

SEQ ID NO: 9394344 - DNA, 22 bp, Homo sapiens
gctggagatgctatgcagaggg

SEQ ID NO: 9394345 - DNA, 22 bp, Homo sapiens
gctggcctgacctgaggctggg

SEQ ID NO: 9394346 - DNA, 22 bp, Homo sapiens
gctggcctgacctgaggctggg

SEQ ID NO: 9394347 - DNA, 22 bp, Homo sapiens
gctggcctgagggccgaggctc

SEQ ID NO: 9394348 - DNA, 22 bp, Homo sapiens
gctggcctgacctgaggctggg

SEQ ID NO: 9394349 - DNA, 22 bp, Homo sapiens
gctggcctgagggccgaggctc

SEQ ID NO: 9394350 - DNA, 22 bp, Homo sapiens
gctggcctctacaggccggcca

SEQ ID NO: 9394351 - DNA, 22 bp, Homo sapiens
gctggcctgaccagccacaggc

SEQ ID NO: 9394352 - DNA, 22 bp, Homo sapiens
gctggccagtgtcccagggatc

SEQ ID NO: 9394353 - DNA, 22 bp, Homo sapiens
gctggccagtgtcccagggatc

SEQ ID NO: 9394354 - DNA, 22 bp, Homo sapiens
gctggccagggctgctcgcgga

SEQ ID NO: 9394355 - DNA, 22 bp, Homo sapiens
gctggccagggctgctcgcgga

SEQ ID NO: 9394356 - DNA, 22 bp, Homo sapiens
gctggccagggctgctcgcgga

SEQ ID NO: 9394357 - DNA, 22 bp, Homo sapiens
gctggagctgcagcctgggcct

SEQ ID NO: 9394358 - DNA, 22 bp, Homo sapiens
gctggcctcatcactgacttct

SEQ ID NO: 9394359 - DNA, 22 bp, Homo sapiens
gctggccgaacggtgccctggc

SEQ ID NO: 9394360 - DNA, 22 bp, Homo sapiens
gctggccgaacggtgccctggc

SEQ ID NO: 9394361 - DNA, 19 bp, Homo sapiens
gctggcccctgggatccag

SEQ ID NO: 9394362 - DNA, 22 bp, Homo sapiens
gctggcctcgcaggcaggatgt

SEQ ID NO: 9394363 - DNA, 22 bp, Homo sapiens
gctggcctttgaggaagctgcg

SEQ ID NO: 9394364 - DNA, 22 bp, Homo sapiens
gctgggagtgggcaagatgaga

SEQ ID NO: 9394365 - DNA, 22 bp, Homo sapiens
gctggcggcagtggtgtctctg

SEQ ID NO: 9394366 - DNA, 22 bp, Homo sapiens
gctggcggcagtggtgtctctg

SEQ ID NO: 9394367 - DNA, 22 bp, Homo sapiens
gctgggagttactgtctccttt

SEQ ID NO: 9394368 - DNA, 22 bp, Homo sapiens
gctgggagtgggcaagatgaga

SEQ ID NO: 9394369 - DNA, 22 bp, Homo sapiens
gctgggatgcgtcttcccaggc

SEQ ID NO: 9394370 - DNA, 22 bp, Homo sapiens
gctgggcaacggaagagagaaa

SEQ ID NO: 9394371 - DNA, 22 bp, Homo sapiens
gctgggatggagactgcagtga

SEQ ID NO: 9394372 - DNA, 22 bp, Homo sapiens
gctgggcaacggaagagagaaa

SEQ ID NO: 9394373 - DNA, 22 bp, Homo sapiens
gctgggagtttgatttgactgg

SEQ ID NO: 9394374 - DNA, 22 bp, Homo sapiens
gctgggagtttgatttgactgg

SEQ ID NO: 9394375 - DNA, 22 bp, Homo sapiens
gctgggagttactgtctccttt

SEQ ID NO: 9394376 - DNA, 22 bp, Homo sapiens
gctgggagttactgtctccttt

SEQ ID NO: 9394377 - DNA, 22 bp, Homo sapiens
gctggcctgggcagaggctatg

SEQ ID NO: 9394378 - DNA, 22 bp, Homo sapiens
gctggcctgggcagaggctatg

SEQ ID NO: 9394379 - DNA, 22 bp, Homo sapiens
gctggcctgggctcaagaccag

SEQ ID NO: 9394380 - DNA, 22 bp, Homo sapiens
gctggcctgggcagcctgtcgg

SEQ ID NO: 9394381 - DNA, 22 bp, Homo sapiens
gctggccttgtgtctgaggaag

SEQ ID NO: 9394382 - DNA, 22 bp, Homo sapiens
gctgggcacctctcccagattg

SEQ ID NO: 9394383 - DNA, 22 bp, Homo sapiens
gctgggcaatgccagagaggag

SEQ ID NO: 9394384 - DNA, 22 bp, Homo sapiens
gctgggcaatgccagagaggag

SEQ ID NO: 9394385 - DNA, 22 bp, Homo sapiens
gctgggcaccggagagacccca

SEQ ID NO: 9394386 - DNA, 22 bp, Homo sapiens
gctgggcaacggaagagagaaa

SEQ ID NO: 9394387 - DNA, 22 bp, Homo sapiens
gctgggcaacgggcagaaagat

SEQ ID NO: 9394388 - DNA, 22 bp, Homo sapiens
gctgggcaacgggcagaaagat

SEQ ID NO: 9394389 - DNA, 22 bp, Homo sapiens
gctgggcaacgggcagaaagat

SEQ ID NO: 9394390 - DNA, 22 bp, Homo sapiens
gctgggcaaggctgaagctacc

SEQ ID NO: 9394391 - DNA, 22 bp, Homo sapiens
gctgggcaaggctgaagctacc

SEQ ID NO: 9394392 - DNA, 22 bp, Homo sapiens
gctgggcaagtgccttgggttt

SEQ ID NO: 9394393 - DNA, 22 bp, Homo sapiens
gctgggcaatgccagagaggag

SEQ ID NO: 9394394 - DNA, 22 bp, Homo sapiens
gctgggcaggcctcgtgagggc

SEQ ID NO: 9394395 - DNA, 22 bp, Homo sapiens
gctgggcagtgagtgagtcctt

SEQ ID NO: 9394396 - DNA, 22 bp, Homo sapiens
gctgggcagtgagtgagtcctt

SEQ ID NO: 9394397 - DNA, 22 bp, Homo sapiens
gctgggcaggcctcgtgagggc

SEQ ID NO: 9394398 - DNA, 22 bp, Homo sapiens
gctgggcagctgaggcctctca

SEQ ID NO: 9394399 - DNA, 22 bp, Homo sapiens
gctgggcagctgaggcctctca

SEQ ID NO: 9394400 - DNA, 22 bp, Homo sapiens
gctgggcagctgaggcctctca

SEQ ID NO: 9394401 - DNA, 22 bp, Homo sapiens
gctgggcagcctggccgctgcc

SEQ ID NO: 9394402 - DNA, 22 bp, Homo sapiens
gctgggcagcccctacagagag

SEQ ID NO: 9394403 - DNA, 22 bp, Homo sapiens
gctgggcagcccctacagagag

SEQ ID NO: 9394404 - DNA, 22 bp, Homo sapiens
gctcactgcaagctctgcctcc

SEQ ID NO: 9394405 - DNA, 22 bp, Homo sapiens
gctcactgcaagctccgcctcc

SEQ ID NO: 9394406 - DNA, 22 bp, Homo sapiens
gctcactgcaagctccgcctcc

SEQ ID NO: 9394407 - DNA, 22 bp, Homo sapiens
gctcactgcaagctctgcctcc

SEQ ID NO: 9394408 - DNA, 22 bp, Homo sapiens
gctcactgccattctctagatg

SEQ ID NO: 9394409 - DNA, 22 bp, Homo sapiens
gctcactgcaagctctgcctcc

SEQ ID NO: 9394410 - DNA, 22 bp, Homo sapiens
gctcactggcctgaagaggacg

SEQ ID NO: 9394411 - DNA, 22 bp, Homo sapiens
gctcactgcctgggcaacaaga

SEQ ID NO: 9394412 - DNA, 22 bp, Homo sapiens
gctcactgcaacctccgccttc

SEQ ID NO: 9394413 - DNA, 22 bp, Homo sapiens
gctcactgcaacctctgcctcc

SEQ ID NO: 9394414 - DNA, 22 bp, Homo sapiens
gctcactgcaacctccgccttc

SEQ ID NO: 9394415 - DNA, 22 bp, Homo sapiens
gctcactgcaacctctgcctcc

SEQ ID NO: 9394416 - DNA, 22 bp, Homo sapiens
gctcactgcaacctctgcctcc

SEQ ID NO: 9394417 - DNA, 22 bp, Homo sapiens
gctcactgcaacctctgcttcc

SEQ ID NO: 9394418 - DNA, 22 bp, Homo sapiens
gctcactgcaacctctgcttcc

SEQ ID NO: 9394419 - DNA, 19 bp, Homo sapiens
gccttaacctgttaagggg

SEQ ID NO: 9394420 - DNA, 19 bp, Homo sapiens
gctcagagccatgggggct

SEQ ID NO: 9394421 - DNA, 22 bp, Homo sapiens
gctcagagcccgaggcttgcat

SEQ ID NO: 9394422 - DNA, 22 bp, Homo sapiens
gctcagagcagatggtactcag

SEQ ID NO: 9394423 - DNA, 22 bp, Homo sapiens
gctcagagcactcagactcagc

SEQ ID NO: 9394424 - DNA, 22 bp, Homo sapiens
gctcagagcatcccagtgaatg

SEQ ID NO: 9394425 - DNA, 22 bp, Homo sapiens
gctcagagcatcccagtgaatg

SEQ ID NO: 9394426 - DNA, 20 bp, Homo sapiens
gctcagagcctgaacttcat

SEQ ID NO: 9394427 - DNA, 22 bp, Homo sapiens
gctcatgggcccagagcagccc

SEQ ID NO: 9394428 - DNA, 22 bp, Homo sapiens
gctcatgactgtaatcccagca

SEQ ID NO: 9394429 - DNA, 22 bp, Homo sapiens
gctcatgactgtaatcccagca

SEQ ID NO: 9394430 - DNA, 22 bp, Homo sapiens
gctcagagatgttcagtagctt

SEQ ID NO: 9394431 - DNA, 22 bp, Homo sapiens
gctcagagatgttcagtagctt

SEQ ID NO: 9394432 - DNA, 22 bp, Homo sapiens
gctcagagatgttcagtagctt

SEQ ID NO: 9394433 - DNA, 22 bp, Homo sapiens
gctcagagcactcagactcagc

SEQ ID NO: 9394434 - DNA, 22 bp, Homo sapiens
gctcagagatgtctgctgcctt

SEQ ID NO: 9394435 - DNA, 22 bp, Homo sapiens
gctcagagataaaactgatcag

SEQ ID NO: 9394436 - DNA, 22 bp, Homo sapiens
gctcagagatggggaatgaaaa

SEQ ID NO: 9394437 - DNA, 19 bp, Homo sapiens
gctcagacattaagcagct

SEQ ID NO: 9394438 - DNA, 22 bp, Homo sapiens
gctcagacagatatttcgagat

SEQ ID NO: 9394439 - DNA, 22 bp, Homo sapiens
gctcagacagatatttcgagat

SEQ ID NO: 9394440 - DNA, 22 bp, Homo sapiens
gctcagaccccaccctggcaga

SEQ ID NO: 9394441 - DNA, 19 bp, Homo sapiens
gctcagacattaagcagct

SEQ ID NO: 9394442 - DNA, 22 bp, Homo sapiens
gctcagaccccaccctggcaga

SEQ ID NO: 9394443 - DNA, 22 bp, Homo sapiens
gctcagactctggcctgatgat

SEQ ID NO: 9394444 - DNA, 22 bp, Homo sapiens
gctcagacctgtaatcttagca

SEQ ID NO: 9394445 - DNA, 22 bp, Homo sapiens
gctcagaccccaccctggcaga

SEQ ID NO: 9394446 - DNA, 22 bp, Homo sapiens
gctcagacctgtaatcttagca

SEQ ID NO: 9394447 - DNA, 22 bp, Homo sapiens
gctcagaagatatttgatgctg

SEQ ID NO: 9394448 - DNA, 22 bp, Homo sapiens
gctccaagatcattttcccatt

SEQ ID NO: 9394449 - DNA, 22 bp, Homo sapiens
gctccactgcccctgggcaccg

SEQ ID NO: 9394450 - DNA, 22 bp, Homo sapiens
gctccactaggaatctgctctt

SEQ ID NO: 9394451 - DNA, 22 bp, Homo sapiens
gctccaaggtatccaccagggt

SEQ ID NO: 9394452 - DNA, 22 bp, Homo sapiens
gctccaagccttctttgttact

SEQ ID NO: 9394453 - DNA, 22 bp, Homo sapiens
gctccacttccttctgccctca

SEQ ID NO: 9394454 - DNA, 22 bp, Homo sapiens
gctccacttgattgttacagca

SEQ ID NO: 9394455 - DNA, 22 bp, Homo sapiens
gctccactgtttattggcagaa

SEQ ID NO: 9394456 - DNA, 22 bp, Homo sapiens
gctccacttgcagctaggcttg

SEQ ID NO: 9394457 - DNA, 22 bp, Homo sapiens
gctccagagtgtggcatctggg

SEQ ID NO: 9394458 - DNA, 22 bp, Homo sapiens
gctccagagtgtggcatctggg

SEQ ID NO: 9394459 - DNA, 22 bp, Homo sapiens
gctccagcacctagagcaggtc

SEQ ID NO: 9394460 - DNA, 22 bp, Homo sapiens
gctccagatgaatgcacttgtt

SEQ ID NO: 9394461 - DNA, 22 bp, Homo sapiens
gctccagatgaatgcacttgtt

SEQ ID NO: 9394462 - DNA, 22 bp, Homo sapiens
gctccagatgaatgcacttgtt

SEQ ID NO: 9394463 - DNA, 22 bp, Homo sapiens
gctccagagtgtggcatctggg

SEQ ID NO: 9394464 - DNA, 22 bp, Homo sapiens
gctccagctcgtggctcccagc

SEQ ID NO: 9394465 - DNA, 22 bp, Homo sapiens
gctccagctcgtggctcccagc

SEQ ID NO: 9394466 - DNA, 22 bp, Homo sapiens
gctccaggaagggaaatctcca

SEQ ID NO: 9394467 - DNA, 22 bp, Homo sapiens
gctccaggaagggaaatctcca

SEQ ID NO: 9394468 - DNA, 22 bp, Homo sapiens
gctcctggccagcacagggccc

SEQ ID NO: 9394469 - DNA, 22 bp, Homo sapiens
gctcctggccagcacagggccc

SEQ ID NO: 9394470 - DNA, 22 bp, Homo sapiens
gctcctggcatcctgcttttaa

SEQ ID NO: 9394471 - DNA, 22 bp, Homo sapiens
gctcctggccagcacagggccc

SEQ ID NO: 9394472 - DNA, 22 bp, Homo sapiens
gctcctggccagcacagggccc

SEQ ID NO: 9394473 - DNA, 22 bp, Homo sapiens
gctcctggctctctgagggctg

SEQ ID NO: 9394474 - DNA, 22 bp, Homo sapiens
gctcctggctctctgagggctg

SEQ ID NO: 9394475 - DNA, 22 bp, Homo sapiens
gctcctggctctctgagggctg

SEQ ID NO: 9394476 - DNA, 22 bp, Homo sapiens
gctcctggctctctgagggctg

SEQ ID NO: 9394477 - DNA, 22 bp, Homo sapiens
gctcctggctccaggcagccaa

SEQ ID NO: 9394478 - DNA, 22 bp, Homo sapiens
gctcctggctccaggcagccaa

SEQ ID NO: 9394479 - DNA, 22 bp, Homo sapiens
gctcctggctccaggcagccaa

SEQ ID NO: 9394480 - DNA, 22 bp, Homo sapiens
gctcctggctccaggcagccaa

SEQ ID NO: 9394481 - DNA, 22 bp, Homo sapiens
gctccaggaggatgaccttcct

SEQ ID NO: 9394482 - DNA, 22 bp, Homo sapiens
gctcctctcccagagctgcagg

SEQ ID NO: 9394483 - DNA, 22 bp, Homo sapiens
gctcctggcaggcagtgtgtgt

SEQ ID NO: 9394484 - DNA, 22 bp, Homo sapiens
gctcctcttatttcatcagggc

SEQ ID NO: 9394485 - DNA, 22 bp, Homo sapiens
gctcctcttatttcatcagggc

SEQ ID NO: 9394486 - DNA, 22 bp, Homo sapiens
gctccaggagctcacagctcgc

SEQ ID NO: 9394487 - DNA, 22 bp, Homo sapiens
gctccaggaggatgaccttcct

SEQ ID NO: 9394488 - DNA, 22 bp, Homo sapiens
gctccaggagagggaagcagat

SEQ ID NO: 9394489 - DNA, 22 bp, Homo sapiens
gctccaggagctcacagctcgc

SEQ ID NO: 9394490 - DNA, 22 bp, Homo sapiens
gctccaggagctcacagctcgc

SEQ ID NO: 9394491 - DNA, 22 bp, Homo sapiens
gctccaggagctcacagctcgc

SEQ ID NO: 9394492 - DNA, 22 bp, Homo sapiens
gctccaggagctcacagctcgc

SEQ ID NO: 9394493 - DNA, 20 bp, Homo sapiens
gctctgccacttagaagctg

SEQ ID NO: 9394494 - DNA, 21 bp, Homo sapiens
gctctgccacttaccagattt

SEQ ID NO: 9394495 - DNA, 17 bp, Homo sapiens
gctctgccaggaaagag

SEQ ID NO: 9394496 - DNA, 17 bp, Homo sapiens
gctctgccaggaaagag

SEQ ID NO: 9394497 - DNA, 22 bp, Homo sapiens
gctctgccagcccaaggcgcag

SEQ ID NO: 9394498 - DNA, 22 bp, Homo sapiens
gctctgcccaggaccgtccttg

SEQ ID NO: 9394499 - DNA, 22 bp, Homo sapiens
gctctgtgtccacagctggaaa

SEQ ID NO: 9394500 - DNA, 22 bp, Homo sapiens
gctctgtgttccctccaggctc

SEQ ID NO: 9394501 - DNA, 22 bp, Homo sapiens
gctcttatattgacatcatgct

SEQ ID NO: 9394502 - DNA, 22 bp, Homo sapiens
gctcttatagtcccagcatgtt

SEQ ID NO: 9394503 - DNA, 22 bp, Homo sapiens
gctcttctaaagaatgtacagg

SEQ ID NO: 9394504 - DNA, 22 bp, Homo sapiens
gctcttctcagattgtacactc

SEQ ID NO: 9394505 - DNA, 22 bp, Homo sapiens
gctcttgaaactggggtttcca

SEQ ID NO: 9394506 - DNA, 22 bp, Homo sapiens
gctctgttgaagtagaatagac

SEQ ID NO: 9394507 - DNA, 22 bp, Homo sapiens
gctctgtgttttgcccaggaga

SEQ ID NO: 9394508 - DNA, 22 bp, Homo sapiens
gctctgtgttttgcccaggaga

SEQ ID NO: 9394509 - DNA, 22 bp, Homo sapiens
gctctgtgttgtcagaggcacc

SEQ ID NO: 9394510 - DNA, 22 bp, Homo sapiens
gctctgtgttgtcagaggcacc

SEQ ID NO: 9394511 - DNA, 20 bp, Homo sapiens
gctgaagaagtagcatgtac

SEQ ID NO: 9394512 - DNA, 22 bp, Homo sapiens
gctgagagtgggtgcagtgctt

SEQ ID NO: 9394513 - DNA, 22 bp, Homo sapiens
gctgagcacagcctgtgtcctc

SEQ ID NO: 9394514 - DNA, 22 bp, Homo sapiens
gctgagagtgtgagatcagatt

SEQ ID NO: 9394515 - DNA, 22 bp, Homo sapiens
gctgagatgtcgttagatatct

SEQ ID NO: 9394516 - DNA, 22 bp, Homo sapiens
gctcttggaagacaggatgtgt

SEQ ID NO: 9394517 - DNA, 22 bp, Homo sapiens
gctgaaatgccttgtaaatatt

SEQ ID NO: 9394518 - DNA, 22 bp, Homo sapiens
gctgaaatgggcactgaaggcc

SEQ ID NO: 9394519 - DNA, 22 bp, Homo sapiens
gctcttgaagtactgggtgttg

SEQ ID NO: 9394520 - DNA, 22 bp, Homo sapiens
gctcttgactcccagttctgtg

SEQ ID NO: 9394521 - DNA, 22 bp, Homo sapiens
gctgaaatgtctttagcagtgt

SEQ ID NO: 9394522 - DNA, 22 bp, Homo sapiens
gctgaaatgtctttagcagtgt

SEQ ID NO: 9394523 - DNA, 22 bp, Homo sapiens
gctgaaattagactgcagaagt

SEQ ID NO: 9394524 - DNA, 22 bp, Homo sapiens
gctgaaatgtttaatttgggag

SEQ ID NO: 9394525 - DNA, 22 bp, Homo sapiens
gctgaaattcagattcctaggc

SEQ ID NO: 9394526 - DNA, 22 bp, Homo sapiens
gctgaaattagactgcagaagt

SEQ ID NO: 9394527 - DNA, 18 bp, Homo sapiens
gctgaaattctaaacaaa

SEQ ID NO: 9394528 - DNA, 22 bp, Homo sapiens
gctgaactacatgaagttgccg

SEQ ID NO: 9394529 - DNA, 19 bp, Homo sapiens
gctgaacaagtcagcaacc

SEQ ID NO: 9394530 - DNA, 22 bp, Homo sapiens
gctcctggcttcactgacatca

SEQ ID NO: 9394531 - DNA, 22 bp, Homo sapiens
gctcctggcttcactgacatca

SEQ ID NO: 9394532 - DNA, 16 bp, Homo sapiens
gctcctgggccctcga

SEQ ID NO: 9394533 - DNA, 22 bp, Homo sapiens
gctcctggctctggccaaggga

SEQ ID NO: 9394534 - DNA, 22 bp, Homo sapiens
gctcctggctctggccaaggga

SEQ ID NO: 9394535 - DNA, 22 bp, Homo sapiens
gctcctggctctggccaaggga

SEQ ID NO: 9394536 - DNA, 19 bp, Homo sapiens
gctcctgggcctcactcat

SEQ ID NO: 9394537 - DNA, 19 bp, Homo sapiens
gctcctgggcctcactcat

SEQ ID NO: 9394538 - DNA, 19 bp, Homo sapiens
gctcctgggcctcactcat

SEQ ID NO: 9394539 - DNA, 22 bp, Homo sapiens
gctcctgggccctgggctaact

SEQ ID NO: 9394540 - DNA, 22 bp, Homo sapiens
gctcctgggccctgggctaact

SEQ ID NO: 9394541 - DNA, 16 bp, Homo sapiens
gctcctgggccctcga

SEQ ID NO: 9394542 - DNA, 16 bp, Homo sapiens
gctcctgggccctcga

SEQ ID NO: 9394543 - DNA, 22 bp, Homo sapiens
gctctgaaaaatggaggttggc

SEQ ID NO: 9394544 - DNA, 22 bp, Homo sapiens
gctctctttgtgccacttaagg

SEQ ID NO: 9394545 - DNA, 22 bp, Homo sapiens
gctctgaaaaatggaggttggc

SEQ ID NO: 9394546 - DNA, 22 bp, Homo sapiens
gctctgagcccccagaagcaga

SEQ ID NO: 9394547 - DNA, 22 bp, Homo sapiens
gctctgagcagggagaaacagg

SEQ ID NO: 9394548 - DNA, 22 bp, Homo sapiens
gctctctttaaactgcatggct

SEQ ID NO: 9394549 - DNA, 22 bp, Homo sapiens
gctctcttggtggctgtcctgg

SEQ ID NO: 9394550 - DNA, 22 bp, Homo sapiens
gctcctgggtgtggctgcccct

SEQ ID NO: 9394551 - DNA, 22 bp, Homo sapiens
gctcctgggtgtggctgcccct

SEQ ID NO: 9394552 - DNA, 22 bp, Homo sapiens
gctcctgggtgtggctgcccct

SEQ ID NO: 9394553 - DNA, 22 bp, Homo sapiens
gctcctgggtgtggctgcccct

SEQ ID NO: 9394554 - DNA, 22 bp, Homo sapiens
gctcctgggctctaccttgcta

SEQ ID NO: 9394555 - DNA, 22 bp, Homo sapiens
gctcctgggctctaccttgcta

SEQ ID NO: 9394556 - DNA, 21 bp, Homo sapiens
gctctgccacttaccagattt

SEQ ID NO: 9394557 - DNA, 22 bp, Homo sapiens
gctctgccaaggacccattctc

SEQ ID NO: 9394558 - DNA, 23 bp, Homo sapiens
gctctgccacttaatagctgtgt

SEQ ID NO: 9394559 - DNA, 18 bp, Homo sapiens
gctctgcaggtgctcggt

SEQ ID NO: 9394560 - DNA, 18 bp, Homo sapiens
gctctgcaggtgctcggt

SEQ ID NO: 9394561 - DNA, 22 bp, Homo sapiens
gctctgccaaggacccattctc

SEQ ID NO: 9394562 - DNA, 22 bp, Homo sapiens
gctctgagtgcatgcttttggg

SEQ ID NO: 9394563 - DNA, 18 bp, Homo sapiens
gctctgcagctgaggctt

SEQ ID NO: 9394564 - DNA, 18 bp, Homo sapiens
gctctgcagctgaggctt

SEQ ID NO: 9394565 - DNA, 18 bp, Homo sapiens
gctctgcagctgaggctt

SEQ ID NO: 9394566 - DNA, 18 bp, Homo sapiens
gctctgcagctgaggctt

SEQ ID NO: 9394567 - DNA, 18 bp, Homo sapiens
gctctgcaggtgctcggt

SEQ ID NO: 9394568 - DNA, 22 bp, Homo sapiens
gctctgagtgatcagctgggaa

SEQ ID NO: 9394569 - DNA, 22 bp, Homo sapiens
gctctgagtgattaaggagctt

SEQ ID NO: 9394570 - DNA, 22 bp, Homo sapiens
gctctgagtgagactagattta

SEQ ID NO: 9394571 - DNA, 23 bp, Homo sapiens
gctctgaggaagttgggcacggg

SEQ ID NO: 9394572 - DNA, 22 bp, Homo sapiens
gctctgagctgtcttgcaggtc

SEQ ID NO: 9394573 - DNA, 22 bp, Homo sapiens
gctctgagccgggggcctgtcc

SEQ ID NO: 9394574 - DNA, 22 bp, Homo sapiens
gctctgagcccccagaagcaga

SEQ ID NO: 9394575 - DNA, 22 bp, Homo sapiens
gctctgaggctgggagcactct

SEQ ID NO: 9394576 - DNA, 22 bp, Homo sapiens
gctctgaggagccaagaatgtg

SEQ ID NO: 9394577 - DNA, 22 bp, Homo sapiens
gctctgaggctgggagcactct

SEQ ID NO: 9394578 - DNA, 22 bp, Homo sapiens
gctctgaggctgtgaggtgctg

SEQ ID NO: 9394579 - DNA, 23 bp, Homo sapiens
gctctgagggcttatccctccca

SEQ ID NO: 9394580 - DNA, 22 bp, Homo sapiens
gatgtatacttttctttctctg

SEQ ID NO: 9394581 - DNA, 22 bp, Homo sapiens
gatgtatacagggttgactcat

SEQ ID NO: 9394582 - DNA, 22 bp, Homo sapiens
gatgtataacctggctatgtta

SEQ ID NO: 9394583 - DNA, 22 bp, Homo sapiens
gatgtatagggccatgacacca

SEQ ID NO: 9394584 - DNA, 22 bp, Homo sapiens
gatgtatagggccatgacacca

SEQ ID NO: 9394585 - DNA, 22 bp, Homo sapiens
gatgtatagctttaactgaccc

SEQ ID NO: 9394586 - DNA, 22 bp, Homo sapiens
gatgtatattctgtgccaggat

SEQ ID NO: 9394587 - DNA, 23 bp, Homo sapiens
gatgtatatatgagccgtcacat

SEQ ID NO: 9394588 - DNA, 22 bp, Homo sapiens
gatgtatatacctggtgtggaa

SEQ ID NO: 9394589 - DNA, 22 bp, Homo sapiens
gatgtatagtatgtaatttctg

SEQ ID NO: 9394590 - DNA, 19 bp, Homo sapiens
gatgtctcctttcattgag

SEQ ID NO: 9394591 - DNA, 22 bp, Homo sapiens
gatgtataacctggctatgtta

SEQ ID NO: 9394592 - DNA, 22 bp, Homo sapiens
gatgtataacctggctatgtta

SEQ ID NO: 9394593 - DNA, 22 bp, Homo sapiens
gatgtagagggaagattttaaa

SEQ ID NO: 9394594 - DNA, 22 bp, Homo sapiens
gatgtacaggagtttttcaagg

SEQ ID NO: 9394595 - DNA, 22 bp, Homo sapiens
gatgtacactcagaaaagtcat

SEQ ID NO: 9394596 - DNA, 22 bp, Homo sapiens
gatgtacatgcaagcacttaga

SEQ ID NO: 9394597 - DNA, 22 bp, Homo sapiens
gatgtacactcagaaaagtcat

SEQ ID NO: 9394598 - DNA, 21 bp, Homo sapiens
gatgtacatcaagcactttgc

SEQ ID NO: 9394599 - DNA, 22 bp, Homo sapiens
gatgtgtctattcaacatgaaa

SEQ ID NO: 9394600 - DNA, 22 bp, Homo sapiens
gatgtgtccttttctccatcca

SEQ ID NO: 9394601 - DNA, 22 bp, Homo sapiens
gatgtgtctccatacaccaccc

SEQ ID NO: 9394602 - DNA, 22 bp, Homo sapiens
gatgtgtctattcaacatgaaa

SEQ ID NO: 9394603 - DNA, 20 bp, Homo sapiens
gatgtgtcctcagcagtggt

SEQ ID NO: 9394604 - DNA, 22 bp, Homo sapiens
gatgtgtccctttcaactcaga

SEQ ID NO: 9394605 - DNA, 22 bp, Homo sapiens
gatgtgtcctagtacgggtggg

SEQ ID NO: 9394606 - DNA, 22 bp, Homo sapiens
gatgtgtccttttctccatcca

SEQ ID NO: 9394607 - DNA, 20 bp, Homo sapiens
gatgtgtcctcagcagtggt

SEQ ID NO: 9394608 - DNA, 22 bp, Homo sapiens
gatgtgtctccgtttcaaggca

SEQ ID NO: 9394609 - DNA, 22 bp, Homo sapiens
gatgtgtctccatacaccaccc

SEQ ID NO: 9394610 - DNA, 22 bp, Homo sapiens
gatgtgtctccgtttcaaggca

SEQ ID NO: 9394611 - DNA, 22 bp, Homo sapiens
gatgtgtctggctcccctgcaa

SEQ ID NO: 9394612 - DNA, 22 bp, Homo sapiens
gatgtgtctggctcccctgcaa

SEQ ID NO: 9394613 - DNA, 22 bp, Homo sapiens
gatgtgtgtgccctgggcctgc

SEQ ID NO: 9394614 - DNA, 22 bp, Homo sapiens
gatgtgtccccagaggattgaa

SEQ ID NO: 9394615 - DNA, 22 bp, Homo sapiens
gatgtgtccccagaggattgaa

SEQ ID NO: 9394616 - DNA, 22 bp, Homo sapiens
gatgtgtccctttcaactcaga

SEQ ID NO: 9394617 - DNA, 22 bp, Homo sapiens
gatgtgtcctagtacgggtggg

SEQ ID NO: 9394618 - DNA, 22 bp, Homo sapiens
gatgtcttaggtaacattctat

SEQ ID NO: 9394619 - DNA, 22 bp, Homo sapiens
gatgtctgggtgaggtctactg

SEQ ID NO: 9394620 - DNA, 22 bp, Homo sapiens
gatggggtccttgacctggcca

SEQ ID NO: 9394621 - DNA, 22 bp, Homo sapiens
gatggggtccttgacctggcca

SEQ ID NO: 9394622 - DNA, 18 bp, Homo sapiens
gatggggtccaggcatag

SEQ ID NO: 9394623 - DNA, 22 bp, Homo sapiens
gatgggtgccccagacaagctg

SEQ ID NO: 9394624 - DNA, 22 bp, Homo sapiens
gatggggttttgccaggctggt

SEQ ID NO: 9394625 - DNA, 22 bp, Homo sapiens
gatggggttttgccaggctggt

SEQ ID NO: 9394626 - DNA, 22 bp, Homo sapiens
gatggggttttgccaggctggt

SEQ ID NO: 9394627 - DNA, 22 bp, Homo sapiens
gatgggtagaagtggaagaggt

SEQ ID NO: 9394628 - DNA, 22 bp, Homo sapiens
gatgggtgccccagacaagctg

SEQ ID NO: 9394629 - DNA, 22 bp, Homo sapiens
gatgggtgggttctgtgagagg

SEQ ID NO: 9394630 - DNA, 22 bp, Homo sapiens
gatgggtggtctcagacttgcc

SEQ ID NO: 9394631 - DNA, 22 bp, Homo sapiens
gatggtctttgtctctgataag

SEQ ID NO: 9394632 - DNA, 22 bp, Homo sapiens
gatggtttatgatagatgggaa

SEQ ID NO: 9394633 - DNA, 22 bp, Homo sapiens
gatggtgtcccaggctcaggct

SEQ ID NO: 9394634 - DNA, 22 bp, Homo sapiens
gatggtttggaatgaagtagct

SEQ ID NO: 9394635 - DNA, 22 bp, Homo sapiens
gatggtttggaatgaagtagct

SEQ ID NO: 9394636 - DNA, 22 bp, Homo sapiens
gatggtttggtaaaagtatgtt

SEQ ID NO: 9394637 - DNA, 22 bp, Homo sapiens
gatggtttggtaaaagtatgtt

SEQ ID NO: 9394638 - DNA, 22 bp, Homo sapiens
gatggtggcaagagccaagtct

SEQ ID NO: 9394639 - DNA, 22 bp, Homo sapiens
gatggtgcaggtgaagtgctgg

SEQ ID NO: 9394640 - DNA, 22 bp, Homo sapiens
gatggtgcaattatcgtgcatg

SEQ ID NO: 9394641 - DNA, 22 bp, Homo sapiens
gatgtaaactgggacttcctag

SEQ ID NO: 9394642 - DNA, 22 bp, Homo sapiens
gatgtacaaagagaggatttca

SEQ ID NO: 9394643 - DNA, 22 bp, Homo sapiens
gatgtacaagattgtaggaatg

SEQ ID NO: 9394644 - DNA, 22 bp, Homo sapiens
gatgtacaagtaaaatatgtgt

SEQ ID NO: 9394645 - DNA, 22 bp, Homo sapiens
gatgtacaagattgtaggaatg

SEQ ID NO: 9394646 - DNA, 22 bp, Homo sapiens
gatgtacaatgtcactatgacc

SEQ ID NO: 9394647 - DNA, 22 bp, Homo sapiens
gatgggctgtctgagcgctgtg

SEQ ID NO: 9394648 - DNA, 22 bp, Homo sapiens
gatgggcagcacagctggccaa

SEQ ID NO: 9394649 - DNA, 22 bp, Homo sapiens
gatgggcgtggcgcgtttggtg

SEQ ID NO: 9394650 - DNA, 20 bp, Homo sapiens
gatgggaatcggagctggta

SEQ ID NO: 9394651 - DNA, 20 bp, Homo sapiens
gatgggaatcggagctggta

SEQ ID NO: 9394652 - DNA, 22 bp, Homo sapiens
gatggctggctatatcagggga

SEQ ID NO: 9394653 - DNA, 22 bp, Homo sapiens
gatggctgtcttctccctgtgt

SEQ ID NO: 9394654 - DNA, 22 bp, Homo sapiens
gatggctggagccagtgctttg

SEQ ID NO: 9394655 - DNA, 22 bp, Homo sapiens
gatggctgccttctccctgtgt

SEQ ID NO: 9394656 - DNA, 22 bp, Homo sapiens
gatggctgcctcctgcggtcct

SEQ ID NO: 9394657 - DNA, 22 bp, Homo sapiens
gatggctaggggactggagtta

SEQ ID NO: 9394658 - DNA, 22 bp, Homo sapiens
gatggcccgctagctggcctct

SEQ ID NO: 9394659 - DNA, 18 bp, Homo sapiens
gatggccatttcaatgtt

SEQ ID NO: 9394660 - DNA, 22 bp, Homo sapiens
gatggaatgtcacttctgtggt

SEQ ID NO: 9394661 - DNA, 18 bp, Homo sapiens
gatggaaagtgtatgagt

SEQ ID NO: 9394662 - DNA, 22 bp, Homo sapiens
gatgctgagctgtatggctggt

SEQ ID NO: 9394663 - DNA, 22 bp, Homo sapiens
gatgctggaagtgctgatcttg

SEQ ID NO: 9394664 - DNA, 22 bp, Homo sapiens
gatgctgggaccacagagtgtt

SEQ ID NO: 9394665 - DNA, 22 bp, Homo sapiens
gatgctgggaccacagagtgtt

SEQ ID NO: 9394666 - DNA, 22 bp, Homo sapiens
gatgcgggcccgctccactgcc

SEQ ID NO: 9394667 - DNA, 22 bp, Homo sapiens
gatgcgggcccgctccactgcc

SEQ ID NO: 9394668 - DNA, 22 bp, Homo sapiens
gatgcgggcccgctccactgcc

SEQ ID NO: 9394669 - DNA, 22 bp, Homo sapiens
gatgctgactttccgctgccac

SEQ ID NO: 9394670 - DNA, 22 bp, Homo sapiens
gatgcctgtggtgagcacacat

SEQ ID NO: 9394671 - DNA, 22 bp, Homo sapiens
gatgcctccaaatgagggcaga

SEQ ID NO: 9394672 - DNA, 22 bp, Homo sapiens
gattagatgactaatgagctgt

SEQ ID NO: 9394673 - DNA, 22 bp, Homo sapiens
gattagctaaactctcaggttc

SEQ ID NO: 9394674 - DNA, 22 bp, Homo sapiens
gattcactcatattttacgttt

SEQ ID NO: 9394675 - DNA, 22 bp, Homo sapiens
gattcactcatattttacgttt

SEQ ID NO: 9394676 - DNA, 22 bp, Homo sapiens
gattcactcatattttacgttt

SEQ ID NO: 9394677 - DNA, 22 bp, Homo sapiens
gattcactcatattttacgttt

SEQ ID NO: 9394678 - DNA, 23 bp, Homo sapiens
gattcacagggtggtttatgggg

SEQ ID NO: 9394679 - DNA, 22 bp, Homo sapiens
gattctttacatctctgctgac

SEQ ID NO: 9394680 - DNA, 22 bp, Homo sapiens
gattctttactcagattttgtt

SEQ ID NO: 9394681 - DNA, 22 bp, Homo sapiens
gattctttggcctttattgaca

SEQ ID NO: 9394682 - DNA, 22 bp, Homo sapiens
gattaattcaggatcaggaaat

SEQ ID NO: 9394683 - DNA, 22 bp, Homo sapiens
gattaagattacatatttaagt

SEQ ID NO: 9394684 - DNA, 22 bp, Homo sapiens
gatgttgatttgattaaggctt

SEQ ID NO: 9394685 - DNA, 22 bp, Homo sapiens
gatgttgattcttactctcaat

SEQ ID NO: 9394686 - DNA, 22 bp, Homo sapiens
gatgttgagtatcaatgcttta

SEQ ID NO: 9394687 - DNA, 17 bp, Homo sapiens
gatgttgaatctcttta

SEQ ID NO: 9394688 - DNA, 22 bp, Homo sapiens
gatgtgtttccaggatttgttt

SEQ ID NO: 9394689 - DNA, 22 bp, Homo sapiens
gatgtgtgtgccctgggcctgc

SEQ ID NO: 9394690 - DNA, 21 bp, Homo sapiens
gatttataagccttaagccta

SEQ ID NO: 9394691 - DNA, 22 bp, Homo sapiens
gatttataaaggttgcactgga

SEQ ID NO: 9394692 - DNA, 22 bp, Homo sapiens
gatttacaggttaggtcctgta

SEQ ID NO: 9394693 - DNA, 22 bp, Homo sapiens
gatttacaggttaggtcctgta

SEQ ID NO: 9394694 - DNA, 22 bp, Homo sapiens
gatttacagctatacccaatgg

SEQ ID NO: 9394695 - DNA, 22 bp, Homo sapiens
gatttacagctatacccaatgg

SEQ ID NO: 9394696 - DNA, 22 bp, Homo sapiens
gatttacagctatacccaatgg

SEQ ID NO: 9394697 - DNA, 22 bp, Homo sapiens
gatttacagatctaagggtcac

SEQ ID NO: 9394698 - DNA, 22 bp, Homo sapiens
gatttattgtccctgtcctgct

SEQ ID NO: 9394699 - DNA, 22 bp, Homo sapiens
gatttattgtccctgtcctgct

SEQ ID NO: 9394700 - DNA, 22 bp, Homo sapiens
gatttatttttaatcagcaggg

SEQ ID NO: 9394701 - DNA, 22 bp, Homo sapiens
gatttatttttaatcagcaggg

SEQ ID NO: 9394702 - DNA, 22 bp, Homo sapiens
gatttatttttaatcagcaggg

SEQ ID NO: 9394703 - DNA, 22 bp, Homo sapiens
gatttatttttaatcagcaggg

SEQ ID NO: 9394704 - DNA, 22 bp, Homo sapiens
gatttatttttaatcagcaggg

SEQ ID NO: 9394705 - DNA, 22 bp, Homo sapiens
gatttattggtctttcattggt

SEQ ID NO: 9394706 - DNA, 22 bp, Homo sapiens
gatttattggtctttcattggt

SEQ ID NO: 9394707 - DNA, 22 bp, Homo sapiens
gatttattgtccctgtcctgct

SEQ ID NO: 9394708 - DNA, 22 bp, Homo sapiens
gatttattgtccctgtcctgct

SEQ ID NO: 9394709 - DNA, 22 bp, Homo sapiens
gatttattggtctttcattggt

SEQ ID NO: 9394710 - DNA, 22 bp, Homo sapiens
gatttattggtctttcattggt

SEQ ID NO: 9394711 - DNA, 22 bp, Homo sapiens
gatttatagtatgtgctttcag

SEQ ID NO: 9394712 - DNA, 22 bp, Homo sapiens
gatttatagtatgtgctttcag

SEQ ID NO: 9394713 - DNA, 22 bp, Homo sapiens
gatttaaagtagacctttgttt

SEQ ID NO: 9394714 - DNA, 22 bp, Homo sapiens
gatttacaaagctctctagtgt

SEQ ID NO: 9394715 - DNA, 22 bp, Homo sapiens
gatttacagatctaagggtcac

SEQ ID NO: 9394716 - DNA, 22 bp, Homo sapiens
gatttacagatctaagggtcac

SEQ ID NO: 9394717 - DNA, 22 bp, Homo sapiens
gatttacaaagctctctagtgt

SEQ ID NO: 9394718 - DNA, 22 bp, Homo sapiens
gattgtggaagtcagtggttct

SEQ ID NO: 9394719 - DNA, 22 bp, Homo sapiens
gattgtggaagtcagtggttct

SEQ ID NO: 9394720 - DNA, 22 bp, Homo sapiens
gattgttgcctggctttgacct

SEQ ID NO: 9394721 - DNA, 22 bp, Homo sapiens
gattgtggaagtcagtggttct

SEQ ID NO: 9394722 - DNA, 22 bp, Homo sapiens
gatttaaagtagacctttgttt

SEQ ID NO: 9394723 - DNA, 19 bp, Homo sapiens
gatttaaacgtggctctat

SEQ ID NO: 9394724 - DNA, 19 bp, Homo sapiens
gatttaaacgtggctctat

SEQ ID NO: 9394725 - DNA, 22 bp, Homo sapiens
gattgcattgatttgctccaag

SEQ ID NO: 9394726 - DNA, 22 bp, Homo sapiens
gattgctgggattggtactgat

SEQ ID NO: 9394727 - DNA, 22 bp, Homo sapiens
gattgaatcatatgaaattgtg

SEQ ID NO: 9394728 - DNA, 22 bp, Homo sapiens
gattgagtctgaggatgctgca

SEQ ID NO: 9394729 - DNA, 22 bp, Homo sapiens
gattgcaaatcattacaaagga

SEQ ID NO: 9394730 - DNA, 22 bp, Homo sapiens
gattggactaaaggcaacagct

SEQ ID NO: 9394731 - DNA, 22 bp, Homo sapiens
gattggaaatggaaatggtaaa

SEQ ID NO: 9394732 - DNA, 22 bp, Homo sapiens
gattggttgaaagtagaatact

SEQ ID NO: 9394733 - DNA, 21 bp, Homo sapiens
gattggttcactcatgttgac

SEQ ID NO: 9394734 - DNA, 22 bp, Homo sapiens
gattgtaaaacagatcattatc

SEQ ID NO: 9394735 - DNA, 22 bp, Homo sapiens
gcacaagaataaccatatttaa

SEQ ID NO: 9394736 - DNA, 22 bp, Homo sapiens
gcacaagcagcccactgacatt

SEQ ID NO: 9394737 - DNA, 22 bp, Homo sapiens
gcacaaggagcagtgtatgaaa

SEQ ID NO: 9394738 - DNA, 22 bp, Homo sapiens
gcacaaaacacattttgacaat

SEQ ID NO: 9394739 - DNA, 22 bp, Homo sapiens
gcacaaaacacattttgacaat

SEQ ID NO: 9394740 - DNA, 22 bp, Homo sapiens
gcacaaaaggtacttcatgtag

SEQ ID NO: 9394741 - DNA, 22 bp, Homo sapiens
gcacaaaaggtacttcatgtag

SEQ ID NO: 9394742 - DNA, 22 bp, Homo sapiens
gcacaaagatgaatacagaatg

SEQ ID NO: 9394743 - DNA, 22 bp, Homo sapiens
gcacaaaggtggaaggaggaag

SEQ ID NO: 9394744 - DNA, 22 bp, Homo sapiens
gcacaaaggtggaaggaggaag

SEQ ID NO: 9394745 - DNA, 22 bp, Homo sapiens
gcaatgcataacagagtgggcc

SEQ ID NO: 9394746 - DNA, 22 bp, Homo sapiens
gcaattacagtggcatgtattt

SEQ ID NO: 9394747 - DNA, 22 bp, Homo sapiens
gcaatataatttgtgggatatc

SEQ ID NO: 9394748 - DNA, 22 bp, Homo sapiens
gcaatatactttctggcagtga

SEQ ID NO: 9394749 - DNA, 20 bp, Homo sapiens
gcaatatatgagtgcaataa

SEQ ID NO: 9394750 - DNA, 22 bp, Homo sapiens
gcaatgagcacccagagggcag

SEQ ID NO: 9394751 - DNA, 22 bp, Homo sapiens
gcaatgcaatctttattatatt

SEQ ID NO: 9394752 - DNA, 22 bp, Homo sapiens
gcaatataaccagttgtcatgc

SEQ ID NO: 9394753 - DNA, 22 bp, Homo sapiens
gcaaacatcttagccatagagt

SEQ ID NO: 9394754 - DNA, 22 bp, Homo sapiens
gattttctgagccttcaaattt

SEQ ID NO: 9394755 - DNA, 22 bp, Homo sapiens
gattttcttgggaaacaatgag

SEQ ID NO: 9394756 - DNA, 22 bp, Homo sapiens
gattttgtcaaattccaaatgt

SEQ ID NO: 9394757 - DNA, 22 bp, Homo sapiens
gattttgaatattaaagaagag

SEQ ID NO: 9394758 - DNA, 22 bp, Homo sapiens
gattttgtcaaattccaaatgt

SEQ ID NO: 9394759 - DNA, 22 bp, Homo sapiens
gatttttatataaagtgagaaa

SEQ ID NO: 9394760 - DNA, 22 bp, Homo sapiens
gattttgtcaaattccaaatgt

SEQ ID NO: 9394761 - DNA, 22 bp, Homo sapiens
gcaaacagaaatgcaggacgct

SEQ ID NO: 9394762 - DNA, 22 bp, Homo sapiens
gcaaacagccaggcgcagaagt

SEQ ID NO: 9394763 - DNA, 22 bp, Homo sapiens
gcaaacatccactgcccttgta

SEQ ID NO: 9394764 - DNA, 22 bp, Homo sapiens
gatttttatataaagtgagaaa

SEQ ID NO: 9394765 - DNA, 22 bp, Homo sapiens
gatttcacccacttcccagtgt

SEQ ID NO: 9394766 - DNA, 22 bp, Homo sapiens
gatttcttctctcccaagagga

SEQ ID NO: 9394767 - DNA, 22 bp, Homo sapiens
gatttcttcatttgtggtgaat

SEQ ID NO: 9394768 - DNA, 22 bp, Homo sapiens
gatttcttgacccctgtctcag

SEQ ID NO: 9394769 - DNA, 22 bp, Homo sapiens
gatttcttgagcaagttgctta

SEQ ID NO: 9394770 - DNA, 22 bp, Homo sapiens
gatttcttgataagtagtgtga

SEQ ID NO: 9394771 - DNA, 22 bp, Homo sapiens
gatttcttgataattcaaatcc

SEQ ID NO: 9394772 - DNA, 22 bp, Homo sapiens
gatttctttgcaagctgtgttc

SEQ ID NO: 9394773 - DNA, 22 bp, Homo sapiens
gatttgcagctagagcaaaggt

SEQ ID NO: 9394774 - DNA, 22 bp, Homo sapiens
gatttgcattctgaaagctacc

SEQ ID NO: 9394775 - DNA, 21 bp, Homo sapiens
gatttgcagaaactagacagg

SEQ ID NO: 9394776 - DNA, 22 bp, Homo sapiens
gatttctttagctcatcagatc

SEQ ID NO: 9394777 - DNA, 22 bp, Homo sapiens
gatttcttgataattcaaatcc

SEQ ID NO: 9394778 - DNA, 22 bp, Homo sapiens
gatttctttatgaagtacagaa

SEQ ID NO: 9394779 - DNA, 22 bp, Homo sapiens
gatttctttatgaagtacagaa

SEQ ID NO: 9394780 - DNA, 22 bp, Homo sapiens
gatttctttaggtgtaatagtg

SEQ ID NO: 9394781 - DNA, 22 bp, Homo sapiens
gatttctttaggtgtaatagtg

SEQ ID NO: 9394782 - DNA, 22 bp, Homo sapiens
gattttcatgataaacttgtga

SEQ ID NO: 9394783 - DNA, 22 bp, Homo sapiens
gattttcattatagctagtttc

SEQ ID NO: 9394784 - DNA, 22 bp, Homo sapiens
gattttcattatagctagtttc

SEQ ID NO: 9394785 - DNA, 22 bp, Homo sapiens
gattttcatttgcactctagaa

SEQ ID NO: 9394786 - DNA, 22 bp, Homo sapiens
gattttcatttgcactctagaa

SEQ ID NO: 9394787 - DNA, 22 bp, Homo sapiens
gattttatctttgtgtgcagta

SEQ ID NO: 9394788 - DNA, 22 bp, Homo sapiens
gattttatctttgtgtgcagta

SEQ ID NO: 9394789 - DNA, 22 bp, Homo sapiens
gattttatcgtcatccttctgg

SEQ ID NO: 9394790 - DNA, 22 bp, Homo sapiens
gattttatcgtcatccttctgg

SEQ ID NO: 9394791 - DNA, 22 bp, Homo sapiens
gattttatctttgtgtgcagta

SEQ ID NO: 9394792 - DNA, 22 bp, Homo sapiens
gattttattagcccaaactttg

SEQ ID NO: 9394793 - DNA, 22 bp, Homo sapiens
gattttatatggcatactgtgg

SEQ ID NO: 9394794 - DNA, 22 bp, Homo sapiens
gattttatagtcaggaaaaaga

SEQ ID NO: 9394795 - DNA, 22 bp, Homo sapiens
gattttaattataggaggtcct

SEQ ID NO: 9394796 - DNA, 22 bp, Homo sapiens
gatttgtctaggtcatgacttt

SEQ ID NO: 9394797 - DNA, 21 bp, Homo sapiens
gattttaaagagactgccaca

SEQ ID NO: 9394798 - DNA, 22 bp, Homo sapiens
gcagaacaacgtaggagtggag

SEQ ID NO: 9394799 - DNA, 21 bp, Homo sapiens
gcagaaaggaatcttaggtcc

SEQ ID NO: 9394800 - DNA, 22 bp, Homo sapiens
gcagaaagctccttgcgatctg

SEQ ID NO: 9394801 - DNA, 22 bp, Homo sapiens
gcagaaagcttagagggtttgc

SEQ ID NO: 9394802 - DNA, 22 bp, Homo sapiens
gcactttatagtagaaagagca

SEQ ID NO: 9394803 - DNA, 22 bp, Homo sapiens
gcactttgtggattgtatttcc

SEQ ID NO: 9394804 - DNA, 22 bp, Homo sapiens
gcacttttcaaagcttcctgtg

SEQ ID NO: 9394805 - DNA, 23 bp, Homo sapiens
gcacttttataggtggggaaaca

SEQ ID NO: 9394806 - DNA, 22 bp, Homo sapiens
gcactttgtggattgtatttcc

SEQ ID NO: 9394807 - DNA, 22 bp, Homo sapiens
gcagaagaccatggtggaaaga

SEQ ID NO: 9394808 - DNA, 22 bp, Homo sapiens
gcagaagaccatggtggaaaga

SEQ ID NO: 9394809 - DNA, 22 bp, Homo sapiens
gcagaagcagaggagcctatga

SEQ ID NO: 9394810 - DNA, 22 bp, Homo sapiens
gcagaagcacaggtgacgggcc

SEQ ID NO: 9394811 - DNA, 22 bp, Homo sapiens
gcagaagcagcagatgggcgca

SEQ ID NO: 9394812 - DNA, 22 bp, Homo sapiens
gcagaagcagggcaggggcaaa

SEQ ID NO: 9394813 - DNA, 22 bp, Homo sapiens
gcagaagctgggcagcgaggtg

SEQ ID NO: 9394814 - DNA, 22 bp, Homo sapiens
gcagaagctgggcagcgaggtg

SEQ ID NO: 9394815 - DNA, 22 bp, Homo sapiens
gcagaagctgggagaagggatt

SEQ ID NO: 9394816 - DNA, 22 bp, Homo sapiens
gcagaagcccggtcagcgcacg

SEQ ID NO: 9394817 - DNA, 22 bp, Homo sapiens
gcagagcagtactctcttgact

SEQ ID NO: 9394818 - DNA, 22 bp, Homo sapiens
gcagaaggatccgcaggtgcaa

SEQ ID NO: 9394819 - DNA, 22 bp, Homo sapiens
gcagagcagtgcttgcccagcg

SEQ ID NO: 9394820 - DNA, 22 bp, Homo sapiens
gcagagcagtactctcttgact

SEQ ID NO: 9394821 - DNA, 22 bp, Homo sapiens
gcagagcagtgcttgcccagcg

SEQ ID NO: 9394822 - DNA, 22 bp, Homo sapiens
gcagaaggatccgcaggtgcaa

SEQ ID NO: 9394823 - DNA, 22 bp, Homo sapiens
gcagaagctgttcgaaggccgc

SEQ ID NO: 9394824 - DNA, 22 bp, Homo sapiens
gcagaagctgttcgaaggccgc

SEQ ID NO: 9394825 - DNA, 22 bp, Homo sapiens
gcagaagctgttcgaaggccgc

SEQ ID NO: 9394826 - DNA, 22 bp, Homo sapiens
gcagaagctgggcagcgaggtg

SEQ ID NO: 9394827 - DNA, 22 bp, Homo sapiens
gcagagcatgtcctcaggacag

SEQ ID NO: 9394828 - DNA, 22 bp, Homo sapiens
gcagagcatgtcctcaggacag

SEQ ID NO: 9394829 - DNA, 18 bp, Homo sapiens
gcagagcatcaagggtta

SEQ ID NO: 9394830 - DNA, 22 bp, Homo sapiens
gcagagccagaatggccaggac

SEQ ID NO: 9394831 - DNA, 22 bp, Homo sapiens
gcagagcattggagggaccctg

SEQ ID NO: 9394832 - DNA, 22 bp, Homo sapiens
gcagagcatttcggttgcttcc

SEQ ID NO: 9394833 - DNA, 22 bp, Homo sapiens
gcagagcatgtcctcaggacag

SEQ ID NO: 9394834 - DNA, 22 bp, Homo sapiens
gcagagcattggagggaccctg

SEQ ID NO: 9394835 - DNA, 22 bp, Homo sapiens
gcagagcattggagggaccctg

SEQ ID NO: 9394836 - DNA, 22 bp, Homo sapiens
gcagagccccattgctggcggg

SEQ ID NO: 9394837 - DNA, 22 bp, Homo sapiens
gcagagccaggctggggcaggt

SEQ ID NO: 9394838 - DNA, 22 bp, Homo sapiens
gcagagccaggagcccaggatc

SEQ ID NO: 9394839 - DNA, 22 bp, Homo sapiens
gcagagccaggagcccaggatc

SEQ ID NO: 9394840 - DNA, 22 bp, Homo sapiens
gcaccgccttggaccgcccgct

SEQ ID NO: 9394841 - DNA, 22 bp, Homo sapiens
gcaccgccttggaccgcccgct

SEQ ID NO: 9394842 - DNA, 22 bp, Homo sapiens
gcaccctgagtgttcagctcca

SEQ ID NO: 9394843 - DNA, 19 bp, Homo sapiens
gcaccccatcttcctcctg

SEQ ID NO: 9394844 - DNA, 22 bp, Homo sapiens
gcaccctctgagctccgctccg

SEQ ID NO: 9394845 - DNA, 19 bp, Homo sapiens
gcaccctgaggtcatggcc

SEQ ID NO: 9394846 - DNA, 22 bp, Homo sapiens
gcacccctggacggtagggcca

SEQ ID NO: 9394847 - DNA, 22 bp, Homo sapiens
gcacccctggacggtagggcca

SEQ ID NO: 9394848 - DNA, 22 bp, Homo sapiens
gcacctggctgcccaggtggag

SEQ ID NO: 9394849 - DNA, 22 bp, Homo sapiens
gcacctggacagtgaccctagc

SEQ ID NO: 9394850 - DNA, 22 bp, Homo sapiens
gcacctggacagtgaccctagc

SEQ ID NO: 9394851 - DNA, 22 bp, Homo sapiens
gcacctgattgatttcactgct

SEQ ID NO: 9394852 - DNA, 22 bp, Homo sapiens
gcacctcattttgcaggtagaa

SEQ ID NO: 9394853 - DNA, 22 bp, Homo sapiens
gcacctccaggggccgcccacc

SEQ ID NO: 9394854 - DNA, 22 bp, Homo sapiens
gcacacacatgtgagtacatgc

SEQ ID NO: 9394855 - DNA, 22 bp, Homo sapiens
gcacacacatgtgagtacatgc

SEQ ID NO: 9394856 - DNA, 22 bp, Homo sapiens
gcacacactgttttcctcacat

SEQ ID NO: 9394857 - DNA, 22 bp, Homo sapiens
gcacacactgttttcctcacat

SEQ ID NO: 9394858 - DNA, 22 bp, Homo sapiens
gcacacactgttttcctcacat

SEQ ID NO: 9394859 - DNA, 16 bp, Homo sapiens
gcacacacatcaatga

SEQ ID NO: 9394860 - DNA, 22 bp, Homo sapiens
gcacaatttgactctattcata

SEQ ID NO: 9394861 - DNA, 16 bp, Homo sapiens
gcacacacatcaatga

SEQ ID NO: 9394862 - DNA, 22 bp, Homo sapiens
gcacaagtttcttcattgttca

SEQ ID NO: 9394863 - DNA, 22 bp, Homo sapiens
gcacccaggcttgggcagcaac

SEQ ID NO: 9394864 - DNA, 22 bp, Homo sapiens
gcacccagtttgtctcagggtt

SEQ ID NO: 9394865 - DNA, 22 bp, Homo sapiens
gcacccagtgggatgcttagca

SEQ ID NO: 9394866 - DNA, 22 bp, Homo sapiens
gcaggagaaatgaagattgggt

SEQ ID NO: 9394867 - DNA, 22 bp, Homo sapiens
gcaggagaaatgaagattgggt

SEQ ID NO: 9394868 - DNA, 22 bp, Homo sapiens
gcaggagaaatgaagattgggt

SEQ ID NO: 9394869 - DNA, 22 bp, Homo sapiens
gcaggagaaatgaagattgggt

SEQ ID NO: 9394870 - DNA, 22 bp, Homo sapiens
gcaggagacaactgtaaggaga

SEQ ID NO: 9394871 - DNA, 22 bp, Homo sapiens
gcaggagacaactgtaaggaga

SEQ ID NO: 9394872 - DNA, 22 bp, Homo sapiens
gcaggagactggctgtggtagt

SEQ ID NO: 9394873 - DNA, 22 bp, Homo sapiens
gcaggagagccagcaggcttcc

SEQ ID NO: 9394874 - DNA, 22 bp, Homo sapiens
gcaggagactggctgtggtagt

SEQ ID NO: 9394875 - DNA, 22 bp, Homo sapiens
gcaggagccacttcagggatgc

SEQ ID NO: 9394876 - DNA, 22 bp, Homo sapiens
gcaggagagccagcaggcttcc

SEQ ID NO: 9394877 - DNA, 22 bp, Homo sapiens
gcaggacattcagtgaatgggc

SEQ ID NO: 9394878 - DNA, 22 bp, Homo sapiens
gcaggacaggcgttggtccagt

SEQ ID NO: 9394879 - DNA, 22 bp, Homo sapiens
gcaggacttgaatccaggcagt

SEQ ID NO: 9394880 - DNA, 22 bp, Homo sapiens
gcaggacttgaatccaggcagt

SEQ ID NO: 9394881 - DNA, 19 bp, Homo sapiens
gcaggactcccagctcctc

SEQ ID NO: 9394882 - DNA, 19 bp, Homo sapiens
gcaggactcccagctcctc

SEQ ID NO: 9394883 - DNA, 22 bp, Homo sapiens
gcaggacttgaatccaggcagt

SEQ ID NO: 9394884 - DNA, 22 bp, Homo sapiens
gcaggactcaaatctgaaggca

SEQ ID NO: 9394885 - DNA, 22 bp, Homo sapiens
gcaggacctggcagatggggca

SEQ ID NO: 9394886 - DNA, 22 bp, Homo sapiens
gcaggacagacccaagcagtct

SEQ ID NO: 9394887 - DNA, 22 bp, Homo sapiens
gcaggacagacccaagcagtct

SEQ ID NO: 9394888 - DNA, 22 bp, Homo sapiens
gcaggacaggcgttggtccagt

SEQ ID NO: 9394889 - DNA, 22 bp, Homo sapiens
gcagctgagagaagaacagggc

SEQ ID NO: 9394890 - DNA, 22 bp, Homo sapiens
gcagctgacatctggctgggcc

SEQ ID NO: 9394891 - DNA, 22 bp, Homo sapiens
gcagctgagagaagaacagggc

SEQ ID NO: 9394892 - DNA, 22 bp, Homo sapiens
gcaggagctcgtttccaggctg

SEQ ID NO: 9394893 - DNA, 22 bp, Homo sapiens
gcaggagctgctctcctgacga

SEQ ID NO: 9394894 - DNA, 22 bp, Homo sapiens
gcaggagttagggtaaaaatga

SEQ ID NO: 9394895 - DNA, 22 bp, Homo sapiens
gcaggagttaggcgtcgtggat

SEQ ID NO: 9394896 - DNA, 22 bp, Homo sapiens
gcaggagccaggccgagctggt

SEQ ID NO: 9394897 - DNA, 22 bp, Homo sapiens
gcaggcaccgcggcggcaggtt

SEQ ID NO: 9394898 - DNA, 22 bp, Homo sapiens
gcaggcaccgcggcggcaggtt

SEQ ID NO: 9394899 - DNA, 22 bp, Homo sapiens
gcaggcaccacggctcaggtct

SEQ ID NO: 9394900 - DNA, 22 bp, Homo sapiens
gcaggcaccgcggcggcaggtt

SEQ ID NO: 9394901 - DNA, 22 bp, Homo sapiens
gcaggcaccacggctcaggtct

SEQ ID NO: 9394902 - DNA, 22 bp, Homo sapiens
gcaggcaccgggttgctcccct

SEQ ID NO: 9394903 - DNA, 22 bp, Homo sapiens
gcaggcaccgggttgctcccct

SEQ ID NO: 9394904 - DNA, 22 bp, Homo sapiens
gcaggcacctcgtggagtggaa

SEQ ID NO: 9394905 - DNA, 22 bp, Homo sapiens
gcaggcactcctaggaccatca

SEQ ID NO: 9394906 - DNA, 23 bp, Homo sapiens
gcaggagttcctggactccagga

SEQ ID NO: 9394907 - DNA, 19 bp, Homo sapiens
gcaggcacagccctgggtg

SEQ ID NO: 9394908 - DNA, 22 bp, Homo sapiens
gcaggcaattttggaaggtcag

SEQ ID NO: 9394909 - DNA, 23 bp, Homo sapiens
gcaggagttcctggactccagga

SEQ ID NO: 9394910 - DNA, 22 bp, Homo sapiens
gcaggagttcaattgcccatga

SEQ ID NO: 9394911 - DNA, 22 bp, Homo sapiens
gcaggagttagggtaaaaatga

SEQ ID NO: 9394912 - DNA, 22 bp, Homo sapiens
gcaggagttcaattgcccatga

SEQ ID NO: 9394913 - DNA, 22 bp, Homo sapiens
gcaggagttcaattgcccatga

SEQ ID NO: 9394914 - DNA, 22 bp, Homo sapiens
gcaggcaccacggctcaggtct

SEQ ID NO: 9394915 - DNA, 22 bp, Homo sapiens
gcaggcacatgggcgggtctgg

SEQ ID NO: 9394916 - DNA, 22 bp, Homo sapiens
gcaggcacatgggcgggtctgg

SEQ ID NO: 9394917 - DNA, 19 bp, Homo sapiens
gcaggcacagccctgggtg

SEQ ID NO: 9394918 - DNA, 19 bp, Homo sapiens
gcaggcacagccctgggtg

SEQ ID NO: 9394919 - DNA, 19 bp, Homo sapiens
gcaggcacagccctgggtg

SEQ ID NO: 9394920 - DNA, 22 bp, Homo sapiens
gcagctcccttgaacttctcct

SEQ ID NO: 9394921 - DNA, 22 bp, Homo sapiens
gcagctccttcaatctcaccat

SEQ ID NO: 9394922 - DNA, 22 bp, Homo sapiens
gcagctcctcctgggctggaga

SEQ ID NO: 9394923 - DNA, 22 bp, Homo sapiens
gcagctcctggcacagtttttt

SEQ ID NO: 9394924 - DNA, 22 bp, Homo sapiens
gcagctattgtctcctgggccc

SEQ ID NO: 9394925 - DNA, 22 bp, Homo sapiens
gcagctcacagtctccgccatc

SEQ ID NO: 9394926 - DNA, 22 bp, Homo sapiens
gcagctctgacaatgcctggaa

SEQ ID NO: 9394927 - DNA, 22 bp, Homo sapiens
gcagctctctggcctgccctgg

SEQ ID NO: 9394928 - DNA, 22 bp, Homo sapiens
gcagctctgagactctacagaa

SEQ ID NO: 9394929 - DNA, 22 bp, Homo sapiens
gcagctgaatgtccattgctgc

SEQ ID NO: 9394930 - DNA, 22 bp, Homo sapiens
gcagctgaatgtccattgctgc

SEQ ID NO: 9394931 - DNA, 20 bp, Homo sapiens
gcagctgaaagtatgacacc

SEQ ID NO: 9394932 - DNA, 22 bp, Homo sapiens
gcagctgaagctgcagttccag

SEQ ID NO: 9394933 - DNA, 22 bp, Homo sapiens
gcagctgaaagggatctctaca

SEQ ID NO: 9394934 - DNA, 22 bp, Homo sapiens
gcagctgaaagggatctctaca

SEQ ID NO: 9394935 - DNA, 22 bp, Homo sapiens
gcagctgaaagggatctctaca

SEQ ID NO: 9394936 - DNA, 20 bp, Homo sapiens
gcagagcctcactgcaaggg

SEQ ID NO: 9394937 - DNA, 22 bp, Homo sapiens
gcagagcctgggggtctgcgga

SEQ ID NO: 9394938 - DNA, 22 bp, Homo sapiens
gcagagcctgtgtctgagcaaa

SEQ ID NO: 9394939 - DNA, 22 bp, Homo sapiens
gcagagcctgtgtctgagcaaa

SEQ ID NO: 9394940 - DNA, 22 bp, Homo sapiens
gcagagctcatgcctgcacctc

SEQ ID NO: 9394941 - DNA, 22 bp, Homo sapiens
gcagagctcatgcctgcacctc

SEQ ID NO: 9394942 - DNA, 22 bp, Homo sapiens
gcagagctccccaagacaccaa

SEQ ID NO: 9394943 - DNA, 22 bp, Homo sapiens
gcagcctctgatgatggccgta

SEQ ID NO: 9394944 - DNA, 23 bp, Homo sapiens
gcagcgtccgcaccccggccggg

SEQ ID NO: 9394945 - DNA, 22 bp, Homo sapiens
gcagcgctactcacagctctga

SEQ ID NO: 9394946 - DNA, 22 bp, Homo sapiens
gcagcgctactcacagctctga

SEQ ID NO: 9394947 - DNA, 22 bp, Homo sapiens
gcagctaccacccaggaaggac

SEQ ID NO: 9394948 - DNA, 22 bp, Homo sapiens
gcagcgtggggacaggagctca

SEQ ID NO: 9394949 - DNA, 22 bp, Homo sapiens
gcagcgtggggctgagtcagct

SEQ ID NO: 9394950 - DNA, 22 bp, Homo sapiens
gcaggcagaggtggaggagaca

SEQ ID NO: 9394951 - DNA, 22 bp, Homo sapiens
gcaggcagagaaggaacattta

SEQ ID NO: 9394952 - DNA, 22 bp, Homo sapiens
gcaggcagagaggggtttccag

SEQ ID NO: 9394953 - DNA, 22 bp, Homo sapiens
gcaggcagagaaggaacattta

SEQ ID NO: 9394954 - DNA, 17 bp, Homo sapiens
gcaggcactgctgcctg

SEQ ID NO: 9394955 - DNA, 22 bp, Homo sapiens
gcaggcagagaaggaacattta

SEQ ID NO: 9394956 - DNA, 14 bp, Homo sapiens
gcaggcagaccacc

SEQ ID NO: 9394957 - DNA, 22 bp, Homo sapiens
gcaggcactcctaggaccatca

SEQ ID NO: 9394958 - DNA, 22 bp, Homo sapiens
gcaggcactcctaggaccatca

SEQ ID NO: 9394959 - DNA, 21 bp, Homo sapiens
gcaggcactctagaggagctg

SEQ ID NO: 9394960 - DNA, 21 bp, Homo sapiens
gcaggcactctagaggagctg

SEQ ID NO: 9394961 - DNA, 21 bp, Homo sapiens
gcaggcactctagaggagctg

SEQ ID NO: 9394962 - DNA, 17 bp, Homo sapiens
gcaggcactgctgcctg

SEQ ID NO: 9394963 - DNA, 17 bp, Homo sapiens
gcaggcactgctgcctg

SEQ ID NO: 9394964 - DNA, 22 bp, Homo sapiens
gcaggctgccaccttctgagtt

SEQ ID NO: 9394965 - DNA, 22 bp, Homo sapiens
gcaggcagaggtggaggagaca

SEQ ID NO: 9394966 - DNA, 22 bp, Homo sapiens
gcaggctgccctcttgtgttga

SEQ ID NO: 9394967 - DNA, 22 bp, Homo sapiens
gcaggctgccctcttgtgttga

SEQ ID NO: 9394968 - DNA, 22 bp, Homo sapiens
gcaggcagaggtggaggagaca

SEQ ID NO: 9394969 - DNA, 22 bp, Homo sapiens
gcaggcagaggtggaggagaca

SEQ ID NO: 9394970 - DNA, 22 bp, Homo sapiens
gcaggcagaggtggaggagaca

SEQ ID NO: 9394971 - DNA, 22 bp, Homo sapiens
gcaggctgctgagatccttagg

SEQ ID NO: 9394972 - DNA, 22 bp, Homo sapiens
gcaggctgctgagatccttagg

SEQ ID NO: 9394973 - DNA, 22 bp, Homo sapiens
gcaggctggaggctgttctggg

SEQ ID NO: 9394974 - DNA, 22 bp, Homo sapiens
gcaggctggaggctgttctggg

SEQ ID NO: 9394975 - DNA, 22 bp, Homo sapiens
gcaggctggaggctgttctggg

SEQ ID NO: 9394976 - DNA, 22 bp, Homo sapiens
gcaggctggaggctgttctggg

SEQ ID NO: 9394977 - DNA, 21 bp, Homo sapiens
gcaggctggtcaaacctcagt

SEQ ID NO: 9394978 - DNA, 21 bp, Homo sapiens
gcaggctggtcaaacctcagt

SEQ ID NO: 9394979 - DNA, 22 bp, Homo sapiens
gcaggctggggtagccccactt

SEQ ID NO: 9394980 - DNA, 22 bp, Homo sapiens
gcaggctggggtagccccactt

SEQ ID NO: 9394981 - DNA, 22 bp, Homo sapiens
gcaggctggtctgaccatccct

SEQ ID NO: 9394982 - DNA, 22 bp, Homo sapiens
gcaggctggtctgaccatccct

SEQ ID NO: 9394983 - DNA, 22 bp, Homo sapiens
gcaggctggtctgaccatccct

SEQ ID NO: 9394984 - DNA, 21 bp, Homo sapiens
gcaggctggtcaaacctcagt

SEQ ID NO: 9394985 - DNA, 22 bp, Homo sapiens
gcaggcttatggggagacagag

SEQ ID NO: 9394986 - DNA, 22 bp, Homo sapiens
gcaggcttgcccggcctccttc

SEQ ID NO: 9394987 - DNA, 22 bp, Homo sapiens
gcaggcttcccccacacctacg

SEQ ID NO: 9394988 - DNA, 22 bp, Homo sapiens
gcaggcttcaagcacagctttt

SEQ ID NO: 9394989 - DNA, 22 bp, Homo sapiens
gcaggcttcaagcacagctttt

SEQ ID NO: 9394990 - DNA, 18 bp, Homo sapiens
gcaggcttttcctgggtc

SEQ ID NO: 9394991 - DNA, 22 bp, Homo sapiens
gcaggctttgacttggggcagc

SEQ ID NO: 9394992 - DNA, 22 bp, Homo sapiens
gcaggctttgacttggggcaac

SEQ ID NO: 9394993 - DNA, 22 bp, Homo sapiens
gcagggaaacaggtgctaagga

SEQ ID NO: 9394994 - DNA, 22 bp, Homo sapiens
gcagggaagacccggagcagcg

SEQ ID NO: 9394995 - DNA, 22 bp, Homo sapiens
gcagggaaacaggtgctaagga

SEQ ID NO: 9394996 - DNA, 22 bp, Homo sapiens
gcaggcttgcccggcctccttc

SEQ ID NO: 9394997 - DNA, 22 bp, Homo sapiens
gcaggcttgggacgagctggag

SEQ ID NO: 9394998 - DNA, 19 bp, Homo sapiens
gcaggcttgggtctcccca

SEQ ID NO: 9394999 - DNA, 19 bp, Homo sapiens
gcaggcttgggtctcccca

SEQ ID NO: 9395000 - DNA, 22 bp, Homo sapiens
gcaggcttgggacgagctggag

SEQ ID NO: 9395001 - DNA, 22 bp, Homo sapiens
gcagggacgccagggacagcaa

SEQ ID NO: 9395002 - DNA, 22 bp, Homo sapiens
gcagggaagacccggagcagcg

SEQ ID NO: 9395003 - DNA, 22 bp, Homo sapiens
gcagggacgcagcactctccgt

SEQ ID NO: 9395004 - DNA, 22 bp, Homo sapiens
gcagggaccttgcccaccctcc

SEQ ID NO: 9395005 - DNA, 22 bp, Homo sapiens
gcagggacgcagcactctccgt

SEQ ID NO: 9395006 - DNA, 22 bp, Homo sapiens
gcagggcacaaggacgcacagg

SEQ ID NO: 9395007 - DNA, 22 bp, Homo sapiens
gcagggcacaaggacgcacagg

SEQ ID NO: 9395008 - DNA, 22 bp, Homo sapiens
gcagggcacacaagaatgataa

SEQ ID NO: 9395009 - DNA, 22 bp, Homo sapiens
gcagggcacaaggacgcacagg

SEQ ID NO: 9395010 - DNA, 22 bp, Homo sapiens
gcagggcacacaagaatgataa

SEQ ID NO: 9395011 - DNA, 22 bp, Homo sapiens
gcagggcacacaagaatgataa

SEQ ID NO: 9395012 - DNA, 22 bp, Homo sapiens
gcagggcacaaggacgcacagg

SEQ ID NO: 9395013 - DNA, 22 bp, Homo sapiens
gcagggcaatgatcccgagagg

SEQ ID NO: 9395014 - DNA, 22 bp, Homo sapiens
gcagggcaatgatcccgagagg

SEQ ID NO: 9395015 - DNA, 22 bp, Homo sapiens
gcagggcaaatgtggaaaggag

SEQ ID NO: 9395016 - DNA, 22 bp, Homo sapiens
gcagggcaaatgtggaaaggag

SEQ ID NO: 9395017 - DNA, 22 bp, Homo sapiens
gcagggcaaacccaggtgttca

SEQ ID NO: 9395018 - DNA, 22 bp, Homo sapiens
gcagggcaaatgtggaaaggag

SEQ ID NO: 9395019 - DNA, 20 bp, Homo sapiens
gcagggcaagggatatgaaa

SEQ ID NO: 9395020 - DNA, 20 bp, Homo sapiens
gcagggcaagggatatgaaa

SEQ ID NO: 9395021 - DNA, 22 bp, Homo sapiens
gcagggcaaatgtggaaaggag

SEQ ID NO: 9395022 - DNA, 22 bp, Homo sapiens
gcagggcagaaggtgctgagga

SEQ ID NO: 9395023 - DNA, 22 bp, Homo sapiens
gcagggcagaaggtgctgagga

SEQ ID NO: 9395024 - DNA, 22 bp, Homo sapiens
gcagggcagaaggtgctgagga

SEQ ID NO: 9395025 - DNA, 22 bp, Homo sapiens
gcagggcacagacagtgccaag

SEQ ID NO: 9395026 - DNA, 22 bp, Homo sapiens
gcagggcacagacagtgccaag

SEQ ID NO: 9395027 - DNA, 22 bp, Homo sapiens
gcagggcacagacagtgccaag

SEQ ID NO: 9395028 - DNA, 22 bp, Homo sapiens
gcagggcagagggagaatctct

SEQ ID NO: 9395029 - DNA, 22 bp, Homo sapiens
gcagggcagagggagaatctct

SEQ ID NO: 9395030 - DNA, 22 bp, Homo sapiens
gcagggcagacctccagcctat

SEQ ID NO: 9395031 - DNA, 22 bp, Homo sapiens
gcagggcagacctccagcctat

SEQ ID NO: 9395032 - DNA, 22 bp, Homo sapiens
gcagggcagaaggtgctgagga

SEQ ID NO: 9395033 - DNA, 22 bp, Homo sapiens
gcagggcagaaggtgctgagga

SEQ ID NO: 9395034 - DNA, 22 bp, Homo sapiens
gcagggcagacctccagcctat

SEQ ID NO: 9395035 - DNA, 22 bp, Homo sapiens
gcaggggctaaggacacagaga

SEQ ID NO: 9395036 - DNA, 22 bp, Homo sapiens
gcaggggcggctgggtttccag

SEQ ID NO: 9395037 - DNA, 22 bp, Homo sapiens
gcaggggctactctgagcttcc

SEQ ID NO: 9395038 - DNA, 22 bp, Homo sapiens
gcagggcagccacaggccccct

SEQ ID NO: 9395039 - DNA, 22 bp, Homo sapiens
gcagggcagccacaggccccct

SEQ ID NO: 9395040 - DNA, 22 bp, Homo sapiens
gcaggggcaggagatctcaggc

SEQ ID NO: 9395041 - DNA, 22 bp, Homo sapiens
gcaggggctgagcaccagcggg

SEQ ID NO: 9395042 - DNA, 22 bp, Homo sapiens
gcaggggctgagcaccagcggg

SEQ ID NO: 9395043 - DNA, 22 bp, Homo sapiens
gcaggggctgagcaccagcggg

SEQ ID NO: 9395044 - DNA, 22 bp, Homo sapiens
gcaggggctgctgggaactcgg

SEQ ID NO: 9395045 - DNA, 22 bp, Homo sapiens
gcagggggtcattcacgctggc

SEQ ID NO: 9395046 - DNA, 22 bp, Homo sapiens
gcagggtgaaggtcacatagaa

SEQ ID NO: 9395047 - DNA, 22 bp, Homo sapiens
gcagggtgacgttgcccacctc

SEQ ID NO: 9395048 - DNA, 22 bp, Homo sapiens
gcagggggtcattcacgctggc

SEQ ID NO: 9395049 - DNA, 22 bp, Homo sapiens
gcagggggtcattcacgctggc

SEQ ID NO: 9395050 - DNA, 20 bp, Homo sapiens
gccagaggccggcaggggct

SEQ ID NO: 9395051 - DNA, 22 bp, Homo sapiens
gccacaggctccagcatcagta

SEQ ID NO: 9395052 - DNA, 22 bp, Homo sapiens
gccacaggcacttaagggctgg

SEQ ID NO: 9395053 - DNA, 22 bp, Homo sapiens
gccacaggctccagcatcagta

SEQ ID NO: 9395054 - DNA, 22 bp, Homo sapiens
gccagatgccgtaaagatgggc

SEQ ID NO: 9395055 - DNA, 22 bp, Homo sapiens
gccagatgtagatagcaaggta

SEQ ID NO: 9395056 - DNA, 22 bp, Homo sapiens
gccagatgtagatagcaaggta

SEQ ID NO: 9395057 - DNA, 22 bp, Homo sapiens
gccagatttacagatttgccct

SEQ ID NO: 9395058 - DNA, 22 bp, Homo sapiens
gccacagcttagatcacagcct

SEQ ID NO: 9395059 - DNA, 22 bp, Homo sapiens
gccacagcttttaacctcgggg

SEQ ID NO: 9395060 - DNA, 22 bp, Homo sapiens
gccacaggaaagcaccctggag

SEQ ID NO: 9395061 - DNA, 22 bp, Homo sapiens
gccacaggcacttaagggctgg

SEQ ID NO: 9395062 - DNA, 22 bp, Homo sapiens
gccacaggaaagcaccctggag

SEQ ID NO: 9395063 - DNA, 22 bp, Homo sapiens
gccacagcttagatcacagcct

SEQ ID NO: 9395064 - DNA, 22 bp, Homo sapiens
gccacagcttagatcacagcct

SEQ ID NO: 9395065 - DNA, 22 bp, Homo sapiens
gccacagcggggccgctagagc

SEQ ID NO: 9395066 - DNA, 22 bp, Homo sapiens
gccagcagggaagccttgggct

SEQ ID NO: 9395067 - DNA, 22 bp, Homo sapiens
gccagcagcttcttctcatcct

SEQ ID NO: 9395068 - DNA, 22 bp, Homo sapiens
gccagcagctgtggggtggcca

SEQ ID NO: 9395069 - DNA, 22 bp, Homo sapiens
gccagcagctcttgggcgggca

SEQ ID NO: 9395070 - DNA, 22 bp, Homo sapiens
gccagcagctgtggggtggcca

SEQ ID NO: 9395071 - DNA, 22 bp, Homo sapiens
gccagcagcccagaaggacttt

SEQ ID NO: 9395072 - DNA, 22 bp, Homo sapiens
gccagcagcccagaaggacttt

SEQ ID NO: 9395073 - DNA, 22 bp, Homo sapiens
gccagcagcccagaaggacttt

SEQ ID NO: 9395074 - DNA, 22 bp, Homo sapiens
gccagcagccacagaagtcact

SEQ ID NO: 9395075 - DNA, 22 bp, Homo sapiens
gccagcagccacagaagtcact

SEQ ID NO: 9395076 - DNA, 19 bp, Homo sapiens
gccagcagaatgatgaggc

SEQ ID NO: 9395077 - DNA, 22 bp, Homo sapiens
gccagcaccttctcatatgttt

SEQ ID NO: 9395078 - DNA, 20 bp, Homo sapiens
gccagcacagggagcagttc

SEQ ID NO: 9395079 - DNA, 22 bp, Homo sapiens
gccagcaagtatcaccaaagcc

SEQ ID NO: 9395080 - DNA, 19 bp, Homo sapiens
gccagcacatgtcttctag

SEQ ID NO: 9395081 - DNA, 19 bp, Homo sapiens
gccagcacccagctgtgtc

SEQ ID NO: 9395082 - DNA, 19 bp, Homo sapiens
gccagcacccagctgtgtc

SEQ ID NO: 9395083 - DNA, 22 bp, Homo sapiens
gccagcaccttagcatgaatca

SEQ ID NO: 9395084 - DNA, 22 bp, Homo sapiens
gccagcaccagctactagtcac

SEQ ID NO: 9395085 - DNA, 19 bp, Homo sapiens
gccagcacccagctgtgtc

SEQ ID NO: 9395086 - DNA, 20 bp, Homo sapiens
gcatgtgtatggaaggggga

SEQ ID NO: 9395087 - DNA, 22 bp, Homo sapiens
gcatgtgtatggtaggaatatt

SEQ ID NO: 9395088 - DNA, 22 bp, Homo sapiens
gcatgtgtcatctgcctttcgt

SEQ ID NO: 9395089 - DNA, 15 bp, Homo sapiens
gcatgtgtaataggc

SEQ ID NO: 9395090 - DNA, 22 bp, Homo sapiens
gcatgtgtctttatagcagcat

SEQ ID NO: 9395091 - DNA, 22 bp, Homo sapiens
gcatgtgtgagaccttttagca

SEQ ID NO: 9395092 - DNA, 22 bp, Homo sapiens
gcatgtgtccctcagtctgtgc

SEQ ID NO: 9395093 - DNA, 22 bp, Homo sapiens
gcatgtgtctccccagtggagg

SEQ ID NO: 9395094 - DNA, 21 bp, Homo sapiens
gcatgtgtggtgtgctccaca

SEQ ID NO: 9395095 - DNA, 22 bp, Homo sapiens
gcatgtgtgtcactttcctgcc

SEQ ID NO: 9395096 - DNA, 21 bp, Homo sapiens
gcatgtgtgggactggatcct

SEQ ID NO: 9395097 - DNA, 22 bp, Homo sapiens
gcatgtgtggaggagatgtgct

SEQ ID NO: 9395098 - DNA, 22 bp, Homo sapiens
gcatgtgtggaggagatgtgct

SEQ ID NO: 9395099 - DNA, 22 bp, Homo sapiens
gcatgtgtctttatagcagcat

SEQ ID NO: 9395100 - DNA, 22 bp, Homo sapiens
gcatggcttcggggtgctgcct

SEQ ID NO: 9395101 - DNA, 22 bp, Homo sapiens
gcatggcttctgccaggcacct

SEQ ID NO: 9395102 - DNA, 22 bp, Homo sapiens
gcatggcttctgccaggcacct

SEQ ID NO: 9395103 - DNA, 22 bp, Homo sapiens
gcatggcttctgccaggcacct

SEQ ID NO: 9395104 - DNA, 22 bp, Homo sapiens
gcatggttagacatcaatgtga

SEQ ID NO: 9395105 - DNA, 22 bp, Homo sapiens
gcatggtggggagatggcagcc

SEQ ID NO: 9395106 - DNA, 22 bp, Homo sapiens
gcatgtggaatctctccatggt

SEQ ID NO: 9395107 - DNA, 22 bp, Homo sapiens
gcatggtgacatcatgtgaatg

SEQ ID NO: 9395108 - DNA, 22 bp, Homo sapiens
gcatggtggagtctgagcaggg

SEQ ID NO: 9395109 - DNA, 22 bp, Homo sapiens
gccacagcccgagcaccatgag

SEQ ID NO: 9395110 - DNA, 22 bp, Homo sapiens
gccacagccgaacccttgggcc

SEQ ID NO: 9395111 - DNA, 22 bp, Homo sapiens
gccacacttattctcatgcaca

SEQ ID NO: 9395112 - DNA, 22 bp, Homo sapiens
gccacagcaacaataatgcagc

SEQ ID NO: 9395113 - DNA, 22 bp, Homo sapiens
gccacagcagggccctctcagg

SEQ ID NO: 9395114 - DNA, 22 bp, Homo sapiens
gcatgtgttatttctctgtggg

SEQ ID NO: 9395115 - DNA, 22 bp, Homo sapiens
gcatgtgttatttctctgtggg

SEQ ID NO: 9395116 - DNA, 22 bp, Homo sapiens
gcatgtgttattttatgtatga

SEQ ID NO: 9395117 - DNA, 22 bp, Homo sapiens
gcatgtgttagagtgtgcatgc

SEQ ID NO: 9395118 - DNA, 22 bp, Homo sapiens
gcatgtgttagagtgtgcatgc

SEQ ID NO: 9395119 - DNA, 22 bp, Homo sapiens
gcatgtgttcttgaaaggccac

SEQ ID NO: 9395120 - DNA, 22 bp, Homo sapiens
gcatgtgttattttatgtatga

SEQ ID NO: 9395121 - DNA, 22 bp, Homo sapiens
gcatgtgttggtttatgcatgt

SEQ ID NO: 9395122 - DNA, 22 bp, Homo sapiens
gcatgtgttattttatgtatga

SEQ ID NO: 9395123 - DNA, 22 bp, Homo sapiens
gcatgtttcttaagattgcatt

SEQ ID NO: 9395124 - DNA, 22 bp, Homo sapiens
gccaatggctcatgagcaggac

SEQ ID NO: 9395125 - DNA, 22 bp, Homo sapiens
gccaataactgccatttgcttt

SEQ ID NO: 9395126 - DNA, 22 bp, Homo sapiens
gccaataactggttccaaattt

SEQ ID NO: 9395127 - DNA, 22 bp, Homo sapiens
gccaataacctaagatgggtag

SEQ ID NO: 9395128 - DNA, 22 bp, Homo sapiens
gccaataaatggaaaagatgga

SEQ ID NO: 9395129 - DNA, 20 bp, Homo sapiens
gccaataaactgttagcagg

SEQ ID NO: 9395130 - DNA, 22 bp, Homo sapiens
gcagtaggggctggagggctgt

SEQ ID NO: 9395131 - DNA, 18 bp, Homo sapiens
gcagtaggcgcgcaggac

SEQ ID NO: 9395132 - DNA, 22 bp, Homo sapiens
gcagtaggagtttccagggtgg

SEQ ID NO: 9395133 - DNA, 22 bp, Homo sapiens
gcagtaggagaagaggatgctt

SEQ ID NO: 9395134 - DNA, 22 bp, Homo sapiens
gcagtatatccattacttcata

SEQ ID NO: 9395135 - DNA, 22 bp, Homo sapiens
gcagtataagtggattatgtcc

SEQ ID NO: 9395136 - DNA, 19 bp, Homo sapiens
gcaggtgtgaatccgtaga

SEQ ID NO: 9395137 - DNA, 22 bp, Homo sapiens
gcaggtgtcttcatggaactct

SEQ ID NO: 9395138 - DNA, 22 bp, Homo sapiens
gcaggtgtcttcatggaactct

SEQ ID NO: 9395139 - DNA, 22 bp, Homo sapiens
gcaggtgtcttcagcaggatga

SEQ ID NO: 9395140 - DNA, 22 bp, Homo sapiens
gcaggtgtcttcagcaggatga

SEQ ID NO: 9395141 - DNA, 22 bp, Homo sapiens
gcaggtgtgaatgtgaattaag

SEQ ID NO: 9395142 - DNA, 19 bp, Homo sapiens
gcaggtgtgaatccgtaga

SEQ ID NO: 9395143 - DNA, 22 bp, Homo sapiens
gcaggtgtcttcatggaactct

SEQ ID NO: 9395144 - DNA, 22 bp, Homo sapiens
gcaggtgtcttcatggaactct

SEQ ID NO: 9395145 - DNA, 22 bp, Homo sapiens
gcaggtgtgaatgtgaattaag

SEQ ID NO: 9395146 - DNA, 22 bp, Homo sapiens
gcaggtgtcttcagcaggatga

SEQ ID NO: 9395147 - DNA, 22 bp, Homo sapiens
gcaggtgtcctgggctggcagt

SEQ ID NO: 9395148 - DNA, 22 bp, Homo sapiens
gcaggtgtctgactgccttctt

SEQ ID NO: 9395149 - DNA, 22 bp, Homo sapiens
gcaggtgtctgactgccttctt

SEQ ID NO: 9395150 - DNA, 22 bp, Homo sapiens
gcaggtgtcctgggctggcagt

SEQ ID NO: 9395151 - DNA, 22 bp, Homo sapiens
gcaggtgtcagtccccaaggtg

SEQ ID NO: 9395152 - DNA, 22 bp, Homo sapiens
gcaggtgtcagtccccaaggtg

SEQ ID NO: 9395153 - DNA, 22 bp, Homo sapiens
gcaggtgtcctgggctggcagt

SEQ ID NO: 9395154 - DNA, 22 bp, Homo sapiens
gcaggtgtgaatgtgaattaag

SEQ ID NO: 9395155 - DNA, 22 bp, Homo sapiens
gcagtgtccagggtggtctgca

SEQ ID NO: 9395156 - DNA, 22 bp, Homo sapiens
gcagtgtcagtgcctgggtggt

SEQ ID NO: 9395157 - DNA, 22 bp, Homo sapiens
gcagtgggcaacaagagctgga

SEQ ID NO: 9395158 - DNA, 22 bp, Homo sapiens
gcagtgggcctgaggaagggtg

SEQ ID NO: 9395159 - DNA, 22 bp, Homo sapiens
gcagtggggcgctgggagttgg

SEQ ID NO: 9395160 - DNA, 22 bp, Homo sapiens
gcagtggggaatgctggggaga

SEQ ID NO: 9395161 - DNA, 22 bp, Homo sapiens
gcagtggggcaatcatagctca

SEQ ID NO: 9395162 - DNA, 22 bp, Homo sapiens
gcagtggggaatgctggggaga

SEQ ID NO: 9395163 - DNA, 22 bp, Homo sapiens
gcagtggggaatgctggggaga

SEQ ID NO: 9395164 - DNA, 22 bp, Homo sapiens
gcaggtgggggtcggtgcatct

SEQ ID NO: 9395165 - DNA, 22 bp, Homo sapiens
gcaggtgggggtcggtgcatct

SEQ ID NO: 9395166 - DNA, 22 bp, Homo sapiens
gcaggtgggggtcggtgcatct

SEQ ID NO: 9395167 - DNA, 22 bp, Homo sapiens
gcaggtgggggtcggtgcatct

SEQ ID NO: 9395168 - DNA, 22 bp, Homo sapiens
gcaggtggtcactcatccccag

SEQ ID NO: 9395169 - DNA, 22 bp, Homo sapiens
gcaggtggtcactcatccccag

SEQ ID NO: 9395170 - DNA, 22 bp, Homo sapiens
gcaggtggtccccgtggagtgg

SEQ ID NO: 9395171 - DNA, 22 bp, Homo sapiens
gcaggtgggggtcggtgcatct

SEQ ID NO: 9395172 - DNA, 22 bp, Homo sapiens
gcaggtggggctgctaccagaa

SEQ ID NO: 9395173 - DNA, 22 bp, Homo sapiens
gcaggtggggctgctaccagaa

SEQ ID NO: 9395174 - DNA, 22 bp, Homo sapiens
gcaggtggggctgctaccagaa

SEQ ID NO: 9395175 - DNA, 22 bp, Homo sapiens
gcaggtgggggagaagttgtga

SEQ ID NO: 9395176 - DNA, 22 bp, Homo sapiens
gcaggtgggggagaagttgtga

SEQ ID NO: 9395177 - DNA, 22 bp, Homo sapiens
gcaggtgggagccgctgcctga

SEQ ID NO: 9395178 - DNA, 16 bp, Homo sapiens
gcaggtggggcgcgca

SEQ ID NO: 9395179 - DNA, 16 bp, Homo sapiens
gcaggtggggcgcgca

SEQ ID NO: 9395180 - DNA, 22 bp, Homo sapiens
gcaggtggggctgctaccagaa

SEQ ID NO: 9395181 - DNA, 22 bp, Homo sapiens
gcaggtggggctgctaccagaa

SEQ ID NO: 9395182 - DNA, 22 bp, Homo sapiens
gcaggtggtccccgtggagtgg

SEQ ID NO: 9395183 - DNA, 22 bp, Homo sapiens
gcaggtggtggcgcgcgccctg

SEQ ID NO: 9395184 - DNA, 22 bp, Homo sapiens
gcaggtggtccccgtggagtgg

SEQ ID NO: 9395185 - DNA, 22 bp, Homo sapiens
gcaggtggtggggctatgatct

SEQ ID NO: 9395186 - DNA, 22 bp, Homo sapiens
gcaggtggtggcgcgcgccctg

SEQ ID NO: 9395187 - DNA, 22 bp, Homo sapiens
gcaggtggtggcgcgcgccctg

SEQ ID NO: 9395188 - DNA, 22 bp, Homo sapiens
gcaggtggtgggggagccgttc

SEQ ID NO: 9395189 - DNA, 22 bp, Homo sapiens
gcaggtggtgggggagccgttc

SEQ ID NO: 9395190 - DNA, 22 bp, Homo sapiens
gcaggtggtggggctatgatct

SEQ ID NO: 9395191 - DNA, 23 bp, Homo sapiens
gcaggtggttcgaacagaagttt

SEQ ID NO: 9395192 - DNA, 23 bp, Homo sapiens
gcaggtggttcgaacagaagttt

SEQ ID NO: 9395193 - DNA, 23 bp, Homo sapiens
gcaggtggttcgaacagaagttt

SEQ ID NO: 9395194 - DNA, 22 bp, Homo sapiens
gcaggtggttaaggtcccatgt

SEQ ID NO: 9395195 - DNA, 22 bp, Homo sapiens
gcaggtggtgggggagccgttc

SEQ ID NO: 9395196 - DNA, 22 bp, Homo sapiens
gcaggtggtgggggagccgttc

SEQ ID NO: 9395197 - DNA, 22 bp, Homo sapiens
gcaggtggttaaggtcccatgt

SEQ ID NO: 9395198 - DNA, 22 bp, Homo sapiens
gcaggtggttaaggtcccatgt

SEQ ID NO: 9395199 - DNA, 22 bp, Homo sapiens
gcaggtggttaaggtcccatgt

SEQ ID NO: 9395200 - DNA, 22 bp, Homo sapiens
gcaggtggcagaggtgggatct

SEQ ID NO: 9395201 - DNA, 22 bp, Homo sapiens
gcaggtggcagaggtgggatct

SEQ ID NO: 9395202 - DNA, 22 bp, Homo sapiens
gcaggtggattatcagaagtgc

SEQ ID NO: 9395203 - DNA, 22 bp, Homo sapiens
gcaggtggcagaggtgggatct

SEQ ID NO: 9395204 - DNA, 22 bp, Homo sapiens
gcaggtgggagccgctgcctga

SEQ ID NO: 9395205 - DNA, 22 bp, Homo sapiens
gcaggtgggagccgctgcctga

SEQ ID NO: 9395206 - DNA, 22 bp, Homo sapiens
gcaggtgggagccgctgcctga

SEQ ID NO: 9395207 - DNA, 19 bp, Homo sapiens
gcaggtggatgtggtcagc

SEQ ID NO: 9395208 - DNA, 22 bp, Homo sapiens
gcaggtggattatcagaagtgc

SEQ ID NO: 9395209 - DNA, 22 bp, Homo sapiens
gcaggtggattatcagaagtgc

SEQ ID NO: 9395210 - DNA, 19 bp, Homo sapiens
gcaggtggatgtggtcagc

SEQ ID NO: 9395211 - DNA, 22 bp, Homo sapiens
gcaggtggagcagtagtctggt

SEQ ID NO: 9395212 - DNA, 22 bp, Homo sapiens
gcaggtggagcagtagtctggt

SEQ ID NO: 9395213 - DNA, 22 bp, Homo sapiens
gcaggtggagcagtagtctggt

SEQ ID NO: 9395214 - DNA, 22 bp, Homo sapiens
gcaggtggagcagtagtctggt

SEQ ID NO: 9395215 - DNA, 22 bp, Homo sapiens
gcaggtggaagcagcagactca

SEQ ID NO: 9395216 - DNA, 22 bp, Homo sapiens
gcaggtggaagcagcagactca

SEQ ID NO: 9395217 - DNA, 19 bp, Homo sapiens
gcagggtggcagagctctt

SEQ ID NO: 9395218 - DNA, 19 bp, Homo sapiens
gcagggtggcagagctctt

SEQ ID NO: 9395219 - DNA, 22 bp, Homo sapiens
gcagggtggatggcagggccag

SEQ ID NO: 9395220 - DNA, 22 bp, Homo sapiens
gcagggtggatggcagggccag

SEQ ID NO: 9395221 - DNA, 22 bp, Homo sapiens
gcagggtgccgacttcagggat

SEQ ID NO: 9395222 - DNA, 22 bp, Homo sapiens
gcagggtgacgttgcccacctc

SEQ ID NO: 9395223 - DNA, 22 bp, Homo sapiens
gcagggtgatagtgaggctcag

SEQ ID NO: 9395224 - DNA, 22 bp, Homo sapiens
tgtctcttgagtttgttttaat

SEQ ID NO: 9395225 - DNA, 22 bp, Homo sapiens
tgtctcttgagctgcctgatgc

SEQ ID NO: 9395226 - DNA, 18 bp, Homo sapiens
tgtctcttcttatgtggg

SEQ ID NO: 9395227 - DNA, 22 bp, Homo sapiens
tgtctcttctgcctccagctgt

SEQ ID NO: 9395228 - DNA, 18 bp, Homo sapiens
tgtctcttcttatgtggg

SEQ ID NO: 9395229 - DNA, 22 bp, Homo sapiens
cctggcccacatggcttctccc

SEQ ID NO: 9395230 - DNA, 22 bp, Homo sapiens
tgtctcttggattgcttgctct

SEQ ID NO: 9395231 - DNA, 22 bp, Homo sapiens
tgtctcttggagggtctagtga

SEQ ID NO: 9395232 - DNA, 22 bp, Homo sapiens
tgtctcttggagggtctagtga

SEQ ID NO: 9395233 - DNA, 22 bp, Homo sapiens
tgtctcttggattgcttgctct

SEQ ID NO: 9395234 - DNA, 22 bp, Homo sapiens
tgtctcttcagcccatggcttc

SEQ ID NO: 9395235 - DNA, 22 bp, Homo sapiens
tgtctcttactttgattcttgg

SEQ ID NO: 9395236 - DNA, 22 bp, Homo sapiens
tgtctcttcagcccatggcttc

SEQ ID NO: 9395237 - DNA, 22 bp, Homo sapiens
tgtctcttactttgattcttgg

SEQ ID NO: 9395238 - DNA, 22 bp, Homo sapiens
tgtctctgtgcatttgtgcttc

SEQ ID NO: 9395239 - DNA, 22 bp, Homo sapiens
tgtctctgtgcatttgtgcttc

SEQ ID NO: 9395240 - DNA, 22 bp, Homo sapiens
tgtctctgtctcccaggttgtg

SEQ ID NO: 9395241 - DNA, 22 bp, Homo sapiens
tgtctctgtgagatctgacgat

SEQ ID NO: 9395242 - DNA, 22 bp, Homo sapiens
tgtctctgtgagatctgacgat

SEQ ID NO: 9395243 - DNA, 22 bp, Homo sapiens
tgtctctggtattaggtgaaaa

SEQ ID NO: 9395244 - DNA, 22 bp, Homo sapiens
tgtctctgggtgattcagtcct

SEQ ID NO: 9395245 - DNA, 22 bp, Homo sapiens
tgtctctgggtgattcagtcct

SEQ ID NO: 9395246 - DNA, 22 bp, Homo sapiens
tgtctcaggtacatgcgtcctg

SEQ ID NO: 9395247 - DNA, 22 bp, Homo sapiens
tgtctcagtacactccgatgtt

SEQ ID NO: 9395248 - DNA, 22 bp, Homo sapiens
tgtctcagttcccttctctgga

SEQ ID NO: 9395249 - DNA, 19 bp, Homo sapiens
tgtctcagtgtcccttcct

SEQ ID NO: 9395250 - DNA, 19 bp, Homo sapiens
tgtctcagtgtcccttcct

SEQ ID NO: 9395251 - DNA, 22 bp, Homo sapiens
tgtctcagagtatccctgaact

SEQ ID NO: 9395252 - DNA, 22 bp, Homo sapiens
tgtctcagagtgttgtattaga

SEQ ID NO: 9395253 - DNA, 22 bp, Homo sapiens
tgtctcagaatggctcataata

SEQ ID NO: 9395254 - DNA, 18 bp, Homo sapiens
tgtctcaggctgaaacag

SEQ ID NO: 9395255 - DNA, 22 bp, Homo sapiens
tgtctcagatacgccatcaagg

SEQ ID NO: 9395256 - DNA, 22 bp, Homo sapiens
tgtctcaggcccaagccagtaa

SEQ ID NO: 9395257 - DNA, 22 bp, Homo sapiens
tgtcctggatcatgcctctgaa

SEQ ID NO: 9395258 - DNA, 22 bp, Homo sapiens
tgtcctggagacacaaggtggt

SEQ ID NO: 9395259 - DNA, 22 bp, Homo sapiens
tgtcctggacaacagcccctag

SEQ ID NO: 9395260 - DNA, 22 bp, Homo sapiens
tgtcctggacaacagcccctag

SEQ ID NO: 9395261 - DNA, 22 bp, Homo sapiens
tgtcctggaaaaatggagagtt

SEQ ID NO: 9395262 - DNA, 22 bp, Homo sapiens
tgtcctggaaaaatggagagtt

SEQ ID NO: 9395263 - DNA, 22 bp, Homo sapiens
tgtcctggaaaaatggagagtt

SEQ ID NO: 9395264 - DNA, 22 bp, Homo sapiens
tgtcctggatcatgcctctgaa

SEQ ID NO: 9395265 - DNA, 22 bp, Homo sapiens
tgtcctggatcatgcctctgaa

SEQ ID NO: 9395266 - DNA, 22 bp, Homo sapiens
tgtcctggagttataatgcctg

SEQ ID NO: 9395267 - DNA, 22 bp, Homo sapiens
tgtcctggagacacaaggtggt

SEQ ID NO: 9395268 - DNA, 22 bp, Homo sapiens
tgtcctggagacacaaggtggt

SEQ ID NO: 9395269 - DNA, 22 bp, Homo sapiens
tgtcctggagtgcttgggggaa

SEQ ID NO: 9395270 - DNA, 22 bp, Homo sapiens
tgtcctggagtgcttgggggaa

SEQ ID NO: 9395271 - DNA, 22 bp, Homo sapiens
tgtcctggagttataatgcctg

SEQ ID NO: 9395272 - DNA, 22 bp, Homo sapiens
tgtcctctccaacagcctctgt

SEQ ID NO: 9395273 - DNA, 22 bp, Homo sapiens
tgtcctctaattggcctcttgc

SEQ ID NO: 9395274 - DNA, 22 bp, Homo sapiens
tgtcctcttccagtgctccttc

SEQ ID NO: 9395275 - DNA, 22 bp, Homo sapiens
tgtcctctgttaggggatagcg

SEQ ID NO: 9395276 - DNA, 22 bp, Homo sapiens
tgtcctctgttaggggatagcg

SEQ ID NO: 9395277 - DNA, 22 bp, Homo sapiens
tgtcctgcaagccctaatgaat

SEQ ID NO: 9395278 - DNA, 22 bp, Homo sapiens
tgtcctcttccagtgctccttc

SEQ ID NO: 9395279 - DNA, 22 bp, Homo sapiens
tgtcctgcaagccctaatgaat

SEQ ID NO: 9395280 - DNA, 22 bp, Homo sapiens
cctggccttaagggcagggagc

SEQ ID NO: 9395281 - DNA, 22 bp, Homo sapiens
cctggcctgctcggctcttaag

SEQ ID NO: 9395282 - DNA, 22 bp, Homo sapiens
cctggcctggcactccctctgc

SEQ ID NO: 9395283 - DNA, 22 bp, Homo sapiens
cctggcctggcactccctctgc

SEQ ID NO: 9395284 - DNA, 22 bp, Homo sapiens
cctggctcccggaacagggtct

SEQ ID NO: 9395285 - DNA, 22 bp, Homo sapiens
cctggcctcctggccttctcat

SEQ ID NO: 9395286 - DNA, 22 bp, Homo sapiens
cctggcctcagcctagggctga

SEQ ID NO: 9395287 - DNA, 22 bp, Homo sapiens
cctggcctcagacagagggtgg

SEQ ID NO: 9395288 - DNA, 22 bp, Homo sapiens
cctggcctcagacagagggtgg

SEQ ID NO: 9395289 - DNA, 22 bp, Homo sapiens
cctggccgcggagcccttccag

SEQ ID NO: 9395290 - DNA, 22 bp, Homo sapiens
cctggccggtatcccacctcct

SEQ ID NO: 9395291 - DNA, 22 bp, Homo sapiens
cctggccgcggagcccttccag

SEQ ID NO: 9395292 - DNA, 22 bp, Homo sapiens
cctggcccagggactttcgcct

SEQ ID NO: 9395293 - DNA, 22 bp, Homo sapiens
cctggcccacatggcttctccc

SEQ ID NO: 9395294 - DNA, 19 bp, Homo sapiens
cctggccctgctgcgcggg

SEQ ID NO: 9395295 - DNA, 19 bp, Homo sapiens
cctggccctgctgcgcggg

SEQ ID NO: 9395296 - DNA, 22 bp, Homo sapiens
cctggccctggaatagggcagg

SEQ ID NO: 9395297 - DNA, 22 bp, Homo sapiens
cctggctcgctgacctcagggg

SEQ ID NO: 9395298 - DNA, 22 bp, Homo sapiens
cctggctcgctgacctcagggg

SEQ ID NO: 9395299 - DNA, 22 bp, Homo sapiens
cctggctctctgcagatcctgg

SEQ ID NO: 9395300 - DNA, 22 bp, Homo sapiens
cctggctctctgcagatcctgg

SEQ ID NO: 9395301 - DNA, 22 bp, Homo sapiens
cctggctcctgcacagatcttt

SEQ ID NO: 9395302 - DNA, 22 bp, Homo sapiens
cctggctcctgcctctgcaggg

SEQ ID NO: 9395303 - DNA, 22 bp, Homo sapiens
cctggctcctgcctctgcaggg

SEQ ID NO: 9395304 - DNA, 22 bp, Homo sapiens
cctggctccggttcaagggaaa

SEQ ID NO: 9395305 - DNA, 22 bp, Homo sapiens
cctggctccctgcacagggctc

SEQ ID NO: 9395306 - DNA, 22 bp, Homo sapiens
cctggccaggctctcagcactg

SEQ ID NO: 9395307 - DNA, 22 bp, Homo sapiens
cctggccaggctccaagtactg

SEQ ID NO: 9395308 - DNA, 22 bp, Homo sapiens
cctggccatagggcccaggaaa

SEQ ID NO: 9395309 - DNA, 22 bp, Homo sapiens
cctggccatagggcccaggaaa

SEQ ID NO: 9395310 - DNA, 22 bp, Homo sapiens
cctggccagtttccaggccctg

SEQ ID NO: 9395311 - DNA, 22 bp, Homo sapiens
cctggccagtttccaggccctg

SEQ ID NO: 9395312 - DNA, 22 bp, Homo sapiens
cctggccagtttccaggccctg

SEQ ID NO: 9395313 - DNA, 22 bp, Homo sapiens
cctggccagtttccaggccctg

SEQ ID NO: 9395314 - DNA, 22 bp, Homo sapiens
cctggcatgtcctcctggcatg

SEQ ID NO: 9395315 - DNA, 22 bp, Homo sapiens
cctggcatgtcctcctggcatg

SEQ ID NO: 9395316 - DNA, 22 bp, Homo sapiens
cctggccagcgccggctgctcg

SEQ ID NO: 9395317 - DNA, 22 bp, Homo sapiens
cctggcagtggtgaagaagagg

SEQ ID NO: 9395318 - DNA, 22 bp, Homo sapiens
cctggcagtggtgaagaagagg

SEQ ID NO: 9395319 - DNA, 22 bp, Homo sapiens
cctggcagttcatcaaatggca

SEQ ID NO: 9395320 - DNA, 22 bp, Homo sapiens
cctggcagttcatcaaatggca

SEQ ID NO: 9395321 - DNA, 22 bp, Homo sapiens
cctggcagttcatcaaatggca

SEQ ID NO: 9395322 - DNA, 22 bp, Homo sapiens
cctggcagttttgcccaggatt

SEQ ID NO: 9395323 - DNA, 22 bp, Homo sapiens
cctggcagttttgcccaggatt

SEQ ID NO: 9395324 - DNA, 22 bp, Homo sapiens
cctggcagttttgcccaggatt

SEQ ID NO: 9395325 - DNA, 22 bp, Homo sapiens
cctggcagttttgcccaggatt

SEQ ID NO: 9395326 - DNA, 22 bp, Homo sapiens
cctggcagttttgcccaggatt

SEQ ID NO: 9395327 - DNA, 22 bp, Homo sapiens
cctggcagttttgcccaggatt

SEQ ID NO: 9395328 - DNA, 22 bp, Homo sapiens
cctggcccacatggcttctccc

SEQ ID NO: 9395329 - DNA, 22 bp, Homo sapiens
tgtccagtccttggggtgctgt

SEQ ID NO: 9395330 - DNA, 22 bp, Homo sapiens
tgtccatacctttacctgtgta

SEQ ID NO: 9395331 - DNA, 22 bp, Homo sapiens
tgtccagtgatgccaagatgaa

SEQ ID NO: 9395332 - DNA, 19 bp, Homo sapiens
tgtccagtgatgtcaagga

SEQ ID NO: 9395333 - DNA, 22 bp, Homo sapiens
tgtccatgcgtatccagggagc

SEQ ID NO: 9395334 - DNA, 22 bp, Homo sapiens
tgtccatctgtcttagtacaaa

SEQ ID NO: 9395335 - DNA, 22 bp, Homo sapiens
tgtccatctccatcgagtcctc

SEQ ID NO: 9395336 - DNA, 22 bp, Homo sapiens
tgtccatggagaagctcagggc

SEQ ID NO: 9395337 - DNA, 17 bp, Homo sapiens
tgtccatttgcctggag

SEQ ID NO: 9395338 - DNA, 22 bp, Homo sapiens
tgtccatgggcgtcaggcagga

SEQ ID NO: 9395339 - DNA, 18 bp, Homo sapiens
tgtccatgttgttcctga

SEQ ID NO: 9395340 - DNA, 22 bp, Homo sapiens
tgtccatggggaaggggaagtg

SEQ ID NO: 9395341 - DNA, 22 bp, Homo sapiens
tgtccatggggaaggggaagtg

SEQ ID NO: 9395342 - DNA, 22 bp, Homo sapiens
tgtcctcatcttttccagaaat

SEQ ID NO: 9395343 - DNA, 22 bp, Homo sapiens
tgtcctcatcttttccagaaat

SEQ ID NO: 9395344 - DNA, 22 bp, Homo sapiens
tgtcctcgtccgcctcgaactc

SEQ ID NO: 9395345 - DNA, 22 bp, Homo sapiens
tgtcctcatcctccagtctgtc

SEQ ID NO: 9395346 - DNA, 22 bp, Homo sapiens
tgtcccagatcacaggagggga

SEQ ID NO: 9395347 - DNA, 22 bp, Homo sapiens
cctggcagctgtttggcttggc

SEQ ID NO: 9395348 - DNA, 18 bp, Homo sapiens
cctggcagccatgcgcgc

SEQ ID NO: 9395349 - DNA, 18 bp, Homo sapiens
cctggcagccatgcgcgc

SEQ ID NO: 9395350 - DNA, 18 bp, Homo sapiens
cctggcagccatgcgcgc

SEQ ID NO: 9395351 - DNA, 18 bp, Homo sapiens
cctggcagccatgcgcgc

SEQ ID NO: 9395352 - DNA, 22 bp, Homo sapiens
cctggcagcaggtgggcccgtg

SEQ ID NO: 9395353 - DNA, 22 bp, Homo sapiens
cctggcagcattggtagagatt

SEQ ID NO: 9395354 - DNA, 22 bp, Homo sapiens
cctggcagcattggtagagatt

SEQ ID NO: 9395355 - DNA, 22 bp, Homo sapiens
cctggcagcagcacatgccttc

SEQ ID NO: 9395356 - DNA, 22 bp, Homo sapiens
cctggcagcagcacatgccttc

SEQ ID NO: 9395357 - DNA, 22 bp, Homo sapiens
cctggcagcaggtgggcccgtg

SEQ ID NO: 9395358 - DNA, 22 bp, Homo sapiens
cctggcagcaggtgggcccgtg

SEQ ID NO: 9395359 - DNA, 22 bp, Homo sapiens
cctggcagcaggtgggcccgtg

SEQ ID NO: 9395360 - DNA, 23 bp, Homo sapiens
cctggcagcaaacgaggaggtta

SEQ ID NO: 9395361 - DNA, 22 bp, Homo sapiens
cctggcagcagcacatgccttc

SEQ ID NO: 9395362 - DNA, 23 bp, Homo sapiens
cctggcagcaaacgaggaggtta

SEQ ID NO: 9395363 - DNA, 23 bp, Homo sapiens
cctggcagcaaacgaggaggtta

SEQ ID NO: 9395364 - DNA, 22 bp, Homo sapiens
cctggcagactgtgagggcagg

SEQ ID NO: 9395365 - DNA, 23 bp, Homo sapiens
cctggcagcaaacgaggaggtta

SEQ ID NO: 9395366 - DNA, 22 bp, Homo sapiens
cctggcagactgtgagggcagg

SEQ ID NO: 9395367 - DNA, 22 bp, Homo sapiens
tgtcatgtttcatgtttgtagg

SEQ ID NO: 9395368 - DNA, 22 bp, Homo sapiens
tgtcatgtgcggggaggtgaag

SEQ ID NO: 9395369 - DNA, 22 bp, Homo sapiens
tgtcatgtgttcttaaatacat

SEQ ID NO: 9395370 - DNA, 21 bp, Homo sapiens
tgtcatgtttttccaggcatc

SEQ ID NO: 9395371 - DNA, 22 bp, Homo sapiens
cctggcaggctggggacagtgc

SEQ ID NO: 9395372 - DNA, 20 bp, Homo sapiens
cctggcaggcgggttactta

SEQ ID NO: 9395373 - DNA, 20 bp, Homo sapiens
cctggcaggcgggttactta

SEQ ID NO: 9395374 - DNA, 20 bp, Homo sapiens
cctggcaggcgggttactta

SEQ ID NO: 9395375 - DNA, 22 bp, Homo sapiens
cctggcaggctggggacagtgc

SEQ ID NO: 9395376 - DNA, 22 bp, Homo sapiens
cctggcaggctggggacagtgc

SEQ ID NO: 9395377 - DNA, 22 bp, Homo sapiens
cctggcaggctggggacagtgc

SEQ ID NO: 9395378 - DNA, 22 bp, Homo sapiens
cctggcaggcaagaggaaggga

SEQ ID NO: 9395379 - DNA, 22 bp, Homo sapiens
cctggcaggcaagaggaaggga

SEQ ID NO: 9395380 - DNA, 22 bp, Homo sapiens
cctggcaggcaagaggaaggga

SEQ ID NO: 9395381 - DNA, 22 bp, Homo sapiens
cctggcaggactgttgtaagaa

SEQ ID NO: 9395382 - DNA, 22 bp, Homo sapiens
cctggcaggactgttgtaagaa

SEQ ID NO: 9395383 - DNA, 22 bp, Homo sapiens
cctggcaggcaagaggaaggga

SEQ ID NO: 9395384 - DNA, 22 bp, Homo sapiens
cctggcaggcccctcctggatt

SEQ ID NO: 9395385 - DNA, 22 bp, Homo sapiens
cctggcaggcccctcctggatt

SEQ ID NO: 9395386 - DNA, 22 bp, Homo sapiens
cctggcaggcccctcctggatt

SEQ ID NO: 9395387 - DNA, 22 bp, Homo sapiens
cctggcagtcaggggagtcctt

SEQ ID NO: 9395388 - DNA, 22 bp, Homo sapiens
cctggcagtcaggggagtcctt

SEQ ID NO: 9395389 - DNA, 22 bp, Homo sapiens
cctggcagtcaggggagtcctt

SEQ ID NO: 9395390 - DNA, 22 bp, Homo sapiens
cctggcagtcaggggagtcctt

SEQ ID NO: 9395391 - DNA, 22 bp, Homo sapiens
cctggcaggttacaaccagtta

SEQ ID NO: 9395392 - DNA, 22 bp, Homo sapiens
cctggcaggttacaaccagtta

SEQ ID NO: 9395393 - DNA, 22 bp, Homo sapiens
cctggcaggttacaaccagtta

SEQ ID NO: 9395394 - DNA, 22 bp, Homo sapiens
cctggcaggttacaaccagtta

SEQ ID NO: 9395395 - DNA, 22 bp, Homo sapiens
cctggcaggtggcgccctcggc

SEQ ID NO: 9395396 - DNA, 22 bp, Homo sapiens
cctggcaggtggcgccctcggc

SEQ ID NO: 9395397 - DNA, 22 bp, Homo sapiens
cctggcaggtggcgccctcggc

SEQ ID NO: 9395398 - DNA, 22 bp, Homo sapiens
cctggcaggtggaggttgcagt

SEQ ID NO: 9395399 - DNA, 22 bp, Homo sapiens
cctggcaggtggaggttgcagt

SEQ ID NO: 9395400 - DNA, 22 bp, Homo sapiens
cctggcagggctgcagtaatgg

SEQ ID NO: 9395401 - DNA, 22 bp, Homo sapiens
cctggcagggctgcagtaatgg

SEQ ID NO: 9395402 - DNA, 22 bp, Homo sapiens
cctggcaggtagcattgaggag

SEQ ID NO: 9395403 - DNA, 22 bp, Homo sapiens
cctggcaggtagcattgaggag

SEQ ID NO: 9395404 - DNA, 22 bp, Homo sapiens
cctggcagggctgcagtaatgg

SEQ ID NO: 9395405 - DNA, 22 bp, Homo sapiens
cctggcaggtagcattgaggag

SEQ ID NO: 9395406 - DNA, 22 bp, Homo sapiens
cctggcaggtggaggttgcagt

SEQ ID NO: 9395407 - DNA, 18 bp, Homo sapiens
tggtgcctttcactcttc

SEQ ID NO: 9395408 - DNA, 22 bp, Homo sapiens
tggtgctgagatgaagtgctcc

SEQ ID NO: 9395409 - DNA, 22 bp, Homo sapiens
tggtgctgataatggcaggatt

SEQ ID NO: 9395410 - DNA, 22 bp, Homo sapiens
tggtgctgacagttctgagtgc

SEQ ID NO: 9395411 - DNA, 22 bp, Homo sapiens
tggtcttagctggaaggaggga

SEQ ID NO: 9395412 - DNA, 22 bp, Homo sapiens
tggtctttaaggtagctgtcat

SEQ ID NO: 9395413 - DNA, 17 bp, Homo sapiens
cctgcccagagacagat

SEQ ID NO: 9395414 - DNA, 17 bp, Homo sapiens
cctgcccagagacagat

SEQ ID NO: 9395415 - DNA, 22 bp, Homo sapiens
cctgcccactgcccggtcagcc

SEQ ID NO: 9395416 - DNA, 20 bp, Homo sapiens
tggtcctcacaggtcctccc

SEQ ID NO: 9395417 - DNA, 22 bp, Homo sapiens
cctgccagtgaagctgacgggc

SEQ ID NO: 9395418 - DNA, 22 bp, Homo sapiens
cctgccagtgaagctgacgggc

SEQ ID NO: 9395419 - DNA, 22 bp, Homo sapiens
tggtcctagccagggctctgct

SEQ ID NO: 9395420 - DNA, 22 bp, Homo sapiens
cctgccagtgcctcccactggt

SEQ ID NO: 9395421 - DNA, 22 bp, Homo sapiens
cctgccagtgcctcccactggt

SEQ ID NO: 9395422 - DNA, 22 bp, Homo sapiens
cctgcccacagagagggtgcat

SEQ ID NO: 9395423 - DNA, 22 bp, Homo sapiens
cctgcccacagagagggtgcat

SEQ ID NO: 9395424 - DNA, 22 bp, Homo sapiens
cctgcccacagagagggtgcat

SEQ ID NO: 9395425 - DNA, 22 bp, Homo sapiens
cctgcccactccaggagcaact

SEQ ID NO: 9395426 - DNA, 22 bp, Homo sapiens
tggtccagtttagcattgagtg

SEQ ID NO: 9395427 - DNA, 22 bp, Homo sapiens
tggtccctaaagatgtctacat

SEQ ID NO: 9395428 - DNA, 22 bp, Homo sapiens
tggtccctaaagatgtctacat

SEQ ID NO: 9395429 - DNA, 22 bp, Homo sapiens
tggtcccattgttctgcccagg

SEQ ID NO: 9395430 - DNA, 22 bp, Homo sapiens
tggtccctgatctaatgtctca

SEQ ID NO: 9395431 - DNA, 22 bp, Homo sapiens
tggtccctttctactgagcaca

SEQ ID NO: 9395432 - DNA, 22 bp, Homo sapiens
tggtccctagtgtgggagcttg

SEQ ID NO: 9395433 - DNA, 22 bp, Homo sapiens
tggtaggagatatggtctccga

SEQ ID NO: 9395434 - DNA, 22 bp, Homo sapiens
tggtagggacactatgcagaaa

SEQ ID NO: 9395435 - DNA, 17 bp, Homo sapiens
tggtccaggtggagcca

SEQ ID NO: 9395436 - DNA, 22 bp, Homo sapiens
cctctgtgcctcgtgtcctctg

SEQ ID NO: 9395437 - DNA, 22 bp, Homo sapiens
cctctgtgctttgtccagcctc

SEQ ID NO: 9395438 - DNA, 22 bp, Homo sapiens
cctctgtgctttgtccagcctc

SEQ ID NO: 9395439 - DNA, 22 bp, Homo sapiens
tggtgggacatctgaggagagg

SEQ ID NO: 9395440 - DNA, 22 bp, Homo sapiens
cctggaaacacatgatgatgaa

SEQ ID NO: 9395441 - DNA, 22 bp, Homo sapiens
cctggactcagaggtgctggtg

SEQ ID NO: 9395442 - DNA, 22 bp, Homo sapiens
cctggactgtgtcctgtggtca

SEQ ID NO: 9395443 - DNA, 21 bp, Homo sapiens
cctggactgggagcagcactg

SEQ ID NO: 9395444 - DNA, 21 bp, Homo sapiens
cctggagacaaagacagggtg

SEQ ID NO: 9395445 - DNA, 21 bp, Homo sapiens
cctggagacaaagacagggtg

SEQ ID NO: 9395446 - DNA, 22 bp, Homo sapiens
cctggagacccacttctgccaa

SEQ ID NO: 9395447 - DNA, 22 bp, Homo sapiens
cctggagaccagaggatacttc

SEQ ID NO: 9395448 - DNA, 22 bp, Homo sapiens
cctggagaccagaggatacttc

SEQ ID NO: 9395449 - DNA, 21 bp, Homo sapiens
cctggagacaaagacagggtg

SEQ ID NO: 9395450 - DNA, 22 bp, Homo sapiens
tgtaaacatatcagactttctt

SEQ ID NO: 9395451 - DNA, 22 bp, Homo sapiens
tgtaaacagccccatggagagc

SEQ ID NO: 9395452 - DNA, 22 bp, Homo sapiens
cctggagagctcgggccaggca

SEQ ID NO: 9395453 - DNA, 22 bp, Homo sapiens
cctggagagagaggccaactgc

SEQ ID NO: 9395454 - DNA, 22 bp, Homo sapiens
cctggagacctgatggcagcgg

SEQ ID NO: 9395455 - DNA, 22 bp, Homo sapiens
cctggagacctgatggcagcgg

SEQ ID NO: 9395456 - DNA, 22 bp, Homo sapiens
cctggagacctgatggcagcgg

SEQ ID NO: 9395457 - DNA, 22 bp, Homo sapiens
cctggagacctgatggcagcgg

SEQ ID NO: 9395458 - DNA, 22 bp, Homo sapiens
cctggagacccacttctgccaa

SEQ ID NO: 9395459 - DNA, 22 bp, Homo sapiens
cctggagacgaggctggaccat

SEQ ID NO: 9395460 - DNA, 22 bp, Homo sapiens
cctggagagagaggccaactgc

SEQ ID NO: 9395461 - DNA, 22 bp, Homo sapiens
cctggagacgaggctggaccat

SEQ ID NO: 9395462 - DNA, 22 bp, Homo sapiens
cctggagacgaggctggaccat

SEQ ID NO: 9395463 - DNA, 22 bp, Homo sapiens
tggtgctgcctcagatgcctta

SEQ ID NO: 9395464 - DNA, 22 bp, Homo sapiens
tggtgctgcctcagatgcctta

SEQ ID NO: 9395465 - DNA, 22 bp, Homo sapiens
tggtgctgcctcagatgcctta

SEQ ID NO: 9395466 - DNA, 19 bp, Homo sapiens
tggtgctggcctcccatgg

SEQ ID NO: 9395467 - DNA, 22 bp, Homo sapiens
tggtgctgtctactttgtgcag

SEQ ID NO: 9395468 - DNA, 22 bp, Homo sapiens
tggtgctggtgccacgcccctt

SEQ ID NO: 9395469 - DNA, 22 bp, Homo sapiens
tggtgctgtggaggggcagaag

SEQ ID NO: 9395470 - DNA, 22 bp, Homo sapiens
tggtgctgtgatacgaggcact

SEQ ID NO: 9395471 - DNA, 22 bp, Homo sapiens
tggtgctgtgatacgaggcact

SEQ ID NO: 9395472 - DNA, 22 bp, Homo sapiens
tggtgctgtggaggggcagaag

SEQ ID NO: 9395473 - DNA, 16 bp, Homo sapiens
tggtggccatagttat

SEQ ID NO: 9395474 - DNA, 22 bp, Homo sapiens
tggtggccccctcaagtctttg

SEQ ID NO: 9395475 - DNA, 22 bp, Homo sapiens
tggtgctgccacctcctctgct

SEQ ID NO: 9395476 - DNA, 22 bp, Homo sapiens
tggtgctgccaggctcctgcca

SEQ ID NO: 9395477 - DNA, 22 bp, Homo sapiens
tggtgctgccaggctcctgcca

SEQ ID NO: 9395478 - DNA, 22 bp, Homo sapiens
tggtgctgcaggtgggcacagt

SEQ ID NO: 9395479 - DNA, 22 bp, Homo sapiens
tggtgctgataatggcaggatt

SEQ ID NO: 9395480 - DNA, 22 bp, Homo sapiens
tggtgctgcaggtgggcacagt

SEQ ID NO: 9395481 - DNA, 22 bp, Homo sapiens
tggtggctaccaggtcctgggg

SEQ ID NO: 9395482 - DNA, 22 bp, Homo sapiens
tggtggccgaagccctctctca

SEQ ID NO: 9395483 - DNA, 22 bp, Homo sapiens
tggtggccttgatggcatctgc

SEQ ID NO: 9395484 - DNA, 17 bp, Homo sapiens
tggtggctggagtcagg

SEQ ID NO: 9395485 - DNA, 22 bp, Homo sapiens
tggtggctcacgtctgtaatct

SEQ ID NO: 9395486 - DNA, 22 bp, Homo sapiens
tggtggctcacacctgtaatcc

SEQ ID NO: 9395487 - DNA, 22 bp, Homo sapiens
tggtggctgctccctgccttga

SEQ ID NO: 9395488 - DNA, 17 bp, Homo sapiens
tggtggctggagtcagg

SEQ ID NO: 9395489 - DNA, 22 bp, Homo sapiens
tggtggctgctccctgccttga

SEQ ID NO: 9395490 - DNA, 23 bp, Homo sapiens
tggtggcttgtggtggccaccag

SEQ ID NO: 9395491 - DNA, 23 bp, Homo sapiens
tggtggcttgtggtggccaccag

SEQ ID NO: 9395492 - DNA, 22 bp, Homo sapiens
tggtggcttctgaggatggcga

SEQ ID NO: 9395493 - DNA, 22 bp, Homo sapiens
tggtggcttctgaggatggcga

SEQ ID NO: 9395494 - DNA, 22 bp, Homo sapiens
tggtggcttctgaggatggcga

SEQ ID NO: 9395495 - DNA, 22 bp, Homo sapiens
tggtggctgtaagggagagaag

SEQ ID NO: 9395496 - DNA, 22 bp, Homo sapiens
tggtggctgttgcagaactgag

SEQ ID NO: 9395497 - DNA, 22 bp, Homo sapiens
tggtggctgtaagggagagaag

SEQ ID NO: 9395498 - DNA, 22 bp, Homo sapiens
tggtggctgtaagggagagaag

SEQ ID NO: 9395499 - DNA, 22 bp, Homo sapiens
tgtatgtttctaaatgattgct

SEQ ID NO: 9395500 - DNA, 22 bp, Homo sapiens
tgtattcagggacatatatgta

SEQ ID NO: 9395501 - DNA, 21 bp, Homo sapiens
tgtcagctccctgtcctgtgt

SEQ ID NO: 9395502 - DNA, 22 bp, Homo sapiens
tgtattatgattgttgttcatg

SEQ ID NO: 9395503 - DNA, 22 bp, Homo sapiens
tgtcatggacagattagatgag

SEQ ID NO: 9395504 - DNA, 22 bp, Homo sapiens
tgtcatgtaaagagtaaatggt

SEQ ID NO: 9395505 - DNA, 22 bp, Homo sapiens
tgtcatgtaaagagtaaatggt

SEQ ID NO: 9395506 - DNA, 22 bp, Homo sapiens
tgtcatggtctgtaaggagccc

SEQ ID NO: 9395507 - DNA, 22 bp, Homo sapiens
tgtcatggtatttgtgagctgc

SEQ ID NO: 9395508 - DNA, 22 bp, Homo sapiens
tgtcatgtagcattttatgtct

SEQ ID NO: 9395509 - DNA, 22 bp, Homo sapiens
tgtcatgtataagacactgtgt

SEQ ID NO: 9395510 - DNA, 22 bp, Homo sapiens
tgtcatgtaacctttctgagcc

SEQ ID NO: 9395511 - DNA, 22 bp, Homo sapiens
tgtcatgtagcattttatgtct

SEQ ID NO: 9395512 - DNA, 22 bp, Homo sapiens
tgtcatgtggcaattaaagcag

SEQ ID NO: 9395513 - DNA, 22 bp, Homo sapiens
tgtcatgtggcaattaaagcag

SEQ ID NO: 9395514 - DNA, 22 bp, Homo sapiens
cctggcagacagcactgaagct

SEQ ID NO: 9395515 - DNA, 22 bp, Homo sapiens
cctggcagaatattaaagtgca

SEQ ID NO: 9395516 - DNA, 22 bp, Homo sapiens
cctggcagacagcactgaagct

SEQ ID NO: 9395517 - DNA, 22 bp, Homo sapiens
cctggcagacagcactgaagct

SEQ ID NO: 9395518 - DNA, 22 bp, Homo sapiens
cctggcagactgtgagggcagg

SEQ ID NO: 9395519 - DNA, 22 bp, Homo sapiens
tgtatgtatgcatcttttatgt

SEQ ID NO: 9395520 - DNA, 22 bp, Homo sapiens
tgtatgtatgcatcttttatgt

SEQ ID NO: 9395521 - DNA, 22 bp, Homo sapiens
tgtatgtatgaataagcaagat

SEQ ID NO: 9395522 - DNA, 22 bp, Homo sapiens
tgtatgtatacactgatcatca

SEQ ID NO: 9395523 - DNA, 22 bp, Homo sapiens
tgtatgtgcaatgtttatatgt

SEQ ID NO: 9395524 - DNA, 22 bp, Homo sapiens
tgtatgtatgtatgtatttggg

SEQ ID NO: 9395525 - DNA, 22 bp, Homo sapiens
tgtatgtattggtcagggttct

SEQ ID NO: 9395526 - DNA, 22 bp, Homo sapiens
tgtatgtattttgctaggctga

SEQ ID NO: 9395527 - DNA, 22 bp, Homo sapiens
tgtatgtgtatgtacatatgca

SEQ ID NO: 9395528 - DNA, 22 bp, Homo sapiens
tgtatgtgtcctaattcaagca

SEQ ID NO: 9395529 - DNA, 22 bp, Homo sapiens
tgtatgtgtggatagatgtata

SEQ ID NO: 9395530 - DNA, 22 bp, Homo sapiens
tgtatgtgtatgtacatatgca

SEQ ID NO: 9395531 - DNA, 22 bp, Homo sapiens
cctggcagaatattaaagtgca

SEQ ID NO: 9395532 - DNA, 21 bp, Homo sapiens
cctggcagaagcctgatatgc

SEQ ID NO: 9395533 - DNA, 21 bp, Homo sapiens
cctggcagaagcctgatatgc

SEQ ID NO: 9395534 - DNA, 22 bp, Homo sapiens
cctggcactgctgaagtcctgg

SEQ ID NO: 9395535 - DNA, 22 bp, Homo sapiens
cctggcagaaagagttacacct

SEQ ID NO: 9395536 - DNA, 22 bp, Homo sapiens
cctggcagaaagagttacacct

SEQ ID NO: 9395537 - DNA, 22 bp, Homo sapiens
cctggcacgaagggctgaggtt

SEQ ID NO: 9395538 - DNA, 22 bp, Homo sapiens
cctggcactgaccaggcactga

SEQ ID NO: 9395539 - DNA, 22 bp, Homo sapiens
cctggcaccttcacagactact

SEQ ID NO: 9395540 - DNA, 22 bp, Homo sapiens
cctggcacctgtgttttctgga

SEQ ID NO: 9395541 - DNA, 22 bp, Homo sapiens
cctggcacatagtgggcatgca

SEQ ID NO: 9395542 - DNA, 22 bp, Homo sapiens
cctggcacatgatagatgctca

SEQ ID NO: 9395543 - DNA, 22 bp, Homo sapiens
cctggcacatgatagatgctca

SEQ ID NO: 9395544 - DNA, 22 bp, Homo sapiens
tgtagggaggaagggttggaaa

SEQ ID NO: 9395545 - DNA, 22 bp, Homo sapiens
tgtaggtaagttcgtagatttg

SEQ ID NO: 9395546 - DNA, 22 bp, Homo sapiens
tgtaggtagatcccatgtaaga

SEQ ID NO: 9395547 - DNA, 22 bp, Homo sapiens
tgtagggagagggagttgcacc

SEQ ID NO: 9395548 - DNA, 22 bp, Homo sapiens
tgtagggaggaaagggctcttg

SEQ ID NO: 9395549 - DNA, 22 bp, Homo sapiens
tgtagggagaagagaggcacct

SEQ ID NO: 9395550 - DNA, 22 bp, Homo sapiens
tgtagggacttggcgatcactt

SEQ ID NO: 9395551 - DNA, 22 bp, Homo sapiens
tgtagggacttggcgatcactt

SEQ ID NO: 9395552 - DNA, 22 bp, Homo sapiens
tgtagggactgaggctggagag

SEQ ID NO: 9395553 - DNA, 21 bp, Homo sapiens
tgtaggaggcaagcctgtctc

SEQ ID NO: 9395554 - DNA, 23 bp, Homo sapiens
tgtaggctaagtcccataaatca

SEQ ID NO: 9395555 - DNA, 23 bp, Homo sapiens
tgtaaaccattttgcatcccatg

SEQ ID NO: 9395556 - DNA, 22 bp, Homo sapiens
tgtaaactgcttctcaccaagg

SEQ ID NO: 9395557 - DNA, 22 bp, Homo sapiens
tgtaaacatatgtatgtatgta

SEQ ID NO: 9395558 - DNA, 22 bp, Homo sapiens
tgtaggaatggattctagaagg

SEQ ID NO: 9395559 - DNA, 22 bp, Homo sapiens
cctggagaggcgctgcagagga

SEQ ID NO: 9395560 - DNA, 22 bp, Homo sapiens
cctggagaggcgctgcagagga

SEQ ID NO: 9395561 - DNA, 22 bp, Homo sapiens
cctggagagctcgggccaggca

SEQ ID NO: 9395562 - DNA, 22 bp, Homo sapiens
cctggagagctcgggccaggca

SEQ ID NO: 9395563 - DNA, 22 bp, Homo sapiens
cctggagaggagaaagggccca

SEQ ID NO: 9395564 - DNA, 22 bp, Homo sapiens
cctggagaggcgctgcagagga

SEQ ID NO: 9395565 - DNA, 22 bp, Homo sapiens
tgtagtccaggaattgtgtctg

SEQ ID NO: 9395566 - DNA, 22 bp, Homo sapiens
tgtagtaaacactattctgatc

SEQ ID NO: 9395567 - DNA, 22 bp, Homo sapiens
tgtagtgaggaaagactggttg

SEQ ID NO: 9395568 - DNA, 22 bp, Homo sapiens
tgtagtgtggcctatctttgcc

SEQ ID NO: 9395569 - DNA, 22 bp, Homo sapiens
cctggcacatagcaacccctcc

SEQ ID NO: 9395570 - DNA, 22 bp, Homo sapiens
cctggagcacatggcaggaggc

SEQ ID NO: 9395571 - DNA, 22 bp, Homo sapiens
cctggagcacatggcaggaggc

SEQ ID NO: 9395572 - DNA, 19 bp, Homo sapiens
cctggaggtgaaggttctc

SEQ ID NO: 9395573 - DNA, 22 bp, Homo sapiens
cctggagattatttggtccaat

SEQ ID NO: 9395574 - DNA, 22 bp, Homo sapiens
cctggagcaaaaatctaaggag

SEQ ID NO: 9395575 - DNA, 22 bp, Homo sapiens
cctggagatttcttcaagcttt

SEQ ID NO: 9395576 - DNA, 22 bp, Homo sapiens
cctggagatttcttcaagcttt

SEQ ID NO: 9395577 - DNA, 22 bp, Homo sapiens
cctggagcacagcccagtccca

SEQ ID NO: 9395578 - DNA, 22 bp, Homo sapiens
cctggagcacatggcaggaggc

SEQ ID NO: 9395579 - DNA, 22 bp, Homo sapiens
cctgggccctcaccgccggtgg

SEQ ID NO: 9395580 - DNA, 22 bp, Homo sapiens
cctgggcatctcatgcacctgc

SEQ ID NO: 9395581 - DNA, 22 bp, Homo sapiens
cctgggcatctcatgcacctgc

SEQ ID NO: 9395582 - DNA, 22 bp, Homo sapiens
cctgggcatctcatgcacctgc

SEQ ID NO: 9395583 - DNA, 23 bp, Homo sapiens
cctgggcattggctgcagcttct

SEQ ID NO: 9395584 - DNA, 21 bp, Homo sapiens
cctgggccaaattccctggac

SEQ ID NO: 9395585 - DNA, 22 bp, Homo sapiens
cctgggcagcctgctcaaggac

SEQ ID NO: 9395586 - DNA, 22 bp, Homo sapiens
cctgggaggcggaggttgcagt

SEQ ID NO: 9395587 - DNA, 22 bp, Homo sapiens
cctgggaggcggaggttgcagt

SEQ ID NO: 9395588 - DNA, 22 bp, Homo sapiens
cctgggaggcggaggttgcagg

SEQ ID NO: 9395589 - DNA, 22 bp, Homo sapiens
cctgggaggcggaggttgcagt

SEQ ID NO: 9395590 - DNA, 19 bp, Homo sapiens
cctgggaggcggaggttgc

SEQ ID NO: 9395591 - DNA, 22 bp, Homo sapiens
cctgggaggcggaggttgcagg

SEQ ID NO: 9395592 - DNA, 19 bp, Homo sapiens
cctgggaggcggaggttgc

SEQ ID NO: 9395593 - DNA, 22 bp, Homo sapiens
cctgggaggcggaggttgcagg

SEQ ID NO: 9395594 - DNA, 22 bp, Homo sapiens
tgtggggctgtcaggcaactgg

SEQ ID NO: 9395595 - DNA, 22 bp, Homo sapiens
tgtggggctccctggcagcctg

SEQ ID NO: 9395596 - DNA, 22 bp, Homo sapiens
tgtggggcctcgtgctagctgg

SEQ ID NO: 9395597 - DNA, 22 bp, Homo sapiens
tgtggggccaaagcccagccac

SEQ ID NO: 9395598 - DNA, 22 bp, Homo sapiens
tgtggggcagctagccggcctg

SEQ ID NO: 9395599 - DNA, 22 bp, Homo sapiens
cctgggcctcacccagctcttg

SEQ ID NO: 9395600 - DNA, 22 bp, Homo sapiens
cctgggcctcacccagctcttg

SEQ ID NO: 9395601 - DNA, 22 bp, Homo sapiens
cctgggcctcacccagctcttg

SEQ ID NO: 9395602 - DNA, 21 bp, Homo sapiens
tgtgtgggcatatctgctgca

SEQ ID NO: 9395603 - DNA, 21 bp, Homo sapiens
tgtgtgggcatatctgctgca

SEQ ID NO: 9395604 - DNA, 21 bp, Homo sapiens
tgtgtgggcatatctgctgca

SEQ ID NO: 9395605 - DNA, 22 bp, Homo sapiens
tgtgtctgtcctcggttgatgc

SEQ ID NO: 9395606 - DNA, 22 bp, Homo sapiens
tgtgtctgtcctcggttgatgc

SEQ ID NO: 9395607 - DNA, 22 bp, Homo sapiens
tgtgtgggcgaagacagccttt

SEQ ID NO: 9395608 - DNA, 22 bp, Homo sapiens
tgtgtgggcatgcttttaattt

SEQ ID NO: 9395609 - DNA, 22 bp, Homo sapiens
tgtgtgggtacagatgattgtt

SEQ ID NO: 9395610 - DNA, 22 bp, Homo sapiens
tgtgtggggaaggaaggagctg

SEQ ID NO: 9395611 - DNA, 22 bp, Homo sapiens
tgtggggcttacaaaggcagat

SEQ ID NO: 9395612 - DNA, 22 bp, Homo sapiens
tgtggggctgtggtgttcttct

SEQ ID NO: 9395613 - DNA, 22 bp, Homo sapiens
tgtgggggtacacgtacacatg

SEQ ID NO: 9395614 - DNA, 22 bp, Homo sapiens
tgtgggggtacacgtacacatg

SEQ ID NO: 9395615 - DNA, 20 bp, Homo sapiens
tgtggaaaaacagaagcaga

SEQ ID NO: 9395616 - DNA, 20 bp, Homo sapiens
tgtggaaaaacagaagcaga

SEQ ID NO: 9395617 - DNA, 22 bp, Homo sapiens
tgtgctttcaaagttaagtaaa

SEQ ID NO: 9395618 - DNA, 22 bp, Homo sapiens
tgtgctttcaaagttaagtaaa

SEQ ID NO: 9395619 - DNA, 22 bp, Homo sapiens
tgtgcttcttgcagctcctgta

SEQ ID NO: 9395620 - DNA, 22 bp, Homo sapiens
tgtggcagctggaggtggagaa

SEQ ID NO: 9395621 - DNA, 22 bp, Homo sapiens
tgtggcagctggaggtggagaa

SEQ ID NO: 9395622 - DNA, 20 bp, Homo sapiens
tgtggcaggatgagggcgga

SEQ ID NO: 9395623 - DNA, 20 bp, Homo sapiens
tgtggcaggatgagggcgga

SEQ ID NO: 9395624 - DNA, 22 bp, Homo sapiens
tgtggcaggaagagcttctgag

SEQ ID NO: 9395625 - DNA, 22 bp, Homo sapiens
tgtggcaggcaagatgtacaga

SEQ ID NO: 9395626 - DNA, 22 bp, Homo sapiens
tgtggcagggatactgaggcag

SEQ ID NO: 9395627 - DNA, 22 bp, Homo sapiens
tgtggcaggcattctgaggctg

SEQ ID NO: 9395628 - DNA, 21 bp, Homo sapiens
tgtggctgcctctggccctgg

SEQ ID NO: 9395629 - DNA, 21 bp, Homo sapiens
tgtggctgcctctggccctgg

SEQ ID NO: 9395630 - DNA, 22 bp, Homo sapiens
tgtggctgctcaggtgcagacc

SEQ ID NO: 9395631 - DNA, 22 bp, Homo sapiens
cctgggaggcagaggttgcagt

SEQ ID NO: 9395632 - DNA, 22 bp, Homo sapiens
cctgggaggcagaggttgcagt

SEQ ID NO: 9395633 - DNA, 19 bp, Homo sapiens
cctgggaggcggaggttgc

SEQ ID NO: 9395634 - DNA, 22 bp, Homo sapiens
cctgggaggcagaggttgcagt

SEQ ID NO: 9395635 - DNA, 22 bp, Homo sapiens
tgtggctgttgaggaccccaag

SEQ ID NO: 9395636 - DNA, 22 bp, Homo sapiens
tgtggctgttgaggaccccaag

SEQ ID NO: 9395637 - DNA, 22 bp, Homo sapiens
cctgggagctgtggaaaggctg

SEQ ID NO: 9395638 - DNA, 22 bp, Homo sapiens
cctgggagctgtggaaaggctg

SEQ ID NO: 9395639 - DNA, 22 bp, Homo sapiens
cctgggagctgtggaaaggctg

SEQ ID NO: 9395640 - DNA, 22 bp, Homo sapiens
cctgggagctgtggaaaggctg

SEQ ID NO: 9395641 - DNA, 22 bp, Homo sapiens
cctgggagctgtggaaaggctg

SEQ ID NO: 9395642 - DNA, 22 bp, Homo sapiens
tgtggctgtggttttcataaat

SEQ ID NO: 9395643 - DNA, 22 bp, Homo sapiens
tgtggctgtgtccacctgctgc

SEQ ID NO: 9395644 - DNA, 22 bp, Homo sapiens
tgtggctgtggatgctttccag

SEQ ID NO: 9395645 - DNA, 22 bp, Homo sapiens
tgtggctgtggatgctttccag

SEQ ID NO: 9395646 - DNA, 22 bp, Homo sapiens
tgtggctggtctccgagcgtcg

SEQ ID NO: 9395647 - DNA, 18 bp, Homo sapiens
tgtggctggtccacactg

SEQ ID NO: 9395648 - DNA, 22 bp, Homo sapiens
tgtggctgtctgttctcctagg

SEQ ID NO: 9395649 - DNA, 22 bp, Homo sapiens
tgtggctgtctgttctcctagg

SEQ ID NO: 9395650 - DNA, 22 bp, Homo sapiens
tgtggctgtgccgtcacacgtg

SEQ ID NO: 9395651 - DNA, 18 bp, Homo sapiens
tgtggctggtccacactg

SEQ ID NO: 9395652 - DNA, 22 bp, Homo sapiens
tgtggctgggctaataggcaaa

SEQ ID NO: 9395653 - DNA, 22 bp, Homo sapiens
tgtggctgggaagaaggtaact

SEQ ID NO: 9395654 - DNA, 22 bp, Homo sapiens
tgtggctgctcctgggtggtca

SEQ ID NO: 9395655 - DNA, 22 bp, Homo sapiens
tgtggctgctcctgggtggtca

SEQ ID NO: 9395656 - DNA, 22 bp, Homo sapiens
tgtggctggattgattttacct

SEQ ID NO: 9395657 - DNA, 15 bp, Homo sapiens
tgtggctggctcctg

SEQ ID NO: 9395658 - DNA, 22 bp, Homo sapiens
cctggggacctgcctcagccct

SEQ ID NO: 9395659 - DNA, 22 bp, Homo sapiens
cctggggacctgcctcagccct

SEQ ID NO: 9395660 - DNA, 22 bp, Homo sapiens
cctggggacctgcctcagccct

SEQ ID NO: 9395661 - DNA, 22 bp, Homo sapiens
tgtgttcaatccctagtctcag

SEQ ID NO: 9395662 - DNA, 22 bp, Homo sapiens
tgtgttcaatccctagtctcag

SEQ ID NO: 9395663 - DNA, 22 bp, Homo sapiens
cctggggagaagagcttccccc

SEQ ID NO: 9395664 - DNA, 22 bp, Homo sapiens
tgtgttcagaatttgctgcttt

SEQ ID NO: 9395665 - DNA, 23 bp, Homo sapiens
tgtgttcagtcaaggatcagagt

SEQ ID NO: 9395666 - DNA, 22 bp, Homo sapiens
tgtgttccttaaaggatgggca

SEQ ID NO: 9395667 - DNA, 22 bp, Homo sapiens
tgtgttcctgcctggctctggt

SEQ ID NO: 9395668 - DNA, 22 bp, Homo sapiens
tgtgttctatggttcagggtgg

SEQ ID NO: 9395669 - DNA, 22 bp, Homo sapiens
tgtgttcatttaactgttcttt

SEQ ID NO: 9395670 - DNA, 23 bp, Homo sapiens
tgtgttctcacacagatgcagta

SEQ ID NO: 9395671 - DNA, 22 bp, Homo sapiens
cctggggctccagagcagcgga

SEQ ID NO: 9395672 - DNA, 22 bp, Homo sapiens
cctggggctccagagcagcgga

SEQ ID NO: 9395673 - DNA, 22 bp, Homo sapiens
cctggggctccagagcagcgga

SEQ ID NO: 9395674 - DNA, 19 bp, Homo sapiens
cctgggtccactcagacta

SEQ ID NO: 9395675 - DNA, 22 bp, Homo sapiens
cctgggtgaaatctctcctgca

SEQ ID NO: 9395676 - DNA, 22 bp, Homo sapiens
cctgggtgacagagtgagacct

SEQ ID NO: 9395677 - DNA, 22 bp, Homo sapiens
cctgggtgaatgatattctaaa

SEQ ID NO: 9395678 - DNA, 22 bp, Homo sapiens
cctgggtgacagagtgagacct

SEQ ID NO: 9395679 - DNA, 22 bp, Homo sapiens
cctgggtgacagagtgagacct

SEQ ID NO: 9395680 - DNA, 22 bp, Homo sapiens
cctgggtgaaatctctcctgca

SEQ ID NO: 9395681 - DNA, 22 bp, Homo sapiens
cctgggtgaaatctctcctgca

SEQ ID NO: 9395682 - DNA, 22 bp, Homo sapiens
cctgggtgaaatagtcctcaag

SEQ ID NO: 9395683 - DNA, 22 bp, Homo sapiens
cctgggtgaaatagtcctcaag

SEQ ID NO: 9395684 - DNA, 22 bp, Homo sapiens
cctgggtgatgtgctgccctcg

SEQ ID NO: 9395685 - DNA, 22 bp, Homo sapiens
cctgggtgatgtgctgccctcg

SEQ ID NO: 9395686 - DNA, 22 bp, Homo sapiens
cctgggtgatgtgctgccctcg

SEQ ID NO: 9395687 - DNA, 22 bp, Homo sapiens
cctgggtgcccggcccttctct

SEQ ID NO: 9395688 - DNA, 22 bp, Homo sapiens
cctgggtgacagagtgagacct

SEQ ID NO: 9395689 - DNA, 22 bp, Homo sapiens
cctgggtgacccgtgagcgtcc

SEQ ID NO: 9395690 - DNA, 22 bp, Homo sapiens
cctgggtctcctcctgctggct

SEQ ID NO: 9395691 - DNA, 22 bp, Homo sapiens
cctgggtcttggttcatgctct

SEQ ID NO: 9395692 - DNA, 22 bp, Homo sapiens
cctgggtcttcagtctgctggt

SEQ ID NO: 9395693 - DNA, 22 bp, Homo sapiens
cctgggtcttcagtctgctggt

SEQ ID NO: 9395694 - DNA, 22 bp, Homo sapiens
cctgggtctgtattggtaggta

SEQ ID NO: 9395695 - DNA, 22 bp, Homo sapiens
cctggggaatagagtcaagggg

SEQ ID NO: 9395696 - DNA, 22 bp, Homo sapiens
cctggggaatagagtcaagggg

SEQ ID NO: 9395697 - DNA, 22 bp, Homo sapiens
cctggggaatcttgcaggggaa

SEQ ID NO: 9395698 - DNA, 22 bp, Homo sapiens
cctgggctttggaacagtactt

SEQ ID NO: 9395699 - DNA, 22 bp, Homo sapiens
cctgggctttgctggcaaggcc

SEQ ID NO: 9395700 - DNA, 22 bp, Homo sapiens
cctgggctttgctggcaaggcc

SEQ ID NO: 9395701 - DNA, 22 bp, Homo sapiens
cctgggctttggaacagtactt

SEQ ID NO: 9395702 - DNA, 22 bp, Homo sapiens
cctggggaagtcacttctcttt

SEQ ID NO: 9395703 - DNA, 22 bp, Homo sapiens
cctggggaagtcacttctcttt

SEQ ID NO: 9395704 - DNA, 22 bp, Homo sapiens
cctggggaagtcacttctcttt

SEQ ID NO: 9395705 - DNA, 20 bp, Homo sapiens
cctgggctcaaagcatcctc

SEQ ID NO: 9395706 - DNA, 20 bp, Homo sapiens
cctgggctcaaagcatcctc

SEQ ID NO: 9395707 - DNA, 20 bp, Homo sapiens
cctgggctcaaagcatcctc

SEQ ID NO: 9395708 - DNA, 22 bp, Homo sapiens
cctgggccttgacctcgtgggc

SEQ ID NO: 9395709 - DNA, 22 bp, Homo sapiens
cctgggctttgctggcaaggcc

SEQ ID NO: 9395710 - DNA, 22 bp, Homo sapiens
cctgggcttccacgagcagagg

SEQ ID NO: 9395711 - DNA, 22 bp, Homo sapiens
cctgggcttccacgagcagagg

SEQ ID NO: 9395712 - DNA, 22 bp, Homo sapiens
cctgggctttgctggcaaggcc

SEQ ID NO: 9395713 - DNA, 22 bp, Homo sapiens
cctgggcttccacgagcagagg

SEQ ID NO: 9395714 - DNA, 22 bp, Homo sapiens
cctgggctcaagtgatcctcct

SEQ ID NO: 9395715 - DNA, 22 bp, Homo sapiens
cctgggctcaagcgatcttgtc

SEQ ID NO: 9395716 - DNA, 22 bp, Homo sapiens
cctgggcctctcaaagtgctgg

SEQ ID NO: 9395717 - DNA, 22 bp, Homo sapiens
tgtgtgtctgcacatgtataat

SEQ ID NO: 9395718 - DNA, 22 bp, Homo sapiens
tgtgtgggtggtaaggaaggcc

SEQ ID NO: 9395719 - DNA, 19 bp, Homo sapiens
tgtgtgggtttagagtagt

SEQ ID NO: 9395720 - DNA, 22 bp, Homo sapiens
tgtgtggtgaagcagagatgct

SEQ ID NO: 9395721 - DNA, 22 bp, Homo sapiens
tgtgtgtaaggaagctttatgg

SEQ ID NO: 9395722 - DNA, 22 bp, Homo sapiens
tgtgtgtataataatgtctgca

SEQ ID NO: 9395723 - DNA, 22 bp, Homo sapiens
tgtgtgtataataatgtctgca

SEQ ID NO: 9395724 - DNA, 22 bp, Homo sapiens
tgtgtgtcagtcttgtttaggg

SEQ ID NO: 9395725 - DNA, 21 bp, Homo sapiens
tgtgtgtatgcacacacatgc

SEQ ID NO: 9395726 - DNA, 22 bp, Homo sapiens
tgtgtgtatatgcatttatcta

SEQ ID NO: 9395727 - DNA, 22 bp, Homo sapiens
tgtgtgtatatgcatttatcta

SEQ ID NO: 9395728 - DNA, 22 bp, Homo sapiens
tgtgtgtatatgcatttatcta

SEQ ID NO: 9395729 - DNA, 22 bp, Homo sapiens
cctgggagccaagcctctgtgt

SEQ ID NO: 9395730 - DNA, 22 bp, Homo sapiens
cctgggagccaagcctctgtgt

SEQ ID NO: 9395731 - DNA, 22 bp, Homo sapiens
cctgggagccaagcctctgtgt

SEQ ID NO: 9395732 - DNA, 21 bp, Homo sapiens
cctgggagatcagctgccttc

SEQ ID NO: 9395733 - DNA, 21 bp, Homo sapiens
cctgggagatcagctgccttc

SEQ ID NO: 9395734 - DNA, 21 bp, Homo sapiens
cctgggagatcagctgccttc

SEQ ID NO: 9395735 - DNA, 21 bp, Homo sapiens
cctgggagatcagctgccttc

SEQ ID NO: 9395736 - DNA, 21 bp, Homo sapiens
cctgggagatcagctgccttc

SEQ ID NO: 9395737 - DNA, 22 bp, Homo sapiens
cctgggagccgactgactgtgc

SEQ ID NO: 9395738 - DNA, 22 bp, Homo sapiens
cctgggagctgtggaaaggctg

SEQ ID NO: 9395739 - DNA, 22 bp, Homo sapiens
cctgggagccgactgactgtgc

SEQ ID NO: 9395740 - DNA, 22 bp, Homo sapiens
tgtgccagcctctggctgtgtc

SEQ ID NO: 9395741 - DNA, 22 bp, Homo sapiens
tgtgccagcctctggctgtgtc

SEQ ID NO: 9395742 - DNA, 22 bp, Homo sapiens
tgtgccagcctctggctgtgtc

SEQ ID NO: 9395743 - DNA, 22 bp, Homo sapiens
tgtgccaggcacttgcccaggc

SEQ ID NO: 9395744 - DNA, 22 bp, Homo sapiens
cctgggagagccatctgtggcc

SEQ ID NO: 9395745 - DNA, 22 bp, Homo sapiens
cctgggagagccatctgtggcc

SEQ ID NO: 9395746 - DNA, 22 bp, Homo sapiens
cctgggagagctgcccgggtga

SEQ ID NO: 9395747 - DNA, 22 bp, Homo sapiens
cctgggagagtctgtggtctcc

SEQ ID NO: 9395748 - DNA, 22 bp, Homo sapiens
cctgggagagtctgtggtctcc

SEQ ID NO: 9395749 - DNA, 22 bp, Homo sapiens
cctgggagagtctgtggtctcc

SEQ ID NO: 9395750 - DNA, 22 bp, Homo sapiens
cctgggaagagctgacaggagg

SEQ ID NO: 9395751 - DNA, 22 bp, Homo sapiens
cctgggaagaccggcagtgggg

SEQ ID NO: 9395752 - DNA, 22 bp, Homo sapiens
cctgggaagcccatagcagctt

SEQ ID NO: 9395753 - DNA, 20 bp, Homo sapiens
cctgggaaggcagccccagc

SEQ ID NO: 9395754 - DNA, 22 bp, Homo sapiens
cctgggaagcccatagcagctt

SEQ ID NO: 9395755 - DNA, 20 bp, Homo sapiens
cctgggaaggcagccccagc

SEQ ID NO: 9395756 - DNA, 21 bp, Homo sapiens
cctgggagaattgggtgtggc

SEQ ID NO: 9395757 - DNA, 22 bp, Homo sapiens
tgtgccagttttgtctaagccc

SEQ ID NO: 9395758 - DNA, 22 bp, Homo sapiens
tgtgccagttttgtctaagccc

SEQ ID NO: 9395759 - DNA, 22 bp, Homo sapiens
tgtgccagttttgtctaagccc

SEQ ID NO: 9395760 - DNA, 22 bp, Homo sapiens
tgtgcccaacgtgcaggtttgt

SEQ ID NO: 9395761 - DNA, 23 bp, Homo sapiens
tgtgccattgaggctgaggctca

SEQ ID NO: 9395762 - DNA, 23 bp, Homo sapiens
tgtgccattgaggctgaggctca

SEQ ID NO: 9395763 - DNA, 22 bp, Homo sapiens
tgtgccagtgccttgggtatta

SEQ ID NO: 9395764 - DNA, 22 bp, Homo sapiens
tgtgccagtcatccagatgtgt

SEQ ID NO: 9395765 - DNA, 22 bp, Homo sapiens
tgtgccagggcctccaaaagcc

SEQ ID NO: 9395766 - DNA, 22 bp, Homo sapiens
tgtgcccattacacagaggcat

SEQ ID NO: 9395767 - DNA, 22 bp, Homo sapiens
tgtgcccattccacttgagtac

SEQ ID NO: 9395768 - DNA, 23 bp, Homo sapiens
tgtgctggcatctcaggctttgg

SEQ ID NO: 9395769 - DNA, 22 bp, Homo sapiens
tgtgctgggaaatggcaggata

SEQ ID NO: 9395770 - DNA, 22 bp, Homo sapiens
tgtgctgggaaatggcaggata

SEQ ID NO: 9395771 - DNA, 22 bp, Homo sapiens
tgtgctggggtccagctgagcc

SEQ ID NO: 9395772 - DNA, 22 bp, Homo sapiens
tgtgctggggtccagctgagcc

SEQ ID NO: 9395773 - DNA, 22 bp, Homo sapiens
tgtgctggtacatgtgaggatg

SEQ ID NO: 9395774 - DNA, 22 bp, Homo sapiens
tgtgcttctcacatcactgttg

SEQ ID NO: 9395775 - DNA, 22 bp, Homo sapiens
tgtgcttctctttctcacttaa

SEQ ID NO: 9395776 - DNA, 22 bp, Homo sapiens
tgtgcttctgcagagactattt

SEQ ID NO: 9395777 - DNA, 22 bp, Homo sapiens
cctggctgtgcattgccggccc

SEQ ID NO: 9395778 - DNA, 23 bp, Homo sapiens
cctggctgtggatttgggcctgc

SEQ ID NO: 9395779 - DNA, 23 bp, Homo sapiens
cctggctgtggatttgggcctgc

SEQ ID NO: 9395780 - DNA, 23 bp, Homo sapiens
cctggctgtggatttgggcctgc

SEQ ID NO: 9395781 - DNA, 22 bp, Homo sapiens
cctggctgtgcatgtttctatg

SEQ ID NO: 9395782 - DNA, 19 bp, Homo sapiens
cctggctgtgaagcctgca

SEQ ID NO: 9395783 - DNA, 19 bp, Homo sapiens
cctggctgtgaagcctgca

SEQ ID NO: 9395784 - DNA, 22 bp, Homo sapiens
cctggctgtcgttttgtgaaat

SEQ ID NO: 9395785 - DNA, 19 bp, Homo sapiens
cctggctgtgaagcctgca

SEQ ID NO: 9395786 - DNA, 22 bp, Homo sapiens
cctggctggttgtctgattcta

SEQ ID NO: 9395787 - DNA, 22 bp, Homo sapiens
cctggctgctgtcactgaccat

SEQ ID NO: 9395788 - DNA, 22 bp, Homo sapiens
cctggctgctatagcagcatgt

SEQ ID NO: 9395789 - DNA, 22 bp, Homo sapiens
cctggctgctctgatgagcgcc

SEQ ID NO: 9395790 - DNA, 22 bp, Homo sapiens
cctggctgcattttgctggatg

SEQ ID NO: 9395791 - DNA, 22 bp, Homo sapiens
cctggctgcattttgctggatg

SEQ ID NO: 9395792 - DNA, 22 bp, Homo sapiens
cctggctgcccatggaccctct

SEQ ID NO: 9395793 - DNA, 22 bp, Homo sapiens
cctggctgcccatggaccctct

SEQ ID NO: 9395794 - DNA, 20 bp, Homo sapiens
cctggctgcattcaggacgg

SEQ ID NO: 9395795 - DNA, 22 bp, Homo sapiens
cctggctgcattttgctggatg

SEQ ID NO: 9395796 - DNA, 20 bp, Homo sapiens
cctggctgcattcaggacgg

SEQ ID NO: 9395797 - DNA, 22 bp, Homo sapiens
cctggctgccgagtgtgcagcg

SEQ ID NO: 9395798 - DNA, 22 bp, Homo sapiens
cctggctgctatagcagcatgt

SEQ ID NO: 9395799 - DNA, 22 bp, Homo sapiens
cctggctgctatagcagcatgt

SEQ ID NO: 9395800 - DNA, 22 bp, Homo sapiens
cctggctgctatagcagcatgt

SEQ ID NO: 9395801 - DNA, 22 bp, Homo sapiens
cctggctgccttgtgttgatct

SEQ ID NO: 9395802 - DNA, 22 bp, Homo sapiens
cctggctgcccatggaccctct

SEQ ID NO: 9395803 - DNA, 22 bp, Homo sapiens
cctggctgccgagtgtgcagcg

SEQ ID NO: 9395804 - DNA, 22 bp, Homo sapiens
cctggctgcccatggaccctct

SEQ ID NO: 9395805 - DNA, 22 bp, Homo sapiens
cctggctgccgagtgtgcagcg

SEQ ID NO: 9395806 - DNA, 22 bp, Homo sapiens
cctggctgtttgagcggggaat

SEQ ID NO: 9395807 - DNA, 22 bp, Homo sapiens
cctggctgtttgagcggggaat

SEQ ID NO: 9395808 - DNA, 22 bp, Homo sapiens
cctggctgtggcggtgctctca

SEQ ID NO: 9395809 - DNA, 22 bp, Homo sapiens
cctggctgtggcggtgctctca

SEQ ID NO: 9395810 - DNA, 22 bp, Homo sapiens
cctggctgtggcggtgctctca

SEQ ID NO: 9395811 - DNA, 22 bp, Homo sapiens
cctggctgtttatttcggggct

SEQ ID NO: 9395812 - DNA, 22 bp, Homo sapiens
cctggctgtttatttcggggct

SEQ ID NO: 9395813 - DNA, 22 bp, Homo sapiens
cctggctgtgtgaccttggcaa

SEQ ID NO: 9395814 - DNA, 22 bp, Homo sapiens
cctggctgtgtgaccttggcaa

SEQ ID NO: 9395815 - DNA, 22 bp, Homo sapiens
cctggctttgaccttgctgttt

SEQ ID NO: 9395816 - DNA, 23 bp, Homo sapiens
cctgggaaaactgctgatcttgc

SEQ ID NO: 9395817 - DNA, 18 bp, Homo sapiens
cctggcttttctacttgc

SEQ ID NO: 9395818 - DNA, 22 bp, Homo sapiens
cctgggaaagtgaggtcattat

SEQ ID NO: 9395819 - DNA, 22 bp, Homo sapiens
cctgggaacagcagagtcctgg

SEQ ID NO: 9395820 - DNA, 22 bp, Homo sapiens
cctgggaaagtgaggtcattat

SEQ ID NO: 9395821 - DNA, 22 bp, Homo sapiens
cctgggaacagtgggttggctc

SEQ ID NO: 9395822 - DNA, 22 bp, Homo sapiens
cctgggaagaccggcagtgggg

SEQ ID NO: 9395823 - DNA, 22 bp, Homo sapiens
cctgggaagaccggcagtgggg

SEQ ID NO: 9395824 - DNA, 22 bp, Homo sapiens
tgtctggtgggttgacaggcag

SEQ ID NO: 9395825 - DNA, 22 bp, Homo sapiens
tgtctggtgggttgacaggcag

SEQ ID NO: 9395826 - DNA, 23 bp, Homo sapiens
tgtctggttcatgcttattttgg

SEQ ID NO: 9395827 - DNA, 22 bp, Homo sapiens
tgtctggtttgaagtccatgat

SEQ ID NO: 9395828 - DNA, 23 bp, Homo sapiens
tgtctggtttcttttatttagca

SEQ ID NO: 9395829 - DNA, 22 bp, Homo sapiens
tgtctgtaaggtgtttatgtta

SEQ ID NO: 9395830 - DNA, 22 bp, Homo sapiens
tgtctgtattgaggtgcatatt

SEQ ID NO: 9395831 - DNA, 22 bp, Homo sapiens
tgtctgtcagatattaagtttc

SEQ ID NO: 9395832 - DNA, 20 bp, Homo sapiens
tgtctgtatgcagtcatata

SEQ ID NO: 9395833 - DNA, 17 bp, Homo sapiens
tgtctgtcatcagttcc

SEQ ID NO: 9395834 - DNA, 22 bp, Homo sapiens
tgtctgtctgcacagctcatgg

SEQ ID NO: 9395835 - DNA, 23 bp, Homo sapiens
tgtctgtcatggaatttcaaggt

SEQ ID NO: 9395836 - DNA, 22 bp, Homo sapiens
tgtctttagagtcacaaaacca

SEQ ID NO: 9395837 - DNA, 22 bp, Homo sapiens
tgtctgtctgtccttctcatta

SEQ ID NO: 9395838 - DNA, 22 bp, Homo sapiens
tgtctgtctttagtgagattgc

SEQ ID NO: 9395839 - DNA, 22 bp, Homo sapiens
tgtctttagttgcttagatttg

SEQ ID NO: 9395840 - DNA, 22 bp, Homo sapiens
tgtctggggaactgtgcatcca

SEQ ID NO: 9395841 - DNA, 21 bp, Homo sapiens
cctggctgcacagttgctggt

SEQ ID NO: 9395842 - DNA, 22 bp, Homo sapiens
tgtctgggggttctgaaagctg

SEQ ID NO: 9395843 - DNA, 23 bp, Homo sapiens
tgtctggggcgccagaagagaga

SEQ ID NO: 9395844 - DNA, 22 bp, Homo sapiens
tgtctgggttttgggtcatatt

SEQ ID NO: 9395845 - DNA, 22 bp, Homo sapiens
cctggctgaggggccaaggacc

SEQ ID NO: 9395846 - DNA, 21 bp, Homo sapiens
cctggctgcacagttgctggt

SEQ ID NO: 9395847 - DNA, 22 bp, Homo sapiens
cctggctgaggggccaaggacc

SEQ ID NO: 9395848 - DNA, 22 bp, Homo sapiens
cctggctgagggacctcgggta

SEQ ID NO: 9395849 - DNA, 22 bp, Homo sapiens
cctggctgaggggccaaggacc

SEQ ID NO: 9395850 - DNA, 22 bp, Homo sapiens
cctggctgaggggccaaggacc

SEQ ID NO: 9395851 - DNA, 22 bp, Homo sapiens
cctggctgagggacctcgggta

SEQ ID NO: 9395852 - DNA, 22 bp, Homo sapiens
cctggctgagcctccaggaaga

SEQ ID NO: 9395853 - DNA, 23 bp, Homo sapiens
cctggctgacctgaaggtgtagt

SEQ ID NO: 9395854 - DNA, 22 bp, Homo sapiens
cctggctcttcgggagtttgtt

SEQ ID NO: 9395855 - DNA, 22 bp, Homo sapiens
cctggctctgaagtccacatca

SEQ ID NO: 9395856 - DNA, 22 bp, Homo sapiens
cctggctgacagcttaattcca

SEQ ID NO: 9395857 - DNA, 22 bp, Homo sapiens
cctggctgaaccaatgaagtgg

SEQ ID NO: 9395858 - DNA, 22 bp, Homo sapiens
cctggctgaacaaagtccctcc

SEQ ID NO: 9395859 - DNA, 22 bp, Homo sapiens
cctggctgaacaaagtccctcc

SEQ ID NO: 9395860 - DNA, 22 bp, Homo sapiens
cctggctgaacaaagtccctcc

SEQ ID NO: 9395861 - DNA, 22 bp, Homo sapiens
cctggctgaacaaagtccctcc

SEQ ID NO: 9395862 - DNA, 22 bp, Homo sapiens
tgtctttctatctctagattta

SEQ ID NO: 9395863 - DNA, 22 bp, Homo sapiens
tgtctttctgcaccacctcaca

SEQ ID NO: 9395864 - DNA, 22 bp, Homo sapiens
tgtgaagaattaatgtgaatca

SEQ ID NO: 9395865 - DNA, 22 bp, Homo sapiens
tgtgaacttaagattccttatc

SEQ ID NO: 9395866 - DNA, 22 bp, Homo sapiens
tgtgaagagagtaataaagtca

SEQ ID NO: 9395867 - DNA, 22 bp, Homo sapiens
tgtgaagaattaatgtgaatca

SEQ ID NO: 9395868 - DNA, 22 bp, Homo sapiens
tgtgaagaattaatgtgaatca

SEQ ID NO: 9395869 - DNA, 22 bp, Homo sapiens
tgtctttggaatatttagctga

SEQ ID NO: 9395870 - DNA, 22 bp, Homo sapiens
tgtctttggaatatttagctga

SEQ ID NO: 9395871 - DNA, 22 bp, Homo sapiens
tgtgaagcatagattctgtaga

SEQ ID NO: 9395872 - DNA, 20 bp, Homo sapiens
tgtgaagcaggagggtggtt

SEQ ID NO: 9395873 - DNA, 22 bp, Homo sapiens
tgtgaagcatagattctgtaga

SEQ ID NO: 9395874 - DNA, 22 bp, Homo sapiens
tgtgaagcatagattctgtaga

SEQ ID NO: 9395875 - DNA, 22 bp, Homo sapiens
tgtgaagcatagattctgtaga

SEQ ID NO: 9395876 - DNA, 22 bp, Homo sapiens
tgtgaagagtagacatgtggtg

SEQ ID NO: 9395877 - DNA, 22 bp, Homo sapiens
tgtgaagatcagggtcctagag

SEQ ID NO: 9395878 - DNA, 22 bp, Homo sapiens
tgtgaaggtaaggaggggcaag

SEQ ID NO: 9395879 - DNA, 22 bp, Homo sapiens
tgtgaaggcagagccagtgaaa

SEQ ID NO: 9395880 - DNA, 23 bp, Homo sapiens
tgtgaaggtgggtccaagggctg

SEQ ID NO: 9395881 - DNA, 22 bp, Homo sapiens
tgtgaagctggatcctggagct

SEQ ID NO: 9395882 - DNA, 22 bp, Homo sapiens
tgtgaaggagatgaagggagtg

SEQ ID NO: 9395883 - DNA, 22 bp, Homo sapiens
tgtgaaggagcatgcagagggg

SEQ ID NO: 9395884 - DNA, 22 bp, Homo sapiens
tgtgaaggcagagccagtgaaa

SEQ ID NO: 9395885 - DNA, 22 bp, Homo sapiens
tgtgaaggcagagccagtgaaa

SEQ ID NO: 9395886 - DNA, 22 bp, Homo sapiens
tgtgaggatggagttctacagg

SEQ ID NO: 9395887 - DNA, 22 bp, Homo sapiens
tgtgaggcctctgcaggagcag

SEQ ID NO: 9395888 - DNA, 22 bp, Homo sapiens
tgtgaggcctagacagcctggg

SEQ ID NO: 9395889 - DNA, 22 bp, Homo sapiens
tgtgaggcgaggccagtgagct

SEQ ID NO: 9395890 - DNA, 22 bp, Homo sapiens
tgtgaggcctctgcaggagcag

SEQ ID NO: 9395891 - DNA, 22 bp, Homo sapiens
cctggctgcagtttttgcagaa

SEQ ID NO: 9395892 - DNA, 20 bp, Homo sapiens
cctggctgcattcaggacgg

SEQ ID NO: 9395893 - DNA, 21 bp, Homo sapiens
cctggctgcacagttgctggt

SEQ ID NO: 9395894 - DNA, 21 bp, Homo sapiens
cctggctgcacagttgctggt

SEQ ID NO: 9395895 - DNA, 22 bp, Homo sapiens
tgtgagggttttaagggaatga

SEQ ID NO: 9395896 - DNA, 22 bp, Homo sapiens
tgtgaggctacctgccagggtc

SEQ ID NO: 9395897 - DNA, 22 bp, Homo sapiens
tgtgaggcgaggccagtgagct

SEQ ID NO: 9395898 - DNA, 22 bp, Homo sapiens
tgtgaggagtaggctgagggtg

SEQ ID NO: 9395899 - DNA, 22 bp, Homo sapiens
tgtgaggataaaaaggaaggag

SEQ ID NO: 9395900 - DNA, 20 bp, Homo sapiens
tgtgaggagcatggccgctg

SEQ ID NO: 9395901 - DNA, 22 bp, Homo sapiens
tgtgaggacattggaggactca

SEQ ID NO: 9395902 - DNA, 22 bp, Homo sapiens
tgtgaggacattggaggactca

SEQ ID NO: 9395903 - DNA, 22 bp, Homo sapiens
tgtgaggaacaggactagagca

SEQ ID NO: 9395904 - DNA, 20 bp, Homo sapiens
tgtgagcagatgctgagtga

SEQ ID NO: 9395905 - DNA, 22 bp, Homo sapiens
tgtgagcagagacatgaaaagc

SEQ ID NO: 9395906 - DNA, 22 bp, Homo sapiens
cccagcttgcgggcggcaggag

SEQ ID NO: 9395907 - DNA, 22 bp, Homo sapiens
cccagcttgcaaatgggttgct

SEQ ID NO: 9395908 - DNA, 22 bp, Homo sapiens
cccagcttctgagggggccttg

SEQ ID NO: 9395909 - DNA, 23 bp, Homo sapiens
cccagctttcccactgccgagag

SEQ ID NO: 9395910 - DNA, 22 bp, Homo sapiens
cccaggaaaagcagtgccagca

SEQ ID NO: 9395911 - DNA, 22 bp, Homo sapiens
cccaggaaacccgaaggcgacc

SEQ ID NO: 9395912 - DNA, 22 bp, Homo sapiens
tgcatgtttctgtatgttaatg

SEQ ID NO: 9395913 - DNA, 22 bp, Homo sapiens
tgcatcacaggcaagcaaggct

SEQ ID NO: 9395914 - DNA, 22 bp, Homo sapiens
tgcatcacccttgaaccatcca

SEQ ID NO: 9395915 - DNA, 17 bp, Homo sapiens
cccagctggcagtgccg

SEQ ID NO: 9395916 - DNA, 17 bp, Homo sapiens
cccagctggcagtgccg

SEQ ID NO: 9395917 - DNA, 17 bp, Homo sapiens
cccagctggcagtgccg

SEQ ID NO: 9395918 - DNA, 22 bp, Homo sapiens
cccagctgtggcagaggccggg

SEQ ID NO: 9395919 - DNA, 23 bp, Homo sapiens
cccagctggaagttagaggacca

SEQ ID NO: 9395920 - DNA, 23 bp, Homo sapiens
cccagctgcagacaagggagggt

SEQ ID NO: 9395921 - DNA, 22 bp, Homo sapiens
cccagctgatttttgcagagat

SEQ ID NO: 9395922 - DNA, 22 bp, Homo sapiens
cccagctcttcaagtcaccccc

SEQ ID NO: 9395923 - DNA, 22 bp, Homo sapiens
cccagctcttcaagtcaccccc

SEQ ID NO: 9395924 - DNA, 22 bp, Homo sapiens
tctgtggcagttctggttcatc

SEQ ID NO: 9395925 - DNA, 22 bp, Homo sapiens
tctgtggcatgaggaaataggc

SEQ ID NO: 9395926 - DNA, 22 bp, Homo sapiens
tctgtggcatagtgcttgggaa

SEQ ID NO: 9395927 - DNA, 22 bp, Homo sapiens
tctgtggcatgttgcacttgta

SEQ ID NO: 9395928 - DNA, 22 bp, Homo sapiens
tctgtggcatggtatctggagg

SEQ ID NO: 9395929 - DNA, 22 bp, Homo sapiens
tctgtggcatggtatctggagg

SEQ ID NO: 9395930 - DNA, 23 bp, Homo sapiens
tctgtggccccttcgccccactc

SEQ ID NO: 9395931 - DNA, 22 bp, Homo sapiens
tctgtggcccaagtgatggctg

SEQ ID NO: 9395932 - DNA, 22 bp, Homo sapiens
tctgtggcctgcctcctcattt

SEQ ID NO: 9395933 - DNA, 22 bp, Homo sapiens
tctgtggcctgcctcctcattt

SEQ ID NO: 9395934 - DNA, 22 bp, Homo sapiens
tctgtggcctccttccacttac

SEQ ID NO: 9395935 - DNA, 22 bp, Homo sapiens
cccagcctactctgccatagca

SEQ ID NO: 9395936 - DNA, 19 bp, Homo sapiens
tctgtggccttccctgatg

SEQ ID NO: 9395937 - DNA, 22 bp, Homo sapiens
tctgtggcctgtgtccaagtgc

SEQ ID NO: 9395938 - DNA, 22 bp, Homo sapiens
tctgtggcgcatagttgtctct

SEQ ID NO: 9395939 - DNA, 21 bp, Homo sapiens
tctgtggcggactctaggccc

SEQ ID NO: 9395940 - DNA, 21 bp, Homo sapiens
tctgtggcggactctaggccc

SEQ ID NO: 9395941 - DNA, 22 bp, Homo sapiens
cccagcctttgcttcctggttc

SEQ ID NO: 9395942 - DNA, 22 bp, Homo sapiens
cccagccttccaccctggacta

SEQ ID NO: 9395943 - DNA, 22 bp, Homo sapiens
cccagcctttgcttcctggttc

SEQ ID NO: 9395944 - DNA, 22 bp, Homo sapiens
cccagcctgtctttcccaatga

SEQ ID NO: 9395945 - DNA, 22 bp, Homo sapiens
cccagcctgtctttcccaatga

SEQ ID NO: 9395946 - DNA, 22 bp, Homo sapiens
cccagcctgtgacagccgtcct

SEQ ID NO: 9395947 - DNA, 22 bp, Homo sapiens
cccagcctgtgacagccgtcct

SEQ ID NO: 9395948 - DNA, 22 bp, Homo sapiens
cccagcctgtgacagccgtcct

SEQ ID NO: 9395949 - DNA, 22 bp, Homo sapiens
cccagcgagtttgccggtgaac

SEQ ID NO: 9395950 - DNA, 23 bp, Homo sapiens
cccagcgctgagccctgcaggca

SEQ ID NO: 9395951 - DNA, 22 bp, Homo sapiens
cccagctcaagcagagagctaa

SEQ ID NO: 9395952 - DNA, 22 bp, Homo sapiens
tgcagggaatgcttgcagcatg

SEQ ID NO: 9395953 - DNA, 22 bp, Homo sapiens
tgcagggaatgcttgcagcatg

SEQ ID NO: 9395954 - DNA, 22 bp, Homo sapiens
tgcagggacacgaagacaaata

SEQ ID NO: 9395955 - DNA, 22 bp, Homo sapiens
tgcagggaatgcttgcagcatg

SEQ ID NO: 9395956 - DNA, 22 bp, Homo sapiens
cccagctccgagctccgagccg

SEQ ID NO: 9395957 - DNA, 22 bp, Homo sapiens
cccagctcttcaagtcaccccc

SEQ ID NO: 9395958 - DNA, 22 bp, Homo sapiens
tgcagggaccccgaggctctct

SEQ ID NO: 9395959 - DNA, 22 bp, Homo sapiens
tgcagggagctctggggtgcag

SEQ ID NO: 9395960 - DNA, 22 bp, Homo sapiens
tgccacaccaacatctttcagc

SEQ ID NO: 9395961 - DNA, 22 bp, Homo sapiens
tgccacagacaggacagaacag

SEQ ID NO: 9395962 - DNA, 22 bp, Homo sapiens
tgccaagtgcttacttggccct

SEQ ID NO: 9395963 - DNA, 22 bp, Homo sapiens
tgccaagataacacagctagta

SEQ ID NO: 9395964 - DNA, 22 bp, Homo sapiens
tgccaagataacacagctagta

SEQ ID NO: 9395965 - DNA, 22 bp, Homo sapiens
tgccaagatgtaggcaggcata

SEQ ID NO: 9395966 - DNA, 22 bp, Homo sapiens
tgccaagcacagaggggccact

SEQ ID NO: 9395967 - DNA, 22 bp, Homo sapiens
tgccaagagggcagagggcagt

SEQ ID NO: 9395968 - DNA, 22 bp, Homo sapiens
tgccacagagcaattctgctga

SEQ ID NO: 9395969 - DNA, 22 bp, Homo sapiens
cccaggaggtggaggctgcagt

SEQ ID NO: 9395970 - DNA, 22 bp, Homo sapiens
cccaggagggtggcctctgccc

SEQ ID NO: 9395971 - DNA, 22 bp, Homo sapiens
cccaggaggtggaggctgcagt

SEQ ID NO: 9395972 - DNA, 22 bp, Homo sapiens
cccaggaggtggaggctgcagt

SEQ ID NO: 9395973 - DNA, 22 bp, Homo sapiens
cccaggaggtgtgcccaactcg

SEQ ID NO: 9395974 - DNA, 22 bp, Homo sapiens
tgccaggcctcaggagtctcca

SEQ ID NO: 9395975 - DNA, 22 bp, Homo sapiens
tgccaggcctcaggagtctcca

SEQ ID NO: 9395976 - DNA, 22 bp, Homo sapiens
tgccaggcctcaggagtctcca

SEQ ID NO: 9395977 - DNA, 22 bp, Homo sapiens
cccaggaggttgaggctgcagt

SEQ ID NO: 9395978 - DNA, 22 bp, Homo sapiens
cccaggaggttgaggctgcagt

SEQ ID NO: 9395979 - DNA, 22 bp, Homo sapiens
cccaggaggtgtgcccaactcg

SEQ ID NO: 9395980 - DNA, 22 bp, Homo sapiens
cccaggaggttgaggctgcagt

SEQ ID NO: 9395981 - DNA, 22 bp, Homo sapiens
cccaggcactcttggtcatttt

SEQ ID NO: 9395982 - DNA, 22 bp, Homo sapiens
cccaggcactcttggtcatttt

SEQ ID NO: 9395983 - DNA, 22 bp, Homo sapiens
cccaggcacatccactctgtga

SEQ ID NO: 9395984 - DNA, 22 bp, Homo sapiens
cccaggcagaattagtgtttca

SEQ ID NO: 9395985 - DNA, 22 bp, Homo sapiens
cccaggcagaattagtgtttca

SEQ ID NO: 9395986 - DNA, 22 bp, Homo sapiens
cccaggcagaattagtgtttca

SEQ ID NO: 9395987 - DNA, 22 bp, Homo sapiens
cccaggcagagagctggtgagc

SEQ ID NO: 9395988 - DNA, 22 bp, Homo sapiens
cccaggcagagagctggtgagc

SEQ ID NO: 9395989 - DNA, 22 bp, Homo sapiens
cccaggcagagagctggtgagc

SEQ ID NO: 9395990 - DNA, 22 bp, Homo sapiens
cccaggcacatccactctgtga

SEQ ID NO: 9395991 - DNA, 22 bp, Homo sapiens
cccaggcacatccactctgtga

SEQ ID NO: 9395992 - DNA, 22 bp, Homo sapiens
cccaggcacagattatcccaat

SEQ ID NO: 9395993 - DNA, 22 bp, Homo sapiens
cccaggcacagattatcccaat

SEQ ID NO: 9395994 - DNA, 22 bp, Homo sapiens
cccaggcacactgaagtgacat

SEQ ID NO: 9395995 - DNA, 22 bp, Homo sapiens
cccaggcacactgaagtgacat

SEQ ID NO: 9395996 - DNA, 22 bp, Homo sapiens
cccaggcacactgaagtgacat

SEQ ID NO: 9395997 - DNA, 22 bp, Homo sapiens
cccaggcacactgaagtgacat

SEQ ID NO: 9395998 - DNA, 22 bp, Homo sapiens
cccaggcacaccccgaacggaa

SEQ ID NO: 9395999 - DNA, 22 bp, Homo sapiens
cccaggatgtcgaggctgcagt

SEQ ID NO: 9396000 - DNA, 21 bp, Homo sapiens
tgccaggcctgagctggggtc

SEQ ID NO: 9396001 - DNA, 21 bp, Homo sapiens
tgccaggcctgagctggggtc

SEQ ID NO: 9396002 - DNA, 21 bp, Homo sapiens
tgccaggcctgagctggggtc

SEQ ID NO: 9396003 - DNA, 22 bp, Homo sapiens
tgccaggcgtggtggtgcgcac

SEQ ID NO: 9396004 - DNA, 22 bp, Homo sapiens
tgccaggcgtggtggtgcgcac

SEQ ID NO: 9396005 - DNA, 22 bp, Homo sapiens
tgccaggcgattgctatcagca

SEQ ID NO: 9396006 - DNA, 22 bp, Homo sapiens
tgccaggcgattgctatcagca

SEQ ID NO: 9396007 - DNA, 22 bp, Homo sapiens
tgccaggcgattgctatcagca

SEQ ID NO: 9396008 - DNA, 22 bp, Homo sapiens
tgccaggcgtggtggtgcgcac

SEQ ID NO: 9396009 - DNA, 22 bp, Homo sapiens
cccaggcagcctgcagggaagg

SEQ ID NO: 9396010 - DNA, 22 bp, Homo sapiens
cccaggcagcggggtctccttg

SEQ ID NO: 9396011 - DNA, 22 bp, Homo sapiens
cccaggcagcctgcagggaagg

SEQ ID NO: 9396012 - DNA, 22 bp, Homo sapiens
cccaggcagcggggtctccttg

SEQ ID NO: 9396013 - DNA, 22 bp, Homo sapiens
cccaggcagcggggtctccttg

SEQ ID NO: 9396014 - DNA, 22 bp, Homo sapiens
cccaggcagcggggtctccttg

SEQ ID NO: 9396015 - DNA, 20 bp, Homo sapiens
cccaggcagagctagcggca

SEQ ID NO: 9396016 - DNA, 22 bp, Homo sapiens
cccaggcagccccagaagcttg

SEQ ID NO: 9396017 - DNA, 22 bp, Homo sapiens
cccaggcagccccagaagcttg

SEQ ID NO: 9396018 - DNA, 22 bp, Homo sapiens
cccaggcagccccagaagcttg

SEQ ID NO: 9396019 - DNA, 22 bp, Homo sapiens
cccaggcagcccttctgacgca

SEQ ID NO: 9396020 - DNA, 22 bp, Homo sapiens
cccaggcagcccttctgacgca

SEQ ID NO: 9396021 - DNA, 22 bp, Homo sapiens
cccaggcagtgtgtgcatgcgt

SEQ ID NO: 9396022 - DNA, 22 bp, Homo sapiens
cccaggcagtgctgatccctca

SEQ ID NO: 9396023 - DNA, 22 bp, Homo sapiens
cccaggcagtctggctctaaag

SEQ ID NO: 9396024 - DNA, 22 bp, Homo sapiens
cccaggcagtgctgatccctca

SEQ ID NO: 9396025 - DNA, 22 bp, Homo sapiens
cccaggcagtgctgatccctca

SEQ ID NO: 9396026 - DNA, 22 bp, Homo sapiens
cccaggcagggacgtgctctgg

SEQ ID NO: 9396027 - DNA, 22 bp, Homo sapiens
cccaggcagggacgtgctctgg

SEQ ID NO: 9396028 - DNA, 22 bp, Homo sapiens
cccaggcagtagaaagaagagg

SEQ ID NO: 9396029 - DNA, 22 bp, Homo sapiens
cccaggcagtagaaagaagagg

SEQ ID NO: 9396030 - DNA, 22 bp, Homo sapiens
cccaggcaggagtgtggtggct

SEQ ID NO: 9396031 - DNA, 22 bp, Homo sapiens
cccaggcaggagtgtggtggct

SEQ ID NO: 9396032 - DNA, 22 bp, Homo sapiens
cccaggcaggagtgtggtggct

SEQ ID NO: 9396033 - DNA, 22 bp, Homo sapiens
cccaggcagggacgtgctctgg

SEQ ID NO: 9396034 - DNA, 22 bp, Homo sapiens
cccaggcagggacgtgctctgg

SEQ ID NO: 9396035 - DNA, 22 bp, Homo sapiens
tgctcccacactactcggaggc

SEQ ID NO: 9396036 - DNA, 22 bp, Homo sapiens
tgctcccacactactcggaggc

SEQ ID NO: 9396037 - DNA, 22 bp, Homo sapiens
tgctcccacactactcggaggc

SEQ ID NO: 9396038 - DNA, 22 bp, Homo sapiens
cccagggaggcccaggctctgc

SEQ ID NO: 9396039 - DNA, 22 bp, Homo sapiens
cccagggaggcccaggctctgc

SEQ ID NO: 9396040 - DNA, 22 bp, Homo sapiens
cccagggaggcccaggctctgc

SEQ ID NO: 9396041 - DNA, 22 bp, Homo sapiens
cccagggagagcgcggaggcgg

SEQ ID NO: 9396042 - DNA, 22 bp, Homo sapiens
cccagggagagcgcggaggcgg

SEQ ID NO: 9396043 - DNA, 22 bp, Homo sapiens
cccagggatgtggcagatgtta

SEQ ID NO: 9396044 - DNA, 22 bp, Homo sapiens
cccagggaggtagcaggagaaa

SEQ ID NO: 9396045 - DNA, 22 bp, Homo sapiens
cccagggattataaaggtgaaa

SEQ ID NO: 9396046 - DNA, 22 bp, Homo sapiens
tgctctggagtggcttgtgcac

SEQ ID NO: 9396047 - DNA, 22 bp, Homo sapiens
tgctctggagtggcttgtgcac

SEQ ID NO: 9396048 - DNA, 22 bp, Homo sapiens
tgctgaagttactagagactat

SEQ ID NO: 9396049 - DNA, 23 bp, Homo sapiens
tgctgaagtgttggccctgccca

SEQ ID NO: 9396050 - DNA, 22 bp, Homo sapiens
tgctgaagtccaagagctccaa

SEQ ID NO: 9396051 - DNA, 22 bp, Homo sapiens
tgctgaagtccatctgtttgac

SEQ ID NO: 9396052 - DNA, 22 bp, Homo sapiens
tgctgacctaaattgaggaaga

SEQ ID NO: 9396053 - DNA, 22 bp, Homo sapiens
tgctgaccttgttctgtgagga

SEQ ID NO: 9396054 - DNA, 22 bp, Homo sapiens
tgctgcagaaattctgtgagga

SEQ ID NO: 9396055 - DNA, 20 bp, Homo sapiens
tgctgcagacagggccattg

SEQ ID NO: 9396056 - DNA, 22 bp, Homo sapiens
tgctgcaagtatttattctggg

SEQ ID NO: 9396057 - DNA, 22 bp, Homo sapiens
tgctgcaacattttataactca

SEQ ID NO: 9396058 - DNA, 22 bp, Homo sapiens
tgctgcacagcccgctggccca

SEQ ID NO: 9396059 - DNA, 22 bp, Homo sapiens
tgctgaataataagattactca

SEQ ID NO: 9396060 - DNA, 22 bp, Homo sapiens
tgctgaagttcttcccctaatg

SEQ ID NO: 9396061 - DNA, 19 bp, Homo sapiens
tgctgaagttgtcagtctg

SEQ ID NO: 9396062 - DNA, 21 bp, Homo sapiens
tgctgacatcaggtctgctat

SEQ ID NO: 9396063 - DNA, 21 bp, Homo sapiens
tgctgacatcaggtctgctat

SEQ ID NO: 9396064 - DNA, 22 bp, Homo sapiens
cccaggctcttatgtgacttgc

SEQ ID NO: 9396065 - DNA, 21 bp, Homo sapiens
cccaggctgaattaaaaatat

SEQ ID NO: 9396066 - DNA, 21 bp, Homo sapiens
cccaggctgaattaaaaatat

SEQ ID NO: 9396067 - DNA, 22 bp, Homo sapiens
cccaggctcctgactcattcta

SEQ ID NO: 9396068 - DNA, 22 bp, Homo sapiens
cccaggctcctgctgtgttgac

SEQ ID NO: 9396069 - DNA, 22 bp, Homo sapiens
cccaggctcctgctgtgttgac

SEQ ID NO: 9396070 - DNA, 22 bp, Homo sapiens
cccaggctcctgactcattcta

SEQ ID NO: 9396071 - DNA, 22 bp, Homo sapiens
cccaggctcctgactcattcta

SEQ ID NO: 9396072 - DNA, 22 bp, Homo sapiens
cccaggctcctgactcattcta

SEQ ID NO: 9396073 - DNA, 22 bp, Homo sapiens
tgctccagtgagctggccatcc

SEQ ID NO: 9396074 - DNA, 22 bp, Homo sapiens
tgctccaggtgtgcctctcatg

SEQ ID NO: 9396075 - DNA, 22 bp, Homo sapiens
tgctccagtgagctggccatcc

SEQ ID NO: 9396076 - DNA, 22 bp, Homo sapiens
tgctccagtgagctggccatcc

SEQ ID NO: 9396077 - DNA, 22 bp, Homo sapiens
tgctccagggctgccagaccct

SEQ ID NO: 9396078 - DNA, 22 bp, Homo sapiens
tgctccaggtgtgcctctcatg

SEQ ID NO: 9396079 - DNA, 23 bp, Homo sapiens
tgctccaggtacagaactccagg

SEQ ID NO: 9396080 - DNA, 19 bp, Homo sapiens
tgctccattgaggtgtctc

SEQ ID NO: 9396081 - DNA, 22 bp, Homo sapiens
tgctcccaaacctgacaggctc

SEQ ID NO: 9396082 - DNA, 22 bp, Homo sapiens
tgctccatgcgctcggccggcg

SEQ ID NO: 9396083 - DNA, 22 bp, Homo sapiens
tgctccatgcgctcggccggcg

SEQ ID NO: 9396084 - DNA, 22 bp, Homo sapiens
tgctccagtgcctgccccacag

SEQ ID NO: 9396085 - DNA, 22 bp, Homo sapiens
tgctccagtgcctgccccacag

SEQ ID NO: 9396086 - DNA, 22 bp, Homo sapiens
tgctccatctctcgtggttcca

SEQ ID NO: 9396087 - DNA, 22 bp, Homo sapiens
tgctccatctctcgtggttcca

SEQ ID NO: 9396088 - DNA, 22 bp, Homo sapiens
tgcctgggactctgttatcttg

SEQ ID NO: 9396089 - DNA, 22 bp, Homo sapiens
tgcctgggagtgaccaagactc

SEQ ID NO: 9396090 - DNA, 22 bp, Homo sapiens
tgcctgctcttgagacttacaa

SEQ ID NO: 9396091 - DNA, 22 bp, Homo sapiens
tgcctgctcttaccactctccc

SEQ ID NO: 9396092 - DNA, 20 bp, Homo sapiens
tgcctgggaaggcgtggagg

SEQ ID NO: 9396093 - DNA, 20 bp, Homo sapiens
tgcctgggaaggcgtggagg

SEQ ID NO: 9396094 - DNA, 22 bp, Homo sapiens
cccaggctcctagaggcccaga

SEQ ID NO: 9396095 - DNA, 22 bp, Homo sapiens
cccaggctcctagaggcccaga

SEQ ID NO: 9396096 - DNA, 22 bp, Homo sapiens
cccaggctcctagaggcccaga

SEQ ID NO: 9396097 - DNA, 22 bp, Homo sapiens
tgcctgggccttcccacctctg

SEQ ID NO: 9396098 - DNA, 22 bp, Homo sapiens
tgcctgggatctgtgccctttg

SEQ ID NO: 9396099 - DNA, 22 bp, Homo sapiens
tgcctgggatctgtgccctttg

SEQ ID NO: 9396100 - DNA, 22 bp, Homo sapiens
tgctggagagccttggccaagg

SEQ ID NO: 9396101 - DNA, 22 bp, Homo sapiens
tgctggagagctagttctgcag

SEQ ID NO: 9396102 - DNA, 22 bp, Homo sapiens
tgctggagaggaaggtggggtc

SEQ ID NO: 9396103 - DNA, 22 bp, Homo sapiens
tgctggagaggaaggtggggtc

SEQ ID NO: 9396104 - DNA, 22 bp, Homo sapiens
tgctggagatcattaatgttca

SEQ ID NO: 9396105 - DNA, 22 bp, Homo sapiens
tgctggagatgaaagggccctg

SEQ ID NO: 9396106 - DNA, 22 bp, Homo sapiens
tgctggagatgaaagggccctg

SEQ ID NO: 9396107 - DNA, 22 bp, Homo sapiens
tgctggagcatctgagagcatc

SEQ ID NO: 9396108 - DNA, 22 bp, Homo sapiens
tgctggagcccaggcggccttt

SEQ ID NO: 9396109 - DNA, 22 bp, Homo sapiens
ccccaggcagggcctaacagag

SEQ ID NO: 9396110 - DNA, 22 bp, Homo sapiens
ccccaggcctgttggatggcgc

SEQ ID NO: 9396111 - DNA, 22 bp, Homo sapiens
ccccaggcctgttggatggcgc

SEQ ID NO: 9396112 - DNA, 22 bp, Homo sapiens
tgctggagcaacattattgtgc

SEQ ID NO: 9396113 - DNA, 22 bp, Homo sapiens
tgctggagcatctgagagcatc

SEQ ID NO: 9396114 - DNA, 22 bp, Homo sapiens
tgctggagcatctgagagcatc

SEQ ID NO: 9396115 - DNA, 22 bp, Homo sapiens
tgctggagacatagcaggcagc

SEQ ID NO: 9396116 - DNA, 22 bp, Homo sapiens
tgctggagacctgcttgcacca

SEQ ID NO: 9396117 - DNA, 22 bp, Homo sapiens
tgctggagacatagcaggcagc

SEQ ID NO: 9396118 - DNA, 22 bp, Homo sapiens
tgctggagacatagcaggcagc

SEQ ID NO: 9396119 - DNA, 22 bp, Homo sapiens
ccccagctcagtgcagggacat

SEQ ID NO: 9396120 - DNA, 22 bp, Homo sapiens
tgctggagactcactcaggtgc

SEQ ID NO: 9396121 - DNA, 22 bp, Homo sapiens
tgctggagacctgcttgcacca

SEQ ID NO: 9396122 - DNA, 22 bp, Homo sapiens
ccccagccttccatgggaattg

SEQ ID NO: 9396123 - DNA, 22 bp, Homo sapiens
ccccagccttccatgggaattg

SEQ ID NO: 9396124 - DNA, 22 bp, Homo sapiens
ccccagcccacaagcatattaa

SEQ ID NO: 9396125 - DNA, 23 bp, Homo sapiens
tgctggagacaagtgtgagaagg

SEQ ID NO: 9396126 - DNA, 22 bp, Homo sapiens
tgctggagacatagcaggcagc

SEQ ID NO: 9396127 - DNA, 22 bp, Homo sapiens
ccccagcaggaatacaggggtc

SEQ ID NO: 9396128 - DNA, 22 bp, Homo sapiens
ccccagccagcaggacctctga

SEQ ID NO: 9396129 - DNA, 22 bp, Homo sapiens
ccccagcatatcatggtttcgt

SEQ ID NO: 9396130 - DNA, 18 bp, Homo sapiens
ccccagcagtgtggtgcc

SEQ ID NO: 9396131 - DNA, 22 bp, Homo sapiens
ccccagcagcacctggggcagt

SEQ ID NO: 9396132 - DNA, 22 bp, Homo sapiens
ccccagcagactcagggcaggt

SEQ ID NO: 9396133 - DNA, 22 bp, Homo sapiens
ccccagccagcaggacctctga

SEQ ID NO: 9396134 - DNA, 22 bp, Homo sapiens
tgctgcagctttgtcacatgca

SEQ ID NO: 9396135 - DNA, 22 bp, Homo sapiens
tgctgcaggaattctcaaggga

SEQ ID NO: 9396136 - DNA, 22 bp, Homo sapiens
tgctgcaggaattctcaaggga

SEQ ID NO: 9396137 - DNA, 22 bp, Homo sapiens
ccccaccttgcaattgttccct

SEQ ID NO: 9396138 - DNA, 22 bp, Homo sapiens
ccccacctgtgcgtctgccgca

SEQ ID NO: 9396139 - DNA, 22 bp, Homo sapiens
tgctgcagcagtgcgggcagct

SEQ ID NO: 9396140 - DNA, 22 bp, Homo sapiens
tgctgcagcggcatggtctttg

SEQ ID NO: 9396141 - DNA, 22 bp, Homo sapiens
tgctgcagatcagctgagtcct

SEQ ID NO: 9396142 - DNA, 22 bp, Homo sapiens
cccctcctgcagcacctttctt

SEQ ID NO: 9396143 - DNA, 22 bp, Homo sapiens
cccctcctgcagcacctttctt

SEQ ID NO: 9396144 - DNA, 22 bp, Homo sapiens
cccctcctggccacactgtcag

SEQ ID NO: 9396145 - DNA, 22 bp, Homo sapiens
cccctcctggccacactgtcag

SEQ ID NO: 9396146 - DNA, 22 bp, Homo sapiens
cccctcattctctgagctagtt

SEQ ID NO: 9396147 - DNA, 22 bp, Homo sapiens
cccctccctgacctggttgggc

SEQ ID NO: 9396148 - DNA, 22 bp, Homo sapiens
cccctctggtcaaccagtcaca

SEQ ID NO: 9396149 - DNA, 22 bp, Homo sapiens
cccctctccctcacttatcaat

SEQ ID NO: 9396150 - DNA, 22 bp, Homo sapiens
cccctctccctcacttatcaat

SEQ ID NO: 9396151 - DNA, 22 bp, Homo sapiens
ccctcagcttctccctgcagct

SEQ ID NO: 9396152 - DNA, 22 bp, Homo sapiens
ccctcagcttctccctgcagct

SEQ ID NO: 9396153 - DNA, 22 bp, Homo sapiens
ccctcagcttctccctgcagct

SEQ ID NO: 9396154 - DNA, 22 bp, Homo sapiens
ccctcagctccaccctcagcag

SEQ ID NO: 9396155 - DNA, 22 bp, Homo sapiens
ccctcaggagatgtcagctgga

SEQ ID NO: 9396156 - DNA, 19 bp, Homo sapiens
ccctcaggtctgagcagtc

SEQ ID NO: 9396157 - DNA, 22 bp, Homo sapiens
cccccaccgtgttcctgctcgg

SEQ ID NO: 9396158 - DNA, 22 bp, Homo sapiens
cccccaaggccaggctgagacc

SEQ ID NO: 9396159 - DNA, 22 bp, Homo sapiens
cccccacctgaggacagtctta

SEQ ID NO: 9396160 - DNA, 22 bp, Homo sapiens
cccccagatgcgagccatagcc

SEQ ID NO: 9396161 - DNA, 22 bp, Homo sapiens
cccccagctctgctgggtcccg

SEQ ID NO: 9396162 - DNA, 22 bp, Homo sapiens
cccccagccagcagtgctcagc

SEQ ID NO: 9396163 - DNA, 22 bp, Homo sapiens
cccccaggctctgacacaggag

SEQ ID NO: 9396164 - DNA, 22 bp, Homo sapiens
cccccaggctctgacacaggag

SEQ ID NO: 9396165 - DNA, 17 bp, Homo sapiens
cccctacctccgtttga

SEQ ID NO: 9396166 - DNA, 16 bp, Homo sapiens
cccctcaggaagtaca

SEQ ID NO: 9396167 - DNA, 22 bp, Homo sapiens
ccccctggcaggctggcctctc

SEQ ID NO: 9396168 - DNA, 22 bp, Homo sapiens
ccccgccctgcgcggggataac

SEQ ID NO: 9396169 - DNA, 22 bp, Homo sapiens
cccctcaggtacccgtgcagca

SEQ ID NO: 9396170 - DNA, 21 bp, Homo sapiens
cccctcatacactctccttgc

SEQ ID NO: 9396171 - DNA, 22 bp, Homo sapiens
ccctccagctcaaagcaaccgg

SEQ ID NO: 9396172 - DNA, 22 bp, Homo sapiens
ccctccagggagccatgctggg

SEQ ID NO: 9396173 - DNA, 22 bp, Homo sapiens
ccctccagggagccatgctggg

SEQ ID NO: 9396174 - DNA, 22 bp, Homo sapiens
ccctccagggagccatgctggg

SEQ ID NO: 9396175 - DNA, 22 bp, Homo sapiens
ccctggagaaggggacgcggag

SEQ ID NO: 9396176 - DNA, 22 bp, Homo sapiens
ccctggagaaggggacgcggag

SEQ ID NO: 9396177 - DNA, 19 bp, Homo sapiens
ccctggagaataccctgga

SEQ ID NO: 9396178 - DNA, 22 bp, Homo sapiens
ccctgctgcagagagctttcca

SEQ ID NO: 9396179 - DNA, 22 bp, Homo sapiens
ccctccagagcttgacctgctg

SEQ ID NO: 9396180 - DNA, 20 bp, Homo sapiens
ccctccagcaaccaggactt

SEQ ID NO: 9396181 - DNA, 22 bp, Homo sapiens
ccctccagccatggacccaggt

SEQ ID NO: 9396182 - DNA, 20 bp, Homo sapiens
ccctccagcaaccaggactt

SEQ ID NO: 9396183 - DNA, 22 bp, Homo sapiens
ccctccagccatggacccaggt

SEQ ID NO: 9396184 - DNA, 22 bp, Homo sapiens
ccctccacagacaggacttgtc

SEQ ID NO: 9396185 - DNA, 22 bp, Homo sapiens
ccctccaccaagcagggcgcca

SEQ ID NO: 9396186 - DNA, 22 bp, Homo sapiens
ccctccagagcctggacattct

SEQ ID NO: 9396187 - DNA, 22 bp, Homo sapiens
ccctccagagcttgacctgctg

SEQ ID NO: 9396188 - DNA, 22 bp, Homo sapiens
ccctcatgccagacagcatgca

SEQ ID NO: 9396189 - DNA, 22 bp, Homo sapiens
ccctcatgtcagtccctgccca

SEQ ID NO: 9396190 - DNA, 22 bp, Homo sapiens
ccctggagatcgggagaggaag

SEQ ID NO: 9396191 - DNA, 22 bp, Homo sapiens
ccctggagcatctctgctgtct

SEQ ID NO: 9396192 - DNA, 22 bp, Homo sapiens
ccctggagcatctctgctgtct

SEQ ID NO: 9396193 - DNA, 22 bp, Homo sapiens
ccctggagatcgggagaggaag

SEQ ID NO: 9396194 - DNA, 22 bp, Homo sapiens
ccctggagatcgggagaggaag

SEQ ID NO: 9396195 - DNA, 22 bp, Homo sapiens
ccctggagcatctctgctgtct

SEQ ID NO: 9396196 - DNA, 22 bp, Homo sapiens
ccctggagcatctctgctgtct

SEQ ID NO: 9396197 - DNA, 22 bp, Homo sapiens
ccctggagctagtctgagcaga

SEQ ID NO: 9396198 - DNA, 20 bp, Homo sapiens
ccctggagagaagctccacg

SEQ ID NO: 9396199 - DNA, 19 bp, Homo sapiens
ccctggagaataccctgga

SEQ ID NO: 9396200 - DNA, 19 bp, Homo sapiens
ccctggagaataccctgga

SEQ ID NO: 9396201 - DNA, 22 bp, Homo sapiens
ccctggagatcgggagaggaag

SEQ ID NO: 9396202 - DNA, 22 bp, Homo sapiens
ccctggagaggactcacccctg

SEQ ID NO: 9396203 - DNA, 22 bp, Homo sapiens
ccctggagaggactcacccctg

SEQ ID NO: 9396204 - DNA, 20 bp, Homo sapiens
ccctggagagaagctccacg

SEQ ID NO: 9396205 - DNA, 20 bp, Homo sapiens
ccctggagagaagctccacg

SEQ ID NO: 9396206 - DNA, 22 bp, Homo sapiens
tggagctgagagccaggctggc

SEQ ID NO: 9396207 - DNA, 22 bp, Homo sapiens
tggagctgagagccaggctggc

SEQ ID NO: 9396208 - DNA, 22 bp, Homo sapiens
tggagctgagaagtggagctct

SEQ ID NO: 9396209 - DNA, 22 bp, Homo sapiens
tggagctgagaagtggagctct

SEQ ID NO: 9396210 - DNA, 22 bp, Homo sapiens
tggagctgagaagtggagctct

SEQ ID NO: 9396211 - DNA, 22 bp, Homo sapiens
tggagctgagagccaggctggc

SEQ ID NO: 9396212 - DNA, 22 bp, Homo sapiens
tggagctgagaagtggagctct

SEQ ID NO: 9396213 - DNA, 22 bp, Homo sapiens
tggagctgactcacaccagcta

SEQ ID NO: 9396214 - DNA, 23 bp, Homo sapiens
tggagctgacagtcagagggagg

SEQ ID NO: 9396215 - DNA, 23 bp, Homo sapiens
tggagctgacagtcagagggagg

SEQ ID NO: 9396216 - DNA, 22 bp, Homo sapiens
tggatgaaatattgcatttatg

SEQ ID NO: 9396217 - DNA, 22 bp, Homo sapiens
tggatgagattaaagtgaggtt

SEQ ID NO: 9396218 - DNA, 22 bp, Homo sapiens
tggatgagaaactctggtgact

SEQ ID NO: 9396219 - DNA, 22 bp, Homo sapiens
tggatgagggctgagcactggg

SEQ ID NO: 9396220 - DNA, 22 bp, Homo sapiens
tggatgaggctgggttaggcag

SEQ ID NO: 9396221 - DNA, 22 bp, Homo sapiens
tggatgagggctgagcactggg

SEQ ID NO: 9396222 - DNA, 22 bp, Homo sapiens
tggatgagggctgagcactggg

SEQ ID NO: 9396223 - DNA, 22 bp, Homo sapiens
tggatgagggctgagcactggg

SEQ ID NO: 9396224 - DNA, 22 bp, Homo sapiens
tggatgagattaaagtgaggtt

SEQ ID NO: 9396225 - DNA, 22 bp, Homo sapiens
tggcaagaaactgaggcctgct

SEQ ID NO: 9396226 - DNA, 22 bp, Homo sapiens
tggcaagaaactgaggcctgct

SEQ ID NO: 9396227 - DNA, 22 bp, Homo sapiens
tggcaagaatattggaccagaa

SEQ ID NO: 9396228 - DNA, 22 bp, Homo sapiens
tggatgagttcaatgaggcaga

SEQ ID NO: 9396229 - DNA, 22 bp, Homo sapiens
tggatgagttcaatgaggcaga

SEQ ID NO: 9396230 - DNA, 22 bp, Homo sapiens
tggcaagagggatgcaaggttt

SEQ ID NO: 9396231 - DNA, 22 bp, Homo sapiens
tggcaagagggatgcaaggttt

SEQ ID NO: 9396232 - DNA, 17 bp, Homo sapiens
tggcaagaatggaaatg

SEQ ID NO: 9396233 - DNA, 17 bp, Homo sapiens
tggcaagacagctcagg

SEQ ID NO: 9396234 - DNA, 22 bp, Homo sapiens
tggcaaggaaattagttctcct

SEQ ID NO: 9396235 - DNA, 22 bp, Homo sapiens
tggcaagctcgtttgggtcaga

SEQ ID NO: 9396236 - DNA, 22 bp, Homo sapiens
tggcaagctgggttgggtagcc

SEQ ID NO: 9396237 - DNA, 22 bp, Homo sapiens
tggcaagcagagtctggtgggg

SEQ ID NO: 9396238 - DNA, 22 bp, Homo sapiens
tggcaagcctgagatccgggag

SEQ ID NO: 9396239 - DNA, 22 bp, Homo sapiens
ccctggctcaggcagctttgtt

SEQ ID NO: 9396240 - DNA, 23 bp, Homo sapiens
ccctggccttggggcacaggctg

SEQ ID NO: 9396241 - DNA, 23 bp, Homo sapiens
ccctggccttggggcacaggctg

SEQ ID NO: 9396242 - DNA, 22 bp, Homo sapiens
ccctggctcaggcagctttgtt

SEQ ID NO: 9396243 - DNA, 22 bp, Homo sapiens
ccctggctgataccggaaaggc

SEQ ID NO: 9396244 - DNA, 22 bp, Homo sapiens
ccctggctgccagtcaccagac

SEQ ID NO: 9396245 - DNA, 22 bp, Homo sapiens
ccctggctgccagtcaccagac

SEQ ID NO: 9396246 - DNA, 22 bp, Homo sapiens
ccctggctgccagtcaccagac

SEQ ID NO: 9396247 - DNA, 22 bp, Homo sapiens
ccctggctctgcctcagagccc

SEQ ID NO: 9396248 - DNA, 22 bp, Homo sapiens
ccctggctctgcctcagagccc

SEQ ID NO: 9396249 - DNA, 22 bp, Homo sapiens
ccctggctctgcctcagagccc

SEQ ID NO: 9396250 - DNA, 18 bp, Homo sapiens
tggagctgagggcaatgc

SEQ ID NO: 9396251 - DNA, 18 bp, Homo sapiens
tggagctgagggcaatgc

SEQ ID NO: 9396252 - DNA, 22 bp, Homo sapiens
ccctggcaaaacactctcttga

SEQ ID NO: 9396253 - DNA, 22 bp, Homo sapiens
ccctggatttacatcattctga

SEQ ID NO: 9396254 - DNA, 22 bp, Homo sapiens
ccctggcaaaatccctggtaca

SEQ ID NO: 9396255 - DNA, 22 bp, Homo sapiens
ccctggcaaaatccctggtaca

SEQ ID NO: 9396256 - DNA, 20 bp, Homo sapiens
ccctggcctgtttcatgccc

SEQ ID NO: 9396257 - DNA, 20 bp, Homo sapiens
ccctggcctgtttcatgccc

SEQ ID NO: 9396258 - DNA, 22 bp, Homo sapiens
ccctggcctccaggcagtcctg

SEQ ID NO: 9396259 - DNA, 22 bp, Homo sapiens
ccctggcctccaggcagtcctg

SEQ ID NO: 9396260 - DNA, 22 bp, Homo sapiens
ccctggcctccaggcagtcctg

SEQ ID NO: 9396261 - DNA, 22 bp, Homo sapiens
ccctggcctacaggcccagaga

SEQ ID NO: 9396262 - DNA, 22 bp, Homo sapiens
ccctggcctacaggcccagaga

SEQ ID NO: 9396263 - DNA, 22 bp, Homo sapiens
ccctggcctacaggcccagaga

SEQ ID NO: 9396264 - DNA, 22 bp, Homo sapiens
tggcagatttaacattggaact

SEQ ID NO: 9396265 - DNA, 22 bp, Homo sapiens
tggcagattttctctggaggag

SEQ ID NO: 9396266 - DNA, 22 bp, Homo sapiens
tggcagatgtggcatagagcat

SEQ ID NO: 9396267 - DNA, 22 bp, Homo sapiens
tggcagatgagccgcgctccaa

SEQ ID NO: 9396268 - DNA, 22 bp, Homo sapiens
tggcagaggtatattgggagga

SEQ ID NO: 9396269 - DNA, 22 bp, Homo sapiens
tggcagaggtatattgggagga

SEQ ID NO: 9396270 - DNA, 22 bp, Homo sapiens
tggcagcaaaaccagaatcaga

SEQ ID NO: 9396271 - DNA, 22 bp, Homo sapiens
tggcagattttctctggaggag

SEQ ID NO: 9396272 - DNA, 22 bp, Homo sapiens
tggcagcaaaaccagaatcaga

SEQ ID NO: 9396273 - DNA, 22 bp, Homo sapiens
tggcagcaagttcttgggaggt

SEQ ID NO: 9396274 - DNA, 22 bp, Homo sapiens
tggcagcaattagctagagctg

SEQ ID NO: 9396275 - DNA, 22 bp, Homo sapiens
tggcagcaattagctagagctg

SEQ ID NO: 9396276 - DNA, 22 bp, Homo sapiens
tggcagcacggcatccactctc

SEQ ID NO: 9396277 - DNA, 22 bp, Homo sapiens
tggcagctggagggcaatggcc

SEQ ID NO: 9396278 - DNA, 22 bp, Homo sapiens
tggcagctggctctgcgcaggc

SEQ ID NO: 9396279 - DNA, 22 bp, Homo sapiens
tggcagctggagggcaatggcc

SEQ ID NO: 9396280 - DNA, 22 bp, Homo sapiens
tggcagcacaaggtggcccatg

SEQ ID NO: 9396281 - DNA, 22 bp, Homo sapiens
tggcagcacaaggtggcccatg

SEQ ID NO: 9396282 - DNA, 21 bp, Homo sapiens
tggcagcacccacaccctctg

SEQ ID NO: 9396283 - DNA, 21 bp, Homo sapiens
tggcagcacccacaccctctg

SEQ ID NO: 9396284 - DNA, 22 bp, Homo sapiens
tggcagcacattgacccgggct

SEQ ID NO: 9396285 - DNA, 22 bp, Homo sapiens
tggcagcaccagcagtgtcctt

SEQ ID NO: 9396286 - DNA, 22 bp, Homo sapiens
tggcagaggtaattcaaatccc

SEQ ID NO: 9396287 - DNA, 22 bp, Homo sapiens
tggcacagtcctgggtgcctgc

SEQ ID NO: 9396288 - DNA, 22 bp, Homo sapiens
tggcacagtcctgggtgcctgc

SEQ ID NO: 9396289 - DNA, 22 bp, Homo sapiens
tggcacagggcttggtcgctca

SEQ ID NO: 9396290 - DNA, 22 bp, Homo sapiens
tggcacagggcttggtcgctca

SEQ ID NO: 9396291 - DNA, 22 bp, Homo sapiens
tggcacaggatctcagcggcca

SEQ ID NO: 9396292 - DNA, 22 bp, Homo sapiens
tggcacaggcggtaagggtgtg

SEQ ID NO: 9396293 - DNA, 22 bp, Homo sapiens
tggcacaggagcactgccctgg

SEQ ID NO: 9396294 - DNA, 22 bp, Homo sapiens
tggcacaggatctcagcggcca

SEQ ID NO: 9396295 - DNA, 22 bp, Homo sapiens
tggcacaggatctcagcggcca

SEQ ID NO: 9396296 - DNA, 22 bp, Homo sapiens
tggcacaggaatttagatgcag

SEQ ID NO: 9396297 - DNA, 22 bp, Homo sapiens
tggcacaggaatttagatgcag

SEQ ID NO: 9396298 - DNA, 22 bp, Homo sapiens
tggcaagttaaaatgtggtctt

SEQ ID NO: 9396299 - DNA, 22 bp, Homo sapiens
tggcaagtggcaccggctgtgg

SEQ ID NO: 9396300 - DNA, 23 bp, Homo sapiens
tggcaaggaatgggatggagact

SEQ ID NO: 9396301 - DNA, 22 bp, Homo sapiens
cctagggtcagtgtggcaggag

SEQ ID NO: 9396302 - DNA, 22 bp, Homo sapiens
cctaggtcctatatgacctagc

SEQ ID NO: 9396303 - DNA, 22 bp, Homo sapiens
cctagggagcctgagagcagtg

SEQ ID NO: 9396304 - DNA, 22 bp, Homo sapiens
cctaggcttgttttcatcagct

SEQ ID NO: 9396305 - DNA, 22 bp, Homo sapiens
cctagtttttcacttgtgctgt

SEQ ID NO: 9396306 - DNA, 22 bp, Homo sapiens
cctagttttggacattcctgca

SEQ ID NO: 9396307 - DNA, 20 bp, Homo sapiens
cctagttttctgagcgtgac

SEQ ID NO: 9396308 - DNA, 22 bp, Homo sapiens
cctagttttcattcagcagcct

SEQ ID NO: 9396309 - DNA, 22 bp, Homo sapiens
cctagtttcttaattttgagaa

SEQ ID NO: 9396310 - DNA, 21 bp, Homo sapiens
cctagtgttaaaacagtttaa

SEQ ID NO: 9396311 - DNA, 23 bp, Homo sapiens
tggccaggcataaaggtgggtgg

SEQ ID NO: 9396312 - DNA, 23 bp, Homo sapiens
tggccaggcataaaggtgggtgg

SEQ ID NO: 9396313 - DNA, 22 bp, Homo sapiens
tggccaggcaggtagaacggcc

SEQ ID NO: 9396314 - DNA, 22 bp, Homo sapiens
tggccaggcaggtagaacggcc

SEQ ID NO: 9396315 - DNA, 22 bp, Homo sapiens
tggccaggcattcagataagac

SEQ ID NO: 9396316 - DNA, 23 bp, Homo sapiens
tggccaggcataaaggtgggtgg

SEQ ID NO: 9396317 - DNA, 22 bp, Homo sapiens
tggccaggcattcagataagac

SEQ ID NO: 9396318 - DNA, 22 bp, Homo sapiens
tggccaggcattcagataagac

SEQ ID NO: 9396319 - DNA, 22 bp, Homo sapiens
tggccaggcattcagataagac

SEQ ID NO: 9396320 - DNA, 22 bp, Homo sapiens
cctaggccctcaaagagcataa

SEQ ID NO: 9396321 - DNA, 22 bp, Homo sapiens
cctaggccctaggcttccatca

SEQ ID NO: 9396322 - DNA, 22 bp, Homo sapiens
tggcagctgtctgtggggtctc

SEQ ID NO: 9396323 - DNA, 22 bp, Homo sapiens
tggcagctggctctgcgcaggc

SEQ ID NO: 9396324 - DNA, 22 bp, Homo sapiens
tggcagctggctctgcgcaggc

SEQ ID NO: 9396325 - DNA, 22 bp, Homo sapiens
tggcagcttgaatgcagtcttt

SEQ ID NO: 9396326 - DNA, 22 bp, Homo sapiens
tggcagctgtgtccaggtagaa

SEQ ID NO: 9396327 - DNA, 22 bp, Homo sapiens
tggcagctgtgtccaggtagaa

SEQ ID NO: 9396328 - DNA, 21 bp, Homo sapiens
tggccagctggagtctccaca

SEQ ID NO: 9396329 - DNA, 22 bp, Homo sapiens
tggccacacccacctagaggag

SEQ ID NO: 9396330 - DNA, 22 bp, Homo sapiens
tggccacacccacctagaggag

SEQ ID NO: 9396331 - DNA, 22 bp, Homo sapiens
tggccacacccacctagaggag

SEQ ID NO: 9396332 - DNA, 22 bp, Homo sapiens
tggccacaaagagaacgaggtc

SEQ ID NO: 9396333 - DNA, 22 bp, Homo sapiens
tggcagcttgaatgcagtcttt

SEQ ID NO: 9396334 - DNA, 22 bp, Homo sapiens
tggccaggaggctgcttctgac

SEQ ID NO: 9396335 - DNA, 22 bp, Homo sapiens
tggccaggaggctgcttctgac

SEQ ID NO: 9396336 - DNA, 22 bp, Homo sapiens
tggccagctttttgtagtgctc

SEQ ID NO: 9396337 - DNA, 22 bp, Homo sapiens
tggccaggcaggtagaacggcc

SEQ ID NO: 9396338 - DNA, 22 bp, Homo sapiens
tggccaggcaggtagaacggcc

SEQ ID NO: 9396339 - DNA, 22 bp, Homo sapiens
tggccaggaggctgcttctgac

SEQ ID NO: 9396340 - DNA, 22 bp, Homo sapiens
cctcgggctgaggctcccaggc

SEQ ID NO: 9396341 - DNA, 18 bp, Homo sapiens
cctcggagcctccgtgtc

SEQ ID NO: 9396342 - DNA, 22 bp, Homo sapiens
cctcggagcacgccggccgccc

SEQ ID NO: 9396343 - DNA, 22 bp, Homo sapiens
cctcggagaaaggcagctccac

SEQ ID NO: 9396344 - DNA, 22 bp, Homo sapiens
cctcggagcgggtcagagaggg

SEQ ID NO: 9396345 - DNA, 22 bp, Homo sapiens
cctcctccttatggtggcccag

SEQ ID NO: 9396346 - DNA, 22 bp, Homo sapiens
cctcctccttatggtggcccag

SEQ ID NO: 9396347 - DNA, 22 bp, Homo sapiens
cctcctctgggaagattcagag

SEQ ID NO: 9396348 - DNA, 23 bp, Homo sapiens
cctcctcatatctttgactagtg

SEQ ID NO: 9396349 - DNA, 23 bp, Homo sapiens
cctcctcatatctttgactagtg

SEQ ID NO: 9396350 - DNA, 23 bp, Homo sapiens
cctcctcatatctttgactagtg

SEQ ID NO: 9396351 - DNA, 22 bp, Homo sapiens
cctcctggtccagcatctcttt

SEQ ID NO: 9396352 - DNA, 22 bp, Homo sapiens
cctccctggtggctctggtcta

SEQ ID NO: 9396353 - DNA, 22 bp, Homo sapiens
cctccctggtggctctggtcta

SEQ ID NO: 9396354 - DNA, 22 bp, Homo sapiens
cctccctgggtgctgggattgc

SEQ ID NO: 9396355 - DNA, 22 bp, Homo sapiens
cctccctgggtgctgggattgc

SEQ ID NO: 9396356 - DNA, 22 bp, Homo sapiens
cctccctggccagagcagcagc

SEQ ID NO: 9396357 - DNA, 23 bp, Homo sapiens
tggctgaggtccaggtagtttca

SEQ ID NO: 9396358 - DNA, 22 bp, Homo sapiens
cctcccttttggtgtctgcata

SEQ ID NO: 9396359 - DNA, 22 bp, Homo sapiens
cctcccttttggtgtctgcata

SEQ ID NO: 9396360 - DNA, 22 bp, Homo sapiens
cctccctgtctacctgttgtgg

SEQ ID NO: 9396361 - DNA, 22 bp, Homo sapiens
cctccctgtctacctgttgtgg

SEQ ID NO: 9396362 - DNA, 22 bp, Homo sapiens
cctccctgtctacctgttgtgg

SEQ ID NO: 9396363 - DNA, 22 bp, Homo sapiens
cctccactctggcctctcaggt

SEQ ID NO: 9396364 - DNA, 22 bp, Homo sapiens
cctccactgcttcccagctttg

SEQ ID NO: 9396365 - DNA, 22 bp, Homo sapiens
cctccactctggcctctcaggt

SEQ ID NO: 9396366 - DNA, 22 bp, Homo sapiens
cctccaagtttgactcaggaca

SEQ ID NO: 9396367 - DNA, 22 bp, Homo sapiens
cctccaagtttgactcaggaca

SEQ ID NO: 9396368 - DNA, 22 bp, Homo sapiens
cctccacaggagctgcagtgct

SEQ ID NO: 9396369 - DNA, 22 bp, Homo sapiens
cctccacaggagctgcagtgct

SEQ ID NO: 9396370 - DNA, 20 bp, Homo sapiens
cctccactgtcactgacctg

SEQ ID NO: 9396371 - DNA, 22 bp, Homo sapiens
cctccagactttggccatcctc

SEQ ID NO: 9396372 - DNA, 22 bp, Homo sapiens
cctccagcattactggcccatg

SEQ ID NO: 9396373 - DNA, 22 bp, Homo sapiens
cctccagcattactggcccatg

SEQ ID NO: 9396374 - DNA, 22 bp, Homo sapiens
cctccagcattactggcccatg

SEQ ID NO: 9396375 - DNA, 22 bp, Homo sapiens
cctccagcattactggcccatg

SEQ ID NO: 9396376 - DNA, 22 bp, Homo sapiens
cctccagcgcgatccactccgg

SEQ ID NO: 9396377 - DNA, 22 bp, Homo sapiens
tggctgagggggcagttcagga

SEQ ID NO: 9396378 - DNA, 22 bp, Homo sapiens
tggctgagggggcagttcagga

SEQ ID NO: 9396379 - DNA, 22 bp, Homo sapiens
tggctgagggggcagttcagga

SEQ ID NO: 9396380 - DNA, 22 bp, Homo sapiens
tggctgagagcaattgactctg

SEQ ID NO: 9396381 - DNA, 22 bp, Homo sapiens
tggctgagagcaattgactctg

SEQ ID NO: 9396382 - DNA, 22 bp, Homo sapiens
tggctgagggggcagttcagga

SEQ ID NO: 9396383 - DNA, 22 bp, Homo sapiens
tggctgagggggctctgctcag

SEQ ID NO: 9396384 - DNA, 22 bp, Homo sapiens
tggctgaggtaactatgaataa

SEQ ID NO: 9396385 - DNA, 22 bp, Homo sapiens
tggctgagggggctctgctcag

SEQ ID NO: 9396386 - DNA, 22 bp, Homo sapiens
tggctgaggtaactatgaataa

SEQ ID NO: 9396387 - DNA, 23 bp, Homo sapiens
tggctgaggtccaggtagtttca

SEQ ID NO: 9396388 - DNA, 22 bp, Homo sapiens
tggctgaggtaactatgaataa

SEQ ID NO: 9396389 - DNA, 23 bp, Homo sapiens
tggctgaggtccaggtagtttca

SEQ ID NO: 9396390 - DNA, 22 bp, Homo sapiens
tggctgaggtctggggcttctg

SEQ ID NO: 9396391 - DNA, 22 bp, Homo sapiens
tggccctgctatgatcctgcaa

SEQ ID NO: 9396392 - DNA, 22 bp, Homo sapiens
tggccctgctggacacgcctgc

SEQ ID NO: 9396393 - DNA, 22 bp, Homo sapiens
tggccctgctggacacgcctgc

SEQ ID NO: 9396394 - DNA, 22 bp, Homo sapiens
tggcccgaagatccgagggtca

SEQ ID NO: 9396395 - DNA, 18 bp, Homo sapiens
tggccccttatcagtcct

SEQ ID NO: 9396396 - DNA, 22 bp, Homo sapiens
tggcccctggcacacggaggat

SEQ ID NO: 9396397 - DNA, 22 bp, Homo sapiens
tggcccctggcacacggaggat

SEQ ID NO: 9396398 - DNA, 22 bp, Homo sapiens
tggcccctgaggagcatcagcc

SEQ ID NO: 9396399 - DNA, 22 bp, Homo sapiens
tggcccctgaggagcgtcagcc

SEQ ID NO: 9396400 - DNA, 22 bp, Homo sapiens
tggcccctgaggagcgtcagcc

SEQ ID NO: 9396401 - DNA, 22 bp, Homo sapiens
tggcccagtgcttatgctctga

SEQ ID NO: 9396402 - DNA, 22 bp, Homo sapiens
tggcccagtgcttatgctctga

SEQ ID NO: 9396403 - DNA, 22 bp, Homo sapiens
tggcccagccctgctctagggc

SEQ ID NO: 9396404 - DNA, 22 bp, Homo sapiens
tggccccacagggccttttcag

SEQ ID NO: 9396405 - DNA, 20 bp, Homo sapiens
tggcccagtggggcagggtg

SEQ ID NO: 9396406 - DNA, 20 bp, Homo sapiens
tggcccagtggggcagggtg

SEQ ID NO: 9396407 - DNA, 22 bp, Homo sapiens
tggctcagtttagcagctcagt

SEQ ID NO: 9396408 - DNA, 22 bp, Homo sapiens
tggctcagtttagcagctcagt

SEQ ID NO: 9396409 - DNA, 22 bp, Homo sapiens
tggctcagctgtcacagcctgg

SEQ ID NO: 9396410 - DNA, 22 bp, Homo sapiens
tggccctgcttatgtctctctt

SEQ ID NO: 9396411 - DNA, 22 bp, Homo sapiens
tggctcagctgactcggcttct

SEQ ID NO: 9396412 - DNA, 22 bp, Homo sapiens
tggccctgctgggtcagagctg

SEQ ID NO: 9396413 - DNA, 22 bp, Homo sapiens
tggccctgctgtatcatctgct

SEQ ID NO: 9396414 - DNA, 22 bp, Homo sapiens
tggccctgctgtatcatctgct

SEQ ID NO: 9396415 - DNA, 22 bp, Homo sapiens
tggccctgcttatgtctctctt

SEQ ID NO: 9396416 - DNA, 22 bp, Homo sapiens
tggccctgctgtatcatctgct

SEQ ID NO: 9396417 - DNA, 22 bp, Homo sapiens
tggctcagtttcagtcctggtt

SEQ ID NO: 9396418 - DNA, 22 bp, Homo sapiens
tggctcagtttctgcccagctg

SEQ ID NO: 9396419 - DNA, 22 bp, Homo sapiens
tggctcagtttcagtcctggtt

SEQ ID NO: 9396420 - DNA, 22 bp, Homo sapiens
tggctcagtttcagtcctggtt

SEQ ID NO: 9396421 - DNA, 22 bp, Homo sapiens
tggctcagtttgggggattgaa

SEQ ID NO: 9396422 - DNA, 22 bp, Homo sapiens
tggctcagtttgggggattgaa

SEQ ID NO: 9396423 - DNA, 22 bp, Homo sapiens
tggctcagtttctgcccagctg

SEQ ID NO: 9396424 - DNA, 22 bp, Homo sapiens
cctctcatagtctgtatccttt

SEQ ID NO: 9396425 - DNA, 22 bp, Homo sapiens
cctctccagcggcctcagggcc

SEQ ID NO: 9396426 - DNA, 20 bp, Homo sapiens
tggctgcccgaggcacacac

SEQ ID NO: 9396427 - DNA, 22 bp, Homo sapiens
cctctcagcgattcctcttgga

SEQ ID NO: 9396428 - DNA, 22 bp, Homo sapiens
cctctcagccggactgtcaggc

SEQ ID NO: 9396429 - DNA, 22 bp, Homo sapiens
cctctacttaccactcagccag

SEQ ID NO: 9396430 - DNA, 22 bp, Homo sapiens
tggctgcctagtgtctgagcag

SEQ ID NO: 9396431 - DNA, 22 bp, Homo sapiens
tggctgcctagtgtctgagcag

SEQ ID NO: 9396432 - DNA, 22 bp, Homo sapiens
tggctgcctcagtgtccctgca

SEQ ID NO: 9396433 - DNA, 22 bp, Homo sapiens
tggctgcctgatcgagcaggtg

SEQ ID NO: 9396434 - DNA, 21 bp, Homo sapiens
tggctgcctggctctgtggtt

SEQ ID NO: 9396435 - DNA, 22 bp, Homo sapiens
tggctgcctgatcgagcaggtg

SEQ ID NO: 9396436 - DNA, 21 bp, Homo sapiens
tggctgcctggctctgtggtt

SEQ ID NO: 9396437 - DNA, 22 bp, Homo sapiens
tggctgccgactggctcttggc

SEQ ID NO: 9396438 - DNA, 21 bp, Homo sapiens
tggctgcctacatgctgcagg

SEQ ID NO: 9396439 - DNA, 22 bp, Homo sapiens
tggctgccctcatgggcctgat

SEQ ID NO: 9396440 - DNA, 22 bp, Homo sapiens
tggctgccctcatgggcctgat

SEQ ID NO: 9396441 - DNA, 22 bp, Homo sapiens
tggctgcctagtccctcagcct

SEQ ID NO: 9396442 - DNA, 21 bp, Homo sapiens
tggctgcctacatgctgcagg

SEQ ID NO: 9396443 - DNA, 22 bp, Homo sapiens
tggctgcctagtccctcagcct

SEQ ID NO: 9396444 - DNA, 22 bp, Homo sapiens
tggctgcctagtccctcagcct

SEQ ID NO: 9396445 - DNA, 20 bp, Homo sapiens
cctctctgccctgcaaggcc

SEQ ID NO: 9396446 - DNA, 22 bp, Homo sapiens
cctctctgtaagggtccctccc

SEQ ID NO: 9396447 - DNA, 22 bp, Homo sapiens
cctctctgtaagggtccctccc

SEQ ID NO: 9396448 - DNA, 22 bp, Homo sapiens
cctctctgtaagggtccctccc

SEQ ID NO: 9396449 - DNA, 22 bp, Homo sapiens
cctctctgtagcagcccccagt

SEQ ID NO: 9396450 - DNA, 22 bp, Homo sapiens
cctctctgtaagggtccctccc

SEQ ID NO: 9396451 - DNA, 22 bp, Homo sapiens
cctctctgtgtggcctctccat

SEQ ID NO: 9396452 - DNA, 22 bp, Homo sapiens
cctctctgtgtggcctctccat

SEQ ID NO: 9396453 - DNA, 22 bp, Homo sapiens
cctctctgtgtggcctctccat

SEQ ID NO: 9396454 - DNA, 22 bp, Homo sapiens
cctctctgtgtggcctctccat

SEQ ID NO: 9396455 - DNA, 16 bp, Homo sapiens
cctctcttattcctcc

SEQ ID NO: 9396456 - DNA, 22 bp, Homo sapiens
tggctgccttccctgctggagg

SEQ ID NO: 9396457 - DNA, 22 bp, Homo sapiens
tggctgcctttcacctcatctc

SEQ ID NO: 9396458 - DNA, 20 bp, Homo sapiens
cctctctgcatgctccctga

SEQ ID NO: 9396459 - DNA, 20 bp, Homo sapiens
cctctctgcatgctccctga

SEQ ID NO: 9396460 - DNA, 20 bp, Homo sapiens
cctctctgcatgctccctga

SEQ ID NO: 9396461 - DNA, 20 bp, Homo sapiens
cctctctgcatgctccctga

SEQ ID NO: 9396462 - DNA, 22 bp, Homo sapiens
cctctctcttgtagtccctgcc

SEQ ID NO: 9396463 - DNA, 20 bp, Homo sapiens
cctctctgaagaggtcatct

SEQ ID NO: 9396464 - DNA, 20 bp, Homo sapiens
cctctctgaagaggtcatct

SEQ ID NO: 9396465 - DNA, 22 bp, Homo sapiens
cctctgggggtcctcagagtct

SEQ ID NO: 9396466 - DNA, 22 bp, Homo sapiens
cctctgggggtcctcagagtct

SEQ ID NO: 9396467 - DNA, 22 bp, Homo sapiens
cctctggggtctagcaatagca

SEQ ID NO: 9396468 - DNA, 22 bp, Homo sapiens
cctctggggtctagcaatagca

SEQ ID NO: 9396469 - DNA, 22 bp, Homo sapiens
cctctggggtgagtgggccact

SEQ ID NO: 9396470 - DNA, 22 bp, Homo sapiens
cctctggggtgagtgggccact

SEQ ID NO: 9396471 - DNA, 22 bp, Homo sapiens
cctctgggtatctgtggaagta

SEQ ID NO: 9396472 - DNA, 22 bp, Homo sapiens
cctctgggtgacagactcttgg

SEQ ID NO: 9396473 - DNA, 22 bp, Homo sapiens
cctctgggtgggaggccgggcg

SEQ ID NO: 9396474 - DNA, 22 bp, Homo sapiens
cctctgggtgggaggccgggcg

SEQ ID NO: 9396475 - DNA, 22 bp, Homo sapiens
cctctgggtgacagactcttgg

SEQ ID NO: 9396476 - DNA, 22 bp, Homo sapiens
cctctgggtgacagactcttgg

SEQ ID NO: 9396477 - DNA, 22 bp, Homo sapiens
cctctgggttagtttagggagc

SEQ ID NO: 9396478 - DNA, 18 bp, Homo sapiens
cctctgggttttgttccc

SEQ ID NO: 9396479 - DNA, 22 bp, Homo sapiens
cctctgggttagtttagggagc

SEQ ID NO: 9396480 - DNA, 22 bp, Homo sapiens
cctctggttgcccaggactagg

SEQ ID NO: 9396481 - DNA, 22 bp, Homo sapiens
cctctgggctggaaaattaatg

SEQ ID NO: 9396482 - DNA, 22 bp, Homo sapiens
cctctgggctgcctgcacgggt

SEQ ID NO: 9396483 - DNA, 22 bp, Homo sapiens
cctctgggctgcctgcacgggt

SEQ ID NO: 9396484 - DNA, 22 bp, Homo sapiens
cctctgggggcttccttaccct

SEQ ID NO: 9396485 - DNA, 22 bp, Homo sapiens
cctctggggcatcagacaaagg

SEQ ID NO: 9396486 - DNA, 22 bp, Homo sapiens
cctctgggggcttccttaccct

SEQ ID NO: 9396487 - DNA, 22 bp, Homo sapiens
cctctggctgtaccactggcac

SEQ ID NO: 9396488 - DNA, 22 bp, Homo sapiens
cctctgagctggcctgtggggc

SEQ ID NO: 9396489 - DNA, 23 bp, Homo sapiens
cctctctttttaggtggtgtttg

SEQ ID NO: 9396490 - DNA, 22 bp, Homo sapiens
cctctcttggccgcagtcttct

SEQ ID NO: 9396491 - DNA, 22 bp, Homo sapiens
cctctgagccagcgtcttctct

SEQ ID NO: 9396492 - DNA, 22 bp, Homo sapiens
cctctgagaccagctctgcacc

SEQ ID NO: 9396493 - DNA, 22 bp, Homo sapiens
cctctgagaacacctggcgtcc

SEQ ID NO: 9396494 - DNA, 22 bp, Homo sapiens
tttacagttccatgtgataggc

SEQ ID NO: 9396495 - DNA, 22 bp, Homo sapiens
tttacatctcaccagattcata

SEQ ID NO: 9396496 - DNA, 22 bp, Homo sapiens
tttacatctcaccagattcata

SEQ ID NO: 9396497 - DNA, 22 bp, Homo sapiens
tttacagttaagaaatgttacc

SEQ ID NO: 9396498 - DNA, 22 bp, Homo sapiens
tttacagttaagaaatgttacc

SEQ ID NO: 9396499 - DNA, 22 bp, Homo sapiens
tttacagttaagaaatgttacc

SEQ ID NO: 9396500 - DNA, 22 bp, Homo sapiens
tttacagttaagaaatgttacc

SEQ ID NO: 9396501 - DNA, 22 bp, Homo sapiens
tttacagttccatgtgataggc

SEQ ID NO: 9396502 - DNA, 22 bp, Homo sapiens
tttacagttccatgtgataggc

SEQ ID NO: 9396503 - DNA, 22 bp, Homo sapiens
tttacagttccatgtgataggc

SEQ ID NO: 9396504 - DNA, 22 bp, Homo sapiens
tttacacatacctctttaaagt

SEQ ID NO: 9396505 - DNA, 22 bp, Homo sapiens
tttacacatacctctttaaagt

SEQ ID NO: 9396506 - DNA, 22 bp, Homo sapiens
tttaacagatgctatgtctacc

SEQ ID NO: 9396507 - DNA, 22 bp, Homo sapiens
tttacagttaagaaatgttacc

SEQ ID NO: 9396508 - DNA, 22 bp, Homo sapiens
tttacagtgtcttgttgactgt

SEQ ID NO: 9396509 - DNA, 22 bp, Homo sapiens
tttacagtgtcttgttgactgt

SEQ ID NO: 9396510 - DNA, 22 bp, Homo sapiens
tttacacatacctctttaaagt

SEQ ID NO: 9396511 - DNA, 22 bp, Homo sapiens
tttacagttaagaaatgttacc

SEQ ID NO: 9396512 - DNA, 22 bp, Homo sapiens
tttacatgtaatgttatacaaa

SEQ ID NO: 9396513 - DNA, 22 bp, Homo sapiens
tttacatgtaatgttatacaaa

SEQ ID NO: 9396514 - DNA, 22 bp, Homo sapiens
tttacatgtaatgttatacaaa

SEQ ID NO: 9396515 - DNA, 22 bp, Homo sapiens
tttacatgtcaagactggcagt

SEQ ID NO: 9396516 - DNA, 22 bp, Homo sapiens
tttacatgtccttcaagagcag

SEQ ID NO: 9396517 - DNA, 22 bp, Homo sapiens
tttacatgtccttcaagagcag

SEQ ID NO: 9396518 - DNA, 22 bp, Homo sapiens
tttacatggaatattgtcttgt

SEQ ID NO: 9396519 - DNA, 17 bp, Homo sapiens
tttagaatacaatgttt

SEQ ID NO: 9396520 - DNA, 17 bp, Homo sapiens
tttagaatacaatgttt

SEQ ID NO: 9396521 - DNA, 22 bp, Homo sapiens
tttaaaaaactagtctgagtct

SEQ ID NO: 9396522 - DNA, 22 bp, Homo sapiens
tttaaaaaactagtctgagtct

SEQ ID NO: 9396523 - DNA, 22 bp, Homo sapiens
tttaaaaaactagtctgagtct

SEQ ID NO: 9396524 - DNA, 22 bp, Homo sapiens
tttaaaaaactagtctgagtct

SEQ ID NO: 9396525 - DNA, 22 bp, Homo sapiens
tttaaaaccaaagaaagcctct

SEQ ID NO: 9396526 - DNA, 22 bp, Homo sapiens
tttaaaaggggtattaagtcca

SEQ ID NO: 9396527 - DNA, 22 bp, Homo sapiens
tttaaaaggggtattaagtcca

SEQ ID NO: 9396528 - DNA, 22 bp, Homo sapiens
tttaaaaggcagcttcttttgt

SEQ ID NO: 9396529 - DNA, 22 bp, Homo sapiens
tttaaaaccaaagaaagcctct

SEQ ID NO: 9396530 - DNA, 22 bp, Homo sapiens
tttaaatttagaagaaacactg

SEQ ID NO: 9396531 - DNA, 22 bp, Homo sapiens
ctcctcccaattgccaagtgct

SEQ ID NO: 9396532 - DNA, 22 bp, Homo sapiens
ctcctctccatcagcgccaccc

SEQ ID NO: 9396533 - DNA, 22 bp, Homo sapiens
ctcctcccaattgccaagtgct

SEQ ID NO: 9396534 - DNA, 22 bp, Homo sapiens
ctcctcccaattgccaagtgct

SEQ ID NO: 9396535 - DNA, 22 bp, Homo sapiens
tttagacatctataattgctaa

SEQ ID NO: 9396536 - DNA, 16 bp, Homo sapiens
ctcctctccttcagga

SEQ ID NO: 9396537 - DNA, 16 bp, Homo sapiens
ctcctctccttcagga

SEQ ID NO: 9396538 - DNA, 22 bp, Homo sapiens
ctcctctggaaattcctctgcc

SEQ ID NO: 9396539 - DNA, 22 bp, Homo sapiens
ctcctctggaaattcctctgcc

SEQ ID NO: 9396540 - DNA, 22 bp, Homo sapiens
ctcctctggaaattcctctgcc

SEQ ID NO: 9396541 - DNA, 22 bp, Homo sapiens
ctcctctggcttcctggaggca

SEQ ID NO: 9396542 - DNA, 22 bp, Homo sapiens
ctcctctggcttcctggaggca

SEQ ID NO: 9396543 - DNA, 22 bp, Homo sapiens
ctcctctggcttcctggaggca

SEQ ID NO: 9396544 - DNA, 22 bp, Homo sapiens
tttagacatagctgaaatcatt

SEQ ID NO: 9396545 - DNA, 22 bp, Homo sapiens
tttagacagcatctggtgactt

SEQ ID NO: 9396546 - DNA, 22 bp, Homo sapiens
tttagaatgtgactgtatttga

SEQ ID NO: 9396547 - DNA, 22 bp, Homo sapiens
tttagaatgttagcgttaaagg

SEQ ID NO: 9396548 - DNA, 22 bp, Homo sapiens
tttagacacactttgtatattt

SEQ ID NO: 9396549 - DNA, 22 bp, Homo sapiens
ctcctgagaaataagcaagtaa

SEQ ID NO: 9396550 - DNA, 22 bp, Homo sapiens
ctcctgagaattttcagttgga

SEQ ID NO: 9396551 - DNA, 22 bp, Homo sapiens
ctcctgagaattttcagttgga

SEQ ID NO: 9396552 - DNA, 22 bp, Homo sapiens
ctcctctttagccccagctgga

SEQ ID NO: 9396553 - DNA, 22 bp, Homo sapiens
ctcctctttagccccagctgga

SEQ ID NO: 9396554 - DNA, 22 bp, Homo sapiens
ctcctctttacccgcatggtct

SEQ ID NO: 9396555 - DNA, 22 bp, Homo sapiens
ctcctgagctctgaggaagctt

SEQ ID NO: 9396556 - DNA, 22 bp, Homo sapiens
ctcctgagaggatctctgttgt

SEQ ID NO: 9396557 - DNA, 22 bp, Homo sapiens
ctcctgagaattttcagttgga

SEQ ID NO: 9396558 - DNA, 22 bp, Homo sapiens
ctcctgagaggatctctgttgt

SEQ ID NO: 9396559 - DNA, 22 bp, Homo sapiens
ctcctgagaggatctctgttgt

SEQ ID NO: 9396560 - DNA, 22 bp, Homo sapiens
ctcctgagaggatctctgttgt

SEQ ID NO: 9396561 - DNA, 22 bp, Homo sapiens
ctcctggctatgactacatttc

SEQ ID NO: 9396562 - DNA, 22 bp, Homo sapiens
ctcctgagctctgaggaagctt

SEQ ID NO: 9396563 - DNA, 22 bp, Homo sapiens
ctcctgagctctgaggaagctt

SEQ ID NO: 9396564 - DNA, 22 bp, Homo sapiens
ctcctggctcgcccccagctga

SEQ ID NO: 9396565 - DNA, 22 bp, Homo sapiens
ctcctggctcgcccccagctga

SEQ ID NO: 9396566 - DNA, 22 bp, Homo sapiens
ctcctggctatgactacatttc

SEQ ID NO: 9396567 - DNA, 22 bp, Homo sapiens
ctcctctgtctggccctgagcc

SEQ ID NO: 9396568 - DNA, 22 bp, Homo sapiens
ctcctctgtctggccctgagcc

SEQ ID NO: 9396569 - DNA, 22 bp, Homo sapiens
ctcctctgtctggccctgagcc

SEQ ID NO: 9396570 - DNA, 22 bp, Homo sapiens
ctcctctgtctggccctgagcc

SEQ ID NO: 9396571 - DNA, 22 bp, Homo sapiens
ctcctctgtctaccacgagggt

SEQ ID NO: 9396572 - DNA, 22 bp, Homo sapiens
ctcctctggcttcctggaggca

SEQ ID NO: 9396573 - DNA, 22 bp, Homo sapiens
ctcctctgggtcctggtggcca

SEQ ID NO: 9396574 - DNA, 22 bp, Homo sapiens
ctcctctgggtcctggtggcca

SEQ ID NO: 9396575 - DNA, 22 bp, Homo sapiens
ctcctctgggtcctggtggcca

SEQ ID NO: 9396576 - DNA, 22 bp, Homo sapiens
ctcctctgtctaccacgagggt

SEQ ID NO: 9396577 - DNA, 22 bp, Homo sapiens
ctcctctgtctaccacgagggt

SEQ ID NO: 9396578 - DNA, 22 bp, Homo sapiens
ctcctctgtattgattgggact

SEQ ID NO: 9396579 - DNA, 22 bp, Homo sapiens
ctctcctcagaacaggccctct

SEQ ID NO: 9396580 - DNA, 22 bp, Homo sapiens
ctctcccttgggtgggctttgg

SEQ ID NO: 9396581 - DNA, 22 bp, Homo sapiens
ctctcccttgggtgggctttgg

SEQ ID NO: 9396582 - DNA, 22 bp, Homo sapiens
ctctccctggccagctgtgcag

SEQ ID NO: 9396583 - DNA, 22 bp, Homo sapiens
ctctccctggccagctgtgcag

SEQ ID NO: 9396584 - DNA, 22 bp, Homo sapiens
ctctcctccaggaactcacagt

SEQ ID NO: 9396585 - DNA, 22 bp, Homo sapiens
ctctcctccaggaactcacagt

SEQ ID NO: 9396586 - DNA, 22 bp, Homo sapiens
ctctcctccaacagccctgccg

SEQ ID NO: 9396587 - DNA, 22 bp, Homo sapiens
ctctcctccaacagccctgccg

SEQ ID NO: 9396588 - DNA, 22 bp, Homo sapiens
ctctcctccaacagccctgccg

SEQ ID NO: 9396589 - DNA, 22 bp, Homo sapiens
ctctccctatgcctcccaggag

SEQ ID NO: 9396590 - DNA, 22 bp, Homo sapiens
ctctccctatgcctcccaggag

SEQ ID NO: 9396591 - DNA, 22 bp, Homo sapiens
ctctccctggccagctgtgcag

SEQ ID NO: 9396592 - DNA, 22 bp, Homo sapiens
ctctccctggccagctgtgcag

SEQ ID NO: 9396593 - DNA, 22 bp, Homo sapiens
ctctccctcattgggttccatt

SEQ ID NO: 9396594 - DNA, 22 bp, Homo sapiens
ctctccctaggttagcggtcag

SEQ ID NO: 9396595 - DNA, 22 bp, Homo sapiens
ctctccctatgcctcccaggag

SEQ ID NO: 9396596 - DNA, 22 bp, Homo sapiens
ctctccctatgcctcccaggag

SEQ ID NO: 9396597 - DNA, 22 bp, Homo sapiens
ctctcccccacagcagccttct

SEQ ID NO: 9396598 - DNA, 22 bp, Homo sapiens
ctctcccccacagcagccttct

SEQ ID NO: 9396599 - DNA, 23 bp, Homo sapiens
ctctccccctttgatgttagctc

SEQ ID NO: 9396600 - DNA, 22 bp, Homo sapiens
ctctccctaggttagcggtcag

SEQ ID NO: 9396601 - DNA, 22 bp, Homo sapiens
ctctccctaggttagcggtcag

SEQ ID NO: 9396602 - DNA, 23 bp, Homo sapiens
ctctccccctttgatgttagctc

SEQ ID NO: 9396603 - DNA, 22 bp, Homo sapiens
ctctccccggtacgagcggccg

SEQ ID NO: 9396604 - DNA, 22 bp, Homo sapiens
tttcagtgtgctcctgagggct

SEQ ID NO: 9396605 - DNA, 22 bp, Homo sapiens
tttcagtgttatgactttcatt

SEQ ID NO: 9396606 - DNA, 22 bp, Homo sapiens
tttcagtgtgtaaattgaaata

SEQ ID NO: 9396607 - DNA, 22 bp, Homo sapiens
tttcagttcagtttattatatc

SEQ ID NO: 9396608 - DNA, 22 bp, Homo sapiens
tttcagttgttttagctctgtg

SEQ ID NO: 9396609 - DNA, 21 bp, Homo sapiens
ctctccagtggttcctgattc

SEQ ID NO: 9396610 - DNA, 22 bp, Homo sapiens
ctctccccacaccctctgcatg

SEQ ID NO: 9396611 - DNA, 22 bp, Homo sapiens
ctctcccccacagcagccttct

SEQ ID NO: 9396612 - DNA, 19 bp, Homo sapiens
ctctccagctccagtagct

SEQ ID NO: 9396613 - DNA, 22 bp, Homo sapiens
ctctccagccacagaagctgct

SEQ ID NO: 9396614 - DNA, 22 bp, Homo sapiens
ctctccagcctttagcccacgc

SEQ ID NO: 9396615 - DNA, 22 bp, Homo sapiens
ctctccagccaggggcttcctg

SEQ ID NO: 9396616 - DNA, 22 bp, Homo sapiens
ctctccagcagatgtagtctgt

SEQ ID NO: 9396617 - DNA, 22 bp, Homo sapiens
ctctccagatctgctgagccag

SEQ ID NO: 9396618 - DNA, 22 bp, Homo sapiens
ctctccagagcccttccggccc

SEQ ID NO: 9396619 - DNA, 22 bp, Homo sapiens
ctctccagatctgctgagccag

SEQ ID NO: 9396620 - DNA, 22 bp, Homo sapiens
ctcctgggctgtcggcgctctg

SEQ ID NO: 9396621 - DNA, 22 bp, Homo sapiens
ctcctgggctgtcggcgctctg

SEQ ID NO: 9396622 - DNA, 22 bp, Homo sapiens
ctcctgggctgggaactcagcc

SEQ ID NO: 9396623 - DNA, 22 bp, Homo sapiens
ctctccagaattattactatta

SEQ ID NO: 9396624 - DNA, 22 bp, Homo sapiens
ctcctgggctatgtctgcttgg

SEQ ID NO: 9396625 - DNA, 22 bp, Homo sapiens
ctcctgggctcaagtgatcctc

SEQ ID NO: 9396626 - DNA, 22 bp, Homo sapiens
ctcctgggctatgtctgcttgg

SEQ ID NO: 9396627 - DNA, 22 bp, Homo sapiens
ctcctgggctatgtctgcttgg

SEQ ID NO: 9396628 - DNA, 21 bp, Homo sapiens
ctcctgggctaagatatagtg

SEQ ID NO: 9396629 - DNA, 21 bp, Homo sapiens
ctcctgggctaagatatagtg

SEQ ID NO: 9396630 - DNA, 22 bp, Homo sapiens
ctcctgggatgactctttcttt

SEQ ID NO: 9396631 - DNA, 22 bp, Homo sapiens
ctcctgggatgactctttcttt

SEQ ID NO: 9396632 - DNA, 22 bp, Homo sapiens
ctcctgggatgactctttcttt

SEQ ID NO: 9396633 - DNA, 22 bp, Homo sapiens
ctcctgggctcaagtgatcctc

SEQ ID NO: 9396634 - DNA, 22 bp, Homo sapiens
ctcctgggctcaagtgatcctc

SEQ ID NO: 9396635 - DNA, 22 bp, Homo sapiens
ctcctgggctcatatcattcag

SEQ ID NO: 9396636 - DNA, 22 bp, Homo sapiens
ctcctgggctcaagtgatcctc

SEQ ID NO: 9396637 - DNA, 22 bp, Homo sapiens
ctcctgggctcatatcattcag

SEQ ID NO: 9396638 - DNA, 18 bp, Homo sapiens
ctcctgggctgcagatgc

SEQ ID NO: 9396639 - DNA, 22 bp, Homo sapiens
ctcctgggctcatatcattcag

SEQ ID NO: 9396640 - DNA, 18 bp, Homo sapiens
ctcctgggctgcagatgc

SEQ ID NO: 9396641 - DNA, 22 bp, Homo sapiens
ctcctgggagcagggatggatg

SEQ ID NO: 9396642 - DNA, 22 bp, Homo sapiens
ctcctgggagcagggatggatg

SEQ ID NO: 9396643 - DNA, 22 bp, Homo sapiens
ctcctgggagctgtggcagagc

SEQ ID NO: 9396644 - DNA, 22 bp, Homo sapiens
ctcctgggagctgtggcagagc

SEQ ID NO: 9396645 - DNA, 22 bp, Homo sapiens
ctcctgggagctgtggcagagc

SEQ ID NO: 9396646 - DNA, 22 bp, Homo sapiens
ctcctgggagctgtggcagagc

SEQ ID NO: 9396647 - DNA, 22 bp, Homo sapiens
ctcctgggaggatgcggacccg

SEQ ID NO: 9396648 - DNA, 22 bp, Homo sapiens
ctcctgggagctgtggcagagc

SEQ ID NO: 9396649 - DNA, 22 bp, Homo sapiens
ctcctgggagtcttcctggatg

SEQ ID NO: 9396650 - DNA, 22 bp, Homo sapiens
ctcctgggagtcttcctggatg

SEQ ID NO: 9396651 - DNA, 22 bp, Homo sapiens
ctcctgggagtcttcctggatg

SEQ ID NO: 9396652 - DNA, 20 bp, Homo sapiens
ctccaggggaagagccttcc

SEQ ID NO: 9396653 - DNA, 20 bp, Homo sapiens
ctccaggggaagagccttcc

SEQ ID NO: 9396654 - DNA, 20 bp, Homo sapiens
ctccaggggaagagccttcc

SEQ ID NO: 9396655 - DNA, 22 bp, Homo sapiens
ctccaggggccagaagcctggc

SEQ ID NO: 9396656 - DNA, 22 bp, Homo sapiens
ctccagggctaccaggttttag

SEQ ID NO: 9396657 - DNA, 22 bp, Homo sapiens
ctccagggatgagacagagtag

SEQ ID NO: 9396658 - DNA, 22 bp, Homo sapiens
ctccagggcagcatggcagtgg

SEQ ID NO: 9396659 - DNA, 22 bp, Homo sapiens
ctccagggatgagacagagtag

SEQ ID NO: 9396660 - DNA, 22 bp, Homo sapiens
ctccagggatgagacagagtag

SEQ ID NO: 9396661 - DNA, 22 bp, Homo sapiens
ctccagggaggtctgcaggact

SEQ ID NO: 9396662 - DNA, 22 bp, Homo sapiens
ctccagggaggtctgcaggact

SEQ ID NO: 9396663 - DNA, 22 bp, Homo sapiens
ctccagggaggagcacgggttc

SEQ ID NO: 9396664 - DNA, 22 bp, Homo sapiens
ctccagggaggagcacgggttc

SEQ ID NO: 9396665 - DNA, 22 bp, Homo sapiens
ctccagggaggtctgcaggact

SEQ ID NO: 9396666 - DNA, 22 bp, Homo sapiens
ctccagggggcatccacacagc

SEQ ID NO: 9396667 - DNA, 22 bp, Homo sapiens
ctccagggggcatccacacagc

SEQ ID NO: 9396668 - DNA, 22 bp, Homo sapiens
ctccagggggcatccacacagc

SEQ ID NO: 9396669 - DNA, 22 bp, Homo sapiens
ttgtatttctccactttctgtt

SEQ ID NO: 9396670 - DNA, 22 bp, Homo sapiens
ttgtatttctccactttctgtt

SEQ ID NO: 9396671 - DNA, 22 bp, Homo sapiens
ttgtatttctccactttctgtt

SEQ ID NO: 9396672 - DNA, 22 bp, Homo sapiens
ttgtatttgattgtcatatcgt

SEQ ID NO: 9396673 - DNA, 22 bp, Homo sapiens
ttgtatttgattgtcatatcgt

SEQ ID NO: 9396674 - DNA, 22 bp, Homo sapiens
ttgtatttcttccggtctcatt

SEQ ID NO: 9396675 - DNA, 22 bp, Homo sapiens
ttgtatttcttccggtctcatt

SEQ ID NO: 9396676 - DNA, 22 bp, Homo sapiens
ttgtatttgggtagtatagaga

SEQ ID NO: 9396677 - DNA, 22 bp, Homo sapiens
ttgtatttgggtagtatagaga

SEQ ID NO: 9396678 - DNA, 22 bp, Homo sapiens
ttgtatttgggtagtatagaga

SEQ ID NO: 9396679 - DNA, 22 bp, Homo sapiens
ttgtatttgattgtcatatcgt

SEQ ID NO: 9396680 - DNA, 22 bp, Homo sapiens
ttgtatttgattgtcatatcgt

SEQ ID NO: 9396681 - DNA, 22 bp, Homo sapiens
ttgtatttgattgtcatatcgt

SEQ ID NO: 9396682 - DNA, 22 bp, Homo sapiens
ctccagggagctgcgggagcca

SEQ ID NO: 9396683 - DNA, 22 bp, Homo sapiens
ctccaggcgcttaccaagcgct

SEQ ID NO: 9396684 - DNA, 22 bp, Homo sapiens
ctccagggaggagcacgggttc

SEQ ID NO: 9396685 - DNA, 22 bp, Homo sapiens
ctccagggagctgtggaggttt

SEQ ID NO: 9396686 - DNA, 22 bp, Homo sapiens
ctccagggagcttggaaagacc

SEQ ID NO: 9396687 - DNA, 22 bp, Homo sapiens
ttggtaggggactagagtccag

SEQ ID NO: 9396688 - DNA, 22 bp, Homo sapiens
ttggtattttacaatgtcagtg

SEQ ID NO: 9396689 - DNA, 22 bp, Homo sapiens
ctccaggcgccgcttttgcagt

SEQ ID NO: 9396690 - DNA, 22 bp, Homo sapiens
ttggtcaagctgtcttctttgc

SEQ ID NO: 9396691 - DNA, 22 bp, Homo sapiens
ttggtattttacaatgtcagtg

SEQ ID NO: 9396692 - DNA, 22 bp, Homo sapiens
ttgggttgaagggcgcttcctt

SEQ ID NO: 9396693 - DNA, 22 bp, Homo sapiens
ttgggtggtggggagagttcag

SEQ ID NO: 9396694 - DNA, 22 bp, Homo sapiens
ttgggtgctgtcatggggcacg

SEQ ID NO: 9396695 - DNA, 22 bp, Homo sapiens
ttgggtaggagaaagaacagat

SEQ ID NO: 9396696 - DNA, 22 bp, Homo sapiens
ttgggtaggagaaagaacagat

SEQ ID NO: 9396697 - DNA, 22 bp, Homo sapiens
ttgggtcttatggctggagtag

SEQ ID NO: 9396698 - DNA, 22 bp, Homo sapiens
ctccaggttacttagcctagct

SEQ ID NO: 9396699 - DNA, 22 bp, Homo sapiens
ctccagtctagtagagcctgct

SEQ ID NO: 9396700 - DNA, 22 bp, Homo sapiens
ctccagtgcacccagaggattt

SEQ ID NO: 9396701 - DNA, 22 bp, Homo sapiens
ttgtttcagctgtatgctatgt

SEQ ID NO: 9396702 - DNA, 22 bp, Homo sapiens
ctccagtgcgcaggacagcccc

SEQ ID NO: 9396703 - DNA, 22 bp, Homo sapiens
tttaaaaaactagtctgagtct

SEQ ID NO: 9396704 - DNA, 22 bp, Homo sapiens
tttaaaaaactagtctgagtct

SEQ ID NO: 9396705 - DNA, 22 bp, Homo sapiens
tttaaaaaactagtctgagtct

SEQ ID NO: 9396706 - DNA, 22 bp, Homo sapiens
ttgttaaaatattggagaaagg

SEQ ID NO: 9396707 - DNA, 22 bp, Homo sapiens
ttgttaaaatgcatattctggt

SEQ ID NO: 9396708 - DNA, 22 bp, Homo sapiens
ttgttaaaatgcatattctggt

SEQ ID NO: 9396709 - DNA, 22 bp, Homo sapiens
ttgttaaaaatagatttccagg

SEQ ID NO: 9396710 - DNA, 22 bp, Homo sapiens
ttgttaaaactccattggtttg

SEQ ID NO: 9396711 - DNA, 22 bp, Homo sapiens
ttgtattttgttatgctactgc

SEQ ID NO: 9396712 - DNA, 22 bp, Homo sapiens
ttgtgtactacagtatgccaca

SEQ ID NO: 9396713 - DNA, 22 bp, Homo sapiens
ttgtattttgttatgctactgc

SEQ ID NO: 9396714 - DNA, 22 bp, Homo sapiens
ctccagggttccccgatccact

SEQ ID NO: 9396715 - DNA, 22 bp, Homo sapiens
ctccaggtagctaagtcctggg

SEQ ID NO: 9396716 - DNA, 22 bp, Homo sapiens
ctccaggtagctaagtcctggg

SEQ ID NO: 9396717 - DNA, 21 bp, Homo sapiens
ttgttacaatgcaagagtatg

SEQ ID NO: 9396718 - DNA, 22 bp, Homo sapiens
ttgttaaatggatgcagaataa

SEQ ID NO: 9396719 - DNA, 22 bp, Homo sapiens
ttgttaaaggcaaaacaagcac

SEQ ID NO: 9396720 - DNA, 22 bp, Homo sapiens
ttgttaaaggcaaaacaagcac

SEQ ID NO: 9396721 - DNA, 22 bp, Homo sapiens
ttgttaaagatgcagattccat

SEQ ID NO: 9396722 - DNA, 22 bp, Homo sapiens
ttgttaaagatgcagattccat

SEQ ID NO: 9396723 - DNA, 22 bp, Homo sapiens
ctcatccaccgcagcccctcag

SEQ ID NO: 9396724 - DNA, 22 bp, Homo sapiens
ctcatcataaccctgtgaggat

SEQ ID NO: 9396725 - DNA, 22 bp, Homo sapiens
ctcatcataaccctgtgaggat

SEQ ID NO: 9396726 - DNA, 22 bp, Homo sapiens
ctcatcatgtcacccatgtgct

SEQ ID NO: 9396727 - DNA, 22 bp, Homo sapiens
ctcagtttttttaagagccatg

SEQ ID NO: 9396728 - DNA, 22 bp, Homo sapiens
ttggccagatctgaggatactg

SEQ ID NO: 9396729 - DNA, 22 bp, Homo sapiens
ctcataaaagctttgtttacac

SEQ ID NO: 9396730 - DNA, 22 bp, Homo sapiens
ctcataaacaattctttgaggt

SEQ ID NO: 9396731 - DNA, 22 bp, Homo sapiens
ctcataaaggcacacttgttgt

SEQ ID NO: 9396732 - DNA, 22 bp, Homo sapiens
ctcataaagtgagaatatgacc

SEQ ID NO: 9396733 - DNA, 22 bp, Homo sapiens
ctcataatgtgactgtatttga

SEQ ID NO: 9396734 - DNA, 22 bp, Homo sapiens
ttggccagaatcttcctagtga

SEQ ID NO: 9396735 - DNA, 22 bp, Homo sapiens
ttggccagacactacccccctt

SEQ ID NO: 9396736 - DNA, 22 bp, Homo sapiens
ttggccagaggtttctctcatg

SEQ ID NO: 9396737 - DNA, 22 bp, Homo sapiens
ttggccagagaccagagcaggg

SEQ ID NO: 9396738 - DNA, 22 bp, Homo sapiens
ttggccagactgaggtgctggg

SEQ ID NO: 9396739 - DNA, 22 bp, Homo sapiens
ctcatctcccacctgcgtgcag

SEQ ID NO: 9396740 - DNA, 20 bp, Homo sapiens
ctcatctctgagcctcctgg

SEQ ID NO: 9396741 - DNA, 22 bp, Homo sapiens
ttggctgctagatggtgttaga

SEQ ID NO: 9396742 - DNA, 22 bp, Homo sapiens
ttggctgctatttccatattta

SEQ ID NO: 9396743 - DNA, 20 bp, Homo sapiens
ctcatctctgagcctcctgg

SEQ ID NO: 9396744 - DNA, 20 bp, Homo sapiens
ctcatctctgagcctcctgg

SEQ ID NO: 9396745 - DNA, 22 bp, Homo sapiens
ctcatctcccacctgcgtgcag

SEQ ID NO: 9396746 - DNA, 22 bp, Homo sapiens
ttgggagtaataaaaaattcca

SEQ ID NO: 9396747 - DNA, 22 bp, Homo sapiens
ttgggagttcctactgcggttt

SEQ ID NO: 9396748 - DNA, 22 bp, Homo sapiens
ttgggagttcctactgcggttt

SEQ ID NO: 9396749 - DNA, 22 bp, Homo sapiens
ttggctgctgggaactcaaaca

SEQ ID NO: 9396750 - DNA, 22 bp, Homo sapiens
ttggctgctcagtgatatgaga

SEQ ID NO: 9396751 - DNA, 22 bp, Homo sapiens
ttggctgctgaaatatgttctg

SEQ ID NO: 9396752 - DNA, 22 bp, Homo sapiens
ttggctgctctgtgtttagtat

SEQ ID NO: 9396753 - DNA, 22 bp, Homo sapiens
ttgggaggtaatggagccaagt

SEQ ID NO: 9396754 - DNA, 22 bp, Homo sapiens
ttgggaggtcataaatctgttc

SEQ ID NO: 9396755 - DNA, 22 bp, Homo sapiens
ttgggcagggaaaggacaggca

SEQ ID NO: 9396756 - DNA, 22 bp, Homo sapiens
ttgggcagaggctgtgcagagg

SEQ ID NO: 9396757 - DNA, 22 bp, Homo sapiens
ttgggcagatgtttcctgtgga

SEQ ID NO: 9396758 - DNA, 22 bp, Homo sapiens
ttgggcagaggctgtgcagagg

SEQ ID NO: 9396759 - DNA, 22 bp, Homo sapiens
ttgggcagaggccaggaggatg

SEQ ID NO: 9396760 - DNA, 22 bp, Homo sapiens
ttgggcagaggccaggaggatg

SEQ ID NO: 9396761 - DNA, 22 bp, Homo sapiens
ttgggcacggacaggtggggat

SEQ ID NO: 9396762 - DNA, 22 bp, Homo sapiens
ttgctttgttactgcagtttcc

SEQ ID NO: 9396763 - DNA, 22 bp, Homo sapiens
ttgcttttaatctttgtacatc

SEQ ID NO: 9396764 - DNA, 22 bp, Homo sapiens
ttgcttttaatctttgtacatc

SEQ ID NO: 9396765 - DNA, 22 bp, Homo sapiens
ttgctttgtggtggttcttcca

SEQ ID NO: 9396766 - DNA, 18 bp, Homo sapiens
ttgctttgtaagcttgca

SEQ ID NO: 9396767 - DNA, 22 bp, Homo sapiens
ttgcttttaattaatcattgct

SEQ ID NO: 9396768 - DNA, 22 bp, Homo sapiens
ttgcttttaatctttgtacatc

SEQ ID NO: 9396769 - DNA, 22 bp, Homo sapiens
ttgcttttgggaaaacatgcct

SEQ ID NO: 9396770 - DNA, 22 bp, Homo sapiens
ttggcatttttcctcagctgga

SEQ ID NO: 9396771 - DNA, 22 bp, Homo sapiens
ttggcattcatgggacaacaaa

SEQ ID NO: 9396772 - DNA, 22 bp, Homo sapiens
ttggcattgaagtttcattggt

SEQ ID NO: 9396773 - DNA, 22 bp, Homo sapiens
ttgctttttaattaggaggcag

SEQ ID NO: 9396774 - DNA, 22 bp, Homo sapiens
ttggaaaaacacgatagtggtt

SEQ ID NO: 9396775 - DNA, 22 bp, Homo sapiens
ttggaaaacttacacagagctg

SEQ ID NO: 9396776 - DNA, 22 bp, Homo sapiens
ttggaaaagcgttctctgtagc

SEQ ID NO: 9396777 - DNA, 22 bp, Homo sapiens
ttggaaaagcgttctctgtagc

SEQ ID NO: 9396778 - DNA, 22 bp, Homo sapiens
ttgatatgttaggaagactgat

SEQ ID NO: 9396779 - DNA, 22 bp, Homo sapiens
ctcagtgcttctagcttgatga

SEQ ID NO: 9396780 - DNA, 20 bp, Homo sapiens
ctcagtgctttcattgcctc

SEQ ID NO: 9396781 - DNA, 22 bp, Homo sapiens
ctcagtgctttggatcctggat

SEQ ID NO: 9396782 - DNA, 22 bp, Homo sapiens
ctcagtttccccggcctgggcg

SEQ ID NO: 9396783 - DNA, 22 bp, Homo sapiens
ctcagtttcctcaactgcaaaa

SEQ ID NO: 9396784 - DNA, 20 bp, Homo sapiens
ctcagtttcctcatggctca

SEQ ID NO: 9396785 - DNA, 22 bp, Homo sapiens
ctcagtttcctcttctgttgaa

SEQ ID NO: 9396786 - DNA, 22 bp, Homo sapiens
ctcagtttctgaagtggacagg

SEQ ID NO: 9396787 - DNA, 22 bp, Homo sapiens
ctcagtttctgaagtggacagg

SEQ ID NO: 9396788 - DNA, 22 bp, Homo sapiens
ctcagttttgaaaaggtaagct

SEQ ID NO: 9396789 - DNA, 22 bp, Homo sapiens
ctcagttttgaaaaggtaagct

SEQ ID NO: 9396790 - DNA, 22 bp, Homo sapiens
ctcagttttgctagctggagtt

SEQ ID NO: 9396791 - DNA, 22 bp, Homo sapiens
ctcagttttcccttgggagcgt

SEQ ID NO: 9396792 - DNA, 22 bp, Homo sapiens
ctcagttttaagactactcttt

SEQ ID NO: 9396793 - DNA, 22 bp, Homo sapiens
ctcagtttttgtgggcatcagc

SEQ ID NO: 9396794 - DNA, 22 bp, Homo sapiens
ctcagtttttgtgggcatcagc

SEQ ID NO: 9396795 - DNA, 22 bp, Homo sapiens
ttgctttgccaccagaagtcta

SEQ ID NO: 9396796 - DNA, 22 bp, Homo sapiens
ctcagtttgtgtgatattgtct

SEQ ID NO: 9396797 - DNA, 22 bp, Homo sapiens
ctcagtttcttcatattgtagg

SEQ ID NO: 9396798 - DNA, 22 bp, Homo sapiens
ctcagtttgaatgctgacactg

SEQ ID NO: 9396799 - DNA, 22 bp, Homo sapiens
ctcagtttctgacattaaaatc

SEQ ID NO: 9396800 - DNA, 22 bp, Homo sapiens
ctcagtttctgacattaaaatc

SEQ ID NO: 9396801 - DNA, 22 bp, Homo sapiens
ctcagtttctggataagctggg

SEQ ID NO: 9396802 - DNA, 22 bp, Homo sapiens
ctcagtttcttactctgtataa

SEQ ID NO: 9396803 - DNA, 22 bp, Homo sapiens
ctcagtttctggataagctggg

SEQ ID NO: 9396804 - DNA, 22 bp, Homo sapiens
ttccttcctcctccagttctgg

SEQ ID NO: 9396805 - DNA, 22 bp, Homo sapiens
ttccttcctctttcacaacagc

SEQ ID NO: 9396806 - DNA, 22 bp, Homo sapiens
ttccttcctctttcacaacagc

SEQ ID NO: 9396807 - DNA, 22 bp, Homo sapiens
ttccttcctcctccagttctgg

SEQ ID NO: 9396808 - DNA, 22 bp, Homo sapiens
ttccttcctgtcttccttactg

SEQ ID NO: 9396809 - DNA, 22 bp, Homo sapiens
ttccttcctggggatttatcat

SEQ ID NO: 9396810 - DNA, 22 bp, Homo sapiens
ttccttcctgtcttccttactg

SEQ ID NO: 9396811 - DNA, 22 bp, Homo sapiens
ttccttcccctagctgagaaac

SEQ ID NO: 9396812 - DNA, 22 bp, Homo sapiens
ttccttccctcagtggctgaag

SEQ ID NO: 9396813 - DNA, 22 bp, Homo sapiens
ttccttccgggcaccaggcact

SEQ ID NO: 9396814 - DNA, 22 bp, Homo sapiens
ttccttccatagcaaaacatgc

SEQ ID NO: 9396815 - DNA, 22 bp, Homo sapiens
ttccttccagcttgtgacagtc

SEQ ID NO: 9396816 - DNA, 22 bp, Homo sapiens
ttccttccacttcaggattttg

SEQ ID NO: 9396817 - DNA, 22 bp, Homo sapiens
ttcctggggacttaccgtcatt

SEQ ID NO: 9396818 - DNA, 20 bp, Homo sapiens
ttcctggggaatgatagaag

SEQ ID NO: 9396819 - DNA, 22 bp, Homo sapiens
ctacaaaagtaattgtggtttt

SEQ ID NO: 9396820 - DNA, 22 bp, Homo sapiens
ctaattatgttgttataatcaa

SEQ ID NO: 9396821 - DNA, 22 bp, Homo sapiens
ctaattgttaggtgtctgatgt

SEQ ID NO: 9396822 - DNA, 22 bp, Homo sapiens
ctaattgtaccagatttctctt

SEQ ID NO: 9396823 - DNA, 22 bp, Homo sapiens
ctaattgtttgtgttgtcacct

SEQ ID NO: 9396824 - DNA, 22 bp, Homo sapiens
ctaattctgtatttggtcattg

SEQ ID NO: 9396825 - DNA, 22 bp, Homo sapiens
ctacaaaagtaattgtggtttt

SEQ ID NO: 9396826 - DNA, 22 bp, Homo sapiens
ctacaaaagtaattgtggtttt

SEQ ID NO: 9396827 - DNA, 22 bp, Homo sapiens
ctaatttttgttctgcattgaa

SEQ ID NO: 9396828 - DNA, 22 bp, Homo sapiens
ctacaaaagtaattgtggtttt

SEQ ID NO: 9396829 - DNA, 22 bp, Homo sapiens
ctaatgcagtatcagaatagca

SEQ ID NO: 9396830 - DNA, 22 bp, Homo sapiens
ctaatgtaaaacagacttgcat

SEQ ID NO: 9396831 - DNA, 22 bp, Homo sapiens
ctaatcatctttctcttaaagc

SEQ ID NO: 9396832 - DNA, 22 bp, Homo sapiens
ctaaggtgtccctcttgctgga

SEQ ID NO: 9396833 - DNA, 22 bp, Homo sapiens
ctaagtttatgtagttctttca

SEQ ID NO: 9396834 - DNA, 22 bp, Homo sapiens
ctaataacatgaactactttct

SEQ ID NO: 9396835 - DNA, 22 bp, Homo sapiens
ctaaggcaggtccattccagga

SEQ ID NO: 9396836 - DNA, 22 bp, Homo sapiens
ttccaaatgttggacaactgta

SEQ ID NO: 9396837 - DNA, 22 bp, Homo sapiens
ttccaaatggagaagatgagtt

SEQ ID NO: 9396838 - DNA, 22 bp, Homo sapiens
ttcccacaatctgcgtgtgtat

SEQ ID NO: 9396839 - DNA, 22 bp, Homo sapiens
ttccatttttctaactctcaga

SEQ ID NO: 9396840 - DNA, 22 bp, Homo sapiens
ttccatttggcacttcactgag

SEQ ID NO: 9396841 - DNA, 22 bp, Homo sapiens
ttccatttttctaactctcaga

SEQ ID NO: 9396842 - DNA, 22 bp, Homo sapiens
ttccatttttctaactctcaga

SEQ ID NO: 9396843 - DNA, 22 bp, Homo sapiens
ttccaaatgagttccatcgaat

SEQ ID NO: 9396844 - DNA, 22 bp, Homo sapiens
ttccaaatgcccatctacacag

SEQ ID NO: 9396845 - DNA, 22 bp, Homo sapiens
ctaaggatgcatatgttttgtt

SEQ ID NO: 9396846 - DNA, 22 bp, Homo sapiens
ctaacttttacagtcatgttgc

SEQ ID NO: 9396847 - DNA, 22 bp, Homo sapiens
ttccggacgcccgtcttccagc

SEQ ID NO: 9396848 - DNA, 22 bp, Homo sapiens
ttcccttcctcactctacttgt

SEQ ID NO: 9396849 - DNA, 22 bp, Homo sapiens
ttccctttggcagccttctcct

SEQ ID NO: 9396850 - DNA, 22 bp, Homo sapiens
ttcccagaatgaatggatggag

SEQ ID NO: 9396851 - DNA, 22 bp, Homo sapiens
ttccctggtgggtgagaacctg

SEQ ID NO: 9396852 - DNA, 22 bp, Homo sapiens
ttccctgtgtgcagatgggtgt

SEQ ID NO: 9396853 - DNA, 22 bp, Homo sapiens
ttccctggtgggtgagaacctg

SEQ ID NO: 9396854 - DNA, 22 bp, Homo sapiens
ttcccacagagattacattgaa

SEQ ID NO: 9396855 - DNA, 22 bp, Homo sapiens
ttcccacacccatattgtgatt

SEQ ID NO: 9396856 - DNA, 22 bp, Homo sapiens
cctgggtggctgcctgcctttc

SEQ ID NO: 9396857 - DNA, 22 bp, Homo sapiens
cctgggtggcagaggttgcagt

SEQ ID NO: 9396858 - DNA, 22 bp, Homo sapiens
cctgggtggcagaggttgcagt

SEQ ID NO: 9396859 - DNA, 21 bp, Homo sapiens
cctgggtgggacccctcttcc

SEQ ID NO: 9396860 - DNA, 22 bp, Homo sapiens
cctgggtggttccggcaaggag

SEQ ID NO: 9396861 - DNA, 22 bp, Homo sapiens
cctgggtggttccggcaaggag

SEQ ID NO: 9396862 - DNA, 22 bp, Homo sapiens
ttcacagaccaggaggctgtga

SEQ ID NO: 9396863 - DNA, 22 bp, Homo sapiens
ttcacagtggcttaggctatgg

SEQ ID NO: 9396864 - DNA, 22 bp, Homo sapiens
ttcacagtgtttctcacggtta

SEQ ID NO: 9396865 - DNA, 22 bp, Homo sapiens
ttcacagtggtagtgcatttag

SEQ ID NO: 9396866 - DNA, 22 bp, Homo sapiens
ttcacataaatagatcacatca

SEQ ID NO: 9396867 - DNA, 22 bp, Homo sapiens
ttcacagttcctgggaaaacag

SEQ ID NO: 9396868 - DNA, 22 bp, Homo sapiens
ttcacagttgggcaggttgtgt

SEQ ID NO: 9396869 - DNA, 22 bp, Homo sapiens
ttcacatgaaagtaggaaagga

SEQ ID NO: 9396870 - DNA, 22 bp, Homo sapiens
cgctgggcgccgacctgctggc

SEQ ID NO: 9396871 - DNA, 22 bp, Homo sapiens
cgctgggcaggtccacttgtta

SEQ ID NO: 9396872 - DNA, 22 bp, Homo sapiens
ttcacatggcaatagagaggga

SEQ ID NO: 9396873 - DNA, 22 bp, Homo sapiens
ttcacatgttggacatagagga

SEQ ID NO: 9396874 - DNA, 22 bp, Homo sapiens
ttcacattacaaggccatattt

SEQ ID NO: 9396875 - DNA, 22 bp, Homo sapiens
cgctgggggaacagcgagggtg

SEQ ID NO: 9396876 - DNA, 22 bp, Homo sapiens
cgctgggggaacagcgagggtg

SEQ ID NO: 9396877 - DNA, 22 bp, Homo sapiens
cgctgggggaacttcagccaat

SEQ ID NO: 9396878 - DNA, 22 bp, Homo sapiens
cgctgggggaacagcgagggtg

SEQ ID NO: 9396879 - DNA, 22 bp, Homo sapiens
cgctggggctttttgcttgaga

SEQ ID NO: 9396880 - DNA, 22 bp, Homo sapiens
cgctggggctttttgcttgaga

SEQ ID NO: 9396881 - DNA, 22 bp, Homo sapiens
cggcaggtgtgctcactctgcc

SEQ ID NO: 9396882 - DNA, 22 bp, Homo sapiens
cggcagtgggcgccaggtctcc

SEQ ID NO: 9396883 - DNA, 22 bp, Homo sapiens
cggaagcgttctcagcaggggc

SEQ ID NO: 9396884 - DNA, 22 bp, Homo sapiens
cggaatgtcccaggtcctgatc

SEQ ID NO: 9396885 - DNA, 22 bp, Homo sapiens
cggacaggctcctggagctcct

SEQ ID NO: 9396886 - DNA, 22 bp, Homo sapiens
cggaatgtccttcttaaggtgt

SEQ ID NO: 9396887 - DNA, 22 bp, Homo sapiens
cggctcaggccacaggacggca

SEQ ID NO: 9396888 - DNA, 21 bp, Homo sapiens
cggctcagtgcctgctccttc

SEQ ID NO: 9396889 - DNA, 22 bp, Homo sapiens
cgctgggggaacttcagccaat

SEQ ID NO: 9396890 - DNA, 22 bp, Homo sapiens
cggaaactacgtgacacccgtt

SEQ ID NO: 9396891 - DNA, 22 bp, Homo sapiens
cggaagacagtccgctctttca

SEQ ID NO: 9396892 - DNA, 22 bp, Homo sapiens
cggaagagggacagcgccagcc

SEQ ID NO: 9396893 - DNA, 22 bp, Homo sapiens
cggaaacttgagaaccagccag

SEQ ID NO: 9396894 - DNA, 21 bp, Homo sapiens
cggaaactcggctctggttcc

SEQ ID NO: 9396895 - DNA, 22 bp, Homo sapiens
ttcattcttgggatcagagagt

SEQ ID NO: 9396896 - DNA, 19 bp, Homo sapiens
ttcattctcttattgttgt

SEQ ID NO: 9396897 - DNA, 22 bp, Homo sapiens
ttcattcccaagagtaaacata

SEQ ID NO: 9396898 - DNA, 22 bp, Homo sapiens
ttcattccttctgtaccttgcc

SEQ ID NO: 9396899 - DNA, 22 bp, Homo sapiens
ttcattccttccctaagcaact

SEQ ID NO: 9396900 - DNA, 22 bp, Homo sapiens
ttcattcctgagcccatattta

SEQ ID NO: 9396901 - DNA, 22 bp, Homo sapiens
ttcacttaacatcatatcatga

SEQ ID NO: 9396902 - DNA, 22 bp, Homo sapiens
ttcacttatagggatgttattg

SEQ ID NO: 9396903 - DNA, 22 bp, Homo sapiens
ttcagaaaaaacttcaataagt

SEQ ID NO: 9396904 - DNA, 22 bp, Homo sapiens
cggctggaagctggacaggccg

SEQ ID NO: 9396905 - DNA, 22 bp, Homo sapiens
cggctggagctgagaaaggagc

SEQ ID NO: 9396906 - DNA, 22 bp, Homo sapiens
cggctggagctttgaacctgat

SEQ ID NO: 9396907 - DNA, 22 bp, Homo sapiens
cggctgctgcctgagtcgctgt

SEQ ID NO: 9396908 - DNA, 22 bp, Homo sapiens
cggctgctgcctgagtcgctgt

SEQ ID NO: 9396909 - DNA, 22 bp, Homo sapiens
cggctgcttctgagccccggcg

SEQ ID NO: 9396910 - DNA, 22 bp, Homo sapiens
cggctgcttctgagccccggcg

SEQ ID NO: 9396911 - DNA, 22 bp, Homo sapiens
cggctcctccgcccttgctcac

SEQ ID NO: 9396912 - DNA, 21 bp, Homo sapiens
cggctcagtgcctgctccttc

SEQ ID NO: 9396913 - DNA, 22 bp, Homo sapiens
cggctgagacggccatagacac

SEQ ID NO: 9396914 - DNA, 22 bp, Homo sapiens
cggctctgtcctcagcactgct

SEQ ID NO: 9396915 - DNA, 23 bp, Homo sapiens
cggctgctcggccgagtcctcgg

SEQ ID NO: 9396916 - DNA, 23 bp, Homo sapiens
cggctgctcggccgagtcctcgg

SEQ ID NO: 9396917 - DNA, 22 bp, Homo sapiens
cggctgagcagtgctgatggaa

SEQ ID NO: 9396918 - DNA, 22 bp, Homo sapiens
cggctgagcagtgctgatggaa

SEQ ID NO: 9396919 - DNA, 22 bp, Homo sapiens
cggctgagacggccatagacac

SEQ ID NO: 9396920 - DNA, 22 bp, Homo sapiens
cggctgaggatctccaggcctg

SEQ ID NO: 9396921 - DNA, 20 bp, Homo sapiens
ttgagcttttagtacagaca

SEQ ID NO: 9396922 - DNA, 22 bp, Homo sapiens
ttgacttttcttggtcacatga

SEQ ID NO: 9396923 - DNA, 22 bp, Homo sapiens
ttgagaaaatagttcgaatgtt

SEQ ID NO: 9396924 - DNA, 22 bp, Homo sapiens
ttgactttacagttttcttagg

SEQ ID NO: 9396925 - DNA, 17 bp, Homo sapiens
ttgactgttaatgggtt

SEQ ID NO: 9396926 - DNA, 22 bp, Homo sapiens
ttgactgttgctgccattctgg

SEQ ID NO: 9396927 - DNA, 22 bp, Homo sapiens
ttgactgttgctgccattctgg

SEQ ID NO: 9396928 - DNA, 22 bp, Homo sapiens
ttgactgttttcactccctttc

SEQ ID NO: 9396929 - DNA, 22 bp, Homo sapiens
ttgactatactctggcggaaaa

SEQ ID NO: 9396930 - DNA, 22 bp, Homo sapiens
ttgactgtacaaccttttgtag

SEQ ID NO: 9396931 - DNA, 22 bp, Homo sapiens
ctcagcagtatactctgaagat

SEQ ID NO: 9396932 - DNA, 22 bp, Homo sapiens
ttgataaaatgatgaaatcact

SEQ ID NO: 9396933 - DNA, 18 bp, Homo sapiens
ttgataaacaatttcatt

SEQ ID NO: 9396934 - DNA, 18 bp, Homo sapiens
ttgataaacaatttcatt

SEQ ID NO: 9396935 - DNA, 18 bp, Homo sapiens
ttgataaacaatttcatt

SEQ ID NO: 9396936 - DNA, 22 bp, Homo sapiens
ttgatacacaatggaacaatgt

SEQ ID NO: 9396937 - DNA, 22 bp, Homo sapiens
ttgataaaatgatgaaatcact

SEQ ID NO: 9396938 - DNA, 22 bp, Homo sapiens
ttgataaaatgatatcttcttt

SEQ ID NO: 9396939 - DNA, 22 bp, Homo sapiens
ttgataaaatgatatcttcttt

SEQ ID NO: 9396940 - DNA, 22 bp, Homo sapiens
ttgataaaatgatatcttcttt

SEQ ID NO: 9396941 - DNA, 22 bp, Homo sapiens
ttgaggagtggcgctggactta

SEQ ID NO: 9396942 - DNA, 22 bp, Homo sapiens
ttgaggagtacaaagcatgctt

SEQ ID NO: 9396943 - DNA, 22 bp, Homo sapiens
ttgaggaggcctttcagggctt

SEQ ID NO: 9396944 - DNA, 22 bp, Homo sapiens
ttgaggaggcctttcagggctt

SEQ ID NO: 9396945 - DNA, 23 bp, Homo sapiens
ttgaggacaatttacatggtgtt

SEQ ID NO: 9396946 - DNA, 20 bp, Homo sapiens
ttgagcttttagtacagaca

SEQ ID NO: 9396947 - DNA, 20 bp, Homo sapiens
ttgagcttttagtacagaca

SEQ ID NO: 9396948 - DNA, 22 bp, Homo sapiens
ctcagcagagaccagggaggaa

SEQ ID NO: 9396949 - DNA, 22 bp, Homo sapiens
ctcagcactttggaaggctgat

SEQ ID NO: 9396950 - DNA, 22 bp, Homo sapiens
ctcagcactgacccaggagatg

SEQ ID NO: 9396951 - DNA, 22 bp, Homo sapiens
ctcagcaccccgacaggacatt

SEQ ID NO: 9396952 - DNA, 22 bp, Homo sapiens
ctcagcaccccgacaggacatt

SEQ ID NO: 9396953 - DNA, 22 bp, Homo sapiens
ctatttttctgtaccctaattt

SEQ ID NO: 9396954 - DNA, 20 bp, Homo sapiens
ctcagcagattcttctagaa

SEQ ID NO: 9396955 - DNA, 20 bp, Homo sapiens
ctcagcagattcttctagaa

SEQ ID NO: 9396956 - DNA, 22 bp, Homo sapiens
ctcagcagctgctgctggtggg

SEQ ID NO: 9396957 - DNA, 22 bp, Homo sapiens
ctcagcagctacaggattcggg

SEQ ID NO: 9396958 - DNA, 22 bp, Homo sapiens
ctcagcagctgctgctggtggg

SEQ ID NO: 9396959 - DNA, 23 bp, Homo sapiens
ctcagcagcctgctgcagataag

SEQ ID NO: 9396960 - DNA, 22 bp, Homo sapiens
ctcagcagtaaacgtccggaac

SEQ ID NO: 9396961 - DNA, 22 bp, Homo sapiens
ctcagcaggtcttgggtagggg

SEQ ID NO: 9396962 - DNA, 22 bp, Homo sapiens
ctcagcaggtaccacatgatct

SEQ ID NO: 9396963 - DNA, 23 bp, Homo sapiens
ctcagcaggtcaggccccttcct

SEQ ID NO: 9396964 - DNA, 22 bp, Homo sapiens
ctcagcaggcactgtgccttac

SEQ ID NO: 9396965 - DNA, 17 bp, Homo sapiens
ctcagcagggctcactt

SEQ ID NO: 9396966 - DNA, 17 bp, Homo sapiens
ctcagcagggctcactt

SEQ ID NO: 9396967 - DNA, 22 bp, Homo sapiens
ctattttaagaggccattaggt

SEQ ID NO: 9396968 - DNA, 22 bp, Homo sapiens
ctattttaagaggccattaggt

SEQ ID NO: 9396969 - DNA, 22 bp, Homo sapiens
ctattttaacttgattacctct

SEQ ID NO: 9396970 - DNA, 22 bp, Homo sapiens
ctattttaacttgattacctct

SEQ ID NO: 9396971 - DNA, 22 bp, Homo sapiens
ttcttgtttattaagatataaa

SEQ ID NO: 9396972 - DNA, 22 bp, Homo sapiens
ttcttgtttattaagatataaa

SEQ ID NO: 9396973 - DNA, 22 bp, Homo sapiens
ttcttgtttattaagatataaa

SEQ ID NO: 9396974 - DNA, 22 bp, Homo sapiens
ctattttaagaggccattaggt

SEQ ID NO: 9396975 - DNA, 22 bp, Homo sapiens
ctattttctgtctctatagagt

SEQ ID NO: 9396976 - DNA, 22 bp, Homo sapiens
ctattttccgcagcaggaagta

SEQ ID NO: 9396977 - DNA, 22 bp, Homo sapiens
ttcttgtatataaaaatcattt

SEQ ID NO: 9396978 - DNA, 22 bp, Homo sapiens
ttcttgtatataaaaatcattt

SEQ ID NO: 9396979 - DNA, 22 bp, Homo sapiens
ttcttgtaatttggagaaatga

SEQ ID NO: 9396980 - DNA, 22 bp, Homo sapiens
ttcttgtaatttggagaaatga

SEQ ID NO: 9396981 - DNA, 22 bp, Homo sapiens
ttcttgtactggagatacatga

SEQ ID NO: 9396982 - DNA, 22 bp, Homo sapiens
ttcttgggctccaccccagact

SEQ ID NO: 9396983 - DNA, 22 bp, Homo sapiens
ttcttgtatgtatgcaaaatca

SEQ ID NO: 9396984 - DNA, 22 bp, Homo sapiens
ttcttgtctttgttatgtagga

SEQ ID NO: 9396985 - DNA, 22 bp, Homo sapiens
ttcttgtctttgttatgtagga

SEQ ID NO: 9396986 - DNA, 22 bp, Homo sapiens
ttcttgttctcctcatttagag

SEQ ID NO: 9396987 - DNA, 22 bp, Homo sapiens
ttcttgttctggttctgttagc

SEQ ID NO: 9396988 - DNA, 22 bp, Homo sapiens
ttcttgttctggttctgttagc

SEQ ID NO: 9396989 - DNA, 22 bp, Homo sapiens
ttcttgttggcctcaggtttgc

SEQ ID NO: 9396990 - DNA, 22 bp, Homo sapiens
ctattttaacttgattacctct

SEQ ID NO: 9396991 - DNA, 22 bp, Homo sapiens
ttctgtaggcatggaacaggga

SEQ ID NO: 9396992 - DNA, 22 bp, Homo sapiens
ctattttaacttgattacctct

SEQ ID NO: 9396993 - DNA, 22 bp, Homo sapiens
ttctgtatttagtttgaggaca

SEQ ID NO: 9396994 - DNA, 22 bp, Homo sapiens
ttctgtcaaagactttttcagg

SEQ ID NO: 9396995 - DNA, 22 bp, Homo sapiens
ttctgtatgctctgggtccaga

SEQ ID NO: 9396996 - DNA, 22 bp, Homo sapiens
ttctgtatattgtaaagactca

SEQ ID NO: 9396997 - DNA, 22 bp, Homo sapiens
ttctgtatattgaggttatagt

SEQ ID NO: 9396998 - DNA, 22 bp, Homo sapiens
ttctgtatacgttacaattgag

SEQ ID NO: 9396999 - DNA, 22 bp, Homo sapiens
ttcttcctcacactctcaccca

SEQ ID NO: 9397000 - DNA, 22 bp, Homo sapiens
ttcttcctcacactctcaccca

SEQ ID NO: 9397001 - DNA, 22 bp, Homo sapiens
ttctgtcatttagcattgtcat

SEQ ID NO: 9397002 - DNA, 22 bp, Homo sapiens
ttcttcccttcattccaccacc

SEQ ID NO: 9397003 - DNA, 21 bp, Homo sapiens
ttcttcctaaatacagatctc

SEQ ID NO: 9397004 - DNA, 22 bp, Homo sapiens
ttctgtcagctgctttgtctca

SEQ ID NO: 9397005 - DNA, 22 bp, Homo sapiens
ttctgtcagcgtcagaaattct

SEQ ID NO: 9397006 - DNA, 22 bp, Homo sapiens
ttctgtcacttttttggaatct

SEQ ID NO: 9397007 - DNA, 22 bp, Homo sapiens
ttctgtcaaatgccagtagaga

SEQ ID NO: 9397008 - DNA, 22 bp, Homo sapiens
ctatttctacacagggtcggcg

SEQ ID NO: 9397009 - DNA, 22 bp, Homo sapiens
ctatttctaaacctataagtga

SEQ ID NO: 9397010 - DNA, 23 bp, Homo sapiens
ctatttctcatagttcaggtctt

SEQ ID NO: 9397011 - DNA, 22 bp, Homo sapiens
ctatttctaaacctataagtga

SEQ ID NO: 9397012 - DNA, 22 bp, Homo sapiens
ctatttctgcctaatgacctgt

SEQ ID NO: 9397013 - DNA, 22 bp, Homo sapiens
ctagggccaaaggctgtgatgc

SEQ ID NO: 9397014 - DNA, 22 bp, Homo sapiens
ctagggctagacagacgcatgt

SEQ ID NO: 9397015 - DNA, 22 bp, Homo sapiens
ctagggctccaaagctgagaag

SEQ ID NO: 9397016 - DNA, 23 bp, Homo sapiens
ctagggcagtatttcacagacac

SEQ ID NO: 9397017 - DNA, 22 bp, Homo sapiens
ctagggagtggcagagctggga

SEQ ID NO: 9397018 - DNA, 22 bp, Homo sapiens
ctatttatgtgctattttgtat

SEQ ID NO: 9397019 - DNA, 22 bp, Homo sapiens
ctagggctcgcaagggctggag

SEQ ID NO: 9397020 - DNA, 22 bp, Homo sapiens
ctaggctcttctggaaggttgt

SEQ ID NO: 9397021 - DNA, 22 bp, Homo sapiens
ctaggctcttctggaaggttgt

SEQ ID NO: 9397022 - DNA, 22 bp, Homo sapiens
ctaggctctgccagcactgtcg

SEQ ID NO: 9397023 - DNA, 22 bp, Homo sapiens
ctaggctctgccagcactgtcg

SEQ ID NO: 9397024 - DNA, 22 bp, Homo sapiens
ctaggccatattttgagaactg

SEQ ID NO: 9397025 - DNA, 22 bp, Homo sapiens
ctaggccttcataggcatggaa

SEQ ID NO: 9397026 - DNA, 22 bp, Homo sapiens
ctaggcagggtgctgtgccatg

SEQ ID NO: 9397027 - DNA, 23 bp, Homo sapiens
ctaggcaggattgtaggcgggta

SEQ ID NO: 9397028 - DNA, 22 bp, Homo sapiens
ctaggcagctttgggtgtgaag

SEQ ID NO: 9397029 - DNA, 23 bp, Homo sapiens
ctaggcaggattgtaggcgggta

SEQ ID NO: 9397030 - DNA, 22 bp, Homo sapiens
ctaggcagctttgggtgtgaag

SEQ ID NO: 9397031 - DNA, 22 bp, Homo sapiens
ctaggcagctttgggtgtgaag

SEQ ID NO: 9397032 - DNA, 22 bp, Homo sapiens
ctaggcagctttgggtgtgaag

SEQ ID NO: 9397033 - DNA, 22 bp, Homo sapiens
ctaggcagttctagttctggaa

SEQ ID NO: 9397034 - DNA, 22 bp, Homo sapiens
ctaggcagttctagttctggaa

SEQ ID NO: 9397035 - DNA, 22 bp, Homo sapiens
ctaggctgcacctaggatggct

SEQ ID NO: 9397036 - DNA, 22 bp, Homo sapiens
ctaggctgtaaagagctaggag

SEQ ID NO: 9397037 - DNA, 22 bp, Homo sapiens
ctaggctgtaacccctgccagg

SEQ ID NO: 9397038 - DNA, 22 bp, Homo sapiens
ctagggaaataaactgagtggt

SEQ ID NO: 9397039 - DNA, 22 bp, Homo sapiens
ctagggaacaagatgcccaggg

SEQ ID NO: 9397040 - DNA, 22 bp, Homo sapiens
ctaggcagatggagaagtggct

SEQ ID NO: 9397041 - DNA, 22 bp, Homo sapiens
ctaggcagatggagaagtggct

SEQ ID NO: 9397042 - DNA, 20 bp, Homo sapiens
ctaggcagcgagtgactgag

SEQ ID NO: 9397043 - DNA, 20 bp, Homo sapiens
ctaggcagcgagtgactgag

SEQ ID NO: 9397044 - DNA, 22 bp, Homo sapiens
ctaggcagatggagaagtggct

SEQ ID NO: 9397045 - DNA, 20 bp, Homo sapiens
ctaggcagcgagtgactgag

SEQ ID NO: 9397046 - DNA, 22 bp, Homo sapiens
ctagccatgggcattaaaggta

SEQ ID NO: 9397047 - DNA, 22 bp, Homo sapiens
ctagcccaggaatgccgtggcc

SEQ ID NO: 9397048 - DNA, 20 bp, Homo sapiens
ctagcctggccttgctctgg

SEQ ID NO: 9397049 - DNA, 20 bp, Homo sapiens
ctagcctggccttgctctgg

SEQ ID NO: 9397050 - DNA, 22 bp, Homo sapiens
ttccttttcttaaacatatgtg

SEQ ID NO: 9397051 - DNA, 22 bp, Homo sapiens
ttccttttcttctaccacatgt

SEQ ID NO: 9397052 - DNA, 20 bp, Homo sapiens
ttccttttcgcctctctccc

SEQ ID NO: 9397053 - DNA, 22 bp, Homo sapiens
ttccttctaatattctgcctgt

SEQ ID NO: 9397054 - DNA, 22 bp, Homo sapiens
ttccttctaatattctgcctgt

SEQ ID NO: 9397055 - DNA, 22 bp, Homo sapiens
ttccttctaatattctgcctgt

SEQ ID NO: 9397056 - DNA, 22 bp, Homo sapiens
ttccttctaattttacacctga

SEQ ID NO: 9397057 - DNA, 22 bp, Homo sapiens
ttccttctaattttacacctga

SEQ ID NO: 9397058 - DNA, 22 bp, Homo sapiens
ttcctttccctcacagcctcgg

SEQ ID NO: 9397059 - DNA, 22 bp, Homo sapiens
ttcctttccctcacagcctcgg

SEQ ID NO: 9397060 - DNA, 22 bp, Homo sapiens
ttccttctaattttacacctga

SEQ ID NO: 9397061 - DNA, 22 bp, Homo sapiens
ttcctttagtgtcatatacttt

SEQ ID NO: 9397062 - DNA, 22 bp, Homo sapiens
ttcctttcccttgcttctgtgc

SEQ ID NO: 9397063 - DNA, 22 bp, Homo sapiens
ctgcctggccacaacccagggt

SEQ ID NO: 9397064 - DNA, 22 bp, Homo sapiens
ctgcctggcatggagaagagaa

SEQ ID NO: 9397065 - DNA, 22 bp, Homo sapiens
ctgcctggcatggagaagagaa

SEQ ID NO: 9397066 - DNA, 22 bp, Homo sapiens
ctgcctggcatggagaagagaa

SEQ ID NO: 9397067 - DNA, 22 bp, Homo sapiens
ctgcctggcatagtctggtcga

SEQ ID NO: 9397068 - DNA, 17 bp, Homo sapiens
ctgcctggagtcccatc

SEQ ID NO: 9397069 - DNA, 17 bp, Homo sapiens
ctgcctggagtcccatc

SEQ ID NO: 9397070 - DNA, 20 bp, Homo sapiens
ctgcctggaggcctctacct

SEQ ID NO: 9397071 - DNA, 20 bp, Homo sapiens
ctgcctggaggcctctacct

SEQ ID NO: 9397072 - DNA, 20 bp, Homo sapiens
ctgcctggaggcctctacct

SEQ ID NO: 9397073 - DNA, 20 bp, Homo sapiens
ctgcctggaggcctctacct

SEQ ID NO: 9397074 - DNA, 22 bp, Homo sapiens
ctgcctggaccggcagccctcc

SEQ ID NO: 9397075 - DNA, 22 bp, Homo sapiens
ctgcctggagcattctgaaggt

SEQ ID NO: 9397076 - DNA, 22 bp, Homo sapiens
ctgcctggaccggcagccctcc

SEQ ID NO: 9397077 - DNA, 22 bp, Homo sapiens
ctgcctggaccggcagccctcc

SEQ ID NO: 9397078 - DNA, 22 bp, Homo sapiens
ctgcctggacagctcttacctt

SEQ ID NO: 9397079 - DNA, 22 bp, Homo sapiens
ctgcctggacagctcttacctt

SEQ ID NO: 9397080 - DNA, 22 bp, Homo sapiens
ctgcctggaatgccagcttctc

SEQ ID NO: 9397081 - DNA, 22 bp, Homo sapiens
ctgcctggaatgccagcttctc

SEQ ID NO: 9397082 - DNA, 23 bp, Homo sapiens
ctgctttcccactccatgctctt

SEQ ID NO: 9397083 - DNA, 23 bp, Homo sapiens
ctgctttcccactccatgctctt

SEQ ID NO: 9397084 - DNA, 21 bp, Homo sapiens
ctgctttacttcagaggatct

SEQ ID NO: 9397085 - DNA, 22 bp, Homo sapiens
ctgcttctaagaacctgcagct

SEQ ID NO: 9397086 - DNA, 23 bp, Homo sapiens
ctgcttccttgcttcattgctgg

SEQ ID NO: 9397087 - DNA, 19 bp, Homo sapiens
ctgcttccttccctcactg

SEQ ID NO: 9397088 - DNA, 22 bp, Homo sapiens
ctgcttctaagaacctgcagct

SEQ ID NO: 9397089 - DNA, 22 bp, Homo sapiens
ctgcctgggccggccaccctct

SEQ ID NO: 9397090 - DNA, 22 bp, Homo sapiens
ctgcctgggccatgcccagtcc

SEQ ID NO: 9397091 - DNA, 22 bp, Homo sapiens
ctgcctggcctgatctccacgc

SEQ ID NO: 9397092 - DNA, 22 bp, Homo sapiens
ctgcctggcctgatctccacgc

SEQ ID NO: 9397093 - DNA, 22 bp, Homo sapiens
ctgcctggctaaactcaagtcg

SEQ ID NO: 9397094 - DNA, 22 bp, Homo sapiens
ctgcctggctaaactcaagtcg

SEQ ID NO: 9397095 - DNA, 22 bp, Homo sapiens
ctgcctgggccatgcccagtcc

SEQ ID NO: 9397096 - DNA, 22 bp, Homo sapiens
ctgctttctgcaccccaggtcg

SEQ ID NO: 9397097 - DNA, 22 bp, Homo sapiens
ctgctttcttgttgcatcttaa

SEQ ID NO: 9397098 - DNA, 22 bp, Homo sapiens
ctgctttcttgttgcatcttaa

SEQ ID NO: 9397099 - DNA, 22 bp, Homo sapiens
ctgctttgattagaagagtaca

SEQ ID NO: 9397100 - DNA, 22 bp, Homo sapiens
ctgctttgcatagctgccagag

SEQ ID NO: 9397101 - DNA, 22 bp, Homo sapiens
ctgctttgactgttaagaacca

SEQ ID NO: 9397102 - DNA, 22 bp, Homo sapiens
ctgctttgaggggctctgtata

SEQ ID NO: 9397103 - DNA, 22 bp, Homo sapiens
ctgctttgtggaatcacactgg

SEQ ID NO: 9397104 - DNA, 22 bp, Homo sapiens
ctgctttgggcagctttgtggc

SEQ ID NO: 9397105 - DNA, 22 bp, Homo sapiens
ctgctttgtaaaatagacataa

SEQ ID NO: 9397106 - DNA, 22 bp, Homo sapiens
ctgctttgcatagctgccagag

SEQ ID NO: 9397107 - DNA, 22 bp, Homo sapiens
ctgctttggacaactattcttg

SEQ ID NO: 9397108 - DNA, 22 bp, Homo sapiens
ctgctttgtgtggtccctccag

SEQ ID NO: 9397109 - DNA, 22 bp, Homo sapiens
ctggaaagggtcctcattctgt

SEQ ID NO: 9397110 - DNA, 22 bp, Homo sapiens
ctggaaagacagagggcatggg

SEQ ID NO: 9397111 - DNA, 22 bp, Homo sapiens
ctggaagtataggggagatgat

SEQ ID NO: 9397112 - DNA, 23 bp, Homo sapiens
ctggaagtgcttttatagctttg

SEQ ID NO: 9397113 - DNA, 19 bp, Homo sapiens
ctggaatgtggctggtgca

SEQ ID NO: 9397114 - DNA, 22 bp, Homo sapiens
ctggaaagtacagtgtgtcaca

SEQ ID NO: 9397115 - DNA, 22 bp, Homo sapiens
ctggaaggttctttgtgtgcct

SEQ ID NO: 9397116 - DNA, 22 bp, Homo sapiens
ctggaaggttctttgtgtgcct

SEQ ID NO: 9397117 - DNA, 22 bp, Homo sapiens
ctggacagaaaaggccactgga

SEQ ID NO: 9397118 - DNA, 22 bp, Homo sapiens
ctggacagaaaaggccactgga

SEQ ID NO: 9397119 - DNA, 22 bp, Homo sapiens
ctggaatgttctccagcatggc

SEQ ID NO: 9397120 - DNA, 22 bp, Homo sapiens
ctggacagaagtggctgggcag

SEQ ID NO: 9397121 - DNA, 22 bp, Homo sapiens
ctggacagaagtggctgggcag

SEQ ID NO: 9397122 - DNA, 22 bp, Homo sapiens
ctggacagaaaccagtcctggg

SEQ ID NO: 9397123 - DNA, 22 bp, Homo sapiens
ctggacagaaaccagtcctggg

SEQ ID NO: 9397124 - DNA, 22 bp, Homo sapiens
ctggacaggctggggactgcaa

SEQ ID NO: 9397125 - DNA, 22 bp, Homo sapiens
ctggacaggaagaattgggagc

SEQ ID NO: 9397126 - DNA, 22 bp, Homo sapiens
ctggacaggctggggactgcaa

SEQ ID NO: 9397127 - DNA, 22 bp, Homo sapiens
ctggacagtgggcagaggagac

SEQ ID NO: 9397128 - DNA, 22 bp, Homo sapiens
ctggagtggccggtgctgtggc

SEQ ID NO: 9397129 - DNA, 22 bp, Homo sapiens
ctggagtggccggtgctgtggc

SEQ ID NO: 9397130 - DNA, 22 bp, Homo sapiens
ctggagtgtaaagagcatagaa

SEQ ID NO: 9397131 - DNA, 22 bp, Homo sapiens
ctggagtgtaaagagcatagaa

SEQ ID NO: 9397132 - DNA, 22 bp, Homo sapiens
ctggagtgtaaagagcatagaa

SEQ ID NO: 9397133 - DNA, 20 bp, Homo sapiens
ctggagtgtagcagtggctg

SEQ ID NO: 9397134 - DNA, 20 bp, Homo sapiens
ctggagtgtagcagtggctg

SEQ ID NO: 9397135 - DNA, 22 bp, Homo sapiens
ctggagtgtaaagagcatagaa

SEQ ID NO: 9397136 - DNA, 20 bp, Homo sapiens
ctggagtgtagcagtggctg

SEQ ID NO: 9397137 - DNA, 20 bp, Homo sapiens
ctggagtgtagcagtggctg

SEQ ID NO: 9397138 - DNA, 22 bp, Homo sapiens
ctggagttgggatgtgcctgga

SEQ ID NO: 9397139 - DNA, 22 bp, Homo sapiens
ctggagtttgtggcttgctcaa

SEQ ID NO: 9397140 - DNA, 22 bp, Homo sapiens
ctggagttttggaaaaatgctt

SEQ ID NO: 9397141 - DNA, 22 bp, Homo sapiens
ctggagttctatgtgcttgtga

SEQ ID NO: 9397142 - DNA, 22 bp, Homo sapiens
ctggagttcagtggcgtgaaca

SEQ ID NO: 9397143 - DNA, 22 bp, Homo sapiens
ctggagtgttatggtcaagtca

SEQ ID NO: 9397144 - DNA, 22 bp, Homo sapiens
ctggagtcagcaaggacgaggc

SEQ ID NO: 9397145 - DNA, 22 bp, Homo sapiens
ctggaggtgggggcaagagtgt

SEQ ID NO: 9397146 - DNA, 22 bp, Homo sapiens
ctggaggtgggggcaagagtgt

SEQ ID NO: 9397147 - DNA, 22 bp, Homo sapiens
ctggaggtgcctagatgagctc

SEQ ID NO: 9397148 - DNA, 22 bp, Homo sapiens
ctggaggtgcctagatgagctc

SEQ ID NO: 9397149 - DNA, 22 bp, Homo sapiens
ctggaggtgcttcgctggccac

SEQ ID NO: 9397150 - DNA, 22 bp, Homo sapiens
ctggagggtgagcctcatctct

SEQ ID NO: 9397151 - DNA, 22 bp, Homo sapiens
ctggagggtggagagaagtctc

SEQ ID NO: 9397152 - DNA, 22 bp, Homo sapiens
ctggagggtggagagaagtctc

SEQ ID NO: 9397153 - DNA, 22 bp, Homo sapiens
ctggaggtagatggtggtaatg

SEQ ID NO: 9397154 - DNA, 19 bp, Homo sapiens
ctggaggtagagggttagt

SEQ ID NO: 9397155 - DNA, 22 bp, Homo sapiens
ctggaggtagatggtggtaatg

SEQ ID NO: 9397156 - DNA, 22 bp, Homo sapiens
ctggaggtctacagtggtagct

SEQ ID NO: 9397157 - DNA, 22 bp, Homo sapiens
ctggaggtctacagtggtagct

SEQ ID NO: 9397158 - DNA, 22 bp, Homo sapiens
ctggaggtcatgtaatatggaa

SEQ ID NO: 9397159 - DNA, 21 bp, Homo sapiens
ctggagggtagagttgggctg

SEQ ID NO: 9397160 - DNA, 22 bp, Homo sapiens
ctggagggtgagcctcatctct

SEQ ID NO: 9397161 - DNA, 22 bp, Homo sapiens
ctggagggtgagcctcatctct

SEQ ID NO: 9397162 - DNA, 22 bp, Homo sapiens
ctggagggggaaatgttcattg

SEQ ID NO: 9397163 - DNA, 22 bp, Homo sapiens
ctggagggggaaatgttcattg

SEQ ID NO: 9397164 - DNA, 21 bp, Homo sapiens
ctggagggtagagttgggctg

SEQ ID NO: 9397165 - DNA, 21 bp, Homo sapiens
ctggagggtagagttgggctg

SEQ ID NO: 9397166 - DNA, 22 bp, Homo sapiens
ctggaggggctggcatggtagc

SEQ ID NO: 9397167 - DNA, 22 bp, Homo sapiens
ctggaggggctggcatggtagc

SEQ ID NO: 9397168 - DNA, 22 bp, Homo sapiens
ctggaggggccatccacagtct

SEQ ID NO: 9397169 - DNA, 22 bp, Homo sapiens
ctggaggggccatccacagtct

SEQ ID NO: 9397170 - DNA, 22 bp, Homo sapiens
ctggagggcttctgcaggttac

SEQ ID NO: 9397171 - DNA, 22 bp, Homo sapiens
ctggagggcttctgcaggttac

SEQ ID NO: 9397172 - DNA, 22 bp, Homo sapiens
ctggagggcttctgcaggttac

SEQ ID NO: 9397173 - DNA, 22 bp, Homo sapiens
ctggagggctggactaaggaaa

SEQ ID NO: 9397174 - DNA, 22 bp, Homo sapiens
ctggagggctggactaaggaaa

SEQ ID NO: 9397175 - DNA, 22 bp, Homo sapiens
ctggagggctggactaaggaaa

SEQ ID NO: 9397176 - DNA, 22 bp, Homo sapiens
ctggagggactttctcacggat

SEQ ID NO: 9397177 - DNA, 22 bp, Homo sapiens
ctggagggactttctcacggat

SEQ ID NO: 9397178 - DNA, 23 bp, Homo sapiens
ctggactcaggggatgtgaagga

SEQ ID NO: 9397179 - DNA, 22 bp, Homo sapiens
ctggacttggggaggctagatt

SEQ ID NO: 9397180 - DNA, 22 bp, Homo sapiens
ctggaccagaaaggacatggct

SEQ ID NO: 9397181 - DNA, 22 bp, Homo sapiens
ctggacatcagtgtgcctggct

SEQ ID NO: 9397182 - DNA, 22 bp, Homo sapiens
ctggacagtgggcagaggagac

SEQ ID NO: 9397183 - DNA, 22 bp, Homo sapiens
ctggaccagaaaggacatggct

SEQ ID NO: 9397184 - DNA, 22 bp, Homo sapiens
ctggaggaccacagaagctggt

SEQ ID NO: 9397185 - DNA, 22 bp, Homo sapiens
ctggaggaccacagaagctggt

SEQ ID NO: 9397186 - DNA, 22 bp, Homo sapiens
ctggaggaccacagaagctggt

SEQ ID NO: 9397187 - DNA, 22 bp, Homo sapiens
ctggaggacagaggccatgtct

SEQ ID NO: 9397188 - DNA, 22 bp, Homo sapiens
ctggaggacagaggccatgtct

SEQ ID NO: 9397189 - DNA, 22 bp, Homo sapiens
ctggaggacagaggccatgtct

SEQ ID NO: 9397190 - DNA, 22 bp, Homo sapiens
ctggaggaatcacagaaggctt

SEQ ID NO: 9397191 - DNA, 22 bp, Homo sapiens
ctggagctcttctgagtgtgct

SEQ ID NO: 9397192 - DNA, 22 bp, Homo sapiens
ctggaggaataatggcatcttg

SEQ ID NO: 9397193 - DNA, 22 bp, Homo sapiens
ctggagctctgtgtgttcctga

SEQ ID NO: 9397194 - DNA, 22 bp, Homo sapiens
ctggagctcttctgagtgtgct

SEQ ID NO: 9397195 - DNA, 22 bp, Homo sapiens
ctggagctctccagagccccgt

SEQ ID NO: 9397196 - DNA, 22 bp, Homo sapiens
ctggaggcaaagcagaggcatg

SEQ ID NO: 9397197 - DNA, 22 bp, Homo sapiens
ctggaggcaaagcagaggcatg

SEQ ID NO: 9397198 - DNA, 22 bp, Homo sapiens
ctggaggcacccttagagaggc

SEQ ID NO: 9397199 - DNA, 22 bp, Homo sapiens
ctggaggagcatggactggagt

SEQ ID NO: 9397200 - DNA, 22 bp, Homo sapiens
ctggaggagcatggactggagt

SEQ ID NO: 9397201 - DNA, 22 bp, Homo sapiens
ctggaggaggaagtctacaatg

SEQ ID NO: 9397202 - DNA, 22 bp, Homo sapiens
ctggaggaggaagtctacaatg

SEQ ID NO: 9397203 - DNA, 22 bp, Homo sapiens
ctggaggcaaagcagaggcatg

SEQ ID NO: 9397204 - DNA, 22 bp, Homo sapiens
ctggaggagagtctgaatgaca

SEQ ID NO: 9397205 - DNA, 22 bp, Homo sapiens
ctggaggagaacttgaggaagg

SEQ ID NO: 9397206 - DNA, 22 bp, Homo sapiens
ctggaggagaacttgaggaagg

SEQ ID NO: 9397207 - DNA, 22 bp, Homo sapiens
ctggaggagagtctgaatgaca

SEQ ID NO: 9397208 - DNA, 22 bp, Homo sapiens
ctggaggagcaatatggttagg

SEQ ID NO: 9397209 - DNA, 22 bp, Homo sapiens
ctggaggagagtctgaatgaca

SEQ ID NO: 9397210 - DNA, 22 bp, Homo sapiens
ctggaggagagtctgaatgaca

SEQ ID NO: 9397211 - DNA, 22 bp, Homo sapiens
ctggaggagaacttgaggaagg

SEQ ID NO: 9397212 - DNA, 22 bp, Homo sapiens
ctggaggacccctgcctggaag

SEQ ID NO: 9397213 - DNA, 22 bp, Homo sapiens
ctggaggacccctgcctggaag

SEQ ID NO: 9397214 - DNA, 22 bp, Homo sapiens
ctggaggccactgtacagattg

SEQ ID NO: 9397215 - DNA, 22 bp, Homo sapiens
ctggagggacaaggtatgcatt

SEQ ID NO: 9397216 - DNA, 22 bp, Homo sapiens
ctggaggctggcttcccctggc

SEQ ID NO: 9397217 - DNA, 22 bp, Homo sapiens
ctggaggctggcttcccctggc

SEQ ID NO: 9397218 - DNA, 21 bp, Homo sapiens
ctggaggcaggtggtgccagg

SEQ ID NO: 9397219 - DNA, 21 bp, Homo sapiens
ctggaggcaggtggtgccagg

SEQ ID NO: 9397220 - DNA, 22 bp, Homo sapiens
ctggaggcacccttagagaggc

SEQ ID NO: 9397221 - DNA, 21 bp, Homo sapiens
ctggaggcaggtggtgccagg

SEQ ID NO: 9397222 - DNA, 21 bp, Homo sapiens
ctggaggcaggtggtgccagg

SEQ ID NO: 9397223 - DNA, 22 bp, Homo sapiens
ctggcatgccttgggtgcctct

SEQ ID NO: 9397224 - DNA, 22 bp, Homo sapiens
ctggcatgctaatacagcctgt

SEQ ID NO: 9397225 - DNA, 22 bp, Homo sapiens
ctggcatgctaatacagcctgt

SEQ ID NO: 9397226 - DNA, 22 bp, Homo sapiens
ctggcatgccttgggtgcctct

SEQ ID NO: 9397227 - DNA, 21 bp, Homo sapiens
ctggcatgaggagctttgttt

SEQ ID NO: 9397228 - DNA, 21 bp, Homo sapiens
ctggcatgaggagctttgttt

SEQ ID NO: 9397229 - DNA, 22 bp, Homo sapiens
ctggcatgtgtttggctcctgt

SEQ ID NO: 9397230 - DNA, 22 bp, Homo sapiens
ctggcatgtgtttggctcctgt

SEQ ID NO: 9397231 - DNA, 22 bp, Homo sapiens
ctggcatggtgtatttgttcaa

SEQ ID NO: 9397232 - DNA, 22 bp, Homo sapiens
ctggccacaactagcccaggac

SEQ ID NO: 9397233 - DNA, 19 bp, Homo sapiens
ctggccacacctgctggtt

SEQ ID NO: 9397234 - DNA, 22 bp, Homo sapiens
ctggccacaactagcccaggac

SEQ ID NO: 9397235 - DNA, 19 bp, Homo sapiens
ctggccacacctgctggtt

SEQ ID NO: 9397236 - DNA, 22 bp, Homo sapiens
ctggccaccaagagcttgctca

SEQ ID NO: 9397237 - DNA, 22 bp, Homo sapiens
ctggccacatgtgtgctgagca

SEQ ID NO: 9397238 - DNA, 22 bp, Homo sapiens
ctggccaggcggcccctgcatg

SEQ ID NO: 9397239 - DNA, 22 bp, Homo sapiens
ctggccaggcggcccctgcatg

SEQ ID NO: 9397240 - DNA, 22 bp, Homo sapiens
ctggccaggcggcccctgcatg

SEQ ID NO: 9397241 - DNA, 22 bp, Homo sapiens
ctggccagtgcctgtgggcccc

SEQ ID NO: 9397242 - DNA, 22 bp, Homo sapiens
ctggccagtgcctgtgggcccc

SEQ ID NO: 9397243 - DNA, 22 bp, Homo sapiens
ctggccaggctctcacgtggtc

SEQ ID NO: 9397244 - DNA, 22 bp, Homo sapiens
ctggcagcatggagcctgtgct

SEQ ID NO: 9397245 - DNA, 22 bp, Homo sapiens
ctggcagcagttatgaaacaat

SEQ ID NO: 9397246 - DNA, 22 bp, Homo sapiens
ctggcagcatggagcctgtgct

SEQ ID NO: 9397247 - DNA, 22 bp, Homo sapiens
ctggcagcatggagcctgtgct

SEQ ID NO: 9397248 - DNA, 22 bp, Homo sapiens
ctggcagcattaacagagagca

SEQ ID NO: 9397249 - DNA, 22 bp, Homo sapiens
ctggcagcattaacagagagca

SEQ ID NO: 9397250 - DNA, 22 bp, Homo sapiens
ctggcagggctctttgggtgct

SEQ ID NO: 9397251 - DNA, 22 bp, Homo sapiens
ctggcagggctggtattcaaaa

SEQ ID NO: 9397252 - DNA, 22 bp, Homo sapiens
ctggcagggctctttgggtgct

SEQ ID NO: 9397253 - DNA, 22 bp, Homo sapiens
ctggcagggctctttgggtgct

SEQ ID NO: 9397254 - DNA, 22 bp, Homo sapiens
ctggcagggctctttgggtgct

SEQ ID NO: 9397255 - DNA, 22 bp, Homo sapiens
ctggcagggtgggctttgcttt

SEQ ID NO: 9397256 - DNA, 22 bp, Homo sapiens
ctggcaggtatctaaagttgtc

SEQ ID NO: 9397257 - DNA, 22 bp, Homo sapiens
ctggcaggtccagctggactca

SEQ ID NO: 9397258 - DNA, 22 bp, Homo sapiens
ctggcagtcacggccatgtgct

SEQ ID NO: 9397259 - DNA, 22 bp, Homo sapiens
ctggcagtgcccagtcactgtt

SEQ ID NO: 9397260 - DNA, 22 bp, Homo sapiens
ctggcagtgccctcagccccca

SEQ ID NO: 9397261 - DNA, 22 bp, Homo sapiens
ctggcagtggggcctcagtgtt

SEQ ID NO: 9397262 - DNA, 22 bp, Homo sapiens
ctggcagtgccctcagccccca

SEQ ID NO: 9397263 - DNA, 22 bp, Homo sapiens
ctggcagtctggtggaaggcct

SEQ ID NO: 9397264 - DNA, 22 bp, Homo sapiens
ctggcagtctgcctcttcactg

SEQ ID NO: 9397265 - DNA, 22 bp, Homo sapiens
ctggcagtctggtggaaggcct

SEQ ID NO: 9397266 - DNA, 22 bp, Homo sapiens
ctggcagtgacattgcaggtgc

SEQ ID NO: 9397267 - DNA, 22 bp, Homo sapiens
ctggcagtttgccaggagctcg

SEQ ID NO: 9397268 - DNA, 22 bp, Homo sapiens
ctggcatgaaatggcatctcat

SEQ ID NO: 9397269 - DNA, 22 bp, Homo sapiens
ctggcagtttgccaggagctcg

SEQ ID NO: 9397270 - DNA, 22 bp, Homo sapiens
ctggcagtgtgaccctggacag

SEQ ID NO: 9397271 - DNA, 22 bp, Homo sapiens
ctggcagttggcagggctgcca

SEQ ID NO: 9397272 - DNA, 22 bp, Homo sapiens
ctggcagtgtccagctcgtgat

SEQ ID NO: 9397273 - DNA, 22 bp, Homo sapiens
ctggcagtgtgaccctggacag

SEQ ID NO: 9397274 - DNA, 22 bp, Homo sapiens
ctggcagtgtccagctcgtgat

SEQ ID NO: 9397275 - DNA, 22 bp, Homo sapiens
ctggcacctccagctcatggcc

SEQ ID NO: 9397276 - DNA, 22 bp, Homo sapiens
ctggcacctccagctcatggcc

SEQ ID NO: 9397277 - DNA, 22 bp, Homo sapiens
ctggcaccccacactgtccacg

SEQ ID NO: 9397278 - DNA, 22 bp, Homo sapiens
ctggcaccccacactgtccacg

SEQ ID NO: 9397279 - DNA, 22 bp, Homo sapiens
ctggcacattgtaatatataca

SEQ ID NO: 9397280 - DNA, 22 bp, Homo sapiens
ctggcacattgtaatatataca

SEQ ID NO: 9397281 - DNA, 22 bp, Homo sapiens
ctggcactgtgtctgcggaggg

SEQ ID NO: 9397282 - DNA, 22 bp, Homo sapiens
ctggcacttggcacccatgaaa

SEQ ID NO: 9397283 - DNA, 22 bp, Homo sapiens
ctggcactgagtggcttatgac

SEQ ID NO: 9397284 - DNA, 22 bp, Homo sapiens
ctggcactggatcgtgcatatc

SEQ ID NO: 9397285 - DNA, 22 bp, Homo sapiens
ctggcacgcccacgtaggcact

SEQ ID NO: 9397286 - DNA, 22 bp, Homo sapiens
ctggcactcataggccagttca

SEQ ID NO: 9397287 - DNA, 22 bp, Homo sapiens
ctggcacatgtgagccacatca

SEQ ID NO: 9397288 - DNA, 22 bp, Homo sapiens
ctggcacatgtgagccacatca

SEQ ID NO: 9397289 - DNA, 22 bp, Homo sapiens
ctggcacatgctccctgagtgg

SEQ ID NO: 9397290 - DNA, 22 bp, Homo sapiens
ctggcacatcactcctagttta

SEQ ID NO: 9397291 - DNA, 22 bp, Homo sapiens
ctggcacatgctccctgagtgg

SEQ ID NO: 9397292 - DNA, 22 bp, Homo sapiens
ctggcacatcactcctagttta

SEQ ID NO: 9397293 - DNA, 22 bp, Homo sapiens
ctggcacatagtcagcactcaa

SEQ ID NO: 9397294 - DNA, 22 bp, Homo sapiens
ctggcacatagtcagcactcaa

SEQ ID NO: 9397295 - DNA, 22 bp, Homo sapiens
ctggcacatagtcagcactcaa

SEQ ID NO: 9397296 - DNA, 22 bp, Homo sapiens
ctggcacatagtaggtgcacag

SEQ ID NO: 9397297 - DNA, 22 bp, Homo sapiens
ctggcacatagtaggtgcacag

SEQ ID NO: 9397298 - DNA, 22 bp, Homo sapiens
ctggcacatagtcagcactcaa

SEQ ID NO: 9397299 - DNA, 22 bp, Homo sapiens
ctggcagcagcttctggatcga

SEQ ID NO: 9397300 - DNA, 22 bp, Homo sapiens
ctggcagcaggtcacacgcaga

SEQ ID NO: 9397301 - DNA, 22 bp, Homo sapiens
ctggcagcaggtcacacgcaga

SEQ ID NO: 9397302 - DNA, 22 bp, Homo sapiens
ctggcagcagcttctggatcga

SEQ ID NO: 9397303 - DNA, 22 bp, Homo sapiens
ctggcagattggggtcagcagt

SEQ ID NO: 9397304 - DNA, 22 bp, Homo sapiens
ctggcagattggggtcagcagt

SEQ ID NO: 9397305 - DNA, 22 bp, Homo sapiens
ctggcagcagagctcaacatag
